United States Patent 7,745,391 (HUMAN THROMBOSPONDIN POLYPEPTIDE) - sequence listing, part 182

SEQ ID NO: 445439 - DNA, 1094 bp, Homo sapiens
ggacgcgtgggtcgaccacgcgtcaacaatcttgatgatgggccgctacgtggagcccatcgaggatgtgccttgtgggaacattgtgggcctcgtgggcgtggaccagttcctggtgaagacgggcaccatcaccaccttcgagcacgcgcacaacatgcgggtgatgaagttcagcgtcagccctgttgtcagagtggccgtggaggccaagaacccggctgacctgcccaagctggtggaggggctgaagcggctggccaagtccgaccccatggtgcagtgcatcatcgaggagtcgggagagcacatcatcgcgggcgccggcgagctgcacctggagatctgcctgaaggacctggaggaggaccacgcctgcatccccatcaagaaatctgacccggtcgtctcgtaccgcgagacggtcagtgaagagtcgaacgtgctctgcctctccaagtcccccaacaagcacaaccggctgtacatgaaggcgcggcccttccccgacggcctggccgaggacatcgataaaggcgaggtgtccgcccgtcaggagctcaagcagcgggcgcgctacctggccgagaagtacgagtgggacgtggctgaggcccgcaagatctggtgctttgggcccgacggcaccggccccaacatcctcaccgacatcaccaagggtgtgcagtacctcaacgagatcaaggacagtgtggtggccggcttccagtgggccaccaaggagggcgcactgtgtgaggagaacatgcggggtgtgcgcttcgacgtccacgacgtcaccctgcacgccgacgccatccaccgcggagggggccagatcatccccacagcacggcgctgcctctacgccagtgtgctgaccgcccagccacgcctcatggagcccatctaccttgtggagatccagtgtccagagcaggtggtcggtggcatctacggggttttgaacaggaagcggggccggaacacgcgggtagatgatttctagcaggcaggaagtcctgtgcggtgtcaccatgagcacctccagctgtactagtgccattggaataataaatttgataaggtggtga

SEQ ID NO: 445440 - DNA, 748 bp, Homo sapiens
  misc_feature (21)..(21): n is a, c, g, or t
ccagtgtaccggccgcgttantatatcgtgaaccggcgtcgcggagcgtgggcactataccccttggaagaaggaggagcagctgtccagagcaggtggtcggtggcatctacggggttttgaacaggaagcggggccacgtgttcgaggagtcccaggtggccggcacccccatgtttgtggtcaaggcctatctgcccgtcaacgagtcctttggcttcaccgctgacctgaggtccaacacgggcggccaggcgttcccccagtgtgtgtttgaccactggcagatcctgcccggagaccccttcgacaacagcagccgccccagccaggtggtggcggagacccgcaagcgcaagggcctgaaagaaggcatccctgccctggacaacttcctggacaaattgtaggcggcccttcctgcagcgcctgccgccccggggactcgcagcacccacagcaccacgtcctcgaattctcagacgacacctggagactgtcccgacacagcgacgctcccctgagaggtttctggggcccgctgcgaactcagatgtccaaactaattttaacaaacgcattaagaggtttatttgggtacatggcccgcagtggcttttgccccagaaaggggaaaggaacacgcgggtagatgatttctagcaggcaggaagtcctgtgcggtgtcaccatgagcacctccagctgtactagtgccattggaataataaatttgataaggtggtga

SEQ ID NO: 445441 - DNA, 675 bp, Homo sapiens
ggacgcgtgggtcgaccacgcgtcaacaatcttgatgatgggccgctacgtggagcccatcgaggatgtgccttgtgggaacattgtgggcctcgtgggcgtggaccagttcctggtgaagacgggcaccatcaccaccttcgagcacgcgcacaacatgcgggtgatgaagttcagcgtcagccctgttgtcagagtggccgtggaggccaagaacccggctgacctgcccaagctggtggaggggctgaagcggctggccaagtccgaccccatggtgcagtgcatcatcgaggagtcgggagagcacatcatcgcgggcgccggcgagctgcacctggagatctgcctgaaggacctggaggaggaccacgcctgcatccccatcaagcctgcatccccatcaaggtgaggcgccagtgaccagccttccccacgccccaccccggacacctgccctctgctttaaagctgagctgagctaggctctgcagacgcctagacttgatctcggtcttggtctcagcttcttaagttcctcaagtttcttctttgcagtcttccacaggcatgtggggctgtttttgttgttgttgttgttttttttgagatagtctcgctgtgtcatccaggctggagtgcagtggcgtgatcttggctcgctagaacctccac

SEQ ID NO: 445442 - DNA, 126 bp, Homo sapiens
gccctgtcccccgtgtccccaggcgtgtgcgtgcagacggagacagtgctgcggcaggccattgccgagcgcatcaagcctgtgctgatgatgaacaagatggaccgcgccctgctggagctgcag

SEQ ID NO: 445443 - DNA, 437 bp, Homo sapiens
ccgtgtgaggccggaccgctacgatgcccacggctatcgagaatgtgatgaagaagctgtggggtgagtactttgacccagccaacggcaagttcagcaagtcagccaccagccccgaagggaagaagctgccacgcaccttctgccagctgatcctggaccccatcttcaaggtgtttgatgcgatcatgaatttcaagaaagaggagacagcaaaactgatagagaaactggacatcaaaacctggcatgaaggcactggacatgaattcatgtccagggccttcatgcctagaaaaagaatcccaggattttccctcctgtgtgttttcgtcttgcttcttcatggtccatgatgccagctgaggttgtcagtacaatgaaaccatactggcggatgaaagcactcgacatgaagggatcctctagatccacca

SEQ ID NO: 445444 - DNA, 1753 bp, Homo sapiens
ggacgcgtgggtcgaccacgcgtcaacaatcttgatgatgggccgctacgtggagcccatcgaggatgtgccttgtgggaacattgtgggcctcgtgggcgtggaccagttcctggtgaagacgggcaccatcaccaccttcgagcacgcgcacaacatgcgggtgatgaagttcagcgtcagccctgttgtcagagtggccgtggaggccaagaacccggctgacctgcccaagctggtggaggggctgaagcggctggccaagtccgaccccatggtgcagtgcatcatcgaggagtcgggagagcacatcatcgcgggcgccggcgagctgcacctggagatctgcctgaaggacctggaggaggaccacgcctgcatccccatcaagaaatctgacccggtcgtctcgtaccgcgagacggtcagtgaagagtcgaacgtgctctgcctctccaagtcccccaacaagcacaaccggctgtacatgaaggcgcggcccttccccgacggcctggccgaggacatcgataaaggcgaggtgtccgcccgtcaggagctcaagcagcgggcgcgctacctggccgagaagtacgagtgggacgtggctgaggcccgcaagatctggtgctttgggcccgacggcaccggccccaacatcctcaccgacatcaccaagggtgtgcagtacctcaacgagatcaaggacagtgtggtggccggcttccagtgggccaccaaggagggcgcactgtgtgaggagaacatgcggggtgtgcgcttcgacgtccacgacgtcaccctgcacgccgacgccatccaccgcggagggggccagatcatccccacagcacggcgctgcctctacgccagtgtgctgaccgcccagccacgcctcatggagcccatctaccttgtggagatccagtgtccagagcaggtggtcggtggcatctacggggttttgaacaggaagcggggccacgtgttcgaggagtcccaggtggccggcacccccatgtttgtggtcaaggcctatctgcccgtcaacgagtcctttggcttcaccgctgacctgaggtccaacacgggcggccaggcgttcccccagtgtgtgtttgaccactggcagatcctgcccggagaccccttcgacaacagcagccgccccagccaggtggtggcggagacccgcaagcgcaagggcctgaaagaaggcatccctgccctggacaacttcctggacaaattgtaggcggcccttcctgcagcgcctgccgccccggggactcgcagcacccacagcaccacgtcctcgaattctcagacgacacctggagactgtcccgacacagcgacgctcccctgagaggtttctggggcccgctgcgtgccatcactcaaccataacacttgatgccgtttctttcaatatttatttccagagtccggaggcagcagacacgccctcttagtagggacttaatgggccggtcggggagggggaggcgggatgggacacccaacactttttccatttcttcagagggaaactcagatgtccaaactaattttaacaaacgcattaagaggtttatttgggtacatggcccgcagtggcttttgccccagaaaggggaaaggaacacgcgggtagatgatttctagcaggcaggaagtcctgtgcggtgtcaccatgagcacctccagctgtactagtgccattggaataataaatttgataaggtggtga

SEQ ID NO: 445445 - DNA, 1543 bp, Homo sapiens
ggacgcgtgggtcgaccacgcgtcgcggtgtggccaagtccgaccccatggtgctgtgcatcatcgaggagtcgggagagcacatcatcgcgggcgccggcgagctgcacctggagatctgcctgaaggacctggaggaggaccacgcctgcatccccatcaagcctgcatccccatcaagaaatctgacccggtcgtctcgtaccgcgagacggtcagtgaagagtcgaacgtgctctgcctctccaagtcccccaacaagcacaaccggctgtacatgaaggcgcggcccttccccgacggcctggccgaggacatcgataaaggcgaggtgtccgcccgtcaggagctcaagcagcgggcgcgctacctggccgagaagtacgagtgggacgtggctgaggcccgcaagatctggtgctttgggcccgacggcaccggccccaacatcctcaccgacatcaccaagggtgtgcagtacctcaacgagatcaaggacagtgtggtggccggcttccagtgggccaccaaggagggcgcactgtgtgaggagaacatgcggggtgtgcgcttcgacgtccacgacgtcaccctgcacgccgacgccatccaccgcggagggggccagatcatccccacagcacggcgctgcctctacgccagtgtgctgaccgcccagccacgcctcatggagcccatctaccttgtggagatccagtgtccagagcaggtggtcggtggcatctacggggttttgaacaggaagcggggccacgtgttcgaggagtcccaggtggccggcacccccatgtttgtggtcaaggcctatctgcccgtcaacgagtcctttggcttcaccgctgacctgaggtccaacacgggcggccaggcgttcccccagtgtgtgtttgaccactggcagatcctgcccggagaccccttcgacaacagcagccgccccagccaggtggtggcggagacccgcaagcgcaagggcctgaaagaaggcatccctgccctggacaacttcctggacaaattgtaggcggcccttcctgcagcgcctgccgccccggggactcgcagcacccacagcaccacgtcctcgaattctcagacgacacctggagactgtcccgacacagcgacgctcccctgagaggtttctggggcccgctgcgtgccatcactcaaccataacacttgatgccgtttctttcaatatttatttccagagtccggaggcagcagacacgccctcttagtagggacttaatgggccggtcggggagggggaggcgggatgggacacccaacactttttccatttcttcagagggaaactcagatgtccaaactaattttaacaaacgcattaagaggtttatttgggtacatggcccgcagtggcttttgccccagaaaggggaaaggaacacgcgggtagatgatttctagcaggcaggaagtcctgtgcggtgtcaccatgagcacctccagctgtactagtgccattggaataataaatttgataaggtggtga

SEQ ID NO: 445446 - DNA, 2504 bp, Homo sapiens
ggacgcgtgggtcgaccacgcgtcaacaatcttgatgatgggccgctacgtggagcccatcgaggatgtgccttgtgggaacattgtgggcctcgtgggcgtggaccagttcctggtgaagacgggcaccatcaccaccttcgagcacgcgcacaacatgcgggtgatgaagttcagcgtcagccctgttgtcagagtggccgtggaggccaagaacccggctgacctgcccaagctggtggaggggctgaagcggctggccaagtccgaccccatggtgcagtgcatcatcgaggagtcgggagagcacatcatcgcgggcgccggcgagctgcacctggagatctgcctgaaggacctggaggaggaccacgcctgcatccccatcaagaaatctgacccggtcgtctcgtaccgcgagacggtcagtgaagagtcgaacgtgctctgcctctccaagtcccccaacaagcacaaccggctgtacatgaaggcgcggcccttccccgacggcctggccgaggacatcgataaaggcgaggtgtccgcccgtcaggagctcaagcagcgggcgcgctacctggccgagaagtacgagtgggacgtggctgaggcccgcaagatctggtgctttgggcccgacggcaccggccccaacatcctcaccgacatcaccaagggtgtgcagtacctcaacgagatcaaggacagtgtggtggccggcttccagtgggccaccaaggagggcgcactgtgtgaggagaacatgcggggtgtgcgcttcgacgtccacgacgtcaccctgcacgccgacgccatccaccgcggagggggccagatcatccccacagcacggcgctgcctctacgccagtgtgctgaccgcccagccacgcctcatggagcccatctaccttgtggagatccagtgtccagagcaggtggtcggtggcatctacggggttttgaacaggaagcggggccacgtgttcgaggagtcccaggtggccggcacccccatgtttgtggtcaaggcctatctgcccgtcaacgagtcctttggcttcaccgctgacctgaggtccaacacgggcggccaggcgttcccccagtgtgtgtttgaccactggcagatcctgcccggagaccccttcgacaacagcagccgccccagccaggtggtggcggagacccgcaagcgcaagggcctgaaagaaggcatccctgccctggacaacttcctggacaaattgtaggcggcccttcctgcagcgcctgccgccccggggactcgcagcacccacagcaccacgtcctcgaattctcagacgacacctggagactgtcccgacacagcgacgctcccctgagaggtttctggggcccgctgcgtgccatcactcaaccataacacttgatgccgtttctttcaatatttatttccagagtccggaggcagcagacacgccctcttagtagggacttaatgggccggtcggggagggggaggcgggatgggacacccaacactttttccatttcttcagagggaaactcagatgtccaaactaattttaacaaacgcattaagaggtttatttgggtacatggcccgcagtggcttttgccccagaaaggggaaaggaacacgcgggtagatgatttctagcaggcaggaagtcctgtgcggtgtcaccatgagcacctccagctgtactagtgccattggaataataaatttgataaggtggtgaaaaaaaaaaaaaaaaaaaaaaaaaaaaaaaaaaaaaaaaaaaacaaacaaaaacaaaaacaaagaaggcggacgcccccacaaaaaagaacccgcgaggaggacgcacaaaagaaagaccacaccagcagcctcttgacgagagacaacgggacaccacaaaagaatgcgccaaataaaaacaaacagcacgcagcgacgaacgaataacaaagacgcgaaacagagaaaaaaacgaacagcgagacacacatgcgggaagagcaaccactcactcagcgaggggagacgcacacaagcgagagacacaacacacaccacagacagactcaacgccacgccagcgacgaacaaaacacacaccgcaagaagcaacaggcgcacaccacacaccacaacacacacacccagcaaaactgaaccgcacgagagcagacagaacaacaaatacgagcggaagctgatacagaagacgaacgagcggagcagcgacgacgaagcagggagcgacgacgcggagaggcgacggaggacaagacgacgagagaccggagacgcggagagcgagcccggccggcgacagccgccgcgaaggaacgacaaccacgcaccgacggagcgcgcggcccacgaggcggcggacagccagagacgcccgaagagagagagcagatagcggccggagcagggagggcggaggaaagggacgagaagcacagacagccaacgcacgagagggaagcaagcaagac

SEQ ID NO: 445447 - DNA, 2808 bp, Homo sapiens
ggacgcgtgggtcgaccacgcgtcaacaatcttgatgatgggccgctacgtggagcccatcgaggatgtgccttgtgggaacattgtgggcctcgtgggcgtggaccagttcctggtgaagacgggcaccatcaccaccttcgagcacgcgcacaacatgcgggtgatgaagttcagcgtcagccctgttgtcagagtggccgtggaggccaagaacccggctgacctgcccaagctggtggaggggctgaagcggctggccaagtccgaccccatggtgcagtgcatcatcgaggagtcgggagagcacatcatcgcgggcgccggcgagctgcacctggagatctgcctgaaggacctggaggaggaccacgcctgcatccccatcaagaaatctgacccggtcgtctcgtaccgcgagacggtcagtgaagagtcgaacgtgctctgcctctccaagtcccccaacaagcacaaccggctgtacatgaaggcgcggcccttccccgacggcctggccgaggacatcgataaaggcgaggtgtccgcccgtcaggagctcaagcagcgggcgcgctacctggccgagaagtacgagtgggacgtggctgaggcccgcaagatctggtgctttgggcccgacggcaccggccccaacatcctcaccgacatcaccaagggtgtgcagtacctcaacgagatcaaggacagtgtggtggccggcttccagtgggccaccaaggagggcgcactgtgtgaggagaacatgcggggtgtgcgcttcgacgtccacgacgtcaccctgcacgccgacgccatccaccgcggagggggccagatcatccccacagcacggcgctgcctctacgccagtgtgctgaccgcccagccacgcctcatggagcccatctaccttgtggagatccagtgtccagagcaggtggtcggtggcatctacggggttttgaacaggaagcggggccacgtgttcgaggagtcccaggtggccggcacccccatgtttgtggtcaaggcctatctgcccgtcaacgagtcctttggcttcaccgctgacctgaggtccaacacgggcggccaggcgttcccccagtgtgtgtttgaccactggcagatcctgcccggagaccccttcgacaacagcagccgccccagccaggtggtggcggagacccgcaagcgcaagggcctgaaagaaggcatccctgccctggacaacttcctggacaaattgtaggcggcccttcctgcagcgcctgccgccccggggactcgcagcacccacagcaccacgtcctcgaattctcagacgacacctggagactgtcccgacacagcgacgctcccctgagaggtttctggggcccgctgcgtgccatcactcaaccataacacttgatgccgtttctttcaatatttatttccagagtccggaggcagcagacacgccctcttagtagggacttaatgggccggtcggggagggggaggcgggatgggacacccaacactttttccatttcttcagagggaaactcagatgtccaaactaattttaacaaacgcattaagaggtttatttgggtacatggcccgcagtggcttttgccccagaaaggggaaaggaacacgcgggtagatgatttctagcaggcaggaagtcctgtgcggtgtcaccatgagcacctccagctgtactagtgccattggaataataaatttgataaggtggtgaaaaaaaaaaaaaaaaaaaaaaaaaaaaaaaaaaaaaaaaaaaacaagtgtgtgtgggggcggcgcgcgcgcggcccccggagagaaagttttttaaaccccgtggggggggcgcgcgcggggcccccagagtggcgtaaggaaacacggtgggcacacagcgggtgtcccaggagagaaaacccggggccaaaaaagggggcgggagttccccccaattaaaacaccgcccggggggaacaccaggagggtgttctacgagaacaaacccccagaggggggagctccgaggggcgacaacagcgggggagactatcacaccagggggggcgtcaccagggagggcgcggagatataaaaaataacgcccggggagtggtggcgcggccacacccaccacagcgaggcacacacactgtactcatgcacaaaagtgaatagaggactgaaataaacgcaaagccgacaaccaagcgtcagcggagagtcaaacaataagagcaaaaggagctgcgtcaggctgaaacgaagaacaaccgagaaagcaacaaaataagacaagcgaaaagcatggaacaacagacacataaaaaacagtcgatcagaaaaaaaagagaccagacgagaggacacaactaagacagaagacgaagaacaagcaagacacagaatgagagacacgaagcaaggaaaatggtcgcatcagacagagaaccgtaaggcaaacaatacaacagagacgacaaccgagatagaaaaaagacacgagatagtagaaaggacatcagggaaaaaggaaacgaagagacgcactcgaagcaaagaagagcagacaaagacaagataaaaccgaagcgcggcagacgacggagacgagtgacacaaagcagcgacagagaacatgagacacgaagacaaacaaacaagtaagagcagcgcagaaaccaagatcaagaaaacaagcagaaagaaagagctacgactcagcagcaccgagaagagaggcggatatcaacacaaatcacataacaaacaacgcgcacaagctcacacacc

SEQ ID NO: 445448 - DNA, 2454 bp, Homo sapiens
  misc_feature (1819)..(1819): n is a, c, g, or t
ggacgcgtgggtcgaccacgcgtcaacaatcttgatgatgggccgctacgtggagcccatcgaggatgtgccttgtgggaacattgtgggcctcgtgggcgtggaccagttcctggtgaagacgggcaccatcaccaccttcgagcacgcgcacaacatgcgggtgatgaagttcagcgtcagccctgttgtcagagtggccgtggaggccaagaacccggctgacctgcccaagctggtggaggggctgaagcggctggccaagtccgaccccatggtgcagtgcatcatcgaggagtcgggagagcacatcatcgcgggcgccggcgagctgcacctggagatctgcctgaaggacctggaggaggaccacgcctgcatccccatcaagaaatctgacccggtcgtctcgtaccgcgagacggtcagtgaagagtcgaacgtgctctgcctctccaagtcccccaacaagcacaaccggctgtacatgaaggcgcggcccttccccgacggcctggccgaggacatcgataaaggcgaggtgtccgcccgtcaggagctcaagcagcgggcgcgctacctggccgagaagtacgagtgggacgtggctgaggcccgcaagatctggtgctttgggcccgacggcaccggccccaacatcctcaccgacatcaccaagggtgtgcagtacctcaacgagatcaaggacagtgtggtggccggcttccagtgggccaccaaggagggcgcactgtgtgaggagaacatgcggggtgtgcgcttcgacgtccacgacgtcaccctgcacgccgacgccatccaccgcggagggggccagatcatccccacagcacggcgctgcctctacgccagtgtgctgaccgcccagccacgcctcatggagcccatctaccttgtggagatccagtgtccagagcaggtggtcggtggcatctacggggttttgaacaggaagcggggccacgtgttcgaggagtcccaggtggccggcacccccatgtttgtggtcaaggcctatctgcccgtcaacgagtcctttggcttcaccgctgacctgaggtccaacacgggcggccaggcgttcccccagtgtgtgtttgaccactggcagatcctgcccggagaccccttcgacaacagcagccgccccagccaggtggtggcggagacccgcaagcgcaagggcctgaaagaaggcatccctgccctggacaacttcctggacaaattgtaggcggcccttcctgcagcgcctgccgccccggggactcgcagcacccacagcaccacgtcctcgaattctcagacgacacctggagactgtcccgacacagcgacgctcccctgagaggtttctggggcccgctgcgtgccatcactcaaccataacacttgatgccgtttctttcaatatttatttccagagtccggaggcagcagacacgccctcttagtagggacttaatgggccggtcggggagggggaggcgggatgggacacccaacactttttccatttcttcagagggaaactcagatgtccaaactaattttaacaaacgcattaagaggtttatttgggtacatggcccgcagtggcttttgccccagaaaggggaaaggaacacgcgggtagatgatttctagcaggcaggaagtcctgtgcggtgtcaccatgagcacctccagctgtactagtgccattggaataataaatttgataaggtggtgaaaaaaaaaaaaaaaaaaacaaaaaaaaaaaacatcaacacaaacaaaacaaaaacacaaaaaaaanaaaaaaaaaaaaacaaaaaaaacaaaagaaaacaaagaagaaaaataaaaacaaaatctaatgaaaaaagttacacatagtacccttagaaaaccagagccatcgtacccatagaggccccacacaaccggcagagcaaggctaaggccctacagctacttgtcatccgggaccaaatagctactcttagctgcaattctttgaacacctaacgttaaactttggaaaggcactgaattaaccaaattgaatgtgttgccgacttcaggcgcccatgcggcagaggatttcacggatatgccacgccctcatgattcgtttatgctaggatccttgtgttctcacttgagtgaacctgtggcttcagttgtatcaactacactaatctttcacagctcgcttggataacccttgctatggtgtctaagttacctcgaagcaatgttgcaatcgccatttatcaatttgctggtcctccttgaaacaatctctcaaggtttctagggctattggtaaatgtgccttccactctcctcaaagtgtttttcctccattatgtcagctttaaattgctaaccgtcacaagccccagtgaacactggcaactcggtcaaaccttgcactgcttggaaccc

SEQ ID NO: 445449 - DNA, 1783 bp, Homo sapiens
ggacgcgtgggtcgaccacgcgtcaacaatcttgatgatgggccgctacgtggagcccatcgaggatgtgccttgtgggaacattgtgggcctcgtgggcgtggaccagttcctggtgaagacgggcaccatcaccaccttcgagcacgcgcacaacatgcgggtgatgaagttcagcgtcagccctgttgtcagagtggccgtggaggccaagaacccggctgacctgcccaagctggtggaggggctgaagcggctggccaagtccgaccccatggtgcagtgcatcatcgaggagtcgggagagcacatcatcgcgggcgccggcgagctgcacctggagatctgcctgaaggacctggaggaggaccacgcctgcatccccatcaagaaatctgacccggtcgtctcgtaccgcgagacggtcagtgaagagtcgaacgtgctctgcctctccaagtcccccaacaagcacaaccggctgtacatgaaggcgcggcccttccccgacggcctggccgaggacatcgataaaggcgaggtgtccgcccgtcaggagctcaagcagcgggcgcgctacctggccgagaagtacgagtgggacgtggctgaggcccgcaagatctggtgctttgggcccgacggcaccggccccaacatcctcaccgacatcaccaagggtgtgcagtacctcaacgagatcaaggacagtgtggtggccggcttccagtgggccaccaaggagggcgcactgtgtgaggagaacatgcggggtgtgcgcttcgacgtccacgacgtcaccctgcacgccgacgccatccaccgcggagggggccagatcatccccacagcacggcgctgcctctacgccagtgtgctgaccgcccagccacgcctcatggagcccatctaccttgtggagatccagtgtccagagcaggtggtcggtggcatctacggggttttgaacaggaagcggggccacgtgttcgaggagtcccaggtggccggcacccccatgtttgtggtcaaggcctatctgcccgtcaacgagtcctttggcttcaccgctgacctgaggtccaacacgggcggccaggcgttcccccagtgtgtgtttgaccactggcagatcctgcccggagaccccttcgacaacagcagccgccccagccaggtggtggcggagacccgcaagcgcaagggcctgaaagaaggcatccctgccctggacaacttcctggacaaattgtaggcggcccttcctgcagcgcctgccgccccggggactcgcagcacccacagcaccacgtcctcgaattctcagacgacacctggagactgtcccgacacagcgacgctcccctgagaggtttctggggcccgctgcgtgccatcactcaaccataacacttgatgccgtttctttcaatatttatttccagagtccggaggcagcagacacgccctcttagtagggacttaatgggccggtcggggagggggaggcgggatgggacacccaacactttttccatttcttcagagggaaactcagatgtccaaactaattttaacaaacgcattaagaggtttatttgggtacatggcccgcagtggcttttgccccagaaaggggaaaggaacacgcgggtagatgatttctagcaggcaggaagtcctgtgcggtgtcaccatgagcacctccagctgtactagtgccattggaataataaatttgataaggtggtgattggggataaatagggtacggagctcgaat

SEQ ID NO: 445450 - DNA, 2547 bp, Homo sapiens
  misc_feature (1766)..(1766): n is a, c, g, or t
ggacgcgtgggtcgaccacgcgtcaacaatcttgatgatgggccgctacgtggagcccatcgaggatgtgccttgtgggaacattgtgggcctcgtgggcgtggaccagttcctggtgaagacgggcaccatcaccaccttcgagcacgcgcacaacatgcgggtgatgaagttcagcgtcagccctgttgtcagagtggccgtggaggccaagaacccggctgacctgcccaagctggtggaggggctgaagcggctggccaagtccgaccccatggtgcagtgcatcatcgaggagtcgggagagcacatcatcgcgggcgccggcgagctgcacctggagatctgcctgaaggacctggaggaggaccacgcctgcatccccatcaagaaatctgacccggtcgtctcgtaccgcgagacggtcagtgaagagtcgaacgtgctctgcctctccaagtcccccaacaagcacaaccggctgtacatgaaggcgcggcccttccccgacggcctggccgaggacatcgataaaggcgaggtgtccgcccgtcaggagctcaagcagcgggcgcgctacctggccgagaagtacgagtgggacgtggctgaggcccgcaagatctggtgctttgggcccgacggcaccggccccaacatcctcaccgacatcaccaagggtgtgcagtacctcaacgagatcaaggacagtgtggtggccggcttccagtgggccaccaaggagggcgcactgtgtgaggagaacatgcggggtgtgcgcttcgacgtccacgacgtcaccctgcacgccgacgccatccaccgcggagggggccagatcatccccacagcacggcgctgcctctacgccagtgtgctgaccgcccagccacgcctcatggagcccatctaccttgtggagatccagtgtccagagcaggtggtcggtggcatctacggggttttgaacaggaagcggggccacgtgttcgaggagtcccaggtggccggcacccccatgtttgtggtcaaggcctatctgcccgtcaacgagtcctttggcttcaccgctgacctgaggtccaacacgggcggccaggcgttcccccagtgtgtgtttgaccactggcagatcctgcccggagaccccttcgacaacagcagccgccccagccaggtggtggcggagacccgcaagcgcaagggcctgaaagaaggcatccctgccctggacaacttcctggacaaattgtaggcggcccttcctgcagcgcctgccgccccggggactcgcagcacccacagcaccacgtcctcgaattctcagacgacacctggagactgtcccgacacagcgacgctcccctgagaggtttctggggcccgctgcgtgccatcactcaaccataacacttgatgccgtttctttcaatatttatttccagagtccggaggcagcagacacgccctcttagtagggacttaatgggccggtcggggagggggaggcgggatgggacacccaacactttttccatttcttcagagggaaactcagatgtccaaactaattttaacaaacgcattaagaggtttatttgggtacatggcccgcagtggcttttgccccagaaaggggaaaggaacacgcgggtagatgatttctagcaggcaggaagtcctgtgcggtgtcaccatgagcacctccagctgtactagtgccattggaataataaatttgataaggtggtgaaaaaaaaaaaaanaaaaaaaaaaaaaaaaaaaaaaaaaaaaaaaaaaaaaaaaaaaaaaaaaaaaaaaaaaaaaaaaaaaaaaaaacaaacaaaaacaaaaacaaagaaggcggacgcccccacaaaaaagaacccgcgaggaggacgcacaaaagaaagaccacaccagcagcctcttgacgagagacaacgggacaccacaaaagaatgcgccaaataaaaacaaacagcacgcagcgacgaacgaataacaaagacgcgaaacagagaaaaaaacgaacagcgagacacacatgcgggaagagcaaccactcactcagcgaggggagacgcacacaagcgagagacacaacacacaccacagacagactcaacgccacgccagcgacgaacaaaacacacaccgcaagaagcaacaggcgcacaccacacaccacaacacacacacccagcaaaactgaaccgcacgagagcagacagaacaacaaatacgagcggaagctgatacagaagacgaacgagcggagcagcgacgacgaagcagggagcgacgacgcggagaggcgacggaggacaagacgacgagagaccggagacgcggagagcgagcccggccggcgacagccgccgcgaaggaacgacaaccacgcaccgacggagcgcgcggcccacgaggcggcggacagccagagacgcccgaagagagagagcagatagcggccggagcagggagggcggaggaaagggacgagaagcacagacagccaacgcacgagagggaagcaagcaagac

SEQ ID NO: 445451 - DNA, 1691 bp, Homo sapiens
ggacgcgtgggtcgaccacgcgtcaacaatcttgatgatgggccgctacgtggagcccatcgaggatgtgccttgtgggaacattgtgggcctcgtgggcgtggaccagttcctggtgaagacgggcaccatcaccaccttcgagcacgcgcacaacatgcgggtgatgaagttcagcgtcagccctgttgtcagagtggccgtggaggccaagaacccggctgacctgcccaagctggtggaggggctgaagcggctggccaagtccgaccccatggtgcagtgcatcatcgaggagtcgggagagcacatcatcgcgggcgccggcgagctgcacctggagatctgcctgaaggacctggaggaggaccacgcctgcatccccatcaagatcactcaaccataacacttgatgccgtttctttcaatatttatttccagagtccgacggcctggccgaggacatcgataaaggcgaggtgtccgcccgtcaggagctcaagcagcgggcgcgctacctggccgagaagtacgagtgggacgtggctgaggcccgcaagatctggtgctttgggcccgacggcaccggccccaacatcctcaccgacatcaccaagggtgtgcagtacctcaacgagatcaaggacagtgtggtggccggcttccagtgggccaccaaggagggcgcactgtgtgaggagaacatgcggggtgtgcgcttcgacgtccacgacgtcaccctgcacgccgacgccatccaccgcggagggggccagatcatccccacagcacggcgctgcctctacgccagtgtgctgaccgcccagccacgcctcatggagcccatctaccttgtggagatccagtgtccagagcaggtggtcggtggcatctacggggttttgaacaggaagcggggccacgtgttcgaggagtcccaggtggccggcacccccatgtttgtggtcaaggcctatctgcccgtcaacgagtcctttggcttcaccgctgacctgaggtccaacacgggcggccaggcgttcccccagtgtgtgtttgaccactggcagatcctgcccggagaccccttcgacaacagcagccgccccagccaggtggtggcggagacccgcaagcgcaagggcctgaaagaaggcatccctgccctggacaacttcctggacaaattgtaggcggcccttcctgcagcgcctgccgccccggggactcgcagcacccacagcaccacgtcctcgaattctcagacgacacctggagactgtcccgacacagcgacgctcccctgagaggtttctggggcccgctgcgtgccatcactcaaccataacacttgatgccgtttctttcaatatttatttccagagtccggaggcagcagacacgccctcttagtagggacttaatgggccggtcggggagggggaggcgggatgggacacccaacactttttccatttcttcagagggaaactcagatgtccaaactaattttaacaaacgcattaagaggtttatttgggtacatggcccgcagtggcttttgccccagaaaggggaaaggaacacgcgggtagatgatttctagcaggcaggaagtcctgtgcggtgtcaccatgagcacctccagctgtactagtgccattggaataataaatttgataaggtggtga

SEQ ID NO: 445452 - DNA, 2416 bp, Homo sapiens
  misc_feature (1849)..(1849): n is a, c, g, or t
  misc_feature (2181)..(2181): n is a, c, g, or t
ggacgcgtgggtcgaccacgcgtcaacaatcttgatgatgggccgctacgtggagcccatcgaggatgtgccttgtgggaacattgtgggcctcgtgggcgtggaccagttcctggtgaagacgggcaccatcaccaccttcgagcacgcgcacaacatgcgggtgatgaagttcagcgtcagccctgttgtcagagtggccgtggaggccaagaacccggctgacctgcccaagctggtggaggggctgaagcggctggccaagtccgaccccatggtgcagtgcatcatcgaggagtcgggagagcacatcatcgcgggcgccggcgagctgcacctggagatctgcctgaaggacctggaggaggaccacgcctgcatccccatcaagaaatctgacccggtcgtctcgtaccgcgagacggtcagtgaagagtcgaacgtgctctgcctctccaagtcccccaacaagcacaaccggctgtacatgaaggcgcggcccttccccgacggcctggccgaggacatcgataaaggcgaggtgtccgcccgtcaggagctcaagcagcgggcgcgctacctggccgagaagtacgagtgggacgtggctgaggcccgcaagatctggtgctttgggcccgacggcaccggccccaacatcctcaccgacatcaccaagggtgtgcagtacctcaacgagatcaaggacagtgtggtggccggcttccagtgggccaccaaggagggcgcactgtgtgaggagaacatgcggggtgtgcgcttcgacgtccacgacgtcaccctgcacgccgacgccatccaccgcggagggggccagatcatccccacagcacggcgctgcctctacgccagtgtgctgaccgcccagccacgcctcatggagcccatctaccttgtggagatccagtgtccagagcaggtggtcggtggcatctacggggttttgaacaggaagcggggccacgtgttcgaggagtcccaggtggccggcacccccatgtttgtggtcaaggcctatctgcccgtcaacgagtcctttggcttcaccgctgacctgaggtccaacacgggcggccaggcgttcccccagtgtgtgtttgaccactggcagatcctgcccggagaccccttcgacaacagcagccgccccagccaggtggtggcggagacccgcaagcgcaagggcctgaaagaaggcatccctgccctggacaacttcctggacaaattgtaggcggcccttcctgcagcgcctgccgccccggggactcgcagcacccacagcaccacgtcctcgaattctcagacgacacctggagactgtcccgacacagcgacgctcccctgagaggtttctggggcccgctgcgtgccatcactcaaccataacacttgatgccgtttctttcaatatttatttccagagtccggaggcagcagacacgccccctgtgacggcccagaagtaccgctgcgagctcctgtacgaggggcccccggacgacgaggctgccatgggcattaaaagctgtgaccccaaaggccctcttatgatgtatatttccaaaatggtgccaacctccgacaaaggtcggttctacgcctttggacgagtcttctcggggctggtctccactggcctgaaggtcaggatcatggggcccaactatacccctgggaagaaggaggacctctacctgaagccaatccagagaacaatcttgatgatgggccgctacgtggagcccatcgaggatgtgccttgtgggaacattgtgggcctcgtgggcgtggaccagttcctggtgaagacgggcaccatcaccanccttcgagcacgcgcacaacatgcgggtgatgaagttcagcgtcagccctgttgtcagagtggccgtggaggccaagaacccggctgacctgcccaagctggtggaggggctgaagcggctggccaagtccgaccccatggttgcagtgcatcatcgaggagtcgggagagcacatcatcgcggcgccggcgagctgcacctggagatctgcctgaaggacctggaggaggaccacgcctgcatccccatcaagaaatctgacccggtcgtctcgtaccgcgagacggtcagtgaagagtcgaacgtgctctgcctctccaagtcccccaanaagcacaaccggctgtacatgaggcgcggccttccccgacggcctggccgaggacatcgataaaggcgaggtgtccgcccgtcaggagctcaagcagcgggcgcgctacctggccgagaagtacgagtgggacgtggctgaggcccgcaagatctggtgctttgggcccgacggcaccggcccaacatcctcaccgacatcaccaagggatgtactgacgatgtaccagcatgat

SEQ ID NO: 445453 - DNA, 1671 bp, Homo sapiens
ggacgcgtgggtcgaccacgcgtcaacaatcttgatgatgggccgctacgtggagcccatcgaggatgtgccttgtgggaacattgtgggcctcgtgggcgtggaccagttcctggtgaagacgggcaccatcaccaccttcgagcacgcgcacaacatgcgggtgatgaagttcagcgtcagccctgttgtcagagtggccgtggaggccaagaacccggctgacctgcccaagctggtggaggggctgaagcggctggccaagtccgaccccatggtgcagtgcatcatcgaggagtcgggagagcacatcatcgcgggcgccggcgagctgcacctggagatctgcctgaaggacctggaggaggaccacgcctgcatccccatcaagaaatctgacccggtcgtctcgtaccgcgagacggtcagtgaagagtcgaacgtgctctgcctctccaagtcccccaacaagcacaaccggctgtacatgaaggcgcggcccttccccgacggcctggccgaggacatcgataaaggcgaggtgtccgcccgtcaggagctcaagcagcgggcgcgctacctggccgagaagtacgagtgggacgtggctgaggcccgcaagatctggtgctttgggcccgacggcaccggccccaacatcctcaccgacatcaccaagggtgtgcagtacctcaacgagatcaaggacagtgtggtggccggcttccagtgggccaccaaggagggcgcactgtgtgaggagaacatgcggggtgtgcgcttcgacgtccacgacgtcaccctgcacgccgacgccatccaccgcggagggggccagatcatccccacagcacggcgctgcctctacgccagtgtgctgaccgcccagccacgcctcatggagcccatctaccttgtggagatccagtgtccagagcaggtggtcggtggcatctacggggttttgaacaggaagcggggccacgtgttcgaggagtcccaggtggccggcacccccatgtttgtggtcaaggcctatctgcccgtcaacgagtcctttggcttcaccgctgacctgaggtccaacacgggcggccaggcgttcccccagtgtgtgtttgaccactggcagatcctgcccggagaccccttaacttcctggacaaattgtaggcggcccttcctgcagcgcctgccgccccggggactcgcagcacccacagcaccacgtcctcgaattctcagacgacacctggagactgtcccgacacagcgacgctcccctgagaggtttctggggcccgctgcgtgccatcactcaaccataacacttgatgccgtttctttcaatatttatttccagagtccggaggcagcagacacgccctcttagtagggacttaatgggccggtcggggagggggaggcgggatgggacacccaacactttttccatttcttcagagggaaactcagatgtccaaactaattttaacaaacgcattaagaggtttatttgggtacatggcccgcagtggcttttgccccagaaaggggaaaggaacacgcgggtagatgatttctagcaggcaggaagtcctgtgcggtgtcaccatgagcacctccagctgtactagtgccattggaataataaatttgataaggtggtga

SEQ ID NO: 445454 - DNA, 1593 bp, Homo sapiens
ggacgcgtgggtcgaccacgcgtcaacaatcttgatgatgggccgctacgtggagcccatcgaggatgtgccttgtgggaacattgtgggcctcgtgggcgtggaccagttcctggtgaagacgggcaccatcaccaccttcgagcacgcgcacaacatgcgggtgatgaagttcagcgtcagccctgttgtcagagtggccgtggaggccaagaacccggctgacctgcccaagctggtggaggggctgaagcggctggccaagtccgaccccatggtgcagtgcatcatcgaggagtcgggagagcacatcatcgcgggcgccggcgagctgcacctggagatctgcctgaaggacctggaggaggaccacgcctgcatccccatcaagaaatctgacccggtcgtctcgtaccgcgagacggtcagtgaagagtcgaacgtgctctgcctctccaagtcccccaacaagcacaaccggctgtacatgaaggcgcggcccttccccgacggcctggccgaggacatcgataaaggcgaggtgtccgcccgtcaggagctcaagcagcgggcgcgctacctggccgagaagtacgagtgggacgtggctgaggcccgcaagatctggtgctttgggcccgacggcaccggccccaacatcctcaccgacatcaccaagggtgtgcagtacctcaacgagatcaaggacagtgtggtggccggcttccagtgggccaccaaggagggcgcactgtgtgaggagaacatgcggggtgtgcgcttcgacgtccacgacgtcaccctgcacgccgacgccatccaccgcggagggggccagatcatccccacagcacggcgctgcctctacgccagtgtgctgaccgcccagccacgcctcatggagcccatctaccttgtggagatccagtgtccagagcaggtggtcggtggcatctacggggttttgaacaggaagcggggccacgtgttcgaggagtcccaggtggccggcacccccatgtttgtggtcaaggcctatctgcccgtcaacgagtcctttggcttcaccgctgacctgaggtccaacacgggcggccaggcgttcccccagtgtgtgtttgaccactggcagatcctgcccggagaccccttcgacaacagcagccgccccagccaggtggtggcggagacccgcaagcgcaagggcctgaaagaaggcatccctgccctggacaacttcctggacaaattgtaggcggcccttcctgcagcgcctgccgccccggggactcgcagcacccacagcaccacgtcctcgaattctcagacgacacctggagactgtcccgacacagcgacgctcccctgagaggtttctggggcccgctgcgaactcagatgtccaaactaattttaacaaacgcattaagaggtttatttgggtacatggcccgcagtggcttttgccccagaaaggggaaaggaacacgcgggtagatgatttctagcaggcaggaagtcctgtgcggtgtcaccatgagcacctccagctgtactagtgccattggaataataaatttgataaggtggtga

SEQ ID NO: 445455 - DNA, 1552 bp, Homo sapiens
ggacgcgtgggtcgaccacgcgtcaacaatcttgatgatgggccgctacgtggagcccatcgaggatgtgccttgtgggaacattgtgggcctcgtgggcgtggaccagttcctggtgaagacgggcaccatcaccaccttcgagcacgcgcacaacatgcgggtgatgaagttcagcgtcagccctgttgtcagagtggccgtggaggccaagaacccggctgacctgcccaagctggtggaggggctgaagcggctggccaagtccgaccccatggtgcagtgcatcatcgaggagtcgggagagcacatcatcgcgggcgccggcgagctgcacctggagatctgcctgaaggacctggaggaggaccacgcctgcatccccatcaagaaatctgacccggtcgtctcgtaccgcgagacggtcagtgaagagtcgaacgtgctctgcctctccaagtcccccaacaagcacaaccggctgtacatgaaggcgcggcccttccccgacggcctggccgaggacatcgataaaggcgaggtgtccgcccgtcaggagctcaagcagcgggcgcgctacctggccgagaagtacgagtgggacgtggctgaggcccgcaagatctggtgctttgggcccgacggcaccggccccaacatcctcaccgacatcaccaagggtgtgcagtacctcaacgagatcaaggacagtgtggtggccggcttccagtgggccaccaaggagggcgcactgtgtgaggagaacatgcggggtgtgcgcttcgacgtccacgacgtcaccctgcacgccgacgccatccaccgcggagggggccagatcatccccacagcacggcgctgcctctacgccagtgtgctgaccgcccagccacgcctcatggagcccatctaccttgtggagatccagtgtccagagcaggtggtcggtggcatctacggggttttgaacaggaagcggggccacgtgttcgaggagtcccaggtggccggcacccccatgtttgtggtcaaggcctatctgcccgtcaacgagtcctttggcttcaccgctgacctgaggtccaacacgggcggccaggcgttcccccagtgtgtgtttgaccactggcagatcctgcccggagaccccttcgacaacagcagccgccccagccaggtggtggcggagacccgcaagcgcaagggcctgaaagaaggcatccctgccctggacaacttcctggacaaattgtaggcggcccttcctgcagcgcctgccgccccggggactcgcagcacccacagcaccacgtcctcgaattctcagacgacacctggagactgtcccgacacagcgacgctcccctgagaggtttctggggcccgctgcggtttatttgggtacatggcccgcagtggcttttgccccagaaaggggaaaggaacacgcgggtagatgatttctagcaggcaggaagtcctgtgcggtgtcaccatgagcacctccagctgtactagtgccattggaataataaatttgataaggtggtga

SEQ ID NO: 445456 - DNA, 1423 bp, Homo sapiens
ggacgcgtgggtcgaccacgcgtcaacaatcttgatgatgggccgctacgtggagcccatcgaggatgtgccttgtgggaacattgtgggcctcgtgggcgtggaccagttcctggtgaagacgggcaccatcaccaccttcgagcacgcgcacaacatgcgggtgatgaagttcagcgtcagccctgttgtcagagtggccgtggaggccaagaacccggctgacctgcccaagctggtggaggggctgaagcggctggccaagtccgaccccatggtgcagtgcatcatcgaggagtcgggagagcacatcatcgcgggcgccggcgagctgcacctggagatctgcctgaaggacctggaggaggaccacgcctgcatccccatcaagaaatctgacccggtcgtctcgtaccgcgagacggtcagtgaagagtcgaacgtgctctgcctctccaagtcccccaacaagcacaaccggctgtacatgaaggcgcggcccttccccgacggcctggccgaggacatcgataaaggcgaggtgtccgcccgtcaggagctcaagcagcgggcgcgctacctggccgagaagtacgagtgggacgtggctgaggcccgcaagatctggtgctttgggcccgacggcaccggccccaacatcctcaccgacatcaccaagggtgtgcagtacctcaacgagatcaaggacagtgtggtggccggcttccagtgggccaccaaggagggcgcactgtgtgaggagaacatgcggggtgtgcgcttcgacgtccacgacgtcaccctgcacgccgacgccatccaccgcggagggggccagatcatccccacagcacggcgctgcctctacgccagtgtgctgaccgcccagccacgcctcatggagcccatctaccttgtggagatccagtgtccagagcaggtggtcggtggcatctacggggttttgaacaggaagcggggccacgtgttcgaggagtcccaggtggccggcacccccatgtttgtggtcaaggcctatctgcccgtcaacgagtcctttggcttcaccgctgacctgaggtccaacacgggcggccaggcgttcccccagtgtgtgtttgaccactggcagatcctgcccggagaccccttcgacaacagcagccgccccagccaggtggtggcggagacccgcaagcgcaagggcctgaaagaaggcatccctgccctggacaacttcctggacaaattgtaggcggcccttcctgcagcgcctgccgccccggggactcgcagcacccacagcaccacgtcctcgaattctcagacgacacctggagactgtcccgacacagcgacgctcccctgagaggtttctggggcccgctgcgagtccgctgcattggtaccgagctgattgtat

SEQ ID NO: 445457 - DNA, 2324 bp, Homo sapiens
  misc_feature (1543)..(1543): n is a, c, g, or t
ggacgcgtgggtcgaccacgcgtcaacaatcttgatgatgggccgctacgtggagcccatcgaggatgtgccttgtgggaacattgtgggcctcgtgggcgtggaccagttcctggtgaagacgggcaccatcaccaccttcgagcacgcgcacaacatgcgggtgatgaagttcagcgtcagccctgttgtcagagtggccgtggaggccaagaacccggctgacctgcccaagctggtggaggggctgaagcggctggccaagtccgaccccatggtgcagtgcatcatcgaggagtcgggagagcacatcatcgcgggcgccggcgagctgcacctggagatctgcctgaaggacctggaggaggaccacgcctgcatccccatcaagaaatctgacccggtcgtctcgtaccgcgagacggtcagtgaagagtcgaacgtgctctgcctctccaagtcccccaacaagcacaaccggctgtacatgaaggcgcggcccttccccgacggcctggccgaggacatcgataaaggcgaggtgtccgcccgtcaggagctcaagcagcgggcgcgctacctggccgagaagtacgagtgggacgtggctgaggcccgcaagatctggtgctttgggcccgacggcaccggccccaacatcctcaccgacatcaccaagggtgtgcagtacctcaacgagatcaaggacagtgtggtggccggcttccagtgggccaccaaggagggcgcactgtgtgaggagaacatgcggggtgtgcgcttcgacgtccacgacgtcaccctgcacgccgacgccatccaccgcggagggggccagatcatccccacagcacggcgctgcctctacgccagtgtgctgaccgcccagccacgcctcatggagcccatctaccttgtggagatccagtgtccagagcaggtggtcggtggcatctacggggttttgaacaggaagcggggccacgtgttcgaggagtcccaggtggccggcacccccatgtttgtggtcaaggcctatctgcccgtcaacgagtcctttggcttcaccgctgacctgaggtccaacacgggcggccaggcgttcccccagtgtgtgtttgaccactggcagatcctgcccggagaccccttcgacaacagcagccgccccagccaggtggtggcggagacccgcaagcgcaagggcctgaaagaaggcatccctgccctggacaacttcctggacaaattgtaggcggcccttcctgcagcgcctgccgccccggggactcgcagcacccacagcaccacgtcctcgaattctcagacgacacctggagactgtcccgacacagcgacgctcccctgagaggtttctggggcccgctgcgcagtggcttttgccccagaaaggggaaaggaacacgcgggtagatgatttctagcaggcaggaagtcctgtgcggtgtcaccatgagcacctccagctgtactagtgccattggaataataaatttgataaggtggtgaaaaaaaaaaaaanaaaaaaaaaaaaaaaaaaaaaaaaaaaaaaaaaaaaaaaaaaaaaaaaaaaaaaaaaaaaaaaaaaaaaaaaacaaacaaaaacaaaaacaaagaaggcggacgcccccacaaaaaagaacccgcgaggaggacgcacaaaagaaagaccacaccagcagcctcttgacgagagacaacgggacaccacaaaagaatgcgccaaataaaaacaaacagcacgcagcgacgaacgaataacaaagacgcgaaacagagaaaaaaacgaacagcgagacacacatgcgggaagagcaaccactcactcagcgaggggagacgcacacaagcgagagacacaacacacaccacagacagactcaacgccacgccagcgacgaacaaaacacacaccgcaagaagcaacaggcgcacaccacacaccacaacacacacacccagcaaaactgaaccgcacgagagcagacagaacaacaaatacgagcggaagctgatacagaagacgaacgagcggagcagcgacgacgaagcagggagcgacgacgcggagaggcgacggaggacaagacgacgagagaccggagacgcggagagcgagcccggccggcgacagccgccgcgaaggaacgacaaccacgcaccgacggagcgcgcggcccacgaggcggcggacagccagagacgcccgaagagagagagcagatagcggccggagcagggagggcggaggaaagggacgagaagcacagacagccaacgcacgagagggaagcaagcaagac

SEQ ID NO: 445458 - DNA, 1616 bp, Homo sapiens
ggacgcgtgggtcgaccacgcgtcaacaatcttgatgatgggccgctacgtggagcccatcgaggatgtgccttgtgggaacattgtgggcctcgtgggcgtggaccagttcctggtgaagacgggcaccatcaccaccttcgagcacgcgcacaacatgcgggtgatgaagttcagcgtcagccctgttgtcagagtggccgtggaggccaagaacccggctgacctgcccaagctggtggaggggctgaagcggctggccaagtccgaccccatggtgcagtgcatcatcgaggagtcgggagagcacatcatcgcgggcgccggcgagctgcacctggagatctgcctgaaggacctggaggaggaccacgcctgcatccccatcaagaaatctgacccggtcgtctcgtaccgcgagacggtcagtgaagagtcgaacgtgctctgcctctccaagtcccccaacaagcacaaccggctgtacatgaaggcgcggcccttccccgacggcctggccgaggacatcgataaaggcgaggtgtccgcccgtcaggagctcaagcagcgggcgcgctacctggccgagaagtacgagtgggacgtggctgaggcccgcaagatctggtgctttgggcccgacggcaccggccccaacatcctcaccgacatcaccaagggtgtgcagtacctcaacgagatcaaggacagtgtggtggccggcttccagtgggccaccaaggagggcgcactgtgtgaggagaacatgcggggtgtgcgcttcgacgtccacgacgtcaccctgcacgccgacgccatccaccgcggagggggccagatcatccccacagcacggcgctgcctctacgccagtgtgctgaccgcccagccacgcctcatggagcccatctaccttgtggagatccagtgtccagagcaggtggtcggtggcatctacggggttttgaacaggaagcggggccacgtgttcgaggagtcccaggtggccggcacccccatgtttgtggtcaaggcctatctgcccgtcaacgagtcctttggcttcaccgctgacctgaggtccaacacgggcggccaggcgttcccccagtgtgtgtttgaccactggcagatcctgcccggagaccccttctcgcagcacccacagcaccacgtcctcgaattctcagacgacacctggagactgtcccgacacagcgacgctcccctgagaggtttctggggcccgctgcgtgccatcactcaaccataacacttgatgccgtttctttcaatatttatttccagagtccggaggcagcagacacgccctcttagtagggacttaatgggccggtcggggagggggaggcgggatgggacacccaacactttttccatttcttcagagggaaactcagatgtccaaactaattttaacaaacgcattaagaggtttatttgggtacatggcccgcagtggcttttgccccagaaaggggaaaggaacacgcgggtagatgatttctagcaggcaggaagtcctgtgcggtgtcaccatgagcacctccagctgtactagtgccattggaataataaatttgataaggtggtga

SEQ ID NO: 445459 - DNA, 2557 bp, Homo sapiens
  misc_feature (1290)..(1290): n is a, c, g, or t
  misc_feature (1464)..(1465): n is a, c, g, or t
  misc_feature (1468)..(1468): n is a, c, g, or t
  misc_feature (1471)..(1472): n is a, c, g, or t
  misc_feature (1485)..(1485): n is a, c, g, or t
  misc_feature (1526)..(1526): n is a, c, g, or t
  misc_feature (1536)..(1536): n is a, c, g, or t
  misc_feature (1964)..(1964): n is a, c, g, or t
  misc_feature (2296)..(2296): n is a, c, g, or t
ggacgcgtgggtcgaccacgcgtcaacaatcttgatgatgggccgctacgtggagcccatcgaggatgtgccttgtgggaacattgtgggcctcgtgggcgtggaccagttcctggtgaagacgggcaccatcaccaccttcgagcacgcgcacaacatgcgggtgatgaagttcagcgtcagccctgttgtcagagtggccgtggaggccaagaacccggctgacctgcccaagctggtggaggggctgaagcggctggccaagtccgaccccatggtgcagtgcatcatcgaggagtcgggagagcacatcatcgcgggcgccggcgagctgcacctggagatctgcctgaaggacctggaggaggaccacgcctgcatccccatcaagaaatctgacccggtcgtctcgtaccgcgagacggtcagtgaagagtcgaacgtgctctgcctctccaagtcccccaacaagcacaaccggctgtacatgaaggcgcggcccttccccgacggcctggccgaggacatcgataaaggcgaggtgtccgcccgtcaggagctcaagcagcgggcgcgctacctggccgagaagtacgagtgggacgtggctgaggcccgcaagatctggtgctttgggcccgacggcaccggccccaacatcctcaccgacatcaccaagggtgtgcagtacctcaacgagatcaaggacagtgtggtggccggcttccagtgggccaccaaggagggcgcactgtgtgaggagaacatgcggggtgtgcgcttcgacgtccacgacgtcaccctgcacgccgacgccatccaccgcggagggggccagatcatccccacagcacggcgctgcctctacgccagtgtgctgaccgcccagccacgcctcatggagcccatctaccttgtggagatccagtgtccagagcaggtggtcggtggcatctacggggttttgaacaggaagcggggccacgtgttcgaggagtcccaggtggccggcacccccatgtttgtggtcaaggcctatctgcccgtcaacgagtcctttggcttcaccgctgacctgaggtccaacacgggcggccaggcgttcccccagtgtgtgtttgaccactggcagatcctgcccggagaccccttcgacaacagcagccgccccagccaggtggtggcggagacccgcaagcgcaagggcctgaaagaaggcatccctgccctggacaacttcctggacaaattgtaggcggcccttcctgcagcgcctgccgccccggggantggggtgacaggtactttgacccacccaacggcaagttcagcaagtcagccaccagccccgaagggaagaagctgccacgcaccttctgccagctgatcctggaccccatcttcaaggtgtttgatgcgatcatgaatttcaagaaagaggagacagcaaactgatagagaatnnacntcnnactgacagcgagncaaggacaaagaaggcaacccctgctgaagtctgtgatgcnccgctggctncctgccggagacgccttgttgcagatgatcaccatccacctgccctcccctgtgacggcccagaagtaccgctgcgagctcctgtacgaggggcccccggacgacgaggctgccatgggcattaaaagctgtgaccccaaaggccctcttatgatgtatatttccaaaatggtgccaacctccgacaaaggtcggttctacgcctttggacgagtcttctcggggctggtctccactggcctgaaggtcaggatcatggggcccaactatacccctgggaagaaggaggacctctacctgaagccaatccagagaacaatcttgatgatgggccgctacgtggagcccatcgaggatgtgccttgtgggaacattgtgggcctcgtgggcgtggaccagttcctggtgaagacgggcaccatcaccanccttcgagcacgcgcacaacatgcgggtgatgaagttcagcgtcagccctgttgtcagagtggccgtggaggccaagaacccggctgacctgcccaagctggtggaggggctgaagcggctggccaagtccgaccccatggttgcagtgcatcatcgaggagtcgggagagcacatcatcgcggcgccggcgagctgcacctggagatctgcctgaaggacctggaggaggaccacgcctgcatccccatcaagaaatctgacccggtcgtctcgtaccgcgagacggtcagtgaagagtcgaacgtgctctgcctctccaagtcccccaanaagcacaaccggctgtacatgaggggacacccaacactttttccatttcttcagagggaaactcagatgtccaaactaattttaacaaacgcattaagaggtttatttgggtacatggcccgcagtggcttttgccccagaaaggggaaaggaacacgcgggtagatgatttctagcaggcaggaagtcctgtgcggtgtcaccatgagcacctccagctgtactagtgccattggaataataaatttgataaggtggtga

SEQ ID NO: 445460 - DNA, 878 bp, Homo sapiens
ccgaggatcacgatgtccgtatgagtaaaaattatatagttccctcttcctacatcccacccccagagctgcatttctcactgaaagagaagagaaaatgcagctctgacgtgttcgaggagtcccaggtggccggcacccccatgtttgtggtcaaggcctatctgcccgtcaacgagtcctttggcttcaccgctgacctgaggtccaacacgggcggccaggcgttcccccagtgtgtgtttgaccactggcagatcctgcccggagaccccttcgacaacagcagccgccccagccaggtggtggcggagacccgcaagcgcaagggcctgaaagaaggcatccctgccctggacaacttcctggacaaattgtaggcggcccttcctgcagcgcctgccgccccggggactcgcagcacccacagcaccacgtcctcgaattctcagacgacacctggagactgtcccgacacagcgacgctcccctgagaggtttctggggcccgctgcgtgccatcactcaaccataacacttgatgccgtttctttcaatatttatttccagagtccggaggcagcagacacgccctcttagtagggacttaatgggccggtcggggagggggaggcgggatgggacacccaacactttttccatttcttcagagggaaactcagatgtccaaactaattttaacaaacgcattaagaggtttatttgggtacatggcccgcagtggcttttgccccagaaaggggaaaggaacacgcgggtagatgatttctagcaggcaggaagtcctgtgcggtgtcaccatgagcacctccagctgtactagtgccattggaataataaatttgataaggtggtga

SEQ ID NO: 445461 - DNA, 1166 bp, Homo sapiens
ggacgcgtgggtcgaccacgcgtcaacaatcttgatgatgggccgctacgtggagcccatcgaggatgtgccttgtgggaacattgtgggcctcgtgggcgtggaccagttcctggtgaagacgggcaccatcaccaccttcgagcacgcgcacaacatgcgggtgatgaagttcagcgtcagccctgttgtcagagtggccgtggaggccaagaacccggctgacctgcccaagctggtggaggggctgaagcggctggccaagtccgaccccatggtgcagtgcatcatcgaggagtcgggagagcacatcatcgcgggcgccggcgagctgcacctggagatctgcctgaaggacctggaggaggaccacgcctgcatccccatcaagaaatctgacccggtcgtctcgtaccgcgagacggtcagtgaagagtcgaacgtgctctgcctctccaagtcccccaacaagcacaaccggctgtacatgaaggcgcggcccttccccgacggcctggccgaggacatcgataaaggcgaggtgtccgcccgtcaggagctcaagcagcgggcgcgctacctggccgagaagtacgagtgggacgtggctgaggcccgcaagatctggtgctttgggcccgacggcaccggccccaacatcctcaccgacatcaccaagggtgtgcagtacctcaacgagatcaaggacagtgtggtggccggcttccagtgggccaccaaggagggcgcactgtgtgaggagaacatgcggggtgtgcgcttcgacgtccacgacgtcaccctgcacgccgacgccatccaccgcggagggggccagatcatccccacagcacggcgctgcctctacgccagtgtgctgaccgcccagccacgcctcatggagcccatctaccttgtggagatccaggggacacccaacactttttccatttcttcagagggaaactcagatgtccaaactaattttaacaaacgcattaagaggtttatttgggtacatggcccgcagtggcttttgccccagaaaggggaaaggaacacgcgggtagatgatttctagcaggcaggaagtcctgtgcggtgtcaccatgagcacctccagctgtactagtgccattggaataataaatttgataaggtggtga

SEQ ID NO: 445462 - DNA, 1345 bp, Homo sapiens
  misc_feature (1108)..(1108): n is a, c, g, or t
ggacgcgtgggtcgaccacgcgtcaacaatcttgatgatgggccgctacgtggagcccatcgaggatgtgccttgtgggaacattgtgggcctcgtgggcgtggaccagttcctggtgaagacgggcaccatcaccaccttcgagcacgcgcacaacatgcgggtgatgaagttcagcgtcagccctgttgtcagagtggccgtggaggccaagaacccggctgacctgcccaagctggtggaggggctgaagcggctggccaagtccgaccccatggtgcagtgcatcatcgaggagtcgggagagcacatcatcgcgggcgccggcgagctgcacctggagatctgcctgaaggacctggaggaggaccacgcctgcatccccatcaagaaatctgacccggtcgtctcgtaccgcgagacggtcagtgaagagtcgaacgtgctctgcctctccaagtcccccaacaagcacaaccggctgtacatgaaggcgcggcccttccccgacggcctggccgaggacatcgataaaggcgaggtgtccgcccgtcaggagctcaagcagcgggcgcgctacctggccgagaagtacgagtgggacgtggctgaggcccgcaagatctggtgctttgggcccgacggcaccggccccaacatcctcaccgacatcaccaagggtgtgcagtacctcaacgagatcaaggacagtgtggtggccggcttccagtgggccaccaaggagggcgcactgtgtgaggagaacatgcggggtgtgcgcttcgacgtccacgacgtcaccctgcacgccgacgccatccaccgcggagggggccagatcatccccacagcacggcgctgcctctacgccagtgtgctgaccgcccagccacgcctcatggagcccatctaccttgtggagatccagtgtccagagcaggtggtcggtggcatctacggggttttgaacaggaagcggggccacgtgttcgaggagtcccaggtggccggcacccccatgtttgtggtcaagttcgccgccaagggggagggccagttggggcctgccgagcgggccaagaaagtagaggacatgatgaagaagctntggggtgacaggtactttgacccacccaacggcaagttcagcaagtcagccaccagccccgaagggaagaagctgccacgcaccttctgccagctgatcctggaccccattttatacttcacttttctctacagtgttgttttgttgttgttggtttttattttttatactttggccataccacagagctagattcccaggtctgggctgaataaaacaaggtttttctaaaaaaaa

SEQ ID NO: 445463 - DNA, 1810 bp, Homo sapiens
  misc_feature (415)..(415): n is a, c, g, or t
  misc_feature (717)..(718): n is a, c, g, or t
  misc_feature (721)..(721): n is a, c, g, or t
  misc_feature (724)..(725): n is a, c, g, or t
  misc_feature (738)..(738): n is a, c, g, or t
  misc_feature (779)..(779): n is a, c, g, or t
  misc_feature (789)..(789): n is a, c, g, or t
  misc_feature (1217)..(1217): n is a, c, g, or t
  misc_feature (1549)..(1549): n is a, c, g, or t
ggacgcgtgggtcgaccacgcgtcaacaatcttgatgatgggccgctacgtggagcccatcgaggatgtgccttgtgggaacattgtgggcctcgtgggcgtggaccagttcctggtgaagacgggcaccatcaccaccttcgagcacgcgcacaacatgcgggtgatgaagttcagcgtcagccctgttgtcagagtggccgtggaggccaagaacccggctgacctgcccaagctggtggaggggctgaagcggctggccaagtccgaccccatggtgcagtgcatcatcgaggagtcgggagagcacatcatcgcgggcgccggcgagctgcacctggagatctgcctgaaggacctggaggaggaccacgcctgcatccccatcaagttcgactcttcactgaccgtctcncggtacgagacgaccgggtcagatttcttatgggaatccaggcatggtcctcctccaggtacttcaggcagatctccaggtgcagctttccggcgcccgcgatgatgtgctctcccgactcctcgatgatgcactgcaccatggggtcggacttggccagccgcttcagcaagtcagccaccagccccgaagggaagaagctgccacgcaccttctgccagctgatcctggaccccatcttcaaggtgtttgatgcgatcatgaatttcaagaaagaggagacagcaaactgatagagaatnnacntcnnactgacagcgagncaaggacaaagaaggcaacccctgctgaagtctgtgatgcnccgctggctncctgccggagacgccttgttgcagatgatcaccatccacctgccctcccctgtgacggcccagaagtaccgctgcgagctcctgtacgaggggcccccggacgacgaggctgccatgggcattaaaagctgtgaccccaaaggccctcttatgatgtatatttccaaaatggtgccaacctccgacaaaggtcggttctacgcctttggacgagtcttctcggggctggtctccactggcctgaaggtcaggatcatggggcccaactatacccctgggaagaaggaggacctctacctgaagccaatccagagaacaatcttgatgatgggccgctacgtggagcccatcgaggatgtgccttgtgggaacattgtgggcctcgtgggcgtggaccagttcctggtgaagacgggcaccatcaccanccttcgagcacgcgcacaacatgcgggtgatgaagttcagcgtcagccctgttgtcagagtggccgtggaggccaagaacccggctgacctgcccaagctggtggaggggctgaagcggctggccaagtccgaccccatggttgcagtgcatcatcgaggagtcgggagagcacatcatcgcggcgccggcgagctgcacctggagatctgcctgaaggacctggaggaggaccacgcctgcatccccatcaagaaatctgacccggtcgtctcgtaccgcgagacggtcagtgaagagtcgaacgtgctctgcctctccaagtcccccaanaagcacaaccggctgtacatgaggggacacccaacactttttccatttcttcagagggaaactcagatgtccaaactaattttaacaaacgcattaagaggtttatttgggtacatggcccgcagtggcttttgccccagaaaggggaaaggaacacgcgggtagatgatttctagcaggcaggaagtcctgtgcggtgtcaccatgagcacctccagctgtactagtgccattggaataataaatttgataaggtggtga

SEQ ID NO: 445464 - DNA, 410 bp, Homo sapiens
cggtggggcaggatgtctggtcaggagggctctgaggatctggctatggggctggtaccaggagttccctgtcatgggggtggcatgtctcggacagaggcaaaggacaagggtgggttggctcttgtgggagcctctccagggatgagtcatggagggaggagcagcctggcttctgacagcatcccagactccctgggccaggtgtgtggctcctgtccccctgacgagtccctccctccatcagtgccatctccctcttctacgagctctcggagaatgacttgaacttcatcaagcagagcaaggacggtgccggcttcctcatcaacctcattgactcccccgggcatgtcgacttctcctcggaggtgactgctgccctccgagtcaccgatggcgcattggtg

SEQ ID NO: 445465 - DNA, 3038 bp, Homo sapiens
cgtttgaaacaacaaacactatctcacagtttctgtgggtcaggagtccagacatggcttattgggtaaccgcctcaaagtcttactaggctgtaatacagttattggctagagctgctgtttcatctgaaggttcaattgagagaggatccacttctaagctcactcacatggttgctggcacaattcaattcctctcaggctattggattaagggtctcagttccctactgactgttggtcagtgaactttcctcagttctttgccatatggggatccatagaacagctcactacatggcaactggcttctatcaaagtgagcaataaggaagtaagcaagagaggtttgcaagacaaaagctactatctctttataatctaatctcagaagtagcatcatatcccttctgccatattctgttcattagaagtaaatctctgggtctagccatactctattgcagagatcacacaagggtgtgaatacagacacagggattgttggggctcatcttagaggtcgtctcccatagagttagctgccaatctgaggggtcacagggacccatgcatctgggccagaacactgggatttcatcccttaagcaggacaacattcattcagaaacatatatatatgtttatatgtttctcactaatcaaagagagaagcaaggcctgtccctgacgagctccctttctcagatccgccctgaactgcctaagttaaatccatgtaccttgactaggtgaaccatagagtccaagcctagagttgggtcctgggtttaatcctggttctgtcttagccctatgaccttaggccacttctcttcggcttggttttctttgcatcaggaagtgtcggattagatcccaacaatggttctcaaattggagtgcctgtgaaaatcacctggggtcatttgaaaaattcctgatgcctagcacacccctgacaaattaaatcagaagatctgagggtgagattcaggcaagaggacttcttaacagctccccaagtgatttcattgttcagccaaggttgataactactcatttagaagattggtaatcctaactctggtacatgggaactatctgaggagctttaaaaacaaatacagaagccagaatcttaggacaattaaaatagaaatccctgggggttggtcccagacatggtgtctttcaaagctccccagatgattctaatgtgtagccagatttgtggaccctcaggtttaatgatcttcaagaatcctctatctaaggttctaagcttgtccgaatggacttgtagagctataagcacgtgtaccaccttctcaggaaggtggccgctccaatgctctctgactctaaagaatgaaatgattattcccacccgaacatccatcttctctgggtttaccgtcccctacttacagtccgtaaaaaggtcaccctagacttgacctcagtctcattgtgacacacacagcacgccagcgttcttaacctttttggttacagagacccttttagaaacttcatgaaaattgtaagtcatctcataaggaggatcttacatgcacatcaaattgagcatacaattttcatggatccctaaactcttgatacaaagttaattctatctcactataatataaaagtcaaaaacttacataacccagaaaagcagaatttgcaacatagtagaaatagaccagagtgaaagttctaatcctggttccacaactcaccagtcaacatttaggagtcactgaatcacttgatgcctcagtttactcatatgcccaattaagaattataaaatcatgcaccacataatgtcttggtcaagtacagatcacatatgacgatggtttcataagataatactgtgtttttactgtacctttgtcactgtgtttagatacacaaatacttacattatgttactattgcctatggtattgagtatagtaacctgctgtacagatctatagcctaggagcaataggctataccatacagcataggtgtgtcacaggctctcccaccttggtttgtgtaagtacactctgtgatgtttgcacacaacgaaatcgcctgatgacacaatgctcagaatgtgtctccatcattaagagatacatgactacctaccccatcaatcttgcctattccagaaacaaagtgaaattaataatataaaattggtttgatcaatttatgaattacattgtcattgaaagtaggagaactagaccaggaggcactggtgtgaccctggagtagatggaactgtttgtgcatgtgtctttcttaccttccattctcataaagaattagcacattccccacatacaccctggccagactgtgtctttgggactgcagcactaaggtgtgtttttgtttgttaacttattcccagtgcctgtgttgaccaggaggctttgggaataaaggtacataaaggtcttggagcctgggatgagcctgtggtcaagagatgggcaggcagtgtccttgaatttggaatgtgactcacactctgcctgtaggggaaagaaaagagagatcagactgttactgtgtctatgtagaaagggaagacagaagagactgcattttgaaaaagacctgcactttaaacaattgctttgctgagatgttgttaatttgtagctttgccccagccactttgccccagccactttgacccaacctggagctcacaaaaacatgtgttgtatgaaatcaaggtttaaggaatctagggctgtgcaggacgtgccttgttaacaaaatgtttacaagtagtatacttggtaaaagtcatcgccattctctagtctcaataaaccaggggaacaatgcactgtggaaagccgcagggacctctgcccttgaaagcgggatattgtccaaggtttctccccatgtcatagcctgaaatatgggctcctgggatgagaaagacctgaccgtcccccagcctgacacccttaaagggtctgtgctgaggtggattagtaaaagaggaa

SEQ ID NO: 445466 - DNA, 2984 bp, Homo sapiens
cgtttgaaacaacaaacactatctcacagtttctgtgggtcaggagtccagacatggcttattgggtaaccgcctcaaagtcttactaggctgtaatacagttattggctagagctgctgtttcatctgaaggttcaattgagagaggatccacttctaagctcactcacatggttgctggcacaattcaattcctctcaggctattggattaagggtctcagttccctactgactgttggtcagtgaactttcctcagttctttgccatatggggatccatagaacagctcactacatggcaactggcttctatcaaagtgagcaataaggaagtaagcaagagaggtttgcaagacaaaagctactatctctttataatctaatctcagaagtagcatcatatcccttctgccatattctgttcattagaagtaaatctctgggtctagccatactctattgcagagatcacacaagggtgtgaatacagacacagggattgttggggctcatcttagaggtcgtctcccatagagttagctgccaatctgaggggtcacagggacccatgcatctgggccagaacactgggatttcatcccttaagcaggacaacattcattcagaaacatatatatatgtttatatgtttctcactaatcaaagagagaagcaaggcctgtccctgacgagctccctttctcagatccgccctgaactgcctaagttaaatccatgtaccttgactaggtgaaccatagagtccaagcctagagttgggtcctgggtttaatcctggttctgtcttagccctatgaccttaggccacttctcttcggcttggttttctttgcatcaggaagtgtcggattagatcccaacaatggttctcaaattggagtgcctgtgaaaatcacctggggtcatttgaaaaattcctgatgcctagcacacccctgacaaattaaatcagaagatctgagggtgagattcaggcaagaggacttcttaacagctccccaagtgatttcattgttcagccaaggttgataactactcatttagaagattggtaatcctaactctggtacatgggaactatctgaggagctttaaaaacaaatacagaagccagaatcttaggacaattaaaatagaaatccctgggggttggtcccagacatggtgtctttcaaagctccccagatgattctaatgtgtagccagatttgtggaccctcaggtttaatgatcttcaagaatcctctatctaaggttctaagcttgtccgaatggacttgtagagctataagcacgtgtaccaccttctcaggaaggtggccgctccaatgctctctgactctaaagaatgaaatgattattcccacccgaacatccatcttctctgggtttaccgtcccctacttacagtccgtaaaaaggtcaccctagacttgacctcagtctcattgtgacacacacagcacgccagcgttcttaacctttttggttacagagacccttttagaaacttcatgaaaattgtaagtcatctcataaggaggatcttacatgcacatcaaattgagcatacaattttcatggatccctaaactcttgatacaaagttaattctatctcactataatataaaagtcaaaaacttacataacccagaaaagcagaatttgcaacatagtagaaatagaccagagtgaaagttctaatcctggttccacaactcaccagtcaacatttaggagtcactgaatcacttgatgcctcagtttactcatatgcccaattaagaattataaaatcatgcaccacataatgtcttggtcaagtacagatcacatatgacgatggtttcataagataatactgtgtttttactgtacctttgtcactgtgtttagatacacaaatacttacattatgttactattgcctatggtattgagtatagtaacctgctgtacagatctatagcctaggagcaataggctataccatacagcataggtgtgtcacaggctctcccaccttggtttgtgtaagtacactctgtgatgtttgcacacaacgaaatcgcctgatgacacaatgctcagaatgtgtctccatcattaagagatacatgactacctaccccatcaatcttgcctattccagaaacaaagtgaaattaataatatgaccaggaggcactggtgtgaccctggagtagatggaactgtttgtgcatgtgtctttcttaccttccattctcataaagaattagcacattccccacatacaccctggccagactgtgtctttgggactgcagcactaaggtgtgtttttgtttgttaacttattcccagtgcctgtgttgaccaggaggctttgggaataaaggtacataaaggtcttggagcctgggatgagcctgtggtcaagagatgggcaggcagtgtccttgaatttggaatgtgactcacactctgcctgtaggggaaagaaaagagagatcagactgttactgtgtctatgtagaaagggaagacagaagagactgcattttgaaaaagacctgcactttaaacaattgctttgctgagatgttgttaatttgtagctttgccccagccactttgccccagccactttgacccaacctggagctcacaaaaacatgtgttgtatgaaatcaaggtttaaggaatctagggctgtgcaggacgtgccttgttaacaaaatgtttacaagtagtatacttggtaaaagtcatcgccattctctagtctcaataaaccaggggaacaatgcactgtggaaagccgcagggacctctgcccttgaaagcgggatattgtccaaggtttctccccatgtcatagcctgaaatatgggctcctgggatgagaaagacctgaccgtcccccagcctgacacccttaaagggtctgtgctgaggtggattagtaaaagaggaa

SEQ ID NO: 445467 - DNA, 270 bp, Homo sapiens
  misc_feature (14)..(14): n is a, c, g, or t
  misc_feature (27)..(27): n is a, c, g, or t
  misc_feature (29)..(29): n is a, c, g, or t
gcggcccctactantactaaattcgcngncgctcgactatgagggcagcacctgcctctgaatgggaaatcatgcaactactcagaatgtgtcctcctcatctaatgctcatctgtttaatggtgatgcctcgcgtacaggatctggttacctgtgcagttgtgaatacccagaggttgggcagatcagtgtctctagtcctacccagttttaaagttcatggtaagatttgacctcatctcccgcaaataaatgtattggtgatttgga

SEQ ID NO: 445468 - DNA, 248 bp, Homo sapiens
  misc_feature (25)..(25): n is a, c, g, or t
  misc_feature (51)..(51): n is a, c, g, or t
actccccacctcgcctcaccttccntaggtctgccgggtgacccaatccantgggtgcagccccacccccgctcaacccctaatgctcatctgtttaatggtgatgcctcgcgtacaggatctggttacctgtgcagttgtgaatacccagaggttgggcagatcagtgtctctagtcctacccagttttaaagttcatggtaagatttgacctcatctcccgcaaataaatgtattggtgatttgga

SEQ ID NO: 445469 - DNA, 212 bp, Homo sapiens
actctaggctcccgggtgacgcacgccaagtacatcgtgcaagtggatggtaagatagggctgttccgaggcctgagtccccggctgatgtccaacgccctctctactgtgactcggggtagcatgaagaaggtttctttttcctagtagctgtttttcgtggtggctgacatctgagttaaccagcatctgagtacgtggcgtctgtccga

SEQ ID NO: 445470 - DNA, 1918 bp, Homo sapiens
gatgagccgatgccccccaccctcgccgccgggcgccatgggagcttcggacccggaagtggcgccctgggctcgcggcggtgccgcggggatggcgggagccggagctggagccggagctcgcggcggagcggcggcgggggtcgaggctcgagctcgcgatccaccgcccgcgcaccgcgcacatcctcgccaccctcggcctgcggctcagccctcggcccgcaggatggatggcgggtcagggggcctggggtctggggacaacgccccgaccactgaggctcttttcgtggcactgggcgcgggcgtgacggcgctcagccatcccctgctctacgtgaagctgctcatccaggtgggtcatgagccgatgccccccacccttgggaccaatgtgctggggaggaaggtcctctatctgccgagcttcttcacctacgccaagtacatcgtgcaagtggatggtaagatagggctgttccgaggcctgagtccccggctgatgtccaacgccctctctactgtgactcggggtagcatgaagaaggttttccctccagatgagattgagcaggtttccaacaaggatgatatgaagacttccctgaagaaagttgtgaaggagacctcctacgagatgatgatgcagtgtgtgtcccgcatgttggcccaccccctgcatgtcatctcaatgcgctgcatggtccagtttgtgggacgggaggccaagtacagtggtgtgctgagctccattgggaagattttcaaagaggaagggctgctgggattcttcgttggattaatccctcacctcctgggcgatgtggttttcttgtggggctgtaacctgctggcccacttcatcaatgcctacctggtggatgacagcttcagccaggccctggccatccggagctataccaagttcgtgatggggattgcagtgagcatgctgacctaccccttcctgctagttggcgacctcatggctgtgaacaactgcgggctgcaagctgggctccccccttactccccagtgttcaaatcctggattcactgctggaagtacctgagtgtgcagggccagctcttccgaggctccagcctgcttttccgccgggtgtcatcaggatcatgctttgccctggagtaacctgaatcatctaaaaaacacggtctcaacctggccaccgtgggtgaggcctgaccaccttgggacacctgcaagacgactccaacccaacaacaaccagatgtgctccagcccagccgggcttcagttccatatttgccatgtgtctgtccagatgtggggttgagcgggggtggggctgcacccagtggattgggtcacccggcagacctagggaaggtgaggcgaggtggggagttggcagaatccccatacctcgcagatttgctgagtctgtcttgtgcagagggccagagaatggcttatgggggcccaggttggatggggaaaggctaatggggtcagaccccaccccgtctacccctccagtcagcccagcgcccatcctgcagctcagctgggagcatcattctcctgctttgtacatagggtgtggtcccctggcacgtggccaccatcatgtctaggcctatgctaggaggcaaatggccaggctctgcctgtgtttttctcaacactacttttctgatatgagggcagcacctgcctctgaatgggaaatcatgcaactactcagaatgtgtcctcctcatctaatgctcatctgtttaatggtgatgcctcgcgtacaggatctggttacctgtgcagttgtgaatacccagaggttgggcagatcagtgtctctagtcctacccagttttaaagttcatggtaagatttgacctcatctcccgcaaataaatgtattggtgatttgga

SEQ ID NO: 445471 - DNA, 2293 bp, Homo sapiens
  misc_feature (1942)..(1943): n is a, c, g, or t
  misc_feature (1951)..(1951): n is a, c, g, or t
gggggcgtggcccggtcgcgtgacggggagtgacctcgccgccgggcgccatgggagcttcggacccggaagtggcgccctgggctcgcggcggtgccgcggggatggcgggagccggagctggagccggagctcgcggcggagcggcggcgggggtcgaggctcgagctcgcgatccaccgcccgcgcaccgcgcacatcctcgccaccctcggcctgcggctcagccctcggcccgcaggatggatggcgggtcagggggcctggggtctggggacaacgccccgaccactgaggctcttttcgtggcactgggcgcgggcgtgacggcgctcagccatcccctgctctacgtgaagctgctcatccaggtgggtcatgagccgatgccccccacccttgggaccaatgtgctggggaggaaggtcctctatctgccgagcttcttcacctacgccaagtacatcgtgcaagtggatggtaagatagggctgttccgaggcctgagtccccggctgatgtccaacgccctctctactgtgactcggggtagcatgaagaaggttttccctccagatgagattgagcaggtttccaacaaggatgatatgaagacttccctgaagaaagttgtgaaggagacctcctacgagatgatgatgcagtgtgtgtcccgcatgttggcccaccccctgcatgtcatctcaatgcgctgcatggtccagtttgtgggacgggaggccaagtacagtggtgtgctgagctccattgggaagattttcaaagaggaagggctgctgggattcttcgttggattaatccctcacctcctgggcgatgtggttttcttgtggggctgtaacctgctggcccacttcatcaatgcctacctggtggatgacagcttcagccaggccctggccatccggagctataccaagttcgtgatggggattgcagtgagcatgctgacctaccccttcctgctagttggcgacctcatggctgtgaacaactgcgggctgcaagctgggctccccccttactccccagtgttcaaatcctggattcactgctggaagtacctgagtgtgcagggccagctcttccgaggctccagcctgcttttccgccgggtgtcatcaggatcatgctttgccctggagtaacctgaatcatctaaaaaacacggtctcaacctggccaccgtgggtgaggcctgaccaccttgggacacctgcaagacgactccaacccaacaacaaccagatgtgctccagcccagccgggcttcagttccatatttgccatgtgtctgtccagatgtggggttgagcgggggtggggctgcacccagtggattgggtcacccggcagacctagggaaggtgaggcgaggtggggagttggcagaatccccatacctcgcagatttgctgagtctgtcttgtgcagagggccagagaatggcttatgggggcccaggttggatggggaaaggctaatggggtcagaccccaccccgtctacccctccagtcagcccagcgcccatcctgcagctcagctgggagcatcattctcctgctttgtacatagggtgtggtcccctggcacgtggccaccatcatgtctaggcctatgctaggaggcaaatggccaggctctgcctgtgtttttctcaacactacttttctgatatgagggcagcacctgcctctgaatgggaaatcatgcaactactcagaatgtgtcctcctcatctaatgctcatctgtttaatggtgatgcctcgcgtacaggatctggttacctgtgcagttgtgaatacccagaggttgggcagatcagtgtctctagtcctacccagttttaaagttcatggtaagatttgacctcatctcccgcaaataaatgtattggtgatttggaaaaaaaaacanncaacaaanaaacaatacaaaaaaacaaaaaaaaaaaaaaaacagcacacacaaacaaaatcaatagaattggggggcgcgctcgctaacaaggtcatctcccctgtggagggcccacggacgtaattgaggcgcgacccgcgcgtttgtcctgtcagaagaggacggtgcccaaatggtcggtgcggcttattacaatgaggaggcacgagtgcgggaccgtgtagtctaaccacgtcgcctgagcagtggtgaaacacgtcgctgacggagggggacgaattttggggggacgcgcacccacattgtgcgttgcgtggcccaccatgtgttgccgagccatactcagca

SEQ ID NO: 445472 - DNA, 1869 bp, Homo sapiens
  misc_feature (16)..(16): n is a, c, g, or t
  misc_feature (19)..(19): n is a, c, g, or t
  misc_feature (21)..(21): n is a, c, g, or t
  misc_feature (25)..(26): n is a, c, g, or t
atgcaggctggtacgnccngnagtnntggaggtgccgcggggatggcgggagccggagctggagccggagctcgcggcggagcggcggcgggggtcgaggctcgagctcgcgatccaccgcccgcgcaccgcgcacatcctcgccaccctcggcctgcggctcagccctcggcccgcaggatggatggcgggtcagggggcctggggtctggggacaacgccccgaccactgaggctcttttcgtggcactgggcgcgggcgtgacggcgctcagccatcccctgctctacgtgaagctgctcatccaggtgggtcatgagccgatgccccccacccttgggaccaatgtgctggggaggaaggtcctctatctgccgagcttcttcacctacgccaagtacatcgtgcaagtggatggtaagatagggctgttccgaggcctgagtccccggctgatgtccaacgccctctctactgtgactcggggtagcatgaagaaggttttccctccagatgagattgagcaggtttccaacaaggatgatatgaagacttccctgaagaaagttgtgaaggagacctcctacgagatgatgatgcagtgtgtgtcccgcatgttggcccaccccctgcatgtcatctcaatgcgctgcatggtccagtttgtgggacgggaggccaagtacagtggtgtgctgagctccattgggaagattttcaaagaggaagggctgctgggattcttcgttggattaatccctcacctcctgggcgatgtggttttcttgtggggctgtaacctgctggcccacttcatcaatgcctacctggtggatgacagcttcagccaggccctggccatccggagctataccaagttcgtgatggggattgcagtgagcatgctgacctaccccttcctgctagttggcgacctcatggctgtgaacaactgcgggctgcaagctgggctccccccttactccccagtgttcaaatcctggattcactgctggaagtacctgagtgtgcagggccagctcttccgaggctccagcctgcttttccgccgggtgtcatcaggatcatgctttgccctggagtaacctgaatcatctaaaaaacacggtctcaacctggccaccgtgggtgaggcctgaccaccttgggacacctgcaagacgactccaacccaacaacaaccagatgtgctccagcccagccgggcttcagttccatatttgccatgtgtctgtccagatgtggggttgagcgggggtggggctgcacccagtggattgggtcacccggcagacctagggaaggtgaggcgaggtggggagttggcagaatccccatacctcgcagatttgctgagtctgtcttgtgcagagggccagagaatggcttatgggggcccaggttggatggggaaaggctaatggggtcagaccccaccccgtctacccctccagtcagcccagcgcccatcctgcagctcagctgggagcatcattctcctgctttgtacatagggtgtggtcccctggcacgtggccaccatcatgtctaggcctatgctaggaggcaaatggccaggctctgcctgtgtttttctcaacactacttttctgatatgagggcagcacctgcctctgaatgggaaatcatgcaactactcagaatgtgtcctcctcatctaatgctcatctgtttaatggtgatgcctcgcgtacaggatctggttacctgtgcagttgtgaatacccagaggttgggcagatcagtgtctctagtcctacccagttttaaagttcatggtaagatttgacctcatctcccgcaaataaatgtattggtgatttgga

SEQ ID NO: 445473 - DNA, 2031 bp, Homo sapiens
  misc_feature (1956)..(1956): n is a, c, g, or t
gggggcgtggcccggtcgcgtgacggggagtgacctcgccgccgggcgccatgggagcttcggacccggaagtggcgccctgggctcgcggcggtgccgcggggatggcgggagccggagctggagccggagctcgcggcggagcggcggcgggggtcgaggctcgagctcgcgatccaccgcccgcgcaccgcgcacatcctcgccaccctcggcctgcggctcagccctcggcccgcaggatggatggcgggtcagggggcctggggtctggggacaacgccccgaccactgaggctcttttcgtggcactgggcgcgggcgtgacggcgctcagccatcccctgctctacgtgaagctgctcatccaggtgggtcatgagccgatgccccccacccttgggaccaatgtgctggggaggaaggtcctctatctgccgagcttcttcacctacgccaagtacatcgtgcaagtggatggtaagatagggctgttccgaggcctgagtccccggctgatgtccaacgccctctctactgtgactcggggtagcatgaagaaggttttccctccagatgagattgagcaggtttccaacaaggatgatatgaagacttccctgaagaaagttgtgaaggagacctcctacgagatgatgatgcagtgtgtgtcccgcatgttggcccaccccctgcatgtcatctcaatgcgctgcatggtccagtttgtgggacgggaggccaagtacagtggtgtgctgagctccattgggaagattttcaaagaggaagggctgctgggattcttcgttggattaatccctcacctcctgggcgatgtggttttcttgtggggctgtaacctgctggcccacttcatcaatgcctacctggtggatgacagcttcagccaggccctggccatccggagctataccaagttcgtgatggggattgcagtgagcatgctgacctaccccttcctgctagttggcgacctcatggctgtgaacaactgcgggctgcaagctgggctccccccttactccccagtgttcaaatcctggattcactgctggaagtacctgagtgtgcagggccagctcttccgaggctccagcctgcttttccgccgggtgtcatcaggatcatgctttgccctggagtaacctgaatcatctaaaaaacacggtctcaacctggccaccgtgggtgaggcctgaccaccttgggacacctgcaagacgactccaacccaacaacaaccagatgtgctccagcccagccgggcttcagttccatatttgccatgtgtctgtccagatgtggggttgagcgggggtggggctgcacccagtggattgggtcacccggcagacctagggaaggtgaggcgaggtggggagttggcagaatccccatacctcgcagatttgctgagtctgtcttgtgcagagggccagagaatggcttatgggggcccaggttggatggggaaaggctaatggggtcagaccccaccccgtctacccctccagtcagcccagcgcccatcctgcagctcagctgggagcatcattctcctgctttgtacatagggtgtggtcccctggcacgtggccaccatcatgtctaggcctatgctaggaggcaaatggccaggctctgcctgtgtttttctcaacactacttttctgatatgagggcagcacctgcctctgaatgggaaatcatgcaactactcagaatgtgtcctcctcatctaatgctcatctgtttaatggtgatgcctcgcgtacaggatctggttacctgtgcagttgtgaatacccagaggttgggcagatcagtgtctctagtcctacccagttttaaagttcatggtaagatttgacctcatctcccgcaaataaatgtattggtgatttggaaaacaaaaaacacataaacatcctnattaattacatacaccccctccctcctctttggaaaaaaaaaaaataatttatataattcctttgtcgcccgctg

SEQ ID NO: 445474 - DNA, 2135 bp, Homo sapiens
gggggcgtggcccggtcgcgtgacggggagtgacctcgccgccgggcgccatgggagcttcggacccggaagtggcgccctgggctcgcggcggtgccgcggggatggcgggagccggagctggagccggagctcgcggcggagcggcggcgggggtcgaggctcgagctcgcgatccaccgcccgcgcaccgcgcacatcctcgccaccctcggcctgcggctcagccctcggcccgcaggatggatggcgggtcagggggcctggggtctggggacaacgccccgaccactgaggctcttttcgtggcactgggcgcgggcgtgacggcgctcagccatcccctgctctacgtgaagctgctcatccaggtgggtcatgagccgatgccccccacccttgggaccaatgtgctggggaggaaggtcctctatctgccgagcttcttcacctacgccaagtacatcgtgcaagtggatggtaagatagggctgttccgaggcctgagtccccggctgatgtccaacgccctctctactgtgactcggggtagcatgaagaaggttttccctccagatgagattgagcaggtttccaacaaggatgatatgaagacttccctgaagaaagttgtgaaggagacctcctacgagatgatgatgcagtgtgtgtcccgcatgttggcccaccccctgcatgtcatctcaatgcgctgcatggtccagtttgtgggacgggaggccaagtacagtggtgtgctgagctccattgggaagattttcaaagaggaagggctgctgggattcttcgttggattaatccctcacctcctgggcgatgtggttttcttgtggggctgtaacctgctggcccacttcatcaatgcctacctggtggatgacagcttcagccaggccctggccatccggagctataccaagttcgtgatggggattgcagtgagcatgctgacctaccccttcctgctagttggcgacctcatggctgtgaacaactgcgggctgcaagctgggctccccccttactccccagtgttcaaatcctggattcactgctggaagtacctgagtgtgcagggccagctcttccgaggctccagcctgcttttccgccgggtgtcatcaggatcatgctttgccctggagtaacctgaatcatctaaaaaacacggtctcaacctggccaccgtgggtgaggcctgaccaccttgggacacctgcaagacgactccaacccaacaacaaccagatgtgctccagcccagccgggcttcagttccatatttgccatgtgtctgtccagatgtggggttgagcgggggtggggctgcacccagtggattgggtcacccggcagacctagggaaggtgaggcgaggtggggagttggcagaatccccatacctcgcagatttgctgagtctgtcttgtgcagagggccagagaatggcttatgggggcccaggttggatggggaaaggctaatggggtcagaccccaccccgtctacccctccagtcagcccagcgcccatcctgcagctcagctgggagcatcattctcctgctttgtacatagggtgtggtcccctggcacgtggccaccatcatgtctaggcctatgctaggaggcaaatggccaggctctgcctgtgtttttctcaacactacttttctgatatgagggcagcacctgcctctgaatgggaaatcatgcaactactcagaatgtgtcctcctcatctaatgctcatctgtttaatggtgatgcctcgcgtacaggatctggttacctgtgcagttgtgaatacccagaggttgggcagatcagtgtctctagtcctacccagttttaaagttcatggtaagatttgacctcatctcccgcaaataaatgtattggtgatttggaaagtaacatgtacttggtgaagtttgggaaagaaccaatgacaatcaaaatatgtctcaaaaatatatttcatactcgggaggatcccaaaagggggaaatggaacaggggatttcccggtagtgactataacggggacatgttttatgaaatggttttgggaaaccacctgaaggatctcggcgaaatgtaacgggagtagaa

SEQ ID NO: 445475 - DNA, 3046 bp, Homo sapiens
gggggcgtggcccggtcgcgtgacggggagtgacctcgccgccgggcgccatgggagcttcggacccggaagtggcgccctgggctcgcggcggtgccgcggggatggcgggagccggagctggagccggagctcgcggcggagcggcggcgggggtcgaggctcgagctcgcgatccaccgcccgcgcaccgcgcacatcctcgccaccctcggcctgcggctcagccctcggcccgcaggatggatggcgggtcagggggcctggggtctggggacaacgccccgaccactgaggctcttttcgtggcactgggcgcgggcgtgacggcgctcagccatcccctgctctacgtgaagctgctcatccaggtgggtcatgagccgatgccccccacccttgggaccaatgtgctggggaggaaggtcctctatctgccgagcttcttcacctacgccaagtacatcgtgcaagtggatggtaagatagggctgttccgaggcctgagtccccggctgatgtccaacgccctctctactgtgactcggggtagcatgaagaaggttttccctccagatgagattgagcaggtttccaacaaggatgatatgaagacttccctgaagaaagttgtgaaggagacctcctacgagatgatgatgcagtgtgtgtcccgcatgttggcccaccccctgcatgtcatctcaatgcgctgcatggtccagtttgtgggacgggaggccaagtacagtggtgtgctgagctccattgggaagattttcaaagaggaagggctgctgggattcttcgttggattaatccctcacctcctgggcgatgtggttttcttgtggggctgtaacctgctggcccacttcatcaatgcctacctggtggatgacagcgtgagtgacaccccaggggggctgggaaacgaccagaatccaggttcccagttcagccaggccctggccatccggagctataccaagttcgtgatggggattgcagtgagcatgctgacctaccccttcctgctagttggcgacctcatggctgtgaacaactgcgggctgcaagctgggctccccccttactccccagtgttcaaatcctggattcactgctggaagtacctgagtgtgcaggtgagcaagcactggacggcggaggcctttcctgttctttgctacatccttcagctgaaatggttttgtggatgcttcattgcatgcaaagataagtggtttcatggaattcaatattgtgaggagatacttggtatctataaggcatttaagttttcatcttacataatttcagaaaggatttgaggtggctaagtgtgggtttattttaagattatacatcagacaagaccttttcttctttgagtcttaaagactcttaggataaggataagagaactctggcccaggtggcaggtggtaaagcccaagaactgcttctccttcaagtaacatgggctgaaaattcgaggtctgtaaccagttgagctgagttcctgggttgttagggcggctggcattggaaaccgactcctccctcctgcaggacattcctgggcccaggagagcctgtgggtggggctgggccacgtggggaactggcagcagtaccaaccttgggttctcgtgttctgtaccgaagctacctctccgtagctggagctcttgggcccagcagtcaggggtccaggctttggccgagggcagaaccttgccttttcctggccttgatttgcctcgcagtgaaatggggcagtggcccggagggagccagaactctgagtggcctcgaggctgagaagaggacagatgggagggaagcagggaggagagccgcagttcttcccagtggccctggtcagcgtgagtgtgtctcgtcctccctatgagcactgaaagagtcctagaccacttgggctctgaagcaagaggggcaatgagcctcctctctagggctctcctacagagtagccccaaagacacccctgggcaggaaatgaaccgctcccttctgcttcaacacaggcagattctgccctccagggatgtaggccgaggccgtccaccccggagctgggtctttgagctcctggacccttctttgcctgacactggccttcctctcggagggacaaggaagcgtggcctccctttcactcaccttacttttccttctggtccagggccagctcttccgaggctccagcctgcttttccgccgggtgtcatcaggatcatgctttgccctggagtaacctgaatcatctaaaaaacacggtctcaacctggccaccgtgggtgaggcctgaccaccttgggacacctgcaagacgactccaacccaacaacaaccagatgtgctccagcccagccgggcttcagttccatatttgccatgtgtctgtccagatgtggggttgagcgggggtggggctgcacccagtggattgggtcacccggcagacctagggaaggtgaggcgaggtggggagttggcagaatccccatacctcgcagatttgctgagtctgtcttgtgcagagggccagagaatggcttatgggggcccaggttggatggggaaaggctaatggggtcagaccccaccccgtctacccctccagtcagcccagcgcccatcctgcagctcagctgggagcatcattctcctgctttgtacatagggtgtggtcccctggcacgtggccaccatcatgtctaggcctatgctaggaggcaaatggccaggctctgcctgtgtttttctcaacactacttttctgatatgagggcagcacctgcctctgaatgggaaatcatgcaactactcagaatgtgtcctcctcatctaatgctcatctgtttaatggtgatgcctcgcgtacaggatctggttacctgtgcagttgtgaatacccagaggttgggcagatcagtgtctctagtcctacccagttttaaagttcatggtaagatttgacctcatctcccgcaaataaatgtattggtgatttgga

SEQ ID NO: 445476 - DNA, 1928 bp, Homo sapiens
gggggcgtggcccggtcgcgtgacggggagtgacctcgccgccgggcgccatgggagcttcggacccggaagtggcgccctgggctcgcggcggtgccgcggggatggcgggagccggagctggagccggagctcgcggcggagcggcggcgggggtcgaggctcgagctcgcgatccaccgcccgcgcaccgcgcacatcctcgccaccctcggcctgcggctcagccctcggcccgcaggatggatggcgggtcagggggcctggggtctggggacaacgccccgaccactgaggctcttttcgtggcactgggcgcgggcgtgacggcgctcagccatcccctgctctacgtgaagctgctcatccaggtgggtcatgagccgatgccccccacccttgggaccaatgtgctggggaggaaggtcctctatctgccgagcttcttcacctacgccaagtacatcgtgcaagtggatggtaagatagggctgttccgaggcctgagtccccggctgatgtccaacgccctctctactgtgactcggggtagcatgaagaaggttttccctccagatgagattgagcaggtttccaacaaggatgatatgaagacttccctgaagaaagttgtgaaggagacctcctacgagatgatgatgcagtgtgtgtcccgcatgttggcccaccccctgcatgtcatctcaatgcgctgcatggtccagtttgtgggacgggaggccaagtacagtggtgtgctgagctccattgggaagattttcaaagaggaagggctgctgggattcttcgttggattaatccctcacctcctgggcgatgtggttttcttgtggggctgtaacctgctggcccacttcatcaatgcctacctggtggatgacagcgtgagtgacaccccaggggggctgggaaacgaccagaatccaggttcccagttcagccaggccctggccatccggagctataccaagttcgtgatggggattgcagtgagcatgctgacctaccccttcctgctagttggcgacctcatggctgtgaacaactgcgggctgcaagctgggctccccccttactccccagtgttcaaatcctggattcactgctggaagtacctgagtgtgcagggccagctcttccgaggctccagcctgcttttccgccgggtgtcatcaggatcatgctttgccctggagtaacctgaatcatctaactgcaagacgactccaacccaacaacaaccagatgtgctccagcccagccgggcttcagttccatatttgccatgtgtctgtccagatgtggggttgagcgggggtggggctgcacccagtggattgggtcacccggcagacctagggaaggtgaggcgaggtggggagttggcagaatccccatacctcgcagatttgctgagtctgtcttgtgcagagggccagagaatggcttatgggggcccaggttggatggggaaaggctaatggggtcagaccccaccccgtctacccctccagtcagcccagcgcccatcctgcagctcagctgggagcatcattctcctgctttgtacatagggtgtggtcccctggcacgtggccaccatcatgtctaggcctatgctaggaggcaaatggccaggctctgcctgtgtttttctcaacactacttttctgatatgagggcagcacctgcctctgaatgggaaatcatgcaactactcagaatgtgtcctcctcatctaatgctcatctgtttaatggtgatgcctcgcgtacaggatctggttacctgtgcagttgtgaatacccagaggttgggcagatcagtgtctctagtcctacccagttttaaagttcatggtaagatttgacctcatctcccgcaaataaatgtattggtgatttgga

SEQ ID NO: 445477 - DNA, 2032 bp, Homo sapiens
gggggcgtggcccggtcgcgtgacggggagtgacctcgccgccgggcgccatgggagcttcggacccggaagtggcgccctgggctcgcggcggtgccgcggggatggcgggagccggagctggagccggagctcgcggcggagcggcggcgggggtcgaggctcgagctcgcgatccaccgcccgcgcaccgcgcacatcctcgccaccctcggcctgcggctcagccctcggcccgcaggatggatggcgggtcagggggcctggggtctggggacaacgccccgaccactgaggctcttttcgtggcactgggcgcgggcgtgacggcgctcagccatcccctgctctacgtgaagctgctcatccaggtgggtcatgagccgatgccccccacccttgggaccaatgtgctggggaggaaggtcctctatctgccgagcttcttcacctacgccaagtacatcgtgcaagtggatggtaagatagggctgttccgaggcctgagtccccggctgatgtccaacgccctctctactgtgactcggggtagcatgaagaaggttttccctccagatgagattgagcaggtttccaacaaggatgatatgaagacttccctgaagaaagttgtgaaggagacctcctacgagatgatgatgcagtgtgtgtcccgcatgttggcccaccccctgcatgtcatctcaatgcgctgcatggtccagtttgtgggacgggaggccaagtacagctgtcctgcggggccaccatcccaggaagctcagctgccatggtgcctcattttggggtcattaatgggaaattggcccattcccctagactgattatgagtggtgtgctgagctccattgggaagattttcaaagaggaagggctgctgggattcttcgttggattaatccctcacctcctgggcgatgtggttttcttgtggggctgtaacctgctggcccacttcatcaatgcctacctggtggatgacagcttcagccaggccctggccatccggagctataccaagttcgtgatggggattgcagtgagcatgctgacctaccccttcctgctagttggcgacctcatggctgtgaacaactgcgggctgcaagctgggctccccccttactccccagtgttcaaatcctggattcactgctggaagtacctgagtgtgcagggccagctcttccgaggctccagcctgcttttccgccgggtgtcatcaggatcatgctttgccctggagtaacctgaatcatctaaaaaacacggtctcaacctggccaccgtgggtgaggcctgaccaccttgggacacctgcaagacgactccaacccaacaacaaccagatgtgctccagcccagccgggcttcagttccatatttgccatgtgtctgtccagatgtggggttgagcgggggtggggctgcacccagtggattgggtcacccggcagacctagggaaggtgaggcgaggtggggagttggcagaatccccatacctcgcagatttgctgagtctgtcttgtgcagagggccagagaatggcttatgggggcccaggttggatggggaaaggctaatggggtcagaccccaccccgtctacccctccagtcagcccagcgcccatcctgcagctcagctgggagcatcattctcctgctttgtacatagggtgtggtcccctggcacgtggccaccatcatgtctaggcctatgctaggaggcaaatggccaggctctgcctgtgtttttctcaacactacttttctgatatgagggcagcacctgcctctgaatgggaaatcatgcaactactcagaatgtgtcctcctcatctaatgctcatctgtttaatggtgatgcctcgcgtacaggatctggttacctgtgcagttgtgaatacccagaggttgggcagatcagtgtctctagtcctacccagttttaaagttcatggtaagatttgacctcatctcccgcaaataaatgtattggtgatttgga

SEQ ID NO: 445478 - DNA, 1833 bp, Homo sapiens
gatgagccgatgccccccaccctcgccgccgggcgccatgggagcttcggacccggaagtggcgccctgggctcgcggcggtgccgcggggatggcgggagccggagctggagccggagctcgcggcggagcggcggcgggggtcgaggctcgagctcgcgatccaccgcccgcgcaccgcgcacatcctcgccaccctcggcctgcggctcagccctcggcccgcaggatggatggcgggtcagggggcctggggtctggggacaacgccccgaccactgaggctcttttcgtggcactgggcgcgggcgtgacggcgctcagccatcccctgctctacgtgaagctgctcatccagccaagtacatcgtgcaagtggatggtaagatagggctgttccgaggcctgagtccccggctgatgtccaacgccctctctactgtgactcggggtagcatgaagaaggttttccctccagatgagattgagcaggtttccaacaaggatgatatgaagacttccctgaagaaagttgtgaaggagacctcctacgagatgatgatgcagtgtgtgtcccgcatgttggcccaccccctgcatgtcatctcaatgcgctgcatggtccagtttgtgggacgggaggccaagtacagtggtgtgctgagctccattgggaagattttcaaagaggaagggctgctgggattcttcgttggattaatccctcacctcctgggcgatgtggttttcttgtggggctgtaacctgctggcccacttcatcaatgcctacctggtggatgacagcttcagccaggccctggccatccggagctataccaagttcgtgatggggattgcagtgagcatgctgacctaccccttcctgctagttggcgacctcatggctgtgaacaactgcgggctgcaagctgggctccccccttactccccagtgttcaaatcctggattcactgctggaagtacctgagtgtgcagggccagctcttccgaggctccagcctgcttttccgccgggtgtcatcaggatcatgctttgccctggagtaacctgaatcatctaaaaaacacggtctcaacctggccaccgtgggtgaggcctgaccaccttgggacacctgcaagacgactccaacccaacaacaaccagatgtgctccagcccagccgggcttcagttccatatttgccatgtgtctgtccagatgtggggttgagcgggggtggggctgcacccagtggattgggtcacccggcagacctagggaaggtgaggcgaggtggggagttggcagaatccccatacctcgcagatttgctgagtctgtcttgtgcagagggccagagaatggcttatgggggcccaggttggatggggaaaggctaatggggtcagaccccaccccgtctacccctccagtcagcccagcgcccatcctgcagctcagctgggagcatcattctcctgctttgtacatagggtgtggtcccctggcacgtggccaccatcatgtctaggcctatgctaggaggcaaatggccaggctctgcctgtgtttttctcaacactacttttctgatatgagggcagcacctgcctctgaatgggaaatcatgcaactactcagaatgtgtcctcctcatctaatgctcatctgtttaatggtgatgcctcgcgtacaggatctggttacctgtgcagttgtgaatacccagaggttgggcagatcagtgtctctagtcctacccagttttaaagttcatggtaagatttgacctcatctcccgcaaataaatgtattggtgatttgga

SEQ ID NO: 445479 - DNA, 1459 bp, Homo sapiens
atagtaatagctgcgatgatccgaggtctgagatcctcggcctgagtcgaccaaagtggccgtcattgtaactcggggtagcatgaagaaggttttccctccagatgagattgagcaggtttccaacaaggatgatatgaagacttccctgaagaaagttgtgaaggagacctcctacgagatgatgatgcagtgtgtgtcccgcatgttggcccaccccctgcatgtcatctcaatgcgctgcatggtccagtttgtgggacgggaggccaagtacagtggtgtgctgagctccattgggaagattttcaaagaggaagggctgctgggattcttcgttggattaatccctcacctcctgggcgatgtggttttcttgtggggctgtaacctgctggcccacttcatcaatgcctacctggtggatgacagcttcagccaggccctggccatccggagctataccaagttcgtgatggggattgcagtgagcatgctgacctaccccttcctgctagttggcgacctcatggctgtgaacaactgcgggctgcaagctgggctccccccttactccccagtgttcaaatcctggattcactgctggaagtacctgagtgtgcagggccagctcttccgaggctccagcctgcttttccgccgggtgtcatcaggatcatgctttgccctggagtaacctgaatcatctaaaaaacacggtctcaacctggccaccgtgggtgaggcctgaccaccttgggacacctgcaagacgactccaacccaacaacaaccagatgtgctccagcccagccgggcttcagttccatatttgccatgtgtctgtccagatgtggggttgagcgggggtggggctgcacccagtggattgggtcacccggcagacctagggaaggtgaggcgaggtggggagttggcagaatccccatacctcgcagatttgctgagtctgtcttgtgcagagggccagagaatggcttatgggggcccaggttggatggggaaaggctaatggggtcagaccccaccccgtctacccctccagtcagcccagcgcccatcctgcagctcagctgggagcatcattctcctgctttgtacatagggtgtggtcccctggcacgtggccaccatcatgtctaggcctatgctaggaggcaaatggccaggctctgcctgtgtttttctcaacactacttttctgatatgagggcagcacctgcctctgaatgggaaatcatgcaactactcagaatgtgtcctcctcatctaatgctcatctgtttaatggtgatgcctcgcgtacaggatctggttacctgtgcagttgtgaatacccagaggttgggcagatcagtgtctctagtcctacccagttttaaagttcatggtaagatttgacctcatctcccgcaaataaatgtattggtgatttgga

SEQ ID NO: 445480 - DNA, 1215 bp, Homo sapiens
ggctaggtaagaaggccctgtgtatcggccgaggctggtgtgctgagctccattgggaagattttcaaagaggaagggctgctgggattcttcgttggattaatccctcacctcctgggcgatgtggttttcttgtggggctgtaacctgctggcccacttcatcaatgcctacctggtggatgacagcttcagccaggccctggccatccggagctataccaagttcgtgatggggattgcagtgagcatgctgacctaccccttcctgctagttggcgacctcatggctgtgaacaactgcgggctgcaagctgggctccccccttactccccagtgttcaaatcctggattcactgctggaagtacctgagtgtgcagggccagctcttccgaggctccagcctgcttttccgccgggtgtcatcaggatcatgctttgccctggagtaacctgaatcatctaaaaaacacggtctcaacctggccaccgtgggtgaggcctgaccaccttgggacacctgcaagacgactccaacccaacaacaaccagatgtgctccagcccagccgggcttcagttccatatttgccatgtgtctgtccagatgtggggttgagcgggggtggggctgcacccagtggattgggtcacccggcagacctagggaaggtgaggcgaggtggggagttggcagaatccccatacctcgcagatttgctgagtctgtcttgtgcagagggccagagaatggcttatgggggcccaggttggatggggaaaggctaatggggtcagaccccaccccgtctacccctccagtcagcccagcgcccatcctgcagctcagctgggagcatcattctcctgctttgtacatagggtgtggtcccctggcacgtggccaccatcatgtctaggcctatgctaggaggcaaatggccaggctctgcctgtgtttttctcaacactacttttctgatatgagggcagcacctgcctctgaatgggaaatcatgcaactactcagaatgtgtcctcctcatctaatgctcatctgtttaatggtgatgcctcgcgtacaggatctggttacctgtgcagttgtgaatacccagaggttgggcagatcagtgtctctagtcctacccagttttaaagttcatggtaagatttgacctcatctcccgcaaataaatgtattggtgatttgga

SEQ ID NO: 445481 - DNA, 1489 bp, Homo sapiens
gggggcgtggcccggtcgcgtgacggggagtgacctcgccgccgggcgccatgggagcttcggacccggaagtggcgccctgggctcgcggcggtgccgcggggatggcgggagccggagctggagccggagctcgcggcggagcggcggcgggggtcgaggctcgagctcgcgatccaccgcccgcgcaccgcgcacatcctcgccaccctcggcctgcggctcagccctcggcccgcaggatggatggcgggtcagggggcctggggtctggggacaacgccccgaccactgaggctcttttcgtggcactgggcgcgggcgtgacggcgctcagccatcccctgctctacgtgaagctgctcatccaggtgggtcatgagccgatgccccccacccttgggaccaatgtgctggggaggaaggtcctctatctgccgagcttcttcacctacgccaagtacatcgtgcaagtggatggtaagatagggctgttccgaggcctgagtccccggctgatgtccaacgccctctctactgtgactcggggtagcatgaagaaggttttccctccagatgagattgagcaggtttccaacaaggatgatatgaagacttccctgaagaaagttgtgaaggagacctcctacgagatgatgatgcagtgtgtgtcccgcatgttggcccaccccctgcatgtcatctcaatgcgctgcatggtccagtttgtgggacgggaggccaagtacagtggtgtgctgagctccattgggaagattttcaaagaggaagggctgctgggattcttcgttggattaatccctcacctcctgggcgatgtggttttcttgtggggctgtaacctgctggcccacttcatcaatgcctacctggtggatgacagcgtgagtgacaccccaggggggctgggaaacgaccagaatccaggttcccagttcagccaggccctggccatccggagctataccaagttcgtgatggggattgcagtgagcatgctgacctaccccttcctgctagttggcgacctcatggctgtgaacaactgcgggctgcaagctgggctccccccttactccccagtcgcccatcctgcagctcagctgggagcatcattctcctgctttgtacatagggtgtggtcccctggcacgtggccaccatcatgtctaggcctatgctaggaggcaaatggccaggctctgcctgtgtttttctcaacactacttttctgatatgagggcagcacctgcctctgaatgggaaatcatgcaactactcagaatgtgtcctcctcatctaatgctcatctgtttaatggtgatgcctcgcgtacaggatctggttacctgtgcagttgtgaatacccagaggttgggcagatcagtgtctctagtcctacccagttttaaagttcatggtaagatttgacctcatctcccgcaaataaatgtattggtgatttgga

SEQ ID NO: 445482 - DNA, 1114 bp, Homo sapiens
cgtgtatataattctaagtttggaaaccaatcccctttggtatgtggtaaatattttcttcatcaatgcctacctggtggatgacagcttcagccaggccctggccatccggagctataccaagttcgtgatggggattgcagtgagcatgctgacctaccccttcctgctagttggcgacctcatggctgtgaacaactgcgggctgcaagctgggctccccccttactccccagtgttcaaatcctggattcactgctggaagtacctgagtgtgcagggccagctcttccgaggctccagcctgcttttccgccgggtgtcatcaggatcatgctttgccctggagtaacctgaatcatctaaaaaacacggtctcaacctggccaccgtgggtgaggcctgaccaccttgggacacctgcaagacgactccaacccaacaacaaccagatgtgctccagcccagccgggcttcagttccatatttgccatgtgtctgtccagatgtggggttgagcgggggtggggctgcacccagtggattgggtcacccggcagacctagggaaggtgaggcgaggtggggagttggcagaatccccatacctcgcagatttgctgagtctgtcttgtgcagagggccagagaatggcttatgggggcccaggttggatggggaaaggctaatggggtcagaccccaccccgtctacccctccagtcagcccagcgcccatcctgcagctcagctgggagcatcattctcctgctttgtacatagggtgtggtcccctggcacgtggccaccatcatgtctaggcctatgctaggaggcaaatggccaggctctgcctgtgtttttctcaacactacttttctgatatgagggcagcacctgcctctgaatgggaaatcatgcaactactcagaatgtgtcctcctcatctaatgctcatctgtttaatggtgatgcctcgcgtacaggatctggttacctgtgcagttgtgaatacccagaggttgggcagatcagtgtctctagtcctacccagttttaaagttcatggtaagatttgacctcatctcccgcaaataaatgtattggtgatttgga

SEQ ID NO: 445483 - DNA, 1218 bp, Homo sapiens
gggggcgtggcccggtcgcgtgacggggagtgacctcgccgccgggcgccatgggagcttcggacccggaagtggcgccctgggctcgcggcggtgccgcggggatggcgggagccggagctggagccggagctcgcggcggagcggcggcgggggtcgaggctcgagctcgcgatccaccgcccgcgcaccgcgcacatcctcgccaccctcggcctgcggctcagccctcggcccgcaggatggatggcgggtcagggggcctggggtctggggacaacgccccgaccactgaggctcttttcgtggcactgggcgcgggcgtgacggcgctcagccatcccctgctctacgtgaagctgctcatccaggtgggtcatgagccgatgccccccacccttgggaccaatgtgctggggaggaaggtcctctatctgccgagcttcttcacctacgccaagtacatcgtgcaagtggatggtaagatagggctgttccgaggcctgagtccccggctgatgtccaacgccctctctactgtgactcggggtagcatgaagaaggttttccctccagatgagattgagcaggtttccaacaaggatgatatgaagacttccctgaagaaagttgtgaaggagacctcctacgagatgatgatgcagtgtgtgtcccgcatgttggcccaccccctgcatgtcatctcaatgcgctgcatggtccagtttgtgggacgggaggccaagtacagtggtgtgctgagctccattgggaagattttcaaagaggaagggctgctgggattcttcgttggattaatccctcacctcctgggcgatgtggttttcttgtggggctgtaacctgctggcccacttcatcaatgcctacctggtggatgacagcgtgagtgacaccccaggggggctgggaaacgaccagaatccaggttcccagttcagccaggccctggccatccggagctataccaagttcgtgatggggattgcagtgagcatgctgacctaccccttcctgctagttggcgacctcatggctgtgaacaactgcgggctgcaagctgggctccccccttactccccagtgttcaaatcctggattcactgctggaagtacctgagtgtgcagggcagctcttccgagctccacctgtttccgcgtgtcataagcgcgtcaggtccctagacttaagagggtt

SEQ ID NO: 445484 - DNA, 1087 bp, Homo sapiens
  misc_feature (910)..(910): n is a, c, g, or t
  misc_feature (930)..(930): n is a, c, g, or t
  misc_feature (932)..(932): n is a, c, g, or t
  misc_feature (966)..(966): n is a, c, g, or t
  misc_feature (980)..(980): n is a, c, g, or t
  misc_feature (987)..(987): n is a, c, g, or t
  misc_feature (1005)..(1005): n is a, c, g, or t
  misc_feature (1010)..(1010): n is a, c, g, or t
  misc_feature (1045)..(1045): n is a, c, g, or t
gggggcgtggcccggtcgcgtgacggggagtgacctcgccgccgggcgccatgggagcttcggacccggaagtggcgccctgggctcgcggcggtgccgcggggatggcgggagccggagctggagccggagctcgcggcggagcggcggcgggggtcgaggctcgagctcgcgatccaccgcccgcgcaccgcgcacatcctcgccaccctcggcctgcggctcagccctcggcccgcaggatggatggcgggtcagggggcctggggtctggggacaacgccccgaccactgaggctcttttcgtggcactgggcgcgggcgtgacggcgctcagccatcccctgctctacgtgaagctgctcatccaggtgggtcatgagccgatgccccccacccttgggaccaatgtgctggggaggaaggtcctctatctgccgagcttcttcacctacgccaagtacatcgtgcaagtggatggtaagatagggctgttccgaggcctgagtccccggctgatgtccaacgccctctctactgtgactcggggtagcatgaagaaggttttccctccagatgagattgagcaggtttccaacaaggatgatatgaagacttccctgaagaaagttgtgaaggagacctcctacgagatgatgatgcagtgtgtgtcccgcatgttggcccaccccctgcatgtcatctcaatgcgctgcatggtccagtttgtgggacgggaggccaagtacagtggtgtgctgagctccattgggaagattttcaaagaggaagggctgctgggattcttcgttggattaatccctcacctcctgggcgatgtggttttcttgtggggctgtaacctgctggcccacttcatcaatgcctacctggtggatgacagcttcancaggccctgcattcggagcntncaaagtcgtgatgggattcagtagcatctgactncccttcctgcagtngcgactnatgctgtgacactgcggntgcantgggctcccctactccagtgtcaatctggattacnctgagtctgatttcaggcagcctcgaggtcactgcttcgcgg

SEQ ID NO: 445485 - DNA, 738 bp, Homo sapiens
tgtgaggtgatctacaggatcttaacgtcagcactcttggcacactgcaagacgactccaacccaacaacaaccagatgtgctccagcccagccgggcttcagttccatatttgccatgtgtctgtccagatgtggggttgagcgggggtggggctgcacccagtggattgggtcacccggcagacctagggaaggtgaggcgaggtggggagttggcagaatccccatacctcgcagatttgctgagtctgtcttgtgcagagggccagagaatggcttatgggggcccaggttggatggggaaaggctaatggggtcagaccccaccccgtctacccctccagtcagcccagcgcccatcctgcagctcagctgggagcatcattctcctgctttgtacatagggtgtggtcccctggcacgtggccaccatcatgtctaggcctatgctaggaggcaaatggccaggctctgcctgtgtttttctcaacactacttttctgatatgagggcagcacctgcctctgaatgggaaatcatgcaactactcagaatgtgtcctcctcatctaatgctcatctgtttaatggtgatgcctcgcgtacaggatctggttacctgtgcagttgtgaatacccagaggttgggcagatcagtgtctctagtcctacccagttttaaagttcatggtaagatttgacctcatctcccgcaaataaatgtattggtgatttgga

SEQ ID NO: 445486 - DNA, 967 bp, Homo sapiens
cgcccacgaagtggagagaagtccttggtgattgtaaagagggccccggagctcatttctgaatcgcactctccatttccagagactaaaggatgtcctttgaaatggctggactcagagagttggagtcgttttgagatgagcattatccccagctttgtaaccaatgaggaacacttacttatttttaagtatcttgacagaagcgatttgaacacagtgtcccgtcatttctagaaacagaatggtctcttctatagagcttggattaggaccttgctgggttgagttaggttttaatccttgccttggtttggaactgccttcgggctccagaacttttattgcttggtccgtggctgcaatccttggggcagggcttcccaacaaaggtggattgggtcacccggcagacctagggaaggtgaggcgaggtggggagttggcagaatccccatacctcgcagatttgctgagtctgtcttgtgcagagggccagagaatggcttatgggggcccaggttggatggggaaaggctaatggggtcagaccccaccccgtctacccctccagtcagcccagcgcccatcctgcagctcagctgggagcatcattctcctgctttgtacatagggtgtggtcccctggcacgtggccaccatcatgtctaggcctatgctaggaggcaaatggccaggctctgcctgtgtttttctcaacactacttttctgatatgagggcagcacctgcctctgaatgggaaatcatgcaactactcagaatgtgtcctcctcatctaatgctcatctgtttaatggtgatgcctcgcgtacaggatctggttacctgtgcagttgtgaatacccagaggttgggcagatcagtgtctctagtcctacccagttttaaagttcatggtaagatttgacctcatctcccgcaaataaatgtattggtgatttgga

SEQ ID NO: 445487 - DNA, 1020 bp, Homo sapiens
gggggcgtggcccggtcgcgtgacggggagtgacctcgccgccgggcgccatgggagcttcggacccggaagtggcgccctgggctcgcggcggtgccgcggggatggcgggagccggagctggagccggagctcgcggcggagcggcggcgggggtcgaggctcgagctcgcgatccaccgcccgcgcaccgcgcacatcctcgccaccctcggcctgcggctcagccctcggcccgcaggatggatggcgggtcagggggcctggggtctggggacaacgccccgaccactgaggctcttttcgtggcactgggcgcgggcgtgacggcgctcagccatcccctgctctacgtgaagctgctcatccaggtgggtcatgagccgatgccccccacccttgggaccaatgtgctggggaggaaggtcctctatctgccgagcttcttcacctacgccaagtacatcgtgcaagtggatggtaagatagggctgttccgaggcctgagtccccggctgatgtccaacgccctctctactgtgactcggggtagcatgaagaaggttttccctccagatgagattgagcaggtttccaacaaggatgatatgaagacttccctgaagaaagttgtgaaggagacctcctacgagatgatgatgcagtgtgtgtcccgcatgttggcccaccccctgcatgtcatctcaatgcgctgcatggtccagtttgtgggacgggaggccaagtacaggtgggtaactcttgggactggcagagtggccctgttaccctttcagagtcggccagggcaggccgtgctgggattggttgctgcaccttttctgccctagtgctgtgtgagttcagcctgctgcctggcttctgaggaatgtggcagtggcttcaatagtctgtccagggtcattttctcttcgtcatctcttatcaagggcagccctagatgagcctagatgcctttgcagaggggtgagtgggattgtagtcagcttggattaggat

SEQ ID NO: 445488 - DNA, 333 bp, Homo sapiens
ctactactactaattccgccgtcgaccatcatgtctaggcctatgctaggaggcaaatggccaggctctgcctgtgtttttctcaacactacttttctgatatgagggcagcacctgcctctgaatgggaaatcatgcaactactcagaatgtgtcctcctcatctaatgctcatctgtttaatggtgatgcctcgcgtacaggatctggttacctgtgcagttgtgaatacccagaggttgggcagatcagtgtctctagtcctacccagttttaaagttcatggtaagatttgacctcatctcccgcaaataaatgtattggtgatttgga

SEQ ID NO: 445489 - DNA, 315 bp, Homo sapiens
tgactctacaggatcccggacagcacagagggaggcaaatggccaggctctgcctgtgtttttctcaacactacttttctgatatgagggcagcacctgcctctgaatgggaaatcatgcaactactcagaatgtgtcctcctcatctaatgctcatctgtttaatggtgatgcctcgcgtacaggatctggttacctgtgcagttgtgaatacccagaggttgggcagatcagtgtctctagtcctacccagttttaaagttcatggtaagatttgacctcatctcccgcaaataaatgtattggtgatttgga

SEQ ID NO: 445490 - DNA, 713 bp, Homo sapiens
gatgagccgatgccccccaccctcgccgccgggcgccatgggagcttcggacccggaagtggcgccctgggctcgcggcggtgccgcggggatggcgggagccggagctggagccggagctcgcggcggagcggcggcgggggtcgaggctcgagctcgcgatccaccgcccgcgcaccgcgcacatcctcgccaccctcggcctgcggctcagccctcggcccgcaggatggatggcgggtcagggggcctggggtctggggacaacgccccgaccactgaggctcttttcgtggcactgggcgcgggcgtgacggcgctcagccatcccctgctctacgtgaagctgctcatccaggtgggtcatgagccgatgccccccacccttgggaccaatgtgctggggaggaaggtcctctatctgccgagcttcttcacctacgccaagtacatcgtgcaagtggatggtaagatagggctgttccgaggcctgagtccccggctgatgtccaacgccctctctactgtgactcggggtagcatgaagaaggttttccctccagatgagattgagcaggtttatcagccatgtgaaacctggctccctgtctgctgaggtgggattggagataggggaccagattgctcgaagtcaatgtcgtcgacttctctaacctggattcgcaccagaggatcctctagaacagcataac

SEQ ID NO: 445491 - DNA, 293 bp, Homo sapiens
catgctgacctaccccttcctgctagttggcgacctcatggctgtgaacaactgcgggtaggtgtgcgcccctctacttgccactctacctaccaaggctgtggggtgggggagacccaccgagcccttccagcactctgccccctcccacctgctctgtgtgtaggcttggcctgccaggcaccctggcttccgctgggatttcccagcaccccctggggtaaactgtggtgtcaggggtcagggtgtggatgggtggtagcctgaaggcattccttcttgaagtggctttc

SEQ ID NO: 445492 - DNA, 831 bp, Homo sapiens
  misc_feature (75)..(75): n is a, c, g, or t
  misc_feature (756)..(756): n is a, c, g, or t
tcatatttgccatgtgtctgtccagatgtggaactgaagcccggctgggctggagcacatctggttgttgtgggntggagcccagccgggcttcagttccatatttgccatgtgtctgtccagatgtggggttgagcgggggtggggctgcacccagtggattgggtcacccggcagacctagggaaggtgaggcgaggtggggagttggcagaatccccatacctcgcagatttgctgagtctgtcttgtgcagagggccagagaatggcttatgggggcccaggttggatggggaaaggctaatggggtcagaccccaccccgtctacccctccagtcagcccagcgcccatcctgcagctcagctgggagcatcattctcctgctttgtacatagggtgtggtcccctggcacgtggccaccatcatgtctaggcctatgctaggaggcaaatggccaggctctgcctgtgtttttctcaacactacttttctgatatgagggcagcacctgcctctgaatgggaaatcatgcaactactcagaatgtgtcctcctcatctaatgctcatctgtttaatggtgatgcctcgcgtacaggatctggttacctgtgcagttgtgaatacccagaggttgggcagatcagtgtctctagtcctacccagttttaaagttcatggtaagatttgacctcatctcccgcaaataaatgtattggtgatttggaaaacaaaaaacacataaacatcctnattaattacatacaccccctccctcctctttggaaaaaaaaaaaataatttatataattcctttgtcgcccgctg

SEQ ID NO: 445493 - DNA, 1931 bp, Homo sapiens
gggggcgtggcccggtcgcgtgacggggagtgacctcgccgccgggcgccatgggagcttcggacccggaagtggcgccctgggctcgcggcggtgccgcggggatggcgggagccggagctggagccggagctcgcggcggagcggcggcgggggtcgaggctcgagctcgcgatccaccgcccgcgcaccgcgcacatcctcgccaccctcggcctgcggctcagccctcggcccgcaggatggatggcgggtcagggggcctggggtctggggacaacgccccgaccactgaggctcttttcgtggcactgggcgcgggcgtgacggcgctcagccatcccctgctctacgtgaagctgctcatccaggtgggtcatgagccgatgccccccacccttgggaccaatgtgctggggaggaaggtcctctatctgccgagcttcttcacctacgccaagtacatcgtgcaagtggatggtaagatagggctgttccgaggcctgagtccccggctgatgtccaacgccctctctactgtgactcggggtagcatgaagaaggttttccctccagatgagattgagcaggtttccaacaaggatgatatgaagacttccctgaagaaagttgtgaaggagacctcctacgagatgatgatgcagtgtgtgtcccgcatgttggcccaccccctgcatgtcatctcaatgcgctgcatggtccagtttgtgggacgggaggccaagtacagtggtgtgctgagctccattgggaagattttcaaagaggaagggctgctgggattcttcgttggattaatccctcacctcctgggcgatgtggttttcttgtggggctgtaacctgctggcccacttcatcaatgcctacctggtggatgacagcttcagccaggccctggccatccggagctataccaagttcgtgatggggattgcagtgagcatgctgacctaccccttcctgctagttggcgacctcatggctgtgaacaactgcgggctgcaagctgggctccccccttactccccagtgttcaaatcctggattcactgctggaagtacctgagtgtgcagggccagctcttccgaggctccagcctgcttttccgccgggtgtcatcaggatcatgctttgccctggagtaacctgaatcatctaaaaaacacggtctcaacctggccaccgtgggtgaggcctgaccaccttgggacacctgcaagacgactccaacccaacaacaaccagatgtgctccagcccagccgggcttcagttccatatttgccatgtgtctgtccagatgtggggttgagcgggggtggggctgcacccagtggattgggtcacccggcagacctagggaaggtgaggcgaggtggggagttggcagaatccccatacctcgcagatttgctgagtctgtcttgtgcagagggccagagaatggcttatgggggcccaggttggatggggaaaggctaatggggtcagaccccaccccgtctacccctccagtcagcccagcgcccatcctgcagctcagctgggagcatcattctcctgctttgtacatagggtgtggtcccctggcacgtggccaccatcatgtctaggcctatgctaggaggcaaatggccaggctctgcctgtgtttttctcaacactacttttctgatatgagggcagcacctgcctctgaatgggaaatcatgcaactactcagaatgtgtcctcctcatctaatgctcatctgtttaatggtgatgcctcgcgtacaggatctggttacctgtgcagttgtgaatacccagaggttgggcagatcagtgtctctagtcctacccagttttaaagttcatggtaagatttgacctcatctcccgcaaataaatgtattggtgatttgga

SEQ ID NO: 445494 - DNA, 1982 bp, Homo sapiens
gggggcgtggcccggtcgcgtgacggggagtgacctcgccgccgggcgccatgggagcttcggacccggaagtggcgccctgggctcgcggcggtgccgcggggatggcgggagccggagctggagccggagctcgcggcggagcggcggcgggggtcgaggctcgagctcgcgatccaccgcccgcgcaccgcgcacatcctcgccaccctcggcctgcggctcagccctcggcccgcaggatggatggcgggtcagggggcctggggtctggggacaacgccccgaccactgaggctcttttcgtggcactgggcgcgggcgtgacggcgctcagccatcccctgctctacgtgaagctgctcatccaggtgggtcatgagccgatgccccccacccttgggaccaatgtgctggggaggaaggtcctctatctgccgagcttcttcacctacgccaagtacatcgtgcaagtggatggtaagatagggctgttccgaggcctgagtccccggctgatgtccaacgccctctctactgtgactcggggtagcatgaagaaggttttccctccagatgagattgagcaggtttccaacaaggatgatatgaagacttccctgaagaaagttgtgaaggagacctcctacgagatgatgatgcagtgtgtgtcccgcatgttggcccaccccctgcatgtcatctcaatgcgctgcatggtccagtttgtgggacgggaggccaagtacagtggtgtgctgagctccattgggaagattttcaaagaggaagggctgctgggattcttcgttggattaatccctcacctcctgggcgatgtggttttcttgtggggctgtaacctgctggcccacttcatcaatgcctacctggtggatgacagcgtgagtgacaccccaggggggctgggaaacgaccagaatccaggttcccagttcagccaggccctggccatccggagctataccaagttcgtgatggggattgcagtgagcatgctgacctaccccttcctgctagttggcgacctcatggctgtgaacaactgcgggctgcaagctgggctccccccttactccccagtgttcaaatcctggattcactgctggaagtacctgagtgtgcagggccagctcttccgaggctccagcctgcttttccgccgggtgtcatcaggatcatgctttgccctggagtaacctgaatcatctaaaaaacacggtctcaacctggccaccgtgggtgaggcctgaccaccttgggacacctgcaagacgactccaacccaacaacaaccagatgtgctccagcccagccgggcttcagttccatatttgccatgtgtctgtccagatgtggggttgagcgggggtggggctgcacccagtggattgggtcacccggcagacctagggaaggtgaggcgaggtggggagttggcagaatccccatacctcgcagatttgctgagtctgtcttgtgcagagggccagagaatggcttatgggggcccaggttggatggggaaaggctaatggggtcagaccccaccccgtctacccctccagtcagcccagcgcccatcctgcagctcagctgggagcatcattctcctgctttgtacatagggtgtggtcccctggcacgtggccaccatcatgtctaggcctatgctaggaggcaaatggccaggctctgcctgtgtttttctcaacactacttttctgatatgagggcagcacctgcctctgaatgggaaatcatgcaactactcagaatgtgtcctcctcatctaatgctcatctgtttaatggtgatgcctcgcgtacaggatctggttacctgtgcagttgtgaatacccagaggttgggcagatcagtgtctctagtcctacccagttttaaagttcatggtaagatttgacctcatctcccgcaaataaatgtattggtgatttgga

SEQ ID NO: 445495 - DNA, 1875 bp, Homo sapiens
  misc_feature (16)..(16): n is a, c, g, or t
  misc_feature (23)..(23): n is a, c, g, or t
taggctagtagaggcnggtggtnaatcggccgaggcggtgccgcggggatggcgggagccggagctggagccggagctcgcggcggagcggcggcgggggtcgaggctcgagctcgcgatccaccgcccgcgcaccgcgcacatcctcgccaccctcggcctgcggctcagccctcggcccgcaggatggatggcgggtcagggggcctggggtctggggacaacgccccgaccactgaggctcttttcgtggcactgggcgcgggcgtgacggcgctcagccatcccctgctctacgtgaagctgctcatccaggtgggtcatgagccgatgccccccacccttgggaccaatgtgctggggaggaaggtcctctatctgccgagcttcttcacctacgccaagtacatcgtgcaagtggatggtaagatagggctgttccgaggcctgagtccccggctgatgtccaacgccctctctactgtgactcggggtagcatgaagaaggttttccctccagatgagattgagcaggtttccaacaaggatgatatgaagacttccctgaagaaagttgtgaaggagacctcctacgagatgatgatgcagtgtgtgtcccgcatgttggcccaccccctgcatgtcatctcaatgcgctgcatggtccagtttgtgggacgggaggccaagtacagtggtgtgctgagctccattgggaagattttcaaagaggaagggctgctgggattcttcgttggattaatccctcacctcctgggcgatgtggttttcttgtggggctgtaacctgctggcccacttcatcaatgcctacctggtggatgacagcttcagccaggccctggccatccggagctataccaagttcgtgatggggattgcagtgagcatgctgacctaccccttcctgctagttggcgacctcatggctgtgaacaactgcgggctgcaagctgggctccccccttactccccagtgttcaaatcctggattcactgctggaagtacctgagtgtgcagggccagctcttccgaggctccagcctgcttttccgccgggtgtcatcaggatcatgctttgccctggagtaacctgaatcatctaaaaaacacggtctcaacctggccaccgtgggtgaggcctgaccaccttgggacacctgcaagacgactccaacccaacaacaaccagatgtgctccagcccagccgggcttcagttccatatttgccatgtgtctgtccagatgtggggttgagcgggggtggggctgcacccagtggattgggtcacccggcagacctagggaaggtgaggcgaggtggggagttggcagaatccccatacctcgcagatttgctgagtctgtcttgtgcagagggccagagaatggcttatgggggcccaggttggatggggaaaggctaatggggtcagaccccaccccgtctacccctccagtcagcccagcgcccatcctgcagctcagctgggagcatcattctcctgctttgtacatagggtgtggtcccctggcacgtggccaccatcatgtctaggcctatgctaggaggcaaatggccaggctctgcctgtgtttttctcaacactacttttctgatatgagggcagcacctgcctctgaatgggaaatcatgcaactactcagaatgtgtcctcctcatctaatgctcatctgtttaatggtgatgcctcgcgtacaggatctggttacctgtgcagttgtgaatacccagaggttgggcagatcagtgtctctagtcctacccagttttaaagttcatggtaagatttgacctcatctcccgcaaataaatgtattggtgatttgga

SEQ ID NO: 445496 - DNA, 2155 bp, Homo sapiens
gggggcgtggcccggtcgcgtgacggggagtgacctcgccgccgggcgccatgggagcttcggacccggaagtggcgccctgggctcgcggcggtgccgcggggatggcgggagccggagctggagccggagctcgcggcggagcggcggcgggggtcgaggctcgagctcgcgatccaccgcccgcgcaccgcgcacatcctcgccaccctcggcctgcggctcagccctcggcccgcaggatggatggcgggtcagggggcctggggtctggggacaacgccccgaccactgaggctcttttcgtggcactgggcgcgggcgtgacggcgctcagccatcccctgctctacgtgaagctgctcatccaggtgggtcatgagccgatgccccccacccttgggaccaatgtgctggggaggaaggtcctctatctgccgagcttcttcacctacgccaagtacatcgtgcaagtggatggtaagatagggctgttccgaggcctgagtccccggctgatgtccaacgccctctctactgtgactcggggtagcatgaagaaggttttccctccagatgagattgagcaggtttccaacaaggatgatatgaagacttccctgaagaaagttgtgaaggagacctcctacgagatgatgatgcagtgtgtgtcccgcatgttggcccaccccctgcatgtcatctcaatgcgctgcatggtccagtttgtgggacgggaggccaagtacagtggtgtgctgagctccattgggaagattttcaaagaggaagggctgctgggattcttcgttggattaatccctcacctcctgggcgatgtggttttcttgtggggctgtaacctgctggcccacttcatcaatgcctacctggtggatgacagcgtgagtgacaccccaggggggctgggaaacgaccagaatccaggttcccagttcagccaggccctggccatccggagctataccaagttcgtgatgggggtaagttgtgccagctgtccttccttcccactgccttgcggacccaagcggggcctaggaggccaaccctggtaatggctggaggcaggtcttggtacagggtgttggcgtggtgtgtccctgctccctgggccggggtgggtcactggcactcaggcctctctgggtttcagattgcagtgagcatgctgacctaccccttcctgctagttggcgacctcatggctgtgaacaactgcgggctgcaagctgggctccccccttactccccagtgttcaaatcctggattcactgctggaagtacctgagtgtgcagggccagctcttccgaggctccagcctgcttttccgccgggtgtcatcaggatcatgctttgccctggagtaacctgaatcatctaaaaaacacggtctcaacctggccaccgtgggtgaggcctgaccaccttgggacacctgcaagacgactccaacccaacaacaaccagatgtgctccagcccagccgggcttcagttccatatttgccatgtgtctgtccagatgtggggttgagcgggggtggggctgcacccagtggattgggtcacccggcagacctagggaaggtgaggcgaggtggggagttggcagaatccccatacctcgcagatttgctgagtctgtcttgtgcagagggccagagaatggcttatgggggcccaggttggatggggaaaggctaatggggtcagaccccaccccgtctacccctccagtcagcccagcgcccatcctgcagctcagctgggagcatcattctcctgctttgtacatagggtgtggtcccctggcacgtggccaccatcatgtctaggcctatgctaggaggcaaatggccaggctctgcctgtgtttttctcaacactacttttctgatatgagggcagcacctgcctctgaatgggaaatcatgcaactactcagaatgtgtcctcctcatctaatgctcatctgtttaatggtgatgcctcgcgtacaggatctggttacctgtgcagttgtgaatacccagaggttgggcagatcagtgtctctagtcctacccagttttaaagttcatggtaagatttgacctcatctcccgcaaataaatgtattggtgatttgga

SEQ ID NO: 445497 - DNA, 1851 bp, Homo sapiens
cgcaggtgtgtagccgtggcgtgattgcgggaacctgatcattgagccggagctcgcggcggagcggcggcgggggtcgaggctcgagctcgcgatccaccgcccgcgcaccgcgcacatcctcgccaccctcggcctgcggctcagccctcggcccgcaggatggatggcgggtcagggggcctggggtctggggacaacgccccgaccactgaggctcttttcgtggcactgggcgcgggcgtgacggcgctcagccatcccctgctctacgtgaagctgctcatccaggtgggtcatgagccgatgccccccacccttgggaccaatgtgctggggaggaaggtcctctatctgccgagcttcttcacctacgccaagtacatcgtgcaagtggatggtaagatagggctgttccgaggcctgagtccccggctgatgtccaacgccctctctactgtgactcggggtagcatgaagaaggttttccctccagatgagattgagcaggtttccaacaaggatgatatgaagacttccctgaagaaagttgtgaaggagacctcctacgagatgatgatgcagtgtgtgtcccgcatgttggcccaccccctgcatgtcatctcaatgcgctgcatggtccagtttgtgggacgggaggccaagtacagtggtgtgctgagctccattgggaagattttcaaagaggaagggctgctgggattcttcgttggattaatccctcacctcctgggcgatgtggttttcttgtggggctgtaacctgctggcccacttcatcaatgcctacctggtggatgacagcttcagccaggccctggccatccggagctataccaagttcgtgatggggattgcagtgagcatgctgacctaccccttcctgctagttggcgacctcatggctgtgaacaactgcgggctgcaagctgggctccccccttactccccagtgttcaaatcctggattcactgctggaagtacctgagtgtgcagggccagctcttccgaggctccagcctgcttttccgccgggtgtcatcaggatcatgctttgccctggagtaacctgaatcatctaaaaaacacggtctcaacctggccaccgtgggtgaggcctgaccaccttgggacacctgcaagacgactccaacccaacaacaaccagatgtgctccagcccagccgggcttcagttccatatttgccatgtgtctgtccagatgtggggttgagcgggggtggggctgcacccagtggattgggtcacccggcagacctagggaaggtgaggcgaggtggggagttggcagaatccccatacctcgcagatttgctgagtctgtcttgtgcagagggccagagaatggcttatgggggcccaggttggatggggaaaggctaatggggtcagaccccaccccgtctacccctccagtcagcccagcgcccatcctgcagctcagctgggagcatcattctcctgctttgtacatagggtgtggtcccctggcacgtggccaccatcatgtctaggcctatgctaggaggcaaatggccaggctctgcctgtgtttttctcaacactacttttctgatatgagggcagcacctgcctctgaatgggaaatcatgcaactactcagaatgtgtcctcctcatctaatgctcatctgtttaatggtgatgcctcgcgtacaggatctggttacctgtgcagttgtgaatacccagaggttgggcagatcagtgtctctagtcctacccagttttaaagttcatggtaagatttgacctcatctcccgcaaataaatgtattggtgatttgga

SEQ ID NO: 445498 - DNA, 2995 bp, Homo sapiens
gggggcgtggcccggtcgcgtgacggggagtgacctcgccgccgggcgccatgggagcttcggacccggaagtggcgccctgggctcgcggcggtgccgcggggatggcgggagccggagctggagccggagctcgcggcggagcggcggcgggggtcgaggctcgagctcgcgatccaccgcccgcgcaccgcgcacatcctcgccaccctcggcctgcggctcagccctcggcccgcaggatggatggcgggtcagggggcctggggtctggggacaacgccccgaccactgaggctcttttcgtggcactgggcgcgggcgtgacggcgctcagccatcccctgctctacgtgaagctgctcatccaggtgggtcatgagccgatgccccccacccttgggaccaatgtgctggggaggaaggtcctctatctgccgagcttcttcacctacgccaagtacatcgtgcaagtggatggtaagatagggctgttccgaggcctgagtccccggctgatgtccaacgccctctctactgtgactcggggtagcatgaagaaggttttccctccagatgagattgagcaggtttccaacaaggatgatatgaagacttccctgaagaaagttgtgaaggagacctcctacgagatgatgatgcagtgtgtgtcccgcatgttggcccaccccctgcatgtcatctcaatgcgctgcatggtccagtttgtgggacgggaggccaagtacagtggtgtgctgagctccattgggaagattttcaaagaggaagggctgctgggattcttcgttggattaatccctcacctcctgggcgatgtggttttcttgtggggctgtaacctgctggcccacttcatcaatgcctacctggtggatgacagcttcagccaggccctggccatccggagctataccaagttcgtgatggggattgcagtgagcatgctgacctaccccttcctgctagttggcgacctcatggctgtgaacaactgcgggctgcaagctgggctccccccttactccccagtgttcaaatcctggattcactgctggaagtacctgagtgtgcaggtgagcaagcactggacggcggaggcctttcctgttctttgctacatccttcagctgaaatggttttgtggatgcttcattgcatgcaaagataagtggtttcatggaattcaatattgtgaggagatacttggtatctataaggcatttaagttttcatcttacataatttcagaaaggatttgaggtggctaagtgtgggtttattttaagattatacatcagacaagaccttttcttctttgagtcttaaagactcttaggataaggataagagaactctggcccaggtggcaggtggtaaagcccaagaactgcttctccttcaagtaacatgggctgaaaattcgaggtctgtaaccagttgagctgagttcctgggttgttagggcggctggcattggaaaccgactcctccctcctgcaggacattcctgggcccaggagagcctgtgggtggggctgggccacgtggggaactggcagcagtaccaaccttgggttctcgtgttctgtaccgaagctacctctccgtagctggagctcttgggcccagcagtcaggggtccaggctttggccgagggcagaaccttgccttttcctggccttgatttgcctcgcagtgaaatggggcagtggcccggagggagccagaactctgagtggcctcgaggctgagaagaggacagatgggagggaagcagggaggagagccgcagttcttcccagtggccctggtcagcgtgagtgtgtctcgtcctccctatgagcactgaaagagtcctagaccacttgggctctgaagcaagaggggcaatgagcctcctctctagggctctcctacagagtagccccaaagacacccctgggcaggaaatgaaccgctcccttctgcttcaacacaggcagattctgccctccagggatgtaggccgaggccgtccaccccggagctgggtctttgagctcctggacccttctttgcctgacactggccttcctctcggagggacaaggaagcgtggcctccctttcactcaccttacttttccttctggtccagggccagctcttccgaggctccagcctgcttttccgccgggtgtcatcaggatcatgctttgccctggagtaacctgaatcatctaaaaaacacggtctcaacctggccaccgtgggtgaggcctgaccaccttgggacacctgcaagacgactccaacccaacaacaaccagatgtgctccagcccagccgggcttcagttccatatttgccatgtgtctgtccagatgtggggttgagcgggggtggggctgcacccagtggattgggtcacccggcagacctagggaaggtgaggcgaggtggggagttggcagaatccccatacctcgcagatttgctgagtctgtcttgtgcagagggccagagaatggcttatgggggcccaggttggatggggaaaggctaatggggtcagaccccaccccgtctacccctccagtcagcccagcgcccatcctgcagctcagctgggagcatcattctcctgctttgtacatagggtgtggtcccctggcacgtggccaccatcatgtctaggcctatgctaggaggcaaatggccaggctctgcctgtgtttttctcaacactacttttctgatatgagggcagcacctgcctctgaatgggaaatcatgcaactactcagaatgtgtcctcctcatctaatgctcatctgtttaatggtgatgcctcgcgtacaggatctggttacctgtgcagttgtgaatacccagaggttgggcagatcagtgtctctagtcctacccagttttaaagttcatggtaagatttgacctcatctcccgcaaataaatgtattggtgatttgga

SEQ ID NO: 445499 - DNA, 1548 bp, Homo sapiens
  misc_feature (16)..(16): n is a, c, g, or t
  misc_feature (23)..(23): n is a, c, g, or t
taggctagtagaggcnggtggtnaatcggccgaggcgaggaaggtctctatctgccgagcttcttcacctacgccaagtacatcgtgcaagtggatggtaagatagggctgttccgaggcctgagtccccggctgatgtccaacgccctctctactgtgactcggggtagcatgaagaaggttttccctccagatgagattgagcaggtttccaacaaggatgatatgaagacttccctgaagaaagttgtgaaggagacctcctacgagatgatgatgcagtgtgtgtcccgcatgttggcccaccccctgcatgtcatctcaatgcgctgcatggtccagtttgtgggacgggaggccaagtacagtggtgtgctgagctccattgggaagattttcaaagaggaagggctgctgggattcttcgttggattaatccctcacctcctgggcgatgtggttttcttgtggggctgtaacctgctggcccacttcatcaatgcctacctggtggatgacagcttcagccaggccctggccatccggagctataccaagttcgtgatggggattgcagtgagcatgctgacctaccccttcctgctagttggcgacctcatggctgtgaacaactgcgggctgcaagctgggctccccccttactccccagtgttcaaatcctggattcactgctggaagtacctgagtgtgcagggccagctcttccgaggctccagcctgcttttccgccgggtgtcatcaggatcatgctttgccctggagtaacctgaatcatctaaaaaacacggtctcaacctggccaccgtgggtgaggcctgaccaccttgggacacctgcaagacgactccaacccaacaacaaccagatgtgctccagcccagccgggcttcagttccatatttgccatgtgtctgtccagatgtggggttgagcgggggtggggctgcacccagtggattgggtcacccggcagacctagggaaggtgaggcgaggtggggagttggcagaatccccatacctcgcagatttgctgagtctgtcttgtgcagagggccagagaatggcttatgggggcccaggttggatggggaaaggctaatggggtcagaccccaccccgtctacccctccagtcagcccagcgcccatcctgcagctcagctgggagcatcattctcctgctttgtacatagggtgtggtcccctggcacgtggccaccatcatgtctaggcctatgctaggaggcaaatggccaggctctgcctgtgtttttctcaacactacttttctgatatgagggcagcacctgcctctgaatgggaaatcatgcaactactcagaatgtgtcctcctcatctaatgctcatctgtttaatggtgatgcctcgcgtacaggatctggttacctgtgcagttgtgaatacccagaggttgggcagatcagtgtctctagtcctacccagttttaaagttcatggtaagatttgacctcatctcccgcaaataaatgtattggtgatttgga

SEQ ID NO: 445500 - DNA, 1884 bp, Homo sapiens
gatgagccgatgccccccaccctcgccgccgggcgccatgggagcttcggacccggaagtggcgccctgggctcgcggcggtgccgcggggatggcgggagccggagctggagccggagctcgcggcggagcggcggcgggggtcgaggctcgagctcgcgatccaccgcccgcgcaccgcgcacatcctcgccaccctcggcctgcggctcagccctcggcccgcaggatggatggcgggtcagggggcctggggtctggggacaacgccccgaccactgaggctcttttcgtggcactgggcgcgggcgtgacggcgctcagccatcccctgctctacgtgaagctgctcatccagccaagtacatcgtgcaagtggatggtaagatagggctgttccgaggcctgagtccccggctgatgtccaacgccctctctactgtgactcggggtagcatgaagaaggttttccctccagatgagattgagcaggtttccaacaaggatgatatgaagacttccctgaagaaagttgtgaaggagacctcctacgagatgatgatgcagtgtgtgtcccgcatgttggcccaccccctgcatgtcatctcaatgcgctgcatggtccagtttgtgggacgggaggccaagtacagtggtgtgctgagctccattgggaagattttcaaagaggaagggctgctgggattcttcgttggattaatccctcacctcctgggcgatgtggttttcttgtggggctgtaacctgctggcccacttcatcaatgcctacctggtggatgacagcgtgagtgacaccccaggggggctgggaaacgaccagaatccaggttcccagttcagccaggccctggccatccggagctataccaagttcgtgatggggattgcagtgagcatgctgacctaccccttcctgctagttggcgacctcatggctgtgaacaactgcgggctgcaagctgggctccccccttactccccagtgttcaaatcctggattcactgctggaagtacctgagtgtgcagggccagctcttccgaggctccagcctgcttttccgccgggtgtcatcaggatcatgctttgccctggagtaacctgaatcatctaaaaaacacggtctcaacctggccaccgtgggtgaggcctgaccaccttgggacacctgcaagacgactccaacccaacaacaaccagatgtgctccagcccagccgggcttcagttccatatttgccatgtgtctgtccagatgtggggttgagcgggggtggggctgcacccagtggattgggtcacccggcagacctagggaaggtgaggcgaggtggggagttggcagaatccccatacctcgcagatttgctgagtctgtcttgtgcagagggccagagaatggcttatgggggcccaggttggatggggaaaggctaatggggtcagaccccaccccgtctacccctccagtcagcccagcgcccatcctgcagctcagctgggagcatcattctcctgctttgtacatagggtgtggtcccctggcacgtggccaccatcatgtctaggcctatgctaggaggcaaatggccaggctctgcctgtgtttttctcaacactacttttctgatatgagggcagcacctgcctctgaatgggaaatcatgcaactactcagaatgtgtcctcctcatctaatgctcatctgtttaatggtgatgcctcgcgtacaggatctggttacctgtgcagttgtgaatacccagaggttgggcagatcagtgtctctagtcctacccagttttaaagttcatggtaagatttgacctcatctcccgcaaataaatgtattggtgatttgga

SEQ ID NO: 445501 - DNA, 1296 bp, Homo sapiens
acaggaccctcccagcgaaaccacagccaagggaacggtccgctctccacccaccccctgcatgtcatctcaatgcgctgcatggtccagtttgtgggacgggaggccaagtacagtggtgtgctgagctccattgggaagattttcaaagaggaagggctgctgggattcttcgttggattaatccctcacctcctgggcgatgtggttttcttgtggggctgtaacctgctggcccacttcatcaatgcctacctggtggatgacagcttcagccaggccctggccatccggagctataccaagttcgtgatggggattgcagtgagcatgctgacctaccccttcctgctagttggcgacctcatggctgtgaacaactgcgggctgcaagctgggctccccccttactccccagtgttcaaatcctggattcactgctggaagtacctgagtgtgcagggccagctcttccgaggctccagcctgcttttccgccgggtgtcatcaggatcatgctttgccctggagtaacctgaatcatctaaaaaacacggtctcaacctggccaccgtgggtgaggcctgaccaccttgggacacctgcaagacgactccaacccaacaacaaccagatgtgctccagcccagccgggcttcagttccatatttgccatgtgtctgtccagatgtggggttgagcgggggtggggctgcacccagtggattgggtcacccggcagacctagggaaggtgaggcgaggtggggagttggcagaatccccatacctcgcagatttgctgagtctgtcttgtgcagagggccagagaatggcttatgggggcccaggttggatggggaaaggctaatggggtcagaccccaccccgtctacccctccagtcagcccagcgcccatcctgcagctcagctgggagcatcattctcctgctttgtacatagggtgtggtcccctggcacgtggccaccatcatgtctaggcctatgctaggaggcaaatggccaggctctgcctgtgtttttctcaacactacttttctgatatgagggcagcacctgcctctgaatgggaaatcatgcaactactcagaatgtgtcctcctcatctaatgctcatctgtttaatggtgatgcctcgcgtacaggatctggttacctgtgcagttgtgaatacccagaggttgggcagatcagtgtctctagtcctacccagttttaaagttcatggtaagatttgacctcatctcccgcaaataaatgtattggtgatttgga

SEQ ID NO: 445502 - DNA, 1821 bp, Homo sapiens
gtgggtaagctgctgctgtcacatacagagcaagggtggccaggagtgcaccgctaagtggtttctcatctaggtgggcagctgtctgaccagaggctgccgtgcttacatcagcaacaacagcagtcaacagatttgtctaaagtgtttttcaagtgcttttccgtatgtggcttaaaggccgaggtgaggctgccgggttgtcaaagccactcaagcagacatctgagcaaatctctgaccaagaacccaggccatcgatctggtgggatggccgctccacaggaagctgagggtgggggagtcacctttcctcactaggagctgtttgcttcagcaaagcaggatttgaggagttggggtctgaagggggaaaagcttgctgaggtggaggtggcgataagcctggacttgccctcacctcaccccacaggccaggattcgtctttgggtttcagggtgcatgtctgtcttagcactgactgcgtgccaagccctggatgttggtcaggcagacacgggctcagcccttgaggctcacagtccggtgggttgcacaggcagcggcagctgatccctcttaccgggtctccttctcgggactcccttcagtccacttaccccgtttctgccccccaggccttctctgggcagtgactgtgagggctgacaggaaaggcatgtgcagcgtgcttgtgaggagctcagcacagagggtggggtgagggcatgtgttgctgaagtctgcatcctgaggtgcctgtggcaaaccactcttcccttctgtctcctcagttcagccaggccctggccatccggagctataccaagttcgtgatggggattgcagtgagcatgctgacctaccccttcctgctagttggcgacctcatggctgtgaacaactgcgggctgcaagctgggctccccccttactccccagtgttcaaatcctggattcactgctggaagtacctgagtgtgcagggccagctcttccgaggctccagcctgcttttccgccgggtgtcatcaggatcatgctttgccctggagtaacctgaatcatctaaaaaacacggtctcaacctggccaccgtgggtgaggcctgaccaccttgggacacctgcaagacgactccaacccaacaacaaccagatgtgctccagcccagccgggcttcagttccatatttgccatgtgtctgtccagatgtggggttgagcgggggtggggctgcacccagtggattgggtcacccggcagacctagggaaggtgaggcgaggtggggagttggcagaatccccatacctcgcagatttgctgagtctgtcttgtgcagagggccagagaatggcttatgggggcccaggttggatggggaaaggctaatggggtcagaccccaccccgtctacccctccagtcagcccagcgcccatcctgcagctcagctgggagcatcattctcctgctttgtacatagggtgtggtcccctggcacgtggccaccatcatgtctaggcctatgctaggaggcaaatggccaggctctgcctgtgtttttctcaacactacttttctgatatgagggcagcacctgcctctgaatgggaaatcatgcaactactcagaatgtgtcctcctcatctaatgctcatctgtttaatggtgatgcctcgcgtacaggatctggttacctgtgcagttgtgaatacccagaggttgggcagatcagtgtctctagtcctacccagttttaaagttcatggtaagatttgacctcatctcccgcaaataaatgtattggtgatttgga

SEQ ID NO: 445503 - DNA, 1026 bp, Homo sapiens
atctagaggatccctgaacattcgtgtcataccaagttcgtgatggggattgcagtgagcatgctgacctaccccttcctgctagttggcgacctcatggctgtgaacaactgcgggctgcaagctgggctccccccttactccccagtgttcaaatcctggattcactgctggaagtacctgagtgtgcagggccagctcttccgaggctccagcctgcttttccgccgggtgtcatcaggatcatgctttgccctggagtaacctgaatcatctaaaaaacacggtctcaacctggccaccgtgggtgaggcctgaccaccttgggacacctgcaagacgactccaacccaacaacaaccagatgtgctccagcccagccgggcttcagttccatatttgccatgtgtctgtccagatgtggggttgagcgggggtggggctgcacccagtggattgggtcacccggcagacctagggaaggtgaggcgaggtggggagttggcagaatccccatacctcgcagatttgctgagtctgtcttgtgcagagggccagagaatggcttatgggggcccaggttggatggggaaaggctaatggggtcagaccccaccccgtctacccctccagtcagcccagcgcccatcctgcagctcagctgggagcatcattctcctgctttgtacatagggtgtggtcccctggcacgtggccaccatcatgtctaggcctatgctaggaggcaaatggccaggctctgcctgtgtttttctcaacactacttttctgatatgagggcagcacctgcctctgaatgggaaatcatgcaactactcagaatgtgtcctcctcatctaatgctcatctgtttaatggtgatgcctcgcgtacaggatctggttacctgtgcagttgtgaatacccagaggttgggcagatcagtgtctctagtcctacccagttttaaagttcatggtaagatttgacctcatctcccgcaaataaatgtattggtgatttgga

SEQ ID NO: 445504 - DNA, 1011 bp, Homo sapiens
  misc_feature (47)..(47): n is a, c, g, or t
  misc_feature (97)..(97): n is a, c, g, or t
acatacagcaactattacaagtttgtgataaaaacagccgtgtgtcntcttacctaccccttcctgctagaaggcgacctcatttctaaaaacagcnagaagctgcaagctgggctccccccttactccccagtgttcaaatcctggattcactgctggaagtacctgagtgtgcagggccagctcttccgaggctccagcctgcttttccgccgggtgtcatcaggatcatgctttgccctggagtaacctgaatcatctaaaaaacacggtctcaacctggccaccgtgggtgaggcctgaccaccttgggacacctgcaagacgactccaacccaacaacaaccagatgtgctccagcccagccgggcttcagttccatatttgccatgtgtctgtccagatgtggggttgagcgggggtggggctgcacccagtggattgggtcacccggcagacctagggaaggtgaggcgaggtggggagttggcagaatccccatacctcgcagatttgctgagtctgtcttgtgcagagggccagagaatggcttatgggggcccaggttggatggggaaaggctaatggggtcagaccccaccccgtctacccctccagtcagcccagcgcccatcctgcagctcagctgggagcatcattctcctgctttgtacatagggtgtggtcccctggcacgtggccaccatcatgtctaggcctatgctaggaggcaaatggccaggctctgcctgtgtttttctcaacactacttttctgatatgagggcagcacctgcctctgaatgggaaatcatgcaactactcagaatgtgtcctcctcatctaatgctcatctgtttaatggtgatgcctcgcgtacaggatctggttacctgtgcagttgtgaatacccagaggttgggcagatcagtgtctctagtcctacccagttttaaagttcatggtaagatttgacctcatctcccgcaaataaatgtattggtgatttgga

SEQ ID NO: 445505 - DNA, 731 bp, Homo sapiens
  misc_feature (75)..(75): n is a, c, g, or t
tcatatttgccatgtgtctgtccagatgtggaactgaagcccggctgggctggagcacatctggttgttgtgggntggagcccagccgggcttcagttccatatttgccatgtgtctgtccagatgtggggttgagcgggggtggggctgcacccagtggattgggtcacccggcagacctagggaaggtgaggcgaggtggggagttggcagaatccccatacctcgcagatttgctgagtctgtcttgtgcagagggccagagaatggcttatgggggcccaggttggatggggaaaggctaatggggtcagaccccaccccgtctacccctccagtcagcccagcgcccatcctgcagctcagctgggagcatcattctcctgctttgtacatagggtgtggtcccctggcacgtggccaccatcatgtctaggcctatgctaggaggcaaatggccaggctctgcctgtgtttttctcaacactacttttctgatatgagggcagcacctgcctctgaatgggaaatcatgcaactactcagaatgtgtcctcctcatctaatgctcatctgtttaatggtgatgcctcgcgtacaggatctggttacctgtgcagttgtgaatacccagaggttgggcagatcagtgtctctagtcctacccagttttaaagttcatggtaagatttgacctcatctcccgcaaataaatgtattggtgatttgga

SEQ ID NO: 445506 - DNA, 322 bp, Homo sapiens
  misc_feature (14)..(14): n is a, c, g, or t
  misc_feature (27)..(27): n is a, c, g, or t
  misc_feature (29)..(29): n is a, c, g, or t
gcggcccctactantactaaattcgcngncgctcgacggaggcaaatggccaggctctgcctgtgtttttctcaacactacttttctgatatgagggcagcacctgcctctgaatgggaaatcatgcaactactcagaatgtgtcctcctcatctaatgctcatctgtttaatggtgatgcctcgcgtacaggatctggttacctgtgcagttgtgaatacccagaggttgggcagatcagtgtctctagtcctacccagttttaaagttcatggtaagatttgacctcatctcccgcaaataaatgtattggtgatttgga

SEQ ID NO: 445507 - DNA, 772 bp, Homo sapiens
aggcgtactgaggccccgcagggggcggggaagcctgcgtgtgcgcagctcggcccggcccgccctcttcatcctagcccgccccctccccggctctggacccggttctgtgggagggtccgttccgggctcggtgcgactgcgcagctcctcggcgcttcctcggtggcttccccgggtcgagcaaacaggtaagttcggggagacttcaggccagggcagtctcctgtcttctcttggaaaccacagcagcccatgcacacagaatggcagccacattccagcttccagggcaccaggagatgccgctgaccttccaggatgtggccgtgtacttctctcaggcggaggggcggcagctgggcccccagcagcgggcgctctaccgggatgtgatgctggagaactatgggaacgtggcctctctgggattccctgtccctaagccggagttgatctcccagctggagcaggggaaggaactttgggtcctgaatcttctgggagctgaggaaccagatatcttgaaaagctgccagaaaggtgagaatggatgggatgctaatcctgggagcagcctcccaatcctgccttaagaggctccaagcgagggacagctggggcatggcgttcatattaatggcctcccccaggggcagtctcacagatacagcccctctacaaatgtgagcatgtgcacatgctttagaagttttatcttgctggtctgtttctttgctttaaaaatatatatatactacttctgatcata

SEQ ID NO: 445508 - DNA, 737 bp, Homo sapiens
aggcgtactgaggccccgcagggggcggggaagcctgcgtgtgcgcagctcggcccggcccgccctcttcatcctagcccgccccctccccggctctggacccggttctgtgggagggtccgttccgggctcggtgcgactgcgcagctcctcggcgcttcctcggtggcttccccgggtcgagcaaacaggtaagttcggggagacttcaggccagggcagtctcctgtcttctcttggaaaccacagcagcccatgcacacagaatggcagccacattccagcttccagggcaccaggagatgccgctgaccttccaggatgtggccgtgtacttctctcaggcggaggggcggcagctgggcccccagcagcgggcgctctaccgggatgtgatgctggagaactatgggaacgtggcctctctgggattccctgtccctaagccggagttgatctcccagctggagcaggggaaggaactttgggtcctgaatcttctgggagctgaggaaccagatatcttgaaaagctgccagaaagttattctttcagttgctgagagaggggtgtttgttggcttcatgtatcttgaagctgtattataagacttacttcacttatgactatcattatgagagataagagaattcctgtttgtctctggtaatacattttgttttgaaatatattttatctaatattaatgtagcaattccatccttcttatacttact

SEQ ID NO: 445509 - DNA, 3613 bp, Homo sapiens
aggcgtactgaggccccgcagggggcggggaagcctgcgtgtgcgcagctcggcccggcccgccctcttcatcctagcccgccccctccccggctctggacccggttctgtgggagggtccgttccgggctcggtgcgactgcgcagctcctcggcgcttcctcggtggcttccccgggtcgagcaaacaggtggggcagtgtcggaccaggaaggagcgccaagcgggcaggcaggcggggagggcgcggggagggcgcggggaggcggcggccagtccaggaggagcctgttctgggtgccgcgggagccaccgacgggctgcagaggccgggaggaggcgaccgcggcgcggccctagaaggctggactgaggaccacagctggcttccggcctctccccggagcctggggccttcggcagcatccccgcggcctccttctcacgtcctcagccttggtgaggctgcaccctcacgtggctctttgccccaggttggccaggcaggtagaacggccctgcaccccatttccagggccttcagcaggtctggaccacgggaactgccagctttcaccccttagccgggcgtccctggatccccccgggctctggctctggccgttctgggatttcaggagtcactgagcagtagggcacgtcggcccgtgctgcatagtgacctgcctcccgcgacccaggaggccacagcagcaatcagcttctgcctcctggccatccttccacacccctggttgaatggggctgagcctgagttctccccactgaaggtaagttcggggagacttcaggccagggcagtctcctgtcttctcttggaaaccacagcagcccatgcacacagaatggcagccacattccagcttccagggcaccaggagatgccgctgaccttccaggatgtggccgtgtacttctctcaggcggaggggcggcagctgggcccccagcagcgggcgctctaccgggatgtgatgctggagaactatgggaacgtggcctctctgggattccctgtccctaagccggagttgatctcccagctggagcaggggaaggaactttgggtcctgaatcttctgggagctgaggaaccagatatcttgaaaagctgccagaaagattctgaggttgggaccaagaaggaactatctattttaaaccaaaaattttccgaagaagtaaaaaccccagaatttgtatcaagaagactcttaagggataatgcacaggccgctgagtttcgggaagcatggggccgtgagggcaaactcaaagagcgcgtgggaaattctgccgggcagagtttgaacaaacccaatattcacaagagagttttaacagaagctaccgtgggcagggaaagatctttgggagaaagaacccaagagtgtagtgcatttgatagaaacttgaatctggaccaaaatgttgttagacttcaaagaaataaaacaggagagagggtctttaaatgtgatatatgcagcaaaaccttcaaatataattcagacctaagtagacaccagagaagtcacactggggagaagccgtacgaatgtggccggtgtgggcgagcctttactcacagctcaaatcttgttctgcaccatcacattcacactggaaataaaccatttaaatgtgatgaatgtgggaaaacttttggactcaattctcacctccgtcttcatcggagaattcacactggagaaaaaccctttggctgtggtgagtgtgggaaggctttcagtcgaagctcaactcttattcaacatcggatcattcacacaggagagaaaccctacaagtgtaatgaatgtggaagaggctttagccagagcccccagttaactcagcatcagagaattcacactggagagaagccgcatgaatgcagtcactgtgggaaggccttcagtcgaagctccagccttattcagcatgagagaattcacactggagagaagccccataaatgcaatcagtgtgggaaggccttcagtcagagctcaagccttttcctccatcatcgggttcatactggagagaaaccctatgtatgtaatgaatgcggcagagcctttggttttaactctcatcttactgaacacgtaaggattcacacaggagaaaaaccctatgtttgtaatgagtgcggcaaagcctttcgtcggagttccactcttgttcagcatcgaagagttcacactggggagaagccctaccagtgcgttgaatgtgggaaagctttcagccagagctcccagctcaccctacatcagcgagttcacactggagagaagccctatgactgtggtgactgtgggaaggccttcagccggaggtcaaccctcattcagcatcagaaagttcacagcggagagactcgtaagtgcagaaaacatggtccagcctttgttcatggctccagcctcacagcagatggacagattcccactggagagaagcacggcagagcctttaaccatggtgcaaatctcattctgcgctggacagttcacactggtgagaaatcctttggatgtaatgaatatggaaaagctttcagtcccacctcacgacccactgaagatcagataatgcatgctggggaaaagccctataaatgtcaagaatgtggaaacgccttcagtggaaagtcaacccttattcaacatcaggtaactcacactggtcagaaaccatgtcattgcagtgtgtatgggaaagccttcagccagagttcacagctcacaccacctcagcagactcgtgttggagagaaacctgctttaaatgatggctctaaaagatactttattcatatcaagaagattttccaagaaagacatttttaatgtgataaatgcagaagacagtttagcaactgttcacttgacattagaagataagatggcataatgaaagatatataaggtctaaatattactggcaaagtaaaataaatagttcagatgactactaaagtcaaagtcattaaatctggaagtaaacacgagaattcattctgggaaatcaggctgtctgtgtaaaggttactgctgtgctcaggagttgaaccgtgtggtgctgtatccggatactcatgacgaatggatggagggcgtgaaaagtgagcccagctggtgctctgggtctaccctacctgacatccttccagtcttatcctttgtttcctatccaggcccaggcttgtggctgagaacatccactttcagtcccatatacctgcctccaagtgtggtacagagaacttgggcctgctgggggcgcttagccttactctctccaccacctctcccaccaacccccagatgaactgcaggtagacgtttcttccttgcttggagccccagtttttgcatttcattttcattaaaatgaaaggtggtttggttttggttctaaggagctctacagtttaacagagagagggaccttaggggccaagaaagcaggggcctaccaagtatctccacttttgaaaattgtaattactgataaaaaattttttaaaggcaggtttattgaagcataatttataaacaataaaatttactcttttta

SEQ ID NO: 445510 - DNA, 3012 bp, Homo sapiens
aggcgtactgaggccccgcagggggcggggaagcctgcgtgtgcgcagctcggcccggcccgccctcttcatcctagcccgccccctccccggctctggacccggttctgtgggagggtccgttccgggctcggtgcgactgcgcagctcctcggcgcttcctcggtggcttccccgggtcgagcaaacaggtaagttcggggagacttcaggccagggcagtctcctgtcttctcttggaaaccacagcagcccatgcacacagaatggcagccacattccagcttccagggcaccaggagatgccgctgaccttccaggatgtggccgtgtacttctctcaggcggaggggcggcagctgggcccccagcagcgggcgctctaccgggatgtgatgctggagaactatgggaacgtggcctctctgggattccctgtccctaagccggagttgatctcccagctggagcaggggaaggaactttgggtcctgaatcttctgggagctgaggaaccagatatcttgaaaagctgccagaaagattctgaggttgggaccaagaaggaactatctattttaaaccaaaaattttccgaagaagtaaaaaccccagaatttgtatcaagaagactcttaagggataatgcacaggccgctgagtttcgggaagcatggggccgtgagggcaaactcaaagagcgcgtgggaaattctgccgggcagagtttgaacaaacccaatattcacaagagagttttaacagaagctaccgtgggcagggaaagatctttgggagaaagaacccaagagtgtagtgcatttgatagaaacttgaatctggaccaaaatgttgttagacttcaaagaaataaaacaggagagagggtctttaaatgtgatatatgcagcaaaaccttcaaatataattcagacctaagtagacaccagagaagtcacactggggagaagccgtacgaatgtggccggtgtgggcgagcctttactcacagctcaaatcttgttctgcaccatcacattcacactggaaataaaccatttaaatgtgatgaatgtgggaaaacttttggactcaattctcacctccgtcttcatcggagaattcacactggagaaaaaccctttggctgtggtgagtgtgggaaggctttcagtcgaagctcaactcttattcaacatcggatcattcacacaggagagaaaccctacaagtgtaatgaatgtggaagaggctttagccagagcccccagttaactcagcatcagagaattcacactggagagaagccgcatgaatgcagtcactgtgggaaggccttcagtcgaagctccagccttattcagcatgagagaattcacactggagagaagccccataaatgcaatcagtgtgggaaggccttcagtcagagctcaagccttttcctccatcatcgggttcatactggagagaaaccctatgtatgtaatgaatgcggcagagcctttggttttaactctcatcttactgaacacgtaaggattcacacaggagaaaaaccctatgtttgtaatgagtgcggcaaagcctttcgtcggagttccactcttgttcagcatcgaagagttcacactggggagaagccctaccagtgcgttgaatgtgggaaagctttcagccagagctcccagctcaccctacatcagcgagttcacactggagagaagccctatgactgtggtgactgtgggaaggccttcagccggaggtcaaccctcattcagcatcagaaagttcacagcggagagactcgtaagtgcagaaaacatggtccagcctttgttcatggctccagcctcacagcagatggacagattcccactggagagaagcacggcagagcctttaaccatggtgcaaatctcattctgcgctggacagttcacactggtgagaaatcctttggatgtaatgaatatggaaaagctttcagtcccacctcacgacccactgaagatcagataatgcatgctggggaaaagccctataaatgtcaagaatgtggaaacgccttcagtggaaagtcaacccttattcaacatcaggtaactcacactggtcagaaaccatgtcattgcagtgtgtatgggaaagccttcagccagagttcacagctcacaccacctcagcagactcgtgttggagagaaacctgctttaaatgatggctctaaaagatactttattcatatcaagaagattttccaagaaagacatttttaatgtgataaatgcagaagacagtttagcaactgttcacttgacattagaagataagatggcataatgaaagatatataaggtctaaatattactggcaaagtaaaataaatagttcagatgactactaaagtcaaagtcattaaatctggaagtaaacacgagaattcattctgggaaatcaggctgtctgtgtaaaggttactgctgtgctcaggagttgaaccgtgtggtgctgtatccggatactcatgacgaatggatggagggcgtgaaaagtgagcccagctggtgctctgggtctaccctacctgacatccttccagtcttatcctttgtttcctatccaggcccaggcttgtggctgagaacatccactttcagtcccatatacctgcctccaagtgtggtacagagaacttgggcctgctgggggcgcttagccttactctctccaccacctctcccaccaacccccagatgaactgcaggtagacgtttcttccttgcttggagccccagtttttgcatttcattttcattaaaatgaaaggtggtttggttttggttctaaggagctctacagtttaacagagagagggaccttaggggccaagaaagcaggggcctaccaagtatctccacttttgaaaattgtaattactgataaaaaattttttaaaggcaggtttattgaagcataatttataaacaataaaatttactcttttta

SEQ ID NO: 445511 - DNA, 3195 bp, Homo sapiens
aggcgtactgaggccccgcagggggcggggaagcctgcgtgtgcgcagctcggcccggcccgccctcttcatcctagcccgccccctccccggctctggacccggttctgtgggagggtccgttccgggctcggtgcgactgcgcagctcctcggcgcttcctcggtggcttccccgggtcgagcaaacaggtggggcagtgtcggaccaggaaggagcgccaagcgggcaggcaggcggggagggcgcggggagggcgcggggaggcggcggccagtccaggaggagcctgttctgggtgccgcgggagccaccgacgggctgcagaggccgggaggaggcgaccgcggcgcggccctagaaggctggactgaggaccacagctggcttccggcctctccccggagcctggggccttcggcagcatccccgcggcctccttctcacgtcctcagccttggtgaggctgcaccctcacgtggctctttgccccaggttggccaggcaggtagaacggccctgcaccccatttccagggccttcagcaggtctggaccacgggaactgccagctttcaccccttagccgggcgtccctggatccccccgggctctggctctggccgttctgggatttcaggagtcactgagcagtagggcacgtcggcccgtgctgcatagtgacctgcctcccgcgacccaggaggccacagcagcaatcagcttctgcctcctggccatccttccacacccctggttgaatggggctgagcctgagttctccccactgaaggtaagttcggggagacttcaggccagggcagtctcctgtcttctcttggaaaccacagcagcccatgcacacagaatggcagccacattccagcttccagggcaccaggagatgccgctgaccttccaggatgtggccgtgtacttctctcaggcggaggggcggcagctgggcccccagcagcgggcgctctaccgggatgtgatgctggagaactatgggaacgtggcctctctgggattccctgtccctaagccggagttgatctcccagctggagcaggggaaggaactttgggtcctgaatcttctgggagctgaggaaccagatatcttgaaaagctgccagaaagattctgaggttgggaccaagaaggaactatctattttaaaccaaaaattttccgaagaagtaaaaaccccagaatttgtatcaagaagactcttaagggataatgcacaggccgctgagtttcgggaagcatggggccgtgagggcaaactcaaagagcgcgtgggaaattctgccgggcagagtttgaacaaacccaatattcacaagagagttttaacagaagctaccgtgggcagggaaagatctttgggagaaagaacccaagagtgtagtgcatttgatagaaacttgaatctggaccaaaatgttgttagacttcaaagaaataaaacaggagagagggtctttaaatgtgatatatgcagcaaaaccttcaaatataattcagacctaagtagacaccagagaagtcacactggggagaagccgtacgaatgtggccggtgtgggcgagcctttactcacagctcaaatcttgttctgcaccatcacattcacactggaaataaaccatttaaatgtgatgaatgtgggaaaacttttggactcaattctcacctccgtcttcatcggagaattcacactggagaaaaaccctttggctgtggtgagtgtgggaaggctttcagtcgaagctcaactcttattcaacatcggatcattcacacaggagagaaaccctacaagtgtaatgaatgtggaagaggctttagccagagcccccagttaactcagcatcagagaattcacactggagagaagccgcatgaatgcagtcactgtgggaaggccttcagtcgaagctccagccttattcagcatgagagaattcacactggagagaagccccataaatgcaatcagtgtgggaaggccttcagtcagagctcaagccttttcctccatcatcgggttcatactggagagaaaccctatgtatgtaatgaatgcggcagagcctttggttttaactctcatcttactgaacacgtaaggattcacacaggagaaaaaccctatgtttgtaatgagtgcggcaaagcctttcgtcggagttccactcttgttcagcatcgaagagttcacactggggagaagccctaccagtgcgttgaatgtgggaaagctttcagccagagctcccagctcaccctacatcagcgagttcacactggagagaagccctatgactgtggtgactgtgggaaggccttcagccggaggtcaaccctcattcagcatcagaaagttcacagcggagagactcgtaagtgcagaaaacatggtccagcctttgttcatggctccagcctcacagcagatggacagattcccactggagagaagcacggcagagcctttaaccatggtgcaaatctcattctgcgctggacagttcacactggtgagaaatcctttggatgtaatgaatatggaaaagctttcagtcccacctcacgacccactgaagatcagataatgcatgctggggaaaagccctataaatgtcaagaatgtggaaacgccttcagtggaaagtcaacccttattcaacatcaggtaactcacactggtcagaaaccatgtcattgcagtgtgtatgggaaagccttcagccagagttcacagctcacaccacctcagcagactcgtgttggagagaaacctgctttaaatgatggctctaaaagatactttattcatatcaagaagattttccaagaaagacatttttaatgtgataaatgcagaagacagtttagcaactgttcacttgacattagaagataagatggcataatgaaagatatataaggtctaaatattactggcaaagtaaaataaatagttcagatgactactaaagtcaaagtcattaaatctggaagtaaacacgagaattcattctgggaaatcaggctgtctgtgtaaaggttactgctgtgctcaggagttgaaccgtgtggtgctgtatccggatactcagatgactactaaagtcaaagtcattaaatctggaagtaaacacgagaattcattctgggaaat

SEQ ID NO: 445512 - DNA, 1104 bp, Homo sapiens
tacgtgactcaggaaagggtggaagggggtgaggataaaagattacaaattgggttcagtgtatactactcggcgatggttgcaccaaaatctcacgacccactgaagatcagataatgcatgctggggaaaagccctataaatgtcaagaatgtggaaacgccttcagtggaaagtcaacccttattcaacatcaggtaactcacactggtcagaaaccatgtcattgcagtgtgtatgggaaagccttcagccagagttcacagctcacaccacctcagcagactcgtgttggagagaaacctgctttaaatgatggctctaaaagatactttattcatatcaagaagattttccaagaaagacatttttaatgtgataaatgcagaagacagtttagcaactgttcacttgacattagaagataagatggcataatgaaagatatataaggtctaaatattactggcaaagtaaaataaatagttcagatgactactaaagtcaaagtcattaaatctggaagtaaacacgagaattcattctgggaaatcaggctgtctgtgtaaaggttactgctgtgctcaggagttgaaccgtgtggtgctgtatccggatactcatgacgaatggatggagggcgtgaaaagtgagcccagctggtgctctgggtctaccctacctgacatccttccagtcttatcctttgtttcctatccaggcccaggcttgtggctgagaacatccactttcagtcccatatacctgcctccaagtgtggtacagagaacttgggcctgctgggggcgcttagccttactctctccaccacctctcccaccaacccccagatgaactgcaggtagacgtttcttccttgcttggagccccagtttttgcatttcattttcattaaaatgaaaggtggtttggttttggttctaaggagctctacagtttaacagagagagggaccttaggggccaagaaagcaggggcctaccaagtatctccacttttgaaaattgtaattactgataaaaaattttttaaaggcaggtttattgaagcataatttataaacaataaaatttactcttttta

SEQ ID NO: 445513 - DNA, 1373 bp, Homo sapiens
aggcgtactgaggccccgcagggggcggggaagcctgcgtgtgcgcagctcggcccggcccgccctcttcatcctagcccgccccctccccggctctggacccggttctgtgggagggtccgttccgggctcggtgcgactgcgcagctcctcggcgcttcctcggtggcttccccgggtcgagcaaacaggtggggcagtgtcggaccaggaaggagcgccaagcgggcaggcaggcggggagggcgcggggagggcgcggggaggcggcggccagtccaggaggagcctgttctgggtgccgcgggagccaccgacgggctgcagaggccgggaggaggcgaccgcggcgcggccctagaaggctggactgaggaccacagctggcttccggcctctccccggagcctggggccttcggcagcatccccgcggcctccttctcacgtcctcagccttggtgaggctgcaccctcacgtggctctttgccccaggttggccaggcaggtagaacggccctgcaccccatttccagggccttcagcaggtctggaccacgggaactgccagctttcaccccttagccgggcgtccctggatccccccgggctctggctctggccgttctgggatttcaggagtcactgagcagtagggcacgtcggcccgtgctgcatagtgacctgcctcccgcgacccaggaggccacagcagcaatcagcttctgcctcctggccatccttccacacccctggttgaatggggctgagcctgagttctccccactgaaggtaagttcggggagacttcaggccagggcagtctcctgtcttctcttggaaaccacagcagcccatgcacacagaatggcagccacattccagcttccagggcaccaggagatgccgctgaccttccaggatgtggccgtgtacttctctcaggcggaggggcggcagctgggcccccagcagcgggcgctctaccgggatgtgatgctggagaactatgggaacgtggcctctctgggattccctgtccctaagccggagttgatctcccagctggagcaggggaaggaactttgggtcctgaatcttctgggagctgaggaaccagatatcttgaaaagctgccagaaaggtgagaatggatgggatgctaatcctgggagcagcctcccaatcctgccttaagaggctccaagcgagggacagctggggcatggcgttcatattaatggcctcccccaggggcagtctcacagatacagcccctctacaaatgtgagcatgtgcacatgctttagaagttttatcttgctggtctgtttctttgctttaaaaatatatatatactacttctgatcata

SEQ ID NO: 445514 - DNA, 400 bp, Homo sapiens
gtgtatagttctttgggctttgacaaaaacatacaattgtgccactaccacattccagacattgaacatcttcaccaccacccagaattcctttgtgctctcttgtggttaacccctcctcaaccccagtccgtggaaaccactggtttgttttctatcctctatccatcacctcaccatttccagaaatagtgtgcagctgtttgcacgtggctgcttttactgaacatgatgcattggagtcatccatattgcctgtgtggagtgcttttttgcaccgagtagcattccattgtatggatggagccatttgtttatccgttcacccatggcagggtatttgggcattttcagtatgggcaactatgattaaagctgccatcactgtgtatcaactaca

SEQ ID NO: 445515 - DNA, 2405 bp, Homo sapiens
aggcgtactgaggccccgcagggggcggggaagcctgcgtgtgcgcagctcggcccggcccgccctcttcatcctagcccgccccctccccggctctggacccggttctgtgggagggtccgttccgggctcggtgcgactgcgcagctcctcggcgcttcctcggtggcttccccgggtcgagcaaacaggtaagttcggggagacttcaggccagggcagtctcctgtcttctcttggaaaccacagcagcccatgcacacagaatggcagccacattccagcttccagggcaccaggagatgccgctgaccttccaggatgtggccgtgtacttctctcaggcggaggggcggcagctgggcccccagcagcgggcgctctaccgggatgtgatgctggagaactatgggaacgtggcctctctgggattccctgtccctaagccggagttgatctcccagctggagcaggggaaggaactttgggtcctgaatcttctgggagctgaggaaccagatatcttgaaaagctgccagaaagattctgaggttgggaccaagaaggaactatctattttaaaccaaaaattttccgaagaagtaaaaaccccagaatttgtatcaagaagactcttaagggataatgcacaggccgctgagtttcgggaagcatggggccgtgagggcaaactcaaagagcgcgtgggaaattctgccgggcagagtttgaacaaacccaatattcacaagagagttttaacagaagctaccgtgggcagggaaagatctttgggagaaagaacccaagagtgtagtgcatttgatagaaacttgaatctggaccaaaatgttgttagacttcaaagaaataaaacaggagagagggtctttaaatgtgatatatgcagcaaaaccttcaaatataattcagacctaagtagacaccagagaagtcacactggggagaagccgtacgaatgtggccggtgtgggcgagcctttactcacagctcaaatcttgttctgcaccatcacattcacactggaaataaaccatttaaatgtgatgaatgtgggaaaacttttggactcaattctcacctccgtcttcatcggagaattcacactggagaaaaaccctttggctgtggtgagtgtgggaaggctttcagtcgaagctcaactcttattcaacatcggatcattcacacaggagagaaaccctacaagtgtaatgaatgtggaagaggctttagccagagcccccagttaactcagcatcagagaattcacactggagagaagccgcatgaatgcagtcactgtgggaaggccttcagtcgaagctccagccttattcagcatgagagaattcacactggagagaagccccataaatgcaatcagtgtgggaaggccttcagtcagagctcaagccttttcctccatcatcgggttcatactggagagaaaccctatgtatgtaatgaatgcggcagagcctttggttttaactctcatcttactgaacacgtaaggattcacacaggagaaaaaccctatgtttgtaatgagtgcggcaaagcctttcgtcggagttccactcttgttcagcatcgaagagttcacactggggagaagccctaccagtgcgttgaatgtgggaaagctttcagccagagctcccagctcaccctacatcagcgagttcacactggagagaagccctatgactgtggtgactgtgggaaggccttcagccggaggtcaaccctcattcagcatcagaaagttcacagcggagagactcgtaagtgcagaaaacatggtccagcctttgttcatggctccagcctcacagcagatggacagattcccactggagagaagcacggcagagcctttaaccatggtgcaaatctcattctgcgctggacagttcacactggtgagaaatcctttggatgtaatgaatatggaaaagctttcagtcccacctcacgacccactgaagatcagataatgcatgctggggaaaagccctataaatgtcaagaatgtggaaacgccttcagtggaaagtcaacccttattcaacatcaggtaactcacactggtcagaaaccatgtcattgcagtgtgtatgggaaagccttcagccagagttcacagctcacaccacctcagcagactcgtgttggagagaaacctgctttaaatgatggctctaaaagatactttattcatatcaagaagattttccaagaaagacatttttaatgtgataaatgcagaagacagtttagcaactgttcacttgacattagaagataagatggcataatgaaagatatataaggtctaaatattactggcaaagtaaaataaatagttcagatgact

SEQ ID NO: 445516 - DNA, 399 bp, Homo sapiens
gcccaagaattcggcacgagggatgctggagaactatgggaacgtggcctctctgggattccctgtccctaagccggagttgatctcccagctggagcaggggaaggaactttgggtcctgaatcttctgggagctgaggaaccagatatcttgaaaagctgccagaaaggtgagaatggatgggatgctaatcctgggagcagcctcccaatcctgccttaagaggctccaagcgagggacagctggggcatggcgttcatattaatggcctcccccaggggcagtctcacagatacagcccctctacaaatgtgagcatgtgcacatgctttagaagttttatcttgctggtctgtttctttgctttaaaaatatatatatactacttctgatcata

SEQ ID NO: 445517 - DNA, 426 bp, Homo sapiens
aggcgtactgaggccccgcagggggcggggaagcctgcgtgtgcgcagctcggcccggcccgccctcttcatcctagcccgccccctccccggctctggacccggttctgtgggagggtccgttccgggctcggtgcgactgcgcagctcctcggcgcttcctcggtggcttccccgggtcgagcaaacaggagatgccgctgaccttccaggatgtggccgtgtacttctctcaggcggaggggcggcagctgggcccccagcagcgggcgctctaccgggatgtgatgctggagaactatgggaacgtggcctctctggctaccaagtatctccacttttgaaaattgtaattactgataaaaaattttttaaaggcaggtttattgaagcataatttataaacaataaaatttactcttttta

SEQ ID NO: 445518 - DNA, 3521 bp, Homo sapiens
aggcgtactgaggccccgcagggggcggggaagcctgcgtgtgcgcagctcggcccggcccgccctcttcatcctagcccgccccctccccggctctggacccggttctgtgggagggtccgttccgggctcggtgcgactgcgcagctcctcggcgcttcctcggtggcttccccgggtcgagcaaacaggtggggcagtgtcggaccaggaaggagcgccaagcgggcaggcaggcggggagggcgcggggagggcgcggggaggcggcggccagtccaggaggagcctgttctgggtgccgcgggagccaccgacgggctgcagaggccgggaggaggcgaccgcggcgcggccctagaaggctggactgaggaccacagctggcttccggcctctccccggagcctggggccttcggcagcatccccgcggcctccttctcacgtcctcagccttggtgaggctgcaccctcacgtggctctttgccccaggttggccaggcaggtagaacggccctgcaccccatttccagggccttcagcaggtctggaccacgggaactgccagctttcaccccttagccgggcgtccctggatccccccgggctctggctctggccgttctgggatttcaggagtcactgagcagtagggcacgtcggcccgtgctgcatagtgacctgcctcccgcgacccaggaggccacagcagcaatcagcttctgcctcctggccatccttccacacccctggttgaatggggctgagcctgagttctccccactgaaggtaagttcggggagacttcaggccagggcagtctcctgtcttctcttggaaaccacagcagcccatgcacacagaatggcagccacattccagcttccagggcaccaggagatgccgctgaccttccaggatgtggccgtgtacttctctcaggcggaggggcggcagctgggcccccagcagcgggcgctctaccgggatgtgatgctggagaactatgggaacgtggcctctctgggattccctgtccctaagccggagttgatctcccagctggagcaggggaaggaactttgggtcctgaatcttctgggagctgaggaaccagatatcttgaaaagctgccagaaagattctgaggttgggaccaagaaggaactatctattttaaaccaaaaattttccgaagaagtaaaaaccccagaatttgtatcaagaagactcttaagggataatgcacaggccgctgagtttcgggaagcatggggccgtgagggcaaactcaaagagcgcgtgggaaattctgccgggcagagtttgaacaaacccaatattcacaagagagttttaacagaagctaccgtgggcagggaaagatctttgggagaaagaacccaagagtgtagtgcatttgatagaaacttgaatctggaccaaaatgttgttagacttcaaagaaataaaacaggagagagggtctttaaatgtgatatatgcagcaaaaccttcaaatataattcagacctaagtagacaccagagaagtcacactggggagaagccgtacgaatgtggccggtgtgggcgagcctttactcacagctcaaatcttgttctgcaccatcacattcacactggaaataaaccatttaaatgtgatgaatgtgggaaaacttttggactcaattctcacctccgtcttcatcggagaattcacactggagaaaaaccctttggctgtggtgagtgtgggaaggctttcagtcgaagctcaactcttattcaacatcggatcattcacacaggagagaaaccctacaagtgtaatgaatgtggaagaggctttagccagagcccccagttaactcagcatcagagaattcacactggagagaagccgcatgaatgcagtcactgtgggaaggccttcagtcgaagctccagccttattcagcatgagagaattcacactggagagaagccccataaatgcaatcagtgtgggaaggccttcagtcagagctcaagccttttcctccatcatcgggttcatactggagagaaaccctatgtatgtaatgaatgcggcagagcctttggttttaactctcatcttactgaacacgtaaggattcacacaggagaaaaaccctatgtttgtaatgagtgcggcaaagcctttcgtcggagttccactcttgttcagcatcgaagagttcacactggggagaagccctaccagtgcgttgaatgtgggaaagctttcagccagagctcccagctcaccctacatcagcgagttcacactggagagaagccctatgactgtggtgactgtgggaaggccttcagccggaggtcaaccctcattcagcatcagaaagttcacagcggagagactcgtaagtgcagaaaacatggtccagcctttgttcatggctccagcctcacagcagatggacagattcccactggagagaagcacggcagagcctttaaccatggtgcaaatctcattctgcgctggacagttcacactggtgagaaatcctttggatgtaatgaatatggaaaagctttcagtcccacctcacgacccactgaagatcagataatgcatgctggggaaaagccctataaatgtcaagaatgtggaaacgccttcagtggaaagtcaacccttattcaacatcaggtaactcacactggtcagaaaccatgtcattgcagtgtgtatgggaaagccttcagccagagttcacagctcacaccacctcagcagactcgtgttggagagaaacctgctttaaatgatggctctaaaagatactttattcatatcaagaagattttccaagaaagacatttttaatgtgataaatgcagaagacagtttagcaactgttcacttgacattagaagataagatggcataatgaaagatatataaggtctaaatattactggcaaagtaaaataaatagttcagatgactactaaagtcaaagtcattaaatctggaagtaaacacgagaattcattctgggaaatcaggctgtctgtgtaaaggttactgctgtgctcaggagttgaaccgtgtggtgctgtatccggatactcatgacgaatggatggagggcgtgaaaagtgagcccagctggtgctctgggtctaccctacctgacatccttccagtcttatccctgctgggggcgcttagccttactctctccaccacctctcccaccaacccccagatgaactgcaggtagacgtttcttccttgcttggagccccagtttttgcatttcattttcattaaaatgaaaggtggtttggttttggttctaaggagctctacagtttaacagagagagggaccttaggggccaagaaagcaggggcctaccaagtatctccacttttgaaaattgtaattactgataaaaaattttttaaaggcaggtttattgaagcataatttataaacaataaaatttactcttttta

SEQ ID NO: 445519 - DNA, 2350 bp, Homo sapiens
aggcgtactgaggccccgcagggggcggggaagcctgcgtgtgcgcagctcggcccggcccgccctcttcatcctagcccgccccctccccggctctggacccggttctgtgggagggtccgttccgggctcggtgcgactgcgcagctcctcggcgcttcctcggtggcttccccgggtcgagcaaacaggtggggcagtgtcggaccaggaaggagcgccaagcgggcaggcaggcggggagggcgcggggagggcgcggggaggcggcggccagtccaggaggagcctgttctgggtgccgcgggagccaccgacgggctgcagaggccgggaggaggcgaccgcggcgcggccctagaaggctggactgaggaccacagctggcttccggcctctccccggagcctggggccttcggcagcatccccgcggcctccttctcacgtcctcagccttggtgaggctgcaccctcacgtggctctttgccccaggttggccaggcaggtagaacggccctgcaccccatttccagggccttcagcaggtctggaccacgggaactgccagctttcaccccttagccgggcgtccctggatccccccgggctctggctctggccgttctgggatttcaggagtcactgagcagtagggcacgtcggcccgtgctgcatagtgacctgcctcccgcgacccaggaggccacagcagcaatcagcttctgcctcctggccatccttccacacccctggttgaatggggctgagcctgagttctccccactgaaggtaagttcggggagacttcaggccagggcagtctcctgtcttctcttggaaaccacagcagcccatgcacacagaatggcagccacattccagcttccagggcaccaggagatgccgctgaccttccaggatgtggccgtgtacttctctcaggcggaggggcggcagctgggcccccagcagcgggcgctctaccgggatgtgatgctggagaactatgggaacgtggcctctctgggattccctgtccctaagccggagttgatctcccagctggagcaggggaaggaactttgggtcctgaatcttctgggagctgaggaaccagatatcttgaaaagctgccagaaagattctgaggttgggaccaagaaggaactatctattttaaaccaaaaattttccgaagaagtaaaaaccccagaatttgtatcaagaagactcttaagggataatgcacaggccgctgagtttcgggaagcatggggccgtgagggcaaactcaaagagcgcgtgggaaattctgccgggcagagtttgaacaaacccaatattcacaagagagttttaacagaagctaccgtgggcagggaaagatctttgggagaaagaacccaagagtgtagtgcatttgatagaaacttgaatctggaccaaaatgttgttagacttcaaagaaataaaacaggagagagggtctttaaatgtgatatatgcagcaaaaccttcaaatataattcagacctaagtagacaccagagaagtcacactggggagaagccgtacgaatgtggccggtgtgggcgagcctttactcacagctcaaatcttgttctgcaccatcacattcacactggaaataaaccatttaaatgtgatgaatgtgggaaaacttttggactcaattctcacctccgtcttcatcggagaattcacactggagaaaaaccctttggctgtggtgagtgtgggaaggctttcagtcgaagctcaactcttattcaacatcggatcattcacacaggagagaaaccctacaagtgtaatgaatgtggaagaggctttagccagagcccccagttaactcagcatcagagaattcacactggagagaagccgcatgaatgcagtcactgtgggaaggccttcagtcgaagctccagccttattcagcatgagagaattcacactggagagaagccccataaatgcaatcagtgtgggaaggccttcagtcagagctcaagccttttcctccatcatcgggttcatactggagagaaaccctatgtatgtaatgaatgcggcagagcctttggttttaactctcatcttactgaacacgtaaggattcacacaggagaaaaaccctatgtttgtaatgagtgcgtccgtcgaagtctatttcgacgaccattcaggctactttgggaaagttggtatgaagcattaccacttaaagaggaaccagagcttctgcccaactgtcaaccttgacaaattgtggacttgtcagtgaacagacacgggtgaatgctccggaggatctatagatcac

SEQ ID NO: 445520 - DNA, 701 bp, Homo sapiens
gcaattctcctgcctcagtctcccgagtagctgggactcaagcacacaccaccatgcccagctaatttttgtgtttttattcgagacgaggtttcaccatattggccaggctggtctcgaactcctgagctcgtgatacgcccgcttcggcctcccaaaatgctgggattacaggtgtgaaccgctgcacccagcccaccatctcattttattaaagggaaattaaagcacaaggaaatacagaccatgactgacaggttagagccactagatttctgtctgcagccacagatcttccttcccaggcatccactgcctgcagctagagagtctagtctgtgttcctcacaacaccattatcagatggggtccctcagatggtgagatgcacaagccactggcatgtcacttagactctgcccaatttggacaaattttatcaaactctggttgtgtttcatttgctggttcattataaggatattacaaaggatatagatgaagagatgtagtgggtgagatatgggggaaagggagcagagattccatgccctccctaggtatgcatgctacccctctaggaacctccacatgttcacctatctggaagcttttattttttttttttgagacggagtttcgctcttgttgcgaggctggagtgcaatggcataatctcggctcactgtaacctccacctc

SEQ ID NO: 445521 - DNA, 656 bp, Homo sapiens
agctccccgcgggggcggcccgtttaaaaataatggatcccccgggtgcaaggaattgggcaggagccgccacacgcacgccgggcgtgccagtttataaagggagagagcaagcagcgagtcttgaagctctgtttggtgctttggatccatttccatcggtccttacagccgctcgtcagactccagcagccaagatggtgaagcagatcgagagcaagactgcttttcaggaagccttggacgctgcaggtgataaacttgtagtagttgacttctcagccacgtggtgtgggccttgcaaaatgatcaagcctttctttcattccctctctgaaaagtattccaacgtgatattccttgaagtagatgtggatgactgtcaggatgttgcttcagagtgtgaagtcaaatgcatgccaacattccagttttttaagaagggacaaaaggtgggtgaattttctggagccaataaggaaaagcttgaagccaccattaatgaattagtctaatcatgttttctgaaaacataaccagccattggctatttaaaacttgtaatttttttaatttacaaaaatataaaatatgaagacataaacccagttgccatctgcgtgacaataaaacattaatgctaacactttttaaaa

SEQ ID NO: 445522 - DNA, 321 bp, Homo sapiens
ctttctccatatctaacataactacacgacccgcccggaggaaaatcttgagatgttgcttcagagtgtgaagtcaaatgcatgccaacattccagttttttaagaagggacaaaaggtgggtgaattttctggagccaataaggaaaagcttgaagccaccattaatgaattagtctaatcatgttttctgaaaacataaccagccattggctatttaaaacttgtaatttttttaatttacaaaaatataaaatatgaagacataaacccagttgccatctgcgtgacaataaaacattaatgctaacactttttaaaa

SEQ ID NO: 445523 - DNA, 545 bp, Homo sapiens
ctgatgctagtaacattctgaacattctgcctgttaatgtgcccgtcaaaggaagtaaatattaataaaacttcttcattgagaatataaccggtttggcttttgtaatgccattatattcattatattaattttcatatgctgaaaaatgtcctcatgcggaaatgtggggtacatgacagggaaaagtttctggttttggattacttctgtcaaagctcagtactcgcagtcttgtatttaatcctctccctttgctactttccctaccaggagatgttgcttcagagtgtgaagtcaaatgcatgccaacattccagttttttaagaagggacaaaaggtgggtgaattttctggagccaataaggaaaagcttgaagccaccattaatgaattagtctaatcatgttttctgaaaacataaccagccattggctatttaaaacttgtaatttttttaatttacaaaaatataaaatatgaagacataaacccagttgccatctgcgtgacaataaaacattaatgctaacactttttaaaa

SEQ ID NO: 445524 - DNA, 348 bp, Homo sapiens
  misc_feature (45)..(45): n is a, c, g, or t
  misc_feature (64)..(64): n is a, c, g, or t
tgatttcatgctttttatatatactaaacatttacatatatcaanaaaaaaaaactcttaaggntagttcgcttccaagatgttgcttcagagtgtgaagtcaaatgcatgccaacattccagttttttaagaagggacaaaaggtgggtgaattttctggagccaataaggaaaagcttgaagccaccattaatgaattagtctaatcatgttttctgaaaacataaccagccattggctatttaaaacttgtaatttttttaatttacaaaaatataaaatatgaagacataaacccagttgccatctgcgtgacaataaaacattaatgctaacactttttaaaa

SEQ ID NO: 445525 - DNA, 338 bp, Homo sapiens
  misc_feature (54)..(54): n is a, c, g, or t
aaatggaaaacaccttactactgtgcaatatccacaccacacaaactcctgagntagttagccttcaagatgttgcttcagagtgtgaagtcaaatgcatgccaacattccagttttttaagaagggacaaaaggtgggtgaattttctggagccaataaggaaaagcttgaagccaccattaatgaattagtctaatcatgttttctgaaaacataaccagccattggctatttaaaacttgtaatttttttaatttacaaaaatataaaatatgaagacataaacccagttgccatctgcgtgacaataaaacattaatgctaacactttttaaaa

SEQ ID NO: 445526 - DNA, 332 bp, Homo sapiens
  misc_feature (38)..(38): n is a, c, g, or t
  misc_feature (59)..(59): n is a, c, g, or t
tgtccaccatctcccaccccgccaccccgcccggaganaatctttaggggagttccctncacgatgttgcttcagagtgtgaagtcaaatgcatgccaacattccagttttttaagaagggacaaaaggtgggtgaattttctggagccaataaggaaaagcttgaagccaccattaatgaattagtctaatcatgttttctgaaaacataaccagccattggctatttaaaacttgtaatttttttaatttacaaaaatataaaatatgaagacataaacccagttgccatctgcgtgacaataaaacattaatgctaacactttttaaaa

SEQ ID NO: 445527 - DNA, 335 bp, Homo sapiens
  misc_feature (39)..(39): n is a, c, g, or t
atcataaaattctttctcaaatattttataaaaaaaaancctatggagtaccttcacatgttttagatgttgcttcagagtgtgaagtcaaatgcatgccaacattccagttttttaagaagggacaaaaggtgggtgaattttctggagccaataaggaaaagcttgaagccaccattaatgaattagtctaatcatgttttctgaaaacataaccagccattggctatttaaaacttgtaatttttttaatttacaaaaatataaaatatgaagacataaacccagttgccatctgcgtgacaataaaacattaatgctaacactttttaaaa

SEQ ID NO: 445528 - DNA, 332 bp, Homo sapiens
  misc_feature (50)..(50): n is a, c, g, or t
  misc_feature (52)..(52): n is a, c, g, or t
tcgcacctattcttttcttatctgtcgtcacgattaattcgtaaaaaatnanaaaaaaaactgatgttgcttcagagtgtgaagtcaaatgcatgccaacattccagttttttaagaagggacaaaaggtgggtgaattttctggagccaataaggaaaagcttgaagccaccattaatgaattagtctaatcatgttttctgaaaacataaccagccattggctatttaaaacttgtaatttttttaatttacaaaaatataaaatatgaagacataaacccagttgccatctgcgtgacaataaaacattaatgctaacactttttaaaa

SEQ ID NO: 445529 - DNA, 327 bp, Homo sapiens
tacagtataatatttctccaccacacgaaaaagaagaaaaacgcttagttagttacagatgttgcttcagagtgtgaagtcaaatgcatgccaacattccagttttttaagaagggacaaaaggtgggtgaattttctggagccaataaggaaaagcttgaagccaccattaatgaattagtctaatcatgttttctgaaaacataaccagccattggctatttaaaacttgtaatttttttaatttacaaaaatataaaatatgaagacataaacccagttgccatctgcgtgacaataaaacattaatgctaacactttttaaaa

SEQ ID NO: 445530 - DNA, 325 bp, Homo sapiens
tccctcgaccgtccctgctcccctaaacaaaaaccaaaaaccacttaggagaaccgatgttgcttcagagtgtgaagtcaaatgcatgccaacattccagttttttaagaagggacaaaaggtgggtgaattttctggagccaataaggaaaagcttgaagccaccattaatgaattagtctaatcatgttttctgaaaacataaccagccattggctatttaaaacttgtaatttttttaatttacaaaaatataaaatatgaagacataaacccagttgccatctgcgtgacaataaaacattaatgctaacactttttaaaa

SEQ ID NO: 445531 - DNA, 375 bp, Homo sapiens
ctttctccatatctaacataactacacgacccgcccggaggaaaatcttgagatgttgcttcagagtgtgaagtcaaatgcatgccaacattccagttttttaagaagggacaaaaggtgggtgaattttctggagccaataaggaaaagcttgaagccaccattaatgaattagtctaatcatgttttctgaaaacataaccagccattggctatttaaaacttgtaatttttttaatttacaaaaatataaaatatgaagacataaacccagttgccatctgcgtgacaataaaacattaatgctaacactttttaaaaaaaaccgtctcatgtctgaatagctttcaaaataaatgtgaaatggtcatttaa

SEQ ID NO: 445532 - DNA, 375 bp, Homo sapiens
cgtattttccattaatttttatcccacaccttcaggtatgacgctctcaaagatgttgcttcagagtgtgaagtcaaatgcatgccaacattccagttttttaagaagggacaaaaggtgggtgaattttctggagccaataaggaaaagcttgaagccaccattaatgaattagtctaatcatgttttctgaaaacataaccagccattggctatttaaaacttgtaatttttttaatttacaaaaatataaaatatgaagacataaacccagttgccatctgcgtgacaataaaacattaatgctaacactttttaaaaaaaaccgtctcatgtctgaatagctttcaaaataaatgtgaaatggtcatttaa

SEQ ID NO: 445533 - DNA, 541 bp, Homo sapiens
ctttctccatatctaacataactacacgacccgcccggaggaaaatcttgagatgttgcttcagagtgtgaagtcaaatgcatgccaacattccagttttttaagaagggacaaaaggtgggtgaattttctggagccaataaggaaaagcttgaagccaccattaatgaattagtctaatcatgttttctgaaaacataaccagccattggctatttaaaacttgtaatttttttaatttacaaaaatataaaatatgaagacataaacccagttgccatctgcgtgacaataaaacattaatgctaacactttttaaaaaaaaccgtctcatgtctgaatagctttcaaaataaatgtgaaatggtcatttaatgtattttcctatattctcaatcactttttagtaaccttgtaggccactgattattttaagattttaaaaattattattgctaccttaatgtattgctacaaaaatctcttgttgggggcaatgcaggtaataaagtagtatgttgttatttgttatcttttgaca

SEQ ID NO: 445534 - DNA, 376 bp, Homo sapiens
gctccaggggcggggcgtggccggggcgcagcgacgggcgcggaggtccggccgggcgcgcgcgcccccgccacacgcacgccgggcgtgccagtttataaagggagagagcaagcagcgagtcttgaagctctgtttggtgctttggatccatttccatcggtccttacagccgctcgtcagactccagcagccaagatggtgaagcagatcgagagcaagactgcttttcaggaagccttggacgctgcaggtgataaacttgtagtagttgacttctcagccacgtggtgtgggccttgcaaaatgatcaagcctttctttcattccctctctgttgcttcagagtgtgaagtctgcatgcccattccgttct

SEQ ID NO: 445535 - DNA, 342 bp, Homo sapiens
atgctgaatacatatttatacatatgtatatatatacatatgtatatgtatatatataaatacatatttatacatattttatgtataaaacagtgctacagtgctacgtctaatgtcaattcaatattctcttaacaggtgggtgaattttctggagccaataaggaaaagcttgaagccaccattaatgaattagtctaatcatgttttctgaaaacataaccagccattggctatttaaaacttgtaatttttttaatttacaaaaatataaaatatgaagacataaacccagttgccatctgcgtgacaataaaacattaatgctaacactttttaaaa

SEQ ID NO: 445536 - DNA, 396 bp, Homo sapiens
atgctgaatacatatttatacatatgtatatatatacatatgtatatgtatatatataaatacatatttatacatattttatgtataaaacagtgctacagtgctacgtctaatgtcaattcaatattctcttaacaggtgggtgaattttctggagccaataaggaaaagcttgaagccaccattaatgaattagtctaatcatgttttctgaaaacataaccagccattggctatttaaaacttgtaatttttttaatttacaaaaatataaaatatgaagacataaacccagttgccatctgcgtgacaataaaacattaatgctaacactttttaaaaaaaaccgtctcatgtctgaatagctttcaaaataaatgtgaaatggtcatttaa

SEQ ID NO: 445537 - DNA, 431 bp, Homo sapiens
tactcaggaggctgaggcaagagaatcacttgaaccccggaggcaaaggttactgtgagccgagatcaggcctttgcactccagcctgggcaacaagtgaaactccgtctcaaaaacaaaacaaaacaaaaatgagtccttggtaactagaatattcggttcccagggttacagtatctagatagtaaataattcagggaagttagtggtaagagatttcttgatcatttctactgagaattttatttaacaagcattccttatgaaaaataatatctatgaaaaatttccttcatgaggaacgaaaactttcatttaatgaatgacaagggtatagttttaaaataaagggcaaaaatcaaaggttggtaaacgtgtgatctcagctctggaaaccccattatgcttatgtcacggtgatgtctgagtgt

SEQ ID NO: 445538 - DNA, 332 bp, Homo sapiens
tggctaaaaagtaggtcctgaaaggaggacctccagaatgtgctttgtgtcattgtgtcgagtctttcttttgaaggtttaatatttaactatttatttaatataagcttttcttttgctgttagactgcttttcaggaagccttggacgctgcaggtgataaacttgtagtagttgacttctcagccacgtggtgtgggccttgcaaaatgatcaagcctttctttcatatgtgagtattaaacaatgtctgctttgtaagagatttgtgttttttgagttggtggtcacagtggtaggaaagaaagacagttaaaggattttggtttcgg

SEQ ID NO: 445539 - DNA, 711 bp, Homo sapiens
gctccaggggcggggcgtggccggggcgcagcgacgggcgcggaggtccggccgggcgcgcgcgcccccgccacacgcacgccgggcgtgccagtttataaagggagagagcaagcagcgagtcttgaagctctgtttggtgctttggatccatttccatcggtccttacagccgctcgtcagactccagcagccaagatggtgaagcagatcgagagcaagactgcttttcaggaagccttggacgctgcaggtgataaacttgtagtagttgacttctcagccacgtggtgtgggccttgcaaaatgatcaagcctttctttcattccctctctgaaaagtattccaacgtgatattccttgaagtagatgtggatgactgtcaggatgttgcttcagagtgtgaagtcaaatgcatgccaacattccagttttttaagaagggacaaaaggtgggtgaattttctggagccaataaggaaaagcttgaagccaccattaatgaattagtctaatcatgttttctgaaaacataaccagccattggctatttaaaacttgtaatttttttaatttacaaaaatataaaatatgaagacataaacccagttgccatctgcgtgacaataaaacattaatgctaacactttttaaaaaaaaccgtctcatgtctgaatagctttcaaaataaatgtgaaatggtcatttaa

SEQ ID NO: 445540 - DNA, 900 bp, Homo sapiens
  misc_feature (682)..(682): n is a, c, g, or t
gctccaggggcggggcgtggccggggcgcagcgacgggcgcggaggtccggccgggcgcgcgcgcccccgccacacgcacgccgggcgtgccagtttataaagggagagagcaagcagcgagtcttgaagctctgtttggtgctttggatccatttccatcggtccttacagccgctcgtcagactccagcagccaagatggtgaagcagatcgagagcaagactgcttttcaggaagccttggacgctgcaggtgataaacttgtagtagttgacttctcagccacgtggtgtgggccttgcaaaatgatcaagcctttctttcattccctctctgaaaagtattccaacgtgatattccttgaagtagatgtggatgactgtcaggatgttgcttcagagtgtgaagtcaaatgcatgccaacattccagttttttaagaagggacaaaaggtgggtgaattttctggagccaataaggaaaagcttgaagccaccattaatgaattagtctaatcatgttttctgaaaacataaccagccattggctatttaaaacttgtaatttttttaatttacaaaaatataaaatatgaagacataaacccagttgccatctgcgtgacaataaaacattaatgctaacactttttaaaaaaaaacaacacgcaaaaaaaaaaanttgggggggggggttgggggctgggaaaagtttttaagacattttgtggtgggcgggggggccccagttgtgtttgtgcacttgtgccaaaggtgtgtccaaagggagaccttgggcactgcattaggggtgggttttcccaattaaaaacgcggggggaacccgggtgctggaagattccggtggtgtcggggtaggggtctcaagggccgggcgtt

SEQ ID NO: 445541 - DNA, 777 bp, Homo sapiens
  misc_feature (661)..(661): n is a, c, g, or t
gctccaggggcggggcgtggccggggcgcagcgacgggcgcggaggtccggccgggcgcgcgcgcccccgccacacgcacgccgggcgtgccagtttataaagggagagagcaagcagcgagtcttgaagctctgtttggtgctttggatccatttccatcggtccttacagccgctcgtcagactccagcagccaagatggtgaagcagatcgagagcaagactgcttttcaggaagccttggacgctgcaggtgataaacttgtagtagttgacttctcagccacgtggtgtgggccttgcaaaatgatcaagcctttctttcattccctctctgaaaagtattccaacgtgatattccttgaagtagatgtggatgactgtcaggatgttgcttcagagtgtgaagtcaaatgcatgccaacattccagttttttaagaagggacaaaaggtgggtgaattttctggagccaataaggaaaagcttgaagccaccattaatgaattagtctaatcatgttttctgaaaacataaccagccattggctatttaaaacttgtaatttttttaatttacaaaaatataaaatatgaagacataaacccagttgccatctgcgtgacaataaaacattaatgctaacactttttaaaaaaancacctcctcacatattcccccccgtcccccccagtctcctccgacacccacacactacatccaccctacacgctccagtcactcctctccctcctccccatatcccacagtccctc

SEQ ID NO: 445542 - DNA, 690 bp, Homo sapiens
gctccaggggcggggcgtggccggggcgcagcgacgggcgcggaggtccggccgggcgcgcgcgcccccgccacacgcacgccgggcgtgccagtttataaagggagagagcaagcagcgagtcttgaagctctgtttggtgctttggatccatttccatcggtccttacagccgctcgtcagactccagcagccaagatggtgaagcagatcgagagcaagactgcttttcaggaagccttggacgctgcaggtgataaacttgtagtagttgacttctcagccacgtggtgtgggccttgcaaaatgatcaagcctttctttcattccctctctgaaaagtattccaacgtgatattccttgaagtagatgtggatgactgtcaggatgttgcttcagagtgtgaagtcaaatgcatgccaacattccagttttttaagaagggacaaaaggtgggtgaattttctggagccaataaggaaaagcttgaagccaccattaatgaattagtctaatcatgttttctgaaaacataaccagccattggctatttaaaacttgtaatttttttaatttacaaaaatataaaatatgaagacataaacccagttgccatctgcgtgacaataaaacattaatgctaacactttttaaaaaaagtcgacgggccgctaatttagtagtagtag

SEQ ID NO: 445543 - DNA, 872 bp, Homo sapiens
gctccaggggcggggcgtggccggggcgcagcgacgggcgcggaggtccggccgggcgcgcgcgcccccgccacacgcacgccgggcgtgccagtttataaagggagagagcaagcagcgagtcttgaagctctgtttggtgctttggatccatttccatcggtccttacagccgctcgtcagactccagcagccaagatggtgaagcagatcgagagcaagactgcttttcaggaagccttggacgctgcaggtgataaacttgtagtagttgacttctcagccacgtggtgtgggccttgcaaaatgatcaagcctttctttcattccctctctgaaaagtattccaacgtgatattccttgaagtagatgtggatgactgtcaggatgttgcttcagagtgtgaagtcaaatgcatgccaacattccagttttttaagaagggacaaaaggtgggtgaattttctggagccaataaggaaaagcttgaagccaccattaatgaattagtctaatcatgttttctgaaaacataaccagccattggctatttaaaacttgtaatttttttaatttacaaaaatataaaatataaaaaaaaaaaaaaaaaaaaaaaaaaaacagttggtggggccggcattgggcaccgtagagaaaaaggtttcaaacgacccattccgggtgggggccgcgcggcgccagtatgggtactgtcgagacctggggcccaacgtggtccaaaagaaaaactgcgccacggacaagggctgggttccccccaattaaaaaaacgcgcgcgggaccgggcggttcggcaaatcccagtgggtccggggccacgggtcctcaaaggggcaagcagcgaaggaag

SEQ ID NO: 445544 - DNA, 597 bp, Homo sapiens
gctccaggggcggggcgtggccggggcgcagcgacgggcgcggaggtccggccgggcgcgcgcgcccccgccacacgcacgccgggcgtgccagtttataaagggagagagcaagcagcgagtcttgaagctctgtttggtgctttggatccatttccatcggtccttacagccgctcgtcagactccagcagccaagatggtgaagcagatcgagagcaagactgcttttcaggaagccttggacgctgcaggtgataaacttgtagtagttgacttctcagccacgtggtgtgggccttgcaaaatgatcaagcctttctttcatgatgttgcttcagagtgtgaagtcaaatgcatgccaacattccagttttttaagaagggacaaaaggtgggtgaattttctggagccaataaggaaaagcttgaagccaccattaatgaattagtctaatcatgttttctgaaaacataaccagccattggctatttaaaacttgtaatttttttaatttacaaaaatataaaatatgaagacataaacccagttgccatctgcgtgacaataaaacattaatgctaacactttttaaaa

SEQ ID NO: 445545 - DNA, 757 bp, Homo sapiens
  misc_feature (634)..(634): n is a, c, g, or t
  misc_feature (661)..(661): n is a, c, g, or t
  misc_feature (672)..(672): n is a, c, g, or t
gctccaggggcggggcgtggccggggcgcagcgacgggcgcggaggtccggccgggcgcgcgcgcccccgccacacgcacgccgggcgtgccagtttataaagggagagagcaagcagcgagtcttgaagctctgtttggtgctttggatccatttccatcggtccttacagccgctcgtcagactccagcagccaagatggtgaagcagatcgagagcaagactgcttttcaggaagccttggacgctgcaggtgataaacttgtagtagttgacttctcagccacgtggtgtgggccttgcaaaatgatcaagcctttctttcattccctctctgaaaagtattccaacgtgatattccttgaagtagatgtggatgactgtcaggatgttgcttcagagtgtgaagtcaaatgcatgccaacattccagttttttaagaagggacaaaagtcattcgctcccacattctgatgagcaaccgcttccctatttatttatttatttggttgtttgttttattcattggtctaatttattcaaagggggcaagaagtagcagtgtctgtaaaagagcctagtttttaatagctatggaatcaattcaatttggactggtgtgctctctttaaancaagtcctttaattaacactgaaaatntataagctcanattatttaaatgggaatatttataaatgagcaaatatcatactgttcaatggttctgaaataaaaactttcacttggaagaaaaa

SEQ ID NO: 445546 - DNA, 603 bp, Homo sapiens
gctccaggggcggggcgtggccggggcgcagcgacgggcgcggaggtccggccgggcgcgcgcgcccccgccacacgcacgccgggcgtgccagtttataaagggagagagcaagcagcgagtcttgaagctctgtttggtgctttggatccatttccatcggtccttacagccgctcgtcagactccagcagccaagatggtgaagcagatcgagagcaagactgcttttcaggaagccttggacgctgcaggtgataaacttgtagtagttgacttctcagccacgtggtgtgggccttgcaaaatgatcaagcctttctttcattccctctctgaaaagtattccaacgtgatattccttgaagtagatgtggatgactgtcaggatgttgcttcagagtgtgaagtcaaatgcatgccaacattccagttttttaagaagggacaaaaggtggcttgatcattttgcaaggcccacaccacgtggctgagaagtcaactactacaagtttatcacctgcagcgtccaggcttcctgaaaagcagtcttgctctcgatctgctcaccatctatggctgctggagtcgactcgcttctgtt

SEQ ID NO: 445547 - DNA, 769 bp, Homo sapiens
  misc_feature (616)..(617): n is a, c, g, or t
gctccaggggcggggcgtggccggggcgcagcgacgggcgcggaggtccggccgggcgcgcgcgcccccgccacacgcacgccgggcgtgccagtttataaagggagagagcaagcagcgagtcttgaagctctgtttggtgctttggatccatttccatcggtccttacagccgctcgtcagactccagcagccaagatggtgaagcagatcgagagcaagactgcttttcaggaagccttggacgctgcagtccctctctgaaaagtattccaacgtgatattccttgaagtagatgtggatgactgtcaggatgttgcttcagagtgtgaagtcaaatgcatgccaacattccagttttttaagaagggacaaaaggtgggtgaattttctggagccaataaggaaaagcttgaagccaccattaatgaattagtctaatcatgttttctgaaaacataaccagccattggctatttaaaacttgtaatttttttaatttacaaaaatataaaatatgaagacataaacccagttgccatctgcgtgacaataaaacattaatgctaacactttttaaaaaaaaaaaaaaaaaaaaaaaaaaaaaagaaaaanntgggccaattcgccctaaaggagggggaattacatttaactggccgcggtttacaaccgggggatgggaaaaccctggggttacccaaataatcggctttgagaaatcccccttttgcagttgggggatacagggcccaccgatggccttcc

SEQ ID NO: 445548 - DNA, 426 bp, Homo sapiens
gctccaggggcggggcgtggccggggcgcagcgacgggcgcggaggtccggccgggcgcgcgcgcccccgccacacgcacgccgggcgtgccagtttataaagggagagagcaagcagcgagtcttgaagctctgtttggtgctttggatccatttccatcggtccttacagccgctcgtcagactccagcagccaagatggtgaagcagatcgagagcaagactgcttttcaggaagccttggacgctgcaggtgataaacttgtagtagttgacttctcagccacgtggtgtgggccttgcaaaatgatcaagcctttctttcataccttttgtcccttcttaaaaaactggaatgttgcatgcatttgacttcacactctgaagcacatcctgacagtcatccacatctacgttcaagatatg

SEQ ID NO: 445549 - DNA, 657 bp, Homo sapiens
gctccaggggcggggcgtggccggggcgcagcgacgggcgcggaggtccggccgggcgcgcgcgcccccgccacacgcacgccgggcgtgccagtttataaagggagagagcaagcagcgagtcttgaagctctgtttggtgctttggatccatttccatcggtccttacagccgctcgtcagactccagcagccaagatggtgaagcagatcgagagcaagactgcttttcaggaagccttggacgctgcaggtgataaacttgtagtagttgacttctcagccacgtggtgtgggccttgcaaaatgatcaagcctttctttcattccctctctgaaaagtattccaacgtgatattccttgaagtagatgtggatgactgtcaggatgttgcttcagagtgtgaagtcaaatgcatgccaacattccagttttttaagaagggacaaaaggtgggtgaattttctggagccaataaggaaaagcttgaagccaccattaatgaattagtctaatcatgttttctgaaaacataaccagccattggctatttaaaacttgtaatttttttaatttacaaaaatataaaatatgaagacataaacccagttgccatctgcgtgacaataaaacattaatgctaacactttttaaaa

SEQ ID NO: 445550 - DNA, 843 bp, Homo sapiens
  misc_feature (690)..(691): n is a, c, g, or t
gctccaggggcggggcgtggccggggcgcagcgacgggcgcggaggtccggccgggcgcgcgcgcccccgccacacgcacgccgggcgtgccagtttataaagggagagagcaagcagcgagtcttgaagctctgtttggtgctttggatccatttccatcggtccttacagccgctcgtcagactccagcagccaagatggtgaagcagatcgagagcaagactgcttttcaggaagccttggacgctgcaggtgataaacttgtagtagttgacttctcagccacgtggtgtgggccttgcaaaatgatcaagcctttctttcattccctctctgaaaagtattccaacgtgatattccttgaagtagatgtggatgactgtcaggatgttgcttcagagtgtgaagtcaaatgcatgccaacattccagttttttaagaagggacaaaaggtgggtgaattttctggagccaataaggaaaagcttgaagccaccattaatgaattagtctaatcatgttttctgaaaacataaccagccattggctatttaaaacttgtaatttttttaatttacaaaaatataaaatatgaagacataaacccagttgccatctgcgtgacaataaaacattaatgctaacactttttaaaaaaaaaaaaaaaaaaaaaaaaaaaaaagaaaaanntgggccaattcgccctaaaggagggggaattacatttaactggccgcggtttacaaccgggggatgggaaaaccctggggttacccaaataatcggctttgagaaatcccccttttgcagttgggggatacagggcccaccgatggccttcc

SEQ ID NO: 445551 - DNA, 897 bp, Homo sapiens
  misc_feature (744)..(745): n is a, c, g, or t
gctccaggggcggggcgtggccggggcgcagcgacgggcgcggaggtccggccgggcgcgcgcgcccccgccacacgcacgccgggcgtgccagtttataaagggagagagcaagcagcgagtcttgaagctctgtttggtgctttggatccatttccatcggtccttacagccgctcgtcagactccagcagccaagatggtgaagcagatcgagagcaagactgcttttcaggaagccttggacgctgcaggtgataaacttgtagtagttgacttctcagccacgtggtgtgggccttgcaaaatgatcaagcctttctttcattccctctctgaaaagtattccaacgtgatattccttgaagtagatgtggatgactgtcaggatgttgcttcagagtgtgaagtcaaatgcatgccaacattccagttttttaagaagggacaaaaggtgggtgaattttctggagccaataaggaaaagcttgaagccaccattaatgaattagtctaatcatgttttctgaaaacataaccagccattggctatttaaaacttgtaatttttttaatttacaaaaatataaaatatgaagacataaacccagttgccatctgcgtgacaataaaacattaatgctaacactttttaaaaaaaaccgtctcatgtctgaatagctttcaaaataaatgtgaaatggtcatttaaaaaaaaaaaaaaaaaaaaaaaaaaaagaaaaanntgggccaattcgccctaaaggagggggaattacatttaactggccgcggtttacaaccgggggatgggaaaaccctggggttacccaaataatcggctttgagaaatcccccttttgcagttgggggatacagggcccaccgatggccttcc

SEQ ID NO: 445552 - DNA, 877 bp, Homo sapiens
gctccaggggcggggcgtggccggggcgcagcgacgggcgcggaggtccggccgggcgcgcgcgcccccgccacacgcacgccgggcgtgccagtttataaagggagagagcaagcagcgagtcttgaagctctgtttggtgctttggatccatttccatcggtccttacagccgctcgtcagactccagcagccaagatggtgaagcagatcgagagcaagactgcttttcaggaagccttggacgctgcaggtgataaacttgtagtagttgacttctcagccacgtggtgtgggccttgcaaaatgatcaagcctttctttcattccctctctgaaaagtattccaacgtgatattccttgaagtagatgtggatgactgtcaggatgttgcttcagagtgtgaagtcaaatgcatgccaacattccagttttttaagaagggacaaaaggtgggtgaattttctggagccaataaggaaaagcttgaagccaccattaatgaattagtctaatcatgttttctgaaaacataaccagccattggctatttaaaacttgtaatttttttaatttacaaaaatataaaatatgaagacataaacccagttgccatctgcgtgacaataaaacattaatgctaacactttttaaaaaaaaccgtctcatgtctgaatagctttcaaaataaatgtgaaatggtcatttaatgtattttcctatattctcaatcactttttagtaaccttgtaggccactgattattttaagattttaaaaattattattgctaccttaatgtattgctacaaaaatctcttgttgggggcaatgcaggtaataaagtagtatgttgttatttgttatcttttgaca

SEQ ID NO: 445553 - DNA, 1099 bp, Homo sapiens
gctccaggggcggggcgtggccggggcgcagcgacgggcgcggaggtccggccgggcgcgcgcgcccccgccacacgcacgccgggcgtgccagtttataaagggagagagcaagcagcgagtcttgaagctctgtttggtgctttggatccatttccatcggtccttacagccgctcgtcagactccagcagccaagatggtgaagcagatcgagagcaagactgcttttcaggaagccttggacgctgcaggtgataaacttgtagtagttgacttctcagccacgtggtgtgggccttgcaaaatgatcaagcctttctttcattccctctctgaaaagtattccaacgtgatattccttgaagtagatgtggatgactgtcaggatgttgcttcagagtgtgaagtcaaatgcatgccaacattccagttttttaagaagggacaaaaggtgggtgaattttctggagccaataaggaaaagcttgaagccaccattaatgaattagtctaatcatgttttctgaaaacataaccagccattggctatttaaaacttgtaatttttttaatttacaaaaatataaaatatgaagacataaacccagttgccatctgcgtgacaataaaacattaatgctaacactttttaaaattccagttttttaagaagggacaaaaaggtgggtgaattttctggagccaataaggaaaagcttgaagccaccattaatgaattagtctaatcatgttttctgaaacataaccagaccatggtattgaaaaactgttaatttttttcgaatttaccaacaattaagtttggagacataaccccgttgccatccgcgtgaccattaaaacattatgctacaccttgtaacaaagagaggaccagacgagcgaaacaaacacacaagccaaacaacaacaaaagacacaatacaaacagggcgggccctacaacactggggcacaagcaccccactctgggaggcctaggatataaagccgccacaacaaaccagtgtgacccttggtttacaccaacgcaaaatggccgtccgttatatgaacagttcgtccggcacaggaca

SEQ ID NO: 445554 - DNA, 583 bp, Homo sapiens
gctccaggggcggggcgtggccggggcgcagcgacgggcgcggaggtccggccgggcgcgcgcgcccccgccacacgcacgccgggcgtgccagtttataaagggagagagcaagcagcgagtcttgaagctctgtttggtgctttggatccatttccatcggtccttacagccgctcgtcagactccagcagccaagatggtgaagcagatcgagagcaagactgcttttcaggaagccttggacgctgcagtccctctctgaaaagtattccaacgtgatattccttgaagtagatgtggatgactgtcaggatgttgcttcagagtgtgaagtcaaatgcatgccaacattccagttttttaagaagggacaaaaggtgggtgaattttctggagccaataaggaaaagcttgaagccaccattaatgaattagtctaatcatgttttctgaaaacataaccagccattggctatttaaaacttgtaatttttttaatttacaaaaatataaaatatgaagacataaacccagttgccatctgcgtgacaataaaacattaatgctaacactttttaaaa

SEQ ID NO: 445555 - DNA, 492 bp, Homo sapiens
gctccaggggcggggcgtggccggggcgcagcgacgggcgcggaggtccggccgggcgcgcgcgcccccgccacacgcacgccgggcgtgccagtttataaagggagagagcaagcagcgagtcttgaagctctgtttggtgctttggatccatttccatcggtccttacagccgctcgtcagactccagcagccaagatggtgaagcagatcgagagcaaggatgttgcttcagagtgtgaagtcaaatgcatgccaacattccagttttttaagaagggacaaaaggtgggtgaattttctggagccaataaggaaaagcttgaagccaccattaatgaattagtctaatcatgttttctgaaaacataaccagccattggctatttaaaacttgtaatttttttaatttacaaaaatataaaatatgaagacataaacccagttgccatctgcgtgacaataaaacattaatgctaacactttttaaaa

SEQ ID NO: 445556 - DNA, 564 bp, Homo sapiens
gctccaggggcggggcgtggccggggcgcagcgacgggcgcggaggtccggccgggcgcgcgcgcccccgccacacgcacgccgggcgtgccagtttataaagggagagagcaagcagcgagtcttgaagctctgtttggtgctttggatccatttccatcggtccttacagccgctcgtcagactccagcagccaagatggtgaagcagatcgagagcaagactgcttttcaggaagccttggacgctgcaggtgataaacttgtagtagttgacttctcagccacgtggtgtgggccttgcaaaatgatcaagcctttctttcattccctctctgaaaagtattccaacgtgatattccttgaagtagatgtggatgactgtcagaggtatgtagctggaaatatgagatactgctgagcttttcacattggcctttttctctgaattgcacagtgcttttttccataaatatgtcaaataattctagaactgtaatcctatctaaaaagttctatctcagaagagcaggcaagttaggagcttaatcctagctatcgggag

SEQ ID NO: 445557 - DNA, 496 bp, Homo sapiens
gctccaggggcggggcgtggccggggcgcagcgacgggcgcggaggtccggccgggcgcgcgcgcccccgccacacgcacgccgggcgtgccagtttataaagggagagagcaagcagcgagtcttgaagctctgtttggtgctttggatccatttccatcggtccttacagccgctcgtcagactccagcagccaagatggtgaagcagatcgagagcaagactgcttttcaggaagccttggacgctgcaggtgataaacttgtagtagttgacttctcagccacgtggtgtgggccttgcaaaatgatcaagcctttctttcatcgcacgtccagcatcaagtttgcatgacaaggtatgtgtcaacttgatgaaggatttgcacatgtagagcatggtaggactagtgcagagctctaggcgtgaatgaatacgcctgatgagacatatccagcatgtctgtaggattagaaggtacaggagatgtgatcga

SEQ ID NO: 445558 - DNA, 427 bp, Homo sapiens
cacacctctgcagagagaatggccagcaggaaggcggggacccggggcaaggtggcagccaccaagcaggcccaacgtggttcttccaacgtcttttccatgtttgaacaagcccagatacaggagttcaaagaagccttcagctgtatcgaccagaatcgtgatggcatcatctgcaaggcagacctgagggagacctactcccagctggggaaggtgagtgtcccagaggaggagctggacgccatgctgcaagagggcaagggcccatcaacttcaccgtcttcctcacgctctttggggagaagctcaatgacaaccccaggagcatctagtccttccgatgtttacccagcgcaagggttgtaacagatagttagcagtttctaccagagaaagttctcccctagggggcgatttgccctaa

SEQ ID NO: 445559 - DNA, 708 bp, Homo sapiens
acagcagccacacctctgcagagagaatggccagcaggaaggcggggacccggggcaaggtggcagccaccaagcaggcccaacgtggttcttccaacgtcttttccatgtttgaacaagcccagatacaggagttcaaagaagccttcagctgtatcgaccagaatcgtgatggcatcatctgcaaggcagacctgagggagacctactcccagctggggaaggtgagtgtcccagaggaggagctggacgccatgctgcaagagggcaagggcccatcaacttcaccgtcttcctcacgctctttggggagaagctcaatgggacagaccccgaggaagccatcctgagtgccttccgcatgtttgaccccagcggcaaaggggtggtgaacaaggatgagttcaagcagcttctcctgacccaggcagacaagttctctccagctgaggtgaggctgcccagccccttcaatactcatccccagcaccttctctgggccttcacccatgacccagagcccagtaccagtgaggcagttgctggaagggtggagcagatgttcgccctgacacccatggacctggcggggaacatcgactacaagtcactgtgctacatcatcacccatggagacgagaaagaggaatgaggggcagggccaggcccacgggggggcacctcaataaactctgttgcaaaattgga

SEQ ID NO: 445560 - DNA, 704 bp, Homo sapiens
acagcagccacacctctgcagagagaatggccagcaggaaggcggggacccggggcaaggtggcagccaccaagcaggcccaacgtggttcttccaacgtcttttccatgtttgaacaagcccagatacaggagttcaaagaagccttcagctgtatcgaccagaatcgtgatggcatcatctgcaaggcagacctgagggagacctactcccagctggggaaggtgagtgtcccagaggaggagctggacgccatgctgcaagagggcaagggcccatcaacttcaccgtcttcctcacgctctttggggagaagctcaatgggacagaccccgaggaagccatcctgagtgccttccgcatgtttgaccccagcggcaaaggggtggtgaacaaggatgaccaacccttccctgcgccatgggagcctccgtacccaccttccctgtgcagtcactcccccgcagtcttctgctcagaccctcctcaccccccaggttcaagcagcttctcctgacccaggcagacaagttctctccagctgaggtggagcagatgttcgccctgacacccatggacctggcggggaacatcgactacaagtcactgtgctacatcatcacccatggagacgagaaagaggaatgaggggcagggccaggcccacgggggggcacctcaataaactctgttgcaaaattgga

SEQ ID NO: 445561 - DNA, 435 bp, Homo sapiens
acagcagccacacctctgcagagagaatggccagcaggaaggcggggacccggggcaaggtggcagccaccaagcaggcccaacgtggttcttccaacgtcttttccatgtttgaacaagcccagatacaggagttcaaagaagccttcagctgtatcgaccagaatcgtgatggcatcatctgcaaggcagacctgagggagacctactcccagctggggaaggtgagtgtcccagaggaggagctggacgccatgctgcaagagggcaagggcccatcaacttcaccgtcttcctcacgctctttggggagaagctcaatgacaaccccaggagcatctagtccttccgatgtttacccagcgcaagggttgtaacagatagttagcagtttctaccagagaaagttctcccctagggggcgatttgccctaa

SEQ ID NO: 445562 - DNA, 887 bp, Homo sapiens
cacacctctgcagagagaatggccagcaggaaggcggggacccggggcaaggtggcagccaccaagcaggcccaacgtggttcttccaacgtcttttccatgtttgaacaagcccagatacaggagttcaaagaagccttcagctgtatcgaccagaatcgtgatggcatcatctgcaaggcagacctgagggagacctactcccagctggggtgcgtgcacccacctcccaccctgcgcactggggtccctactctgagctgctgggcgggtgggagtggcttgggggacaggactctgctcccctgcttcccctcctccccgtctcctcacactgcccttccccccttgtcacgccttgcttccacttcaccttcccgacccacagctgcctctgcccctccagcccctgtggccaggatggagggagggcggcctgggccttctgggggacacccagggtccctgtgtgcacctcatgccccacccccagctggggaaggtgagtgtcccagaggaggagctggacgccatgctgcaagagggcaagggcccatcaacttcaccgtcttcctcacgctctttggggagaagctcaatgggacagaccccgaggaagccatcctgagtgccttccgcatgtttgaccccagcggcaaaggggtggtgaacaaggatgagttcaagcagcttctcctgacccaggcagacaagttctctccagctgaggtggagcagatgttcgccctgacacccatggacctggcggggaacatcgactacaagtcactgtgctacatcatcacccatggagacgagaaagaggaatgaggggcagggccaggcccacgggggggcacctcaataaactctgttgcaaaattgga

SEQ ID NO: 445563 - DNA, 641 bp, Homo sapiens
cacacctctgcagagagaatggccagcaggaaggcggggacccggggcaaggtggcagccaccaagcaggcccaacgtggttcttccaacgtcttttccatgtttgaacaagcccagatacaggagttcaaagaaagctgggggctgctcccacctgaaggcccccatcccacaggccttcagctgtatcgaccagaatcgtgatggcatcatctgcaaggcagacctgagggagacctactcccagctggggaaggtgagtgtcccagaggaggagctggacgccatgctgcaagagggcaagggcccatcaacttcaccgtcttcctcacgctctttggggagaagctcaatgggacagaccccgaggaagccatcctgagtgccttccgcatgtttgaccccagcggcaaaggggtggtgaacaaggatgagttcaagcagcttctcctgacccaggcagacaagttctctccagctgaggtggagcagatgttcgccctgacacccatggacctggcggggaacatcgactacaagtcactgtgctacatcatcacccatggagacgagaaagaggaatgaggggcagggccaggcccacgggggggcacctcaataaactctgttgcaaaattgga

SEQ ID NO: 445564 - DNA, 499 bp, Homo sapiens
acagcagccacacctctgcagagagaatggccagcaggaaggcggggacccggggcaaggtggcagccaccaagcaggcccaacgtggttcttccaacgtcttttccatgtttgaacaagcccagatacaggagttcaaagaagccttcagctgtatcgaccagaatcgtgatggcatcatctgcaaggcagacctgagggagacctactcccagctggggaaggtgagtgtcccagaggaggagctggacgccatgctgcaagagggcaagaaccccatctttactaaaaatacaaaaattagccaggcatggtggctcgtgactgtagtcccagctactttggaggccgaggcaaaagaatcacttgaacccaggaggcggaggttgcagtgagccgagatcgcgcattacactccagcctgagtgacagagcgagactccatctccaaatacacacacagacacacacacacacacacacacacacacagcacgtt

SEQ ID NO: 445565 - DNA, 300 bp, Homo sapiens
cacacctctgcagagagaatggccagcaggaaggcggggacccggggcaaggtggcagccaccaagcaggcccaacgtggttcttccaacgtcttttccatgtttgaacaagcccagatacaggagttcaaagaagccttcagctgtatcgaccagaatcgtgatggcatcatctgcaaggcagacctgagggagacctactcccagctggaaggtagtttcccagggggggttgacgcaatttcaaagggaaggcccataattacgtttctagttttgggaagttatggaaacccagag

SEQ ID NO: 445566 - DNA, 373 bp, Homo sapiens
cacacctctgcagagagaatggccagcaggaaggcggggacccggggcaaggtggcagccaccaagcaggcccaacgtggttcttccaacgtcttttccatgtttgaacaagcccagatacaggagttcaaagaaggaaggtgagtgtcccagaggaggagctggacgccatgctgcaagagggcaagggcccatcaacttcaccgtcttcctcacgctctttggggagaagctcaatgtggacaacccccggaggcatcctagtcctcccccatttttccccccgcaaagggtgtaacaagattagttaagagctctctacccgagaaagttttccctaggtgagagatttgcctaaccatgacctgcggga

SEQ ID NO: 445567 - DNA, 300 bp, Homo sapiens
cacacctctgcagagagaatggccagcaggaaggcggggacccggggcaaggtggcagccaccaagcaggcccaacgtggttcttccaacgtcttttccatgtttgaacaagcccagatacaggagttcaaagaacttttctcaacttccaccttcctagagcttggggttgcttcacttaaggccccattcaaaggctttagtttattgaccagattgtatggatatttgaaggaagccttagggaactattcagttgggaagtgagttccagagagattgagaatttaaaaggaagcc

SEQ ID NO: 445568 - DNA, 289 bp, Homo sapiens
gactgtgcacagacctggggggaagtggatagggagaggtttcgtacactcggggtgggcctgtgcctgtggctggaggggcgtcctttgcctcttggcccacatttgcactgactcctcactctgcccagagtcagccaagagaaaaacattaacccagagtctggggtctagggttgaaaagctaaggcaaaaagcacagatgcagggggcagacagaaaggccacaggactcaggtgaggtctctgccgggctgggccaggagccaggggactgccactcaccagt

SEQ ID NO: 445569 - DNA, 609 bp, Homo sapiens
acagcagccacacctctgcagagagaatggccagcaggaaggcggggacccggggcaaggtggcagccaccaagcaggcccaacgtggttcttccaacgtcttttccatgtttgaacaagcccagatacaggagttcaaagaagccttcagctgtatcgaccagaatcgtgatggcatcatctgcaaggcagacctgagggagacctactcccagctggggaaggtgagtgtcccagaggaggagctggacgccatgctgcaagagggcaagggcccatcaacttcaccgtcttcctcacgctctttggggagaagctcaatgggacagaccccgaggaagccatcctgagtgccttccgcatgtttgaccccagcggcaaaggggtggtgaacaaggatgagttcaagcagcttctcctgacccaggcagacaagttctctccagctgaggtggagcagatgttcgccctgacacccatggacctggcggggaacatcgactacaagtcactgtgctacatcatcacccatggagacgagaaagaggaatgaggggcagggccaggcccacgggggggcacctcaataaactctgttgcaaaattgga

SEQ ID NO: 445570 - DNA, 1043 bp, Homo sapiens
acagcagccacacctctgcagagagaatggccagcaggaaggcggggacccggggcaaggtggcagccaccaagcaggcccaacgtggttcttccaacgtcttttccatgtttgaacaagcccagatacaggagttcaaagaagccttcagctgtatcgaccagaatcgtgatggcatcatctgcaaggcagacctgagggagacctactcccagctggggaaggtgagtgtcccagaggaggagctggacgccatgctgcaagagggcaagggcccatcaacttcaccgtcttcctcacgctctttggggagaagctcaatgggacagaccccgaggaagccatcctgagtgccttccgcatgtttgaccccagcggcaaaggggtggtgaacaaggatgagttcaagcagcttctcctgacccaggcagacaagttctctccagctgaggtggagcagatgttcgccctgacacccatggacctggcggggaacatcgactacaagtcactgtgctacatcatcacccatggagacgagaaagaggaatgaggggcagggccaggcccacgggggggcacctcaataaactctgttgcaaaattggaaaaaaaaaaaaaaaaaaccaagaaaaagctaacagcgccaacgagaacaacaacaccgacaccctagtcaaagtcactacagccgcgaaagccacaacagaagaaacacaacaaacacgaacgaaacggcaggcgtgtgggcggcggctcgcgcgccaatgacacaaggaatttagaaccccacagcagatggagggggggaggcgcaacaccagcgatggagatatcccacactgatgcgacagagctgggatcgcagcgaagcaacgtcggagcagtcacgaaagggagggcggggcgtcagccacaccaaaaagaaaagaacgcccgggggggaacgaaacaagcgtggctagtacacaccaagggcgagcggggcgggggactaccggcgtctcataaaccagagagcgcacgcgacggaataatatacc

SEQ ID NO: 445571 - DNA, 601 bp, Homo sapiens
cacacctctgcagagagaatggccagcaggaaggcggggacccggggcaaggtggcagccaccaagcaggcccaacgtggttcttccaacgtcttttccatgtttgaacaagcccagatacaggagttcaaagaagccttcagctgtatcgaccagaatcgtgatggcatcatctgcaaggcagacctgagggagacctactcccagctggggaaggtgagtgtcccagaggaggagctggacgccatgctgcaagagggcaagggcccatcaacttcaccgtcttcctcacgctctttggggagaagctcaatgggacagaccccgaggaagccatcctgagtgccttccgcatgtttgaccccagcggcaaaggggtggtgaacaaggatgagttcaagcagcttctcctgacccaggcagacaagttctctccagctgaggtggagcagatgttcgccctgacacccatggacctggcggggaacatcgactacaagtcactgtgctacatcatcacccatggagacgagaaagaggaatgaggggcagggccaggcccacgggggggcacctcaataaactctgttgcaaaattgga

SEQ ID NO: 445572 - DNA, 670 bp, Homo sapiens
cacacctctgcagagagaatggccagcaggaaggcggggacccggggcaaggtggcagccaccaagcaggcccaacgtggttcttccaacgtcttttccatgtttgaacaagcccagatacaggagttcaaagaagtctctcccccacctcccaccttccctagagctgggggctgctcccacctgaaggcccccatcccacaggccttcagctgtatcgaccagaatcgtgatggcatcatctgcaaggcagacctgagggagacctactcccagctggggaaggtgagtgtcccagaggaggagctggacgccatgctgcaagagggcaagggcccatcaacttcaccgtcttcctcacgctctttggggagaagctcaatgggacagaccccgaggaagccatcctgagtgccttccgcatgtttgaccccagcggcaaaggggtggtgaacaaggatgagttcaagcagcttctcctgacccaggcagacaagttctctccagctgaggtggagcagatgttcgccctgacacccatggacctggcggggaacatcgactacaagtcactgtgctacatcatcacccatggagacgagaaagaggaatgaggggcagggccaggcccacgggggggcacctcaataaactctgttgcaaaattgga

SEQ ID NO: 445573 - DNA, 558 bp, Homo sapiens
acagcagccacacctctgcagagagaatggccagcaggaaggcggggacccggggcaaggtggcagccaccaagcaggcccaacgtggttcttccaacgtcttttccatgtttgaacaagcccagatacaggagttcaaagaagccttcagctgtatcgaccagaatcgtgatggcatcatctgcaaggcagacctgagggagacctactcccagctggggaaggtgagtgtcccagaggaggagctggacgccatgctgcaagagggcaagggacagaccccgaggaagccatcctgagtgccttccgcatgtttgaccccagcggcaaaggggtggtgaacaaggatgagttcaagcagcttctcctgacccaggcagacaagttctctccagctgaggtggagcagatgttcgccctgacacccatggacctggcggggaacatcgactacaagtcactgtgctacatcatcacccatggagacgagaaagaggaatgaggggcagggccaggcccacgggggggcacctcaataaactctgttgcaaaattgga

SEQ ID NO: 445574 - DNA, 468 bp, Homo sapiens
cacacctctgcagagagaatggccagcaggaaggcggggacccggggcaaggtggcagccaccaagcaggcccaacgtggttcttccaacgtcttttccatgtttgaacaagcccagatacaggagttcaaagaagccttcagctgtatcgaccagaatcgtgatggcatcatctgcaaggcagacctgagggagacctactcccagctgggtgaggctgcccagccccttcaatactcatccccagcaccttctctgggccttcacccatgacccagagcccagtaccagtgaggcagttgctggaagggtggagcagatgttcgccctgacacccatggacctggcggggaacatcgactacaagtcactgtgctacatcatcacccatggagacgagaaagaggaatgaggggcagggccaggcccacgggggggcacctcaataaactctgttgcaaaattgga

SEQ ID NO: 445575 - DNA, 621 bp, Homo sapiens
cacacctctgcagagagaatggccagcaggaaggcggggacccggggcaaggtggcagccaccaagcaggcccaacgtggttcttccaacgtcttttccatgtttgaacaagcccagatacaggagttcaaagaagtctctcccccacctcccaccttccctagagctgggggctgctcccacctgaaggcccccatcccacaggccttcagctgtatcgaccagaatcgtgatggcatcatctgcaaggcagacctgagggagacctactcccagctggggaaggtgagtgtcccagaggaggagctggacgccatgctgcaagagggcaagggcccatcaacttcaccgtcttcctcacgctctttggggagaagctcaatgggacagaccccgaggaagccatcctgagtgccttccgcatgtttgaccccagcggcaaaggggtggtgaacaaggatgagtggagcagatgttcgccctgacacccatggacctggcggggaacatcgactacaagtcactgtgctacatcatcacccatggagacgagaaagaggaatgaggggcagggccaggcccacgggggggcacctcaataaactctgttgcaaaattgga

SEQ ID NO: 445576 - DNA, 1297 bp, Homo sapiens
cgggttcacaccattctcctgcctcaggctcctgagtagctgggactacaggcgcccgccaccacgcccagctaattttttgtatttttagtagagacggggtttcactgtgttagccaggatggtcttgatctgctaacctcgtgatccacccgccccggcctcccaaagtgctaggattacaggtgtgagccaccgcgcccggcctgattctttaagctgtttttctttgttgctggtgttttctttttggactcctcttccttgctccatatccctacagtatttcccaccattctaggtttgtccctttctcttcttctgggacactctcatcaacagtcagtcctcagccccctcctctgcaaatgacactcagaactctctctggctcagatctcagatttgggattaacaaacttccacttagacattctgcctgactgacctcaggcatttcgcactctgaatgtcaaacccaactcattgtcatctctgaagctgctcacttaattctcctctgtattctctttaacaacccagttgcccaacccagaaactgggagtcacgcagacctcctttctctcttactcccacacaatgagccatgaagtccagtctttctatcttaacatcactgtcaaacccacactgtattccatgcccagcgctgccacgtgaatgtactctgctcacttccttcctggattacccatagccccacctcatcctcctacccttgctttcctccctgaagtcagagagatcctactcaagagataactgctcctgacagcccttattacagaactgaagtactctccttagcttcagctctgtgcccacgtgccttggctttggatacaaggtactacagcactttgtccactctccaggcttacctgtgtcattccacatgcacatcttagaaaatgccagccttagagaattctccctagccccaaaatgtctttgcccagtgcaattccttcttcctgtattacccctttccctccttcacactatctgcctggctaattcttatttatccttagttcaagtatggccttttctgggaaggtgaccctccttggccaccccttgcatatactttgatgccctagggcacaccccctttatttccctcatagaaacagccttctgtaaattgttccatgacaacctgtatttcaatttgtaagaaatttgcatgtactgtgagctccccaacgtcaggagactgacccttttgatatcattgctaagcctcattaaatgaatgaatgaaaatgaatg

SEQ ID NO: 445577 - DNA, 600 bp, Homo sapiens
gtcagctgacgtcacccttcaccttcctattcttcctgccttgaatgtggatgtgactttttgttatgtaagaaaaataaatgaatgtatttaagccattgttaggtagggtttctgtacctcatagctgaacgcatttctaactgatagtggtgagcaatgaacaagtgaattttacagtaatggagcagagggtcaagttgaccctacaatctttagcttgactaattgaatgactggaagcccaattggtagataaatataaagagtgtcagaaggaggagaggtcagagcacatagataagttttatttgggtgactctaagacctcagtcatgcctgacataatgggattctgtgacgcatgtgtgtggacctttgcaatggagctgctcagaacatcgttggaacccccctttggaaattctcagcaaagcctgattcaccttctctgtaatttcctcactgtcgatgatttttcagtactttcatggggggttgatttttggaaatatctgagactaagtaaggtgcattatgagattaggataaataaaatatttgggtgagtgatttaataaataaacataatcctgataa

SEQ ID NO: 445578 - DNA, 634 bp, Homo sapiens
  misc_feature (54)..(54): n is a, c, g, or t
tgcattagaggatccccacctctaccccacggggactggtcattcaagattatnatgctgataagatgtttccagcttttggttttggcgctcagatacctcctcagtggcaggtatcacatgaatttccaatgaacttcaacccatccaatccctactgcaatggaatccaaggcattgtagaggcgtatcggtcttgtcttcctcagataaaactctatggaccaactaatttttctccaatcataaatcacgtggccaggtttgctgctgcagccacgcaacagcagacagcttctcaatattttgtgcttttgattattactgatggtgtgatcacagaccttgatgaaaccagacaagctatagttaatgcctccaggctgcctatgtccatcataattgttggagttggaggtgctgacttcagcgccatggagtttctggatggtgatggtggaagtctccgctccccattgggcgaagtggccatcagagatattgtccagtttgtgcctttcagacagttccagaatgctccaaaagaagcacttgctcagtgtgcttgtccagttgtgagctgtcctcggtgttaccgaggctgtgcctagagagtggagatttctgatgaaag

SEQ ID NO: 445579 - DNA, 430 bp, Homo sapiens
tggaaaaaacagtattttattaaatatttttttctttttagtgataagatgtttccagcttttggttttggcgctcagatacctcctcagtggcaggtatcacatgaatttccaatgaacttcaacccatccaatccctactgcaatggtaagttaaaaaataaacatgaagacttcaaatggaaaggctcactagtctttgttattttgttctttgttctttgttttttttcttgtgattaaaactactcaaatttcatctctaggtttcattttcttacatatttaactttctgttgtataaggtagaagaattgcaccaggttggtggttagggtggtaatggtaattacggggcaaatcagtattatgatgatgaaggtggtaagctaaatcctcctaccttaagaactttaataggacaaaaaca

SEQ ID NO: 445580 - DNA, 4851 bp, Homo sapiens
gagccctaggttctcctgaatccctgcggtcccagcgtcgctccggacgctgccaacctgttctccaccgtcgctcgacttccacctctaagactcccacgaaactcaggttgaataattcatcaaattacacaactgaactcaagacatggctgcccagtgtgtcacaaaggtggcgctgaatgtttcctgtgccaatcttttggataaagatatagggtcaaagtcagaccctttatgtgtgttgtttttgaatacaagtggtcaacagtggtatgaggttgagcgcacagaaaggattaagaattgcttgaatccccaattttccaagacatttattattgattactactttgaagtggttcagaaattgaaatttggggtttatgacatcgacaacaaaactattgagctgagtgatgatgacttcttaggggaatgtgaatgtacccttggacaaattgtttccagcaagaagctaactcgaccactggtgatgaaaactggcagacctgcaggaaaagggagcattacgatttcagctgaagaaataaaagataatagagtggtcttgtttgaaatggaagccagaaaactggataataaggatctatttggaaagtcagacccatacctggaattccacaagcagacatctgatggaaactggctaatggttcatcggacagaggttgttaaaaacaacttgaatcctgtttggaggcctttcaagatctctcttaactcactgtgttacggagatatggacaaaaccattaaggtggagtgttatgattatgacaatgatgggtcacatgatctcattggaacatttcagaccaccatgacaaaactgaaagaagcctccagaagctcacctgttgaatttgaatgcataaatgagaaaaaaaggcaaaagaaaaaaagctacaagaattcaggtgttatcagtgtgaaacagtgtgagattacagtagaatgcacattccttgactatataatgggaggatgtcagctgaattttactgtgggagtggacttcactggctccaatggtgacccaaggtctccagactcccttcattacatcagccccaatggcgttaatgagtatttgactgctctctggtctgtgggactggtcattcaagattatgatgctgataagatgtttccagcttttggttttggcgctcagatacctcctcagtggcaggtatcacatgaatttccaatgaacttcaacccatccaatccctactgcaatggaatccaaggcattgtagaggcgtatcggtcttgtcttcctcagataaaactctatggaccaactaatttttctccaatcataaatcacgtggccaggtttgctgctgcagccacgcaacagcagacagcttctcaatattttgtgcttttgattattactgatggtgtgatcacagaccttgatgaaaccagacaagctatagttaatgcctccaggctgcctatgtccatcataattgttggagttggaggtgctgacttcagcgccatggagtttctggatggtgatggtggaagtctccgctccccattgggcgaagtggccatcagagatattgtccagtttgtgcctttcagacagttccagaatgctccaaaagaagcacttgctcagtgtgtcttggcagagattccccagcaggtggtgggctacttcaatacatacaaactccttcctcccaagaacccagccacgaaacaacagaagcagtgaccacttcaacagaattcttttgtgttatgtggagcaatgccatctctcaccccaaatcgtgtatctgtcattctacgtactttttacccccagcatttatgatgtaaatctctttctctatggattatatctgtttaaagcattctttctaggttattttggggggacagtgccaagtccatctttgcccagtcaattcagtgattgatagcaatttacattaattgcagtaaagctctttggattagaaattagtgtggggaaagcttattctgttgttgtttttgtttactttcatatgatgaaaatgctgtgtttaagtgtttgtcaataggaagaatggaaaactgttgggatgatgtggtttgcaggttgctgtgcctgattcacagtgtatgttgtataagccaatgtccatacctgattatgagagcttcttaaattatatgatatcaaatttgttcctgtaactctgtatacagtgcttttctgcaaggtaaaaataacctgtctatgcatctgatttttgctacagtttagacactgtggtttacaaaacagcatgcactcaacttgggactttatgaaaagtactgaatgagcaggaaaaggcacatactcagttttttaaatgtacaatcaacaagtaaaaataacctcatgtaagtaagccatttttatttgcctttctagatattttattttattgtggaaaactgtaaacatggtcagatttggctttttttttcattaactgagcaagactttcaggatattgtagatgcacagatggtaggttgtcctgaattctacattattagattactttaattgagatttgttaaaacggttaggactgttttgtccaggaaagataagaggaccaaacatataaggtgaaattcagaattccgtttccttctaactaatgaaaaactgcttactaaaaaaaaattttatactttccttgctaaggtcccatatattgatttgtacagatccacttagtcattttctcctttttttaagaaccattttcatctgatttttaaactcacgataccagttatctgttaatcaaaattgcattttacaatttaataatgtgatatttcctatgtctacagcataccttattaggtataaaacctactgcaacttagaaaaaggaaagaaaaaagaaaacttttccaactgctgcattaagatagggtggattttatgtgctttttttttttaagagttgaatttcttttcctgacttttaccttttacagcgtattacttagtgaacattacattttcagaatagatcctaatattttattgagggcctatgtgctaaaaactatgcatatctatatattggccaattatctttaataatttaccttttgaaattgcatgtttatcatatatccttaagtggacacatacagtgccatgttgatgtgcctctcagttttattgaaaagctgccccacagcccatgtctcttgttctctgcaatgcctcaagggagtgagctctcaaccacagatagctgtggcttctcagaagcagctcattgccaaggccaggctgagaggggacctgcttgctgtggtggttgcctagcccagatgagcatttacctaccaccttcccacttggctagctgtcctttggatatgtgctgttaactggggaaggcatctaactagtagcctgctactccatagtatggctcaatagatgacacatcattttgacattatcaataggagaaaagaaaactaacccttcttctgattgtttggagccatagttgtctcagatgttctaattctctttgtatgcttggaaacagcatagatatgttgctgtggttttcagaattttctcttttaatcacaagaagccttttaaaaaatgacttacacatattctcaatgtacagtaaaacagacagaagtgagcttatctgtttgatgctgtggcagggtcccagtcactgggcatatcctccttctccttaaccagctcctcagcagcccctgagtcacctgcacaaggtgcttgggaactgctggttatgagcattcctggttttcttcagccaaataacaggtaatcactgtcaattggatttggtcttcattattttatattctgattttatcagaattattctattttaaaattgttttaaaatttaaaaacatttaattcatgatcatgttcatcagtagatgctattattcataagaactgtgattccagcaaactagggtaattggtgcctttttacagttttgaataaaagcatttacaatttctaaattatcagttttcacagtttcagcactcaacctcatcatacgctgatttaatattgttttacattaaaatagtccttttccctgttgtgccaccattcatttaagtgctgtttgttcttaaaatgcatttaaagaaaaattacccatattgactttcacacctcatataatcagatctattacaaatatatatcggagtgacggtgcccaggatagatgtaatatttcttacagatgctggcacagaggaaataatataccagctaatctagtcacctaaccttgtggttagaattgcaattttaagaccagaaaaatttgaagtctgatcagagatttacaactgttcattatagtggtgccttaggcaatctttccaaagtaaattcagggccccattgctacttatgccatatttggacatactttttttttcttcaattttgtaaacttcctggaaagctgtcttcactaagtatcccctagtctctatatatgtggttagtagtcatggaaatgacacataaagtacgccagaagtttgatggaacgtgttagaaactgttttgtgcttttatggatgtcatacttgacaatacatgtgtaagttactaatatatgaattgatgctaaatatatcttacatttgaattccttttggataaagttatttcttgatgtgacacagtagtgtgttttcatttttattctttacatgtgaccaaaacaatagaaaagttaaaaataaaatatagtgttttaggtggc

SEQ ID NO: 445581 - DNA, 4382 bp, Homo sapiens
  misc_feature (19)..(19): n is a, c, g, or t
ttctctacgattctcgagnatcccgacacttgaaaccgtaagactgcaggaaaagggagcattacgatttcagctgaagaaataaaagataatagagtggtcttgtttgaaatggaagccagaaaactggataataaggatctatttggaaagtcagacccatacctggaattccacaagcagacatctgatggaaactggctaatggttcatcggacagaggttgttaaaaacaacttgaatcctgtttggaggcctttcaagatctctcttaactcactgtgttacggagatatggacaaaaccattaaggtggagtgttatgattatgacaatgatgggtcacatgatctcattggaacatttcagaccaccatgacaaaactgaaagaagcctccagaagctcacctgttgaatttgaatgcataaatgagaaaaaaaggcaaaagaaaaaaagctacaagaattcaggtgttatcagtgtgaaacagtgtgagattacagtagaatgcacattccttgactatataatgggaggatgtcagctgaattttactgtgggagtggacttcactggctccaatggtgacccaaggtctccagactcccttcattacatcagccccaatggcgttaatgagtatttgactgctctctggtctgtgggactggtcattcaagattatgatgctgataagatgtttccagcttttggttttggcgctcagatacctcctcagtggcaggtatcacatgaatttccaatgaacttcaacccatccaatccctactgcaatggaatccaaggcattgtagaggcgtatcggtcttgtcttcctcagataaaactctatggaccaactaatttttctccaatcataaatcacgtggccaggtttgctgctgcagccacgcaacagcagacagcttctcaatattttgtgcttttgattattactgatggtgtgatcacagaccttgatgaaaccagacaagctatagttaatgcctccaggctgcctatgtccatcataattgttggagttggaggtgctgacttcagcgccatggagtttctggatggtgatggtggaagtctccgctccccattgggcgaagtggccatcagagatattgtccagtttgtgcctttcagacagttccagaatgctccaaaagaagcacttgctcagtgtgtcttggcagagattccccagcaggtggtgggctacttcaatacatacaaactccttcctcccaagaacccagccacgaaacaacagaagcagtgaccacttcaacagaattcttttgtgttatgtggagcaatgccatctctcaccccaaatcgtgtatctgtcattctacgtactttttacccccagcatttatgatgtaaatctctttctctatggattatatctgtttaaagcattctttctaggttattttggggggacagtgccaagtccatctttgcccagtcaattcagtgattgatagcaatttacattaattgcagtaaagctctttggattagaaattagtgtggggaaagcttattctgttgttgtttttgtttactttcatatgatgaaaatgctgtgtttaagtgtttgtcaataggaagaatggaaaactgttgggatgatgtggtttgcaggttgctgtgcctgattcacagtgtatgttgtataagccaatgtccatacctgattatgagagcttcttaaattatatgatatcaaatttgttcctgtaactctgtatacagtgcttttctgcaaggtaaaaataacctgtctatgcatctgatttttgctacagtttagacactgtggtttacaaaacagcatgcactcaacttgggactttatgaaaagtactgaatgagcaggaaaaggcacatactcagttttttaaatgtacaatcaacaagtaaaaataacctcatgtaagtaagccatttttatttgcctttctagatattttattttattgtggaaaactgtaaacatggtcagatttggctttttttttcattaactgagcaagactttcaggatattgtagatgcacagatggtaggttgtcctgaattctacattattagattactttaattgagatttgttaaaacggttaggactgttttgtccaggaaagataagaggaccaaacatataaggtgaaattcagaattccgtttccttctaactaatgaaaaactgcttactaaaaaaaaattttatactttccttgctaaggtcccatatattgatttgtacagatccacttagtcattttctcctttttttaagaaccattttcatctgatttttaaactcacgataccagttatctgttaatcaaaattgcattttacaatttaataatgtgatatttcctatgtctacagcataccttattaggtataaaacctactgcaacttagaaaaaggaaagaaaaaagaaaacttttccaactgctgcattaagatagggtggattttatgtgctttttttttttaagagttgaatttcttttcctgacttttaccttttacagcgtattacttagtgaacattacattttcagaatagatcctaatattttattgagggcctatgtgctaaaaactatgcatatctatatattggccaattatctttaataatttaccttttgaaattgcatgtttatcatatatccttaagtggacacatacagtgccatgttgatgtgcctctcagttttattgaaaagctgccccacagcccatgtctcttgttctctgcaatgcctcaagggagtgagctctcaaccacagatagctgtggcttctcagaagcagctcattgccaaggccaggctgagaggggacctgcttgctgtggtggttgcctagcccagatgagcatttacctaccaccttcccacttggctagctgtcctttggatatgtgctgttaactggggaaggcatctaactagtagcctgctactccatagtatggctcaatagatgacacatcattttgacattatcaataggagaaaagaaaactaacccttcttctgattgtttggagccatagttgtctcagatgttctaattctctttgtatgcttggaaacagcatagatatgttgctgtggttttcagaattttctcttttaatcacaagaagccttttaaaaaatgacttacacatattctcaatgtacagtaaaacagacagaagtgagcttatctgtttgatgctgtggcagggtcccagtcactgggcatatcctccttctccttaaccagctcctcagcagcccctgagtcacctgcacaaggtgcttgggaactgctggttatgagcattcctggttttcttcagccaaataacaggtaatcactgtcaattggatttggtcttcattattttatattctgattttatcagaattattctattttaaaattgttttaaaatttaaaaacatttaattcatgatcatgttcatcagtagatgctattattcataagaactgtgattccagcaaactagggtaattggtgcctttttacagttttgaataaaagcatttacaatttctaaattatcagttttcacagtttcagcactcaacctcatcatacgctgatttaatattgttttacattaaaatagtccttttccctgttgtgccaccattcatttaagtgctgtttgttcttaaaatgcatttaaagaaaaattacccatattgactttcacacctcatataatcagatctattacaaatatatatcggagtgacggtgcccaggatagatgtaatatttcttacagatgctggcacagaggaaataatataccagctaatctagtcacctaaccttgtggttagaattgcaattttaagaccagaaaaatttgaagtctgatcagagatttacaactgttcattatagtggtgccttaggcaatctttccaaagtaaattcagggccccattgctacttatgccatatttggacatactttttttttcttcaattttgtaaacttcctggaaagctgtcttcactaagtatcccctagtctctatatatgtggttagtagtcatggaaatgacacataaagtacgccagaagtttgatggaacgtgttagaaactgttttgtgcttttatggatgtcatacttgacaatacatgtgtaagttactaatatatgaattgatgctaaatatatcttacatttgaattccttttggataaagttatttcttgatgtgacacagtagtgtgttttcatttttattctttacatgtgaccaaaacaatagaaaagttaaaaataaaatatagtgttttaggtggc

SEQ ID NO: 445582 - DNA, 3084 bp, Homo sapiens
cgtgacatggcatatcatagtgaattatgaagtgcctacaaattcagagtggccgtcctaatactatgaactgctcgtctgaccccagcatttatgatgtaaatctctttctctatggattatatctgtttaaagcattctttctaggttattttggggggacagtgccaagtccatctttgcccagtcaattcagtgattgatagcaatttacattaattgcagtaaagctctttggattagaaattagtgtggggaaagcttattctgttgttgtttttgtttactttcatatgatgaaaatgctgtgtttaagtgtttgtcaataggaagaatggaaaactgttgggatgatgtggtttgcaggttgctgtgcctgattcacagtgtatgttgtataagccaatgtccatacctgattatgagagcttcttaaattatatgatatcaaatttgttcctgtaactctgtatacagtgcttttctgcaaggtaaaaataacctgtctatgcatctgatttttgctacagtttagacactgtggtttacaaaacagcatgcactcaacttgggactttatgaaaagtactgaatgagcaggaaaaggcacatactcagttttttaaatgtacaatcaacaagtaaaaataacctcatgtaagtaagccatttttatttgcctttctagatattttattttattgtggaaaactgtaaacatggtcagatttggctttttttttcattaactgagcaagactttcaggatattgtagatgcacagatggtaggttgtcctgaattctacattattagattactttaattgagatttgttaaaacggttaggactgttttgtccaggaaagataagaggaccaaacatataaggtgaaattcagaattccgtttccttctaactaatgaaaaactgcttactaaaaaaaaattttatactttccttgctaaggtcccatatattgatttgtacagatccacttagtcattttctcctttttttaagaaccattttcatctgatttttaaactcacgataccagttatctgttaatcaaaattgcattttacaatttaataatgtgatatttcctatgtctacagcataccttattaggtataaaacctactgcaacttagaaaaaggaaagaaaaaagaaaacttttccaactgctgcattaagatagggtggattttatgtgctttttttttttaagagttgaatttcttttcctgacttttaccttttacagcgtattacttagtgaacattacattttcagaatagatcctaatattttattgagggcctatgtgctaaaaactatgcatatctatatattggccaattatctttaataatttaccttttgaaattgcatgtttatcatatatccttaagtggacacatacagtgccatgttgatgtgcctctcagttttattgaaaagctgccccacagcccatgtctcttgttctctgcaatgcctcaagggagtgagctctcaaccacagatagctgtggcttctcagaagcagctcattgccaaggccaggctgagaggggacctgcttgctgtggtggttgcctagcccagatgagcatttacctaccaccttcccacttggctagctgtcctttggatatgtgctgttaactggggaaggcatctaactagtagcctgctactccatagtatggctcaatagatgacacatcattttgacattatcaataggagaaaagaaaactaacccttcttctgattgtttggagccatagttgtctcagatgttctaattctctttgtatgcttggaaacagcatagatatgttgctgtggttttcagaattttctcttttaatcacaagaagccttttaaaaaatgacttacacatattctcaatgtacagtaaaacagacagaagtgagcttatctgtttgatgctgtggcagggtcccagtcactgggcatatcctccttctccttaaccagctcctcagcagcccctgagtcacctgcacaaggtgcttgggaactgctggttatgagcattcctggttttcttcagccaaataacaggtaatcactgtcaattggatttggtcttcattattttatattctgattttatcagaattattctattttaaaattgttttaaaatttaaaaacatttaattcatgatcatgttcatcagtagatgctattattcataagaactgtgattccagcaaactagggtaattggtgcctttttacagttttgaataaaagcatttacaatttctaaattatcagttttcacagtttcagcactcaacctcatcatacgctgatttaatattgttttacattaaaatagtccttttccctgttgtgccaccattcatttaagtgctgtttgttcttaaaatgcatttaaagaaaaattacccatattgactttcacacctcatataatcagatctattacaaatatatatcggagtgacggtgcccaggatagatgtaatatttcttacagatgctggcacagaggaaataatataccagctaatctagtcacctaaccttgtggttagaattgcaattttaagaccagaaaaatttgaagtctgatcagagatttacaactgttcattatagtggtgccttaggcaatctttccaaagtaaattcagggccccattgctacttatgccatatttggacatactttttttttcttcaattttgtaaacttcctggaaagctgtcttcactaagtatcccctagtctctatatatgtggttagtagtcatggaaatgacacataaagtacgccagaagtttgatggaacgtgttagaaactgttttgtgcttttatggatgtcatacttgacaatacatgtgtaagttactaatatatgaattgatgctaaatatatcttacatttgaattccttttggataaagttatttcttgatgtgacacagtagtgtgttttcatttttattctttacatgtgaccaaaacaatagaaaagttaaaaataaaatatagtgttttaggtggc

SEQ ID NO: 445583 - DNA, 4387 bp, Homo sapiens
gagccctaggttctcctgaatccctgcggtcccagcgtcgctccggacgctgccaacctgttctccaccgtcgctcgacttccacctctaagactcccacgaaactcaggttgaataattcatcaaattacacaactgaactcaagacatggctgcccagtgtgtcacaaaggtggcgctgaatgtttcctgtgccaatcttttggataaagatatagggtcaaagtcagaccctttatgtgtgttgtttttgaatacaagtggtcaacagtggtatgaggttgagcgcacagaaaggattaagaattgcttgaatccccaattttccaagacatttattattgattactactttgaagtggttcagaaattgaaatttggggtttatgacatcgacaacaaaactattgagctgagtgatgatgacttcttaggggaatgtgaatgtacccttggacaaattgtttccagcaagaagctaactcgaccactggtgatgaaaactggcagacctgcaggaaaagggagcattacgatttcagctgaagaaataaaagataatagagtggtcttgtttgaaatggaagccagaaaactggataataaggatctatttggaaagtcagacccatacctggaattccacaagcagacatctgatggaaactggctaatggttcatcggacagaggttgttaaaaacaacttgaatcctgtttggaggcctttcaagatctctcttaactcactgtgttacggagatatggacaaaaccattaaggtggagtgttatgattatgacaatgatgggtcacatgatctcattggaacatttcagaccaccatgacaaaactgaaagaagcctccagaagctcacctgttgaatttgaatgcataaatgagaaaaaaaggcaaaagaaaaaaagctacaagaattcaggtgttatcagtgtgaaacagtgtgagattacagtagaatgcacattccttgactatataatgggaggatgtcagctgaattttactgtgggagtggacttcactggctccaatggtgacccaaggtctccagactcccttcattacatcagccccaatggcgttaatgagtatttgactgctctctggtctgtgggactggtcattcaagattatgatgctgataagatgtttccagcttttggttttggcgctcagatacctcctcagtggcaggtatcacatgaatttccaatgaacttcaacccatccaatccctactgcaatggaatccaaggcattgtagaggcgtatcggtcttgtcttcctcagataaaactctatggaccaactaatttttctccaatcataaatcacgtggccaggtttgctgctgcagccacgcaacagcagacagcttctcaatattttgtgcttttgattattactgatggtgtgatcacagaccttgatgaaaccagacaagctatagttaatgcctccaggctgcctatgtccatcataattgttggagttggaggtgctgacttcagcgccatggagtttctggatggtgatggtggaagtctccgctccccattgggcgaagtggccatcagagatattgtccagtttgtgcctttcagacagttccagaatgctccaaaagaagcacttgctcagtgtgtcttggcagagattccccagcaggtggtgggctacttcaatacatacaaactccttcctcccaagaacccagccacgaaacaacagaagcagtgaccacttcaacagaattcttttgtgttatgtggagcaatgccatctctcaccccaaatcgtgtatctgtcattctacgtactttttacccccagcatttatgatgtaaatctctttctctatggattatatctgtttaaagcattctttctaggttattttggggggacagtgccaagtccatctttgcccagtcaattcagtgattgatagcaatttacattaattgcagtaaagctctttggattagaaattagtgtggggaaagcttattctgttgttgtttttgtttactttcatatgatgaaaatgctgtgtttaagtgtttgtcaataggaagaatggaaaactgttgggatgatgtggtttgcaggttgctgtgcctgattcacagtgtatgttgtataagccaatgtccatacctgattatgagagcttcttaaattatatgatatcaaatttgttcctgtaactctgtatacagtgcttttctgcaaggtaaaaataacctgtctatgcatctgatttttgctacagtttagacactgtggtttacaaaacagcatgcactcaacttgggactttatgaaaagtactgaatgagcaggaaaaggcacatactcagttttttaaatgtacaatcaacaagtaaaaataacctcatgtaagtaagccatttttatttgcctttctagatattttattttattgtggaaaactgtaaacatggtcagatttggctttttttttcattaactgagcaagactttcaggatattgtagatgcacagatggtaggttgtcctgaattctacattattagattactttaattgagatttgttaaaacggttaggactgttttgtccaggaaagataagaggaccaaacatataaggtgaaattcagaattccgtttccttctaactaatgaaaaactgcttactaaaaaaaaattttatactttccttgctaaggtcccatatattgatttgtacagatccacttagtcattttctcctttttttaagaaccattttcatctgatttttaaactcacgataccagttatctgttaatcaaaattgcattttacaatttaataatgtgatatttcctatgtctacagcataccttattaggtataaaacctactgcaacttagaaaaaggaaagaaaaaagaaaacttttccaactgctgcattaagatagggtggattttatgtgctttttttttttaagagttgaatttcttttcctgacttttaccttttacagcgtattacttagtgaacattacattttcagaatagatcctaatattttattgagggcctatgtgctaaaaactatgcatatctatatattggccaattatctttaataatttaccttttgaaattgcatgtttatcatatatccttaagtggacacatacagtgccatgttgatgtgcctctcagttttattgaaaagctgccccacagcccatgtctcttgttctctgcaatgcctcaagggagtgagctctcaaccacagatagctgtggcttctcagaagcagctcattgccaaggccaggctgagaggggacctgcttgctgtggtggttgcctagcccagatgagcatttacctaccaccttcccacttggctagctgtcctttggatatgtgctgttaactggggaaggcatctaactagtagcctgctactccatagtatggctcaatagatgacacatcattttgacattatcaataggagaaaagaaaactaacccttcttctgattgtttggagccatagttgtctcagatgttctaattctctttgtatgcttggaaacagcatagatatgttgctgtggttttcagaattttctcttttaatcacaagaagccttttaaaaaatgacttacacatattctcaatgtacagtaaaacagacagaagtgagcttatctgtttgatgctgtggcagggtcccagtcactgggcatatcctccttctccttaaccagctcctcagcagcccctgagtcacctgcacaaggtgcttgggaactgctggttatgagcattcctggttttcttcagccaaataacaggtaatcactgtcaattggatttggtcttcattattttatattctgattttatcagaattattctattttaaaattgttttaaaatttaaaaacatttaattcatgatcatgttcatcagtagatgctattattcataagaactgtgattccagcaaactagggtaattggtgcctttttacagttttgaataaaagcatttacaatttctaaattatcagttttcacagtttcagcactcaacctcatcatacgctgatttaatattgttttacattaaaatagtccttttccctgttgtgccaccattcatttaagtgctgtttgttcttaaaatgcatttaaagaaaaattacccatattgacttttcaccactcttaatataaattcggaatctaattaccaaattttataattcggaaagttgaccggtgccccacggaatagatggtaaattaatttctttaccaggaattcctgtcaaccagagggtttttataccccggcttttctggc

SEQ ID NO: 445584 - DNA, 4766 bp, Homo sapiens
gagccctaggttctcctgaatccctgcggtcccagcgtcgctccggacgctgccaacctgttctccaccgtcgctcgacttccacctctaagactcccacgaaactcaggttgaataattcatcaaattacacaactgaactcaagacatggctgcccagtgtgtcacaaaggtggcgctgaatgtttcctgtgccaatcttttggataaagatatagggtcaaagtcagaccctttatgtgtgttgtttttgaatacaagtggtcaacagtggtatgaggttgagcgcacagaaaggattaagaattgcttgaatccccaattttccaagacatttattattgattactactttgaagtggttcagaaattgaaatttggggtttatgacatcgacaacaaaactattgagctgagtgatgatgacttcttaggggaatgtgaatgtacccttggacaaattgtttccagcaagaagctaactcgaccactggtgatgaaaactggcagacctgcaggaaaagggagcattacgatttcagctgaagaaataaaagataatagagtggtcttgtttgaaatggaagccagaaaactggataataaggatctatttggaaagtcagacccatacctggaattccacaagcagacatctgatggaaactggctaatggttcatcggacagaggttgttaaaaacaacttgaatcctgtttggaggcctttcaagatctctcttaactcactgtgttacggagatatggacaaaaccattaaggtggagtgttatgattatgacaatgatgggtcacatgatctcattggaacatttcagaccaccatgacaaaactgaaagaagcctccagaagctcacctgttgaatttgaatgcataaatgagaaaaaaaggcaaaagaaaaaaagctacaagaattcaggtgttatcagtgtgaaacagtgtgagattacagtagaatgcacattccttgactatataatgggaggatgtcagctgaattttactgtgggagtggacttcactggctccaatggtgacccaaggtctccagactcccttcattacatcagccccaatggcgttaatgagtatttgactgctctctggtctgtgggactggtcattcaagattatgatgctgataagatgtttccagcttttggttttggcgctcagatacctcctcagtggcaggtatcacatgaatttccaatgaacttcaacccatccaatccctactgcaatggaatccaaggcattgtagaggcgtatcggtcttgtcttcctcagataaaactctatggaccaactaatttttctccaatcataaatcacgtggccaggtttgctgctgcagccacgcaacagcagacagcttctcaatattttgtgcttttgattattactgatggtgtgatcacagaccttgatgaaaccagacaagctatagttaatgcctccaggctgcctatgtccatcataattgttggagttggaggtgctgacttcagcgccatggagtttctggatggtgatggtggaagtctccgctccccattgggcgaagtggccatcagagatattgtccagtttgtgcctttcagacagttccagaatgctccaaaagaagcacttgctcagtgtgtcttggcagagattccccagcaggtggtgggctacttcaatacatacaaactccttcctcccaagaacccagccacgaaacaacagaagcagtgaccacttcaacagaattcttttgtgttatgtggagcaatgccatctctcaccccaaatcgtgtatctgtcattctacgtactttttacccccagcatttatgatgtaaatctctttctctatggattatatctgtttaaagcattctttctaggttattttggggggacagtgccaagtccatctttgcccagtcaattcagtgattgatagcaatttacattaattgcagtaaagctctttggattagaaattagtgtggggaaagcttattctgttgttgtttttgtttactttcatatgatgaaaatgctgtgtttaagtgtttgtcaataggaagaatggaaaactgttgggatgatgtggtttgcaggttgctgtgcctgattcacagtgtatgttgtataagccaatgtccatacctgattatgagagcttcttaaattatatgatatcaaatttgttcctgtaactctgtatacagtgcttttctgcaaggtaaaaataacctgtctatgcatctgatttttgctacagtttagacactgtggtttacaaaacagcatgcactcaacttgggactttatgaaaagtactgaatgagcaggaaaaggcacatactcagttttttaaatgtacaatcaacaagtaaaaataacctcatgtaagtaagccatttttatttgcctttctagatattttattttattgtggaaaactgtaaacatggtcagatttggctttttttttcattaactgagcaagactttcaggatattgtagatgcacagatggtaggttgtcctgaattctacattattagattactttaattgagatttgttaaaacggttaggactgttttgtccaggaaagataagaggaccaaacatataaggtgaaattcagaattccgtttccttctaactaatgaaaaactgcttactaaaaaaaaattttatactttccttgctaaggtcccatatattgatttgtacagatccacttagtcattttctcctttttttaagaaccattttcatctgatttttaaactcacgataccagttatctgttaatcaaaattgcattttacaatttaataatgtgatatttcctatgtctacagcataccttattaggtataaaacctactgcaacttagaaaaaggaaagaaaaaagaaaacttttccaactgctgcattaagatagggtggattttatgtgctttttttttttaagagttgaatttcttttcctgacttttaccttttacagcgtattacttagtgaacattacattttcagaatagatcctaatattttattgagggcctatgtgctaaaaactatgcatatctatatattggccaattatctttaataatttaccttttgaaattgcatgtttatcatatatccttaagtggacacatacagtgccatgttgatgtgcctctcagttttattgaaaagctgccccacagcccatgtctcttgttctctgcaatgcctcaagggagtgagctctcaaccacagatagctgtggcttctcagaagcagctcattgccaaggccaggctgagaggggacctgcttgctgtggtggttgcctagcccagatgagcatttacctaccaccttcccacttggctagctgtcctttggatatgtgctgttaactggggaaggcatctaactagtagcctgctactccatagtatggctcaatagatgacacatcattttgacattatcaataggagaaaagaaaactaacccttcttctgattgtttggagccatagttgtctcagatgttctaattctctttgtatgcttggaaacagcatagatatgttgctgtggttttcagaattttctcttttaatcacaagaagccttttaaaaaatgacttacacatattctcaatgtacagtaaaacagacagaagtgagcttatctgtttgatgctgtggcagggtcccagtcactgggcatatcctccttctccttaaccagctcctcagcagcccctgagtcacctgcacaaggtgcttgggaactgctggttatgagcattcctggttttcttcagccaaataacaggtaatcactgtcaattggatttggtcttcattattttatattctgattttatcagaattattctattttaaaattgttttaaaatttaaaaacatttaattcatgatcatgttcatcagtagatgctattattcataagaactgtgattccagcaaactagggtaattggtgcctttttacagttttgaataaaagcatttacaatttctaaattatcagttttcacagtttcagcactcaacctcatcatacgctgatttaatattgttttacattaaaatagtccttttccctgttgtgccaccattcatttaagtgctgtttgttcttaaaatgcatttaaagaaaaattacccatattgactttcacacctcatataatcagatctattacaaatatatatcggagtgacggtgcccaggatagatgtaatatttcttacagatgctggcacagaggaaataatataccagctaatctagtcacctaaccttgtggttagaattgcaattttaagaccagaaaaatttgaagtctgatcagagatttacaactgttcattatagtggtgccttaggcaatctttccaaagtaaattcagggccccattgctacttatgccatatttggacatactttttttttcttcaattttgtaaacttcctggaaagctgtcttcactaagtatcccctagtctctatatatgtggttagtagtcatggaaatgacacataaagtacgccagaagtttgatggaacgtgttagaaactgttttgtgcttttatggatgtcatacttgacaatacatgtgtaagttactaatatatgaattgatgctaaatatatcttacatttgaattccttttggataaagttatttcttgatgtga

SEQ ID NO: 445585 - DNA, 4732 bp, Homo sapiens
gagccctaggttctcctgaatccctgcggtcccagcgtcgctccggacgctgccaacctgttctccaccgtcgctcgacttccacctctaagactcccacgaaactcaggttgaataattcatcaaattacacaactgaactcaagacatggctgcccagtgtgtcacaaaggtggcgctgaatgtttcctgtgccaatcttttggataaagatatagggtcaaagtcagaccctttatgtgtgttgtttttgaatacaagtggtcaacagtggtatgaggttgagcgcacagaaaggattaagaattgcttgaatccccaattttccaagacatttattattgattactactttgaagtggttcagaaattgaaatttggggtttatgacatcgacaacaaaactattgagctgagtgatgatgacttcttaggggaatgtgaatgtacccttggacaaattgtttccagcaagaagctaactcgaccactggtgatgaaaactggcagacctgcaggaaaagggagcattacgatttcagctgaagaaataaaagataatagagtggtcttgtttgaaatggaagccagaaaactggataataaggatctatttggaaagtcagacccatacctggaattccacaagcagacatctgatggaaactggctaatggttcatcggacagaggttgttaaaaacaacttgaatcctgtttggaggcctttcaagatctctcttaactcactgtgttacggagatatggacaaaaccattaaggtggagtgttatgattatgacaatgatgggtcacatgatctcattggaacatttcagaccaccatgacaaaactgaaagaagcctccagaagctcacctgttgaatttgaatgcataaatgagaaaaaaaggcaaaagaaaaaaagctacaagaattcaggtgttatcagtgtgaaacagtgtgagattacagtagaatgcacattccttgactatataatgggaggatgtcagctgaattttactgtgggagtggacttcactggctccaatggtgacccaaggtctccagactcccttcattacatcagccccaatggcgttaatgagtatttgactgctctctggtctgtgggactggtcattcaagattatgatgctgataagatgtttccagcttttggttttggcgctcagatacctcctcagtggcaggtatcacatgaatttccaatgaacttcaacccatccaatccctactgcaatggaatccaaggcattgtagaggcgtatcggtcttgtcttcctcagataaaactctatggaccaactaatttttctccaatcataaatcacgtggccaggtttgctgctgcagccacgcaacagcagacagcttctcaatattttgtgcttttgattattactgatggtgtgatcacagaccttgatgaaaccagacaagctatagttaatgcctccaggctgcctatgtccatcataattgttggagttggaggtgctgacttcagcgccatggagtttctggatggtgatggtggaagtctccgctccccattgggcgaagtggccatcagagatattgtccagtttgtgcctttcagacagttccagaatgctccaaaagaagcacttgctcagtgtgtcttggcagagattccccagcaggtggtgggctacttcaatacatacaaactccttcctcccaagaacccagccacgaaacaacagaagcagtgaccacttcaacagaattcttttgtgttatgtggagcaatgccatctctcaccccaaatcgtgtatctgtcattctacgtactttttacccccagcatttatgatgtaaatctctttctctatggattatatctgtttaaagcattctttctaggttattttggggggacagtgccaagtccatctttgcccagtcaattcagtgattgatagcaatttacattaattgcagtaaagctctttggattagaaattagtgtggggaaagcttattctgttgttgtttttgtttactttcatatgatgaaaatgctgtgtttaagtgtttgtcaataggaagaatggaaaactgttgggatgatgtggtttgcaggttgctgtgcctgattcacagtgtatgttgtataagccaatgtccatacctgattatgagagcttcttaaattatatgatatcaaatttgttcctgtaactctgtatacagtgcttttctgcaaggtaaaaataacctgtctatgcatctgatttttgctacagtttagacactgtggtttacaaaacagcatgcactcaacttgggactttatgaaaagtactgaatgagcaggaaaaggcacatactcagttttttaaatgtacaatcaacaagtaaaaataacctcatgtaagtaagccatttttatttgcctttctagatattttattttattgtggaaaactgtaaacatggtcagatttggctttttttttcattaactgagcaagactttcaggatattgtagatgcacagatggtaggttgtcctgaattctacattattagattactttaattgagatttgttaaaacggttaggactgttttgtccaggaaagataagaggaccaaacatataaggtgaaattcagaattccgtttccttctaactaatgaaaaactgcttactaaaaaaaaattttatactttccttgctaaggtcccatatattgatttgtacagatccacttagtcattttctcctttttttaagaaccattttcatctgatttttaaactcacgataccagttatctgttaatcaaaattgcattttacaatttaataatgtgatatttcctatgtctacagcataccttattaggtataaaacctactgcaacttagaaaaaggaaagaaaaaagaaaacttttccaactgctgcattaagatagggtggattttatgtgctttttttttttaagagttgaatttcttttcctgacttttaccttttacagcgtattacttagtgaacattacattttcagaatagatcctaatattttattgagggcctatgtgctaaaaactatgcatatctatatattggccaattatctttaataatttaccttttgaaattgcatgtttatcatatatccttaagtggacacatacagtgccatgttgatgtgcctctcagttttattgaaaagctgccccacagcccatgtctcttgttctctgcaatgcctcaagggagtgagctctcaaccacagatagctgtggcttctcagaagcagctcattgccaaggccaggctgagaggggacctgcttgctgtggtggttgcctagcccagatgagcatttacctaccaccttcccacttggctagctgtcctttggatatgtgctgttaactggggaaggcatctaactagtagcctgctactccatagtatggctcaatagatgacacatcattttgacattatcaataggagaaaagaaaactaacccttcttctgattgtttggagccatagttgtctcagatgttctaattctctttgtatgcttggaaacagcatagatatgttgctgtggttttcagaattttctcttttaatcacaagaagccttttaaaaaatgacttacacatattctcaatgtacagtaaaacagacagaagtgagcttatctgtttgatgctgtggcagggtcccagtcactgggcatatcctccttctccttaaccagctcctcagcagcccctgagtcacctgcacaaggtgcttgggaactgctggttatgagcattcctggttttcttcagccaaataacaggtaatcactgtcaattggatttggtcttcattattttatattctgattttatcagaattattctattttaaaattgttttaaaatttaaaaacatttaattcatgatcatgttcatcagtagatgctattattcataagaactgtgattccagcaaactagggtaattggtgcctttttacagttttgaataaaagcatttacaatttctaaattatcagttttcacagtttcagcactcaacctcatcatacgctgatttaatattgttttacattaaaatagtccttttccctgttgtgccaccattcatttaagtgctgtttgttcttaaaatgcatttaaagaaaaattacccatattgactttcacacctcatataatcagatctattacaaatatatatcggagtgacggtgcccaggatagatgtaatatttcttacagatgctggcacagaggaaataatataccagctaatctagtcacctaaccttgtggttagaattgcaattttaagaccagaaaaatttgaagtctgatcagagatttacaactgttcattatagtggtgccttaggcaatctttccaaagtaaattcagggccccattgctacttatgccatatttggacatactttttttttcttcaattttgtaaacttcctggaaagctgtcttcactaagtatcccctagtctctatatatgtggttagtagtcatggaaatgacacataaagtacgccagaagtttgatggaacgtgttagaaactgttttgtgcttttatggatgtcatacttgacaatacatgtgtaagttactaatatatgaattgatgctaaatatatcttacatttg

SEQ ID NO: 445586 - DNA, 3748 bp, Homo sapiens
  misc_feature (54)..(54): n is a, c, g, or t
tgcattagaggatccccacctctaccccacggggactggtcattcaagattatnatgctgataagatgtttccagcttttggttttggcgctcagatacctcctcagtggcaggtatcacatgaatttccaatgaacttcaacccatccaatccctactgcaatggaatccaaggcattgtagaggcgtatcggtcttgtcttcctcagataaaactctatggaccaactaatttttctccaatcataaatcacgtggccaggtttgctgctgcagccacgcaacagcagacagcttctcaatattttgtgcttttgattattactgatggtgtgatcacagaccttgatgaaaccagacaagctatagttaatgcctccaggctgcctatgtccatcataattgttggagttggaggtgctgacttcagcgccatggagtttctggatggtgatggtggaagtctccgctccccattgggcgaagtggccatcagagatattgtccagtttgtgcctttcagacagttccagaatgctccaaaagaagcacttgctcagtgtgtcttggcagagattccccagcaggtggtgggctacttcaatacatacaaactccttcctcccaagaacccagccacgaaacaacagaagcagtgaccacttcaacagaattcttttgtgttatgtggagcaatgccatctctcaccccaaatcgtgtatctgtcattctacgtactttttacccccagcatttatgatgtaaatctctttctctatggattatatctgtttaaagcattctttctaggttattttggggggacagtgccaagtccatctttgcccagtcaattcagtgattgatagcaatttacattaattgcagtaaagctctttggattagaaattagtgtggggaaagcttattctgttgttgtttttgtttactttcatatgatgaaaatgctgtgtttaagtgtttgtcaataggaagaatggaaaactgttgggatgatgtggtttgcaggttgctgtgcctgattcacagtgtatgttgtataagccaatgtccatacctgattatgagagcttcttaaattatatgatatcaaatttgttcctgtaactctgtatacagtgcttttctgcaaggtaaaaataacctgtctatgcatctgatttttgctacagtttagacactgtggtttacaaaacagcatgcactcaacttgggactttatgaaaagtactgaatgagcaggaaaaggcacatactcagttttttaaatgtacaatcaacaagtaaaaataacctcatgtaagtaagccatttttatttgcctttctagatattttattttattgtggaaaactgtaaacatggtcagatttggctttttttttcattaactgagcaagactttcaggatattgtagatgcacagatggtaggttgtcctgaattctacattattagattactttaattgagatttgttaaaacggttaggactgttttgtccaggaaagataagaggaccaaacatataaggtgaaattcagaattccgtttccttctaactaatgaaaaactgcttactaaaaaaaaattttatactttccttgctaaggtcccatatattgatttgtacagatccacttagtcattttctcctttttttaagaaccattttcatctgatttttaaactcacgataccagttatctgttaatcaaaattgcattttacaatttaataatgtgatatttcctatgtctacagcataccttattaggtataaaacctactgcaacttagaaaaaggaaagaaaaaagaaaacttttccaactgctgcattaagatagggtggattttatgtgctttttttttttaagagttgaatttcttttcctgacttttaccttttacagcgtattacttagtgaacattacattttcagaatagatcctaatattttattgagggcctatgtgctaaaaactatgcatatctatatattggccaattatctttaataatttaccttttgaaattgcatgtttatcatatatccttaagtggacacatacagtgccatgttgatgtgcctctcagttttattgaaaagctgccccacagcccatgtctcttgttctctgcaatgcctcaagggagtgagctctcaaccacagatagctgtggcttctcagaagcagctcattgccaaggccaggctgagaggggacctgcttgctgtggtggttgcctagcccagatgagcatttacctaccaccttcccacttggctagctgtcctttggatatgtgctgttaactggggaaggcatctaactagtagcctgctactccatagtatggctcaatagatgacacatcattttgacattatcaataggagaaaagaaaactaacccttcttctgattgtttggagccatagttgtctcagatgttctaattctctttgtatgcttggaaacagcatagatatgttgctgtggttttcagaattttctcttttaatcacaagaagccttttaaaaaatgacttacacatattctcaatgtacagtaaaacagacagaagtgagcttatctgtttgatgctgtggcagggtcccagtcactgggcatatcctccttctccttaaccagctcctcagcagcccctgagtcacctgcacaaggtgcttgggaactgctggttatgagcattcctggttttcttcagccaaataacaggtaatcactgtcaattggatttggtcttcattattttatattctgattttatcagaattattctattttaaaattgttttaaaatttaaaaacatttaattcatgatcatgttcatcagtagatgctattattcataagaactgtgattccagcaaactagggtaattggtgcctttttacagttttgaataaaagcatttacaatttctaaattatcagttttcacagtttcagcactcaacctcatcatacgctgatttaatattgttttacattaaaatagtccttttccctgttgtgccaccattcatttaagtgctgtttgttcttaaaatgcatttaaagaaaaattacccatattgactttcacacctcatataatcagatctattacaaatatatatcggagtgacggtgcccaggatagatgtaatatttcttacagatgctggcacagaggaaataatataccagctaatctagtcacctaaccttgtggttagaattgcaattttaagaccagaaaaatttgaagtctgatcagagatttacaactgttcattatagtggtgccttaggcaatctttccaaagtaaattcagggccccattgctacttatgccatatttggacatactttttttttcttcaattttgtaaacttcctggaaagctgtcttcactaagtatcccctagtctctatatatgtggttagtagtcatggaaatgacacataaagtacgccagaagtttgatggaacgtgttagaaactgttttgtgcttttatggatgtcatacttgacaatacatgtgtaagttactaatatatgaattgatgctaaatatatcttacatttgaattccttttggataaagttatttcttgatgtgacacagtagtgtgttttcatttttattctttacatgtgaccaaaacaatagaaaagttaaaaataaaatatagtgttttaggtggc

SEQ ID NO: 445587 - DNA, 889 bp, Homo sapiens
tgtattttttgatttttaagtatatatatattttatatggaaacagtatatactagcacatagtaacaatatatatcagcgaagaaaggaatacaccagaaagttaagcatgcttatttctgagtggtgaaatgatagaaaatgtgtaatcagattttttaaaatgcctaaagacaaaagttcccaaggagtacctaagatcaagcaagtcttcttgctggggcctcattatcttactatcttccctgattgggtatgagtatcaccctgttctgcagggttaccaggttcgagcctgtgttcaaggtggtctgaaatgttacacaaacccacagcccttctcccttttccagccacctaatgatccccatggtatccagagagaagacctcatcctgagtcttcgcgctgtgctggcttctacaccacgatttgctgagtttctgctgcccctgttgattgagaaagtggattctgaggttctgagtgccaagttggattctctacagactctggtgagtgatttttcctccttgcaggacccagctaccttttgacaagttaggggtcctaaaggatatagattctaggatagccaaggaacagttcatgggcctcagaagaggatacccaggatttgggcctttgtgtcgacctgaagcccccagctgcatatcgtcgtgtcccatcccccatcccatagtaactgaggaaaggctgaccaggactccctctttaggcttctattttatcaaccagggttatctcctacttctctgttcccttagtaggactgttaaaaatcttaactggtttttctgctgagaccagggctccttcaggtgccattatgctgaggtacctgcacatcctagggtgtctgagtgtg

SEQ ID NO: 445588 - DNA, 582 bp, Homo sapiens
tgtattttttgatttttaagtatatatatattttatatggaaacagtatatactagcacatagtaacaatatatatcagcgaagaaaggaatacaccagaaagttaagcatgcttatttctgagtggtgaaatgatagaaaatgtgtaatcagattttttaaaatgcctaaagacaaaagttcccaaggagtacctaagatcaagcaagtcttcttgctggggcctcattatcttactatcttccctgattgggtatgagtatcaccctgttctgcagggttaccaggttcgagcctgtgttcaaggtggtctgaaatgttacacaaacccacagcccttctcccttttccagccacctaatgatccccatggtatccagagagaagacctcatcctgagtcttcgcgctgtgctggcttctacaccacgatttgctgaggtgggtctagccaaggttagggtatatagcctctgcccatagatggctctgaagaaagagcagtaaaagcatggagaaaaaaatatctggtatacattttagggcatgacaccctgcaagtgtcttgtgtggcaggtatctt

SEQ ID NO: 445589 - DNA, 512 bp, Homo sapiens
aactgtcatgggtctcagtctccaacctctgtggactgtaggggagtcaggcaccatttggcctcctccccagctctgtgatgtgctgcttctctagactgcaggcaccacctgtgtgaaccggacatgaaactggtgtggcctagtgccaagctgttgcaggcagctgcaggtgcatctgcccgggcctgtgactctgtcaccagcaatgtactgcctttactgctggaacagttccacaagcacagtcaggtaagggagcagaatctttgggggaaatgatgggacctgtgtgctaggttccctttctcagagagtgagctaagttttagcttgggccaacatagtagaccttgggttttgctcccattagctgctgctgctgcttcccttactcactttttccctgtctcatacataaaaggatcattctcccaagacaggaggatagcttgaagccaggagttcaagatcagcctgggcaacaaagtgagatcccatctctaaaaaaa

SEQ ID NO: 445590 - DNA, 667 bp, Homo sapiens
aaccagttggagagatgtaggactgctctcttcttaggctttaagaagccctgtccaactcagtggtgtaggtacttgagttctgctcttttagcaaggaggcgttgggagctcacactcctgaatctgcctaatatcagacgtaggcaagagagctgtgagcccaggctcagccaatgcttatctgctctgcgcctccagcagggtggcagcactggaagcatcaggaaccctggctgctctctaccctgtggccttcagcagccacctcgtacccaagctcgctgaggagctgcgtgtaggtatgtgtctctaatcctctgtggcccatccctttccagcaaggctttggggccttcgtgcttcctatcacacagtaaacctttgtctcatgggttgctttcaggggagtcaaatttgactaacggagatgagcccacccaatgctcccggcatctgtgctgtctgcaagccttgtcagctgtatcaacacatcccagcatcgtcaaggagacactgcctctgctgctgcagcatctctggcaagtgaacagaggtaactactaggaataaccaccaacggactgggctgaatagggagctgtagtctctaaggcagtggttctagctgtagctatacataagagtaacagaatcaactctttta

SEQ ID NO: 445591 - DNA, 469 bp, Homo sapiens
ttccccaattgctctctctgtctccaattacaggtaacaaaggccctagtgctcagataccatcctctcagctcctgccttacagcccgggtacgtcctttctggagacagaagaacccaggacctaaacaaactttctggttgctcctattcctcccaaggacttccatcctcccctgtgtgttttttgttttcttttcttttttctttttggagacagggtcttactctgtcacccaggctggagtacagtagtgcaatcacagctcactccagcctcaacctccgtaggctcaagtgatcctcccacttcagcctcgcaagtagctgggactacaggggcaccccaccacacccaactaatgtttgtattttttgtaagaactgggtttggccatgttgcccagactcctagactcaagcagtccacctgccttggcctcccaaagtgctaggattacaggcatga

SEQ ID NO: 445592 - DNA, 3453 bp, Homo sapiens
ttgctacgtctaggcccgcgtggtttatcggccttcgcgttatggccgctgccgcggctgtggaggcggcggcgcctatgggtgccctatggggcctcgtgcacgacttcgtcgtgggtcagcaagagggccccgctgaccaggtggctgcaggtcctctctagagaatccagaaccccgaactcgggcacgaggaatccagcttttgtcacaggtgctactccactgtcacaccttgctcctggagaaggaagtggtacacctgatactgttctatgagaaccggctgaaggaccatcatcttgtgatcccatctgtcctgcagggtttgaaggcacttagcctgtgtgtggccctgcccccagggctggctgtttctgtgcttaaagccatcttccaggaagtgcatgtacagtccctgccacaggtggaccgacacacagtctacaatatcatcaccaattttatgcgaacccgggaagaagagctaaagagcctaggagctgacttcacctttggcttcatccaggtgatggatggggaaaaggatccccgtaatcttctggtggccttccgcatcgtccatgacctcatctccagggactatagcctgggaccctttgtggaggagttgtttgaagtgacatcctgttatttccctatcgattttacccctccacctaatgatccccatggtatccagagagaagacctcatcctgagtcttcgcgctgtgctggcttctacaccacgatttgctgagtttctgctgcccctgttgattgagaaagtggattctgaggttctgagtgccaagttggattctctacagactctgaatgcttgctgtgctgtgtatggacagaaggaactgaaggacttcctccccagcctttgggcttctatccgcagagaggtgttccagacggcaagtgagcgggtggaggcagagggcctggcggccctccactccctgactgcgtgtttgtctcgctctgtgctgagggctgatgctgaggacctccttgactccttccttagcaacattctacaggactgcaggcaccacctgtgtgaaccggacatgaaactggtgtggcctagtgccaagctgttgcaggcagctgcaggtgcatctgcccgggcctgtgactctgtcaccagcaatgtactgcctttactgctggaacagttccacaagcacagtcagagcagccagcggcggacaatccttgaaatgctcctgggtttcttgaagctgcagcagaaatggagctatgaagacaaagatcaaaggcctctgaatggcttcaaggaccagctgtgctcactggtattcatggctctaacagaccccagcacccagcttcagcttgttggcatccgtacactgacagtcttgggtgcccagccagatctcctatcttatgaggacttggagctggcagtgggtcacctgtacagactgagcttcctgaaggaggattcccagagttgcagggtggcagcactggaagcatcaggaaccctggctgctctctaccctgtggccttcagcagccacctcgtacccaagctcgctgaggagctgcgtgtaggggagtcaaatttgactaacggagatgagcccacccaatgctcccggcatctgtgctgtctgcaagccttgtcagctgtatcaacacatcccagcatcgtcaaggagacactgcctctgctgctgcagcatctctggcaagtgaacagagggaatatggttgcacaatccagtgacgttattgctgtctgtcagagcctcagacagatggcagaaaaatgtcagcaggaccctgagagttgctggtatttccaccagacagctataccttgcctgcttgccttggctgtgcaggcctctatgccagagaaggagccctcagttctgagaaaagtactattggaggatgaggtgttggctgccatggtgtctgtcattggcactgctacaacccacctgagccctgagttagctgcccagagtgtgacacacattgtgcccctcttcttggatggcaacgtgtcctttctgcctgaaaacagcttcccgagcagattccagccattccaggatggctcctcagggcagaggcggctgattgcactgcttatggcctttgtctgctccctgcctcgaaatgtggaaatccctcagctgaaccaactcatgcgggagcttttggaactgagctgctgccacagctgccccttttcttccaccgctgctgccaagtgctttgcaggactcctcaacaagcaccctgcagggcagcagctggatgaattcctacagctagctgtggacaaagtggaggctggcctgggctctgggccctgtcgtagtcaggccttcactcttcttctctgggtaacaaaggccctagtgctcagataccatcctctcagctcctgccttacagcccggctcatgggcctcctgagtgacccagaattaggtccagcagcagctgatggcttctctctgctcatgtctgactgcactgatgtgctgactcgtgctggccatgccgaagtgcggatcatgttccgccagcggttcttcacagataatgtgcctgctttggtccagggcttccatgctgctccccaagatgtgaagccaaactacttgaagggtctttctcatgtacttaacaggctgcccaagcctgtactcttgccagagctgcccacgcttctttccttgctgctggaggccctgtcctgccctgactgtgtggtgcagctctccaccctcagctgccttcagcctcttctactggaagcaccccaagtcatgagtcttcacgtggacaccctcgtcaccaagtttctgaacctcagctctagcccttccatggctgtccggatcgccgcactgcagtgcatgcatgctctcactcgcctgcccacccctgtgctgctgccgtacaaaccacaggtgattcgggccttagccaaacccctggatgacaagaagagactggtgcgcaaggaagcagtgtcagccagaggggagtggtttctgttggggagccctggcagctgagccctcagtcctggcctagactgttctgacaatctaacctgggattactaactgttgagccatcttccccaaagcagggaaaccactggtctctgactgcctttcccacagacacagcacaaatgctaggcctctgttgcatggctgtacaaagaacataagagtccatatttctagtggatttgtaaaataagtgtgtgtgagacacttgcgtttgaagaaagatctagggtcctgggtctcttgcatttatatgtcagaaaaggggcgatatgctgctgaggggtgagtgcatatgagtgtggccctgaggaccagggctggcagatgttgtctacctgctgaagaataaagatttcttttggtaa

SEQ ID NO: 445593 - DNA, 3130 bp, Homo sapiens
tgtattttttgatttttaagtatatatatattttatatggaaacagtatatactagcacatagtaacaatatatatcagcgaagaaaggaatacaccagaaagttaagcatgcttatttctgagtggtgaaatgatagaaaatgtgtaatcagattttttaaaatgcctaaagacaaaagttcccaaggagtacctaagatcaagcaagtcttcttgctggggcctcattatcttactatcttccctgattgggtatgagtatcaccctgttctgcagggttaccaggttcgagcctgtgttcaaggtggtctgaaatgttacacaaacccacagcccttctcccttttccagccacctaatgatccccatggtatccagagagaagacctcatcctgagtcttcgcgctgtgctggcttctacaccacgatttgctgagtttctgctgcccctgttgattgagaaagtggattctgaggttctgagtgccaagttggattctctacagactctgaatgcttgctgtgctgtgtatggacagaaggaactgaaggacttcctccccagcctttgggcttctatccgcagagaggtgttccagacggcaagtgagcgggtggaggcagagggcctggcggccctccactccctgactgcgtgtttgtctcgctctgtgctgagggctgatgctgaggacctccttgactccttccttagcaacattctacaggactgcaggcaccacctgtgtgaaccggacatgaaactggtgtggcctagtgccaagctgttgcaggcagctgcaggtgcatctgcccgggcctgtgactctgtcaccagcaatgtactgcctttactgctggaacagttccacaagcacagtcagagcagccagcggcggacaatccttgaaatgctcctgggtttcttgaagctgcagcagaaatggagctatgaagacaaagatcaaaggcctctgaatggcttcaaggaccagctgtgctcactggtattcatggctctaacagaccccagcacccagcttcagcttgttggcatccgtacactgacagtcttgggtgcccagccagatctcctatcttatgaggacttggagctggcagtgggtcacctgtacagactgagcttcctgaaggaggattcccagagttgcagggtggcagcactggaagcatcaggaaccctggctgctctctaccctgtggccttcagcagccacctcgtacccaagctcgctgaggagctgcgtgtaggggagtcaaatttgactaacggagatgagcccacccaatgctcccggcatctgtgctgtctgcaagccttgtcagctgtatcaacacatcccagcatcgtcaaggagacactgcctctgctgctgcagcatctctggcaagtgaacagagggaatatggttgcacaatccagtgacgttattgctgtctgtcagagcctcagacagatggcagaaaaatgtcagcaggaccctgagagttgctggtatttccaccagacagctataccttgcctgcttgccttggctgtgcaggcctctatgccagagaaggagccctcagttctgagaaaagtactattggaggatgaggtgttggctgccatggtgtctgtcattggcactgctacaacccacctgagccctgagttagctgcccagagtgtgacacacattgtgcccctcttcttggatggcaacgtgtcctttctgcctgaaaacagcttcccgagcagattccagccattccaggatggctcctcagggcagaggcggctgattgcactgcttatggcctttgtctgctccctgcctcgaaatgtggaaatccctcagctgaaccaactcatgcgggagcttttggaactgagctgctgccacagctgccccttttcttccaccgctgctgccaagtgctttgcaggactcctcaacaagcaccctgcagggcagcagctggatgaattcctacagctagctgtggacaaagtggaggctggcctgggctctgggccctgtcgtagtcaggccttcactcttcttctctgggtaacaaaggccctagtgctcagataccatcctctcagctcctgccttacagcccggctcatgggcctcctgagtgacccagaattaggtccagcagcagctgatggcttctctctgctcatgtctgactgcactgatgtgctgactcgtgctggccatgccgaagtgcggatcatgttccgccagcggttcttcacagataatgtgcctgctttggtccagggcttccatgctgctccccaagatgtgaagccaaactacttgaagggtctttctcatgtacttaacaggctgcccaagcctgtactcttgccagagctgcccacgcttctttccttgctgctggaggccctgtcctgccctgactgtgtggtgcagctctccaccctcagctgccttcagcctcttctactggaagcaccccaagtcatgagtcttcacgtggacaccctcgtcaccaagtttctgaacctcagctctagcccttccatggctgtccggatcgccgcactgcagtgcatgcatgctctcactcgcctgcccacccctgtgctgctgccgtacaaaccacaggtgattcgggccttagccaaacccctggatgacaagaagagactggtgcgcaaggaagcagtgtcagccagaggggagtggtttctgttggggagccctggcagctgagccctcagtcctggcctagactgttctgacaatctaacctgggattactaactgttgagccatcttccccaaagcagggaaaccactggtctctgactgcctttcccacagacacagcacaaatgctaggcctctgttgcatggctgtacaaagaacataagagtccatatttctagtggatttgtaaaataagtgtgtgtgagacacttgcgtttgaagaaagatctagggtcctgggtctcttgcatttatatgtcagaaaaggggcgatatgctgctgaggggtgagtgcatatgagtgtggccctgaggaccagggctggcagatgttgtctacctgctgaagaataaagatttcttttggtaa

SEQ ID NO: 445594 - DNA, 2807 bp, Homo sapiens
tatctgagtacgaggccggtgtgaattaggccacctaatgatccccatggtatccagagagaagacctcatcctgagtcttcgcgctgtgctggcttctacaccacgatttgctgagtttctgctgcccctgttgattgagaaagtggattctgaggttctgagtgccaagttggattctctacagactctgaatgcttgctgtgctgtgtatggacagaaggaactgaaggacttcctccccagcctttgggcttctatccgcagagaggtgttccagacggcaagtgagcgggtggaggcagagggcctggcggccctccactccctgactgcgtgtttgtctcgctctgtgctgagggctgatgctgaggacctccttgactccttccttagcaacattctacaggactgcaggcaccacctgtgtgaaccggacatgaaactggtgtggcctagtgccaagctgttgcaggcagctgcaggtgcatctgcccgggcctgtgactctgtcaccagcaatgtactgcctttactgctggaacagttccacaagcacagtcagagcagccagcggcggacaatccttgaaatgctcctgggtttcttgaagctgcagcagaaatggagctatgaagacaaagatcaaaggcctctgaatggcttcaaggaccagctgtgctcactggtattcatggctctaacagaccccagcacccagcttcagcttgttggcatccgtacactgacagtcttgggtgcccagccagatctcctatcttatgaggacttggagctggcagtgggtcacctgtacagactgagcttcctgaaggaggattcccagagttgcagggtggcagcactggaagcatcaggaaccctggctgctctctaccctgtggccttcagcagccacctcgtacccaagctcgctgaggagctgcgtgtaggggagtcaaatttgactaacggagatgagcccacccaatgctcccggcatctgtgctgtctgcaagccttgtcagctgtatcaacacatcccagcatcgtcaaggagacactgcctctgctgctgcagcatctctggcaagtgaacagagggaatatggttgcacaatccagtgacgttattgctgtctgtcagagcctcagacagatggcagaaaaatgtcagcaggaccctgagagttgctggtatttccaccagacagctataccttgcctgcttgccttggctgtgcaggcctctatgccagagaaggagccctcagttctgagaaaagtactattggaggatgaggtgttggctgccatggtgtctgtcattggcactgctacaacccacctgagccctgagttagctgcccagagtgtgacacacattgtgcccctcttcttggatggcaacgtgtcctttctgcctgaaaacagcttcccgagcagattccagccattccaggatggctcctcagggcagaggcggctgattgcactgcttatggcctttgtctgctccctgcctcgaaatgtggaaatccctcagctgaaccaactcatgcgggagcttttggaactgagctgctgccacagctgccccttttcttccaccgctgctgccaagtgctttgcaggactcctcaacaagcaccctgcagggcagcagctggatgaattcctacagctagctgtggacaaagtggaggctggcctgggctctgggccctgtcgtagtcaggccttcactcttcttctctgggtaacaaaggccctagtgctcagataccatcctctcagctcctgccttacagcccggctcatgggcctcctgagtgacccagaattaggtccagcagcagctgatggcttctctctgctcatgtctgactgcactgatgtgctgactcgtgctggccatgccgaagtgcggatcatgttccgccagcggttcttcacagataatgtgcctgctttggtccagggcttccatgctgctccccaagatgtgaagccaaactacttgaagggtctttctcatgtacttaacaggctgcccaagcctgtactcttgccagagctgcccacgcttctttccttgctgctggaggccctgtcctgccctgactgtgtggtgcagctctccaccctcagctgccttcagcctcttctactggaagcaccccaagtcatgagtcttcacgtggacaccctcgtcaccaagtttctgaacctcagctctagcccttccatggctgtccggatcgccgcactgcagtgcatgcatgctctcactcgcctgcccacccctgtgctgctgccgtacaaaccacaggtgattcgggccttagccaaacccctggatgacaagaagagactggtgcgcaaggaagcagtgtcagccagaggggagtggtttctgttggggagccctggcagctgagccctcagtcctggcctagactgttctgacaatctaacctgggattactaactgttgagccatcttccccaaagcagggaaaccactggtctctgactgcctttcccacagacacagcacaaatgctaggcctctgttgcatggctgtacaaagaacataagagtccatatttctagtggatttgtaaaataagtgtgtgtgagacacttgcgtttgaagaaagatctagggtcctgggtctcttgcatttatatgtcagaaaaggggcgatatgctgctgaggggtgagtgcatatgagtgtggccctgaggaccagggctggcagatgttgtctacctgctgaagaataaagatttcttttggtaa

SEQ ID NO: 445595 - DNA, 2881 bp, Homo sapiens
cctgtttttgaggtagtggggctctggtcactgcttggcaggaaggttagcttacattcatagctcctgacttgagtacagctccttgatgtagtacctgcttttagggactgatggcaaggacagggttgaccttgatgtgactgacacaccacccatctcaggcttaagatcttccttctgtcccacagtttctgctgcccctgttgattgagaaagtggattctgaggttctgagtgccaagttggattctctacagactctgaatgcttgctgtgctgtgtatggacagaaggaactgaaggacttcctccccagcctttgggcttctatccgcagagaggtgttccagacggcaagtgagcgggtggaggcagagggcctggcggccctccactccctgactgcgtgtttgtctcgctctgtgctgagggctgatgctgaggacctccttgactccttccttagcaacattctacaggactgcaggcaccacctgtgtgaaccggacatgaaactggtgtggcctagtgccaagctgttgcaggcagctgcaggtgcatctgcccgggcctgtgactctgtcaccagcaatgtactgcctttactgctggaacagttccacaagcacagtcagagcagccagcggcggacaatccttgaaatgctcctgggtttcttgaagctgcagcagaaatggagctatgaagacaaagatcaaaggcctctgaatggcttcaaggaccagctgtgctcactggtattcatggctctaacagaccccagcacccagcttcagcttgttggcatccgtacactgacagtcttgggtgcccagccagatctcctatcttatgaggacttggagctggcagtgggtcacctgtacagactgagcttcctgaaggaggattcccagagttgcagggtggcagcactggaagcatcaggaaccctggctgctctctaccctgtggccttcagcagccacctcgtacccaagctcgctgaggagctgcgtgtaggggagtcaaatttgactaacggagatgagcccacccaatgctcccggcatctgtgctgtctgcaagccttgtcagctgtatcaacacatcccagcatcgtcaaggagacactgcctctgctgctgcagcatctctggcaagtgaacagagggaatatggttgcacaatccagtgacgttattgctgtctgtcagagcctcagacagatggcagaaaaatgtcagcaggaccctgagagttgctggtatttccaccagacagctataccttgcctgcttgccttggctgtgcaggcctctatgccagagaaggagccctcagttctgagaaaagtactattggaggatgaggtgttggctgccatggtgtctgtcattggcactgctacaacccacctgagccctgagttagctgcccagagtgtgacacacattgtgcccctcttcttggatggcaacgtgtcctttctgcctgaaaacagcttcccgagcagattccagccattccaggatggctcctcagggcagaggcggctgattgcactgcttatggcctttgtctgctccctgcctcgaaatgtggaaatccctcagctgaaccaactcatgcgggagcttttggaactgagctgctgccacagctgccccttttcttccaccgctgctgccaagtgctttgcaggactcctcaacaagcaccctgcagggcagcagctggatgaattcctacagctagctgtggacaaagtggaggctggcctgggctctgggccctgtcgtagtcaggccttcactcttcttctctgggtaacaaaggccctagtgctcagataccatcctctcagctcctgccttacagcccggctcatgggcctcctgagtgacccagaattaggtccagcagcagctgatggcttctctctgctcatgtctgactgcactgatgtgctgactcgtgctggccatgccgaagtgcggatcatgttccgccagcggttcttcacagataatgtgcctgctttggtccagggcttccatgctgctccccaagatgtgaagccaaactacttgaagggtctttctcatgtacttaacaggctgcccaagcctgtactcttgccagagctgcccacgcttctttccttgctgctggaggccctgtcctgccctgactgtgtggtgcagctctccaccctcagctgccttcagcctcttctactggaagcaccccaagtcatgagtcttcacgtggacaccctcgtcaccaagtttctgaacctcagctctagcccttccatggctgtccggatcgccgcactgcagtgcatgcatgctctcactcgcctgcccacccctgtgctgctgccgtacaaaccacaggtgattcgggccttagccaaacccctggatgacaagaagagactggtgcgcaaggaagcagtgtcagccagaggggagtggtttctgttggggagccctggcagctgagccctcagtcctggcctagactgttctgacaatctaacctgggattactaactgttgagccatcttccccaaagcagggaaaccactggtctctgactgcctttcccacagacacagcacaaatgctaggcctctgttgcatggctgtacaaagaacataagagtccatatttctagtggatttgtaaaataagtgtgtgtgagacacttgcgtttgaagaaagatctagggtcctgggtctcttgcatttatatgtcagaaaaggggcgatatgctgctgaggggtgagtgcatatgagtgtggccctgaggaccagggctggcagatgttgtctacctgctgaagaataaagatttcttttggtaa

SEQ ID NO: 445596 - DNA, 3432 bp, Homo sapiens
ttgctacgtctaggcccgcgtggtttatcggccttcgcgttatggccgctgccgcggctgtggaggcggcggcgcctatgggtgccctatggggcctcgtgcacgacttcgtcgtgggtcagcaagagggccccgctgaccaggtggctgcaggtcctctctagagaatccagaaccccgaactcgggcacgaggaatccagcttttgtcacaggtgctactccactgtcacaccttgctcctggagaaggaagtggtacacctgatactgttctatgagaaccggctgaaggaccatcatcttgtgatcccatctgtcctgcagggtttgaaggcacttagcctgtgtgtggccctgcccccagggctggctgtttctgtgcttaaagccatcttccaggaagtgcatgtacagtccctgccacaggtggaccgacacacagtctacaatatcatcaccaattttatgcgaacccgggaagaagagctaaagagcctaggagctgacttcacctttggcttcatccaggtgatggatggggaaaaggatccccgtaatcttctggtggccttccgcatcgtccatgacctcatctccagggactatagcctgggaccctttgtggaggagttgtttgaagtgacatcctgttatttccctatcgattttacccctccacctaatgatccccatggtatccagagagaagacctcatcctgagtcttcgcgctgtgctggcttctacaccacgatttgctgagtttctgctgcccctgttgattgagaaagtggattctgaggttctgagtgccaagttggattctctacagactctgaatgcttgctgtgctgtgtatggacagaaggaactgaaggacttcctccccagcctttgggcttctatccgcagagaggtgttccagacggcaagtgagcgggtggaggcagagggcctggcggccctccactccctgactgcgtgtttgtctcgctctgtgctgagggctgatgctgaggacctccttgactccttccttagcaacattctacaggactgcaggcaccacctgtgtgaaccggacatgaaactggtgtggcctagtgccaagctgttgcaggcagctgcaggtgcatctgcccgggcctgtgactctgtcaccagcaatgtactgcctttactgctggaacagttccacaagcacagtcagagcagccagcggcggacaatccttgaaatgctcctgggtttcttgaagctgcagcagaaatggagctatgaagacaaagatcaaaggcctctgaatggcttcaaggaccagctgtgctcactggtattcatggctctaacagaccccagcacccagcttcagcttgttggcatccgtacactgacagtcttgggtgcccagccagatctcctatcttatgaggacttggagctggcagtgggtcacctgtacagactgagcttcctgaaggaggattcccagagttgcagggtggcagcactggaagcatcaggaaccctggctgctctctaccctgtggccttcagcagccacctcgtacccaagctcgctgaggagctgcgtgtaggggagtcaaatttgactaacggagatgagcccacccaatgctcccggcatctgtgctgtctgcaagccttgtcagctgtatcaacacatcccagcatcgtcaaggagacactgcctctgctgctgcagcatctctggcaagtgaacagagggaatatggttgcacaatccagtgacgttattgctgtctgtcagagcctcagacagatggcagaaaaatgtcagcaggaccctgagagttgctggtatttccaccagacagctataccttgcctgcttgccttggctgtgcaggcctctatgccagagaaggagccctcagttctgagaaaagtactattggaggatgaggtgttggctgccatggtgtctgtcattggcactgctacaacccacctgagccctgagttagctgcccagagtgtgacacacattgtgcccctcttcttggatggcaacgtgtcctttctgcctgaaaacagcttcccgagcagattccagccattccaggatggctcctcagggcagaggcggctgattgcactgcttatggcctttgtctgctccctgcctcgaaatgtggaaatccctcagctgaaccaactcatgcgggagcttttggaactgagctgctgccacagctgccccttttcttccaccgctgctgccaagtgctttgcaggactcctcaacaagcaccctgcagggcagcagctggatgaattcctacagctagctgtggacaaagtggaggctggcctgggctctgggccctgtcgtagtcaggccttcactcttcttctctgggtaacaaaggccctagtgctcagataccatcctctcagctcctgccttacagcccggctcatgggcctcctgagtgacccagaattaggtccagcagcagctgatggcttctctctgctcatgtctgactgcactgatgtgctgactcgtgctggccatgccgaagtgcggatcatgttccgccagcggttcttcacagataatgtgcctgctttggtccagggcttccatgctgctccccaagatgtgaagccaaactacttgaagggtctttctcatgtacttaacaggctgcccaagcctgtactcttgccagagctgcccacggccctgtcctgccctgactgtgtggtgcagctctccaccctcagctgccttcagcctcttctactggaagcaccccaagtcatgagtcttcacgtggacaccctcgtcaccaagtttctgaacctcagctctagcccttccatggctgtccggatcgccgcactgcagtgcatgcatgctctcactcgcctgcccacccctgtgctgctgccgtacaaaccacaggtgattcgggccttagccaaacccctggatgacaagaagagactggtgcgcaaggaagcagtgtcagccagaggggagtggtttctgttggggagccctggcagctgagccctcagtcctggcctagactgttctgacaatctaacctgggattactaactgttgagccatcttccccaaagcagggaaaccactggtctctgactgcctttcccacagacacagcacaaatgctaggcctctgttgcatggctgtacaaagaacataagagtccatatttctagtggatttgtaaaataagtgtgtgtgagacacttgcgtttgaagaaagatctagggtcctgggtctcttgcatttatatgtcagaaaaggggcgatatgctgctgaggggtgagtgcatatgagtgtggccctgaggaccagggctggcagatgttgtctacctgctgaagaataaagatttcttttggtaa

SEQ ID NO: 445597 - DNA, 3658 bp, Homo sapiens
ttgctacgtctaggcccgcgtggtttatcggccttcgcgttatggccgctgccgcggctgtggaggcggcggcgcctatgggtgccctatggggcctcgtgcacgacttcgtcgtgggtcagcaagagggccccgctgaccaggtggctgcaggtcctctctagagaatccagaaccccgaactcgggcacgaggaatccagcttttgtcacaggtgctactccactgtcacaccttgctcctggagaaggaagtggtacacctgatactgttctatgagaaccggctgaaggaccatcatcttgtgatcccatctgtcctgcagggtttgaaggcacttagcctgtgtgtggccctgcccccagggctggctgtttctgtgcttaaagccatcttccaggaagtgcatgtacagtccctgccacaggtggaccgacacacagtctacaatatcatcaccaattttatgcgaacccgggaagaagagctaaagagcctaggagctgacttcacctttggcttcatccaggtgatggatggggaaaaggatccccgtaatcttctggtggccttccgcatcgtccatgacctcatctccagggactatagcctgggaccctttgtggaggagttgtttgaagtgacatcctgttatttccctatcgattttacccctccacctaatgatccccatggtatccagagagaagacctcatcctgagtcttcgcgctgtgctggcttctacaccacgatttgctgagtttctgctgcccctgttgattgagaaagtggattctgaggttctgagtgccaagttggattctctacagactctgaatgcttgctgtgctgtgtatggacagaaggaactgaaggacttcctccccagcctttgggcttctatccgcagagaggtgttccagacggcaagtgagcgggtggaggcagagggcctggcggccctccactccctgactgcgtgtttgtctcgctctgtgctgagggctgatgctgaggacctccttgactccttccttagcaacattctacaggactgcaggcaccacctgtgtgaaccggacatgaaactggtgtggcctagtgccaagctgttgcaggcagctgcaggtgcatctgcccgggcctgtgactctgtcaccagcaatgtactgcctttactgctggaacagttccacaagcacagtcagagcagccagcggcggacaatccttgaaatgctcctgggtttcttgaagctgcagcagaaatggagctatgaagacaaagatcaaaggcctctgaatggcttcaaggaccagctgtgctcactggtattcatggctctaacagaccccagcacccagcttcagcttgttggcatccgtacactgacagtcttgggtgcccagccagatctcctatcttatgaggacttggagctggcagtgggtcacctgtacagactgagcttcctgaaggaggattcccagagttgcagggtggcagcactggaagcatcaggaaccctggctgctctctaccctgtggccttcagcagccacctcgtacccaagctcgctgaggagctgcgtgtaggggagtcaaatttgactaacggagatgagcccacccaatgctcccggcatctgtgctgtctgcaagccttgtcagctgtatcaacacatcccagcatcgtcaaggagacactgcctctgctgctgcagcatctctggcaagtgaacagagggaatatggttgcacaatccagtgacgttattgctgtctgtcagagcctcagacagatggcagaaaaatgtcagcaggaccctgagagttgctggtatttccaccagacagctataccttgcctgcttgccttggctgtgcaggcctctatgccagagaaggagccctcagttctgagaaaagtactattggaggatgaggtgttggctgccatggtgtctgtcattggcactgctacaacccacctgagccctgagttagctgcccagagtgtgacacacattgtgcccctcttcttggatggcaacgtgtcctttctgcctgaaaacagcttcccgagcagattccagccattccaggatggctcctcagggcagaggcggctgattgcactgcttatggcctttgtctgctccctgcctcgaaatgtaagtgagcacatttgggaagtactgttatttaaccttgacaaggtgactccgggctgaaatttgccacaggctaagctgatcttttacttcccccaccagagaagttagttctcatccgtcccggtccctgctgccactatgtactggttctcttggagttcaagtgttctctgggtccattacatggccaggttttctgtaggtggaaatccctcagctgaaccaactcatgcgggagcttttggaactgagctgctgccacagctgccccttttcttccaccgctgctgccaagtgctttgcaggactcctcaacaagcaccctgcagggcagcagctggatgaattcctacagctagctgtggacaaagtggaggctggcctgggctctgggccctgtcgtagtcaggccttcactcttcttctctgggtaacaaaggccctagtgctcagataccatcctctcagctcctgccttacagcccggctcatgggcctcctgagtgacccagaattaggtccagcagcagctgatggcttctctctgctcatgtctgactgcactgatgtgctgactcgtgctggccatgccgaagtgcggatcatgttccgccagcggttcttcacagataatgtgcctgctttggtccagggcttccatgctgctccccaagatgtgaagccaaactacttgaagggtctttctcatgtacttaacaggctgcccaagcctgtactcttgccagagctgcccacgcttctttccttgctgctggaggccctgtcctgccctgactgtgtggtgcagctctccaccctcagctgccttcagcctcttctactggaagcaccccaagtcatgagtcttcacgtggacaccctcgtcaccaagtttctgaacctcagctctagcccttccatggctgtccggatcgccgcactgcagtgcatgcatgctctcactcgcctgcccacccctgtgctgctgccgtacaaaccacaggtgattcgggccttagccaaacccctggatgacaagaagagactggtgcgcaaggaagcagtgtcagccagaggggagtggtttctgttggggagccctggcagctgagccctcagtcctggcctagactgttctgacaatctaacctgggattactaactgttgagccatcttccccaaagcagggaaaccactggtctctgactgcctttcccacagacacagcacaaatgctaggcctctgttgcatggctgtacaaagaacataagagtccatatttctagtggatttgtaaaataagtgtgtgtgagacacttgcgtttgaagaaagatctagggtcctgggtctcttgcatttatatgtcagaaaaggggcgatatgctgctgaggggtgagtgcatatgagtgtggccctgaggaccagggctggcagatgttgtctacctgctgaagaataaagatttcttttggtaa

SEQ ID NO: 445598 - DNA, 3473 bp, Homo sapiens
ttgctacgtctaggcccgcgtggtttatcggccttcgcgttatggccgctgccgcggctgtggaggcggcggcgcctatgggtgccctatggggcctcgtgcacgacttcgtcgtgggtcagcaagagggccccgctgaccaggtggctgcaggtcctctctagagaatccagaaccccgaactcgggcacgaggaatccagcttttgtcacaggtgctactccactgtcacaccttgctcctggagaaggaagtggtacacctgatactgttctatgagaaccggctgaaggaccatcatcttgtgatcccatctgtcctgcagggtttgaaggcacttagcctgtgtgtggccctgcccccagggctggctgtttctgtgcttaaagccatcttccaggaagtgcatgtacagtccctgccacaggtggaccgacacacagtctacaatatcatcaccaattttatgcgaacccgggaagaagagctaaagagcctaggagctgacttcacctttggcttcatccaggtgatggatggggaaaaggatccccgtaatcttctggtggccttccgcatcgtccatgacctcatctccagggactatagcctgggaccctttgtggaggagttgtttgaagtgacatcctgttatttccctatcgattttacccctccacctaatgatccccatggtatccagagagaagacctcatcctgagtcttcgcgctgtgctggcttctacaccacgatttgctgagtttctgctgcccctgttgattgagaaagtggattctgaggttctgagtgccaagttggattctctacagactctgaatgcttgctgtgctgtgtatggacagaaggaactgaaggacttcctccccagcctttgggcttctatccgcagagaggtgttccagacggcaagtgagcgggtggaggcagagggcctggcggccctccactccctgactgcgtgtttgtctcgctctgtgctgagggctgatgctgaggacctccttgactccttccttagcaacattctacaggactgcaggcaccacctgtgtgaaccggacatgaaactggtgtggcctagtgccaagctgttgcaggcagctgcaggtgcatctgcccgggcctgtgactctgtcaccagcaatgtactgcctttactgctggaacagttccacaagcacagtcagtaccccttgaaacgttacagagcagccagcggcggacaatccttgaaatgctcctgggtttcttgaagctgcagcagaaatggagctatgaagacaaagatcaaaggcctctgaatggcttcaaggaccagctgtgctcactggtattcatggctctaacagaccccagcacccagcttcagcttgttggcatccgtacactgacagtcttgggtgcccagccagatctcctatcttatgaggacttggagctggcagtgggtcacctgtacagactgagcttcctgaaggaggattcccagagttgcagggtggcagcactggaagcatcaggaaccctggctgctctctaccctgtggccttcagcagccacctcgtacccaagctcgctgaggagctgcgtgtaggggagtcaaatttgactaacggagatgagcccacccaatgctcccggcatctgtgctgtctgcaagccttgtcagctgtatcaacacatcccagcatcgtcaaggagacactgcctctgctgctgcagcatctctggcaagtgaacagagggaatatggttgcacaatccagtgacgttattgctgtctgtcagagcctcagacagatggcagaaaaatgtcagcaggaccctgagagttgctggtatttccaccagacagctataccttgcctgcttgccttggctgtgcaggcctctatgccagagaaggagccctcagttctgagaaaagtactattggaggatgaggtgttggctgccatggtgtctgtcattggcactgctacaacccacctgagccctgagttagctgcccagagtgtgacacacattgtgcccctcttcttggatggcaacgtgtcctttctgcctgaaaacagcttcccgagcagattccagccattccaggatggctcctcagggcagaggcggctgattgcactgcttatggcctttgtctgctccctgcctcgaaatgtggaaatccctcagctgaaccaactcatgcgggagcttttggaactgagctgctgccacagctgccccttttcttccaccgctgctgccaagtgctttgcaggactcctcaacaagcaccctgcagggcagcagctggatgaattcctacagctagctgtggacaaagtggaggctggcctgggctctgggccctgtcgtagtcaggccttcactcttcttctctgggtaacaaaggccctagtgctcagataccatcctctcagctcctgccttacagcccggctcatgggcctcctgagtgacccagaattaggtccagcagcagctgatggcttctctctgctcatgtctgactgcactgatgtgctgactcgtgctggccatgccgaagtgcggatcatgttccgccagcggttcttcacagataatgtgcctgctttggtccagggcttccatgctgctccccaagatgtgaagccaaactacttgaagggtctttctcatgtacttaacaggctgcccaagcctgtactcttgccagagctgcccacgcttctttccttgctgctggaggccctgtcctgccctgactgtgtggtgcagctctccaccctcagctgccttcagcctcttctactggaagcaccccaagtcatgagtcttcacgtggacaccctcgtcaccaagtttctgaacctcagctctagcccttccatggctgtccggatcgccgcactgcagtgcatgcatgctctcactcgcctgcccacccctgtgctgctgccgtacaaaccacaggtgattcgggccttagccaaacccctggatgacaagaagagactggtgcgcaaggaagcagtgtcagccagaggggagtggtttctgttggggagccctggcagctgagccctcagtcctggcctagactgttctgacaatctaacctgggattactaactgttgagccatcttccccaaagcagggaaaccactggtctctgactgcctttcccacagacacagcacaaatgctaggcctctgttgcatggctgtacaaagaacataagagtccatatttctagtggatttgtaaaataagtgtgtgtgagacacttgcgtttgaagaaagatctagggtcctgggtctcttgcatttatatgtcagaaaaggggcgatatgctgctgaggggtgagtgcatatgagtgtggccctgaggaccagggctggcagatgttgtctacctgctgaagaataaagatttcttttggtaa

SEQ ID NO: 445599 - DNA, 3594 bp, Homo sapiens
ttgctacgtctaggcccgcgtggtttatcggccttcgcgttatggccgctgccgcggctgtggaggcggcggcgcctatgggtgccctatggggcctcgtgcacgacttcgtcgtgggtcagcaagagggccccgctgaccaggtggctgcaggtcctctctagagaatccagaaccccgaactcgggcacgaggaatccagcttttgtcacaggtgctactccactgtcacaccttgctcctggagaaggaagtggtacacctgatactgttctatgagaaccggctgaaggaccatcatcttgtgatcccatctgtcctgcagggtttgaaggcacttagcctgtgtgtggccctgcccccagggctggctgtttctgtgcttaaagccatcttccaggaagtgcatgtacagtccctgccacaggtggaccgacacacagtctacaatatcatcaccaattttatgcgaacccgggaagaagagctaaagagcctaggagctgacttcacctttggcttcatccaggtgatggatggggaaaaggatccccgtaatcttctggtggccttccgcatcgtccatgacctcatctccagggactatagcctgggaccctttgtggaggagttgtttgaagtgacatcctgttatttccctatcgattttacccctccacctaatgatccccatggtatccagagagaagacctcatcctgagtcttcgcgctgtgctggcttctacaccacgatttgctgagtttctgctgcccctgttgattgagaaagtggattctgaggttctgagtgccaagttggattctctacagactctgaatgcttgctgtgctgtgtatggacagaaggaactgaaggacttcctccccagcctttgggcttctatccgcagagaggtgttccagacggcaagtgagcgggtggaggcagagggcctggcggccctccactccctgactgcgtgtttgtctcgctctgtgctgagggctgatgctgaggacctccttgactccttccttagcaacattctacaggactgcaggcaccacctgtgtgaaccggacatgaaactggtgtggcctagtgccaagctgttgcaggcagctgcaggtgcatctgcccgggcctgtgactctgtcaccagcaatgtactgcctttactgctggaacagttccacaagcacagtcagagcagccagcggcggacaatccttgaaatgctcctgggtttcttgaagctgcagcagaaatggagctatgaagacaaagatcaaaggcctctgaatggcttcaaggaccagctgtgctcactggtattcatggctctaacagaccccagcacccagcttcagcttgttggcatccgtacactgacagtcttgggtgcccagccagatctcctatcttatgaggacttggagctggcagtgggtcacctgtacagactgagcttcctgaaggaggattcccagagttgcagggtggcagcactggaagcatcaggaaccctggctgctctctaccctgtggccttcagcagccacctcgtacccaagctcgctgaggagctgcgtgtaggggagtcaaatttgactaacggagatgagcccacccaatgctcccggcatctgtgctgtctgcaagccttgtcagctgtatcaacacatcccagcatcgtcaaggagacactgcctctgctgctgcagcatctctggcaagtgaacagagggaatatggttgcacaatccagtgacgttattgctgtctgtcagagcctcagacagatggcagaaaaatgtcagcaggaccctgagagttgctggtatttccaccagacagctataccttgcctgcttgccttggctgtgcaggcctctatgccagagaaggagccctcagttctgagaaaagtactattggaggatgaggtgttggctgccatggtgtctgtcattggcactgctacaacccacctgagccctgagttagctgcccagagtgtgacacacattgtgcccctcttcttggatggcaacgtgtcctttctgcctgaaaacagcttcccgagcagattccagccattccaggatggctcctcagggcagaggcggctgattgcactgcttatggcctttgtctgctccctgcctcgaaatgtggaaatccctcagctgaaccaactcatgcgggagcttttggaactgagctgctgccacagctgccccttttcttccaccgctgctgccaagtgctttgcaggactcctcaacaagcaccctgcagggcagcagctggatgaattcctacagctagctgtggacaaagtggaggctggcctgggctctgggccctgtcgtagtcaggccttcactcttcttctctgggtaacaaaggccctagtgctcagataccatcctctcagctcctgccttacagcccggctcatgggcctcctgagtgacccagaattaggtccagcagcagctgatggcttctctctgctcatgtctgactgcactgatgtgctgactcgtgctggccatgccgaagtgcggatcatgttccgccagcggttcttcacagataatgtgcctgctttggtccagggcttccatgctgctccccaagatgtgaagccaaactacttgaagggtctttctcatgtacttaacaggctgcccaagcctgtactcttgccagagctgcccacgcttctttccttgctgctggaggccctgtcctgccctgactgtgtggtgcagctctccaccctcagctgccttcagcctcttctactggaagcaccccaagtcatgagtcttcacgtggacaccctcgtcaccaagtttctgaacctcagctctagcccttccatggctgtccggatcgccgcactgcagtgcatgcatgctctcactcgcctgcccacccctgtgctgctgccgtacaaaccacaggtgattcgggccttagccaaacccctggatgacaagaagagactggtgcgcaaggaagcagtgtcagccagaggggagtggtttctgttggggagccctggcagctgagccctcagtcctggcctagactgttctgacaatctaacctgggattactaactgttgagccatcttccccaaagcagggaaaccactggtctctgactgcctttcccacagacacagcacaaatgctaggcctctgttgcatggctgtacaaagaacataagagtccatatttctagtggatttgtaaaataagtgtgtgtgagacacttgcgtttgaagaaagatctagggtcctgggtctcttgcatttatatgtcagaaaaggggcgatatgctgctgaggggtgagtgcatatgagtgtggccctgaggaccagggctggcagatgttgtctacctgctgaagaataaagatttcttttggtaatggggctgtcagatatttcccccaccccacatatgcctcatataaccagaggcatcactggaataacaatgacagggattggccaaaaatttttcagggtaaccaggacagtagcacatgcctgtaaccccaacacttcag

SEQ ID NO: 445600 - DNA, 3028 bp, Homo sapiens
ttgctacgtctaggcccgcgtggtttatcggccttcgcgttatggccgctgccgcggctgtggaggcggcggcgcctatgggtgccctatggggcctcgtgcacgacttcgtcgtgggtcagcaagagggccccgctgaccaggtggctgcaggtcctctctagagaatccagaaccccgaactcgggcacgaggaatccagcttttgtcacaggtgctactccactgtcacaccttgctcctggagaaggaagtggtacacctgatactgttctatgagaaccggctgaaggaccatcatcttgtgatcccatctgtcctgcagggtttgaaggcacttagcctgtgtgtggccctgcccccagggctggctgtttctgtgcttaaagccatcttccaggaagtgcatgtacagtccctgccacaggtggaccgacacacagtctacaatatcatcaccaattttatgcgaacccgggaagaagagctaaagagcctaggagctgacttcacctttggcttcatccaggtgatggatggggaaaaggatccccgtaatcttctggtggccttccgcatcgtccatgacctcatctccagggactatagcctgggaccctttgtggaggagttgtttgaagtgacatcctgttatttccctatcgattttacccctccacctaatgatccccatggtatccagagagaagacctcatcctgagtcttcgcgctgtgctggcttctacaccacgatttgctgagtttctgctgcccctgttgattgagaaagtggattctgaggttctgagtgccaagttggattctctacagactctgaatgcttgctgtgctgtgtatggacagaaggaactgaaggacttcctccccagcctttgggcttctatccgcagagaggtgttccagacggcaagtgagcgggtggaggcagagggcctggcggccctccactccctgactgcgtgtttgtctcgctctgtgctgagggctgatgctgaggacctccttgactccttccttagcaacattctacaggactgcaggcaccacctgtgtgaaccggacatgaaactggtgtggcctagtgccaagctgttgcaggcagctgcaggtgcatctgcccgggcctgtgactctgtcaccagcaatgtactgcctttactgctggaacagttccacaagcacagtcagagcagccagcggcggacaatccttgaaatgctcctgggtttcttgaagctgcagcagaaatggagctatgaagacaaagatcaaaggcctctgaatggcttcaaggaccagctgtgctcactggtattcatggctctaacagaccccagcacccagcttcagcttgttggcatccgtacactgacagtcttgggtgcccagccagatctcctatcttatgaggacttggagctggcagtgggtcacctgtacagactgagcttcctgaaggaggattcccagagttgcagggtggcagcactggaagcatcaggaaccctggctgctctctaccctgtggccttcagcagccacctcgtacccaagctcgctgaggagctgcgtgtaggggagtcaaatttgactaacggagatgagcccacccaatgctcccggcatctgtgctgtctgcaagccttgtcagctgtatcaacacatcccagcatcgtcaaggagacactgcctctgctgctgcagcatctctggcaagtgaacagagggaatatggttgcacaatccagtgacgttattgctgtctgtcagagcctcagacagatggcagaaaaatgtcagcaggaccctgagagttgctggtatttccaccagacagctataccttgcctgcttgccttggctgtgcaggcctctatgccagagaaggagccctcagttctgagaaaagtactattggaggatgaggtgttggctgccatggtgtctgtcattggcactgctacaacccacctgagccctgagttagctgcccagagtgtgacacacattgtgcccctcttcttggatggcaacgtgtcctttctgcctgaaaacagcttcccgagcagattccagccattccaggatggctcctcagggcagaggcggctgattgcactgcttatggcctttgtctgctccctgcctcgaaatgtggaaatccctcagctgaaccaactcatgcgggagcttttggaactgagctgctgccacagctgccccttttcttccaccgctgctgccaagtgctttgcaggactcctcaacaagcaccctgcagggcagcagctggatgaattcctacagctagctgtggacaaagtggaggctggcctgggctctgggccctgtcgtagtcaggccttcactcttcttctctgggtaacaaaggccctagtgctcagataccatcctctcagctcctgccttacagcccggctcatgggcctcctgagtgacccagaattaggtccagcagcagctgatggcttctctctgctcatgtctgactgcactgatgtgctgactcgtgctggccatgccgaagtgcggatcatgttccgccagcggttcttcacagataatgtgcctgctttggtccagggcttccatgctgctccccaagatgtgaagccaaactacttgaagggtctttctcatgtacttaacaggctgcccaagcctgtactcttgccagagctgcccacgcttctttccttgctgctggaggccctgtcctgccctgactgtgtggtgcagctctccaccctctgttgcatggctgtacaaagaacataagagtccatatttctagtggatttgtaaaataagtgtgtgtgagacacttgcgtttgaagaaagatctagggtcctgggtctcttgcatttatatgtcagaaaaggggcgatatgctgctgaggggtgagtgcatatgagtgtggccctgaggaccagggctggcagatgttgtctacctgctgaagaataaagatttcttttggtaa

SEQ ID NO: 445601 - DNA, 2157 bp, Homo sapiens
aaccagttggagagatgtaggactgctctcttcttaggctttaagaagccctgtccaactcagtggtgtaggtacttgagttctgctcttttagcaaggaggcgttgggagctcacactcctgaatctgcctaatatcagacgtaggcaagagagctgtgagcccaggctcagccaatgcttatctgctctgcgcctccagcagggtggcagcactggaagcatcaggaaccctggctgctctctaccctgtggccttcagcagccacctcgtacccaagctcgctgaggagctgcgtgtaggggagtcaaatttgactaacggagatgagcccacccaatgctcccggcatctgtgctgtctgcaagccttgtcagctgtatcaacacatcccagcatcgtcaaggagacactgcctctgctgctgcagcatctctggcaagtgaacagagggaatatggttgcacaatccagtgacgttattgctgtctgtcagagcctcagacagatggcagaaaaatgtcagcaggaccctgagagttgctggtatttccaccagacagctataccttgcctgcttgccttggctgtgcaggcctctatgccagagaaggagccctcagttctgagaaaagtactattggaggatgaggtgttggctgccatggtgtctgtcattggcactgctacaacccacctgagccctgagttagctgcccagagtgtgacacacattgtgcccctcttcttggatggcaacgtgtcctttctgcctgaaaacagcttcccgagcagattccagccattccaggatggctcctcagggcagaggcggctgattgcactgcttatggcctttgtctgctccctgcctcgaaatgtggaaatccctcagctgaaccaactcatgcgggagcttttggaactgagctgctgccacagctgccccttttcttccaccgctgctgccaagtgctttgcaggactcctcaacaagcaccctgcagggcagcagctggatgaattcctacagctagctgtggacaaagtggaggctggcctgggctctgggccctgtcgtagtcaggccttcactcttcttctctgggtaacaaaggccctagtgctcagataccatcctctcagctcctgccttacagcccggctcatgggcctcctgagtgacccagaattaggtccagcagcagctgatggcttctctctgctcatgtctgactgcactgatgtgctgactcgtgctggccatgccgaagtgcggatcatgttccgccagcggttcttcacagataatgtgcctgctttggtccagggcttccatgctgctccccaagatgtgaagccaaactacttgaagggtctttctcatgtacttaacaggctgcccaagcctgtactcttgccagagctgcccacgcttctttccttgctgctggaggccctgtcctgccctgactgtgtggtgcagctctccaccctcagctgccttcagcctcttctactggaagcaccccaagtcatgagtcttcacgtggacaccctcgtcaccaagtttctgaacctcagctctagcccttccatggctgtccggatcgccgcactgcagtgcatgcatgctctcactcgcctgcccacccctgtgctgctgccgtacaaaccacaggtgattcgggccttagccaaacccctggatgacaagaagagactggtgcgcaaggaagcagtgtcagccagaggggagtggtttctgttggggagccctggcagctgagccctcagtcctggcctagactgttctgacaatctaacctgggattactaactgttgagccatcttccccaaagcagggaaaccactggtctctgactgcctttcccacagacacagcacaaatgctaggcctctgttgcatggctgtacaaagaacataagagtccatatttctagtggatttgtaaaataagtgtgtgtgagacacttgcgtttgaagaaagatctagggtcctgggtctcttgcatttatatgtcagaaaaggggcgatatgctgctgaggggtgagtgcatatgagtgtggccctgaggaccagggctggcagatgttgtctacctgctgaagaataaagatttcttttggtaa

SEQ ID NO: 445602 - DNA, 2644 bp, Homo sapiens
ttgctacgtctaggcccgcgtggtttatcggccttcgcgttatggccgctgccgcggctgtggaggcggcggcgcctatgggtgccctatggggcctcgtgcacgacttcgtcgtgggtcagcaagagggccccgctgaccaggtggctgcaggtcctctctagagaatccagaaccccgaactcgggcacgaggaatccagcttttgtcacaggtgctactccactgtcacaccttgctcctggagaaggaagtggtacacctgatactgttctatgagaaccggctgaaggaccatcatcttgtgatcccatctgtcctgcagggtttgaaggcacttagcctgtgtgtggccctgcccccagggctggctgtttctgtgcttaaagccatcttccaggaagtgcatgtacagtccctgccacaggtggaccgacacacagtctacaatatcatcaccaattttatgcgaacccgggaagaagagctaaagagcctaggagctgacttcacctttggcttcatccaggtgatggatggggaaaaggatccccgtaatcttctggtggccttccgcatcgtccatgacctcatctccagggactatagcctgggaccctttgtggaggagttgtttgaagtgacatcctgttatttccctatcgattttacccctccacctaatgatccccatggtatccagagagaagacctcatcctgagtcttcgcgctgtgctggcttctacaccacgatttgctgagtttctgctgcccctgttgattgagaaagtggattctgaggttctgagtgccaagttggattctctacagactctgaatgcttgctgtgctgtgtatggacagaaggaactgaaggacttcctccccagcctttgggcttctatccgcagagaggtgttccagacggcaagtgagcgggtggaggcagagggcctggcggccctccactccctgactgcgtgtttgtctcgctctgtgctgagggctgatgctgaggacctccttgactccttccttagcaacattctacaggactgcaggcaccacctgtgtgaaccggacatgaaactggtgtggcctagtgccaagctgttgcaggcagctgcaggtgcatctgcccgggcctgtgactctgtcaccagcaatgtactgcctttactgctggaacagttccacaagcacagtcagagcagccagcggcggacaatccttgaaatgctcctgggtttcttgaagctgcagcagaaatggagctatgaagacaaagatcaaaggcctctgaatggcttcaaggaccagctgtgctcactggtattcatggctctaacagaccccagcacccagcttcagcttgttggcatccgtacactgacagtcttgggtgcccagccagatctcctatcttatgaggacttggagctggcagtgggtcacctgtacagactgagcttcctgaaggaggattcccagagttgcagggtggcagcactggaagcatcaggaaccctggctgctctctaccctgtggccttcagcagccacctcgtacccaagctcgctgaggagctgcgtgtaggggagtcaaatttgactaacggagatgagcccacccaatgctcccggcatctgtgctgtctgcaagccttgtcagctgtatcaacacatcccagcatcgtcaaggagacactgcctctgctgctgcagcatctctggcaagtgaacagagggaatatggttgcacaatccagtgacgttattgctgtctgtcagagcctcagacagatggcagaaaaatgtcagcaggaccctgagagttgctggtatttccaccagacagctataccttgcctgcttgccttggctgtgcaggcctctatgccagagaaggagccctcagttctgagaaaagtactattggaggatgaggtgttggctgccatggtgtctgtcattggcactgctacaacccacctgagccctgagttagctgcccagagtgtgacacacattgtgcccctcttcttggatggcaacgtgtcctttctgcctgaaaacagcttcccgagcagattccagccattccaggatggctcctcagggcagaggcggctgattgcactgcttatggcctttgtctgctccctgcctcgaaatgtggaaatccctcagctgaaccaactcatgcgggagcttttggaactgagctgctgccacagctgccccttttcttccaccgctgctgccaagtgctttgcaggactcctcaacaagcaccctgcagggcagcagctggatgaattcctacagctagctgtggacaaagtggaggctggcctgggctctgggccctgtcgtagtcaggccttcactcttcttctctgggtaacaaaggccctagtgctcagataccatcctctcagctcctgccttacagcccggctcatgggcctcctgagtgacccagaattaggtccagcagcagctgatggcttctctctgctcatgtctgactgcactgatgtgctgactcgtgctggccatgccgaagtgcggatcatgttccgccagcggttcttcacagatgttgtctacctgctgaagaataaagatttcttttggtaa

SEQ ID NO: 445603 - DNA, 2073 bp, Homo sapiens
ttgctacgtctaggcccgcgtggtttatcggccttcgcgttatggccgctgccgcggctgtggaggcggcggcgcctatgggtgccctatggggcctcgtgcacgacttcgtcgtgggtcagcaagagggccccgctgaccaggtggctgcaggtcctctctagagaatccagaaccccgaactcgggcacgaggaatccagcttttgtcacaggtgctactccactgtcacaccttgctcctggagaaggaagtggtacacctgatactgttctatgagaaccggctgaaggaccatcatcttgtgatcccatctgtcctgcagggtttgaaggcacttagcctgtgtgtggccctgcccccagggctggctgtttctgtgcttaaagccatcttccaggaagtgcatgtacagtccctgccacaggtggaccgacacacagtctacaatatcatcaccaattttatgcgaacccgggaagaagagctaaagagcctaggagctgacttcacctttggcttcatccaggtgatggatggggaaaaggatccccgtaatcttctggtggccttccgcatcgtccatgacctcatctccagggactatagcctgggaccctttgtggaggagttgtttgaagtgacatcctgttatttccctatcgattttacccctccacctaatgatccccatggtatccagagagaagacctcatcctgagtcttcgcgctgtgctggcttctacaccacgatttgctgagtttctgctgcccctgttgattgagaaagtggattctgaggttctgagtgccaagttggattctctacagactctgaatgcttgctgtgctgtgtatggacagaaggaactgaaggacttcctccccagcctttgggcttctatccgcagagaggtgttccagacggcaagtgagcgggtggaggcagagggcctggcggccctccactccctgactgcgtgtttgtctcgctctgtgctgagggctgatgctgaggacctccttgactccttccttagcaacattctacaggactgcaggcaccacctgtgtgaaccggacatgaaactggtgtggcctagtgccaagctgttgcaggcagctgcaggtgcatctgcccgggcctgtgactctgtcaccagcaatgtactgcctttactgctggaacagttccacaagcacagtcagagcagccagcggcggacaatccttgaaatgctcctgggtttcttgaagctgcagcagaaatggagctatgaagacaaagatcaaaggcctctgaatggcttcaaggaccagctgtgctcactggtattcatggctctaacagaccccagcacccagcttcagcttgttggcatccgtacactgacagtcttgggtgcccagccagatctcctatcttatgaggacttggagctggcagtgggtcacctgtacagactgagcttcctgaaggaggattcccagagttgcagggtggcagcactggaagcatcaggaaccctggctgctctctaccctgtggccttcagcagccacctcgtacccaagctcgctgaggagctgcgtgtaggggagtcaaatttgactaacggagatgagcccacccaatgctcccggcatctgtgctgtctgcaagccttgtcagctgtatcaacacatcccagcatcgtcaaggagacactgcctctgctgctgcagcatctctggcaagtgaacagagggaatatggttgcacaatccagtgacgttattgctgtctgtcagagcctcagacagatggcagaaaaatgtcagcaggaccctgagagttgctggtatttccaccagacagctataccttgcctgcttgccttggctgtgcaggcctctatgccagagaaggaggcctcagtctgaggaaacgactatgcacgaagaggtgtcgaagcacgggcgccgtcaggggcaggaaaaacaagctaactaatagggccaacggtgaccgtggcccgcatcgaggacggcgctcgcaacagacccgacagaaagcaccgaacccagcacgg

SEQ ID NO: 445604 - DNA, 749 bp, Homo sapiens
tcacgctttatacttccagagcgcacgcttctttccttgctgctggaggccctgtcctgccctgactgtgtggtgcagctctccaccctcagctgccttcagcctcttctactggaagcaccccaagtcatgagtcttcacgtggacaccctcgtcaccaagtttctgaacctcagctctagcccttccatggctgtccggatcgccgcactgcagtgcatgcatgctctcactcgcctgcccacccctgtgctgctgccgtacaaaccacaggtgattcgggccttagccaaacccctggatgacaagaagagactggtgcgcaaggaagcagtgtcagccagaggggagtggtttctgttggggagccctggcagctgagccctcagtcctggcctagactgttctgacaatctaacctgggattactaactgttgagccatcttccccaaagcagggaaaccactggtctctgactgcctttcccacagacacagcacaaatgctaggcctctgttgcatggctgtacaaagaacataagagtccatatttctagtggatttgtaaaataagtgtgtgtgagacacttgcgtttgaagaaagatctagggtcctgggtctcttgcatttatatgtcagaaaaggggcgatatgctgctgaggggtgagtgcatatgagtgtggccctgaggaccagggctggcagatgttgtctacctgctgaagaataaagatttcttttggtaa

SEQ ID NO: 445605 - DNA, 1470 bp, Homo sapiens
ttgctacgtctaggcccgcgtggtttatcggccttcgcgttatggccgctgccgcggctgtggaggcggcggcgcctatgggtgccctatggggcctcgtgcacgacttcgtcgtgggtcagcaagagggccccgctgaccaggtggctgcaggtcctctctagagaatccagaaccccgaactcgggcacgaggaatccagcttttgtcacaggtgctactccactgtcacaccttgctcctggagaaggaagtggtacacctgatactgttctatgagaaccggctgaaggaccatcatcttgtgatcccatctgtcctgcagggtttgaaggcacttagcctgtgtgtggccctgcccccagggctggctgtttctgtgcttaaagccatcttccaggaagtgcatgtacagtccctgccacaggtggaccgacacacagtctacaatatcatcaccaattttatgcgaacccgggaagaagagctaaagagcctaggagctgacttcacctttggcttcatccaggtgatggatggggaaaaggatccccgtaatcttctggtggccttccgcatcgtccatgacctcatctccagggactatagcctgggaccctttgtggaggagttgtttgaagtgacatcctgttatttccctatcgattttacccctccacctaatgatccccatggtatccagagagaagacctcatcctgagtcttcgcgctgtgctggcttctacaccacgatttgctgagtttctgctgcccctgttgattgagaaagtggattctgaggttctgagtgccaagttggattctctacagactctgaatgcttgctgtgctgtgtatggacagaaggaactgaaggacttcctccccagcctttgggcttctatccgcagagaggtgttccagacggcaagtgagcgggtggaggcagagggcctggcggccctccactccctgactgcgtgtttgtctcgctctgtgctgagggctgatgctgaggacctccttgactccttccttagcaacattctacaggactgcaggcaccacctgtgtgaaccggacatgaaactggtgtggcctagtgccaagctgttgcaggcagctgcaggtgcatctgcccgggcctgtgactctgtcaccagcaatgtactgcctttactgctggaacagttccacaagcacagtcaggtaagggagcagaatctttgggggaaatgatgggacctgtgtgctaggttccctttctcagagagtgagctaagttttagcttgggccaacatagtagaccttgggttttgctcccattagctgctgctgctgcttcccttactcactttttccctgtctcatacataaaaggatcattctcccaagacaggaggatagcttgaagccaggagttcaagatcagcctgggcaacaaagtgagatcccatctctaaaaaaa

SEQ ID NO: 445606 - DNA, 1232 bp, Homo sapiens
ttgctacgtctaggcccgcgtggtttatcggccttcgcgttatggccgctgccgcggctgtggaggcggcggcgcctatgggtgccctatggggcctcgtgcacgacttcgtcgtgggtcagcaagagggccccgctgaccaggtggctgcaggtcctctctagagaatccagaaccccgaactcgggcacgaggaatccagcttttgtcacaggtgctactccactgtcacaccttgctcctggagaaggaagtggtacacctgatactgttctatgagaaccggctgaaggaccatcatcttgtgatcccatctgtcctgcagggtttgaaggcacttagcctgtgtgtggccctgcccccagggctggctgtttctgtgcttaaagccatcttccaggaagtgcatgtacagtccctgccacaggtggaccgacacacagtctacaatatcatcaccaattttatgcgaacccgggaagaagagctaaagagcctaggagctgacttcacctttggcttcatccaggtgatggatggggaaaaggatccccgtaatcttctggtggccttccgcatcgtccatgacctcatctccagggactatagcctgggaccctttgtggaggagttgtttgaagtgacatcctgttatttccctatcgattttacccctccacctaatgatccccatggtatccagagagaagacctcatcctgagtcttcgcgctgtgctggcttctacaccacgatttgctgagtttctgctgcccctgttgattgagaaagtggattctgaggttctgagtgccaagttggattctctacagactctgaatgcttgctgtgctgtgtatggacagaaggaactgaaggacttcctccccagcctttgggcttctatccgcagagaggtgttccagacggcaagtgagcgggtggaggcagagggcctggcggccctccactccctgactgcgtgtttgtctcgctctgtgctgagggctgatgctgaggacctccttgactccttccttagcaacattctacagggtaatggggccgtggcagccaggaaggggagtgagcacaatagaaacgacattccttgcctgggtgcggtggctcacgcctgtaatccctgcactttaggaggccgaggcgggtggatcacctgaggtcaggagttaaagaccagcctggccaacatggtgaaacctcgtctctact

SEQ ID NO: 445607 - DNA, 452 bp, Homo sapiens
gatgggaccaagatgagcctcatcactaatgctgccaactttctttttgcctacaggtttctgttggggagccctggcagctgagccctcagtcctggcctagactgttctgacaatctaacctgggattactaactgttgagccatcttccccaaagcagggaaaccactggtctctgactgcctttcccacagacacagcacaaatgctaggcctctgttgcatggctgtacaaagaacataagagtccatatttctagtggatttgtaaaataagtgtgtgtgagacacttgcgtttgaagaaagatctagggtcctgggtctcttgcatttatatgtcagaaaaggggcgatatgctgctgaggggtgagtgcatatgagtgtggccctgaggaccagggctggcagatgttgtctacctgctgaagaataaagatttcttttggtaa

SEQ ID NO: 445608 - DNA, 870 bp, Homo sapiens
  misc_feature (14)..(14): n is a, c, g, or t
  misc_feature (16)..(16): n is a, c, g, or t
  misc_feature (870)..(870): n is a, c, g, or t
aagcaggcgtacgncngaggtagattcgcgttatggccgctgccgcggctgtggaggcggcggcgcctatgggtgccctatggggcctcgtgcacgacttcgtcgtgggtcagcaagagggccccgctgaccaggtggctgcagatgtgaaatctggcaactatacagtgttacaagttgtggaagcccttgggtcctctctagagaatccagaaccccgaactcgggcacgaggaatccagcttttgtcacaggtgctactccactgtcacaccttgctcctggagaaggaagaaggtactggtgtcactaataggaatgtcttcctggattgctgagcccagtggtacacctgatactgttctatgagaaccggctgaaggaccatcatcttgtgatcccatctgtcctgcagggtttgaaggcacttagcctgtgtgtggccctgcccccagggctggctgtttctgtgcttaaagccatcttccaggaagtgcatgtacagtccctgccacaggtggaccgacacacagtctacaatatcatcaccaattttatgcgaacccgggaagaagagctaaagagcctaggagctgacttcacctttggcttcatccaggtgatggatggggaaaaggatccccgtaatcttctggtggccttccgcatcgtccatgacctcatctccagggactatagcctgggacctttgtggaggagtgttgaaagtgaatcctgttatttcctatgatcttacccttcaattaatgatccatggttcccgagagaagactcatctgaatttcgcgatgtgctggttctaacagaatggagtcggtgcccgcgatgcaacggacccggcactgccan

SEQ ID NO: 445609 - DNA, 355 bp, Homo sapiens
atcccctgcagcagaaacagcatttgccccttccatagggatttgtggcactttgaacttgagagagatgatctagggtcctgggtctcttgcatttatatgtcagaaaaggggcgatatgctgctgaggggtgagtgcatatgagtgtggccctgaggaccagggctggcagatgttgtctacctgctgaagaataaagatttcttttggtaatggggctgtcagatatttcccccaccccacatatgcctcatataaccagaggcatcactggaataacaatgacagggattggccaaaaatttttcagggtaaccaggacagtagcacatgcctgtaaccccaacacttcag

SEQ ID NO: 445610 - DNA, 463 bp, Homo sapiens
tctgttgcatggctgtacaaagaacataagagtccatatttctagtggatttgtaaaataagtgtgtgtgagacacttgcgtttgaagaaagatctagggtcctgggtctcttgcatttatatgtcagaaaaggggcgatatgctgctgaggggtgagtgcatatgagtgtggccctgaggaccagggctggcagatgttgtctacctgctgaagaataaagatttcttttggtaatggggctgtcagatatttcccccaccccacatatgcctcatataaccagaggcatcactggaataacaatgacagggattggccaaaaatttttcagggtaaccaggacagtagcacatgcctgtaaccccaacacttcaggaggctgaggcaggcggatcacttgaggctaggagtttgagactagccctggcagtatagcaagaacccatctctacaaataatta

SEQ ID NO: 445611 - DNA, 519 bp, Homo sapiens
gtagagcattttaaaatataccttgacttcccagatgggaacctgaatggaaatgattactggcacatatgtgccaaattaatatttgttcaatgcatgaatgatcagggcatgtcccattgacgtggtgatcctaattcaaaccctaggttgaaaagcacgtctgtggaggagagggctgctttagaatcctagctccttggtcatacctagtactctgcccccaggttagctgcccagagtgtgacacacattgtgcccctcttcttggatggcaacgtgtcctttctgcctgaaaacagcttcccgagcagattccagccattccaggtaacagtcttagaacttacatccttcaagctggtttttttttagggctaatctggaatgggtagaggggcagacaagcttattgctggcaggcttgatcgggctctccttcctttataggatggctcctcagggcagaggcggctgattgcactgcttatggcctttgtctgctccctgcctcgaaat

SEQ ID NO: 445612 - DNA, 469 bp, Homo sapiens
actctggatgatttgggatttctaataagagcttagaagggttgtgatggctgcaggggaagaaagatgagattcatgttcccttctaactacagatctcctatcttatgaggacttggagctggcagtgggtcacctgtacagactgagcttcctgaaggaggattcccagagttggtgagaatttaaagcaatgagatagagcaagctgttccctgcctctgtattggcagcaaaagatcaagctaggaccagggctctgtgcttctgacccttggctctccttaggggaggtgagctctgtgttagactctggctgctaaccagttggagagatgtaggactgctctcttcttaggctttaagaagccctgtccaactcagtggtgtaggtacttgagttctgctcttttagcaaggaggcgttgggagctcacactcctgaatctgcctaatatcagacgtaggc

SEQ ID NO: 445613 - DNA, 279 bp, Homo sapiens
gaaagaattttccctatatccagagtagcaggattgaaatcctttaaaatattctttgactctagtaccccttgaaacgttacagagcagccagcggcggacaatccttgaaatgctcctgggtttcttgaagctgcagcagaaatggagctatgaagacaaaggtgaggttgccttccattgcagtgctctggggactgttgaacacttcagcctataaaggatagcagggcaaagagtgctgtggaaaagtagtctagaacagtggtcctattctga

SEQ ID NO: 445614 - DNA, 613 bp, Homo sapiens
tgagtcaatatccataccctttctctgtagtttctcttagattgatcttatgctggtataaagagcactgttcacttagagattatgaagcaggaactagctgtgtcagctgaggtattctttgagcattttcttcacttctttctcccccacccccaagtccctgccacaggtggaccgacacacagtctacaatatcatcaccaattttatgcgaacccgggaagaaggtaagagacagagctttctgggaaatgtcaaaagcaagcacatcctactttttcccctattagtaggactcattttacctggggttatatagaagagctggtatcctgagagagaatgataaagggaaagagggggtctgctccctcccagtgaagtaaagaaagggtagagtttgtttgagccagtgttttaaattcttgcctccacagcaatgtgtatattgttgcacatctcttcactgagtactttcttggaatggaaaaagggtcagccctgaagagaaaggggaggcaatgatagcagagggagaacacaggctaggagaaagcccacactttctgtgctgtgggacagtatagtaaccttattctctccttcccag

SEQ ID NO: 445615 - DNA, 3534 bp, Homo sapiens
  misc_feature (4)..(4): n is a, c, g, or t
tggnatgtgaccgacagcaccgccccctagggctgggcctgattttctcattggcttcccccgtgttcgcgttatggccgctgccgcggctgtggaggcggcggcgcctatgggtgccctatggggcctcgtgcacgacttcgtcgtgggtcagcaagagggccccgctgaccaggtggctgcagatgtgaaatctggcaactatacagtgttacaagttgtggaagcccttgggtcctctctagagaatccagaaccccgaactcgggcacgaggaatccagcttttgtcacaggtgctactccactgtcacaccttgctcctggagaaggaagtggtacacctgatactgttctatgagaaccggctgaaggaccatcatcttgtgatcccatctgtcctgcagggtttgaaggcacttagcctgtgtgtggccctgcccccagggctggctgtttctgtgcttaaagccatcttccaggaagtgcatgtacagtccctgccacaggtggaccgacacacagtctacaatatcatcaccaattttatgcgaacccgggaagaagagctaaagagcctaggagctgacttcacctttggcttcatccaggtgatggatggggaaaaggatccccgtaatcttctggtggccttccgcatcgtccatgacctcatctccagggactatagcctgggaccctttgtggaggagttgtttgaagtgacatcctgttatttccctatcgattttacccctccacctaatgatccccatggtatccagagagaagacctcatcctgagtcttcgcgctgtgctggcttctacaccacgatttgctgagtttctgctgcccctgttgattgagaaagtggattctgaggttctgagtgccaagttggattctctacagactctgaatgcttgctgtgctgtgtatggacagaaggaactgaaggacttcctccccagcctttgggcttctatccgcagagaggtgttccagacggcaagtgagcgggtggaggcagagggcctggcggccctccactccctgactgcgtgtttgtctcgctctgtgctgagggctgatgctgaggacctccttgactccttccttagcaacattctacaggactgcaggcaccacctgtgtgaaccggacatgaaactggtgtggcctagtgccaagctgttgcaggcagctgcaggtgcatctgcccgggcctgtgactctgtcaccagcaatgtactgcctttactgctggaacagttccacaagcacagtcagagcagccagcggcggacaatccttgaaatgctcctgggtttcttgaagctgcagcagaaatggagctatgaagacaaagatcaaaggcctctgaatggcttcaaggaccagctgtgctcactggtattcatggctctaacagaccccagcacccagcttcagcttgttggcatccgtacactgacagtcttgggtgcccagccagatctcctatcttatgaggacttggagctggcagtgggtcacctgtacagactgagcttcctgaaggaggattcccagagttgcagggtggcagcactggaagcatcaggaaccctggctgctctctaccctgtggccttcagcagccacctcgtacccaagctcgctgaggagctgcgtgtaggggagtcaaatttgactaacggagatgagcccacccaatgctcccggcatctgtgctgtctgcaagccttgtcagctgtatcaacacatcccagcatcgtcaaggagacactgcctctgctgctgcagcatctctggcaagtgaacagagggaatatggttgcacaatccagtgacgttattgctgtctgtcagagcctcagacagatggcagaaaaatgtcagcaggaccctgagagttgctggtatttccaccagacagctataccttgcctgcttgccttggctgtgcaggcctctatgccagagaaggagccctcagttctgagaaaagtactattggaggatgaggtgttggctgccatggtgtctgtcattggcactgctacaacccacctgagccctgagttagctgcccagagtgtgacacacattgtgcccctcttcttggatggcaacgtgtcctttctgcctgaaaacagcttcccgagcagattccagccattccaggatggctcctcagggcagaggcggctgattgcactgcttatggcctttgtctgctccctgcctcgaaatgtggaaatccctcagctgaaccaactcatgcgggagcttttggaactgagctgctgccacagctgccccttttcttccaccgctgctgccaagtgctttgcaggactcctcaacaagcaccctgcagggcagcagctggatgaattcctacagctagctgtggacaaagtggaggctggcctgggctctgggccctgtcgtagtcaggccttcactcttcttctctgggtaacaaaggccctagtgctcagataccatcctctcagctcctgccttacagcccggctcatgggcctcctgagtgacccagaattaggtccagcagcagctgatggcttctctctgctcatgtctgactgcactgatgtgctgactcgtgctggccatgccgaagtgcggatcatgttccgccagcggttcttcacagataatgtgcctgctttggtccagggcttccatgctgctccccaagatgtgaagccaaactacttgaagggtctttctcatgtacttaacaggctgcccaagcctgtactcttgccagagctgcccacgcttctttccttgctgctggaggccctgtcctgccctgactgtgtggtgcagctctccaccctcagctgccttcagcctcttctactggaagcaccccaagtcatgagtcttcacgtggacaccctcgtcaccaagtttctgaacctcagctctagcccttccatggctgtccggatcgccgcactgcagtgcatgcatgctctcactcgcctgcccacccctgtgctgctgccgtacaaaccacaggtgattcgggccttagccaaacccctggatgacaagaagagactggtgcgcaaggaagcagtgtcagccagaggggagtggtttctgttggggagccctggcagctgagccctcagtcctggcctagactgttctgacaatctaacctgggattactaactgttgagccatcttccccaaagcagggaaaccactggtctctgactgcctttcccacagacacagcacaaatgctaggcctctgttgcatggctgtacaaagaacataagagtccatatttctagtggatttgtaaaataagtgtgtgtgagacacttgcgtttgaagaaagatctagggtcctgggtctcttgcatttatatgtcagaaaaggggcgatatgctgctgaggggtgagtgcatatgagtgtggccctgaggaccagggctggcagatgttgtctacctgctgaagaataaagatttcttttggtaa

SEQ ID NO: 445616 - DNA, 687 bp, Homo sapiens
  misc_feature (14)..(14): n is a, c, g, or t
  misc_feature (16)..(16): n is a, c, g, or t
aagcaggcgtacgncngaggtagattcgcgttatggccgctgccgcggctgtggaggcggcggcgcctatgggtgccctatggggcctcgtgcacgacttcgtcgtgggtcagcaagagggccccgctgaccaggtggctgcagatgtgaaatctggcaactatacagtgttacaagttgtggaagcccttgggtcctctctagagaatccagaaccccgaactcgggcacgaggaatccagcttttgtcacaggtgctactccactgtcacaccttgctcctggagaaggaagtggtacacctgatactgttctatgagaaccggctgaaggaccatcatcttgtgatcccatctgtcctgcagggtttgaaggcacttagcctgtgtgtggccctgcccccagggctggctgtttctgtgcttaaagccatcttccaggaagtgcatgtacagtccctgccacaggtggaccgacacacagtctacaatatcatcaccaattttatgcgaacccgggaagaaggtaagagacagagctttctgggaaatgtcaaaagcaagcacatcctactttttcccctattagtaggactcattttacctggggttatatagaagagctggtatcctgagagagaatgataaagggaaagagggggtctgctccctcccagtgaagtaaaga

SEQ ID NO: 445617 - DNA, 3543 bp, Homo sapiens
  misc_feature (14)..(14): n is a, c, g, or t
  misc_feature (16)..(16): n is a, c, g, or t
aagcaggcgtacgncngaggtagattcgcgttatggccgctgccgcggctgtggaggcggcggcgcctatgggtgccctatggggcctcgtgcacgacttcgtcgtgggtcagcaagagggccccgctgaccaggtggctgcagatgtgaaatctggcaactatacagtgttacaagttgtggaagcccttgggtcctctctagagaatccagaaccccgaactcgggcacgaggaatccagcttttgtcacaggtgctactccactgtcacaccttgctcctggagaaggaagaaggtactggtgtcactaataggaatgtcttcctggattgctgagcccagtggtacacctgatactgttctatgagaaccggctgaaggaccatcatcttgtgatcccatctgtcctgcagggtttgaaggcacttagcctgtgtgtggccctgcccccagggctggctgtttctgtgcttaaagccatcttccaggaagtgcatgtacagtccctgccacaggtggaccgacacacagtctacaatatcatcaccaattttatgcgaacccgggaagaagagctaaagagcctaggagctgacttcacctttggcttcatccaggtgatggatggggaaaaggatccccgtaatcttctggtggccttccgcatcgtccatgacctcatctccagggactatagcctgggaccctttgtggaggagttgtttgaagtgacatcctgttatttccctatcgattttacccctccacctaatgatccccatggtatccagagagaagacctcatcctgagtcttcgcgctgtgctggcttctacaccacgatttgctgagtttctgctgcccctgttgattgagaaagtggattctgaggttctgagtgccaagttggattctctacagactctgaatgcttgctgtgctgtgtatggacagaaggaactgaaggacttcctccccagcctttgggcttctatccgcagagaggtgttccagacggcaagtgagcgggtggaggcagagggcctggcggccctccactccctgactgcgtgtttgtctcgctctgtgctgagggctgatgctgaggacctccttgactccttccttagcaacattctacaggactgcaggcaccacctgtgtgaaccggacatgaaactggtgtggcctagtgccaagctgttgcaggcagctgcaggtgcatctgcccgggcctgtgactctgtcaccagcaatgtactgcctttactgctggaacagttccacaagcacagtcagagcagccagcggcggacaatccttgaaatgctcctgggtttcttgaagctgcagcagaaatggagctatgaagacaaagatcaaaggcctctgaatggcttcaaggaccagctgtgctcactggtattcatggctctaacagaccccagcacccagcttcagcttgttggcatccgtacactgacagtcttgggtgcccagccagatctcctatcttatgaggacttggagctggcagtgggtcacctgtacagactgagcttcctgaaggaggattcccagagttgcagggtggcagcactggaagcatcaggaaccctggctgctctctaccctgtggccttcagcagccacctcgtacccaagctcgctgaggagctgcgtgtaggggagtcaaatttgactaacggagatgagcccacccaatgctcccggcatctgtgctgtctgcaagccttgtcagctgtatcaacacatcccagcatcgtcaaggagacactgcctctgctgctgcagcatctctggcaagtgaacagagggaatatggttgcacaatccagtgacgttattgctgtctgtcagagcctcagacagatggcagaaaaatgtcagcaggaccctgagagttgctggtatttccaccagacagctataccttgcctgcttgccttggctgtgcaggcctctatgccagagaaggagccctcagttctgagaaaagtactattggaggatgaggtgttggctgccatggtgtctgtcattggcactgctacaacccacctgagccctgagttagctgcccagagtgtgacacacattgtgcccctcttcttggatggcaacgtgtcctttctgcctgaaaacagcttcccgagcagattccagccattccaggatggctcctcagggcagaggcggctgattgcactgcttatggcctttgtctgctccctgcctcgaaatgtggaaatccctcagctgaaccaactcatgcgggagcttttggaactgagctgctgccacagctgccccttttcttccaccgctgctgccaagtgctttgcaggactcctcaacaagcaccctgcagggcagcagctggatgaattcctacagctagctgtggacaaagtggaggctggcctgggctctgggccctgtcgtagtcaggccttcactcttcttctctgggtaacaaaggccctagtgctcagataccatcctctcagctcctgccttacagcccggctcatgggcctcctgagtgacccagaattaggtccagcagcagctgatggcttctctctgctcatgtctgactgcactgatgtgctgactcgtgctggccatgccgaagtgcggatcatgttccgccagcggttcttcacagataatgtgcctgctttggtccagggcttccatgctgctccccaagatgtgaagccaaactacttgaagggtctttctcatgtacttaacaggctgcccaagcctgtactcttgccagagctgcccacgcttctttccttgctgctggaggccctgtcctgccctgactgtgtggtgcagctctccaccctcagctgccttcagcctcttctactggaagcaccccaagtcatgagtcttcacgtggacaccctcgtcaccaagtttctgaacctcagctctagcccttccatggctgtccggatcgccgcactgcagtgcatgcatgctctcactcgcctgcccacccctgtgctgctgccgtacaaaccacaggtgattcgggccttagccaaacccctggatgacaagaagagactggtgcgcaaggaagcagtgtcagccagaggggagtggtttctgttggggagccctggcagctgagccctcagtcctggcctagactgttctgacaatctaacctgggattactaactgttgagccatcttccccaaagcagggaaaccactggtctctgactgcctttcccacagacacagcacaaatgctaggcctctgttgcatggctgtacaaagaacataagagtccatatttctagtggatttgtaaaataagtgtgtgtgagacacttgcgtttgaagaaagatctagggtcctgggtctcttgcatttatatgtcagaaaaggggcgatatgctgctgaggggtgagtgcatatgagtgtggccctgaggaccagggctggcagatgttgtctacctgctgaagaataaagatttcttttggtaa

SEQ ID NO: 445618 - DNA, 2781 bp, Homo sapiens
tcgatcaagggatggcgcttagttataccatactggccctgcgccttacaattacagcgctgtgctggcttctacaccacgatttgctgagtttctgctgcccctgttgattgagaaagtggattctgaggttctgagtgccaagttggattctctacagactctgaatgcttgctgtgctgtgtatggacagaaggaactgaaggacttcctccccagcctttgggcttctatccgcagagaggtgttccagacggcaagtgagcgggtggaggcagagggcctggcggccctccactccctgactgcgtgtttgtctcgctctgtgctgagggctgatgctgaggacctccttgactccttccttagcaacattctacaggactgcaggcaccacctgtgtgaaccggacatgaaactggtgtggcctagtgccaagctgttgcaggcagctgcaggtgcatctgcccgggcctgtgactctgtcaccagcaatgtactgcctttactgctggaacagttccacaagcacagtcagagcagccagcggcggacaatccttgaaatgctcctgggtttcttgaagctgcagcagaaatggagctatgaagacaaagatcaaaggcctctgaatggcttcaaggaccagctgtgctcactggtattcatggctctaacagaccccagcacccagcttcagcttgttggcatccgtacactgacagtcttgggtgcccagccagatctcctatcttatgaggacttggagctggcagtgggtcacctgtacagactgagcttcctgaaggaggattcccagagttgcagggtggcagcactggaagcatcaggaaccctggctgctctctaccctgtggccttcagcagccacctcgtacccaagctcgctgaggagctgcgtgtaggggagtcaaatttgactaacggagatgagcccacccaatgctcccggcatctgtgctgtctgcaagccttgtcagctgtatcaacacatcccagcatcgtcaaggagacactgcctctgctgctgcagcatctctggcaagtgaacagagggaatatggttgcacaatccagtgacgttattgctgtctgtcagagcctcagacagatggcagaaaaatgtcagcaggaccctgagagttgctggtatttccaccagacagctataccttgcctgcttgccttggctgtgcaggcctctatgccagagaaggagccctcagttctgagaaaagtactattggaggatgaggtgttggctgccatggtgtctgtcattggcactgctacaacccacctgagccctgagttagctgcccagagtgtgacacacattgtgcccctcttcttggatggcaacgtgtcctttctgcctgaaaacagcttcccgagcagattccagccattccaggatggctcctcagggcagaggcggctgattgcactgcttatggcctttgtctgctccctgcctcgaaatgtggaaatccctcagctgaaccaactcatgcgggagcttttggaactgagctgctgccacagctgccccttttcttccaccgctgctgccaagtgctttgcaggactcctcaacaagcaccctgcagggcagcagctggatgaattcctacagctagctgtggacaaagtggaggctggcctgggctctgggccctgtcgtagtcaggccttcactcttcttctctgggtaacaaaggccctagtgctcagataccatcctctcagctcctgccttacagcccggctcatgggcctcctgagtgacccagaattaggtccagcagcagctgatggcttctctctgctcatgtctgactgcactgatgtgctgactcgtgctggccatgccgaagtgcggatcatgttccgccagcggttcttcacagataatgtgcctgctttggtccagggcttccatgctgctccccaagatgtgaagccaaactacttgaagggtctttctcatgtacttaacaggctgcccaagcctgtactcttgccagagctgcccacgcttctttccttgctgctggaggccctgtcctgccctgactgtgtggtgcagctctccaccctcagctgccttcagcctcttctactggaagcaccccaagtcatgagtcttcacgtggacaccctcgtcaccaagtttctgaacctcagctctagcccttccatggctgtccggatcgccgcactgcagtgcatgcatgctctcactcgcctgcccacccctgtgctgctgccgtacaaaccacaggtgattcgggccttagccaaacccctggatgacaagaagagactggtgcgcaaggaagcagtgtcagccagaggggagtggtttctgttggggagccctggcagctgagccctcagtcctggcctagactgttctgacaatctaacctgggattactaactgttgagccatcttccccaaagcagggaaaccactggtctctgactgcctttcccacagacacagcacaaatgctaggcctctgttgcatggctgtacaaagaacataagagtccatatttctagtggatttgtaaaataagtgtgtgtgagacacttgcgtttgaagaaagatctagggtcctgggtctcttgcatttatatgtcagaaaaggggcgatatgctgctgaggggtgagtgcatatgagtgtggccctgaggaccagggctggcagatgttgtctacctgctgaagaataaagatttcttttggtaa

SEQ ID NO: 445619 - DNA, 2481 bp, Homo sapiens
tcgatagacggctaggtacgaggccgggtggtgggctgatgctgaggacctccttgactccttccttagcaacattctacaggactgcaggcaccacctgtgtgaaccggacatgaaactggtgtggcctagtgccaagctgttgcaggcagctgcaggtgcatctgcccgggcctgtgactctgtcaccagcaatgtactgcctttactgctggaacagttccacaagcacagtcagagcagccagcggcggacaatccttgaaatgctcctgggtttcttgaagctgcagcagaaatggagctatgaagacaaagatcaaaggcctctgaatggcttcaaggaccagctgtgctcactggtattcatggctctaacagaccccagcacccagcttcagcttgttggcatccgtacactgacagtcttgggtgcccagccagatctcctatcttatgaggacttggagctggcagtgggtcacctgtacagactgagcttcctgaaggaggattcccagagttgcagggtggcagcactggaagcatcaggaaccctggctgctctctaccctgtggccttcagcagccacctcgtacccaagctcgctgaggagctgcgtgtaggggagtcaaatttgactaacggagatgagcccacccaatgctcccggcatctgtgctgtctgcaagccttgtcagctgtatcaacacatcccagcatcgtcaaggagacactgcctctgctgctgcagcatctctggcaagtgaacagagggaatatggttgcacaatccagtgacgttattgctgtctgtcagagcctcagacagatggcagaaaaatgtcagcaggaccctgagagttgctggtatttccaccagacagctataccttgcctgcttgccttggctgtgcaggcctctatgccagagaaggagccctcagttctgagaaaagtactattggaggatgaggtgttggctgccatggtgtctgtcattggcactgctacaacccacctgagccctgagttagctgcccagagtgtgacacacattgtgcccctcttcttggatggcaacgtgtcctttctgcctgaaaacagcttcccgagcagattccagccattccaggatggctcctcagggcagaggcggctgattgcactgcttatggcctttgtctgctccctgcctcgaaatgtggaaatccctcagctgaaccaactcatgcgggagcttttggaactgagctgctgccacagctgccccttttcttccaccgctgctgccaagtgctttgcaggactcctcaacaagcaccctgcagggcagcagctggatgaattcctacagctagctgtggacaaagtggaggctggcctgggctctgggccctgtcgtagtcaggccttcactcttcttctctgggtaacaaaggccctagtgctcagataccatcctctcagctcctgccttacagcccggctcatgggcctcctgagtgacccagaattaggtccagcagcagctgatggcttctctctgctcatgtctgactgcactgatgtgctgactcgtgctggccatgccgaagtgcggatcatgttccgccagcggttcttcacagataatgtgcctgctttggtccagggcttccatgctgctccccaagatgtgaagccaaactacttgaagggtctttctcatgtacttaacaggctgcccaagcctgtactcttgccagagctgcccacgcttctttccttgctgctggaggccctgtcctgccctgactgtgtggtgcagctctccaccctcagctgccttcagcctcttctactggaagcaccccaagtcatgagtcttcacgtggacaccctcgtcaccaagtttctgaacctcagctctagcccttccatggctgtccggatcgccgcactgcagtgcatgcatgctctcactcgcctgcccacccctgtgctgctgccgtacaaaccacaggtgattcgggccttagccaaacccctggatgacaagaagagactggtgcgcaaggaagcagtgtcagccagaggggagtggtttctgttggggagccctggcagctgagccctcagtcctggcctagactgttctgacaatctaacctgggattactaactgttgagccatcttccccaaagcagggaaaccactggtctctgactgcctttcccacagacacagcacaaatgctaggcctctgttgcatggctgtacaaagaacataagagtccatatttctagtggatttgtaaaataagtgtgtgtgagacacttgcgtttgaagaaagatctagggtcctgggtctcttgcatttatatgtcagaaaaggggcgatatgctgctgaggggtgagtgcatatgagtgtggccctgaggaccagggctggcagatgttgtctacctgctgaagaataaagatttcttttggtaa

SEQ ID NO: 445620 - DNA, 3199 bp, Homo sapiens
  misc_feature (14)..(14): n is a, c, g, or t
  misc_feature (16)..(16): n is a, c, g, or t
aagcaggcgtacgncngaggtagattcgcgttatggccgctgccgcggctgtggaggcggcggcgcctatgggtgccctatggggcctcgtgcacgacttcgtcgtgggtcagcaagagggccccgctgaccaggtggctgcagatgtgaaatctggcaactatacagtgttacaagttgtggaagcccttgggtcctctctagagaatccagaaccccgaactcgggcacgaggaatccagcttttgtcacaggtgctactccactgtcacaccttgctcctggagaaggaagtggtacacctgatactgttctatgagaaccggctgaaggaccatcatcttgtgatcccatctgtcctgcagggtttgaaggcacttagcctgtgtgtggccctgcccccagggctggctgtttctgtgcttaaagccatcttccaggaagtgcatgtacagtccctgccacaggtggaccgacacacagtctacaatatcatcaccaattttatgcgaacccgggaagaagagctaaagagcctaggagctgacttcacctttggcttcatccaggtgatggatggggaaaaggatccccgtaatcttctggtggccttccgcatcgtccatgacctcatctccagggactatagcctgggaccctttgtggaggagttgtttgaagtgacatcctgttatttccctatcgattttacccctccacctaatgatccccatggtatccagagagaagacctcatcctgagtcttcgcgctgtgctggcttctacaccacgatttgctgagtttctgctgcccctgttgattgagaaagtggattctgaggttctgagtgccaagttggattctctacagactctgaatgcttgctgtgctgtgtatggacagaaggaactgaaggacttcctccccagcctttgggcttctatccgcagagagagcagccagcggcggacaatccttgaaatgctcctgggtttcttgaagctgcagcagaaatggagctatgaagacaaagatcaaaggcctctgaatggcttcaaggaccagctgtgctcactggtattcatggctctaacagaccccagcacccagcttcagcttgttggcatccgtacactgacagtcttgggtgcccagccagatctcctatcttatgaggacttggagctggcagtgggtcacctgtacagactgagcttcctgaaggaggattcccagagttgcagggtggcagcactggaagcatcaggaaccctggctgctctctaccctgtggccttcagcagccacctcgtacccaagctcgctgaggagctgcgtgtaggggagtcaaatttgactaacggagatgagcccacccaatgctcccggcatctgtgctgtctgcaagccttgtcagctgtatcaacacatcccagcatcgtcaaggagacactgcctctgctgctgcagcatctctggcaagtgaacagagggaatatggttgcacaatccagtgacgttattgctgtctgtcagagcctcagacagatggcagaaaaatgtcagcaggaccctgagagttgctggtatttccaccagacagctataccttgcctgcttgccttggctgtgcaggcctctatgccagagaaggagccctcagttctgagaaaagtactattggaggatgaggtgttggctgccatggtgtctgtcattggcactgctacaacccacctgagccctgagttagctgcccagagtgtgacacacattgtgcccctcttcttggatggcaacgtgtcctttctgcctgaaaacagcttcccgagcagattccagccattccaggatggctcctcagggcagaggcggctgattgcactgcttatggcctttgtctgctccctgcctcgaaatgtggaaatccctcagctgaaccaactcatgcgggagcttttggaactgagctgctgccacagctgccccttttcttccaccgctgctgccaagtgctttgcaggactcctcaacaagcaccctgcagggcagcagctggatgaattcctacagctagctgtggacaaagtggaggctggcctgggctctgggccctgtcgtagtcaggccttcactcttcttctctgggtaacaaaggccctagtgctcagataccatcctctcagctcctgccttacagcccggctcatgggcctcctgagtgacccagaattaggtccagcagcagctgatggcttctctctgctcatgtctgactgcactgatgtgctgactcgtgctggccatgccgaagtgcggatcatgttccgccagcggttcttcacagataatgtgcctgctttggtccagggcttccatgctgctccccaagatgtgaagccaaactacttgaagggtctttctcatgtacttaacaggctgcccaagcctgtactcttgccagagctgcccacgcttctttccttgctgctggaggccctgtcctgccctgactgtgtggtgcagctctccaccctcagctgccttcagcctcttctactggaagcaccccaagtcatgagtcttcacgtggacaccctcgtcaccaagtttctgaacctcagctctagcccttccatggctgtccggatcgccgcactgcagtgcatgcatgctctcactcgcctgcccacccctgtgctgctgccgtacaaaccacaggtgattcgggccttagccaaacccctggatgacaagaagagactggtgcgcaaggaagcagtgtcagccagaggggagtggtttctgttggggagccctggcagctgagccctcagtcctggcctagactgttctgacaatctaacctgggattactaactgttgagccatcttccccaaagcagggaaaccactggtctctgactgcctttcccacagacacagcacaaatgctaggcctctgttgcatggctgtacaaagaacataagagtccatatttctagtggatttgtaaaataagtgtgtgtgagacacttgcgtttgaagaaagatctagggtcctgggtctcttgcatttatatgtcagaaaaggggcgatatgctgctgaggggtgagtgcatatgagtgtggccctgaggaccagggctggcagatgttgtctacctgctgaagaataaagatttcttttggtaa

SEQ ID NO: 445621 - DNA, 3314 bp, Homo sapiens
ttgctacgtctaggcccgcgtggtttatcggccttcgcgttatggccgctgccgcggctgtggaggcggcggcgcctatgggtgccctatggggcctcgtgcacgacttcgtcgtgggtcagcaagagggccccgctgaccaggtggctgcaggtcctctctagagaatccagaaccccgaactcgggcacgaggaatccagcttttgtcacaggtgctactccactgtcacaccttgctcctggagaaggaagtggtacacctgatactgttctatgagaaccggctgaaggaccatcatcttgtgatcccatctgtcctgcagggtttgaaggcacttagcctgtgtgtggccctgcccccagggctggctgtttctgtgcttaaagccatcttccaggaagtgcatgtacagtccctgccacaggtggaccgacacacagtctacaatatcatcaccaattttatgcgaacccgggaagaagagctaaagagcctaggagctgacttcacctttggcttcatccaggtgatggatggggaaaaggatccccgtaatcttctggtggccttccgcatcgtccatgacctcatctccagggactatagcctgggaccctttgtggaggagttgtttgaagtgacatcctgttatttccctatcgattttacccctccacctaatgatccccatggtatccagagagaagacctcatcctgagtcttcgcgctgtgctggcttctacaccacgatttgctgagtttctgctgcccctgttgattgagaaagtggattctgaggttctgagtgccaagttggattctctacagactctgaatgcttgctgtgctgtgtatggacagaaggaactgaaggacttcctccccagcctttgggcttctatccgcagagagactgcaggcaccacctgtgtgaaccggacatgaaactggtgtggcctagtgccaagctgttgcaggcagctgcaggtgcatctgcccgggcctgtgactctgtcaccagcaatgtactgcctttactgctggaacagttccacaagcacagtcagagcagccagcggcggacaatccttgaaatgctcctgggtttcttgaagctgcagcagaaatggagctatgaagacaaagatcaaaggcctctgaatggcttcaaggaccagctgtgctcactggtattcatggctctaacagaccccagcacccagcttcagcttgttggcatccgtacactgacagtcttgggtgcccagccagatctcctatcttatgaggacttggagctggcagtgggtcacctgtacagactgagcttcctgaaggaggattcccagagttgcagggtggcagcactggaagcatcaggaaccctggctgctctctaccctgtggccttcagcagccacctcgtacccaagctcgctgaggagctgcgtgtaggggagtcaaatttgactaacggagatgagcccacccaatgctcccggcatctgtgctgtctgcaagccttgtcagctgtatcaacacatcccagcatcgtcaaggagacactgcctctgctgctgcagcatctctggcaagtgaacagagggaatatggttgcacaatccagtgacgttattgctgtctgtcagagcctcagacagatggcagaaaaatgtcagcaggaccctgagagttgctggtatttccaccagacagctataccttgcctgcttgccttggctgtgcaggcctctatgccagagaaggagccctcagttctgagaaaagtactattggaggatgaggtgttggctgccatggtgtctgtcattggcactgctacaacccacctgagccctgagttagctgcccagagtgtgacacacattgtgcccctcttcttggatggcaacgtgtcctttctgcctgaaaacagcttcccgagcagattccagccattccaggatggctcctcagggcagaggcggctgattgcactgcttatggcctttgtctgctccctgcctcgaaatgtggaaatccctcagctgaaccaactcatgcgggagcttttggaactgagctgctgccacagctgccccttttcttccaccgctgctgccaagtgctttgcaggactcctcaacaagcaccctgcagggcagcagctggatgaattcctacagctagctgtggacaaagtggaggctggcctgggctctgggccctgtcgtagtcaggccttcactcttcttctctgggtaacaaaggccctagtgctcagataccatcctctcagctcctgccttacagcccggctcatgggcctcctgagtgacccagaattaggtccagcagcagctgatggcttctctctgctcatgtctgactgcactgatgtgctgactcgtgctggccatgccgaagtgcggatcatgttccgccagcggttcttcacagataatgtgcctgctttggtccagggcttccatgctgctccccaagatgtgaagccaaactacttgaagggtctttctcatgtacttaacaggctgcccaagcctgtactcttgccagagctgcccacgcttctttccttgctgctggaggccctgtcctgccctgactgtgtggtgcagctctccaccctcagctgccttcagcctcttctactggaagcaccccaagtcatgagtcttcacgtggacaccctcgtcaccaagtttctgaacctcagctctagcccttccatggctgtccggatcgccgcactgcagtgcatgcatgctctcactcgcctgcccacccctgtgctgctgccgtacaaaccacaggtgattcgggccttagccaaacccctggatgacaagaagagactggtgcgcaaggaagcagtgtcagccagaggggagtggtttctgttggggagccctggcagctgagccctcagtcctggcctagactgttctgacaatctaacctgggattactaactgttgagccatcttccccaaagcagggaaaccactggtctctgactgcctttcccacagacacagcacaaatgctaggcctctgttgcatggctgtacaaagaacataagagtccatatttctagtggatttgtaaaataagtgtgtgtgagacacttgcgtttgaagaaagatctagggtcctgggtctcttgcatttatatgtcagaaaaggggcgatatgctgctgaggggtgagtgcatatgagtgtggccctgaggaccagggctggcagatgttgtctacctgctgaagaataaagatttcttttggtaa

SEQ ID NO: 445622 - DNA, 3347 bp, Homo sapiens
ttgctacgtctaggcccgcgtggtttatcggccttcgcgttatggccgctgccgcggctgtggaggcggcggcgcctatgggtgccctatggggcctcgtgcacgacttcgtcgtgggtcagcaagagggccccgctgaccaggtggctgcaggtcctctctagagaatccagaaccccgaactcgggcacgaggaatccagcttttgtcacaggtgctactccactgtcacaccttgctcctggagaaggaagtggtacacctgatactgttctatgagaaccggctgaaggaccatcatcttgtgatcccatctgtcctgcagggtttgaaggcacttagcctgtgtgtggccctgcccccagggctggctgtttctgtgcttaaagccatcttccaggaagtgcatgtacagtccctgccacaggtggaccgacacacagtctacaatatcatcaccaattttatgcgaacccgggaagaagagctaaagagcctaggagctgacttcacctttggcttcatccaggtgatggatggggaaaaggatccccgtaatcttctggtggccttccgcatcgtccatgacctcatctccagggactatagcctgggaccctttgtggaggagttgtttgaagtgacatcctgttatttccctatcgattttacccctccacctaatgatccccatggtatccagagagaagacctcatcctgagtcttcgcgctgtgctggcttctacaccacgatttgctgagtttctgctgcccctgttgattgagaaagtggattctgaggttctgagtgccaagttggattctctacagactctgaatgcttgctgtgctgtgtatggacagaaggaactgaaggacttcctccccagcctttgggcttctatccgcagagaggtgttccagacggcaagtgagcgggtggaggcagagggcctggcggccctccactccctgactgcgtgtttgtctcgctctgtgctgagggctgatgctgaggacctccttgactccttccttagcaacattctacaggactgcaggcaccacctgtgtgaaccggacatgaaactggtgtggcctagtgccaagctgttgcaggcagctgcaggtgcatctgcccgggcctgtgactctgtcaccagcaatgtactgcctttactgctggaacagttccacaagcacagtcagagcagccagcggcggacaatccttgaaatgctcctgggtttcttgaagctgcagcagaaatggagctatgaagacaaagatcaaaggcctctgaatggcttcaaggaccagctgtgctcactggtattcatggctctaacagaccccagcacccagcttcagcttgttggcatccgtacactgacagtcttgggtgcccagccagatctcctatcttatgaggacttggagctggcagtgggtcacctgtacagactgagcttcctgaaggaggattcccagagttgcagggtggcagcactggaagcatcaggaaccctggctgctctctaccctgtggccttcagcagccacctcgtacccaagctcgctgaggagctgcgtgtaggggagtcaaatttgactaacggagatgagcccacccaatgctcccggcatctgtgctgtctgcaagccttgtcagctgtatcaacacatcccagcatcgtcaaggagacactgcctctgctgctgcagcatctctggcaagtgaacagagggaatatggttgcacaatccagtgacgttattgctgtctgtcagagcctcagacagatggcagaaaaatgtcagcaggaccctgagagttgctggtatttccaccagacagctataccttgcctgcttgccttggctgtgcaggcctctatgccagagaaggagccctcagttctgagaaaagtactattggaggatgaggtgttggctgccatggtgtctgtcattggcactgctacaacccacctgagccctgagttagctgcccagagtgtgacacacattgtgcccctcttcttggatggcaacgtgtcctttctgcctgaaaacagcttcccgagcagattccagccattccaggatggctcctcagggcagaggcggctgattgcactgcttatggcctttgtctgctccctgcctcgaaatgtggaaatccctcagctgaaccaactcatgcgggagcttttggaactgagctgctgccacagctgccccttttcttccaccgctgctgccaagtgctttgcaggactcctcaacaagcaccctgcagggcagcagctggatgaattcctacagctagctgtggacaaagtggaggctggcctgggctctgggccctgtcgtagtcaggccttcactcttcttctctgggtaacaaaggccctagtgctcagataccatcctctcagctcctgccttacagcccggctcatgggcctcctgagtgacccagaattaggtccagcagcagctgatggcttctctctgctcatgtctgactgcactgatgtgctgactcgtgctggccatgccgaagtgcggatcatgttccgccagcggttcttcacagataatgtgcctgctttggtccagggcttccatgctgctccccaagatgtgaagccaaactacttgaagggtctttctcatgtacttaacaggctgcccaagcctgtactcttgccagagctgcccacgcttctttccttgctgctggaggccctgtcctgccctgactgtgtggtgcagctctccaccctcagctgccttcagcctcttctactggaagcaccccaagtcatgagtcttcacgtggacaccctcgtcaccaagtttctgaacctcagctctagcccttccatggctgtccggatcgccgcactgcagtgcatgcatgctctcactcgcctgcccacccctgtgctgctgccgtacaaaccacaggtgattcgggccttagccaaacccctggatgacaagaagagactggtgcgcaaggaagcagtgtcagccagaggggagtggtttctgttggggagccctggcagctgagccctcagtcctggcctagactgttctgacaatctaacctgggattactaactgttgagccatatttctagtggatttgtaaaataagtgtgtgtgagacacttgcgtttgaagaaagatctagggtcctgggtctcttgcatttatatgtcagaaaaggggcgatatgctgctgaggggtgagtgcatatgagtgtggccctgaggaccagggctggcagatgttgtctacctgctgaagaataaagatttcttttggtaa

SEQ ID NO: 445623 - DNA, 2066 bp, Homo sapiens
agcaggctgtagggagcaggctgcccagatctcctatcttatgaggacttggagctggcagtgggtcacctgtacagactgagcttcctgaaggaggattcccagagttgcagggtggcagcactggaagcatcaggaaccctggctgctctctaccctgtggccttcagcagccacctcgtacccaagctcgctgaggagctgcgtgtaggggagtcaaatttgactaacggagatgagcccacccaatgctcccggcatctgtgctgtctgcaagccttgtcagctgtatcaacacatcccagcatcgtcaaggagacactgcctctgctgctgcagcatctctggcaagtgaacagagggaatatggttgcacaatccagtgacgttattgctgtctgtcagagcctcagacagatggcagaaaaatgtcagcaggaccctgagagttgctggtatttccaccagacagctataccttgcctgcttgccttggctgtgcaggcctctatgccagagaaggagccctcagttctgagaaaagtactattggaggatgaggtgttggctgccatggtgtctgtcattggcactgctacaacccacctgagccctgagttagctgcccagagtgtgacacacattgtgcccctcttcttggatggcaacgtgtcctttctgcctgaaaacagcttcccgagcagattccagccattccaggatggctcctcagggcagaggcggctgattgcactgcttatggcctttgtctgctccctgcctcgaaatgtggaaatccctcagctgaaccaactcatgcgggagcttttggaactgagctgctgccacagctgccccttttcttccaccgctgctgccaagtgctttgcaggactcctcaacaagcaccctgcagggcagcagctggatgaattcctacagctagctgtggacaaagtggaggctggcctgggctctgggccctgtcgtagtcaggccttcactcttcttctctgggtaacaaaggccctagtgctcagataccatcctctcagctcctgccttacagcccggctcatgggcctcctgagtgacccagaattaggtccagcagcagctgatggcttctctctgctcatgtctgactgcactgatgtgctgactcgtgctggccatgccgaagtgcggatcatgttccgccagcggttcttcacagataatgtgcctgctttggtccagggcttccatgctgctccccaagatgtgaagccaaactacttgaagggtctttctcatgtacttaacaggctgcccaagcctgtactcttgccagagctgcccacgcttctttccttgctgctggaggccctgtcctgccctgactgtgtggtgcagctctccaccctcagctgccttcagcctcttctactggaagcaccccaagtcatgagtcttcacgtggacaccctcgtcaccaagtttctgaacctcagctctagcccttccatggctgtccggatcgccgcactgcagtgcatgcatgctctcactcgcctgcccacccctgtgctgctgccgtacaaaccacaggtgattcgggccttagccaaacccctggatgacaagaagagactggtgcgcaaggaagcagtgtcagccagaggggagtggtttctgttggggagccctggcagctgagccctcagtcctggcctagactgttctgacaatctaacctgggattactaactgttgagccatcttccccaaagcagggaaaccactggtctctgactgcctttcccacagacacagcacaaatgctaggcctctgttgcatggctgtacaaagaacataagagtccatatttctagtggatttgtaaaataagtgtgtgtgagacacttgcgtttgaagaaagatctagggtcctgggtctcttgcatttatatgtcagaaaaggggcgatatgctgctgaggggtgagtgcatatgagtgtggccctgaggaccagggctggcagatgttgtctacctgctgaagaataaagatttcttttggtaa

SEQ ID NO: 445624 - DNA, 2840 bp, Homo sapiens
ttgctacgtctaggcccgcgtggtttatcggccttcgcgttatggccgctgccgcggctgtggaggcggcggcgcctatgggtgccctatggggcctcgtgcacgacttcgtcgtgggtcagcaagagggccccgctgaccaggtggctgcaggtcctctctagagaatccagaaccccgaactcgggcacgaggaatccagcttttgtcacaggtgctactccactgtcacaccttgctcctggagaaggaagtggtacacctgatactgttctatgagaaccggctgaaggaccatcatcttgtgatcccatctgtcctgcagggtttgaaggcacttagcctgtgtgtggccctgcccccagggctggctgtttctgtgcttaaagccatcttccaggaagtgcatgtacagtccctgccacaggtggaccgacacacagtctacaatatcatcaccaattttatgcgaacccgggaagaagagctaaagagcctaggagctgacttcacctttggcttcatccaggtgatggatggggaaaaggatccccgtaatcttctggtggccttccgcatcgtccatgacctcatctccagggactatagcctgggaccctttgtggaggagttgtttgaagtgacatcctgttatttccctatcgattttacccctccacctaatgatccccatggtatccagagagaagacctcatcctgagtcttcgcgctgtgctggcttctacaccacgatttgctgagtttctgctgcccctgttgattgagaaagtggattctgaggttctgagtgccaagttggattctctacagactctgaatgcttgctgtgctgtgtatggacagaaggaactgaaggacttcctccccagcctttgggcttctatccgcagagaggtgttccagacggcaagtgagcgggtggaggcagagggcctggcggccctccactccctgactgcgtgtttgtctcgctctgtgctgagggctgatgctgaggacctccttgactccttccttagcaacattctacaggactgcaggcaccacctgtgtgaaccggacatgaaactggtgtggcctagtgccaagctgttgcaggcagctgcaggtgcatctgcccgggcctgtgactctgtcaccagcaatgtactgcctttactgctggaacagttccacaagcacagtcagagcagccagcggcggacaatccttgaaatgctcctgggtttcttgaagctgcagcagaaatggagctatgaagacaaagatcaaaggcctctgaatggcttcaaggaccagctgtgctcactggtattcatggctctaacagaccccagcacccagcttcagcttgttggcatccgtacactgacagtcttgggtgcccagccagatctcctatcttatgaggacttggagctggcagtgggtcacctgtacagactgagcttcctgaaggaggattcccagagttgcagggtggcagcactggaagcatcaggaaccctggctgctctctaccctgtggccttcagcagccacctcgtacccaagctcgctgaggagctgcgtgtaggggagtcaaatttgactaacggagatgagcccacccaatgctcccggcatctgtgctgtctgcaagccttgtcagctgtatcaacacatcccagcatcgtcaaggagacactgcctctgctgctgcagcatctctggcaagtgaacagagggaatatggttgcacaatccagtgacgttattgctgtctgtcagagcctcagacagatggcagaaaaatgtcagcaggaccctgagagttgctggtatttccaccagacagctataccttgcctgcttgccttggctgtgcaggcctctatgccagagaaggagccctcagttctgagaaaagtactattggaggatgaggtgttggctgccatggtgtctgtcattggcactgctacaacccacctgagccctgagttagctgcccagagtgtgacacacattgtgcccctcttcttggatggcaacgtgtcctttctgcctgaaaacagcttcccgagcagattccagccattccaggatggctcctcagggcagaggcggctgattgcactgcttatggcctttgtctgctccctgcctcgaaatgtggaaatccctcagctgaaccaactcatgcgggagcttttggaactgagctgctgccacagctgccccttttcttccaccgctgctgccaagtgctttgcaggactcctcaacaagcaccctgcagggcagcagctggatgaattcctacagctagctgtggacaaagtggaggctggcctgggctctgggccctgtcgtagtcaggccttcactcttcttctctgggtaacaaaggccctagtgctcagataccatcctctcagctcctgccttacagcccgggtacgtcctttctggagacagaagaacccaggacctaaacaaactttctggttgctcctattcctcccaaggacttccatcctcccctgtgtgttttttgttttcttttcttttttctttttggagacagggtcttactctgtcacccaggctggagtacagtagtgcaatcacagctcactccagcctcaacctccgtaggctcaagtgatcctcccacttcagcctcgcaagtagctgggactacaggggcaccccaccacacccaactaatgtttgtattttttgtaagaactgggtttggccatgttgcccagactcctagactcaagcagtccacctgccttggcctcccaaagtgctaggattacaggcatga

SEQ ID NO: 445625 - DNA, 2078 bp, Homo sapiens
tttccttgcatctccagggacaccagggacaacatttctatttcttatgttaagaatgttcatcttagctatccctctttcccactgttggcctagtctaaagactgtgcagagttctcaggagcgctctgtggccccaggtcagaccactcctgtttctggtgccctgattctcaggactatagcactaccagagaccagattaagaactgctgtcgtggctagagtcaagccccagagtcagtgatgctgacagaacccaatcattcatttcttgaacccgtcatggtcttgtgattgtgtgcatgtgtgtgtgttttgcagagaaggagccctcagttctgagaaaagtactattggaggatgaggtgttggctgccatggtgtctgtcattggcactgctacaacccacctgagccctgagttagctgcccagagtgtgacacacattgtgcccctcttcttggatggcaacgtgtcctttctgcctgaaaacagcttcccgagcagattccagccattccaggatggctcctcagggcagaggcggctgattgcactgcttatggcctttgtctgctccctgcctcgaaatgtaagtgagcacatttgggaagtactgttatttaaccttgacaaggtgactccgggctgaaatttgccacaggctaagctgatcttttacttcccccaccagagaagttagttctcatccgtcccggtccctgctgccactatgtactggttctcttggagttcaagtgttctctgggtccattacatggccaggttttctgtaggtggaaatccctcagctgaaccaactcatgcgggagcttttggaactgagctgctgccacagctgccccttttcttccaccgctgctgccaagtgctttgcaggactcctcaacaagcaccctgcagggcagcagctggatgaattcctacagctagctgtggacaaagtggaggctggcctgggctctgggccctgtcgtagtcaggccttcactcttcttctctgggtaacaaaggccctagtgctcagataccatcctctcagctcctgccttacagcccggctcatgggcctcctgagtgacccagaattaggtccagcagcagctgatggcttctctctgctcatgtctgactgcactgatgtgctgactcgtgctggccatgccgaagtgcggatcatgttccgccagcggttcttcacagataatgtgcctgctttggtccagggcttccatgctgctccccaagatgtgaagccaaactacttgaagggtctttctcatgtacttaacaggctgcccaagcctgtactcttgccagagctgcccacgcttctttccttgctgctggaggccctgtcctgccctgactgtgtggtgcagctctccaccctcagctgccttcagcctcttctactggaagcaccccaagtcatgagtcttcacgtggacaccctcgtcaccaagtttctgaacctcagctctagcccttccatggctgtccggatcgccgcactgcagtgcatgcatgctctcactcgcctgcccacccctgtgctgctgccgtacaaaccacaggtgattcgggccttagccaaacccctggatgacaagaagagactggtgcgcaaggaagcagtgtcagccagaggggagtggtttctgttggggagccctggcagctgagccctcagtcctggcctagactgttctgacaatctaacctgggattactaactgttgagccatcttccccaaagcagggaaaccactggtctctgactgcctttcccacagacacagcacaaatgctaggcctctgttgcatggctgtacaaagaacataagagtccatatttctagtggatttgtaaaataagtgtgtgtgagacacttgcgtttgaagaaagatctagggtcctgggtctcttgcatttatatgtcagaaaaggggcgatatgctgctgaggggtgagtgcatatgagtgtggccctgaggaccagggctggcagatgttgtctacctgctgaagaataaagatttcttttggtaa

SEQ ID NO: 445626 - DNA, 1963 bp, Homo sapiens
ttgctacgtctaggcccgcgtggtttatcggccttcgcgttatggccgctgccgcggctgtggaggcggcggcgcctatgggtgccctatggggcctcgtgcacgacttcgtcgtgggtcagcaagagggccccgctgaccaggtggctgcaggtcctctctagagaatccagaaccccgaactcgggcacgaggaatccagcttttgtcacaggtgctactccactgtcacaccttgctcctggagaaggaagtggtacacctgatactgttctatgagaaccggctgaaggaccatcatcttgtgatcccatctgtcctgcagggtttgaaggcacttagcctgtgtgtggccctgcccccagggctggctgtttctgtgcttaaagccatcttccaggaagtgcatgtacagtccctgccacaggtggaccgacacacagtctacaatatcatcaccaattttatgcgaacccgggaagaagagctaaagagcctaggagctgacttcacctttggcttcatccaggtgatggatggggaaaaggatccccgtaatcttctggtggccttccgcatcgtccatgacctcatctccagggactatagcctgggaccctttgtggaggagttgtttgaagtgacatcctgttatttccctatcgattttacccctccacctaatgatccccatggtatccagagagaagacctcatcctgagtcttcgcgctgtgctggcttctacaccacgatttgctgagtttctgctgcccctgttgattgagaaagtggattctgaggttctgagtgccaagttggattctctacagactctgaatgcttgctgtgctgtgtatggacagaaggaactgaaggacttcctccccagcctttgggcttctatccgcagagaggtgttccagacggcaagtgagcgggtggaggcagagggcctggcggccctccactccctgactgcgtgtttgtctcgctctgtgctgagggctgatgctgaggacctccttgactccttccttagcaacattctacaggactgcaggcaccacctgtgtgaaccggacatgaaactggtgtggcctagtgccaagctgttgcaggcagctgcaggtgcatctgcccgggcctgtgactctgtcaccagcaatgtactgcctttactgctggaacagttccacaagcacagtcagagcagccagcggcggacaatccttgaaatgctcctgggtttcttgaagctgcagcagaaatggagctatgaagacaaagatcaaaggcctctgaatggcttcaaggaccagctgtgctcactggtattcatggctctaacagaccccagcacccagcttcagcttgttggcatccgtacactgacagtcttgggtgcccagccagatctcctatcttatgaggacttggagctggcagtgggtcacctgtacagactgagcttcctgaaggaggattcccagagttgcagggtggcagcactggaagcatcaggaaccctggctgctctctaccctgtggccttcagcagccacctcgtacccaagctcgctgaggagctgcgtgtaggtatgtgtctctaatcctctgtggcccatccctttccagcaaggctttggggccttcgtgcttcctatcacacagtaaacctttgtctcatgggttgctttcaggggagtcaaatttgactaacggagatgagcccacccaatgctcccggcatctgtgctgtctgcaagccttgtcagctgtatcaacacatcccagcatcgtcaaggagacactgcctctgctgctgcagcatctctggcaagtgaacagaggtaactactaggaataaccaccaacggactgggctgaatagggagctgtagtctctaaggcagtggttctagctgtagctatacataagagtaacagaatcaactctttta

SEQ ID NO: 445627 - DNA, 1212 bp, Homo sapiens
ttgctacgtctaggcccgcgtggtttatcggccttcgcgttatggccgctgccgcggctgtggaggcggcggcgcctatgggtgccctatggggcctcgtgcacgacttcgtcgtgggtcagcaagagggccccgctgaccaggtggctgcaggtcctctctagagaatccagaaccccgaactcgggcacgaggaatccagcttttgtcacaggtgctactccactgtcacaccttgctcctggagaaggaagtggtacacctgatactgttctatgagaaccggctgaaggaccatcatcttgtgatcccatctgtcctgcagggtttgaaggcacttagcctgtgtgtggccctgcccccagggctggctgtttctgtgcttaaagccatcttccaggaagtgcatgtacagtccctgccacaggtggaccgacacacagtctacaatatcatcaccaattttatgcgaacccgggaagaagagctaaagagcctaggagctgacttcacctttggcttcatccaggtgatggatggggaaaaggatccccgtaatcttctggtggccttccgcatcgtccatgacctcatctccagggactatagcctgggaccctttgtggaggagttgtttgaagtgacatcctgttatttccctatcgattttacccctccacctaatgatccccatggtatccagagagaagacctcatcctgagtcttcgcgctgtgctggcttctacaccacgatttgctgagtttctgctgcccctgttgattgagaaagtggattctgaggttctgagtgccaagttggattctctacagactctggtgagtgatttttcctccttgcaggacccagctaccttttgacaagttaggggtcctaaaggatatagattctaggatagccaaggaacagttcatgggcctcagaagaggatacccaggatttgggcctttgtgtcgacctgaagcccccagctgcatatcgtcgtgtcccatcccccatcccatagtaactgaggaaaggctgaccaggactccctctttaggcttctattttatcaaccagggttatctcctacttctctgttcccttagtaggactgttaaaaatcttaactggtttttctgctgagaccagggctccttcaggtgccattatgctgaggtacctgcacatcctagggtgtctgagtgtg

SEQ ID NO: 445628 - DNA, 660 bp, Homo sapiens
gagcttgctaataacattaacagggcttcaactgctcaagcactgtcctgggactgcccgtgggaaaagcgtcaagaccacagttgggcagagctttatagtacctaagaagagaagggagcacaaagagtctagttctgccgtcctactccctacagtggggctagtgtggataattctttattggaagtagatgaccctctcttttcaaatggcagcacctctgtattatgagaataccaggctcttatgcaggtgtccaatcattttgtccacaggcaaaaatgatattttccctttctaacagcttctcagggagctctgcacttaaagtgatttgcatttcattgctaaagggaaaatgtgtagcctttatgtcagcatttcctctctcctttttagggcagcagctggatgaattcctacagctagctgtggacaaagtggaggctggcctgggctctgggccctgtcgtagtcaggccttcactcttcttctctgggtaaggagttggagtggagtctggttagccagagaggcaattatgtctggttaaataaaatgtccctgtttgaccctaaaccataaacatctatgtctcagggttctcgggtttgagtgtcattccccaattgctctctctgtctccaattacaggt

SEQ ID NO: 445629 - DNA, 780 bp, Homo sapiens
cccaagtggttatgagattcaataactccttgctgccaacagagccttctcaacagctgcaggcctatgtggcctgggtgaatgcacagctgaagaagaggccagcagtgaagcctgtgcaggacctgcgacaagatctccgggatggggtgatcctggcatatctcatcgagattgttgcaggagaaaagctgagtggggtacagctgagtcccggtaaccaacaggagatgaagaataatgtggagaaagtgctacagtttgtggcctctaaaaagattcgtatgcaccagacttcggctaaagatattgtggatggaaacctgaagtctatcatgaggctggtccttgccttggcagctcatttcaaacctggctccagcaggacggtgaaccaaggacgggactccagagcccctctgcaaagtcaccgaccacactgtgccactgctgttgcccagggagcagctgctgctctggccgatgtgtgtcatgacatgtcccgatcaggacgggatgtctttcgatatagacagaggaacagcagcatggatgaggaaattgagaatccatactggagtgtgcgggccctagtgcagcagtacgaagggcaacaaaggtccccgtctgaatccagctgctccaggtaactgtggcctctgaaacctgaattctggaggattctcggagttctcggcttcaagtaacaatacaacaagcaaaaaggcacctaagccctttttctcccctcagtttatgtttggctttaaagggataccc

SEQ ID NO: 445630 - DNA, 5469 bp, Homo sapiens
tcccgcaggaaagcggggctgggggcagcccggcagcgccgctcaacctagtgcgcgcccagttgtttccataggaaccgcgaccgcgccgggcccctccagcggaggcccccgtgcgagcatgcccagtgcaagccgctagtttggctccagtctaggtttccagtaagtggcatgcgggactccggagggatcccaatgagctgagccgagagcctttgtgtgcagagggaggaggaggaggcggcggcggccgccgggctggagaccccgcccggggagcccccagcaggaacaatgctagcctgcctgacccgagggaacttactggacgtcctgcaggagggcttcaatgagcaacagctgcaggcctatgtggcctgggtgaatgcacagctgaagaagaggccagcagtgaagcctgtgcaggacctgcgacaagatctccgggatggggtgatcctggcatatctcatcgagattgttgcaggagaaaagctgagtggggtacagctgagtcccggtaaccaacaggagatgaagaataatgtggagaaagtgctacagtttgtggcctctaaaaagattcgtatgcaccagacttcggctaaagatattgtggatggaaacctgaagtctatcatgaggctggtccttgccttggcagctcatttcaaacctggctccagcaggacggtgaaccaaggacgggactccagagcccctctgcaaagtcaccgaccacactgtgccactgctgttgcccagggagcagctgctgctctggccgatgtgtgtcatgacatgtcccgatcaggacgggatgtctttcgatatagacagaggaacagcagcatggatgaggaaattgagaatccatactggagtgtgcgggccctagtgcagcagtacgaagggcaacaaaggtccccgtctgaatccagctgctccagcctgacttcacccagtccaatccacagtgcaaagagcgagtccattataacccagtcagaagagaaggcagattttgtgattattcccgctgaaggaatagagaacagaacagaagggacagattctccattatctcgagactggcggccagggagccctggaacctatctggagacctcatgggaagaacagctgttggaacaacaagaatatttagaaaaagaaatggaggaagcaaagaaaatgatatcaggactacaggccttactgctcaatggatccttacctgaagatgaacaggagaggcccttggccctctgtgaaccaggtgtcaatcccgaggaacaactgattataatccaaagtcgtctggatcagagtatggaggagaatcaggacttaaagaaggaactgctgaaatgtaaacaagaagccagaaacttacaggggataaaggatgccttgcagcagagattgactcagcaggacacatctgttcttcagctcaaacaagagctactgagggcaaatatggacaaagatgagctgcacaaccagaatgtggatctgcagaggaagctagatgagaggaaccggctcttgggagaatataaaaaagagctggggcagaaggatcgccttcttcagcagcaccaggccaagttagaagaagcactccggaaactctctgatgtcagttaccaccaggtggatctagagcgagagctagaacacaaagatgtcctcttggctcactgtatgaaaagagaggcagatgaggcgaccaactacaacagtcacaactctcaaagcaatggttttctccttccaacggcaggaaaaggagctacttcagtcagcaacagagggaccagcgacctgcagcttgttcgagatgctctccgcagcctgcgcaacagcttcagtggccacgatcctcagcaccacactattgacagcttggagcagggcatttctagcctcatggagcgcctgcatgttatggagacgcagaagaaacaagaaagaaaggttcgggtcaagtcacccagaactcaagtaggtagtgaataccgggagtcctggccccctaactcaaagttgcctcactcacagagctctccaactgtcagcagcacctgtactaaagtgctctatttcactgaccggtcacttacgcccttcatggtcaatataccaaagaggttggaggaggtgacgttaaaggattttaaagcagctattgatcgggaaggaaatcaccggtatcacttcaaagcactggatcctgagtttggcactgtcaaagaggagattttccatgatgatgatgccatccctggatgggaagggaaaattgtagcttgggtggaagaagaccatggagagaattaatgccaagtatcagattgagggcttatggaacctggtcactccctggctgcttcactcaggaaagggaactaaaaccagaatacactaagaagtttctagtttgtgtgccaaaacagaagcttctccaagcatgatggccacaggtcagtcctctttctgtgcctggcatatctggtacttaaaattctgtccaaatgtagaccatgggttcatctggagttccttgtccgtgggaacacagtgttctattctactctgaggacaacaaaccgaaggccttaaacgatggggatggatgatcccgcctctgtaggggcatggctgctattatctggaaattaggaattggatgcatcattcctgtgtgttacagtattattttaattggcctcaatggttgcagcaatcagagtcccagcgtttgtactcacagacaaggcaaaggtaccagcttttctgtttctttgaacctactgcaaaccaagaataactcatgaggtggtaccaaagatgaaagcccagacttcagtaatcttttgaaccagacgtggatggtgctgaattgttgcttggatggaaaaagggctgcccatgttgtgctacactatgctaaaactgtaatttagtaagaccttgggctgcctcttctgtcttaactggttctgcagcttgtccttttgcccacatagggcctatttcatgtactgttagttttctctggggactctttaactttagagccatttctttttcttcaaactgatgaacttttgtttgaaaggcataaggagtgaaaagctccttgaaaatccaggcgggtatggaaaggtgctgctacccatatctttttgactttctttgtttcatgactttaactcatggcatctcctttgtagtaaaaggagacagaccattaatttcagcatttctttgtgatttataagtactgagcatgaagtacttgtctgcccctcatttcaaggccagagttattttctatttatgtattagtctaggctgatcttttagggcacaatagaaaccatggggcgtggagcatgagttgtgaatggcagggatcattctgggtaaaaaaaacctagaatcatttctgatgtgcaacattgtcaagtgaagaagctaacagttcaactaccgagattatttgataacctgggttttctcattcatccatcaagcaccatcaaccagtcagccattattatttatatatgtattaccaaaagcagtctatctgcctgtgacctccaatgtacactgccaaacacaagagtaggacacatctgttctgggttcttgacctatctgtctccaattcatctccccttttcagccatttcaacaaactactctttggagctctgagatgacatcttgttgttttatatagatgtatcttttaaaaatagttcacgtttggagaattcttttgtactcatttgctttttgtctgagaaccatgtctatttttataactggagtgtgagttctgtatcttctcacattctgtatactgtatccattttctagagaacccagtagcttttatacagtctcttcttaccaccccttgtggtttcagaacaagctttattttattacgagtatattaatgacaactaattcctgttccaattctacctgttttagttgtgaaggtagttttgtgtaatccagttgattgctcctctggcagagagaaggagctcaaaagatacttgatgtctttcatgtaagtttacctggtcttttcctattgaagaatttttcatcagaaacgactgggaaagtttgggaaagtcagcaaaagaaagaatgcatttcgaaagcaaacagaagaaaaaagtatattctcacagtttttccccaggaagtctggagaaaaagtcctcatgtcaccaatttctctgttgcatgaattttagtgttttgctataagacagcatgagggctatcaggccaaaattcattattgtatttccaatacagtttgtcttgaatgtctgtctcttaaaccagtttttacttgtcagttttctctcagcaaacagtcttactattatgtggaatttaacttttcagagaaaatttccaaagtcctctaccttatttggcttttatctgtgtcttttggaaaaggagctgcatggcctcagtgcctccataaaaagcttaagttgagttcatgggagaacattaagatcgttttttttcccttttagctcggtaatctcatgtaccacaggtaatgaccaagcatctctgctagaggatgtaactctcataactcctgtgtaaaatgaggatcctgttggtgatcctcattccagtttccaaagcgagaggagccttctgagcagaagtatgcaagactgattctgtttggaacagtttcctatttggctgcattctaggaggcctcctgacttattcatagtattgtcgcctggtggcattggtgtggggtagcttgtcctgctacttgctaaagttctctttctttgagaaaactgaggaaccagaatgcttagagttcataaaataatctctaaaccatgttaggttaaaacaaaatgaccatctcacaaaaacgagtttagttgaatgctcaattccttacaaaatcttcatttaaggctgagtgtggtggctcatgcctgtaattccagcactttgggaggccgaggcaggaagactgcttgagcccaggagttcaagaccagcctgggcaacgtaggaagactccgtctctacatagaaattttattataaaagtagctggggatggtggcacacacctgtagtcccagctactcaggaggttgaggtgggaagattgcttgagcccaggagtttgaggttgcagtgagctgatcatgccactgcactctagcctaggctacagagcaggaccccatctccaaaaaaaaaaaaaaaaaagtcatttaaaaactgaagaatgttctcttcttgctcagttccctaaattagctggggggattgggatactttacaattttacatttttaaatttgaagaatttgttttaaacttacttggtaatggcacttctacttactgaccaacttttcagctctt

SEQ ID NO: 445631 - DNA, 3667 bp, Homo sapiens
gtcatatcagttgctgttcccctactatgagtgaggagtgatgagtcctcgcgatcgtgtccatgtctgaagcaagtcttgtcctcgtggtcctaggcaaccatagcatatggacattgtgtttggcaagggtgtgagagctgtgggctgtgacctcaggcagctttgttctcccgggacactttgaataactgcagatggctggtttagagcaaatgaatgttctaaccacagtctctttctgattgtagagttgcctcactcacagagctctccaactgtcagcagcacctgtactaaagtgctctatttcactgaccggtcacttacgcccttcatggtcaatataccaaagaggttggaggaggtgacgttaaaggattttaaagcagctattgatcgggaaggaaatcaccggtatcacttcaaagcactggatcctgagtttggcactgtcaaagaggagattttccatgatgatgatgccatccctggatgggaagggaaaattgtagcttgggtggaagaagaccatggagagaattaatgccaagtatcagattgagggcttatggaacctggtcactccctggctgcttcactcaggaaagggaactaaaaccagaatacactaagaagtttctagtttgtgtgccaaaacagaagcttctccaagcatgatggccacaggtcagtcctctttctgtgcctggcatatctggtacttaaaattctgtccaaatgtagaccatgggttcatctggagttccttgtccgtgggaacacagtgttctattctactctgaggacaacaaaccgaaggccttaaacgatggggatggatgatcccgcctctgtaggggcatggctgctattatctggaaattaggaattggatgcatcattcctgtgtgttacagtattattttaattggcctcaatggttgcagcaatcagagtcccagcgtttgtactcacagacaaggcaaaggtaccagcttttctgtttctttgaacctactgcaaaccaagaataactcatgaggtggtaccaaagatgaaagcccagacttcagtaatcttttgaaccagacgtggatggtgctgaattgttgcttggatggaaaaagggctgcccatgttgtgctacactatgctaaaactgtaatttagtaagaccttgggctgcctcttctgtcttaactggttctgcagcttgtccttttgcccacatagggcctatttcatgtactgttagttttctctggggactctttaactttagagccatttctttttcttcaaactgatgaacttttgtttgaaaggcataaggagtgaaaagctccttgaaaatccaggcgggtatggaaaggtgctgctacccatatctttttgactttctttgtttcatgactttaactcatggcatctcctttgtagtaaaaggagacagaccattaatttcagcatttctttgtgatttataagtactgagcatgaagtacttgtctgcccctcatttcaaggccagagttattttctatttatgtattagtctaggctgatcttttagggcacaatagaaaccatggggcgtggagcatgagttgtgaatggcagggatcattctgggtaaaaaaaacctagaatcatttctgatgtgcaacattgtcaagtgaagaagctaacagttcaactaccgagattatttgataacctgggttttctcattcatccatcaagcaccatcaaccagtcagccattattatttatatatgtattaccaaaagcagtctatctgcctgtgacctccaatgtacactgccaaacacaagagtaggacacatctgttctgggttcttgacctatctgtctccaattcatctccccttttcagccatttcaacaaactactctttggagctctgagatgacatcttgttgttttatatagatgtatcttttaaaaatagttcacgtttggagaattcttttgtactcatttgctttttgtctgagaaccatgtctatttttataactggagtgtgagttctgtatcttctcacattctgtatactgtatccattttctagagaacccagtagcttttatacagtctcttcttaccaccccttgtggtttcagaacaagctttattttattacgagtatattaatgacaactaattcctgttccaattctacctgttttagttgtgaaggtagttttgtgtaatccagttgattgctcctctggcagagagaaggagctcaaaagatacttgatgtctttcatgtaagtttacctggtcttttcctattgaagaatttttcatcagaaacgactgggaaagtttgggaaagtcagcaaaagaaagaatgcatttcgaaagcaaacagaagaaaaaagtatattctcacagtttttccccaggaagtctggagaaaaagtcctcatgtcaccaatttctctgttgcatgaattttagtgttttgctataagacagcatgagggctatcaggccaaaattcattattgtatttccaatacagtttgtcttgaatgtctgtctcttaaaccagtttttacttgtcagttttctctcagcaaacagtcttactattatgtggaatttaacttttcagagaaaatttccaaagtcctctaccttatttggcttttatctgtgtcttttggaaaaggagctgcatggcctcagtgcctccataaaaagcttaagttgagttcatgggagaacattaagatcgttttttttcccttttagctcggtaatctcatgtaccacaggtaatgaccaagcatctctgctagaggatgtaactctcataactcctgtgtaaaatgaggatcctgttggtgatcctcattccagtttccaaagcgagaggagccttctgagcagaagtatgcaagactgattctgtttggaacagtttcctatttggctgcattctaggaggcctcctgacttattcatagtattgtcgcctggtggcattggtgtggggtagcttgtcctgctacttgctaaagttctctttctttgagaaaactgaggaaccagaatgcttagagttcataaaataatctctaaaccatgttaggttaaaacaaaatgaccatctcacaaaaacgagtttagttgaatgctcaattccttacaaaatcttcatttaaggctgagtgtggtggctcatgcctgtaattccagcactttgggaggccgaggcaggaagactgcttgagcccaggagttcaagaccagcctgggcaacgtaggaagactccgtctctacatagaaattttattataaaagtagctggggatggtggcacacacctgtagtcccagctactcaggaggttgaggtgggaagattgcttgagcccaggagtttgaggttgcagtgagctgatcatgccactgcactctagcctaggctacagagcaggaccccatctccaaaaaaaaaaaaaaaaaagtcatttaaaaactgaagaatgttctcttcttgctcagttccctaaattagctggggggattgggatactttacaattttacatttttaaatttgaagaatttgttttaaacttacttggtaatggcacttctacttactgaccaacttttcagctctt

SEQ ID NO: 445632 - DNA, 412 bp, Homo sapiens
caacgaaatgtcttgaggaggctgagttgtgattttaacttggggtgagcttaccaagttcaactctggactaagtcatctgaaggagagttaagtttctttctgcctttgtggttattcaggccttactgctcaatggatccttacctgaagatgaacaggagaggcccttggccctctgtgaaccaggtgtcaatcccgaggaacaactggtgagctccatcttttgtgattggacactaaatctgtatgtattttacttgtatttagcatttgacactgctgttcatgccttcttgaaatgctgtcttccttgaccagttctggttttcctcctacatttttgaccattgtttccttcttcattcatttaataaacaaatatttattgagtgctgactatatgccagac

SEQ ID NO: 445633 - DNA, 435 bp, Homo sapiens
tgttgtggaagagatggtagaaaagtatgtagtattttaagcacacttttatgatttaaatttcttggttaagttctctcattgatcataactcttgtgatttttgtgtggctccccaggttcgggtcaagtcacccagaactcaagtaggtagtgaataccgggagtcctggccccctaactcaagtaagtacccatttttgctcagtagggactcctagcatattagaccagaaatttagtatttttcacactacattttggggatgtaatttttcttgtagtacttcacttttatactattttgtttctgtagcaatactgcaattgagttagttctaagactatgaagacatatgccatcaccacccccagtgccatttagccacgtgcaggcaggatgctgttgactcagagaggctaaaatatctttga

SEQ ID NO: 445634 - DNA, 4965 bp, Homo sapiens
actcgaggcgcagcctgcgccgccgggagcctccctcccagtgggagatgggttgagatgcccccgccaggggggatgcccggcaccgtgcgtccgcggaggccaagatgcagcggccaggggccggcagcctgcgaggggaggcagcttccgccggggccgggctgctgcacagtctgagcggccgggactgcgcgcttcagagcctggagcatcccagtcgctggggccgagacgccgccgccgccgccgttcccgctttctcccgcgagccgggccagtagctttgctagctggccttcccgtggaggcgttttccagccccagcgcggggagacatgcctgaatttgggagcgatgtgactctcagcctcccacttcacccggggacgcaggcttgctgaagcccgagacaggagggggaccatgggagggacgcaagtcaaatgcctgacttcacccagtccaatccacagtgcaaagagcgagtccattataacccagtcagaagagaaggcagattttgtgattattcccgctgaaggaatagagaacagaacagaagggacagattctccattatctcgagactggcggccagggagccctggaacctatctggagacctcatgggaagaacagctgttggaacaacaagaatatttagaaaaagaaatggaggaagcaaagaaaatgatatcaggactacaggccttactgctcaatggatccttacctgaagatgaacaggagaggcccttggccctctgtgaaccaggtgtcaatcccgaggaacaactgattataatccaaagtcgtctggatcagagtatggaggagaatcaggacttaaagaaggaactgctgaaatgtaaacaagaagccagaaacttacaggggataaaggatgccttgcagcagagattgactcagcaggacacatctgttcttcagctcaaacaagagctactgagggcaaatatggacaaagatgagctgcacaaccagaatgtggatctgcagaggaagctagatgagaggaaccggctcttgggagaatataaaaaagagctggggcagaaggatcgccttcttcagcagcaccaggccaagttagaagaagcactccggaaactctctgatgtcagttaccaccaggtggatctagagcgagagctagaacacaaagatgtcctcttggctcactgtatgaaaagagaggcagatgaggcgaccaactacaacagtcacaactctcaaagcaatggttttctccttccaacggcaggaaaaggagctacttcagtcagcaacagagggaccagcgacctgcagcttgttcgagatgctctccgcagcctgcgcaacagcttcagtggccacgatcctcagcaccacactattgacagcttggagcagggcatttctagcctcatggagcgcctgcatgttatggagacgcagaagaaacaagaaagaaaggttcgggtcaagtcacccagaactcaagtaggtagtgaataccgggagtcctggccccctaactcaaagttgcctcactcacagagctctccaactgtcagcagcacctgtactaaagtgctctatttcactgaccggtcacttacgcccttcatggtcaatataccaaagaggttggaggaggtgacgttaaaggattttaaagcagctattgatcgggaaggaaatcaccggtatcacttcaaagcactggatcctgagtttggcactgtcaaagaggagattttccatgatgatgatgccatccctggatgggaagggaaaattgtagcttgggtggaagaagaccatggagagaattaatgccaagtatcagattgagggcttatggaacctggtcactccctggctgcttcactcaggaaagggaactaaaaccagaatacactaagaagtttctagtttgtgtgccaaaacagaagcttctccaagcatgatggccacaggtcagtcctctttctgtgcctggcatatctggtacttaaaattctgtccaaatgtagaccatgggttcatctggagttccttgtccgtgggaacacagtgttctattctactctgaggacaacaaaccgaaggccttaaacgatggggatggatgatcccgcctctgtaggggcatggctgctattatctggaaattaggaattggatgcatcattcctgtgtgttacagtattattttaattggcctcaatggttgcagcaatcagagtcccagcgtttgtactcacagacaaggcaaaggtaccagcttttctgtttctttgaacctactgcaaaccaagaataactcatgaggtggtaccaaagatgaaagcccagacttcagtaatcttttgaaccagacgtggatggtgctgaattgttgcttggatggaaaaagggctgcccatgttgtgctacactatgctaaaactgtaatttagtaagaccttgggctgcctcttctgtcttaactggttctgcagcttgtccttttgcccacatagggcctatttcatgtactgttagttttctctggggactctttaactttagagccatttctttttcttcaaactgatgaacttttgtttgaaaggcataaggagtgaaaagctccttgaaaatccaggcgggtatggaaaggtgctgctacccatatctttttgactttctttgtttcatgactttaactcatggcatctcctttgtagtaaaaggagacagaccattaatttcagcatttctttgtgatttataagtactgagcatgaagtacttgtctgcccctcatttcaaggccagagttattttctatttatgtattagtctaggctgatcttttagggcacaatagaaaccatggggcgtggagcatgagttgtgaatggcagggatcattctgggtaaaaaaaacctagaatcatttctgatgtgcaacattgtcaagtgaagaagctaacagttcaactaccgagattatttgataacctgggttttctcattcatccatcaagcaccatcaaccagtcagccattattatttatatatgtattaccaaaagcagtctatctgcctgtgacctccaatgtacactgccaaacacaagagtaggacacatctgttctgggttcttgacctatctgtctccaattcatctccccttttcagccatttcaacaaactactctttggagctctgagatgacatcttgttgttttatatagatgtatcttttaaaaatagttcacgtttggagaattcttttgtactcatttgctttttgtctgagaaccatgtctatttttataactggagtgtgagttctgtatcttctcacattctgtatactgtatccattttctagagaacccagtagcttttatacagtctcttcttaccaccccttgtggtttcagaacaagctttattttattacgagtatattaatgacaactaattcctgttccaattctacctgttttagttgtgaaggtagttttgtgtaatccagttgattgctcctctggcagagagaaggagctcaaaagatacttgatgtctttcatgtaagtttacctggtcttttcctattgaagaatttttcatcagaaacgactgggaaagtttgggaaagtcagcaaaagaaagaatgcatttcgaaagcaaacagaagaaaaaagtatattctcacagtttttccccaggaagtctggagaaaaagtcctcatgtcaccaatttctctgttgcatgaattttagtgttttgctataagacagcatgagggctatcaggccaaaattcattattgtatttccaatacagtttgtcttgaatgtctgtctcttaaaccagtttttacttgtcagttttctctcagcaaacagtcttactattatgtggaatttaacttttcagagaaaatttccaaagtcctctaccttatttggcttttatctgtgtcttttggaaaaggagctgcatggcctcagtgcctccataaaaagcttaagttgagttcatgggagaacattaagatcgttttttttcccttttagctcggtaatctcatgtaccacaggtaatgaccaagcatctctgctagaggatgtaactctcataactcctgtgtaaaatgaggatcctgttggtgatcctcattccagtttccaaagcgagaggagccttctgagcagaagtatgcaagactgattctgtttggaacagtttcctatttggctgcattctaggaggcctcctgacttattcatagtattgtcgcctggtggcattggtgtggggtagcttgtcctgctacttgctaaagttctctttctttgagaaaactgaggaaccagaatgcttagagttcataaaataatctctaaaccatgttaggttaaaacaaaatgaccatctcacaaaaacgagtttagttgaatgctcaattccttacaaaatcttcatttaaggctgagtgtggtggctcatgcctgtaattccagcactttgggaggccgaggcaggaagactgcttgagcccaggagttcaagaccagcctgggcaacgtaggaagactccgtctctacatagaaattttattataaaagtagctggggatggtggcacacacctgtagtcccagctactcaggaggttgaggtgggaagattgcttgagcccaggagtttgaggttgcagtgagctgatcatgccactgcactctagcctaggctacagagcaggaccccatctccaaaaaaaaaaaaaaaaaagtcatttaaaaactgaagaatgttctcttcttgctcagttccctaaattagctggggggattgggatactttacaattttacatttttaaatttgaagaatttgttttaaacttacttggtaatggcacttctacttactgaccaacttttcagctctt

SEQ ID NO: 445635 - DNA, 2400 bp, Homo sapiens
tcccgcaggaaagcggggctgggggcagcccggcagcgccgctcaacctagtgcgcgcccagttgtttccataggaaccgcgaccgcgccgggcccctccagcggaggcccccgtgcgagcatgcccagtgcaagccgctagtttggctccagtctaggtttccagtaagtggcatgcgggactccggagggatcccaatgagctgagccgagagcctttgtgtgcagagggaggaggaggaggcggcggcggccgccgggctggagaccccgcccggggagcccccagcaggaacaatgctagcctgcctgacccgagggaacttactggacgtcctgcaggagggcttcaatgagcaacagctgcaggcctatgtggcctgggtgaatgcacagctgaagaagaggccagcagtgaagcctgtgcaggacctgcgacaagatctccgggatggggtgatcctggcatatctcatcgagattgttgcaggagaaaagctgagtggggtacagctgagtcccggtaaccaacaggagatgaagaataatgtggagaaagtgctacagtttgtggcctctaaaaagattcgtatgcaccagacttcggctaaagatattgtggatggaaacctgaagtctatcatgaggctggtccttgccttggcagctcatttcaaacctggctccagcaggacggtgaaccaaggacgggactccagagcccctctgcaaagtcaccgaccacactgtgccactgctgttgcccagggagcagctgctgctctggccgatgtgtgtcatgacatgtcccgatcaggacgggatgtctttcgatatagacagaggaacagcagcatggatgaggaaattgagaatccatactggagtgtgcgggccctagtgcagcagtacgaagggcaacaaaggtccccgtctgaatccagctgctccagcctgacttcacccagtccaatccacagtgcaaagagcgagtccattataacccagtcagaagagaaggcagattttgtgattattcccgctgaaggaatagagaacagaacagaagggacagattctccattatctcgagactggcggccagggagccctggaacctatctggagacctcatgggaagaacagctgttggaacaacaagaatatttagaaaaagaaatggaggaagcaaagaaaatgatatcaggactacaggccttactgctcaatggatccttacctgaagatgaacaggagaggcccttggccctctgtgaaccaggtgtcaatcccgaggaacaactgattataatccaaagtcgtctggatcagagtatggaggagaatcaggacttaaagaaggaactgctgaaatgtaaacaagaagccagaaacttacaggggataaaggatgccttgcagcagagattgactcagcaggacacatctgttcttcagctcaaacaagagctactgagggcaaatatggacaaagatgagctgcacaaccagaatgtggatctgcagaggaagctagatgagaggaaccggctcttgggagaatataaaaaagagctggggcagaaggatcgccttcttcagcagcaccaggccaagttagaagaagcactccggaaactctctgatgtcagttaccaccaggtggatctagagcgagagctagaacacaaagatgtcctcttggctcactgtatgaaaagagaggcagatgaggcgaccaactacaacagtcacaactctcaaagcaatggttttctccttccaacggcaggaaaaggagctacttcagtcagcaacagagggaccagcgacctgcagcttgttcgagatgctctccgcagcctgcgcaacagcttcagtggccacgatcctcagcaccacactattgacagcttggagcagggcatttctagcctcatggagcgcctgcatgttatggagacgcagaagaaacaagaaagaaaggttcgggtcaagtcacccagaactcaagtaggtagtgaataccgggagtcctggccccctaactcaagtaagtacccatttttgctcagtagggactcctagcatattagaccagaaatttagtatttttcacactacattttggggatgtaatttttcttgtagtacttcacttttatactattttgtttctgtagcaatactgcaattgagttagttctaagactatgaagacatatgccatcaccacccccagtgccatttagccacgtgcaggcaggatgctgttgactcagagaggctaaaatatctttgaagaacacagaagctcaaaagatttatgctgaaaaagcaaaatataaaacaacaaaaacacatacatacgtaaatttttctacactcccaaacagcaca

SEQ ID NO: 445636 - DNA, 4141 bp, Homo sapiens
  misc_feature (3903)..(3903): n is a, c, g, or t
  misc_feature (4006)..(4006): n is a, c, g, or t
gtccctgacctgcaccatttccaaatcttgggtacaatttgggcaggtgaccagggtcctattggaacagaaacctgccattggtggctctgcccccatccccaccacccccaatccgctattgactaggaggtgggtaggggggttggtgctttccttttcctttccatctgcagctttgcgttaaagattaaacactggagctcttatccaagcttgctcttgcagccaaaagactaattgcaaaggcatcttctcagtgaagggggcggggtgggctagggctgagtggaaatggtgagagagattattgtagaaaatatctcttccgggaacttagggcaaagagttttattttcaggaatcacatccctgtctcccccaacctcagaccaggcccccaatctcctccccacaagaaaaagcaaaggcagtctgaaaacctgttgccaaaggaagggaacacttctgaaggaggaagttgagagtcttaggccaggtcttgaaggagggggtatcaattaagcagagactgattggaaggggacctaacgtagcctatgatagactcctttctgaggtttacctgtttttgtcgcgggcggtggcgggggcggggtgcggtaatctagagaggtctgggttgtgtgagatattttgagttgaagaatctatttgactagtaaaaaagttgaactttaaagtggtagctttggggacagaggacatgggggttgcattgcaggagtcagcatggagcagggtgcttgtcacacagtttggatcttgtggtttcttacgcatggggccaaaataaacccaggtgaatggcctatgggagggagagagggaagggagcttgctagagccgaggtagagatgagttctttgagaaagagcgggcgtttgtgattgtgtagggggctgcccatagtggacatcctggtggatgtcctctgtccttaccatcctttctcttctctctccagggtaacaagatgctcaactatagtgctcccagtgcagggggttgcctgctggacagaaaggcagtgggcacccctgctggtgggggcttccctcggaggcactcagtcaccctgcccagctccaagttccaccagaaccagctcctcagcagcctcaagggtgagccagcccccgctctgagctcgcgagacagccgcttccgagaccgctccttctcggaagggggcgagcggctgctgcccacccagaagcagcccgggggcggccaggtcaactccagccgctacaagacggagctgtgccgcccctttgaggaaaacggtgcctgtaagtacggggacaagtgccagttcgcacacggcatccacgagctccgcagcctgacccgccaccccaagtacaagacggagctgtgccgcaccttccacaccatcggcttttgcccctacgggccccgctgccacttcatccacaacgctgaagagcgccgtgccctggccggggcccgggacctctccgctgaccgtccccgcctccagcatagctttagctttgctgggtttcccagtgccgctgccaccgccgctgccaccgggctgctggacagccccacgtccatcaccccaccccctattctgagcgccgatgacctcctgggctcacctaccctgcccgatggcaccaataacccttttgccttctccagccaggagctggcaagcctctttgcccctagcatggggctgcccgggggtggctccccgaccaccttcctcttccggcccatgtccgagtcccctcacatgtttgactctccccccagccctcaggattctctctcggaccaggagggctacctgagcagctccagcagcagccacagtggctcagactccccgaccttggacaactcaagacgcctgcccatcttcagcagactttccatctcagatgactaagccagggtagggagggacctcctgcctactccagcccctaccctgcacccacatcccataccctcttctccctacccatcccattccccacaggccctacattaacaaggttaagctcaacccctttcccccagcacctcagaatgtgccctccctctccccctcataaccccacctaacataaggacaagtcaatttgtcagtagcttcttctggcttgaaaccccctccctggattttatagcccacttaccatgcataacagacaagtcccatattttgtcagtagatgcctttttttttccggcttaagccttaagtgccaaatcacaagagaaaaagcagtaacagtttacagaagcaacttagtgccttgtaatctaactttgtcactgtgactacattacctcttcagcgccagagggcacccgtgggcctcccggagcctctgcccatggcggggtggagacccggaaccagcagccccctccactggcgacacaactgcaccttccctcatttcagtctcccgcacacttattcctcctcccctcttcccggtggcacctctccacctgtacccgcccccgccccaccaccccggccccttggaagagttgttgccagaccagggttttgggggaaacctgtcttgacattcaaaacctttttcttcccgatctgaacccctgttgactaatcttgcctgggtttgtgtaggtctgcaggaaggaaggctgaaaaagcggacgaagattttgacttaagtgggactttgtgatttaattttttcttttttttaagtggggaggaaggggaagctagatggactaggagagacttgattttggtgctaaagttccccagttcatatgtgacatctttttaaaaaaaataacaacaaaaaaaaaatgagagaaaagctaaaaaaaaaaaagtaaggggtgagcagttaatggtattcattccacatacaatatctgtgtaaaacgatttcctgtagaagtagctttaatggtttttgctctagaataccgtaggtctatccttagagcactcacgccatgctttcttccctgggttttaaacttcatataactttcagaaattggagagcaaaaattttgcttgtcactgcacatcaatataaaaaagcttatttaacttatcaaaacgtatttattgccaaactatgcttttttttgttaattttgttcatatttatcgggatgacaaatccatagaatatattcttttatgttaaattatgatcttcatattaatcttaaaattttgtgacgtgtctttttcctttttttccacagttttaatatattattcttcaacgacattttttgtaactttacacttttttggttattttattttaaaaaaatgaaaaattaatttaaaaaaatgcaaaaaactgttggattatttattttagaaattcccccctttgtgttggactgcaaattgagtttctttctctttaggcctttcacaactaggactgagaatgtatgtaaaagttctgtgacagtacagaaggaaaacaactttttatgtatagcttctaaaaggggaaaaaaaaaaaaaagagaaaccctttgacttccacgtgcccatctcaagacattccactcacagatttgaggttctggattccaggtctggagttttccaatgttaatgtaaacagaactggcacacacacattaagatgaatgtaattattattcctcttgctggtcactaccgtcgctttctatttctctttctttgtgtgaatttatttaaaagaaaaaaaaactttttgtaacgactatttgcagtttaaaaatcaataaaccccgttttttcaagaaacattgatggtggagctggttttacttggttttggtttgactttgccagtaaggttctccccttgtataccttgcaagtcctgggnagggggaggcggagagagagggctgtggctgtgggtggcggcatctctcatccctataagctaagcctatagctcccttccttgatgctggcagtttgctgcncttagaggggacggggtggaggttttctgcaaaggagcctgtacttcctgctgtattacttctgaaaagactgtgcagtgtgttagttgttggctgaatagcagcgggcccagccttgccgacacttgtgtggcc

SEQ ID NO: 445637 - DNA, 2122 bp, Homo sapiens
  misc_feature (1994)..(1994): n is a, c, g, or t
gtgtgttgggggtggtgagaatgcgctctcttcggcccgccccgtcctttccaaagaaacgtgctcataatggggtgacctaattacatcgcaatggaactcaatcttagccactccgcagcaccgggtttcataacagactcggcggcctcgagtgctgggaagaaacgtgcgagggccgaggggggcggcggagcccgcgtggaaatcggaaagaagcgcagccctgcgacttccgcctgggtcatcacgccagcagtcgggccaaggcgcagggggcgggtgggggacacgttaactttttatttgggtgggcggcatccaaacctaacagtatatattttatcattttcaagggagtcatgctccattgcgggcccttcggtttcgtggctcccatgtccccctctccacctcccgccaaaacggcgcagcgtgacaagccatatgttccactccggtgggggcgagagagaagcaacaataagttaaaagtgccgcctccctccacctctttaccttcattcttaccaaagtaaccttttttcattgttctagagtcttgaggtgtgtgtggggaggatggaggaggagggagggttgtggcgccgcccagaattcggagcgcgcgtggaaagtagtgagttgctcggtgggctttttctgggaggaaggggcattcaggaaggattagggttttcttgactaaaaagtttaaagattggatgcgtgaaaagaaacggcacgcctaggcctggtaaaacaaacaatcgtcccgggttgtggtctttttttgcggcgccccccacccgcccacacccggagagcgccggctgcaaagcgagcgcgagtgtcgacgcgtgcgacgcactaaattgtgccgcgctcgcgcccgccagaccatgtcctcctggggaaaaagtttccctagtccccccagcaccgcgccccaccctacgccccgctggaaaaaaaacagcaacataaaatcctaggcttgaacattctgtgcgtcccaaatttctaatgtcctcggcctgcccggtttgccgaagggagccgagtgtcgaagagaagtcgggaaaaggtaagttgtgcagacacttggggaagtttcaaggagaccgccagctcaagatggaaaccgcggcccgggcgctaaggacgggcttcagctcccgctggcaaaaagagaaagtcgagcccgccttcctgcccaacaaaaaacaacaacatgacaacaagaaccccggagggagtggaatgagtgacgtcacagccgcgctctgaggctgacaaaggagggggcgcgcccctcccgctctgcgcccgcgcggccccggagagggggcgcctgaagcgccgggtagggaagtcagccgacttgaaacttttcctcttaaagaaaaaaaaaaaaaagttgtgcgcggctcacagtggggtttttttttttccgccttcttttctcgtctcccctcccccttcttccttttgaaagtttcttctcctccccctgccccccctccccgcctgaccgcatggctgattcaactccagtgtcaatcaacttctttttcctcctcttcctcatttaaataagtttaaagctcctcctccccccggcccaccaaatctgaactttataaattgggctttgcgcgccccagcccggagtcagaaaggcgaggggcgccgggaactggcgtgtgggactccagacaggagaggctgcgccttccccgcaccgggaccttcgcgacacaccagatcctcgcccctggctcgcgcgaacgcacaggatgaccaccaccctcgtgtctgccaccatcttcgacttgagcgaagttttatgcaaggtaaaggggggcggagcatttgcttttcaaaaagtctttttcttttgccttaagaaagaacccccaaaagtttgggtcttggaaggcaatggggaaagtggtgcagcgagatgattcttttctcctccggcatttctnccaagtttgaaggaatttggccccgtccttcccaccctttgagtttcaacagttgctggcggggattacatgtgaatctggaggccagggttttgaggggcgaagtttgcctggcagggcagcccggg

SEQ ID NO: 445638 - DNA, 577 bp, Homo sapiens
ttttgtgttgttgttgtgtgtctgtttgtttttcgcaacagagtctggtttaattaataaatctttttggaagttttctttgacagatcctacataaataaatatagttttaaaagtggacttttaaacatcaggtttttcctttccgtcatggttttcctacgacaaggataaaagacccctcttccttatttgaaaattctcgcaatcaactagaactgaaattatgaacaccaactctgtccaaactatacttttgttacttcttggtgagcaagagaaatgaagaaaaccaaagaaaatcatgtgctattttaatgtaatttatcctatacttttttcaaaaagtcacactcacgtctgcttgagagttttagaggaatataactttcagaaattggagagcaaaaattttgcttgtcactgcacatcaatataaaaaagcttatttaacttatcaaaacgtatttattgccaaactatgcttttttttgttaattttgttcatatttatcgggatgaatatgaacaaaattaacaaaaaaaagcatagtttggcaataaatacgttttgata

SEQ ID NO: 445639 - DNA, 4684 bp, Homo sapiens
gtgtgttgggggtggtgagaatgcgctctcttcggcccgccccgtcctttccaaagaaacgtgctcataatggggtgacctaattacatcgcaatggaactcaatcttagccactccgcagcaccgggtttcataacagactcggcggcctcgagtgctgggaagaaacgtgcgagggccgaggggggcggcggagcccgcgtggaaatcggaaagaagcgcagccctgcgacttccgcctgggtcatcacgccagcagtcgggccaaggcgcagggggcgggtgggggacacgttaactttttatttgggtgggcggcatccaaacctaacagtatatattttatcattttcaagggagtcatgctccattgcgggcccttcggtttcgtggctcccatgtccccctctccacctcccgccaaaacggcgcagcgtgacaagccatatgttccactccggtgggggcgagagagaagcaacaataagttaaaagtgccgcctccctccacctctttaccttcattcttaccaaagtaaccttttttcattgttctagagtcttgaggtgtgtgtggggaggatggaggaggagggagggttgtggcgccgcccagaattcggagcgcgcgtggaaagtagtgagttgctcggtgggctttttctgggaggaaggggcattcaggaaggattagggttttcttgactaaaaagtttaaagattggatgcgtgaaaagaaacggcacgcctaggcctggtaaaacaaacaatcgtcccgggttgtggtctttttttgcggcgccccccacccgcccacacccggagagcgccggctgcaaagcgagcgcgagtgtcgacgcgtgcgacgcactaaattgtgccgcgctcgcgcccgccagaccatgtcctcctggggaaaaagtttccctagtccccccagcaccgcgccccaccctacgccccgctggaaaaaaaacagcaacataaaatcctaggcttgaacattctgtgcgtcccaaatttctaatgtcctcggcctgcccggtttgccgaagggagccgagtgtcgaagagaagtcgggaaaaggtaagttgtgcagacacttggggaagtttcaaggagaccgccagctcaagatggaaaccgcggcccgggcgctaaggacgggcttcagctcccgctggcaaaaagagaaagtcgagcccgccttcctgcccaacaaaaaacaacaacatgacaacaagaaccccggagggagtggaatgagtgacgtcacagccgcgctctgaggctgacaaaggagggggcgcgcccctcccgctctgcgcccgcgcggccccggagagggggcgcctgaagcgccgggtagggaagtcagccgacttgaaacttttcctcttaaagaaaaaaaaaaaaaagttgtgcgcggctcacagtggggtttttttttttccgccttcttttctcgtctcccctcccccttcttccttttgaaagtttcttctcctccccctgccccccctccccgcctgaccgcatggctgattcaactccagtgtcaatcaacttctttttcctcctcttcctcatttaaataagtttaaagctcctcctccccccggcccaccaaatctgaactttataaattgggctttgcgcgccccagcccggagtcagaaaggcgaggggcgccgggaactggcgtgtgggactccagacaggagaggctgcgccttccccgcaccgggaccttcgcgacacaccagatcctcgcccctggctcgcgcgaacgcacaggatgaccaccaccctcgtgtctgccaccatcttcgacttgagcgaagttttatgcaagggtaacaagatgctcaactatagtgctcccagtgcagggggttgcctgctggacagaaaggcagtgggcacccctgctggtgggggcttccctcggaggcactcagtcaccctgcccagctccaagttccaccagaaccagctcctcagcagcctcaagggtgagccagcccccgctctgagctcgcgagacagccgcttccgagaccgctccttctcggaagggggcgagcggctgctgcccacccagaagcagcccgggggcggccaggtcaactccagccgctacaagacggagctgtgccgcccctttgaggaaaacggtgcctgtaagtacggggacaagtgccagttcgcacacggcatccacgagctccgcagcctgacccgccaccccaagtacaagacggagctgtgccgcaccttccacaccatcggcttttgcccctacgggccccgctgccacttcatccacaacgctgaagagcgccgtgccctggccggggcccgggacctctccgctgaccgtccccgcctccagcatagctttagctttgctgggtttcccagtgccgctgccaccgccgctgccaccgggctgctggacagccccacgtccatcaccccaccccctattctgagcgccgatgacctcctgggctcacctaccctgcccgatggcaccaataacccttttgccttctccagccaggagctggcaagcctctttgcccctagcatggggctgcccgggggtggctccccgaccaccttcctcttccggcccatgtccgagtcccctcacatgtttgactctccccccagccctcaggattctctctcggaccaggagggctacctgagcagctccagcagcagccacagtggctcagactccccgaccttggacaactcaagacgcctgcccatcttcagcagactttccatctcagatgactaagccagggtagggagggacctcctgcctactccagcccctaccctgcacccacatcccataccctcttctccctacccatcccattccccacaggccctacattaacaaggttaagctcaacccctttcccccagcacctcagaatgtgccctccctctccccctcataaccccacctaacataaggacaagtcaatttgtcagtagcttcttctggcttgaaaccccctccctggattttatagcccacttaccatgcataacagacaagtcccatattttgtcagtagatgcctttttttttccggcttaagccttaagtgccaaatcacaagagaaaaagcagtaacagtttacagaagcaacttagtgccttgtaatctaactttgtcactgtgactacattacctcttcagcgccagagggcacccgtgggcctcccggagcctctgcccatggcggggtggagacccggaaccagcagccccctccactggcgacacaactgcaccttccctcatttcagtctcccgcacacttattcctcctcccctcttcccggtggcacctctccacctgtacccgcccccgccccaccaccccggccccttggaagagttgttgccagaccagggttttgggggaaacctgtcttgacattcaaaacctttttcttcccgatctgaacccctgttgactaatcttgcctgggtttgtgtaggtctgcaggaaggaaggctgaaaaagcggacgaagattttgacttaagtgggactttgtgatttaattttttcttttttttaagtggggaggaaggggaagctagatggactaggagagacttgattttggtgctaaagttccccagttcatatgtgacatctttttaaaaaaaataacaacaaaaaaaaaatgagagaaaagctaaaaaaaaaaaagtaaggggtgagcagttaatggtattcattccacatacaatatctgtgtaaaacgatttcctgtagaagtagctttaatggtttttgctctagaataccgtaggtctatccttagagcactcacgccatgctttcttccctgggttttaaacttcatataactttcagaaattggagagcaaaaattttgcttgtcactgcacatcaatataaaaaagcttatttaacttatcaaaacgtatttattgccaaactatgcttttttttgttaattttgttcatatttatcgggatgacaaatccatagaatatattcttttatgttaaattatgatcttcatattaatcttaaaattttgtgacgtgtctttttcctttttttccacagttttaatatattattcttcaacgacattttttgtaactttacacttttttggttattttattttaaaaaaatgaaaaattaatttaaaaaaatgcaaaaaactgttggattatttattttagaaattcccccctttgtgttggactgcaaattgagtttctttctctttaggcctttcacaactaggactgagaatgtatgtaaaagttctgtgacagtacagaaggaaaacaactttttatgtatagcttctaaaaggggaaaaaaaaaaaaaagagaaaccctttgacttccacgtgcccatctcaagacattccactcacagatttgaggttctggattccaggtctggagttttccaatgttaatgtaaacagaactggcacacacacattaagatgaatgtaattattattcctcttgctggtcactaccgtcgctttctatttctctttctttgtgtgaatttatttaaaagaaaaaaaaactttttgtaacgactatttgcagtttaaaaatcaataaaccccgttttttcaagaa

SEQ ID NO: 445640 - DNA, 4626 bp, Homo sapiens
gtgtgttgggggtggtgagaatgcgctctcttcggcccgccccgtcctttccaaagaaacgtgctcataatggggtgacctaattacatcgcaatggaactcaatcttagccactccgcagcaccgggtttcataacagactcggcggcctcgagtgctgggaagaaacgtgcgagggccgaggggggcggcggagcccgcgtggaaatcggaaagaagcgcagccctgcgacttccgcctgggtcatcacgccagcagtcgggccaaggcgcagggggcgggtgggggacacgttaactttttatttgggtgggcggcatccaaacctaacagtatatattttatcattttcaagggagtcatgctccattgcgggcccttcggtttcgtggctcccatgtccccctctccacctcccgccaaaacggcgcagcgtgacaagccatatgttccactccggtgggggcgagagagaagcaacaataagttaaaagtgccgcctccctccacctctttaccttcattcttaccaaagtaaccttttttcattgttctagagtcttgaggtgtgtgtggggaggatggaggaggagggagggttgtggcgccgcccagaattcggagcgcgcgtggaaagtagtgagttgctcggtgggctttttctgggaggaaggggcattcaggaaggattagggttttcttgactaaaaagtttaaagattggatgcgtgaaaagaaacggcacgcctaggcctggtaaaacaaacaatcgtcccgggttgtggtctttttttgcggcgccccccacccgcccacacccggagagcgccggctgcaaagcgagcgcgagtgtcgacgcgtgcgacgcactaaattgtgccgcgctcgcgcccgccagaccatgtcctcctggggaaaaagtttccctagtccccccagcaccgcgccccaccctacgccccgctggaaaaaaaacagcaacataaaatcctaggcttgaacattctgtgcgtcccaaatttctaatgtcctcggcctgcccggtttgccgaagggagccgagtgtcgaagagaagtcgggaaaaggtaagttgtgcagacacttggggaagtttcaaggagaccgccagctcaagatggaaaccgcggcccgggcgctaaggacgggcttcagctcccgctggcaaaaagagaaagtcgagcccgccttcctgcccaacaaaaaacaacaacatgacaacaagaaccccggagggagtggaatgagtgacgtcacagccgcgctctgaggctgacaaaggagggggcgcgcccctcccgctctgcgcccgcgcggccccggagagggggcgcctgaagcgccgggtagggaagtcagccgacttgaaacttttcctcttaaagaaaaaaaaaaaaaagttgtgcgcggctcacagtggggtttttttttttccgccttcttttctcgtctcccctcccccttcttccttttgaaagtttcttctcctccccctgccccccctccccgcctgaccgcatggctgattcaactccagtgtcaatcaacttctttttcctcctcttcctcatttaaataagtttaaagctcctcctccccccggcccaccaaatctgaactttataaattgggctttgcgcgccccagcccggagtcagaaaggcgaggggcgccgggaactggcgtgtgggactccagacaggagaggctgcgccttccccgcaccgggaccttcgcgacacaccagatcctcgcccctggctcgcgcgaacgcacaggatgaccaccaccctcgtgtctgccaccatcttcgacttgagcgaagttttatgcaagggtaacaagatgctcaactatagtgctcccagtgcagggggttgcctgctggacagaaaggcagtgggcacccctgctggtgggggcttccctcggaggcactcagtcaccctgcccagctccaagttccaccagaaccagctcctcagcagcctcaagggtgagccagcccccgctctgagctcgcgagacagccgcttccgagaccgctccttctcggaagggggcgagcggctgctgcccacccagaagcagcccgggggcggccaggtcaactccagccgctacaagacggagctgtgccgcccctttgaggaaaacggtgcctgtaagtacggggacaagtgccagttcgcacacggcatccacgagctccgcagcctgacccgccaccccaagtacaagacggagctgtgccgcaccttccacaccatcggcttttgcccctacgggccccgctgccacttcatccacaacgctgaagagcgccgtgccctggccggggcccgggacctctccgctgaccgtccccgcctccagcatagctttagctttgctgggtttcccagtgccgctgccaccgccgctgccaccgggctgctggacagccccacgtccatcaccccaccccctattctgagcgccgatgacctcctgggctcacctaccctgcccgatggcaccaataacccttttgccttctccagccaggagctggcaagcctctttgcccctagcatggggctgcccgggggtggctccccgaccaccttcctcttccggcccatgtccgagtcccctcacatgtttgactctccccccagccctcaggattctctctcggaccaggagggctacctgagcagctccagcagcagccacagtggctcagactccccgaccttggacaactcaagacgcctgcccatcttcagcagactttccatctcagatgactaagccagggtagggagggacctcctgcctactccagcccctaccctgcacccacatcccataccctcttctccctacccatcccattccccacaggccctacattaacaaggttaagctcaacccctttcccccagcacctcagaatgtgccctccctctccccctcataaccccacctaacataaggacaagtcaatttgtcagtagcttcttctggcttgaaaccccctccctggattttatagcccacttaccatgcataacagacaagtcccatattttgtcagtagatgcctttttttttccggcttaagccttaagtgccaaatcacaagagaaaaagcagtaacagtttacagaagcaacttagtgccttgtaatctaactttgtcactgtgactacattacctcttcagcgccagagggcacccgtgggcctcccggagcctctgcccatggcggggtggagacccggaaccagcagccccctccactggcgacacaactgcaccttccctcatttcagtctcccgcacacttattcctcctcccctcttcccggtggcacctctccacctgtacccgcccccgccccaccaccccggccccttggaagagttgttgccagaccagggttttgggggaaacctgtcttgacattcaaaacctttttcttcccgatctgaacccctgttgactaatcttgcctgggtttgtgtaggtctgcaggaaggaaggctgaaaaagcggacgaagattttgacttaagtgggactttgtgatttaattttttcttttttttaagtggggaggaaggggaagctagatggactaggagagacttgattttggtgctaaagttccccagttcatatgtgacatctttttaaaaaaaataacaacaaaaaaaaaatgagagaaaagctaaaaaaaagatttcctgtagaagtagctttaatggtttttgctctagaataccgtaggtctatccttagagcactcacgccatgctttcttccctgggttttaaacttcatataactttcagaaattggagagcaaaaattttgcttgtcactgcacatcaatataaaaaagcttatttaacttatcaaaacgtatttattgccaaactatgcttttttttgttaattttgttcatatttatcgggatgacaaatccatagaatatattcttttatgttaaattatgatcttcatattaatcttaaaattttgtgacgtgtctttttcctttttttccacagttttaatatattattcttcaacgacattttttgtaactttacacttttttggttattttattttaaaaaaatgaaaaattaatttaaaaaaatgcaaaaaactgttggattatttattttagaaattcccccctttgtgttggactgcaaattgagtttctttctctttaggcctttcacaactaggactgagaatgtatgtaaaagttctgtgacagtacagaaggaaaacaactttttatgtatagcttctaaaaggggaaaaaaaaaaaaaagagaaaccctttgacttccacgtgcccatctcaagacattccactcacagatttgaggttctggattccaggtctggagttttccaatgttaatgtaaacagaactggcacacacacattaagatgaatgtaattattattcctcttgctggtcactaccgtcgctttctatttctctttctttgtgtgaatttatttaaaagaaaaaaaaactttttgtaacgactatttgcagtttaaaaatcaataaaccccgttttttcaagaa

SEQ ID NO: 445641 - DNA, 4630 bp, Homo sapiens
gtgtgttgggggtggtgagaatgcgctctcttcggcccgccccgtcctttccaaagaaacgtgctcataatggggtgacctaattacatcgcaatggaactcaatcttagccactccgcagcaccgggtttcataacagactcggcggcctcgagtgctgggaagaaacgtgcgagggccgaggggggcggcggagcccgcgtggaaatcggaaagaagcgcagccctgcgacttccgcctgggtcatcacgccagcagtcgggccaaggcgcagggggcgggtgggggacacgttaactttttatttgggtgggcggcatccaaacctaacagtatatattttatcattttcaagggagtcatgctccattgcgggcccttcggtttcgtggctcccatgtccccctctccacctcccgccaaaacggcgcagcgtgacaagccatatgttccactccggtgggggcgagagagaagcaacaataagttaaaagtgccgcctccctccacctctttaccttcattcttaccaaagtaaccttttttcattgttctagagtcttgaggtgtgtgtggggaggatggaggaggagggagggttgtggcgccgcccagaattcggagcgcgcgtggaaagtagtgagttgctcggtgggctttttctgggaggaaggggcattcaggaaggattagggttttcttgactaaaaagtttaaagattggatgcgtgaaaagaaacggcacgcctaggcctggtaaaacaaacaatcgtcccgggttgtggtctttttttgcggcgccccccacccgcccacacccggagagcgccggctgcaaagcgagcgcgagtgtcgacgcgtgcgacgcactaaattgtgccgcgctcgcgcccgccagaccatgtcctcctggggaaaaagtttccctagtccccccagcaccgcgccccaccctacgccccgctggaaaaaaaacagcaacataaaatcctaggcttgaacattctgtgcgtcccaaatttctaatgtcctcggcctgcccggtttgccgaagggagccgagtgtcgaagagaagtcgggaaaaggtaagttgtgcagacacttggggaagtttcaaggagaccgccagctcaagatggaaaccgcggcccgggcgctaaggacgggcttcagctcccgctggcaaaaagagaaagtcgagcccgccttcctgcccaacaaaaaacaacaacatgacaacaagaaccccggagggagtggaatgagtgacgtcacagccgcgctctgaggctgacaaaggagggggcgcgcccctcccgctctgcgcccgcgcggccccggagagggggcgcctgaagcgccgggtagggaagtcagccgacttgaaacttttcctcttaaagaaaaaaaaaaaaaagttgtgcgcggctcacagtggggtttttttttttccgccttcttttctcgtctcccctcccccttcttccttttgaaagtttcttctcctccccctgccccccctccccgcctgaccgcatggctgattcaactccagtgtcaatcaacttctttttcctcctcttcctcatttaaataagtttaaagctcctcctccccccggcccaccaaatctgaactttataaattgggctttgcgcgccccagcccggagtcagaaaggcgaggggcgccgggaactggcgtgtgggactccagacaggagaggctgcgccttccccgcaccgggaccttcgcgacacaccagatcctcgcccctggctcgcgcgaacgcacaggatgaccaccaccctcgtgtctgccaccatcttcgacttgagcgaagttttatgcaagggtaacaagatgctcaactatagtgctcccagtgcagggggttgcctgctggacagaaaggcagtgggcacccctgctggtgggggcttccctcggaggcactcagtcaccctgcccagctccaagttccaccagaaccagctcctcagcagcctcaagggtgagccagcccccgctctgagctcgcgagacagccgcttccgagaccgctccttctcggaagggggcgagcggctgctgcccacccagaagcagcccgggggcggccaggtcaactccagccgctacaagacggagctgtgccgcccctttgaggaaaacggtgcctgtaagtacggggacaagtgccagttcgcacacggcatccacgagctccgcagcctgacccgccaccccaagtacaagacggagctgtgccgcaccttccacaccatcggcttttgcccctacgggccccgctgccacttcatccacaacgctgaagagcgccgtgccctggccggggcccgggacctctccgctgaccgtccccgcctccagcatagctttagctttgctgggtttcccagtgccgctgccaccgccgctgccaccgggctgctggacagccccacgtccatcaccccaccccctattctgagcgccgatgacctcctgggctcacctaccctgcccgatggcaccaataacccttttgccttctccagccaggagctggcaagcctctttgcccctagcatggggctgcccgggggtggctccccgaccaccttcctcttccggcccatgtccgagtcccctcacatgtttgactctccccccagccctcaggattctctctcggaccaggagggctacctgagcagctccagcagcagccacagtggctcagactccccgaccttggacaactcaagacgcctgcccatcttcagcagactttccatctcagatgactaagccagggtagggagggacctcctgcctactccagcccctaccctgcacccacatcccataccctcttctccctacccatcccattccccacaggccctacattaacaaggttaagctcaacccctttcccccagcacctcagaatgtgccctccctctccccctcataaccccacctaacataaggacaagtcaatttgtcagtagcttcttctggcttgaaaccccctccctggattttatagcccacttaccatgcataacagacaagtcccatattttgtcagtagatgcctttttttttccggcttaagccttaagtgccaaatcacaagagaaaaagcagtaacagtttacagaagcaacttagtgccttgtaatctaactttgtcactgtgactacattacctcttcagcgccagagggcacccgtgggcctcccggagcctctgcccatggcggggtggagacccggaaccagcagccccctccactggcgacacaactgcaccttccctcatttcagtctcccgcacacttattcctcctcccctcttcccggtggcacctctccacctgtacccgcccccgccccaccaccccggccccttggaagagttgttgccagaccagggttttgggggaaacctgtcttgacattcaaaacctttttcttcccgatctgaacccctgttgactaatcttgcctgggtttgtgtaggtctgcaggaaggaaggctgaaaaagcggacgaagattttgacttaagtgggactttgtgatttaattttttcttttttttaagtggggaggaaggggaagctagatggactaggagagacttgattttggtgctaaagttccccagttcatatgtgacatctttttaaaaaaaataacaacaaaaaaaaaatgagagaaaagctaaaaaaaaaaaagtaaggggtgagcagttaatggtattcattccacatacaatatctgtgtaaaacgatttcctgtagaagtagctttaatggtttttgctctagaataccgtaggtctatccttagagcactcacgccatgctttcttccctgggttttaaacttcatataactttcagaaattggagagcaaaaattttgcttgtcactgcacatcaatataaaaaagcttatttaacttatctcgggatgacaaatccatagaatatattcttttatgttaaattatgatcttcatattaatcttaaaattttgtgacgtgtctttttcctttttttccacagttttaatatattattcttcaacgacattttttgtaactttacacttttttggttattttattttaaaaaaatgaaaaattaatttaaaaaaatgcaaaaaactgttggattatttattttagaaattcccccctttgtgttggactgcaaattgagtttctttctctttaggcctttcacaactaggactgagaatgtatgtaaaagttctgtgacagtacagaaggaaaacaactttttatgtatagcttctaaaaggggaaaaaaaaaaaaaagagaaaccctttgacttccacgtgcccatctcaagacattccactcacagatttgaggttctggattccaggtctggagttttccaatgttaatgtaaacagaactggcacacacacattaagatgaatgtaattattattcctcttgctggtcactaccgtcgctttctatttctctttctttgtgtgaatttatttaaaagaaaaaaaaactttttgtaacgactatttgcagtttaaaaatcaataaaccccgttttttcaagaa

SEQ ID NO: 445642 - DNA, 3972 bp, Homo sapiens
gtgtgttgggggtggtgagaatgcgctctcttcggcccgccccgtcctttccaaagaaacgtgctcataatggggtgacctaattacatcgcaatggaactcaatcttagccactccgcagcaccgggtttcataacagactcggcggcctcgagtgctgggaagaaacgtgcgagggccgaggggggcggcggagcccgcgtggaaatcggaaagaagcgcagccctgcgacttccgcctgggtcatcacgccagcagtcgggccaaggcgcagggggcgggtgggggacacgttaactttttatttgggtgggcggcatccaaacctaacagtatatattttatcattttcaagggagtcatgctccattgcgggcccttcggtttcgtggctcccatgtccccctctccacctcccgccaaaacggcgcagcgtgacaagccatatgttccactccggtgggggcgagagagaagcaacaataagttaaaagtgccgcctccctccacctctttaccttcattcttaccaaagtaaccttttttcattgttctagagtcttgaggtgtgtgtggggaggatggaggaggagggagggttgtggcgccgcccagaattcggagcgcgcgtggaaagtagtgagttgctcggtgggctttttctgggaggaaggggcattcaggaaggattagggttttcttgactaaaaagtttaaagattggatgcgtgaaaagaaacggcacgcctaggcctggtaaaacaaacaatcgtcccgggttgtggtctttttttgcggcgccccccacccgcccacacccggagagcgccggctgcaaagcgagcgcgagtgtcgacgcgtgcgacgcactaaattgtgccgcgctcgcgcccgccagaccatgtcctcctggggaaaaagtttccctagtccccccagcaccgcgccccaccctacgccccgctggaaaaaaaacagcaacataaaatcctaggcttgaacattctgtgcgtcccaaatttctaatgtcctcggcctgcccggtttgccgaagggagccgagtgtcgaagagaagtcgggaaaaggtaagttgtgcagacacttggggaagtttcaaggagaccgccagctcaagatggaaaccgcggcccgggcgctaaggacgggcttcagctcccgctggcaaaaagagaaagtcgagcccgccttcctgcccaacaaaaaacaacaacatgacaacaagaaccccggagggagtggaatgagtgacgtcacagccgcgctctgaggctgacaaaggagggggcgcgcccctcccgctctgcgcccgcgcggccccggagagggggcgcctgaagcgccgggtagggaagtcagccgacttgaaacttttcctcttaaagaaaaaaaaaaaaaagttgtgcgcggctcacagtggggtttttttttttccgccttcttttctcgtctcccctcccccttcttccttttgaaagtttcttctcctccccctgccccccctccccgcctgaccgcatggctgattcaactccagtgtcaatcaacttctttttcctcctcttcctcatttaaataagtttaaagctcctcctccccccggcccaccaaatctgaactttataaattgggctttgcgcgccccagcccggagtcagaaaggcgaggggcgccgggaactggcgtgtgggactccagacaggagaggctgcgccttccccgcaccgggaccttcgcgacacaccagatcctcgcccctggctcgcgcgaacgcacaggatgaccaccaccctcgtgtctgccaccatcttcgacttgagcgaagttttatgcaagggtaacaagatgctcaactatagtgctcccagtgcagggggttgcctgctggacagaaaggcagtgggcacccctgctggtgggggcttccctcggaggcactcagtcaccctgcccagctccaagttccaccagaaccagctcctcagcagcctcaagggtgagccagcccccgctctgagctcgcgagacagccgcttccgagaccgctccttctcggaagggggcgagcggctgctgcccacccagaagcagcccgggggcggccaggtcaactccagccgctacaagacggagctgtgccgcccctttgaggaaaacggtgcctgtaagtacggggacaagtgccagttcgcacacggcatccacgagctccgcagcctgacccgccaccccaagtacaagacggagctgtgccgcaccttccacaccatcggcttttgcccctacgggccccgctgccacttcatccacaacgctgaagagcgccgtgccctggccggggcccgggacctctccgctgaccgtccccgcctccagcatagctttagctttgctgggtttcccagtgccgctgccaccgccgctgccaccgggctgctggacagccccacgtccatcaccccaccccctattctgagcgccgatgacctcctgggctcacctaccctgcccgatggcaccaataacccttttgccttctccagccaggagctggcaagcctctttgcccctagcatggggctgcccgggggtggctccccgaccaccttcctcttccggcccatgtccgagtcccctcacatgtttgactctccccccagccctcaggattctctctcggaccaggagggctacctgagcagctccagcagcagccacagtggctcagactccccgaccttggacaactcaagacgcctgcccatcttcagcagactttccatctcagatgactaagccagggtatctgcaggaaggaaggctgaaaaagcggacgaagattttgacttaagtgggactttgtgatttaattttttcttttttttaagtggggaggaaggggaagctagatggactaggagagacttgattttggtgctaaagttccccagttcatatgtgacatctttttaaaaaaaataacaacaaaaaaaaaatgagagaaaagctaaaaaaaaaaaagtaaggggtgagcagttaatggtattcattccacatacaatatctgtgtaaaacgatttcctgtagaagtagctttaatggtttttgctctagaataccgtaggtctatccttagagcactcacgccatgctttcttccctgggttttaaacttcatataactttcagaaattggagagcaaaaattttgcttgtcactgcacatcaatataaaaaagcttatttaacttatcaaaacgtatttattgccaaactatgcttttttttgttaattttgttcatatttatcgggatgacaaatccatagaatatattcttttatgttaaattatgatcttcatattaatcttaaaattttgtgacgtgtctttttcctttttttccacagttttaatatattattcttcaacgacattttttgtaactttacacttttttggttattttattttaaaaaaatgaaaaattaatttaaaaaaatgcaaaaaactgttggattatttattttagaaattcccccctttgtgttggactgcaaattgagtttctttctctttaggcctttcacaactaggactgagaatgtatgtaaaagttctgtgacagtacagaaggaaaacaactttttatgtatagcttctaaaaggggaaaaaaaaaaaaaagagaaaccctttgacttccacgtgcccatctcaagacattccactcacagatttgaggttctggattccaggtctggagttttccaatgttaatgtaaacagaactggcacacacacattaagatgaatgtaattattattcctcttgctggtcactaccgtcgctttctatttctctttctttgtgtgaatttatttaaaagaaaaaaaaactttttgtaacgactatttgcagtttaaaaatcaataaaccccgttttttcaagaa

SEQ ID NO: 445643 - DNA, 5111 bp, Homo sapiens
  misc_feature (4929)..(4929): n is a, c, g, or t
gtgtgttgggggtggtgagaatgcgctctcttcggcccgccccgtcctttccaaagaaacgtgctcataatggggtgacctaattacatcgcaatggaactcaatcttagccactccgcagcaccgggtttcataacagactcggcggcctcgagtgctgggaagaaacgtgcgagggccgaggggggcggcggagcccgcgtggaaatcggaaagaagcgcagccctgcgacttccgcctgggtcatcacgccagcagtcgggccaaggcgcagggggcgggtgggggacacgttaactttttatttgggtgggcggcatccaaacctaacagtatatattttatcattttcaagggagtcatgctccattgcgggcccttcggtttcgtggctcccatgtccccctctccacctcccgccaaaacggcgcagcgtgacaagccatatgttccactccggtgggggcgagagagaagcaacaataagttaaaagtgccgcctccctccacctctttaccttcattcttaccaaagtaaccttttttcattgttctagagtcttgaggtgtgtgtggggaggatggaggaggagggagggttgtggcgccgcccagaattcggagcgcgcgtggaaagtagtgagttgctcggtgggctttttctgggaggaaggggcattcaggaaggattagggttttcttgactaaaaagtttaaagattggatgcgtgaaaagaaacggcacgcctaggcctggtaaaacaaacaatcgtcccgggttgtggtctttttttgcggcgccccccacccgcccacacccggagagcgccggctgcaaagcgagcgcgagtgtcgacgcgtgcgacgcactaaattgtgccgcgctcgcgcccgccagaccatgtcctcctggggaaaaagtttccctagtccccccagcaccgcgccccaccctacgccccgctggaaaaaaaacagcaacataaaatcctaggcttgaacattctgtgcgtcccaaatttctaatgtcctcggcctgcccggtttgccgaagggagccgagtgtcgaagagaagtcgggaaaaggtaagttgtgcagacacttggggaagtttcaaggagaccgccagctcaagatggaaaccgcggcccgggcgctaaggacgggcttcagctcccgctggcaaaaagagaaagtcgagcccgccttcctgcccaacaaaaaacaacaacatgacaacaagaaccccggagggagtggaatgagtgacgtcacagccgcgctctgaggctgacaaaggagggggcgcgcccctcccgctctgcgcccgcgcggccccggagagggggcgcctgaagcgccgggtagggaagtcagccgacttgaaacttttcctcttaaagaaaaaaaaaaaaaagttgtgcgcggctcacagtggggtttttttttttccgccttcttttctcgtctcccctcccccttcttccttttgaaagtttcttctcctccccctgccccccctccccgcctgaccgcatggctgattcaactccagtgtcaatcaacttctttttcctcctcttcctcatttaaataagtttaaagctcctcctccccccggcccaccaaatctgaactttataaattgggctttgcgcgccccagcccggagtcagaaaggcgaggggcgccgggaactggcgtgtgggactccagacaggagaggctgcgccttccccgcaccgggaccttcgcgacacaccagatcctcgcccctggctcgcgcgaacgcacaggatgaccaccaccctcgtgtctgccaccatcttcgacttgagcgaagttttatgcaagggtaacaagatgctcaactatagtgctcccagtgcagggggttgcctgctggacagaaaggcagtgggcacccctgctggtgggggcttccctcggaggcactcagtcaccctgcccagctccaagttccaccagaaccagctcctcagcagcctcaagggtgagccagcccccgctctgagctcgcgagacagccgcttccgagaccgctccttctcggaagggggcgagcggctgctgcccacccagaagcagcccgggggcggccaggtcaactccagccgctacaagacggagctgtgccgcccctttgaggaaaacggtgcctgtaagtacggggacaagtgccagttcgcacacggcatccacgagctccgcagcctgacccgccaccccaagtacaagacggagctgtgccgcaccttccacaccatcggcttttgcccctacgggccccgctgccacttcatccacaacgctgaagagcgccgtgccctggccggggcccgggacctctccgctgaccgtccccgcctccagcatagctttagctttgctgggtttcccagtgccgctgccaccgccgctgccaccgggctgctggacagccccacgtccatcaccccaccccctattctgagcgccgatgacctcctgggctcacctaccctgcccgatggcaccaataacccttttgccttctccagccaggagctggcaagcctctttgcccctagcatggggctgcccgggggtggctccccgaccaccttcctcttccggcccatgtccgagtcccctcacatgtttgactctccccccagccctcaggattctctctcggaccaggagggctacctgagcagctccagcagcagccacagtggctcagactccccgaccttggacaactcaagacgcctgcccatcttcagcagactttccatctcagatgactaagccagggtagggagggacctcctgcctactccagcccctaccctgcacccacatcccataccctcttctccctacccatcccattccccacaggccctacattaacaaggttaagctcaacccctttcccccagcacctcagaatgtgccctccctctccccctcataaccccacctaacataaggacaagtcaatttgtcagtagcttcttctggcttgaaaccccctccctggattttatagcccacttaccatgcataacagacaagtcccatattttgtcagtagatgcctttttttttccggcttaagccttaagtgccaaatcacaagagaaaaagcagtaacagtttacagaagcaacttagtgccttgtaatctaactttgtcactgtgactacattacctcttcagcgccagagggcacccgtgggcctcccggagcctctgcccatggcggggtggagacccggaaccagcagccccctccactggcgacacaactgcaccttccctcatttcagtctcccgcacacttattcctcctcccctcttcccggtggcacctctccacctgtacccgcccccgccccaccaccccggccccttggaagagttgttgccagaccagggttttgggggaaacctgtcttgacattcaaaacctttttcttcccgatctgaacccctgttgactaatcttgcctgggtttgtgtaggtctgcaggaaggaaggctgaaaaagcggacgaagattttgacttaagtgggactttgtgatttaattttttcttttttttaagtggggaggaaggggaagctagatggactaggagagacttgattttggtgctaaagttccccagttcatatgtgacatctttttaaaaaaaataacaacaaaaaaaaaatgagagaaaagctaaaaaaaaaaaagtaaggggtgagcagttaatggtattcattccacatacaatatctgtgtaaaacgatttcctgtagaagtagctttaatggtttttgctctagaataccgtaggtctatccttagagcactcacgccatgctttcttccctgggttttaaacttcatataactttcagaaattggagagcaaaaattttgcttgtcactgcacatcaatataaaaaagcttatttaacttatcaaaacgtatttattgccaaactatgcttttttttgttaattttgttcatatttatcgggatgacaaatccatagaatatattcttttatgttaaattatgatcttcatattaatcttaaaattttgtgacgtgtctttttcctttttttccacagttttaatatattattcttcaacgacattttttgtaactttacacttttttggttattttattttaaaaaaatgaaaaattaatttaaaaaaatgcaaaaaactgttggattatttattttagaaattcccccctttgtgttggactgcaaattgagtttctttctctttaggcctttcacaactaggactgagaatgtatgtaaaagttctgtgacagtacagaaggaaaacaactttttatgtatagcttctaaaaggggaaaaaaaaaaaaaagagaaaccctttgacttccacgtgcccatctcaagacattccactcacagatttgaggttctggattccaggtctggagttttccaatgttaatgtaaacagaactggcacacacacattaagatgaatgtaattattattcctcttgctggtcactaccgtcgctttctatttctctttctttgtgtgaatttatttaaaagaaaaaaaaactttttgtaacgactatttgcagtttaaaaatcaataaaccccgttttttcaagaaaaaaaaaacaaaaataaaaaaaaaaaaaacacacacaaaaacaaaaaaacacataacaaaaaaaaacaaaaaataataaaaaaaaacaaaaaaaacaaaaaaaaaaaaaaaaaaaaaaaagagggggggccgccgccccaaaagaattctcccccgcgggggcgcccccagtttatagcgcgaccgaccaccacgtctctgtgtgatgaccaaagggggcgccccattatgatgaggagccgcantctatattaactaacgccagacggcgcccgacccgccggcggtgtataaaaacagcgcgctagagaactggggcagaacaaccaatgctgaccaaccaggcggcaccctggtgggacagaagacgaccccctctacccccggggggggggacgcacaatattggggcaacactcccaccaca

SEQ ID NO: 445644 - DNA, 4630 bp, Homo sapiens
gtgtgttgggggtggtgagaatgcgctctcttcggcccgccccgtcctttccaaagaaacgtgctcataatggggtgacctaattacatcgcaatggaactcaatcttagccactccgcagcaccgggtttcataacagactcggcggcctcgagtgctgggaagaaacgtgcgagggccgaggggggcggcggagcccgcgtggaaatcggaaagaagcgcagccctgcgacttccgcctgggtcatcacgccagcagtcgggccaaggcgcagggggcgggtgggggacacgttaactttttatttgggtgggcggcatccaaacctaacagtatatattttatcattttcaagggagtcatgctccattgcgggcccttcggtttcgtggctcccatgtccccctctccacctcccgccaaaacggcgcagcgtgacaagccatatgttccactccggtgggggcgagagagaagcaacaataagttaaaagtgccgcctccctccacctctttaccttcattcttaccaaagtaaccttttttcattgttctagagtcttgaggtgtgtgtggggaggatggaggaggagggagggttgtggcgccgcccagaattcggagcgcgcgtggaaagtagtgagttgctcggtgggctttttctgggaggaaggggcattcaggaaggattagggttttcttgactaaaaagtttaaagattggatgcgtgaaaagaaacggcacgcctaggcctggtaaaacaaacaatcgtcccgggttgtggtctttttttgcggcgccccccacccgcccacacccggagagcgccggctgcaaagcgagcgcgagtgtcgacgcgtgcgacgcactaaattgtgccgcgctcgcgcccgccagaccatgtcctcctggggaaaaagtttccctagtccccccagcaccgcgccccaccctacgccccgctggaaaaaaaacagcaacataaaatcctaggcttgaacattctgtgcgtcccaaatttctaatgtcctcggcctgcccggtttgccgaagggagccgagtgtcgaagagaagtcgggaaaaggtaagttgtgcagacacttggggaagtttcaaggagaccgccagctcaagatggaaaccgcggcccgggcgctaaggacgggcttcagctcccgctggcaaaaagagaaagtcgagcccgccttcctgcccaacaaaaaacaacaacatgacaacaagaaccccggagggagtggaatgagtgacgtcacagccgcgctctgaggctgacaaaggagggggcgcgcccctcccgctctgcgcccgcgcggccccggagagggggcgcctgaagcgccgggtagggaagtcagccgacttgaaacttttcctcttaaagaaaaaaaaaaaaaagttgtgcgcggctcacagtggggtttttttttttccgccttcttttctcgtctcccctcccccttcttccttttgaaagtttcttctcctccccctgccccccctccccgcctgaccgcatggctgattcaactccagtgtcaatcaacttctttttcctcctcttcctcatttaaataagtttaaagctcctcctccccccggcccaccaaatctgaactttataaattgggctttgcgcgccccagcccggagtcagaaaggcgaggggcgccgggaactggcgtgtgggactccagacaggagaggctgcgccttccccgcaccgggaccttcgcgacacaccagatcctcgcccctggctcgcgcgaacgcacaggatgaccaccaccctcgtgtctgccaccatcttcgacttgagcgaagttttatgcaagggtaacaagatgctcaactatagtgctcccagtgcagggggttgcctgctggacagaaaggcagtgggcacccctgctggtgggggcttccctcggaggcactcagtcaccctgcccagctccaagttccaccagaaccagctcctcagcagcctcaagggtgagccagcccccgctctgagctcgcgagacagccgcttccgagaccgctccttctcggaagggggcgagcggctgctgcccacccagaagcagcccgggggcggccaggtcaactccagccgctacaagacggagctgtgccgcccctttgaggaaaacggtgcctgtaagtacggggacaagtgccagttcgcacacggcatccacgagctccgcagcctgacccgccaccccaagtacaagacggagctgtgccgcaccttccacaccatcggcttttgcccctacgggccccgctgccacttcatccacaacgctgaagagcgccgtgccctggccggggcccgggacctctccgctgaccgtccccgcctccagcatagctttagctttgctgggtttcccagtgccgctgccaccgccgctgccaccgggctgctggacagccccacgtccatcaccccaccccctattctgagcgccgatgacctcctgggctcacctaccctgcccgatggcaccaataacccttttgccttctccagccaggagctggcaagcctctttgcccctagcatggggctgcccgggggtggctccccgaccaccttcctcttccggcccatgtccgagtcccctcacatgtttgactctccccccagccctcaggattctctctcggaccaggagggctacctgagcagctccagcagcagccacagtggctcagactccccgaccttggacaactcaagacgcctgcccatcttcagcagactttccatctcagatgactaagccagggtagggagggacctcctgcctactccagcccctaccctgcacccacatcccataccctcttctccctacccatcccattccccacaggccctacattaacaaggttaagctcaacccctttcccccagcacctcagaatgtgccctccctctccccctcataaccccacctaacataaggacaagtcaatttgtcagtagcttcttctggcttgaaaccccctccctggattttatagcccacttaccatgcataacagacaagtcccatattttgtcagtagatgcctttttttttccggcttaagccttaagtgccaaatcacaagagaaaaagcagtaacagtttacagaagcaacttagtgccttgtaatctaactttgtcactgtgactacattacctcttcagcgccagagggcacccgtgggcctcccggagcctctgcccatggcggggtggagacccggaaccagcagccccctccactggcgacacaactgcaccttccctcatttcagtctcccgcacacttattcctcctcccctcttcccggtggcacctctccacctgtacccgcccccgccccaccaccccggccccttggaagagttgttgccagaccagggttttgggggaaacctgtcttgacattcaaaacctttttcttcccgatctgaacccctgttgactaatcttgcctgggtttgtgtaggtctgcaggaaggaaggctgaaaaagcggacgaagattttgacttaagtgggactttgtgatttaattttttcttttttttaagtggggaggaaggggaagctagatggactaggagagacttgattttggtgctaaagttccccagttcatatgtgacatctttttaaaaaaaataacaacaaaaaaaaaatgagagaaaagctaaaaaaaaaaaagtaaggggtgagcagttaatggtattcattccacatacaatatctgtgtaaaacgatttcctgtagaagtagctttaatggtttttgctctagaataccgtaggtctatccttagagcactcacgccatgctttcttccctgggttttaaacttcatataactttcagaaattggagagcaaaaattttgcttgtcactgcacatcaatataaaaaagcttatttaacttatcaaaacgtatttattgccaaactatgcttttttttgttaattttgttcatatttatcgggatgacaaatccatagaatatattcttttatgttaaattatgatcttcatattaatcttaaaattttgtgacgtgtctttttcctttttttccacagttttaatatattattcttcaacgacattttttgtaactttacacttttttggttattttattttaaaaaaatgaaaaattaatttaaaaaaatgcaaaaaactgttggattatttattttagaaattcccccctttgtgttggactgcaaattgagtttctttctctttaggcctttcacaactatatgtatagcttctaaaaggggaaaaaaaaaaaaaagagaaaccctttgacttccacgtgcccatctcaagacattccactcacagatttgaggttctggattccaggtctggagttttccaatgttaatgtaaacagaactggcacacacacattaagatgaatgtaattattattcctcttgctggtcactaccgtcgctttctatttctctttctttgtgtgaatttatttaaaagaaaaaaaaactttttgtaacgactatttgcagtttaaaaatcaataaaccccgttttttcaagaa

SEQ ID NO: 445645 - DNA, 1881 bp, Homo sapiens
  misc_feature (17)..(17): n is a, c, g, or t
aggccaaagaattcggncacaggggagggacctcctgcctactccagcccctaccctgcacccacatcccataccctcttctccctacccatcccattccccacaggccctacattaacaaggttaagctcaacccctttcccccagcacctcagaatgtgccctccctctccccctcataaccccacctaacataaggacaagtcaatttgtcagtagcttcttctggcttgaaaccccctccctggattttatagcccacttaccatgcataacagacaagtcccatattttgtcagtagatgcctttttttttccggcttaagccttaagtgccaaatcacaagagaaaaagcagtaacagtttacagaagcaacttagtgccttgtaatctaactttgtcactgtgactacattacctcttcagcgccagagggcacccgtgggcctcccggagcctctgcccatggcggggtggagacccggaaccagcagccccctccactggcgacacaactgcaccttccctcatttcagtctcccgcacacttattcctcctcccctcttcccggtggcacctctccacctgtacccgcccccgccccaccaccccggccccttggaagagttgttgccagaccagggttttgggggaaacctgtcttgacattcaaaacctttttcttcccgatctgaacccctgttgactaatcttgcctgggtttgtgtaggtctgcaggaaggaaggctgaaaaagcggacgaagattttgacttaagtgggactttgtgatttaattttttcttttttttaagtggggaggaaggggaagctagatggactaggagagacttgattttggtgctaaagttccccagttcatatgtgacatctttttaaaaaaaataacaacaaaaaaaaaatgagagaaaagctaaaaaaaaaaaagtaaggggtgagcagttaatggtattcattccacatacaatatctgtgtaaaacgatttcctgtagaagtagctttaatggtttttgctctagaataccgtaggtctatccttagagcactcacgccatgctttcttccctgggttttaaacttcatataactttcagaaattggagagcaaaaattttgcttgtcactgcacatcaatataaaaaagcttatttaacttatcaaaacgtatttattgccaaactatgcttttttttgttaattttgttcatatttatcgggatgacaaatccatagaatatattcttttatgttaaattatgatcttcatattaatcttaaaattttgtgacgtgtctttttcctttttttccacagttttaatatattattcttcaacgacattttttgtaactttacacttttttggttattttattttaaaaaaatgaaaaattaatttaaaaaaatgcaaaaaactgttggattatttattttagaaattcccccctttgtgttggactgcaaattgagtttctttctctttaggcctttcacaactaggactgagaatgtatgtaaaagttctgtgacagtacagaaggaaaacaactttttatgtatagcttctaaaaggggaaaaaaaaaaaaaagagaaaccctttgacttccacgtgcccatctcaagacattccactcacagatttgaggttctggattccaggtctggagttttccaatgttaatgtaaacagaactggcacacacacattaagatgaatgtaattattattcctcttgctggtcactaccgtcgctttctatttctctttctttgtgtgaatttatttaaaagaaaaaaaaactttttgtaacgactatttgcagtttaaaaatcaataaaccccgttttttcaagaa

SEQ ID NO: 445646 - DNA, 2099 bp, Homo sapiens
cccttacctgcccttaacccacccccacccttgttttcaaccccgtcccccgtttttttggaaaaccacccttcgcaccactttctgtaacccccttccacgttcatacacatgggcccccccccacacaatggtttaaaaattcttccggctcccggccgccacaaattttttttctttttttttttttcccattttttttttaatgggaactcatgtaacaacctacatttattggaaaatgaaatcagtaactaagactctgccaggcccccacccccaacccagcaccaggcctctacttggtctgtcccagttctttaagccccagaatggacaaccatgtgaacagctcaggtcaactgcaggcccacattcccacactgcaaacccctcataaccccacctaacataaggacaagtcaatttgtcagtagcttcttctggcttgaaaccccctccctggattttatagcccacttaccatgcataacagacaagtcccatattttgtcagtagatgcctttttttttccggcttaagccttaagtgccaaatcacaagagaaaaagcagtaacagtttacagaagcaacttagtgccttgtaatctaactttgtcactgtgactacattacctcttcagcgccagagggcacccgtgggcctcccggagcctctgcccatggcggggtggagacccggaaccagcagccccctccactggcgacacaactgcaccttccctcatttcagtctcccgcacacttattcctcctcccctcttcccggtggcacctctccacctgtacccgcccccgccccaccaccccggccccttggaagagttgttgccagaccagggttttgggggaaacctgtcttgacattcaaaacctttttcttcccgatctgaacccctgttgactaatcttgcctgggtttgtgtaggtctgcaggaaggaaggctgaaaaagcggacgaagattttgacttaagtgggactttgtgatttaattttttcttttttttaagtggggaggaaggggaagctagatggactaggagagacttgattttggtgctaaagttccccagttcatatgtgacatctttttaaaaaaaataacaacaaaaaaaaaatgagagaaaagctaaaaaaaaaaaagtaaggggtgagcagttaatggtattcattccacatacaatatctgtgtaaaacgatttcctgtagaagtagctttaatggtttttgctctagaataccgtaggtctatccttagagcactcacgccatgctttcttccctgggttttaaacttcatataactttcagaaattggagagcaaaaattttgcttgtcactgcacatcaatataaaaaagcttatttaacttatcaaaacgtatttattgccaaactatgcttttttttgttaattttgttcatatttatcgggatgacaaatccatagaatatattcttttatgttaaattatgatcttcatattaatcttaaaattttgtgacgtgtctttttcctttttttccacagttttaatatattattcttcaacgacattttttgtaactttacacttttttggttattttattttaaaaaaatgaaaaattaatttaaaaaaatgcaaaaaactgttggattatttattttagaaattcccccctttgtgttggactgcaaattgagtttctttctctttaggcctttcacaactaggactgagaatgtatgtaaaagttctgtgacagtacagaaggaaaacaactttttatgtatagcttctaaaaggggaaaaaaaaaaaaaagagaaaccctttgacttccacgtgcccatctcaagacattccactcacagatttgaggttctggattccaggtctggagttttccaatgttaatgtaaacagaactggcacacacacattaagatgaatgtaattattattcctcttgctggtcactaccgtcgctttctatttctctttctttgtgtgaatttatttaaaagaaaaaaaaactttttgtaacgactatttgcagtttaaaaatcaataaaccccgttttttcaagaa

SEQ ID NO: 445647 - DNA, 3774 bp, Homo sapiens
gtgtgttgggggtggtgagaatgcgctctcttcggcccgccccgtcctttccaaagaaacgtgctcataatggggtgacctaattacatcgcaatggaactcaatcttagccactccgcagcaccgggtttcataacagactcggcggcctcgagtgctgggaagaaacgtgcgagggccgaggggggcggcggagcccgcgtggaaatcggaaagaagcgcagccctgcgacttccgcctgggtcatcacgccagcagtcgggccaaggcgcagggggcgggtgggggacacgttaactttttatttgggtgggcggcatccaaacctaacagtatatattttatcattttcaagggagtcatgctccattgcgggcccttcggtttcgtggctcccatgtccccctctccacctcccgccaaaacggcgcagcgtgacaagccatatgttccactccggtgggggcgagagagaagcaacaataagttaaaagtgccgcctccctccacctctttaccttcattcttaccaaagtaaccttttttcattgttctagagtcttgaggtgtgtgtggggaggatggaggaggagggagggttgtggcgccgcccagaattcggagcgcgcgtggaaagtagtgagttgctcggtgggctttttctgggaggaaggggcattcaggaaggattagggttttcttgactaaaaagtttaaagattggatgcgtgaaaagaaacggcacgcctaggcctggtaaaacaaacaatcgtcccgggttgtggtctttttttgcggcgccccccacccgcccacacccggagagcgccggctgcaaagcgagcgcgagtgtcgacgcgtgcgacgcactaaattgtgccgcgctcgcgcccgccagaccatgtcctcctggggaaaaagtttccctagtccccccagcaccgcgccccaccctacgccccgctggaaaaaaaacagcaacataaaatcctaggcttgaacattctgtgcgtcccaaatttctaatgtcctcggcctgcccggtttgccgaagggagccgagtgtcgaagagaagtcgggaaaaggtaagttgtgcagacacttggggaagtttcaaggagaccgccagctcaagatggaaaccgcggcccgggcgctaaggacgggcttcagctcccgctggcaaaaagagaaagtcgagcccgccttcctgcccaacaaaaaacaacaacatgacaacaagaaccccggagggagtggaatgagtgacgtcacagccgcgctctgaggctgacaaaggagggggcgcgcccctcccgctctgcgcccgcgcggccccggagagggggcgcctgaagcgccgggtagggaagtcagccgacttgaaacttttcctcttaaagaaaaaaaaaaaaaagttgtgcgcggctcacagtggggtttttttttttccgccttcttttctcgtctcccctcccccttcttccttttgaaagtttcttctcctccccctgccccccctccccgcctgaccgcatggctgattcaactccagtgtcaatcaacttctttttcctcctcttcctcatttaaataagtttaaagctcctcctccccccggcccaccaaatctgaactttataaattgggctttgcgcgccccagcccggagtcagaaaggcgaggggcgccgggaactggcgtgtgggactccagacaggagaggctgcgccttccccgcaccgggaccttcgcgacacaccagatcctcgcccctggctcgcgcgaacgcacaggatgaccaccaccctcgtgtctgccaccatcttcgacttgagcgaagttttatgcaagggtaacaagatgctcaactatagtgctcccagtgcagggggttgcctgctggacagaaaggcagtgggcacccctgctggtgggggcttccctcggaggcactcagtcaccctgcccagctccaagttccaccagaaccagctcctcagcagcctcaagggtgagccagcccccgctctgagctcgcgagacagccgcttccgagaccgctccttctcggaagggggcgagcggctgctgcccacccagaagcagcccgggggcggccaggtcaactccagccgctacaagacggagctgtgccgcccctttgaggaaaacggtgcctgtaagtacggggacaagtgccagttcgcacacggcatccacgagctccgcagcctgacccgccaccccaagtacaagacggagctgtgccgcaccttccacaccatcggcttttgcccctacgggccccgctgccacttcatccacaacgctgaagagcgccgtgccctggccggggcccgggacctctccgctgaccgtccccgcctccagcatagctttagctttgctgggtttcccagtgccgctgccaccgccgctgccaccgggctgctggacagccccacgtccatcaccccaccccctattctgagcgccgatgacctcctgggctcacctaccctgcccgatggcaccaataacccttttgccttctccagccaggagctggcaagcctctttgcccctagcatggggctgcccgggggtggctccccgaccaccttcctcttccggcccatgtccgagtcccctcacatgtttgactctccccccagccctcaggattctctctcggaccaggagggctacctgagcagctccagcagcagccacagtggctcagactccccgaccttggacaactcaagacgcctgcccatcttcagcagactttccatctcagatgactaagccagggtagggagggacctcctgcctactccagcccctaccctgcacccacatcccataccctcttctccctacccatcccattccccacaggccctacattaacaaggttaagctcaacccctttcccccagcacctcagaatgtgccctccctctccccctcataaccccacctaacataaggacaagtcaatttgtcagtagcttcttctggcttgaaaccccctccctggattttatagcccacttaccatgcataacagacaagtcccatattttgtcagtagatgcctttttttttccggcttaagccttaagtgccaaatcacaagagaaaaagcagtaacagtttacagaagcaacttagtgccttgtaatctaactttgtcactgtgactacattacctcttcagcgccagagggcacccgtgggcctcccggagcctctgcccatggcggggtggagacccggaaccagcagccccctccactggcgacacaactgcaccttccctcatttcagtctcccgcacacttattcctcctcccctcttcccggtggcacctctccacctgtacccgcccccgccccaccaccccggccccttggaagagttgttgccagaccagggttttgggggaaacctgtcttgacattcaaaacctttttcttcccgatctgaacccctgttgactaatcttgcctgggtttgtgtaggtctgcaggaaggaaggctgaaaaagcggacgaagattttgacttaagtgggactttgtgatttaattttttcttttttttaagtggggaggaaggggaagctagatggactaggagagacttgattttggtgctaaagttccccagttcatatgtgacatcttgagccgttaatggcatttattccatatctactatttgtgaacctattatctgtcccatttgctttctggtttct

SEQ ID NO: 445648 - DNA, 2512 bp, Homo sapiens
gtgtgttgggggtggtgagaatgcgctctcttcggcccgccccgtcctttccaaagaaacgtgctcataatggggtgacctaattacatcgcaatggaactcaatcttagccactccgcagcaccgggtttcataacagactcggcggcctcgagtgctgggaagaaacgtgcgagggccgaggggggcggcggagcccgcgtggaaatcggaaagaagcgcagccctgcgacttccgcctgggtcatcacgccagcagtcgggccaaggcgcagggggcgggtgggggacacgttaactttttatttgggtgggcggcatccaaacctaacagtatatattttatcattttcaagggagtcatgctccattgcgggcccttcggtttcgtggctcccatgtccccctctccacctcccgccaaaacggcgcagcgtgacaagccatatgttccactccggtgggggcgagagagaagcaacaataagttaaaagtgccgcctccctccacctctttaccttcattcttaccaaagtaaccttttttcattgttctagagtcttgaggtgtgtgtggggaggatggaggaggagggagggttgtggcgccgcccagaattcggagcgcgcgtggaaagtagtgagttgctcggtgggctttttctgggaggaaggggcattcaggaaggattagggttttcttgactaaaaagtttaaagattggatgcgtgaaaagaaacggcacgcctaggcctggtaaaacaaacaatcgtcccgggttgtggtctttttttgcggcgccccccacccgcccacacccggagagcgccggctgcaaagcgagcgcgagtgtcgacgcgtgcgacgcactaaattgtgccgcgctcgcgcccgccagaccatgtcctcctggggaaaaagtttccctagtccccccagcaccgcgccccaccctacgccccgctggaaaaaaaacagcaacataaaatcctaggcttgaacattctgtgcgtcccaaatttctaatgtcctcggcctgcccggtttgccgaagggagccgagtgtcgaagagaagtcgggaaaaggtaagttgtgcagacacttggggaagtttcaaggagaccgccagctcaagatggaaaccgcggcccgggcgctaaggacgggcttcagctcccgctggcaaaaagagaaagtcgagcccgccttcctgcccaacaaaaaacaacaacatgacaacaagaaccccggagggagtggaatgagtgacgtcacagccgcgctctgaggctgacaaaggagggggcgcgcccctcccgctctgcgcccgcgcggccccggagagggggcgcctgaagcgccgggtagggaagtcagccgacttgaaacttttcctcttaaagaaaaaaaaaaaaaagttgtgcgcggctcacagtggggtttttttttttccgccttcttttctcgtctcccctcccccttcttccttttgaaagtttcttctcctccccctgccccccctccccgcctgaccgcatggctgattcaactccagtgtcaatcaacttctttttcctcctcttcctcatttaaataagtttaaagctcctcctccccccggcccaccaaatctgaactttataaattgggctttgcgcgccccagcccggagtcagaaaggcgaggggcgccgggaactggcgtgtgggactccagacaggagaggctgcgccttccccgcaccgggaccttcgcgacacaccagatcctcgcccctggctcgcgcgaacgcacaggatgaccaccaccctcgtgtctgccaccatcttcgacttgagcgaagttttatgcaagggtaacaagatgctcaactatagtgctcccagtgcagggggttgcctgctggacagaaaggcagtgggcacccctgctggtgggggcttccctcggaggcactcagtcaccctgcccagctccaagttccaccagaaccagctcctcagcagcctcaagggtgagccagcccccgctctgagctcgcgagacagccgcttccgagaccgctccttctcggaagggggcgagcggctgctgcccacccagaagcagcccgggggcggccaggtcaactccagccgctacaagacggagctgtgccgcccctttgaggaaaacggtgcctccctcaggattctctctcggaccaggagggctacctgagcagctccagcagcagccacagtggctcagactccccgaccttggacaactcaagacgcctgcccatcttcagcagactttccatctcagatgactaagccagggtagggagggacctcctgcctactcctaatcacataaactattccccccgagcaatctccaattaccatatatacaccaaaaagcatggtcaaccagtacttattactaatcaacgccataatcattcaaaggccccgcaccaataggatctcccgaatcaacctgaccctctcttctaaatattc

SEQ ID NO: 445649 - DNA, 4630 bp, Homo sapiens
gtgtgttgggggtggtgagaatgcgctctcttcggcccgccccgtcctttccaaagaaacgtgctcataatggggtgacctaattacatcgcaatggaactcaatcttagccactccgcagcaccgggtttcataacagactcggcggcctcgagtgctgggaagaaacgtgcgagggccgaggggggcggcggagcccgcgtggaaatcggaaagaagcgcagccctgcgacttccgcctgggtcatcacgccagcagtcgggccaaggcgcagggggcgggtgggggacacgttaactttttatttgggtgggcggcatccaaacctaacagtatatattttatcattttcaagggagtcatgctccattgcgggcccttcggtttcgtggctcccatgtccccctctccacctcccgccaaaacggcgcagcgtgacaagccatatgttccactccggtgggggcgagagagaagcaacaataagttaaaagtgccgcctccctccacctctttaccttcattcttaccaaagtaaccttttttcattgttctagagtcttgaggtgtgtgtggggaggatggaggaggagggagggttgtggcgccgcccagaattcggagcgcgcgtggaaagtagtgagttgctcggtgggctttttctgggaggaaggggcattcaggaaggattagggttttcttgactaaaaagtttaaagattggatgcgtgaaaagaaacggcacgcctaggcctggtaaaacaaacaatcgtcccgggttgtggtctttttttgcggcgccccccacccgcccacacccggagagcgccggctgcaaagcgagcgcgagtgtcgacgcgtgcgacgcactaaattgtgccgcgctcgcgcccgccagaccatgtcctcctggggaaaaagtttccctagtccccccagcaccgcgccccaccctacgccccgctggaaaaaaaacagcaacataaaatcctaggcttgaacattctgtgcgtcccaaatttctaatgtcctcggcctgcccggtttgccgaagggagccgagtgtcgaagagaagtcgggaaaaggtaagttgtgcagacacttggggaagtttcaaggagaccgccagctcaagatggaaaccgcggcccgggcgctaaggacgggcttcagctcccgctggcaaaaagagaaagtcgagcccgccttcctgcccaacaaaaaacaacaacatgacaacaagaaccccggagggagtggaatgagtgacgtcacagccgcgctctgaggctgacaaaggagggggcgcgcccctcccgctctgcgcccgcgcggccccggagagggggcgcctgaagcgccgggtagggaagtcagccgacttgaaacttttcctcttaaagaaaaaaaaaaaaaagttgtgcgcggctcacagtggggtttttttttttccgccttcttttctcgtctcccctcccccttcttccttttgaaagtttcttctcctccccctgccccccctccccgcctgaccgcatggctgattcaactccagtgtcaatcaacttctttttcctcctcttcctcatttaaataagtttaaagctcctcctccccccggcccaccaaatctgaactttataaattgggctttgcgcgccccagcccggagtcagaaaggcgaggggcgccgggaactggcgtgtgggactccagacaggagaggctgcgccttccccgcaccgggaccttcgcgacacaccagatcctcgcccctggctcgcgcgaacgcacaggatgaccaccaccctcgtgtctgccaccatcttcgacttgagcgaagttttatgcaagggtaacaagatgctcaactatagtgctcccagtgcagggggttgcctgctggacagaaaggcagtgggcacccctgctggtgggggcttccctcggaggcactcagtcaccctgcccagctccaagttccaccagaaccagctcctcagcagcctcaagggtgagccagcccccgctctgagctcgcgagacagccgcttccgagaccgctccttctcggaagggggcgagcggctgctgcccacccagaagcagcccgggggcggccaggtcaactccagccgctacaagacggagctgtgccgcccctttgaggaaaacggtgcctgtaagtacggggacaagtgccagttcgcacacggcatccacgagctccgcagcctgacccgccaccccaagtacaagacggagctgtgccgcaccttccacaccatcggcttttgcccctacgggccccgctgccacttcatccacaacgctgaagagcgccgtgccctggccggggcccgggacctctccgctgaccgtccccgcctccagcatagctttagctttgctgggtttcccagtgccgctgccaccgccgctgccaccgggctgctggacagccccacgtccatcaccccaccccctattctgagcgccgatgacctcctgggctcacctaccctgcccgatggcaccaataacccttttgccttctccagccaggagctggcaagcctctttgcccctagcatggggctgcccgggggtggctccccgaccaccttcctcttccggcccatgtccgagtcccctcacatgtttgactctccccccagccctcaggattctctctcggaccaggagggctacctgagcagctccagcagcagccacagtggctcagactccccgaccttggacaactcaagacgcctgcccatcttcagcagactttccatctcagatgactaagccagggtagggagggacctcctgcctactccagcccctaccctgcacccacatcccataccctcttctccctacccatcccattccccacaggccctacattaacaaggttaagctcaacccctttcccccagcacctcagaatgtgccctccctctccccctcataaccccacctaacataaggacaagtcaatttgtcagtagcttcttctggcttgaaaccccctccctggattttatagcccacttaccatgcataacagacaagtcccatattttgtcagtagatgcctttttttttccggcttaagccttaagtgccaaatcacaagagaaatgtgactacattacctcttcagcgccagagggcacccgtgggcctcccggagcctctgcccatggcggggtggagacccggaaccagcagccccctccactggcgacacaactgcaccttccctcatttcagtctcccgcacacttattcctcctcccctcttcccggtggcacctctccacctgtacccgcccccgccccaccaccccggccccttggaagagttgttgccagaccagggttttgggggaaacctgtcttgacattcaaaacctttttcttcccgatctgaacccctgttgactaatcttgcctgggtttgtgtaggtctgcaggaaggaaggctgaaaaagcggacgaagattttgacttaagtgggactttgtgatttaattttttcttttttttaagtggggaggaaggggaagctagatggactaggagagacttgattttggtgctaaagttccccagttcatatgtgacatctttttaaaaaaaataacaacaaaaaaaaaatgagagaaaagctaaaaaaaaaaaagtaaggggtgagcagttaatggtattcattccacatacaatatctgtgtaaaacgatttcctgtagaagtagctttaatggtttttgctctagaataccgtaggtctatccttagagcactcacgccatgctttcttccctgggttttaaacttcatataactttcagaaattggagagcaaaaattttgcttgtcactgcacatcaatataaaaaagcttatttaacttatcaaaacgtatttattgccaaactatgcttttttttgttaattttgttcatatttatcgggatgacaaatccatagaatatattcttttatgttaaattatgatcttcatattaatcttaaaattttgtgacgtgtctttttcctttttttccacagttttaatatattattcttcaacgacattttttgtaactttacacttttttggttattttattttaaaaaaatgaaaaattaatttaaaaaaatgcaaaaaactgttggattatttattttagaaattcccccctttgtgttggactgcaaattgagtttctttctctttaggcctttcacaactaggactgagaatgtatgtaaaagttctgtgacagtacagaaggaaaacaactttttatgtatagcttctaaaaggggaaaaaaaaaaaaaagagaaaccctttgacttccacgtgcccatctcaagacattccactcacagatttgaggttctggattccaggtctggagttttccaatgttaatgtaaacagaactggcacacacacattaagatgaatgtaattattattcctcttgctggtcactaccgtcgctttctatttctctttctttgtgtgaatttatttaaaagaaaaaaaaactttttgtaacgactatttgcagtttaaaaatcaataaaccccgttttttcaagaa

SEQ ID NO: 445650 - DNA, 5008 bp, Homo sapiens
  misc_feature (4770)..(4770): n is a, c, g, or t
  misc_feature (4873)..(4873): n is a, c, g, or t
gtgtgttgggggtggtgagaatgcgctctcttcggcccgccccgtcctttccaaagaaacgtgctcataatggggtgacctaattacatcgcaatggaactcaatcttagccactccgcagcaccgggtttcataacagactcggcggcctcgagtgctgggaagaaacgtgcgagggccgaggggggcggcggagcccgcgtggaaatcggaaagaagcgcagccctgcgacttccgcctgggtcatcacgccagcagtcgggccaaggcgcagggggcgggtgggggacacgttaactttttatttgggtgggcggcatccaaacctaacagtatatattttatcattttcaagggagtcatgctccattgcgggcccttcggtttcgtggctcccatgtccccctctccacctcccgccaaaacggcgcagcgtgacaagccatatgttccactccggtgggggcgagagagaagcaacaataagttaaaagtgccgcctccctccacctctttaccttcattcttaccaaagtaaccttttttcattgttctagagtcttgaggtgtgtgtggggaggatggaggaggagggagggttgtggcgccgcccagaattcggagcgcgcgtggaaagtagtgagttgctcggtgggctttttctgggaggaaggggcattcaggaaggattagggttttcttgactaaaaagtttaaagattggatgcgtgaaaagaaacggcacgcctaggcctggtaaaacaaacaatcgtcccgggttgtggtctttttttgcggcgccccccacccgcccacacccggagagcgccggctgcaaagcgagcgcgagtgtcgacgcgtgcgacgcactaaattgtgccgcgctcgcgcccgccagaccatgtcctcctggggaaaaagtttccctagtccccccagcaccgcgccccaccctacgccccgctggaaaaaaaacagcaacataaaatcctaggcttgaacattctgtgcgtcccaaatttctaatgtcctcggcctgcccggtttgccgaagggagccgagtgtcgaagagaagtcgggaaaaggtaagttgtgcagacacttggggaagtttcaaggagaccgccagctcaagatggaaaccgcggcccgggcgctaaggacgggcttcagctcccgctggcaaaaagagaaagtcgagcccgccttcctgcccaacaaaaaacaacaacatgacaacaagaaccccggagggagtggaatgagtgacgtcacagccgcgctctgaggctgacaaaggagggggcgcgcccctcccgctctgcgcccgcgcggccccggagagggggcgcctgaagcgccgggtagggaagtcagccgacttgaaacttttcctcttaaagaaaaaaaaaaaaaagttgtgcgcggctcacagtggggtttttttttttccgccttcttttctcgtctcccctcccccttcttccttttgaaagtttcttctcctccccctgccccccctccccgcctgaccgcatggctgattcaactccagtgtcaatcaacttctttttcctcctcttcctcatttaaataagtttaaagctcctcctccccccggcccaccaaatctgaactttataaattgggctttgcgcgccccagcccggagtcagaaaggcgaggggcgccgggaactggcgtgtgggactccagacaggagaggctgcgccttccccgcaccgggaccttcgcgacacaccagatcctcgcccctggctcgcgcgaacgcacaggatgaccaccaccctcgtgtctgccaccatcttcgacttgagcgaagttttatgcaagggtaacaagatgctcaactatagtgctcccagtgcagggggttgcctgctggacagaaaggcagtgggcacccctgctggtgggggcttccctcggaggcactcagtcaccctgcccagctccaagttccaccagaaccagctcctcagcagcctcaagggtgagccagcccccgctctgagctcgcgagacagccgcttccgagaccgctccttctcggaagggggcgagcggctgctgcccacccagaagcagcccgggggcggccaggtcaactccagccgctacaagacggagctgtgccgcccctttgaggaaaacggtgcctgtaagtacggggacaagtgccagttcgcacacggcatccacgagctccgcagcctgacccgccaccccaagtacaagacggagctgtgccgcaccttccacaccatcggcttttgcccctacgggccccgctgccacttcatccacaacgctgaagagcgccgtgccctggccggggcccgggacctctccgctgaccgtccccgcctccagcatagctttagctttgctgggtttcccagtgccgctgccaccgccgctgccaccgggctgctggacagccccacgtccatcaccccaccccctattctgagcgccgatgacctcctgggctcacctaccctgcccgatggcaccaataacccttttgccttctccagccaggagctggcaagcctctttgcccctagcatggggctgcccgggggtggctccccgaccaccttcctcttccggcccatgtccgagtcccctcacatgtttgactctccccccagccctcaggattctctctcggaccaggagggctacctgagcagctccagcagcagccacagtggctcagactccccgaccttggacaactcaagacgcctgcccatcttcagcagactttccatctcagatgactaagccagggtagggagggacctcctgcctactccagcccctaccctgcacccacatcccataccctcttctccctacccatcccattccccacaggccctacattaacaaggttaagctcaacccctttcccccagcacctcagaatgtgccctccctctccccctcataaccccacctaacataaggacaagtcaatttgtcagtagcttcttctggcttgaaaccccctccctggattttatagcccacttaccatgcataacagacaagtcccatattttgtcagtagatgcctttttttttccggcttaagccttaagtgccaaatcacaagagaaaaagcagtaacagtttacagaagcaacttagtgccttgtaatctaactttgtcactgtgactacattacctcttcagcgccagagggcacccgtgggcctcccggagcctctgcccatggcggggtggagacccggaaccagcagccccctccactggcgacacaactgcaccttccctcatttcagtctcccgcacacttattcctcctcccctcttcccggtggcacctctccacctgtacccgcccccgccccaccaccccggccccttggaagagttgttgccagaccagggttttgggggaaacctgtcttgacattcaaaacctttttcttcccgatctgaacccctgttgactaatcttgcctgggtttgtgtaggtctgcaggaaggaaggctgaaaaagcggacgaagattttgacttaagtgggactttgtgatttaattttttcttttttttaagtggggaggaaggggaagctagatggactaggagagacttgattttggtgctaaagttccccagttcatatgtgacatctttttaaaaaaaataacaacaaaaaaaaaatgagagaaaagctaaaaaaaaaaaagtaaggggtgagcagttaatggtattcattccacatacaatatctgtgtaaaacgatttcctgtagaagtagctttaatggtttttgctctagaataccgtaggtctatccttagagcactcacgccatgctttcttccctgggttttaaacttcatataactttcagaaattggagagcaaaaattttgcttgtcactgcacatcaatataaaaaagcttatttaacttatcaaaacgtatttattgccaaactatgcttttttttgttaattttgttcatatttatcgggatgacaaatccatagaatatattcttttatgttaaattatgatcttcatattaatcttaaaattttgtgacgtgtctttttcctttttttccacagttttaatatattattcttcaacgacattttttgtaactttacacttttttggttattttattttaaaaaaatgaaaaattaatttaaaaaaatgcaaaaaactgttggattatttattttagaaattcccccctttgtgttggactgcaaattgagtttctttctctttaggcctttcacaactaggactgagaatgtatgtaaaagttctgtgacagtacagaaggaaaacaactttttatgtatagcttctaaaaggggaaaaaaaaaaaaaagagaaaccctttgacttccacgtgcccatctcaagacattccactcacagatttgaggttctggattccaggtctggagttttccaatgttaatgtaaacagaactggcacacacacattaagatgaatgtaattattattcctcttgctggtcactaccgtcgctttctatttctctttctttgtgtgaatttatttaaaagaaaaaaaaactttttgtaacgactatttgcagtttaaaaatcaataaaccccgttttttcaagaaacattgatggtggagctggttttacttggttttggtttgactttgccagtaaggttctccccttgtataccttgcaagtcctgggnagggggaggcggagagagagggctgtggctgtgggtggcggcatctctcatccctataagctaagcctatagctcccttccttgatgctggcagtttgctgcncttagaggggacggggtggaggttttctgcaaaggagcctgtacttcctgctgtattacttctgaaaagactgtgcagtgtgttagttgttggctgaatagcagcgggcccagccttgccgacacttgtgtggcc

SEQ ID NO: 445651 - DNA, 5031 bp, Homo sapiens
  misc_feature (4849)..(4849): n is a, c, g, or t
gtgtgttgggggtggtgagaatgcgctctcttcggcccgccccgtcctttccaaagaaacgtgctcataatggggtgacctaattacatcgcaatggaactcaatcttagccactccgcagcaccgggtttcataacagactcggcggcctcgagtgctgggaagaaacgtgcgagggccgaggggggcggcggagcccgcgtggaaatcggaaagaagcgcagccctgcgacttccgcctgggtcatcacgccagcagtcgggccaaggcgcagggggcgggtgggggacacgttaactttttatttgggtgggcggcatccaaacctaacagtatatattttatcattttcaagggagtcatgctccattgcgggcccttcggtttcgtggctcccatgtccccctctccacctcccgccaaaacggcgcagcgtgacaagccatatgttccactccggtgggggcgagagagaagcaacaataagttaaaagtgccgcctccctccacctctttaccttcattcttaccaaagtaaccttttttcattgttctagagtcttgaggtgtgtgtggggaggatggaggaggagggagggttgtggcgccgcccagaattcggagcgcgcgtggaaagtagtgagttgctcggtgggctttttctgggaggaaggggcattcaggaaggattagggttttcttgactaaaaagtttaaagattggatgcgtgaaaagaaacggcacgcctaggcctggtaaaacaaacaatcgtcccgggttgtggtctttttttgcggcgccccccacccgcccacacccggagagcgccggctgcaaagcgagcgcgagtgtcgacgcgtgcgacgcactaaattgtgccgcgctcgcgcccgccagaccatgtcctcctggggaaaaagtttccctagtccccccagcaccgcgccccaccctacgccccgctggaaaaaaaacagcaacataaaatcctaggcttgaacattctgtgcgtcccaaatttctaatgtcctcggcctgcccggtttgccgaagggagccgagtgtcgaagagaagtcgggaaaaggtaagttgtgcagacacttggggaagtttcaaggagaccgccagctcaagatggaaaccgcggcccgggcgctaaggacgggcttcagctcccgctggcaaaaagagaaagtcgagcccgccttcctgcccaacaaaaaacaacaacatgacaacaagaaccccggagggagtggaatgagtgacgtcacagccgcgctctgaggctgacaaaggagggggcgcgcccctcccgctctgcgcccgcgcggccccggagagggggcgcctgaagcgccgggtagggaagtcagccgacttgaaacttttcctcttaaagaaaaaaaaaaaaaagttgtgcgcggctcacagtggggtttttttttttccgccttcttttctcgtctcccctcccccttcttccttttgaaagtttcttctcctccccctgccccccctccccgcctgaccgcatggctgattcaactccagtgtcaatcaacttctttttcctcctcttcctcatttaaataagtttaaagctcctcctccccccggcccaccaaatctgaactttataaattgggctttgcgcgccccagcccggagtcagaaaggcgaggggcgccgggaactggcgtgtgggactccagacaggagaggctgcgccttccccgcaccgggaccttcgcgacacaccagatcctcgcccctggctcgcgcgaacgcacaggatgaccaccaccctcgtgtctgccaccatcttcgacttgagcgaagttttatgcaagggtaacaagatgctcaactatagtgctcccagtgcagggggttgcctgctggacagaaaggcagtgggcacccctgctggtgggggcttccctcggaggcactcagtcaccctgcccagctccaagttccaccagaaccagctcctcagcagcctcaagggtgagccagcccccgctctgagctcgcgagacagccgcttccgagaccgctccttctcggaagggggcgagcggctgctgcccacccagaagcagcccgggggcggccaggtcaactccagccgctacaagacggagctgtgccgcccctttgaggaaaacggtgcctgtaagtacggggacaagtgccagttcgcacacggcatccacgagctccgcagcctgacccgccaccccaagtacaagacggagctgtgccgcaccttccacaccatcggcttttgcccctacgggccccgctgccacttcatccacaacgctgaagagcgccgtgccctggccggggcccgggacctctccgctgaccgtccccgcctccagcatagctttagctttgctgggtttcccagtgccgctgccaccgccgctgccaccgggctgctggacagccccacgtccatcaccccaccccctattctgagcgccgatgacctcctgggctcacctaccctgcccgatggcaccaataacccttttgccttctccagccaggagctggcaagcctctttgcccctagcatggggctgcccgggggtggctccccgaccaccttcctcttccggcccatgtccgagtcccctcacatgtttgactctccccccagccctcaggattctctctcggaccaggagggctacctgagcagctccagcagcagccacagtggctcagactccccgaccttggacaactcaagacgcctgcccatcttcagcagactttccatctcagatgactaagccagggtagggagggacctcctgcctactccagcccctaccctgcacccacatcccataccctcttctccctacccatcccattccccacaggccctacattaacaaggttaagctcaacccctttcccccagcacctcagaatgtgccctccctctccccctcataaccccacctaacataaggacaagtcaatttgtcagtagcttcttctggcttgaaaccccctccctggattttatagcccacttaccatgcataacagacaagtcccatattttgtcagtagatgcctttttttttccggcttaagccttaagtgccaaatcacaagagaaaaagcagtaacagtttacagaagcaacttagtgccttgtaatctaactttgtcactgtgactacattacctcttcagcgccagagggcacccgtgggcctcccggagcctctgcccatggcggggtggagacccggaaccagcagccccctccactggcgacacaactgcaccttccctcatttcagtctcccgcacacttattcctcctcccctcttcccggtggcacctctccacctgtacccgcccccgccccaccaccccggccccttggaagagttgttgccagaccagggttttgggggaaacctgtcttgacattcaaaacctttttcttcccgatctgaacccctgttgactaatcttgcctgggtttgtgtaggtctgcaggaaggaaggctgaaaaagcggacgaagattttgacttaagtgggactttgtgatttaattttttcttttttttaagtggggaggaaggggaagctagatggactaggagagacttgattttggtgctaaagttccccagttcatatgtgacatctttttaaaaaaaataacaacaaaaaaaaaatgagagaaaagctaaaaaaaaaaaagtaaggggtgagcagttaatggtattcattccacatacaatatctgtgtaaaacgatttcctgtagaagtagctttaatggtttttgctctagaataccgtaggtctatccttagagcactcacgccatgctttcttccctgggttttaaacttcatataactttcagaaattggagagcaaaaattttgcttgtcactgcacatcaatataaaaaagcttatttaacttatcaaaacgtatttattgccaaactatgcttttttttgttaattttgttcatatttatcgggatgacaaatccatagaatatattcttttatgttaaattatgatcttcatattaatcttaaaattttgtgacgtgtctttttcctttttttccacagttttaatatattattcttcaacgacattttttgtaactttacacttttttggttattttattttaaaaaaatgaaaaattaatttaaaaaaatgcaaaaaactgttggattatttattttagaaattcccccctttgtgttggactgcaaattgagtttctttctctttaggcctttcacaactaggactgagaatgtatgtaaaagttctgtgacagtacagaaggaaaacaactttttatgtatagcttctaaaaggggaaaaaaaaaaaaaagagaaaccctttgacttccacgtgcccatctcaagacattccactcacagatttgaggttctggattccaggtctggagttttccaatgttaatgtaaacagaactggcacacacacattaagatgaatgtaattattattcctcttgctggtcactaccgtcgctttctatttctctttctttgtgtgaatttatttaaaagaaaaaaaaactttttgtaacgactatttgcagtttaaaaatcaataaaccccgttttttcaagaaaaaaaacaaaaaaaacaaaaaaaaaaaaaaaaaaaaaaaagagggggggccgccgccccaaaagaattctcccccgcgggggcgcccccagtttatagcgcgaccgaccaccacgtctctgtgtgatgaccaaagggggcgccccattatgatgaggagccgcantctatattaactaacgccagacggcgcccgacccgccggcggtgtataaaaacagcgcgctagagaactggggcagaacaaccaatgctgaccaaccaggcggcaccctggtgggacagaagacgaccccctctacccccggggggggggacgcacaatattggggcaacactcccaccaca

SEQ ID NO: 445652 - DNA, 4589 bp, Homo sapiens
gtgtgttgggggtggtgagaatgcgctctcttcggcccgccccgtcctttccaaagaaacgtgctcataatggggtgacctaattacatcgcaatggaactcaatcttagccactccgcagcaccgggtttcataacagactcggcggcctcgagtgctgggaagaaacgtgcgagggccgaggggggcggcggagcccgcgtggaaatcggaaagaagcgcagccctgcgacttccgcctgggtcatcacgccagcagtcgggccaaggcgcagggggcgggtgggggacacgttaactttttatttgggtgggcggcatccaaacctaacagtatatattttatcattttcaagggagtcatgctccattgcgggcccttcggtttcgtggctcccatgtccccctctccacctcccgccaaaacggcgcagcgtgacaagccatatgttccactccggtgggggcgagagagaagcaacaataagttaaaagtgccgcctccctccacctctttaccttcattcttaccaaagtaaccttttttcattgttctagagtcttgaggtgtgtgtggggaggatggaggaggagggagggttgtggcgccgcccagaattcggagcgcgcgtggaaagtagtgagttgctcggtgggctttttctgggaggaaggggcattcaggaaggattagggttttcttgactaaaaagtttaaagattggatgcgtgaaaagaaacggcacgcctaggcctggtaaaacaaacaatcgtcccgggttgtggtctttttttgcggcgccccccacccgcccacacccggagagcgccggctgcaaagcgagcgcgagtgtcgacgcgtgcgacgcactaaattgtgccgcgctcgcgcccgccagaccatgtcctcctggggaaaaagtttccctagtccccccagcaccgcgccccaccctacgccccgctggaaaaaaaacagcaacataaaatcctaggcttgaacattctgtgcgtcccaaatttctaatgtcctcggcctgcccggtttgccgaagggagccgagtgtcgaagagaagtcgggaaaaggtaagttgtgcagacacttggggaagtttcaaggagaccgccagctcaagatggaaaccgcggcccgggcgctaaggacgggcttcagctcccgctggcaaaaagagaaagtcgagcccgccttcctgcccaacaaaaaacaacaacatgacaacaagaaccccggagggagtggaatgagtgacgtcacagccgcgctctgaggctgacaaaggagggggcgcgcccctcccgctctgcgcccgcgcggccccggagagggggcgcctgaagcgccgggtagggaagtcagccgacttgaaacttttcctcttaaagaaaaaaaaaaaaaagttgtgcgcggctcacagtggggtttttttttttccgccttcttttctcgtctcccctcccccttcttccttttgaaagtttcttctcctccccctgccccccctccccgcctgaccgcatggctgattcaactccagtgtcaatcaacttctttttcctcctcttcctcatttaaataagtttaaagctcctcctccccccggcccaccaaatctgaactttataaattgggctttgcgcgccccagcccggagtcagaaaggcgaggggcgccgggaactggcgtgtgggactccagacaggagaggctgcgccttccccgcaccgggaccttcgcgacacaccagatcctcgcccctggctcgcgcgaacgcacaggatgaccaccaccctcgtgtctgccaccatcttcgacttgagcgaagttttatgcaagggtaacaagatgctcaactatagtctccaagttccaccagaaccagctcctcagcagcctcaagggtgagccagcccccgctctgagctcgcgagacagccgcttccgagaccgctccttctcggaagggggcgagcggctgctgcccacccagaagcagcccgggggcggccaggtcaactccagccgctacaagacggagctgtgccgcccctttgaggaaaacggtgcctgtaagtacggggacaagtgccagttcgcacacggcatccacgagctccgcagcctgacccgccaccccaagtacaagacggagctgtgccgcaccttccacaccatcggcttttgcccctacgggccccgctgccacttcatccacaacgctgaagagcgccgtgccctggccggggcccgggacctctccgctgaccgtccccgcctccagcatagctttagctttgctgggtttcccagtgccgctgccaccgccgctgccaccgggctgctggacagccccacgtccatcaccccaccccctattctgagcgccgatgacctcctgggctcacctaccctgcccgatggcaccaataacccttttgccttctccagccaggagctggcaagcctctttgcccctagcatggggctgcccgggggtggctccccgaccaccttcctcttccggcccatgtccgagtcccctcacatgtttgactctccccccagccctcaggattctctctcggaccaggagggctacctgagcagctccagcagcagccacagtggctcagactccccgaccttggacaactcaagacgcctgcccatcttcagcagactttccatctcagatgactaagccagggtagggagggacctcctgcctactccagcccctaccctgcacccacatcccataccctcttctccctacccatcccattccccacaggccctacattaacaaggttaagctcaacccctttcccccagcacctcagaatgtgccctccctctccccctcataaccccacctaacataaggacaagtcaatttgtcagtagcttcttctggcttgaaaccccctccctggattttatagcccacttaccatgcataacagacaagtcccatattttgtcagtagatgcctttttttttccggcttaagccttaagtgccaaatcacaagagaaaaagcagtaacagtttacagaagcaacttagtgccttgtaatctaactttgtcactgtgactacattacctcttcagcgccagagggcacccgtgggcctcccggagcctctgcccatggcggggtggagacccggaaccagcagccccctccactggcgacacaactgcaccttccctcatttcagtctcccgcacacttattcctcctcccctcttcccggtggcacctctccacctgtacccgcccccgccccaccaccccggccccttggaagagttgttgccagaccagggttttgggggaaacctgtcttgacattcaaaacctttttcttcccgatctgaacccctgttgactaatcttgcctgggtttgtgtaggtctgcaggaaggaaggctgaaaaagcggacgaagattttgacttaagtgggactttgtgatttaattttttcttttttttaagtggggaggaaggggaagctagatggactaggagagacttgattttggtgctaaagttccccagttcatatgtgacatctttttaaaaaaaataacaacaaaaaaaaaatgagagaaaagctaaaaaaaaaaaagtaaggggtgagcagttaatggtattcattccacatacaatatctgtgtaaaacgatttcctgtagaagtagctttaatggtttttgctctagaataccgtaggtctatccttagagcactcacgccatgctttcttccctgggttttaaacttcatataactttcagaaattggagagcaaaaattttgcttgtcactgcacatcaatataaaaaagcttatttaacttatcaaaacgtatttattgccaaactatgcttttttttgttaattttgttcatatttatcgggatgacaaatccatagaatatattcttttatgttaaattatgatcttcatattaatcttaaaattttgtgacgtgtctttttcctttttttccacagttttaatatattattcttcaacgacattttttgtaactttacacttttttggttattttattttaaaaaaatgaaaaattaatttaaaaaaatgcaaaaaactgttggattatttattttagaaattcccccctttgtgttggactgcaaattgagtttctttctctttaggcctttcacaactaggactgagaatgtatgtaaaagttctgtgacagtacagaaggaaaacaactttttatgtatagcttctaaaaggggaaaaaaaaaaaaaagagaaaccctttgacttccacgtgcccatctcaagacattccactcacagatttgaggttctggattccaggtctggagttttccaatgttaatgtaaacagaactggcacacacacattaagatgaatgtaattattattcctcttgctggtcactaccgtcgctttctatttctctttctttgtgtgaatttatttaaaagaaaaaaaaactttttgtaacgactatttgcagtttaaaaatcaataaaccccgttttttcaagaa

SEQ ID NO: 445653 - DNA, 4496 bp, Homo sapiens
gtgtgttgggggtggtgagaatgcgctctcttcggcccgccccgtcctttccaaagaaacgtgctcataatggggtgacctaattacatcgcaatggaactcaatcttagccactccgcagcaccgggtttcataacagactcggcggcctcgagtgctgggaagaaacgtgcgagggccgaggggggcggcggagcccgcgtggaaatcggaaagaagcgcagccctgcgacttccgcctgggtcatcacgccagcagtcgggccaaggcgcagggggcgggtgggggacacgttaactttttatttgggtgggcggcatccaaacctaacagtatatattttatcattttcaagggagtcatgctccattgcgggcccttcggtttcgtggctcccatgtccccctctccacctcccgccaaaacggcgcagcgtgacaagccatatgttccactccggtgggggcgagagagaagcaacaataagttaaaagtgccgcctccctccacctctttaccttcattcttaccaaagtaaccttttttcattgttctagagtcttgaggtgtgtgtggggaggatggaggaggagggagggttgtggcgccgcccagaattcggagcgcgcgtggaaagtagtgagttgctcggtgggctttttctgggaggaaggggcattcaggaaggattagggttttcttgactaaaaagtttaaagattggatgcgtgaaaagaaacggcacgcctaggcctggtaaaacaaacaatcgtcccgggttgtggtctttttttgcggcgccccccacccgcccacacccggagagcgccggctgcaaagcgagcgcgagtgtcgacgcgtgcgacgcactaaattgtgccgcgctcgcgcccgccagaccatgtcctcctggggaaaaagtttccctagtccccccagcaccgcgccccaccctacgccccgctggaaaaaaaacagcaacataaaatcctaggcttgaacattctgtgcgtcccaaatttctaatgtcctcggcctgcccggtttgccgaagggagccgagtgtcgaagagaagtcgggaaaaggtaagttgtgcagacacttggggaagtttcaaggagaccgccagctcaagatggaaaccgcggcccgggcgctaaggacgggcttcagctcccgctggcaaaaagagaaagtcgagcccgccttcctgcccaacaaaaaacaacaacatgacaacaagaaccccggagggagtggaatgagtgacgtcacagccgcgctctgaggctgacaaaggagggggcgcgcccctcccgctctgcgcccgcgcggccccggagagggggcgcctgaagcgccgggtagggaagtcagccgacttgaaacttttcctcttaaagaaaaaaaaaaaaaagttgtgcgcggctcacagtggggtttttttttttccgccttcttttctcgtctcccctcccccttcttccttttgaaagtttcttctcctccccctgccccccctccccgcctgaccgcatggctgattcaactccagtgtcaatcaacttctttttcctcctcttcctcatttaaataagtttaaagctcctcctccccccggcccaccaaatctgaactttataaattgggctttgcgcgccccagcccggagtcagaaaggcgaggggcgccgggaactggcgtgtgggactccagacaggagaggctgcgccttccccgcaccgggaccttcgcgacacaccagatcctcgcccctggctcgcgcgaacgcacaggatgaccaccaccctcgtgtctgccaccatcttcgacttgagcgaagttttatgcaagggtaacaagatgctcaactatagtgctcccagtgcagggggttgcctgctggacagaaaggcagtgggcacccctgctggtgggggcttccctcggaggcactcagtcaccctgcccagctccaagttccaccagaaccagctcctcagcagcctcaagggtgagccagcccccgctctgagctcgcgagacagccgcttccgagaccgctccttctcggaagggggcgagcggctgctgcccacccagaagcagcccgggggcggccaggtcaactccagccgctacaagacggagctgtgccgcccctttgaggaaaacggtgcctgtaagtacggggacaagtgccagttcgcacacggcatccacgagctccgcagcctgacccgccaccccaagtacaagacggagctgtgccgcaccttccacaccatcggcttttgcccctacgggccccgctgccacttcatccacaacgctgaagagcgccgtgccctggccggggcccgggacctctccgctgaccgtccccgcctccagcatagctttagctttgctgggtttcccagtgccgctgccaccgccgctgccaccgggctgctggacagccccacgtccatcaccccaccccctattctgagcgccgatgacctcctgggctcacctaccctgcccgatggcaccaataacccttttgccttctccagccaggagctggcaagcctctttgcccctagcatggggctgcccgggggtggctccccgaccaccttcctcttccggcccatgtccgagtcccctcacatgtttgactctccccccagccctcaggattctctctcggaccaggagggctacctgagcagctccagcagcagccacagtggctcagactccccgaccttggacaactcaagacgcctgcccatcttcagcagactttccatctcagatgactaagccagggtagggagggacctcctgcctactccagcccctaccctgcacccacatcccataccctcttctccctacccatcccattccccacaggccctacattaacaaggttaagctcaacccctttcccccagcacctcagaatgtgccctccctctccccctcataaccccacctaacataaggacaagtcaatttgtcagtagcttcttctggcttgaaaccccctccctggattttatagcccacttaccatgcataacagacaagtcccatattttgtcagtagatgcctttttttttccggcttaagccttaagtgccaaatcacaagagaaaaagcagtaacagtttacagaagcaacttagtgccttgtaatctaactttgtcactgtgactacattacctcttcagcgccagagggcacccgtgggcctcccggagcctctgcccatggcggggtggagacccggaaccagcagccccctccactggcgacacaactgcaccttccctcatttcagtctcccgcacacttattcctcctcccctcttcccggtggcacctctccacctgtacccgcccccgccccaccaccccggccccttggaagagttgttgccagaccagggttttgggggaaacctgtcttgacattcaaaacctttttcttcccgatctgaacccctgttgactaatcttgcctgggtttgtgtaggtctgcaggaaggaaggctgaaaaagcggacgaagattttgacttaagtgggactttgtgatttaattttttcttttttttaagtggggaggaaggggaagctagatggactaggagagacttgattttggtgctaaagttccccagttcatatgtgacatctttttaaaaaaaataacaacaaaaaaaaaatgagagaaaagctaaaaaaaaaaaagtaaggggtgagcagttaatggtattcattccacatacaatatctgtgtaaaacgatttcctgtagaagtagctttaatggtttttgctctagaataccgtaggtctatccttagagcactcacgccatgctttcttccctgggttttaaacttcatataactttcagaaattggagagcaaaaattttgcttgtcactgcacatcaatataaaaaagcttatttaacttatcaaaacgtatttattgccaaactatgcttttttttgttaattttgttcatatttatcgggatgacaaatccatagaatatattcttttatgttaaattatgatcttcatattaatcttaaaattttgtgacgtgtctttttcctttttttccacagttttaatatattattcttcaacgacattttttgtaactttacacttttttggttattttattttaaaaaaatgaaaaattaatttaaaaaaatgcaaaaaactgttggattatttattttagacattccactcacagatttgaggttctggattccaggtctggagttttccaatgttaatgtaaacagaactggcacacacacattaagatgaatgtaattattattcctcttgctggtcactaccgtcgctttctatttctctttctttgtgtgaatttatttaaaagaaaaaaaaactttttgtaacgactatttgcagtttaaaaatcaataaaccccgttttttcaagaa

SEQ ID NO: 445654 - DNA, 2490 bp, Homo sapiens
cggtacgagccctggtattccccccgccacctcacacacccccatccgggagacccacgtgcagctgggcccgggctggcgccgcacctcggggtctgcgcgtctccccggcgcgttccgggcgcagccccacgacacggacccctggcggggcggcatccgagaagtcgcaggcggagagggggcgtcctggaggccgggcgcggggacgctgcggcccgcggccacacaaaggaggcggcgggaaggcggggcaaggcgggccgggggcgggggcggcaggaaggggcgggggcccgcgcggcgccgccgataaagcccccgccgccgcggcagccagcttgcgctgtggggctgcccgggctgcgcggcgtctgcaggcgccaccgctgcctctttccggctgtgaccctcctcgccgccgccgcttcgctgcgtcctccgactccccgcgccgccgagaccaggctcccgctccggttgcggccgcaccgccctccgcggccgccccctggggatccagcgagcgcggtcgtccttggtggaaggaaccatgaactggcatctccccctcttcctcttggcctctgtgacgctgccttccatctgctcccacttcaatcctctgtctctcgaggaactaggctccaacacggggatccaggttttcaatcagattgtgaagtcgaggcctcatgacaacatcgtgatctctccccatgggattgcgtcggtcctggggatgcttcagctgggggcggacggcaggaccaagaagcagctcgccatggtgatgagatacggcgtaaatggagttggtaaaatattaaagaagatcaacaaggccatcgtctccaagaagaataaagacattgtgacagtggctaacgccgtgtttgttaagaatgcctctgaaattgaagtgccttttgttacaaggaacaaagatgtgttccagtgtgaggtccggaatgtgaactttgaggatccagcctctgcctgtgattccatcaatgcatgggttaaaaatgaaaccagggatatgattgacaatctgctgtccccagatcttattgatggtgtgctcaccagactggtcctcgtcaacgcagtgtatttcaagggtctgtggaaatcacggttccaacccgagaacacaaagaaacgcactttcgtggcagccgacgggaaatcctatcaagtgccaatgctggcccagctctccgtgttccggtgtgggtcgacaagtgcccccaatgatttatggtacaacttcattgaactgccctaccacggggaaagcatcagcatgctgattgcactgccgactgagagctccactccgctgtctgccatcatcccacacatcagcaccaagaccatagacagctggatgagcatcatggtgcccaagagggtgcaggtgatcctgcccaagttcacagctgtagcacaaacagatttgaaggagccgctgaaagttcttggcattactgacatgtttgattcatcaaaggcaaattttgcaaaaataacaaggtcagaaaacctccatgtttctcatatcttgcaaaaagcaaaaattgaagtcagtgaagatggaaccaaagcttcagcagcaacaactgcaattctcattgcaagatcatcgcctccctggtttatagtagacagaccttttctgtttttcatccgacataatcctacaggtgctgtgttattcatggggcagataaacaaaccctgaagagtatacaaaagaaaccatgcaaagcaacgactactttgctacgaagaaagactcctttcctgcatctttcatagttctgttaaatatttttgtacatcgcttctttttcaaaactagttcttaggaacagactcgatgcaagtgtttctgttctgggaggtattggagggaaaaaacaagcaggatggctggaacactgtactgaggaatgaatagaaaggcttccagatgtctaaaagattctttaaactactgaactgttacctaggttaacaaccctgttgagtatttgctgtttgtccagttcaggaatttttgttttgttttgtctatatgtgcggcttttcagaagaaatttaatcagtgtgacagaaaaaaaaatgttttatggtagcttttactttttatgaaaaaaaaattatttgccttttaaattcttttcccccatccccctccaaagtcttgatagcaagcgttattttgggggtagaaacggtgaaatctctagcctctttgtgtttttgttgttgttgttgttgttgttttatataatgcatgtattcactaaaataaaatttaaaaaactcctgtcttgctagacaaggttgctgttgtgcagtgtgcctgtcactactggtctgtactccttggatttgcatttttgtattttgtacaaagtaaaaataaactgttatgagtagtaaaaataaagctatttctctgctatttgaaaataaata

SEQ ID NO: 445655 - DNA, 432 bp, Homo sapiens
gtcattaaaaacagaaagcaaaaacaaagaaaatgttcgccttgaattctttgtaatcatttcatgattaaagaattaaaataatggttctataattagtttctatgcctgaatgataaaacctttctaatatgaagaagaacatgataatcattttattgtgtcatcaaaacccatcaggttttgtaatttaatttccattgctttgtgtttttgttgttgttgttgttgttgttttatataatgcatgtattcactaaaataaaatttaaaaaactcctgtcttgctagacaaggttgctgttgtgcagtgtgcctgtcactactggtctgtactccttggatttgcatttttgtattttgtacaaagtaaaaataaactgttatgagtagtaaaaataaagctatttctctgctatttgaaaataaata

SEQ ID NO: 445656 - DNA, 2169 bp, Homo sapiens
cagtgctcggttgaattctgcgtggctgcgtgtcgtcgtatgcatgtgcccttctgcaggcgccaccgctgcctctttccggctgtgaccctcctcgccgccgccgcttcgctgcgtcctccgactccccgcgccgccgagaccaggctcccgctccggttgcggccgcaccgccctccgcggccgccccctggggatccagcgagcgcggtcgtccttggtggaaggaaccatgaactggcatctccccctcttcctcttggcctctgtgacgctgccttccatctgctcccacttcaatcctctgtctctcgaggaactaggctccaacacggggatccaggttttcaatcagattgtgaagtcgaggcctcatgacaacatcgtgatctctccccatgggattgcgtcggtcctggggatgcttcagctgggggcggacggcaggaccaagaagcagctcgccatggtgatgagatacggcgtaaatggagttggtaaaatattaaagaagatcaacaaggccatcgtctccaagaagaataaagacattgtgacagtggctaacgccgtgtttgttaagaatgcctctgaaattgaagtgccttttgttacaaggaacaaagatgtgttccagtgtgaggtccggaatgtgaactttgaggatccagcctctgcctgtgattccatcaatgcatgggttaaaaatgaaaccagggatatgattgacaatctgctgtccccagatcttattgatggtgtgctcaccagactggtcctcgtcaacgcagtgtatttcaagggtctgtggaaatcacggttccaacccgagaacacaaagaaacgcactttcgtggcagccgacgggaaatcctatcaagtgccaatgctggcccagctctccgtgttccggtgtgggtcgacaagtgcccccaatgatttatggtacaacttcattgaactgccctaccacggggaaagcatcagcatgctgattgcactgccgactgagagctccactccgctgtctgccatcatcccacacatcagcaccaagaccatagacagctggatgagcatcatggtgcccaagagggtgcaggtgatcctgcccaagttcacagctgtagcacaaacagatttgaaggagccgctgaaagttcttggcattactgacatgtttgattcatcaaaggcaaattttgcaaaaataacaaggtcagaaaacctccatgtttctcatatcttgcaaaaagcaaaaattgaagtcagtgaagatggaaccaaagcttcagcagcaacaactgcaattctcattgcaagatcatcgcctccctggtttatagtagacagaccttttctgtttttcatccgacataatcctacaggtgctgtgttattcatggggcagataaacaaaccctgaagagtatacaaaagaaaccatgcaaagcaacgactactttgctacgaagaaagactcctttcctgcatctttcatagttctgttaaatatttttgtacatcgcttctttttcaaaactagttcttaggaacagactcgatgcaagtgtttctgttctgggaggtattggagggaaaaaacaagcaggatggctggaacactgtactgaggaatgaatagaaaggcttccagatgtctaaaagattctttaaactactgaactgttacctaggttaacaaccctgttgagtatttgctgtttgtccagttcaggaatttttgttttgttttgtctatatgtgcggcttttcagaagaaatttaatcagtgtgacagaaaaaaaaatgttttatggtagcttttactttttatgaaaaaaaaattatttgccttttaaattcttttcccccatccccctccaaagtcttgatagcaagcgttattttgggggtagaaacggtgaaatctctagcctctttgtgtttttgttgttgttgttgttgttgttttatataatgcatgtattcactaaaataaaatttaaaaaactcctgtcttgctagacaaggttgctgttgtgcagtgtgcctgtcactactggtctgtactccttggatttgcatttttgtattttgtacaaagtaaaaataaactgttatgagtagtaaaaataaagctatttctctgctatttgaaaataaata

SEQ ID NO: 445657 - DNA, 2436 bp, Homo sapiens
cggtacgagccctggtattccccccgccacctcacacacccccatccgggagacccacgtgcagctgggcccgggctggcgccgcacctcggggtctgcgcgtctccccggcgcgttccgggcgcagccccacgacacggacccctggcggggcggcatccgagaagtcgcaggcggagagggggcgtcctggaggccgggcgcggggacgctgcggcccgcggccacacaaaggaggcggcgggaaggcggggcaaggcgggccgggggcgggggcggcaggaaggggcgggggcccgcgcggcgccgccgataaagcccccgccgccgcggcagccagcttgcgctgtggggctgcccgggctgcgcggcgtctgcaggcgccaccgctgcctctttccggctgtgaccctcctcgccgccgccgcttcgctgcgtcctccgactccccgcgccgccgagaccaggctcccgctccggttgcggccgcaccgccctccgcggccgccccctggggatccagcgagcgcggtcgtccttggtggaaggaaccatgaactggcatctccccctcttcctcttggcctctgtgacgctgccttccatctgctcccacttcaatcctctgtctctcgaggaactaggctccaacacggggatccaggttttcaatcagattgtgaagtcgaggcctcatgacaacatcgtgatctctccccatgggattgcgtcggtcctggggatgcttcagctgggggcggacggcaggaccaagaagcagctcgccatggtgatgagatacggcgtaaatggagttggtaaaatattaaagaagatcaacaaggccatcgtctccaagaagaataaagacattgtgacagtggctaacgccgtgtttgttaagaatgcctctgaaattgaagtgccttttgttacaaggaacaaagatgtgttccagtgtgaggtccggaatgtgaactttgaggatccagcctctgcctgtgattccatcaatgcatgggttaaaaatgaaaccagggatatgattgacaatctgctgtccccagatcttattgatggtgtgctcaccagactggtcctcgtcaacgcagtgtatttcaagggtctgtggaaatcacggttccaacccgagaacacaaagaaacgcactttcgtggcagccgacgggaaatcctatcaagtgccaatgctggcccagctctccgtgttccggtgtgggtcgacaagtgcccccaatgatttatggtacaacttcattgaactgccctaccacggggaaagcatcagcatgctgattgcactgccgactgagagctccactccgctgtctgccatcatcccacacatcagcaccaagaccatagacagctggatgagcatcatggtgcccaagagggtgcaggtgatcctgcccaagttcacagctgtagcacaaacagatttgaaggagccgctgaaagttcttggcattactgacatgtttgattcatcaaaggcaaattttgcaaaaataacaaggtcagaaaacctccatgtttctcatatcttgcaaaaagcaaaaattgaagtcagtgaagatggaaccaaagcttcagcagcaacaactgcaattctcattgcaagatcatcgcctccctggtttatagtagacagaccttttctgtttttcatccgacataatcctacaggtgctgtgttattcatggggcagataaacaaaccctgaagagtatactgcatctttcatagttctgttaaatatttttgtacatcgcttctttttcaaaactagttcttaggaacagactcgatgcaagtgtttctgttctgggaggtattggagggaaaaaacaagcaggatggctggaacactgtactgaggaatgaatagaaaggcttccagatgtctaaaagattctttaaactactgaactgttacctaggttaacaaccctgttgagtatttgctgtttgtccagttcaggaatttttgttttgttttgtctatatgtgcggcttttcagaagaaatttaatcagtgtgacagaaaaaaaaatgttttatggtagcttttactttttatgaaaaaaaaattatttgccttttaaattcttttcccccatccccctccaaagtcttgatagcaagcgttattttgggggtagaaacggtgaaatctctagcctctttgtgtttttgttgttgttgttgttgttgttttatataatgcatgtattcactaaaataaaatttaaaaaactcctgtcttgctagacaaggttgctgttgtgcagtgtgcctgtcactactggtctgtactccttggatttgcatttttgtattttgtacaaagtaaaaataaactgttatgagtagtaaaaataaagctatttctctgctatttgaaaataaata

SEQ ID NO: 445658 - DNA, 2727 bp, Homo sapiens
cggtacgagccctggtattccccccgccacctcacacacccccatccgggagacccacgtgcagctgggcccgggctggcgccgcacctcggggtctgcgcgtctccccggcgcgttccgggcgcagccccacgacacggacccctggcggggcggcatccgagaagtcgcaggcggagagggggcgtcctggaggccgggcgcggggacgctgcggcccgcggccacacaaaggaggcggcgggaaggcggggcaaggcgggccgggggcgggggcggcaggaaggggcgggggcccgcgcggcgccgccgataaagcccccgccgccgcggcagccagcttgcgctgtggggctgcccgggctgcgcggcgtctgcaggcgccaccgctgcctctttccggctgtgaccctcctcgccgccgccgcttcgctgcgtcctccgactccccgcgccgccgagaccaggctcccgctccggttgcggccgcaccgccctccgcggccgccccctggggatccagcgagcgcggtcgtccttggtggaaggaaccatgaactggcatctccccctcttcctcttggcctctgtgacgctgccttccatctgctcccacttcaatcctctgtctctcgaggaactaggctccaacacggggatccaggttttcaatcagattgtgaagtcgaggcctcatgacaacatcgtgatctctccccatgggattgcgtcggtcctggggatgcttcagctgggggcggacggcaggaccaagaagcagctcgccatggtgatgagatacggcgtaaatggagttggtaaaatattaaagaagatcaacaaggccatcgtctccaagaagaataaagacattgtgacagtggctaacgccgtgtttgttaagaatgcctctgaaattgaagtgccttttgttacaaggaacaaagatgtgttccagtgtgaggtccggaatgtgaactttgaggatccagcctctgcctgtgattccatcaatgcatgggttaaaaatgaaaccagggatatgattgacaatctgctgtccccagatcttattgatggtgtgctcaccagactggtcctcgtcaacgcagtgtatttcaagggtctgtggaaatcacggttccaacccgagaacacaaagaaacgcactttcgtggcagccgacgggaaatcctatcaagtgccaatgctggcccagctctccgtgttccggtgtgggtcgacaagtgcccccaatgatttatggtacaacttcattgaactgccctaccacggggaaagcatcagcatgctgattgcactgccgactgagagctccactccgctgtctgccatcatcccacacatcagcaccaagaccatagacagctggatgagcatcatggtgcccaagagggtgcaggtgatcctgcccaagttcacagctgtagcacaaacagatttgaaggagccgctgaaagttcttggcattactgacatgtttgattcatcaaaggcaaattttgcaaaaataacaaggtcagaaaacctccatgtttctcatatcttgcaaaaagcaaaaattgaagtcagtgaagatggaaccaaagcttcagcagcaacaactgcaattctcattgcaagatcatcgcctccctggtttatagtagacagaccttttctgtttttcatccgacataatcctacaggtgctgtgttattcatggggcagataaacaaaccctgaagagtatacaaaagaaaccatgcaaagcaacgactactttgctacgaagaaagactcctttcctgcatctttcatagttctgttaaatatttttgtacatcgcttctttttcaaaactagttcttaggaacagactcgatgcaagtgtttctgttctgggaggtattggagggaaaaaacaagcaggatggctggaacactgtactgaggaatgaatagaaaggcttccagatgtctaaaagattctttaaactactgaactgttacctaggttaacaaccctgttgagtatttgctgtttgtccagttcaggaatttttgttttgttttgtctatatgtgcggcttttcagaagaaatttaatcagtgtgacagaaaaaaaaatgttttatggtagcttttactttttatgaaaaaaaaattatttgccttttaaattcttttcccccatccccctccaaagtcttgatagcaagcgttattttgggggtagaaacggtgaaatctctagcctctttgtgtttttgttgttgttgttgttgttgttttatataatgcatgtattcactaaaataaaatttaaaaaactcctgtcttgctagacaaggttgctgttgtgcagtgtgcctgtcactactggtctgtactccttggatttgcatttttgtcggtcaagcttaaacataaccggtcatggagttgcttacacaaacaacaaccaacacagcaactaacatacttcatatcacaacacagcccagaacgagacgaagcaagagccaaactatgagctcatcactagaccgacgaaacaaacccaaaacggagaggcgcgtatacaatcatgatacaaaccaacaccgctccatatgagacacacacggactaacaggacgcaggcagagaggaagacacatgagtatcaactgggcgaacacccacacaccgacatatagtttcttctctttattctcacaatg

SEQ ID NO: 445659 - DNA, 2209 bp, Homo sapiens
cggtacgagccctggtattccccccgccacctcacacacccccatccgggagacccacgtgcagctgggcccgggctggcgccgcacctcggggtctgcgcgtctccccggcgcgttccgggcgcagccccacgacacggacccctggcggggcggcatccgagaagtcgcaggcggagagggggcgtcctggaggccgggcgcggggacgctgcggcccgcggccacacaaaggaggcggcgggaaggcggggcaaggcgggccgggggcgggggcggcaggaaggggcgggggcccgcgcggcgccgccgataaagcccccgccgccgcggcagccagcttgcgctgtggggctgcccgggctgcgcggcgtctgcaggcgccaccgctgcctctttccggctgtgaccctcctcgccgccgccgcttcgctgcgtcctccgactccccgcgccgccgagaccaggctcccgctccggttgcggccgcaccgccctccgcggccgccccctggggatccagcgagcgcggagttggtaaaatattaaagaagatcaacaaggccatcgtctccaagaagaataaagacattgtgacagtggctaacgccgtgtttgttaagaatgcctctgaaattgaagtgccttttgttacaaggaacaaagatgtgttccagtgtgaggtccggaatgtgaactttgaggatccagcctctgcctgtgattccatcaatgcatgggttaaaaatgaaaccagggatatgattgacaatctgctgtccccagatcttattgatggtgtgctcaccagactggtcctcgtcaacgcagtgtatttcaagggtctgtggaaatcacggttccaacccgagaacacaaagaaacgcactttcgtggcagccgacgggaaatcctatcaagtgccaatgctggcccagctctccgtgttccggtgtgggtcgacaagtgcccccaatgatttatggtacaacttcattgaactgccctaccacggggaaagcatcagcatgctgattgcactgccgactgagagctccactccgctgtctgccatcatcccacacatcagcaccaagaccatagacagctggatgagcatcatggtgcccaagagggtgcaggtgatcctgcccaagttcacagctgtagcacaaacagatttgaaggagccgctgaaagttcttggcattactgacatgtttgattcatcaaaggcaaattttgcaaaaataacaaggtcagaaaacctccatgtttctcatatcttgcaaaaagcaaaaattgaagtcagtgaagatggaaccaaagcttcagcagcaacaactgcaattctcattgcaagatcatcgcctccctggtttatagtagacagaccttttctgtttttcatccgacataatcctacaggtgctgtgttattcatggggcagataaacaaaccctgaagagtatacaaaagaaaccatgcaaagcaacgactactttgctacgaagaaagactcctttcctgcatctttcatagttctgttaaatatttttgtacatcgcttctttttcaaaactagttcttaggaacagactcgatgcaagtgtttctgttctgggaggtattggagggaaaaaacaagcaggatggctggaacactgtactgaggaatgaatagaaaggcttccagatgtctaaaagattctttaaactactgaactgttacctaggttaacaaccctgttgagtatttgctgtttgtccagttcaggaatttttgttttgttttgtctatatgtgcggcttttcagaagaaatttaatcagtgtgacagaaaaaaaaatgttttatggtagcttttactttttatgaaaaaaaaattatttgccttttaaattcttttcccccatccccctccaaagtcttgatagcaagcgttattttgggggtagaaacggtgaaatctctagcctctttgtgtttttgttgttgttgttgttgttgttttatataatgcatgtattcactaaaataaaatttaaaaaactcctgtcttgctagacaaggttgctgttgtgcagtgtgcctgtcactactggtctgtactccttggatttgcatttttgtattttgtacaaagtaaaaataaactgttatgagtagtaaaaataaagctatttctctgctatttgaaaataaata

SEQ ID NO: 445660 - DNA, 1087 bp, Homo sapiens
gtgtagaagacatgagagagtaatgtaaagggcctggcccaaggtaggcttagtaaatggtgaccattgagcctgttgtaacatggccagcctatggaacaagcatgaagtgtgtcttcagacaccagcctctgagggtccatgaagctagctaacttgctggccttatgcttacatggtctcatgtaatgtgcacaacacattttccttttcttcccgtagctgcaattctcattgcaagatcatcgcctccctggtttatagtagacagaccttttctgtttttcatccgacataatcctacaggtgctgtgttattcatggggcagataaacaaaccctgaagagtatacaaaagaaaccatgcaaagcaacgactactttgctacgaagaaagactcctttcctgcatctttcatagttctgttaaatatttttgtacatcgcttctttttcaaaactagttcttaggaacagactcgatgcaagtgtttctgttctgggaggtattggagggaaaaaacaagcaggatggctggaacactgtactgaggaatgaatagaaaggcttccagatgtctaaaagattctttaaactactgaactgttacctaggttaacaaccctgttgagtatttgctgtttgtccagttcaggaatttttgttttgttttgtctatatgtgcggcttttcagaagaaatttaatcagtgtgacagaaaaaaaaatgttttatggtagcttttactttttatgaaaaaaaaattatttgccttttaaattcttttcccccatccccctccaaagtcttgatagcaagcgttattttgggggtagaaacggtgaaatctctagcctctttgtgtttttgttgttgttgttgttgttgttttatataatgcatgtattcactaaaataaaatttaaaaaactcctgtcttgctagacaaggttgctgttgtgcagtgtgcctgtcactactggtctgtactccttggatttgcatttttgtattttgtacaaagtaaaaataaactgttatgagtagtaaaaataaagctatttctctgctatttgaaaataaata

SEQ ID NO: 445661 - DNA, 1100 bp, Homo sapiens
  misc_feature (937)..(937): n is a, c, g, or t
  misc_feature (966)..(966): n is a, c, g, or t
  misc_feature (1018)..(1018): n is a, c, g, or t
  misc_feature (1028)..(1028): n is a, c, g, or t
  misc_feature (1071)..(1071): n is a, c, g, or t
cggtacgagccctggtattccccccgccacctcacacacccccatccgggagacccacgtgcagctgggcccgggctggcgccgcacctcggggtctgcgcgtctccccggcgcgttccgggcgcagccccacgacacggacccctggcggggcggcatccgagaagtcgcaggcggagagggggcgtcctggaggccgggcgcggggacgctgcggcccgcggccacacaaaggaggcggcgggaaggcggggcaaggcgggccgggggcgggggcggcaggaaggggcgggggcccgcgcggcgccgccgataaagcccccgccgccgcggcagccagcttgcgctgtggggctgcccgggctgcgcggcgtctgcaggcgccaccgctgcctctttccggctgtgaccctcctcgccgccgccgcttcgctgcgtcctccgactccccgcgccgccgagaccaggctcccgctccggttgcggccgcaccgccctccgcggccgccccctggggatccagcgagcgcggtcgtccttggtggaaggaaccatgaactggcatctccccctcttcctcttggcctctgtgacgctgccttccatctgctcccacttcaatcctctgtctctcgaggaactaggctccaacacggggatccaggttttcaatcagattgtgaagtcgaggcctcatgacaacatcgtgatctctccccatgggattgcgtcggtcctggggatgcttcagctgggggcggacggcaggaccaagaagcagctcgccatggtgatgagatacggcgtaaatggagttggtaaaatattaaagaagatcaacaaggccatcgtctccaagaagaataaagacattgtgacagtggctaacgccgtgtttgttaagaatgcctctgaaattgaagtgccttttgttacntatggtaatacatattttaaatctaaaanatcacaatgtgtactgaatggttgtgaaaatatattgatatatatctagttntatgaaatancatggatataggatttaggtgatcttattcttagtccaaagtngtgtgatgaatactttaataaaggttgct

SEQ ID NO: 445662 - DNA, 408 bp, Homo sapiens
cgttgattttcaagcttagagaatggctagacttttcattagttttagaagtttcaatagcacttttactttttatgaaaaaaaaattatttgccttttaaattcttttcccccatccccctccaaagtcttgatagcaagcgttattttgggggtagaaacggtgaaatctctagcctctttgtgtttttgttgttgttgttgttgttgttttatataatgcatgtattcactaaaataaaatttaaaaaactcctgtcttgctagacaaggttgctgttgtgcagtgtgcctgtcactactggtctgtactccttggatttgcatttttgtattttgtacaaagtaaaaataaactgttatgagtagtaaaaataaagctatttctctgctatttgaaaataaata

SEQ ID NO: 445663 - DNA, 519 bp, Homo sapiens
gtcggtctagaggatcccatgcgcgacgcttccatcaatgcatgggttaaaaatgaaaccaggatatgattgacaatctgctgtccccagatcttattgatggtgtgctcaccagactggtcctcgtcaacgcagtgtatttcaagggtctgtggaaatcacggttccaacccgagaacacaaagaaacgcactttcgtggcagccgacgggaaatcctatcaagtgccaatgctggcccagctctccgtgttccggtgtgggtcgacaagtgcccccaatgatttatggtacaacttcattgaactgccctaccacggggaaagcatcagcatgctgattgcactgccgactgagagctccactccgctgtctgccatcatcccacacatcagcaccaagaccatagacagctggatgagcatcatggtgcccaagagggtgcaggtgatcctgcccaagttcacagctgtagcacaaacagatttgatggaagcgtcgcgcatgggtaccgagctcg

SEQ ID NO: 445664 - DNA, 2604 bp, Homo sapiens
atggtcaatccttggttaggaggaaagggagtggagaggaccgtgctgcctggcgttccccagctgcctttctttctgttttccccccaacggaatctctatgtggtctcctagagcctcgtgcctgcctctcagctagatgctgatatcattcccactcatgtagttgggaaggaagggtgtggcagagataaagggtccacggtcacgcagtatgtggggggtcacacagcctgtatgccaaagtggcacaccctgtgaatatgtagggtcgcacagcctttatgtgtcagtgccagagcctggacccgggtctgtagatgtgtgaaccgtgagctgataccatggatattcaaagatttacatcccatcaatgtttataccttcttgagaagaaatttgtgtcaaagcacactcctcctttcaagactacctcctcgccgtgctgcgtgatagccctagtatcacaaccaaaacacatgatacagaaagaggccagtatctgtgtggcttcaggctcttgtgcgttggccatgaagcaaaggaaggctgttgcatgaaataacctccttctgactccacccttgcatttgtgagatgtaaacagcagtgttaccaagaggtcttccagggaacacgttgcaggtcgtccttggtggaaggaaccatgaactggcatctccccctcttcctcttggcctctgtgacgctgccttccatctgctcccacttcaatcctctgtctctcgaggaactaggctccaacacggggatccaggttttcaatcagattgtgaagtcgaggcctcatgacaacatcgtgatctctccccatgggattgcgtcggtcctggggatgcttcagctgggggcggacggcaggaccaagaagcagctcgccatggtgatgagatacggcgtaaatggagttggtaaaatattaaagaagatcaacaaggccatcgtctccaagaagaataaagacattgtgacagtggctaacgccgtgtttgttaagaatgcctctgaaattgaagtgccttttgttacaaggaacaaagatgtgttccagtgtgaggtccggaatgtgaactttgaggatccagcctctgcctgtgattccatcaatgcatgggttaaaaatgaaaccagggatatgattgacaatctgctgtccccagatcttattgatggtgtgctcaccagactggtcctcgtcaacgcagtgtatttcaagggtctgtggaaatcacggttccaacccgagaacacaaagaaacgcactttcgtggcagccgacgggaaatcctatcaagtgccaatgctggcccagctctccgtgttccggtgtgggtcgacaagtgcccccaatgatttatggtacaacttcattgaactgccctaccacggggaaagcatcagcatgctgattgcactgccgactgagagctccactccgctgtctgccatcatcccacacatcagcaccaagaccatagacagctggatgagcatcatggtgcccaagagggtgcaggtgatcctgcccaagttcacagctgtagcacaaacagatttgaaggagccgctgaaagttcttggcattactgacatgtttgattcatcaaaggcaaattttgcaaaaataacaaggtcagaaaacctccatgtttctcatatcttgcaaaaagcaaaaattgaagtcagtgaagatggaaccaaagcttcagcagcaacaactgcaattctcattgcaagatcatcgcctccctggtttatagtagacagaccttttctgtttttcatccgacataatcctacaggtgctgtgttattcatggggcagataaacaaaccctgaagagtatacaaaagaaaccatgcaaagcaacgactactttgctacgaagaaagactcctttcctgcatctttcatagttctgttaaatatttttgtacatcgcttctttttcaaaactagttcttaggaacagactcgatgcaagtgtttctgttctgggaggtattggagggaaaaaacaagcaggatggctggaacactgtactgaggaatgaatagaaaggcttccagatgtctaaaagattctttaaactactgaactgttacctaggttaacaaccctgttgagtatttgctgtttgtccagttcaggaatttttgttttgttttgtctatatgtgcggcttttcagaagaaatttaatcagtgtgacagaaaaaaaaatgttttatggtagcttttactttttatgaaaaaaaaattatttgccttttaaattcttttcccccatccccctccaaagtcttgatagcaagcgttattttgggggtagaaacggtgaaatctctagcctctttgtgtttttgttgttgttgttgttgttgttttatataatgcatgtattcactaaaataaaatttaaaaaactcctgtcttgctagacaaggttgctgttgtgcagtgtgcctgtcactactggtctgtactccttggatttgcatttttgtattttgtacaaagtaaaaataaactgttatgagtagtaaaaataaagctatttctctgctatttgaaaataaata

SEQ ID NO: 445665 - DNA, 1782 bp, Homo sapiens
  misc_feature (46)..(46): n is a, c, g, or t
ggcacgagcggaaagaggcagcggtggccctgcagacgccgcgcanccgggcgacggcaggaccaagaagcagctcgccatggtgatgagatacggcgtaaatggagttggtaaaatattaaagaagatcaacaaggccatcgtctccaagaagaataaagacattgtgacagtggctaacgccgtgtttgttaagaatgcctctgaaattgaagtgccttttgttacaaggaacaaagatgtgttccagtgtgaggtccggaatgtgaactttgaggatccagcctctgcctgtgattccatcaatgcatgggttaaaaatgaaaccagggatatgattgacaatctgctgtccccagatcttattgatggtgtgctcaccagactggtcctcgtcaacgcagtgtatttcaagggtctgtggaaatcacggttccaacccgagaacacaaagaaacgcactttcgtggcagccgacgggaaatcctatcaagtgccaatgctggcccagctctccgtgttccggtgtgggtcgacaagtgcccccaatgatttatggtacaacttcattgaactgccctaccacggggaaagcatcagcatgctgattgcactgccgactgagagctccactccgctgtctgccatcatcccacacatcagcaccaagaccatagacagctggatgagcatcatggtgcccaagagggtgcaggtgatcctgcccaagttcacagctgtagcacaaacagatttgaaggagccgctgaaagttcttggcattactgacatgtttgattcatcaaaggcaaattttgcaaaaataacaaggtcagaaaacctccatgtttctcatatcttgcaaaaagcaaaaattgaagtcagtgaagatggaaccaaagcttcagcagcaacaactgcaattctcattgcaagatcatcgcctccctggtttatagtagacagaccttttctgtttttcatccgacataatcctacaggtgctgtgttattcatggggcagataaacaaaccctgaagagtatacaaaagaaaccatgcaaagcaacgactactttgctacgaagaaagactcctttcctgcatctttcatagttctgttaaatatttttgtacatcgcttctttttcaaaactagttcttaggaacagactcgatgcaagtgtttctgttctgggaggtattggagggaaaaaacaagcaggatggctggaacactgtactgaggaatgaatagaaaggcttccagatgtctaaaagattctttaaactactgaactgttacctaggttaacaaccctgttgagtatttgctgtttgtccagttcaggaatttttgttttgttttgtctatatgtgcggcttttcagaagaaatttaatcagtgtgacagaaaaaaaaatgttttatggtagcttttactttttatgaaaaaaaaattatttgccttttaaattcttttcccccatccccctccaaagtcttgatagcaagcgttattttgggggtagaaacggtgaaatctctagcctctttgtgtttttgttgttgttgttgttgttgttttatataatgcatgtattcactaaaataaaatttaaaaaactcctgtcttgctagacaaggttgctgttgtgcagtgtgcctgtcactactggtctgtactccttggatttgcatttttgtattttgtacaaagtaaaaataaactgttatgagtagtaaaaataaagctatttctctgctatttgaaaataaata

SEQ ID NO: 445666 - DNA, 1080 bp, Homo sapiens
ttttctccatttctgctttcatgctaggttcacagctgtagcacaaacagatttgaaggagccgctgaaagttcttggcattactgacatgtttgattcatcaaaggcaaattttgcaaaaataacaaggtcagaaaacctccatgtttctcatatcttgcaaaaagcaaaaattgaagtcagtgaagatggaaccaaagcttcagcagcaacaactgcaattctcattgcaagatcatcgcctccctggtttatagtagacagaccttttctgtttttcatccgacataatcctacaggtgctgtgttattcatggggcagataaacaaaccctgaagagtatacaaaagaaaccatgcaaagcaacgactactttgctacgaagaaagactcctttcctgcatctttcatagttctgttaaatatttttgtacatcgcttctttttcaaaactagttcttaggaacagactcgatgcaagtgtttctgttctgggaggtattggagggaaaaaacaagcaggatggctggaacactgtactgaggaatgaatagaaaggcttccagatgtctaaaagattctttaaactactgaactgttacctaggttaacaaccctgttgagtatttgctgtttgtccagttcaggaatttttgttttgttttgtctatatgtgcggcttttcagaagaaatttaatcagtgtgacagaaaaaaaaatgttttatggtagcttttactttttatgaaaaaaaaattatttgccttttaaattcttttcccccatccccctccaaagtcttgatagcaagcgttattttgggggtagaaacggtgaaatctctagcctctttgtgtttttgttgttgttgttgttgttgttttatataatgcatgtattcactaaaataaaatttaaaaaactcctgtcttgctagacaaggttgctgttgtgcagtgtgcctgtcactactggtctgtactccttggatttgcatttttgtattttgtacaaagtaaaaataaactgttatgagtagtaaaaataaagctatttctctgctatttgaaaataaata

SEQ ID NO: 445667 - DNA, 1071 bp, Homo sapiens
cggtacgagccctggtattccccccgccacctcacacacccccatccgggagacccacgtgcagctgggcccgggctggcgccgcacctcggggtctgcgcgtctccccggcgcgttccgggcgcagccccacgacacggacccctggcggggcggcatccgagaagtcgcaggcggagagggggcgtcctggaggccgggcgcggggacgctgcggcccgcggccacacaaaggaggcggcgggaaggcggggcaaggcgggccgggggcgggggcggcaggaaggggcgggggcccgcgcggcgccgccgataaagcccccgccgccgcggcagccagcttgcgctgtggggctgcccgggctgcgcggcgtctgcaggcgccaccgctgcctctttccggctgtgaccctcctcgccgccgccgcttcgctgcgtcctccgactccccgcgccgccgagaccaggctcccgctccggttgcggccgcaccgccctccgcggccgccccctggggatccagcgagcgcggtcgtccttggtggaaggaaccatgaactggcatctccccctcttcctcttggcctctgtgacgctgccttccatctgctcccacttcaatcctctgtctctcgaggaactaggctccaacacggggatccaggttttcaatcagattgtgaagtcgaggcctcatgacaacatcgtgatctctccccatgggattgcgtcggtcctggggatgcttcagctgggggcggacggcaggaccaagaagcagctcgccatggtgatgagatacggcgtaaatggtgcgtgtgcacaattgctcactggcggagcctttgcctgagagtcttgtgacaggagggtttatggcttggtttttgctgacaaccccaagaagcagagcagccagaaggggatttgctggtgccacttggggcttggggtcagtctcttctaaagaacaaacactgtggtgctggcagttaggagaactagactctggtcccttttttgtacttttggagcttggggtctgccactaggtctcctttcccagggctc

SEQ ID NO: 445668 - DNA, 1064 bp, Homo sapiens
cccagaggatgcagatgtaccttctctcaggccgatgacctcaggcctccccggtccctggagctctaggaaaggtgagcgcgatctcgcgcccacacccagtgctctgggtcataagcctggatctggaaaaacaaacgccctttgagaagacggggactcgccaggatacccctctctcccctcatccagcctccagcccacccaattcctccccacctcctccacctccccaggccccactcacctcctccaactcctctggggaaacccaagccctgcagctcatggaacagaagaagtggaaccgtcgtttctggaacaggactatctgagagcggttcttcctggccctcgagttcatggaacggtataactggaaccgacgcttacggagcaagggtatgcgagagcggttcttcctggccctcgggttcgtggaacggtataactggaaccgacgcttacggagcaagggtatgcgagagcggttcttcctggccctcgggttcatggaatggcctaactggaaccaacgcttacggagcaagggtatgcgagagcggttcttcctatacaggaagtggaagatgtttggtttggagtcctcgtcgtcctcctccatgtcattggccaggtagctgaggacagaaatcaggttgctgctcaggggcaccaccaggagaggcctccggctgaggtcagcttcccagagaggaaggtaagggaccgtccctagctcaggactggcacccaccctgcagagagccatgccttcctcaggagggctctgctggacagagacctgatcaagggcgtctcccactccttcaggatggagacaaaaacccaactggtggccgagagtggtggcttacgcctggaatcccagcacactgggaggccaaagcaggaggatcacttgaggccaggagtttgagacgggcctgggcaacatagcaagaccctcgtctctattaaaaatgtaagaaatatgccagacgcggtggctcatgcctgtaatcccagcactttagaaggctgaagcaggtggatcgcttgag

SEQ ID NO: 445669 - DNA, 519 bp, Homo sapiens
cccagaggatgcagatgtaccttctctcaggccgatgacctcaggcctccccggtccctggagctctaggaaaggtgagcgcgatctcgcgcccacacccagtgctctgggtcataagcctggatctggaaaaacaaacgccctttgagaagacggggactcgccaggatacccctctctcccctcatccagcctccagcccacccaattcctccccacctcctccacctccccaggccccactcacctcctccaactcctctggggaaacccaagccctgcagctcatggaacagaagaagtggaaccgtcgtttctggaacaggactatctgagagcggttcttcctggccctcgagttcatggaacggtataactggaaccgacgcttacggagcaagggtatgcgagagcggttcttcctggccctcgggttcgtggaacggtataactggaaccgacggttccacttcttctgttccatgagctgcagggcttgggttcccccagaggagttgg

SEQ ID NO: 445670 - DNA, 659 bp, Homo sapiens
cccagaggatgcagatgtaccttctctcaggccgatgacctcaggcctccccggtccctggagctctaggaaaggtgagcgcgatctcgcgcccacacccagtgctctgggtcataagcctggatctggaaaaacaaacgccctttgagaagacggggactcgccaggatacccctctctcccctcatccagcctccagcccacccaattcctccccacctcctccacctccccaggccccactcacctcctccaactcctctggggaaacccaagccctgcagctcatggaacagaagaagtggaaccgtcgtttctggaacaggactatctgagagcggttcttcctggccctcgagttcatggaacggtataactggaaccgacgcttacggagcaagggtatgcgagagcggttcttcctggccctcgggttcgtggaacggtataactggaaccgacgcttacggagcaagggtatgcgagagcggttcttcctggccctcgggttcatggaatggcctaactggaaccaacgcttacggagcaatttgaaaggcaaggtaagaggatcgcttgagcttgagtctgaggccgcagtgagctatgaccacaccactgcaccccagtctgggtgacagcgcaagaccccaacgcca

SEQ ID NO: 445671 - DNA, 464 bp, Homo sapiens
ggtgggaaggtgggtatgggggatggagactccagctgtgcagcctccattctgagagctgcttagataaggtgcgcaaagccaggcattcctaggctagcactgtcaggatatgatttgtatcacttttgttttcacattatctgtctcttgaggaagtcactgcctgtctgcttttcactctgtaccctgggtttccctgataagataggcaaacttccagcattacagagattgttaatcccctagcttgtgcttccctaatacaaattgtttttttaagaaaccctcaaatttgtgttctaacaattggcatgttttatacatcttgacctcatatccaggtttaaaggaggtgaacacactggttcttaaagcttccctctatcacagacgctcctaaataagctatctgtggtaatctagccctgttcatcttgcaaactgagttgctgtataattgt

SEQ ID NO: 445672 - DNA, 1205 bp, Homo sapiens
acgtgaggccgggcagggggcggggccggcgaatgcccgtcccgacccgtcgcgcctcccctgttagctccctgccagccgaggcggggcgaacctctgccctgttgcgtgggagtgactcacagctcccgccccttttggctccgctttctcgcggccagtccctcgcaccacgtgccctcctggccgcgcccccagctgccctttccaactgcctgttggaagccgctgtaaaacgtcgtgaggagcgccgctgctttacggctgcctctcccagactagagccccggagcgcccaccgccgtcagccgcgtcttcaagctagtcggccccgcggagagcgagagaccctgcgcaccgcagccctctccgctgcgcccattcctgccgccggcgatgtaactcggggaggcagcggtgcccgctggcccggggttgagacaggcggcaggtgcctgtgaggcgggcgggtgccgggggccagcaggatggaggaaagcatggaagaggaggaggggggcagctacgaggcgatgatggacgaccagaaccacaacaactgggaggctgcggtggacggcttccggcagcccctgccacctccgccgcccccctcgtcgatcccggcccctgcccgagagcctccgggggggcagctgctggcggtgcccgcggtctccgtggacaggaaaggccccaaggaggggctcccgatggggccgcagccaccgccggaggctaatggggtgatcatgatgttgaagagctgcgacgcggccgccgccgtggccaaggcggcccccgcccccaccgccagctccaccatcaacatcaacacctccacctccaagttcttaatgaatgttataactattgaagattataagagcacatactggccaaaattggatggtgccatagatcaacttttaactcagagtcctggtgactatatccccatatcctatgaacagatatacagttgtgtgtataaatgtgtatgccagcagcactcggaacagatgtatagtgatctgattaaaaagataactaatcacttagagagagtctcaaaggagctgcaggtaaagaactgattgtattgatttttgcttccttgggttttcctgactggttgcagttagcttttctaatacacatttggaagcttgttaatttgattatgatataaatttataaatgtt

SEQ ID NO: 445673 - DNA, 2781 bp, Homo sapiens
acgtgaggccgggcagggggcggggccggcgaatgcccgtcccgacccgtcgcgcctcccctgttagctccctgccagccgaggcggggcgaacctctgccctgttgcgtgggagtgactcacagctcccgccccttttggctccgctttctcgcggccagtccctcgcaccacgtgccctcctggccgcgcccccagctgccctttccaactgcctgttggaagccgctgtaaaacgtcgtgaggagcgccgctgctttacggctgcctctcccagactagagccccggagcgcccaccgccgtcagccgcgtcttcaagctagtcggccccgcggagagcgagagaccctgcgcaccgcagccctctccgctgcgcccattcctgccgccggcgatgtaactcggggaggcagcggtgcccgctggcccggggttgagacaggcggcaggtgcctgtgaggcgggcgggtgccgggggccagcaggatggaggaaagcatggaagaggaggaggggggcagctacgaggcgatgatggacgaccagaaccacaacaactgggaggctgcggtggacggcttccggcagcccctgccacctccgccgcccccctcgtcgatcccggcccctgcccgagagcctccgggggggcagctgctggcggtgcccgcggtctccgtggacaggaaaggccccaaggaggggctcccgatggggccgcagccaccgccggaggctaatggggtgatcatgatgttgaagagctgcgacgcggccgccgccgtggccaaggcggcccccgcccccaccgccagctccaccatcaacatcaacacctccacctccaagttcttaatgaatgttataactattgaagattataagagcacatactggccaaaattggatggtgccatagatcaacttttaactcagagtcctggtgactatatccccatatcctatgaacagatatacagatacaaaaccgtacatgcaggctggttgtctggttagtcaatggctgatttgcttcaactgtctagtatgtatgtgcagcctgaaactggctccttaaaaggaaagccgggtcagtcatcttgaaaaaatgacatgtaaaagtaaatcgataattgttttgagagacggtacatgttttaaaggttggccttaagcttcagtaacattgtcattttgtgaccttttgttgtcacacctgtaccctaacctgacaggaattaactactgtttttttgtggggcagaaagcaaaacctggtgttgtgacttttatcctaatggttcttaggcaaggttagtgagaagaaacacaaacccagatgcatgcattgtgcattattttgtagacaagctactttttcttctgtccctttaacaaatttgcagcaattaccctccctttggggtctagagtgaaagctaatttgtgggtagatgagattgcagaagaatggatgtccatggctgtgaacactgcacactgcacatccatctccagtgctcacactgtgcagctaccactccctggctgcgtgccatgctgtcgggttgcagatttgcacacataaattcctcaggaagagtttgcatgagcatcacctcgcaatattctgtactgaccaaacaagggatttgaacgtttttcagcacaaaaggataacttccgagtggtggtctgtacgcatactagcaaaggtaatggtgatctagcaaacaaaattggtttctgcagttagaagtgagcaggagcacttgtattatagtatttaaataatcctggttaatctctttttaagccgagtaacccctccagattttgcctttttattattgaggctggctttattttcttctactttttttcccgttttatagcagttaattatttttgtgattattatgcaagaagcattgcccttgagttaaactgttattgtttcataagcagctattaaaataactgagcattgttttatgaacatacactaatctgagatactgaaaagctttgcaactaaaaagcaaaacaacctacattagtcatctagccattgtttggatgttttgagttgattttttatggtgcctcttttagcttggaatattacgtttactttaatccaagtctaggccttttaaagggtccttaaaattaaagttcagaatgtgaatccctttgacatctattacaggtttataggacctttttggttgtgattactgttttcaatacgattgtataaatgaagttaactttgtcagaagttaaaatggaggtcataggagttcctggagaaatggctctcctgtttctttcattaccccactgaagttcaccccagtttctggccacaagaatatgagaaaggaaccctgttgttttccaagggaaatcattcctctctgtccccactgttgattaactaaagtcctggacaccttccttcctccactggccaagacccaccttgacccaccttgaacctcttttcagagccgagtggcatgaatatgtgtactgtttctgcttctgttgatggagtggctgtgggagaattaaaggaaatgctaatttgagcttcattcataggggaacctactatatattgcatccctgctggttggaaattatcttcatctctggactgcattgtttagaaaaatgttaatggcttacaattctgagaactttattgtgtggctctggggttaagaattctgtggtttgaaaaaaaataaatattttgtattgattctca

SEQ ID NO: 445674 - DNA, 2423 bp, Homo sapiens
tctcccagtctacatgtcctggctgttaatcatcttggccccttgaggcacatcacagtttgaaggacctgtttaagttgaaatagactttgcttatttattgggattctaaaaaattctgagtgagtttgcagtatgagaggaaataagatttcctcctccttcctctcattttatattgactgtttgccagaaactgttttcttctgttttcttatattttgtttttgagatggagtctcactctctcacccaggctggagtgcagtggtgcaatctcagctcactgcaacctctgcctcctgggttcaagtgattctcctgcctcggcctcctgagtagctggaattacaggcacgtgccactacgcccggctactttttgtattttgtttttagtagagacggggtttcaccatgttggtcaggctggtcttgaactcctgacctcaagtgatccacccacctcggcctcccaaagtgctgggattataggtgtgagccactgcacctggccttttttttttttctttctgggtattcttgccagtacagtatatggtttttctaccccaattacatactgggttttgtaccacatcactaaaggcccaaatcattgaagatacaaaaccgtacatgcaggctggttgtctggttagtcaatggctgatttgcttcaactgtctagtatgtatgtgcagcctgaaactggctccttaaaaggaaagccgggtcagtcatcttgaaaaaatgacatgtaaaagtaaatcgataattgttttgagagacggtacatgttttaaaggttggccttaagcttcagtaacattgtcattttgtgaccttttgttgtcacacctgtaccctaacctgacaggaattaactactgtttttttgtggggcagaaagcaaaacctggtgttgtgacttttatcctaatggttcttaggcaaggttagtgagaagaaacacaaacccagatgcatgcattgtgcattattttgtagacaagctactttttcttctgtccctttaacaaatttgcagcaattaccctccctttggggtctagagtgaaagctaatttgtgggtagatgagattgcagaagaatggatgtccatggctgtgaacactgcacactgcacatccatctccagtgctcacactgtgcagctaccactccctggctgcgtgccatgctgtcgggttgcagatttgcacacataaattcctcaggaagagtttgcatgagcatcacctcgcaatattctgtactgaccaaacaagggatttgaacgtttttcagcacaaaaggataacttccgagtggtggtctgtacgcatactagcaaaggtaatggtgatctagcaaacaaaattggtttctgcagttagaagtgagcaggagcacttgtattatagtatttaaataatcctggttaatctctttttaagccgagtaacccctccagattttgcctttttattattgaggctggctttattttcttctactttttttcccgttttatagcagttaattatttttgtgattattatgcaagaagcattgcccttgagttaaactgttattgtttcataagcagctattaaaataactgagcattgttttatgaacatacactaatctgagatactgaaaagctttgcaactaaaaagcaaaacaacctacattagtcatctagccattgtttggatgttttgagttgattttttatggtgcctcttttagcttggaatattacgtttactttaatccaagtctaggccttttaaagggtccttaaaattaaagttcagaatgtgaatccctttgacatctattacaggtttataggacctttttggttgtgattactgttttcaatacgattgtataaatgaagttaactttgtcagaagttaaaatggaggtcataggagttcctggagaaatggctctcctgtttctttcattaccccactgaagttcaccccagtttctggccacaagaatatgagaaaggaaccctgttgttttccaagggaaatcattcctctctgtccccactgttgattaactaaagtcctggacaccttccttcctccactggccaagacccaccttgacccaccttgaacctcttttcagagccgagtggcatgaatatgtgtactgtttctgcttctgttgatggagtggctgtgggagaattaaaggaaatgctaatttgagcttcattcataggggaacctactatatattgcatccctgctggttggaaattatcttcatctctggactgcattgtttagaaaaatgttaatggcttacaattctgagaactttattgtgtggctctggggttaagaattctgtggtttgaaaaaaaataaatattttgtattgattctca

SEQ ID NO: 445675 - DNA, 1594 bp, Homo sapiens
acgtgaggccgggcagggggcggggccggcgaatgcccgtcccgacccgtcgcgcctcccctgttagctccctgccagccgaggcggggcgaacctctgccctgttgcgtgggagtgactcacagctcccgccccttttggctccgctttctcgcggccagtccctcgcaccacgtgccctcctggccgcgcccccagctgccctttccaactgcctgttggaagccgctgtaaaacgtcgtgaggagcgccgctgctttacggctgcctctcccagactagagccccggagcgcccaccgccgtcagccgcgtcttcaagctagtcggccccgcggagagcgagagaccctgcgcaccgcagccctctccgctgcgcccattcctgccgccggcgatgtaactcggggaggcagcggtgcccgctggcccggggttgagacaggcggcaggtgcctgtgaggcgggcgggtgccgggggccagcaggatggaggaaagcatggaagaggaggaggggggcagctacgaggcgatgatggacgaccagaaccacaacaactgggaggctgcggtggacggcttccggcagcccctgccacctccgccgcccccctcgtcgatcccggcccctgcccgagagcctccgggggggcagctgctggcggtgcccgcggtctccgtggacaggaaaggccccaaggaggggctcccgatggggccgcagccaccgccggaggctaatggggtgatcatgatgttgaagagctgcgacgcggccgccgccgtggccaaggcggcccccgcccccaccgccagctccaccatcaacatcaacacctccacctccaagttcttaatgaatgttataactattgaagattataagagcacatactggccaaaattggatggtgccatagatcaacttttaactcagagtcctggtgactatatccccatatcctatgaacagatatacagttgtgtgtataaatgtgtatgccagcagcactcggaacagatgtatagtgatctgattaaaaagataactaatcacttagagagagtctcaaaggagctgcaggccagccctccagatctctatattgaaagatttaatatagctcttggacaatatatgggagcattgcagagcattgtgcctcttttcatatatatgaataagttttacatcgaaaccaagcttaacagagacttaaaagatgaccttataaagctgtttacggaacatgttgcagaaaagcacatttacagcctaatgcctttacttttagaagcccagtcaacaccatttcaggtcacaccttcaactatggcaaatattgtgaaaggcctgtataccctcagaccaggtaaacatttctcatttctgttgggattggaactgtttgttacagccttttccaagagggcagtggttctgtatgtgttttgtgaggcttaatggtacttggatttgctggagcaaaaaaattgagtagatactcatcattgtgaaatgtaaactcagagctcagttggaatgttctctgctagtggaaaccaactagtgtggtttttgcagaacctgtg

SEQ ID NO: 445676 - DNA, 1662 bp, Homo sapiens
ctgacaggaattaactactgtcaggttagggtacaggtgtgacaacaaaaggtcacataaatgacaatgttactgaagcttaaggccaacctttaaaacctgtaccctaacctgacaggaattaactactgtttttttgtggggcagaaagcaaaacctggtgttgtgacttttatcctaatggttcttaggcaaggttagtgagaagaaacacaaacccagatgcatgcattgtgcattattttgtagacaagctactttttcttctgtccctttaacaaatttgcagcaattaccctccctttggggtctagagtgaaagctaatttgtgggtagatgagattgcagaagaatggatgtccatggctgtgaacactgcacactgcacatccatctccagtgctcacactgtgcagctaccactccctggctgcgtgccatgctgtcgggttgcagatttgcacacataaattcctcaggaagagtttgcatgagcatcacctcgcaatattctgtactgaccaaacaagggatttgaacgtttttcagcacaaaaggataacttccgagtggtggtctgtacgcatactagcaaaggtaatggtgatctagcaaacaaaattggtttctgcagttagaagtgagcaggagcacttgtattatagtatttaaataatcctggttaatctctttttaagccgagtaacccctccagattttgcctttttattattgaggctggctttattttcttctactttttttcccgttttatagcagttaattatttttgtgattattatgcaagaagcattgcccttgagttaaactgttattgtttcataagcagctattaaaataactgagcattgttttatgaacatacactaatctgagatactgaaaagctttgcaactaaaaagcaaaacaacctacattagtcatctagccattgtttggatgttttgagttgattttttatggtgcctcttttagcttggaatattacgtttactttaatccaagtctaggccttttaaagggtccttaaaattaaagttcagaatgtgaatccctttgacatctattacaggtttataggacctttttggttgtgattactgttttcaatacgattgtataaatgaagttaactttgtcagaagttaaaatggaggtcataggagttcctggagaaatggctctcctgtttctttcattaccccactgaagttcaccccagtttctggccacaagaatatgagaaaggaaccctgttgttttccaagggaaatcattcctctctgtccccactgttgattaactaaagtcctggacaccttccttcctccactggccaagacccaccttgacccaccttgaacctcttttcagagccgagtggcatgaatatgtgtactgtttctgcttctgttgatggagtggctgtgggagaattaaaggaaatgctaatttgagcttcattcataggggaacctactatatattgcatccctgctggttggaaattatcttcatctctggactgcattgtttagaaaaatgttaatggcttacaattctgagaactttattgtgtggctctggggttaagaattctgtggtttgaaaaaaaataaatattttgtattgattctca

SEQ ID NO: 445677 - DNA, 3202 bp, Homo sapiens
ttttttttactggctgcttggagttaattttacgtttggcgccaggtgcacaggtccgggagtaatgaaagctatcaagtgctggggtccgggcggtagagagcggggctcttactggattttggtgtttgctgtgttgatgcacaatgtctgcttgttgcatccgcctattttacagggtggggggtggagagggtggggagcagcactcggaacagatgtatagtgatctgattaaaaagataactaatcacttagagagagtctcaaaggagctgcaggccagccctccagatctctatattgaaagatttaatatagctcttggacaatatatgggagcattgcagagcattgtgcctcttttcatatatatgaataagttttacatcgaaaccaagcttaacagagacttaaaagatgaccttataaagctgtttacggaacatgttgcagaaaagcacatttacagcctaatgcctttacttttagaagcccagtcaacaccatttcaggtcacaccttcaactatggcaaatattgtgaaaggcctgtataccctcagaccagagtgggttcagatggctccaactctattttctaaatttattccaaacattctccctccggcggtggaatctgaactttctgaatatgctgctcaagatcagaaatttcaaagagaacttatacagaatggttttacaaggggtgaccagtcccggaagagagctggggatgagttggcttataatagctcgtcagcatgtgcaagttccagggggtacagatagtgaatgtattgaatatgctttccttcctgaaaagaggacacactggagctgcagagactgtattcagagcacagtgggggctgcacacactcaggagctctgtcacaaagctgttcatggaagaggatgttggacttcttacttggtttgtaattttaaaacaaaaactaaaaaaaaaaaaaacgttgctgctagacttgggggtgattttgaaatgggacaatcttttaatgagtttatctacagattctgtgaggaaaaagcatctcagaaagtgaccatttctaagtgaaatctgacagccaaaatcagcagcttcctccaaaaatataagagcagaagaattttttttttaagcacttgttttgttcatttgtggacttggcattttggtgtattggtttcacatgtcaggatctcttttgctttaaaaccaagcagatcattacagtacagtatttttcacccacaaccaaaacaaccccttttaaaagagttggtctttgtttagcattagaaagtcttgttaaaggaaaatgctaactctgcttttgctagaactttcccccatcagttcacaactttcttctactctgtgccttgagctttgtgcactttgcaactgtgtgaccatgttgtcaaactcctcctggagaagtgtatggtatctaaactcacccaccaagatggcaggtgtggccctgtagcaggatgctaattaagtgggaaaatagaaaccttttgcacatgggtcggattttcccctggttcaccagagcatattcatattaatgttggggaccaactctcctagagcatttccattccctgtgccacttaacacgatgtctgtcaccagctgctatagtattggcagtactctagtttagggatgggcggtactttagcacggaagcttcccttagtattattgagagctacttcctgcgatgctctaggaagcagatacagttattaagtccaaatacacagtggtgtggggttcctgatcacttcattttaaatgaatgagataattacttaaaaaaagtctgtcatttgaacattatatttgagtgtgatagggaagaagtagcactgctgtcctaaggctcccttccagctgtggcaaagctatatttctgtttctccacatccacagtgctttttagtccatcataaaagtttctgaagcttattctagctgttgttgaaagcccaagaaaaatagatgtggcaagagaaaaatacttttcttctcaattttgcttgaatcttaattgagcataggcttctctactaggcaacatcagactaatagtatttacctcttcagagaacttgaggggaaaagaaacatcccagggatgctgtcgcatgtctgctctgcaggttcttcatacagctgcctctgccaattcagtttattttttggggggagtggtgtgggtgggagagttagaagtgggatattgggagcaagtaagtcacccaataattgaagtccttgatttgtaaaactgttatacagagaagtaaagataaaggttgtcagatttattttttaaagtacttaaccagagttcgtggattttgtggactttaattggactcaattcactctgtgagcatcctggattgcatcgatgaacactgaattactgtaagaacatagacaggctctcactatgacctggacagtttaagttgctacactggtaacattctagtatcaaggagaattccattcatcatgacattcacattttacttttctcaatggaatgcttgcttcaggcttaccaatcacacctagaactgaagtctgagtgagtggtattaataatttttctgaaaggaataaaattggaatgtttctaaatgtggagaaattcttcagtatcctaataatatacccaaatgctttttctgggagagagcattcttttacaaaagaactttccctataaaagcatcacagtataatgtgaattggcattaaaatctttggatgcttttgcattattaagttcatggagaaatatattctttttactatgtatgtattaataaaaagtgggcaaagtaaagtttgcaaaatttagtttctctaaatttttgcacagtgactgcagctggctatgggtcagctcttaatacaacaaaaccttgactggaagtcactatagaaaggctgcggtggacggcttccggcagcccctgccacctccgccgcccccctcgtcgatcccggcccctgcccgagagcctccgggggggcagctgctggcggtgcccgcggtctccgtggacaggaaaggccccaaggaggggctcccgatggggccgcagccaccgccggaggctaatggggtgatcatgatgttgaagagctgcgacgcggccgc

SEQ ID NO: 445678 - DNA, 2392 bp, Homo sapiens
  misc_feature (2346)..(2346): n is a, c, g, or t
  misc_feature (2349)..(2349): n is a, c, g, or t
  misc_feature (2351)..(2351): n is a, c, g, or t
  misc_feature (2353)..(2353): n is a, c, g, or t
  misc_feature (2358)..(2358): n is a, c, g, or t
  misc_feature (2363)..(2363): n is a, c, g, or t
acgtgaggccgggcagggggcggggccggcgaatgcccgtcccgacccgtcgcgcctcccctgttagctccctgccagccgaggcggggcgaacctctgccctgttgcgtgggagtgactcacagctcccgccccttttggctccgctttctcgcggccagtccctcgcaccacgtgccctcctggccgcgcccccagctgccctttccaactgcctgttggaagccgctgtaaaacgtcgtgaggagcgccgctgctttacggctgcctctcccagactagagccccggagcgcccaccgccgtcagccgcgtcttcaagctagtcggccccgcggagagcgagagaccctgcgcaccgcagccctctccgctgcgcccattcctgccgccggcgatgtaactcggggaggcagcggtgcccgctggcccggggttgagacaggcggcaggtgcctgtgaggcgggcgggtgccgggggccagcaggatggaggaaagcatggaagaggaggaggggggcagctacgaggcgatgatggacgaccagaaccacaacaactgggaggctgcggtggacggcttccggcagcccctgccacctccgccgcccccctcgtcgatcccggcccctgcccgagagcctccgggggggcagctgctggcggtgcccgcggtctccgtggacaggaaaggccccaaggaggggctcccgatggggccgcagccaccgccggaggctaatggggtgatcatgatgttgaagagctgcgacgcggccgccgccgtggccaaggcggcccccgcccccaccgccagctccaccatcaacatcaacacctccacctccaagttcttaatgaatgttataactattgaagattataagagcacatactggccaaaattggatggtgccatagatcaacttttaactcagagtcctggtgactatatccccatatcctatgaacagatatacagatacaaaaccgtacatgcaggctggttgtctggttagtcaatggctgatttgcttcaactgtctagtatgtatgtgcagcctgaaactggctccttaaaaggaaagccgggtcagtcatcttgaaaaaatgacatgtaaaagtaaatcgataattgttttgagagacggtacatgttttaaaggttggccttaagcttcagtaacattgtcattttgtgaccttttgttgtcacacctgtaccctaacctgacaggaattaactactgtttttttgtggggcagaaagcaaaacctggtgttgtgacttttatcctaatggttcttaggcaaggttagtgagaagaaacacaaacccagatgcatgcattgtgcattattttgtagacaagctactttttcttctgtccctttaacaaatttgcagcaattaccctccctttggggtctagagtgaaagctaatttgtgggtagatgagattgcagaagaatggatgtccatggctgtgaacactgcacactgcacatccatctccagtgctcacactgtgcagctaccactccctggctgcgtgccatgctgtcgggttgcagatttgcacacataaattcctcaggaagagtttgcatgagcatcacctcgcaatattctgtactgaccaaacaagggatttgaacgtttttcagcacaaaaggataacttccgagtggtggtctgtacgcatactagcaaaggtaatggtgatctagcaaacaaaattggtttctgcagttagaagtgagcaggagcacttgtattatagtatttaaataatcctggttaatctctttttaagccgagtaacccctccagattttgcctttttattattgaggctggctttattttcttctactttttttcccgttttatagcagttaattatttttgtgattattatgcaagaagcattgcccttgagttaaactgttattgtttcataagcagctattaaaataactgagcattgttttatgaacatacactaatctgagatactgaaaagctttgcaactaaaaagcaaaacaacctacattagtcatctagccattgtttggatgttttgagttgattttttatggtgcctcttttagcttggaatattacgtttactttaatccaagtctaggccttttaaagggtccttaaaattaaagttcagaatgtgaatccctttgacatctattacaggtttataggacctttttggttgtgattactgttttcaatacgattgtataaatgaagttaactttgtcagaagttaaaatggaggtcataggagttcctggagaaatggctctcctgtttctttcatttccngantnantgtcngtgtntttatcctctagagtcagctgtgaccatg

SEQ ID NO: 445679 - DNA, 2633 bp, Homo sapiens
ctaagatgtttaatatgtatttttaaataggtttggttagaactgaaatgtctgctatacttttattatcaaatatgttgatcctttcctcctgttttgatgtgaagtcagttttgttgactgcctcttcttatccccaggggtgaccagtcccggaagagagctggggatgagttggcttataatagctcgtcagcatgtgcaagttccagggggtacagatagtgaatgtattgaatatgctttccttcctgaaaagaggacacactggagctgcagagactgtattcagagcacagtgggggctgcacacactcaggagctctgtcacaaagctgttcatggaagaggatgttggacttcttacttggtttgtaattttaaaacaaaaactaaaaaaaaaaaaaacgttgctgctagacttgggggtgattttgaaatgggacaatcttttaatgagtttatctacagattctgtgaggaaaaagcatctcagaaagtgaccatttctaagtgaaatctgacagccaaaatcagcagcttcctccaaaaatataagagcagaagaattttttttttaagcacttgttttgttcatttgtggacttggcattttggtgtattggtttcacatgtcaggatctcttttgctttaaaaccaagcagatcattacagtacagtatttttcacccacaaccaaaacaaccccttttaaaagagttggtctttgtttagcattagaaagtcttgttaaaggaaaatgctaactctgcttttgctagaactttcccccatcagttcacaactttcttctactctgtgccttgagctttgtgcactttgcaactgtgtgaccatgttgtcaaactcctcctggagaagtgtatggtatctaaactcacccaccaagatggcaggtgtggccctgtagcaggatgctaattaagtgggaaaatagaaaccttttgcacatgggtcggattttcccctggttcaccagagcatattcatattaatgttggggaccaactctcctagagcatttccattccctgtgccacttaacacgatgtctgtcaccagctgctatagtattggcagtactctagtttagggatgggcggtactttagcacggaagcttcccttagtattattgagagctacttcctgcgatgctctaggaagcagatacagttattaagtccaaatacacagtggtgtggggttcctgatcacttcattttaaatgaatgagataattacttaaaaaaagtctgtcatttgaacattatatttgagtgtgatagggaagaagtagcactgctgtcctaaggctcccttccagctgtggcaaagctatatttctgtttctccacatccacagtgctttttagtccatcataaaagtttctgaagcttattctagctgttgttgaaagcccaagaaaaatagatgtggcaagagaaaaatacttttcttctcaattttgcttgaatcttaattgagcataggcttctctactaggcaacatcagactaatagtatttacctcttcagagaacttgaggggaaaagaaacatcccagggatgctgtcgcatgtctgctctgcaggttcttcatacagctgcctctgccaattcagtttattttttggggggagtggtgtgggtgggagagttagaagtgggatattgggagcaagtaagtcacccaataattgaagtccttgatttgtaaaactgttatacagagaagtaaagataaaggttgtcagatttattttttaaagtacttaaccagagttcgtggattttgtggactttaattggactcaattcactctgtgagcatcctggattgcatcgatgaacactgaattactgtaagaacatagacaggctctcactatgacctggacagtttaagttgctacactggtaacattctagtatcaaggagaattccattcatcatgacattcacattttacttttctcaatggaatgcttgcttcaggcttaccaatcacacctagaactgaagtctgagtgagtggtattaataatttttctgaaaggaataaaattggaatgtttctaaatgtggagaaattcttcagtatcctaataatatacccaaatgctttttctgggagagagcattcttttacaaaagaactttccctataaaagcatcacagtataatgtgaattggcattaaaatctttggatgcttttgcattattaagttcatggagaaatatattctttttactatgtatgtattaataaaaagtgggcaaagtaaagtttgcaaaatttagtttctctaaatttttgcacagtgactgcagctggctatgggtcagctcttaatacaacaaaaccttgactggaagtcactatagaaaggctgcggtggacggcttccggcagcccctgccacctccgccgcccccctcgtcgatcccggcccctgcccgagagcctccgggggggcagctgctggcggtgcccgcggtctccgtggacaggaaaggccccaaggaggggctcccgatggggccgcagccaccgccggaggctaatggggtgatcatgatgttgaagagctgcgacgcggccgc

SEQ ID NO: 445680 - DNA, 345 bp, Homo sapiens
gcggccgccgccgtggccaaggcggcccccgcccccaccgccagctccaccatcaacatcaacacctccacctccaagttctgtgagtccagcctttccctgcagccttggcttttctccacctcactcggacgccgaatccaccccctcttggagaaagctccgcttcctttgtttcaggcctcggtctttcctcttctccccgtccgccttcgcctccctgcctccttccccctcaccgtcccctccccctcatttggtgtctgcggccagcgcctgagcggccctggcttcttgtattacctggcctagagaggcagcctggtacacacggagccccaagtt

SEQ ID NO: 445681 - DNA, 295 bp, Homo sapiens
ttcctagtggtgcttgtatgtcagaagccatagtgagctcagcacagggcgttctgcacatcatctctttaatccaagaaaaacaaaatggcggatgaaactcctattgacctgggatacaaagccactgactttggctcttgatcttttggtgggttctgaatcactccttctgtattagggcatatactttcactctaaaacattgtggtaaatgaaataaatcttgtacagatgtcgttggccttgttatgttatgttataaatcctgtacagatgtccttggccttaatac

SEQ ID NO: 445682 - DNA, 4006 bp, Homo sapiens
acgtgaggccgggcagggggcggggccggcgaatgcccgtcccgacccgtcgcgcctcccctgttagctccctgccagccgaggcggggcgaacctctgccctgttgcgtgggagtgactcacagctcccgccccttttggctccgctttctcgcggccagtccctcgcaccacgtgccctcctggccgcgcccccagctgccctttccaactgcctgttggaagccgctgtaaaacgtcgtgaggagcgccgctgctttacggctgcctctcccagactagagccccggagcgcccaccgccgtcagccgcgtcttcaagctagtcggccccgcggagagcgagagaccctgcgcaccgcagccctctccgctgcgcccattcctgccgccggcgatgtaactcggggaggcagcggtgcccgctggcccggggttgagacaggcggcaggtgcctgtgaggcgggcgggtgccgggggccagcaggatggaggaaagcatggaagaggaggaggggggcagctacgaggcgatgatggacgaccagaaccacaacaactgggaggctgcggtggacggcttccggcagcccctgccacctccgccgcccccctcgtcgatcccggcccctgcccgagagcctccgggggggcagctgctggcggtgcccgcggtctccgtggacaggaaaggccccaaggaggggctcccgatggggccgcagccaccgccggaggctaatggggtgatcatgatgttgaagagctgcgacgcggccgccgccgtggccaaggcggcccccgcccccaccgccagctccaccatcaacatcaacacctccacctccaagttcttaatgaatgttataactattgaagattataagagcacatactggccaaaattggatggtgccatagatcaacttttaactcagagtcctggtgactatatccccatatcctatgaacagatatacagttgtgtgtataaatgtgtatgccagcagcactcggaacagatgtatagtgatctgattaaaaagataactaatcacttagagagagtctcaaaggagctgcaggccagccctccagatctctatattgaaagatttaatatagctcttggacaatatatgggagcattgcagagcattgtgcctcttttcatatatatgaataagttttacatcgaaaccaagcttaacagagacttaaaagatgaccttataaagctgtttacggaacatgttgcagaaaagcacatttacagcctaatgcctttacttttagaagcccagtcaacaccatttcaggtcacaccttcaactatggcaaatattgtgaaaggcctgtataccctcagaccagagtgggttcagatggctccaactctattttctaaatttattccaaacattctccctccggcggtggaatctgaactttctgaatatgctgctcaagatcagaaatttcaaagagaacttatacagaatggttttacaaggggtgaccagtcccggaagagagctggggatgagttggcttataatagctcgtcagcatgtgcaagttccagggggtacagatagtgaatgtattgaatatgctttccttcctgaaaagaggacacactggagctgcagagactgtattcagagcacagtgggggctgcacacactcaggagctctgtcacaaagctgttcatggaagaggatgttggacttcttacttggtttgtaattttaaaacaaaaactaaaaaaaaaaaaaacgttgctgctagacttgggggtgattttgaaatgggacaatcttttaatgagtttatctacagattctgtgaggaaaaagcatctcagaaagtgaccatttctaagtgaaatctgacagccaaaatcagcagcttcctccaaaaatataagagcagaagaattttttttttaagcacttgttttgttcatttgtggacttggcattttggtgtattggtttcacatgtcaggatctcttttgctttaaaaccaagcagatcattacagtacagtatttttcacccacaaccaaaacaaccccttttaaaagagttggtctttgtttagcattagaaagtcttgttaaaggaaaatgctaactctgcttttgctagaactttcccccatcagttcacaactttcttctactctgtgccttgagctttgtgcactttgcaactgtgtgaccatgttgtcaaactcctcctggagaagtgtatggtatctaaactcacccaccaagatggcaggtgtggccctgtagcaggatgctaattaagtgggaaaatagaaaccttttgcacatgggtcggattttcccctggttcaccagagcatattcatattaatgttggggaccaactctcctagagcatttccattccctgtgccacttaacacgatgtctgtcaccagctgctatagtattggcagtactctagtttagggatgggcggtactttagcacggaagcttcccttagtattattgagagctacttcctgcgatgctctaggaagcagatacagttattaagtccaaatacacagtggtgtggggttcctgatcacttcattttaaatgaatgagataattacttaaaaaaagtctgtcatttgaacattatatttgagtgtgatagggaagaagtagcactgctgtcctaaggctcccttccagctgtggcaaagctatatttctgtttctccacatccacagtgctttttagtccatcataaaagtttctgaagcttattctagctgttgttgaaagcccaagaaaaatagatgtggcaagagaaaaatacttttcttctcaattttgcttgaatcttaattgagcataggcttctctactaggcaacatcagactaatagtatttacctcttcagagaacttgaggggaaaagaaacatcccagggatgctgtcgcatgtctgctctgcaggttcttcatacagctgcctctgccaattcagtttattttttggggggagtggtgtgggtgggagagttagaagtgggatattgggagcaagtaagtcacccaataattgaagtccttgatttgtaaaactgttatacagagaagtaaagataaaggttgtcagatttattttttaaagtacttaaccagagttcgtggattttgtggactttaattggactcaattcactctgtgagcatcctggattgcatcgatgaacactgaattactgtaagaacatagacaggctctcactatgacctggacagtttaagttgctacactggtaacattctagtatcaaggagaattccattcatcatgacattcacattttacttttctcaatggaatgcttgcttcaggcttaccaatcacacctagaactgaagtctgagtgagtggtattaataatttttctgaaaggaataaaattggaatgtttctaaatgtggagaaattcttcagtatcctaataatatacccaaatgctttttctgggagagagcattcttttacaaaagaactttccctataaaagcatcacagtataatgtgaattggcattaaaatctttggatgcttttgcattattaagttcatggagaaatatattctttttactatgtatgtattaataaaaagtgggcaaagtaaagtttgcaaaatttagtttctctaaatttttgcacagtgactgcagctggctatgggtcagctcttaatacaacaaaaccttgactggaagtcactatagaaaggctgcggtggacggcttccggcagcccctgccacctccgccgcccccctcgtcgatcccggcccctgcccgagagcctccgggggggcagctgctggcggtgcccgcggtctccgtggacaggaaaggccccaaggaggggctcccgatggggccgcagccaccgccggaggctaatggggtgatcatgatgttgaagagctgcgacgcggccgc

SEQ ID NO: 445683 - DNA, 3292 bp, Homo sapiens
acgtgaggccgggcagggggcggggccggcgaatgcccgtcccgacccgtcgcgcctcccctgttagctccctgccagccgaggcggggcgaacctctgccctgttgcgtgggagtgactcacagctcccgccccttttggctccgctttctcgcggccagtccctcgcaccacgtgccctcctggccgcgcccccagctgccctttccaactgcctgttggaagccgctgtaaaacgtcgtgaggagcgccgctgctttacggctgcctctcccagactagagccccggagcgcccaccgccgtcagccgcgtcttcaagctagtcggccccgcggagagcgagagaccctgcgcaccgcagccctctccgctgcgcccattcctgccgccggcgatgtaactcggggaggcagcggtgcccgctggcccggggttgagacaggcggcaggtgcctgtgaggcgggcgggtgccgggggccagcaggatggaggaaagcatggaagaggaggaggggggcagctacgaggcgatgatggacgaccagaaccacaacaactgggaggctgcggtggacggcttccggcagcccctgccacctccgccgcccccctcgtcgatcccggcccctgcccgagagcctccgggggggcagctgctggcggtgcccgcggtctccgtggacaggaaaggccccaaggaggggctcccgatggggccgcagccaccgccggaggctaatggggtgatcatgatgttgaagagctgcgacgcggccgccgccgtggccaaggcggcccccgcccccaccgccagctccaccatcaacatcaacacctccacctccaagttcttaatgaatgttataactattgaagattataagagcacatactggccaaaattggatggtgccatagatcaacttttaactcagagtcctggtgactatatccccatatcctatgaacagatatacagatacaaaaccgtacatgcaggctggttgtctggttagtcaatggctgatttgcttcaactgtctagtatgtatgtgcagcctgaaactggctccttaaaaggaaagccgggtcagtcatcttgaaaaaatgacatgtaaaagtaaatcgataattgttttgagagacggtacatgttttaaaggttggccttaagcttcagtaacattgtcattttgtgaccttttgttgtcacacctgtaccctaacctgacaggaattaactactgtttttttgtggggcagaaagcaaaacctggtgttgtgacttttatcctaatggttcttaggcaaggttagtgagaagaaacacaaacccagatgcatgcattgtgcattattttgtagacaagctactttttcttctgtccctttaacaaatttgcagcaattaccctccctttggggtctagagtgaaagctaatttgtgggtagatgagattgcagaagaatggatgtccatggctgtgaacactgcacactgcacatccatctccagtgctcacactgtgcagctaccactccctggctgcgtgccatgctgtcgggttgcagatttgcacacataaattcctcaggaagagtttgcatgagcatcacctcgcaatattctgtactgaccaaacaagggatttgaacgtttttcagcacaaaaggataacttccgagtggtggtctgtacgcatactagcaaaggtaatggtgatctagcaaacaaaattggtttctgcagttagaagtgagcaggagcacttgtattatagtatttaaataatcctggttaatctctttttaagccgagtaacccctccagattttgcctttttattattgaggctggctttattttcttctactttttttcccgttttatagcagttaattatttttgtgattattatgcaagaagcattgcccttgagttaaactgttattgtttcataagcagctattaaaataactgagcattgttttatgaacatacactaatctgagatactgaaaagctttgcaactaaaaagcaaaacaacctacattagtcatctagccattgtttggatgttttgagttgattttttatggtgcctcttttagcttggaatattacgtttactttaatccaagtctaggccttttaaagggtccttaaaattaaagttcagaatgtgaatccctttgacatctattacaggtttataggacctttttggttgtgattactgttttcaatacgattgtataaatgaagttaactttgtcagaagttaaaatggaggtcataggagttcctggagaaatggctctcctgtttctttcattaccccactgaagttcaccccagtttctggccacaagaatatgagaaaggaaccctgttgttttccaagggaaatcattcctctctgtccccactgttgattaactaaagtcctggacaccttccttcctccactggccaagacccaccttgacccaccttgaacctcttttcagagccgagtggcatgaatatgtgtactgtttctgcttctgttgatggagtggctgtgggagaattaaaggaaatgctaatttgagcttcattcataggggaacctactatatattgcatccctgctggttggaaattatcttcatctctggactgcattgtttagaaaaatgttaatggcttacaattctgagaactttattgtgtggctctggggttaagaattctgtggtttgaaaaaaaataaatattttgtattgattctcacgtcatttcaatgttgtgactatgtactaaatgcactaagactgggtattctcttagaagagtgcgttttgttaaacagatggcagttcactctcattagttctatttgtcaatattacagccacacacttcaggataacttactcaaatgtgaagtcatgggaagctatggctagtaacaggaatgcttatgaaaaatttggagggcaagcacgagcaagaggcttttgccactcactagcacagccagagcaaggatgaagcaatgaagtcttgttcctagtggtgcttgtatgtcagaagccatagtgagctcagcacagggcgttctgcacatcatctctttaatccaagaaaaacaaaatggcggatgaaactcctattgacctgggatacaaagccactgactttggctcttgatcttttggtgggttctgaatcactccttctgtattagggcatatactttcactctaaaacattgtggtaaatgaaataaatcttgtacaga

SEQ ID NO: 445684 - DNA, 3776 bp, Homo sapiens
acgtgaggccgggcagggggcggggccggcgaatgcccgtcccgacccgtcgcgcctcccctgttagctccctgccagccgaggcggggcgaacctctgccctgttgcgtgggagtgactcacagctcccgccccttttggctccgctttctcgcggccagtccctcgcaccacgtgccctcctggccgcgcccccagctgccctttccaactgcctgttggaagccgctgtaaaacgtcgtgaggagcgccgctgctttacggctgcctctcccagactagagccccggagcgcccaccgccgtcagccgcgtcttcaagctagtcggccccgcggagagcgagagaccctgcgcaccgcagccctctccgctgcgcccattcctgccgccggcgatgtaactcggggaggcagcggtgcccgctggcccggggttgagacaggcggcaggtgcctgtgaggcgggcgggtgccgggggccagcaggatggaggaaagcatggaagaggaggaggggggcagctacgaggcgatgatggacgaccagaaccacaacaactgggaggctgcggtggacggcttccggcagcccctgccacctccgccgcccccctcgtcgatcccggcccctgcccgagagcctccgggggggcagctgctggcggtgcccgcggtctccgtggacaggaaaggccccaaggaggggctcccgatggggccgcagccaccgccggaggctaatggggtgatcatgatgttgaagagctgcgacgcggccgccgccgtggccaaggcggcccccgcccccaccgccagctccaccatcaacatcaacacctccacctccaagttctgccagccctccagatctctatattgaaagatttaatatagctcttggacaatatatgggagcattgcagagcattgtgcctcttttcatatatatgaataagttttacatcgaaaccaagcttaacagagacttaaaagatgaccttataaagctgtttacggaacatgttgcagaaaagcacatttacagcctaatgcctttacttttagaagcccagtcaacaccatttcaggtcacaccttcaactatggcaaatattgtgaaaggcctgtataccctcagaccagagtgggttcagatggctccaactctattttctaaatttattccaaacattctccctccggcggtggaatctgaactttctgaatatgctgctcaagatcagaaatttcaaagagaacttatacagaatggttttacaaggggtgaccagtcccggaagagagctggggatgagttggcttataatagctcgtcagcatgtgcaagttccagggggtacagatagtgaatgtattgaatatgctttccttcctgaaaagaggacacactggagctgcagagactgtattcagagcacagtgggggctgcacacactcaggagctctgtcacaaagctgttcatggaagaggatgttggacttcttacttggtttgtaattttaaaacaaaaactaaaaaaaaaaaaaacgttgctgctagacttgggggtgattttgaaatgggacaatcttttaatgagtttatctacagattctgtgaggaaaaagcatctcagaaagtgaccatttctaagtgaaatctgacagccaaaatcagcagcttcctccaaaaatataagagcagaagaattttttttttaagcacttgttttgttcatttgtggacttggcattttggtgtattggtttcacatgtcaggatctcttttgctttaaaaccaagcagatcattacagtacagtatttttcacccacaaccaaaacaaccccttttaaaagagttggtctttgtttagcattagaaagtcttgttaaaggaaaatgctaactctgcttttgctagaactttcccccatcagttcacaactttcttctactctgtgccttgagctttgtgcactttgcaactgtgtgaccatgttgtcaaactcctcctggagaagtgtatggtatctaaactcacccaccaagatggcaggtgtggccctgtagcaggatgctaattaagtgggaaaatagaaaccttttgcacatgggtcggattttcccctggttcaccagagcatattcatattaatgttggggaccaactctcctagagcatttccattccctgtgccacttaacacgatgtctgtcaccagctgctatagtattggcagtactctagtttagggatgggcggtactttagcacggaagcttcccttagtattattgagagctacttcctgcgatgctctaggaagcagatacagttattaagtccaaatacacagtggtgtggggttcctgatcacttcattttaaatgaatgagataattacttaaaaaaagtctgtcatttgaacattatatttgagtgtgatagggaagaagtagcactgctgtcctaaggctcccttccagctgtggcaaagctatatttctgtttctccacatccacagtgctttttagtccatcataaaagtttctgaagcttattctagctgttgttgaaagcccaagaaaaatagatgtggcaagagaaaaatacttttcttctcaattttgcttgaatcttaattgagcataggcttctctactaggcaacatcagactaatagtatttacctcttcagagaacttgaggggaaaagaaacatcccagggatgctgtcgcatgtctgctctgcaggttcttcatacagctgcctctgccaattcagtttattttttggggggagtggtgtgggtgggagagttagaagtgggatattgggagcaagtaagtcacccaataattgaagtccttgatttgtaaaactgttatacagagaagtaaagataaaggttgtcagatttattttttaaagtacttaaccagagttcgtggattttgtggactttaattggactcaattcactctgtgagcatcctggattgcatcgatgaacactgaattactgtaagaacatagacaggctctcactatgacctggacagtttaagttgctacactggtaacattctagtatcaaggagaattccattcatcatgacattcacattttacttttctcaatggaatgcttgcttcaggcttaccaatcacacctagaactgaagtctgagtgagtggtattaataatttttctgaaaggaataaaattggaatgtttctaaatgtggagaaattcttcagtatcctaataatatacccaaatgctttttctgggagagagcattcttttacaaaagaactttccctataaaagcatcacagtataatgtgaattggcattaaaatctttggatgcttttgcattattaagttcatggagaaatatattctttttactatgtatgtattaataaaaagtgggcaaagtaaagtttgcaaaatttagtttctctaaatttttgcacagtgactgcagctggctatgggtcagctcttaatacaacaaaaccttgactggaagtcactatagaaaggctgcggtggacggcttccggcagcccctgccacctccgccgcccccctcgtcgatcccggcccctgcccgagagcctccgggggggcagctgctggcggtgcccgcggtctccgtggacaggaaaggccccaaggaggggctcccgatggggccgcagccaccgccggaggctaatggggtgatcatgatgttgaagagctgcgacgcggccgc

SEQ ID NO: 445685 - DNA, 1332 bp, Homo sapiens
acgtgaggccgggcagggggcggggccggcgaatgcccgtcccgacccgtcgcgcctcccctgttagctccctgccagccgaggcggggcgaacctctgccctgttgcgtgggagtgactcacagctcccgccccttttggctccgctttctcgcggccagtccctcgcaccacgtgccctcctggccgcgcccccagctgccctttccaactgcctgttggaagccgctgtaaaacgtcgtgaggagcgccgctgctttacggctgcctctcccagactagagccccggagcgcccaccgccgtcagccgcgtcttcaagctagtcggccccgcggagagcgagagaccctgcgcaccgcagccctctccgctgcgcccattcctgccgccggcgatgtaactcggggaggcagcggtgcccgctggcccggggttgagacaggcggcaggtgcctgtgaggcgggcgggtgccgggggccagcaggatggaggaaagcatggaagaggaggaggggggcagctacgaggcgatgatggacgaccagaaccacaacaactgggaggctgcggtggacggcttccggcagcccctgccacctccgccgcccccctcgtcgatcccggcccctgcccgagagcctccgggggggcagctgctggcggtgcccgcggtctccgtggacaggaaaggccccaaggaggggctcccgatggggccgcagccaccgccggaggctaatggggtgatcatgatgttgaagagctgcgacgcggccgccgccgtggccaaggcggcccccgcccccaccgccagctccaccatcaacatcaacacctccacctccaagttcttaatgaatgttataactattgaagattataagagcacatactggccaaaattggatggtgccatagatcaacttttaactcagagtcctggtgactatatccccatatcctatgaacagatatacagttgtgtgtataaatgtgtatgccagcagcactcggaacagatgtatagtgatctgattaaaaagataactaatcacttagagagagtctcaaaggagctgcaggccagccctccagatctctatattgaaagatttaatatagctcttggacaatatatgggagcattgcagagcattgtgcctcttttcatatatatggtaagtaagagctccttcctccttcccaaatacctaggtgtattgttgagagcacaaatagatgcagagagttaagcatattctgtttttcttttactacatttgtgttagaaatggaaattaagttatttcagtaatgtgcgatagttgt

SEQ ID NO: 445686 - DNA, 551 bp, Homo sapiens
cgagggggcgggacatgccggcagtctcgcgataactgcgcaggcgcggaccaaagcgatctcttctgaggatccggcaagatggcagaagtagagcagaagaagaagcggaccttccgcaagttcacctaccgcggcgtggacctcgaccagctgctggacatgtcctacgagcagctgatgcagctgtacagtgcgcgccagcggcggcggctgaaccggggcctgcggcggaagcagcactccctgctgaagcgcctgcgcaaggccaagaaggaggcgccgcccatggagaagccggaagtggtgaagacgcacctgcgggacatgatcatcctacccgagatggtgggcagcatggtgggcgtctacaacggcaagaccttcaaccaggtggagatcaagcccgagatgatcggccactacctgggcgagttctccatcacctacaagcccgtaaagcatggccggcccggcatcggggccacccactcctcccgcttcatccctctcaagtaatggctcagctaataaaggcgcacatgactcca

SEQ ID NO: 445687 - DNA, 1948 bp, Homo sapiens
cgagggggcgggacatgccggcagtctcgcgataactgcgcaggcgcggaccaaagcgatctcttctgaggatccggcaagatggcagaagtagagcagaagaagaagcggaccttccgcaagttcacctaccgcggcgtggacctcgaccagctgctggacatgtcctacgagcagctgatgcagctgtacagtgcgcgccagcggcggcggctgaaccggggcctgcggcggaagcagcactccctgctgaagcgcctgcgcaaggccaagaaggaggcgccgcccatggagaagccggaagtggtgaagacgcacctgcgggacatgatcatcctacccgagatggtgggcagcatggtgggcgtctacaacggcaagaccttcaaccaggtggagatcaagcccgagatgatcggccactacctgggcgagttctccatcacctacaagcccgtaaagcatggccggcccggcatcggggccacccactcctcccgcttcatccctctcaagtaatggctcagctaataaaggcgcacatgactccaaaaaaaaacaaaaaaaacccgagactagttctctctgtcgagattgcgcggccgttggggcgtgcaggggcgccagtcggcggacgaggggcccccgggagtttgctggactggagacatgagcctccaactggtgtggtggggctcggtagcccattcgggggacttgggttgtgcgcccacagattggtttggccctgcgtgaccagagcagcccaagccgccaccttggtgaaattgctagtggccaaaatcctgtgcatggtgggcgtgttcttcttcatgctgctcggctccctgctccccgtgaagatcatcgagacagattttgagaaggcccatcgctcgaaaaagatcctctctctctgcaacacctttggaggaggggtgtttctggccacgtgcttcaacgctctgctgcccgctgtgagggaaaagctccagaaggtcctgagcctcggccacatcagcaccgactacccgctggccgaaaccatcctcctgctgggcttcttcatgaccgtcttcctggagcagctgatcctgaccttccgcaaggagaagccgtccttcatcgacctggagaccttcaacgccggatcggacgtgggcagcgactcggagtatgagagccccttcatggggggcgcgcggggccacgcgctgtacgtggagccccacggccacggccccagcctgagcgtgcagggcctctcgcgcgccagccccgtgcgcctgctcagcctggccttcgcgctgtcggcccactcggtctttgagggcctggccctgggcctgcaggaggagggggagaaagtggtgagcctgttcgtgggggtggccgtccacgagacactggtggccgtggccctgggcatcagcatggcccggagtgccatgcccctgcgggacgcggccaagctggcggtcaccgtaagcgccatgatccccctgggcatcggcctgggcctgggcattgagagcgcccagggcgtgccgggcagcgtggcgtccgtgctgctgcagggcctggcgggcggcaccttcctcttcatcaccttcctggagatcctggccaaggagctggaggagaagagtgaccgtctgctcaaggtcctcttcctggtgctgggctacaccgtcctggccgggatggtcttcctcaagtggtgagcggcctcgccattgtccctgccgccggagcccgccgggagccccgggccggacacaggccgcgtcccccggccgcgcgtcccccaagagcgagcactgtggccctgggccaccacctgtgcacaaggggcctcccgggaccaggctgtgcccccgatcctacaccctgagcctcagagcactgctactttttaaaatacttctttctcttaaaagtctttacc

SEQ ID NO: 445688 - DNA, 525 bp, Homo sapiens
ccacgcgtccgcccacgcgtcgcggacgcgtgggtcgacccacgcgtcgggcaagatggcagaagtagagcagaagaagaagcggaccttccgcaagttcacctaccgcggcgtggacctcgaccagctgctggacatgtcctacgagcagctgatgcagctgtacagtgcgcgccagcggcggcggctgaaccggggcctgcggcggaagcagcactccctgctgaagcgcctgcgcaaggccaagaaggaggcgccgcccatggagaagccggaagtggtgaagacgcacctgcgggacatgatcatcctacccgagatggtgggcagcatggtgggcgtctacaacggcaagaccttcaaccaggtggagatcaagcccgagatgatcggccactacctgggcgagttctccatcacctacaagcccgtaaagcatggccggcccggcatcggggccacccactcctcccgcttcatccctctcaagtaatggctcagctaataaaggcgcacatgactcca

SEQ ID NO: 445689 - DNA, 510 bp, Homo sapiens
  misc_feature (35)..(36): n is a, c, g, or t
aaatgtcaggctgtactggtctgagtctttggatnncaagatggcagaagtagagcagaagaagaagcggaccttccgcaagttcacctaccgcggcgtggacctcgaccagctgctggacatgtcctacgagcagctgatgcagctgtacagtgcgcgccagcggcggcggctgaaccggggcctgcggcggaagcagcactccctgctgaagcgcctgcgcaaggccaagaaggaggcgccgcccatggagaagccggaagtggtgaagacgcacctgcgggacatgatcatcctacccgagatggtgggcagcatggtgggcgtctacaacggcaagaccttcaaccaggtggagatcaagcccgagatgatcggccactacctgggcgagttctccatcacctacaagcccgtaaagcatggccggcccggcatcggggccacccactcctcccgcttcatccctctcaagtaatggctcagctaataaaggcgcacatgactcca

SEQ ID NO: 445690 - DNA, 510 bp, Homo sapiens
ttaggctagtagaggctggggtgaatcggacgagggcaagatggcagaagtagagcagaagaagaagcggaccttccgcaagttcacctaccgcggcgtggacctcgaccagctgctggacatgtcctacgagcagctgatgcagctgtacagtgcgcgccagcggcggcggctgaaccggggcctgcggcggaagcagcactccctgctgaagcgcctgcgcaaggccaagaaggaggcgccgcccatggagaagccggaagtggtgaagacgcacctgcgggacatgatcatcctacccgagatggtgggcagcatggtgggcgtctacaacggcaagaccttcaaccaggtggagatcaagcccgagatgatcggccactacctgggcgagttctccatcacctacaagcccgtaaagcatggccggcccggcatcggggccacccactcctcccgcttcatccctctcaagtaatggctcagctaataaaggcgcacatgactcca

SEQ ID NO: 445691 - DNA, 682 bp, Homo sapiens
  misc_feature (17)..(18): n is a, c, g, or t
agaagagcctacatggnnacgataccttgaagctgttctgttactctgggctctcatcctctcctattatacagtgaaagcctgtttcaacagaagtaaagagtaaaaaaaaaataggttatgaactcctgcagctatgtctcccaagataataatattgtaaactcaaaagctactaccccatggcctcgtccgaattcggcacgagcaagatggcagaagtagagcagaagaagaagcggaccttccgcaagttcacctaccgcggcgtggacctcgaccagctgctggacatgtcctacgagcagctgatgcagctgtacagtgcgcgccagcggcggcggctgaaccggggcctgcggcggaagcagcactccctgctgaagcgcctgcgcaaggccaagaaggaggcgccgcccatggagaagccggaagtggtgaagacgcacctgcgggacatgatcatcctacccgagatggtgggcagcatggtgggcgtctacaacggcaagaccttcaaccaggtggagatcaagcccgagatgatcggccactacctgggcgagttctccatcacctacaagcccgtaaagcatggccggcccggcatcggggccacccactcctcccgcttcatccctctcaagtaatggctcagctaataaaggcgcacatgactcca

SEQ ID NO: 445692 - DNA, 480 bp, Homo sapiens
acaaaatatggggagtagatcacacaaagcaatcggatctgagcagctaacgttcacctaccgcggcgtggacctcgaccagctgctggacatgtcctacgagcagctgatgcagctgtacagtgcgcgccagcggcggcggctgaaccggggcctgcggcggaagcagcactccctgctgaagcgcctgcgcaaggccaagaaggaggcgccgcccatggagaagccggaagtggtgaagacgcacctgcgggacatgatcatcctacccgagatggtgggcagcatggtgggcgtctacaacggcaagaccttcaaccaggtggagatcaagcccgagatgatcggccactacctgggcgagttctccatcacctacaagcccgtaaagcatggccggcccggcatcggggccacccactcctcccgcttcatccctctcaagtaatggctcagctaataaaggcgcacatgactcca

SEQ ID NO: 445693 - DNA, 856 bp, Homo sapiens
  misc_feature (17)..(18): n is a, c, g, or t
agaagagcctacatggnnacgataccttgaagctgttctgttactctgggctctcatcctctcctattatacagtgaaagcctgtttcaacagaagtaaagagtaaaaaaaaaataggttatgaactcctgcagctatgtctcccaagataataatattgtaaactcaaaagctactaccccatggcctcgtccgaattcggcacgagcaagatggcagaagtagagcagaagaagaagcggaccttccgcaagttcacctaccgcggcgtggacctcgaccagctgctggacatgtcctacgagcagctgatgcagctgtacagtgcgcgccagcggcggcggctgaaccggggcctgcggcggaagcagcactccctgctgaagcgcctgcgcaaggccaagaaggaggcgccgcccatggagaagccggaagtggtgaagacgcacctgcgggacatgatcatcctacccgagatggtgggcagcatggtgggcgtctacaacggcaagaccttcaaccaggtggagatcaagcccgagatgatcggccactacctgggcgagttctccatcacctacaagcccgtaaagcatggccggcccggcatcggggccacccactcctcccgcttcatccctctcaagtaatggctcagctaataaaggcgcacatgactccaaaaaaaaaaaaaaaaaaaaaaaaaaaaacagtcgtattacgattcatgtggcggtggttttacaacgttcgtgaattggccctggtgttaccaagtttattcgccttgcgcacatccccttttgcagatggggtaataccaagaggcccgacggttggctttccgagttgtccc

SEQ ID NO: 445694 - DNA, 1907 bp, Homo sapiens
ttaggctagtagaggctggggtgaatcggacgagggcaagatggcagaagtagagcagaagaagaagcggaccttccgcaagttcacctaccgcggcgtggacctcgaccagctgctggacatgtcctacgagcagctgatgcagctgtacagtgcgcgccagcggcggcggctgaaccggggcctgcggcggaagcagcactccctgctgaagcgcctgcgcaaggccaagaaggaggcgccgcccatggagaagccggaagtggtgaagacgcacctgcgggacatgatcatcctacccgagatggtgggcagcatggtgggcgtctacaacggcaagaccttcaaccaggtggagatcaagcccgagatgatcggccactacctgggcgagttctccatcacctacaagcccgtaaagcatggccggcccggcatcggggccacccactcctcccgcttcatccctctcaagtaatggctcagctaataaaggcgcacatgactccaaaaaaaaacaaaaaaaacccgagactagttctctctgtcgagattgcgcggccgttggggcgtgcaggggcgccagtcggcggacgaggggcccccgggagtttgctggactggagacatgagcctccaactggtgtggtggggctcggtagcccattcgggggacttgggttgtgcgcccacagattggtttggccctgcgtgaccagagcagcccaagccgccaccttggtgaaattgctagtggccaaaatcctgtgcatggtgggcgtgttcttcttcatgctgctcggctccctgctccccgtgaagatcatcgagacagattttgagaaggcccatcgctcgaaaaagatcctctctctctgcaacacctttggaggaggggtgtttctggccacgtgcttcaacgctctgctgcccgctgtgagggaaaagctccagaaggtcctgagcctcggccacatcagcaccgactacccgctggccgaaaccatcctcctgctgggcttcttcatgaccgtcttcctggagcagctgatcctgaccttccgcaaggagaagccgtccttcatcgacctggagaccttcaacgccggatcggacgtgggcagcgactcggagtatgagagccccttcatggggggcgcgcggggccacgcgctgtacgtggagccccacggccacggccccagcctgagcgtgcagggcctctcgcgcgccagccccgtgcgcctgctcagcctggccttcgcgctgtcggcccactcggtctttgagggcctggccctgggcctgcaggaggagggggagaaagtggtgagcctgttcgtgggggtggccgtccacgagacactggtggccgtggccctgggcatcagcatggcccggagtgccatgcccctgcgggacgcggccaagctggcggtcaccgtaagcgccatgatccccctgggcatcggcctgggcctgggcattgagagcgcccagggcgtgccgggcagcgtggcgtccgtgctgctgcagggcctggcgggcggcaccttcctcttcatcaccttcctggagatcctggccaaggagctggaggagaagagtgaccgtctgctcaaggtcctcttcctggtgctgggctacaccgtcctggccgggatggtcttcctcaagtggtgagcggcctcgccattgtccctgccgccggagcccgccgggagccccgggccggacacaggccgcgtcccccggccgcgcgtcccccaagagcgagcactgtggccctgggccaccacctgtgcacaaggggcctcccgggaccaggctgtgcccccgatcctacaccctgagcctcagagcactgctactttttaaaatacttctttctcttaaaagtctttacc

SEQ ID NO: 445695 - DNA, 1092 bp, Homo sapiens
gggtctgtcagggttggaaagtccaagccgtaggacccagtttcctttcttagctgatgtctttggccagaacaccgtgggctgttacttgctttgagttggaagcggtttgcatttacgcctgtaaatgtattcattcttaatgttatgtaaggttttttttgtacgcaattctcgattctttgaagagatgacaacaaattttggttttctactgttatgtgagaacattaggccccagcaacacgtcattgtgtaaggaaaaataaaagtgcgcaagatggcagaagtagagcagaagaagaagcggaccttccgcaagttcacctaccgcggcgtggacctcgaccagctgctggacatgtcctacgagcagctgatgcagctgtacagtgcgcgccagcggcggcggctgaaccggggcctgcggcggaagcagcactccctgctgaagcgcctgcgcaaggccaagaaggaggcgccgcccatggagaagccggaagtggtgaagacgcacctgcgggacatgatcatcctacccgagatggtgggcagcatggtgggcgtctacaacggcaagaccttcaaccaggtggagatcaagcccgagatgatcggccactacctgggcgagttctccatcacctacaagcccgtaaagcatggccggcccggcatcggggccacccactcctcccgcttcatccctctcaagtaatggctcagctaataaaggcgcacatgactccaaaaaaaaaaaaaaaaaaaaagaaaaaaaaaaaaaaaaaaaaaaaaagagggggggcgcgcaccaagaacacacccaggagcgccacaaaacagggcaccaccgatatgggccaaaggggcccaaagaggcggccctaaaacacgaagacacggcgcgcgtaacaacacgccagacgacgggaaaccggcaacgcggacaatgggaaacgcacccaccaccggggcgggccaacactggcgcaccaccctccacgaatataccctcggggcctctcaattccagtgtatcgttgctaaccccggtatattcgctgagaactgcccacgcactgttgaaattcg

SEQ ID NO: 445696 - DNA, 1006 bp, Homo sapiens
ccacgcgtccgcccacgcgtcgcggacgcgtgggtcgacccacgcgtcgggcaagatggcagaagtagagcagaagaagaagcggaccttccgcaagttcacctaccgcggcgtggacctcgaccagctgctggacatgtcctacgagcagctgatgcagctgtacagtgcgcgccagcggcggcggctgaaccggggcctgcggcggaagcagcactccctgctgaagcgcctgcgcaaggccaagaaggaggcgccgcccatggagaagccggaagtggtgaagacgcacctgcgggacatgatcatcctacccgagatggtgggcagcatggtgggcgtctacaacggcaagaccttcaaccaggtggagatcaagcccgagatgatcggccactacctgggcgagttctccatcacctacaagcccgtaaagcatggccggcccggcatcggggccacccactcctcccgcttcatccctctcaagtaatggctcagctaataaaggcgcacatgactccaaaaaaaaaaaaaacaaacaaaaggggcttctaatgtgccgggtgtgcgcgggaaaacggggtgtactggaatggggccctggggccaaagctgttccttggccccagtttctttgtgccaagggggaaaatcggcgcggaccccctaagaggggagcccgcaataacttccgaaaagcccggttaaccggatagaaccgcgcgcgacaaggcccgcccacgccaccacgcagagcgcgcgggggacgaccgccgaagagacaagacacgcggcgccccgaaaacagagcaaaaaccacagccccaggagaaaacaacaggaggcacgcgaacagagagaacgtgcggagagcaaacgcgggcagaccgggggagcgggccggggggcgaggaagagcgcagaagcacgcggacaggggcgcccgcagggggagaggacaggacggagcggcgggacgggaggcggggcgggtgcggaaccc

SEQ ID NO: 445697 - DNA, 850 bp, Homo sapiens
ccacgcgtccgcccacgcgtcgcggacgcgtgggtcgacccacgcgtcgggcaagatggcagaagtagagcagaagaagaagcggaccttccgcaagttcacctaccgcggcgtggacctcgaccagctgctggacatgtcctacgagcagctgatgcagctgtacagtgcgcgccagcggcggcggctgaaccggggcctgcggcggaagcagcactccctgctgaagcgcctgcgcaaggccaagaaggaggcgccgcccatggagaagccggaagtggtgaagacgcacctgcgggacatgatcatcctacccgagatggtgggcagcatggtgggcgtctacaacggcaagaccttcaaccaggtggagatcaagcccgagatgatcggccactacctgggcgagttctccatcacctacaagcccgtaaagcatggccggcccggcatcggggccacccactcctcccgcttcatccctctcaagtaatggctcagctaataaaggcgcacatgactccaaaaaaaaaaaaaaaaaaaaagaaaaaaaaaaaaaaaaaaaagggggggggggcctaaaagttcccccgggggggccacgaaattagacgcactaacccgcgcaattgtggaccaagaggggccccacaaaggagcgcgaataaaacgccaaagcacaggggcgagcgaaaacagtcacccagaggaacaacgccacgagtgcaattggggaggaccccactcggggatgacaaagggcccaacccccccgggataagcgccagcgccacaaacagacggtaaagggcaaacagccgatagtgcgcggacagggagcgaagcgaat

SEQ ID NO: 445698 - DNA, 320 bp, Homo sapiens
gcgtcgacaccacttccggcttctccatgggcggcgctccttcttggccttgcgcaggcgcttcagccggaagtggtgaagacgcacctgcgggacatgatcatcctacccgagatggtgggcagcatggtgggcgtctacaacggcaagaccttcaaccaggtggagatcaagcccgagatgatcggccactacctgggcgagttctccatcacctacaagcccgtaaagcatggccggcccggcatcggggccacccactcctcccgcttcatccctctcaagtaatggctcagctaataaaggcgcacatgactcca

SEQ ID NO: 445699 - DNA, 211 bp, Homo sapiens
aattcgcggccgcgtcgacaagacgacagaagggcggcaagaccttcaaccaggtggagatcaagcccgagatgatcggccactacctgggcgagttctccatcacctacaagcccgtaaagcatggccggcccggcatcggggccacccactcctcccgcttcatccctctcaagtaatggctcagctaataaaggcgcacatgactcca

SEQ ID NO: 445700 - DNA, 929 bp, Homo sapiens
cgagggggcgggacatgccggcagtctcgcgataactgcgcaggcgcggaccaaagcgatctcttctgaggatccggcaagatggtgagtgttgcgatttggcgcgtctctgccgggcctatccggctccatccaacctctgaccgtctcgcgggggccgcagttcgtccccgcggctacggcggcttgctcccgaccctgcaggcggctggatgttggggcgaggggcggacttggtgggtgtcgggacgacgcggggctgggaaggcctgtccgggccttcatgtccgggtcctcgtaacccggagccgcgagtgatccccggggacgggtcgaagcggtgtgtccctgtcgggcttctgtccccggcggcgccgcgcgtcttccgcggtgtcctcgggcccggtggccccgggagatgggtgtcgggatcccgctgacgcccgatccgcgcccgcacaggcagaagtagagcagaagaagaagcggaccttccgcaagttcacctaccgcggcgtggacctcgaccagctgctggacatgtcctacgagcagctgatgcagctgtacagtgcgcgccagcggcggcggctgaaccggggcctgcggcggaagcagcactccctgctgaagcgcctgcgcaaggccaagaaggaggcgccgcccatggagaagccggaagtggtgaagacgcacctgcgggacatgatcatcctacccgagatggtgggcagcatggtgggcgtctacaacggcaagaccttcaaccaggtggagatcaagcccgagatgatcggccactacctgggcgagttctccatcacctacaagcccgtaaagcatggccggcccggcatcggggccacccactcctcccgcttcatccctctcaagtaatggctcagctaataaaggcgcacatgactcca

SEQ ID NO: 445701 - DNA, 703 bp, Homo sapiens
cgagggggcgggacatgccggcagtctcgcgataactgcgcaggcgcggaccaaagcgatctcttctgaggatccggcaagatggtgagtgttgcgatttggcgcgtctctgccgggcctatccggctccatccaacctctgaccgtctcgcgggggccgcagttcgtccccgcggctacggcggcttgctcccgaccctgcaggcggctggatgttggggcgaggggcggacttggcagaagtagagcagaagaagaagcggaccttccgcaagttcacctaccgcggcgtggacctcgaccagctgctggacatgtcctacgagcagctgatgcagctgtacagtgcgcgccagcggcggcggctgaaccggggcctgcggcggaagcagcactccctgctgaagcgcctgcgcaaggccaagaaggaggcgccgcccatggagaagccggaagtggtgaagacgcacctgcgggacatgatcatcctacccgagatggtgggcagcatggtgggcgtctacaacggcaagaccttcaaccaggtggagatcaagcccgagatgatcggccactacctgggcgagttctccatcacctacaagcccgtaaagcatggccggcccggcatcggggccacccactcctcccgcttcatccctctcaagtaatggctcagctaataaaggcgcacatgactcca

SEQ ID NO: 445702 - DNA, 559 bp, Homo sapiens
  misc_feature (13)..(13): n is a, c, g, or t
  misc_feature (43)..(43): n is a, c, g, or t
  misc_feature (50)..(50): n is a, c, g, or t
ttttaaaaccccnttttactactactactactactactactangctgctnagaagacgactgaaggggctcttctgaggatccggcaagatggcagaagtagagcagaagaagaagcggaccttccgcaagttcacctaccgcggcgtggacctcgaccagctgctggacatgtcctacgagcagctgatgcagctgtacagtgcgcgccagcggcggcggctgaaccggggcctgcggcggaagcagcactccctgctgaagcgcctgcgcaaggccaagaaggaggcgccgcccatggagaagccggaagtggtgaagacgcacctgcgggacatgatcatcctacccgagatggtgggcagcatggtgggcgtctacaacggcaagaccttcaaccaggtggagatcaagcccgagatgatcggccactacctgggcgagttctccatcacctacaagcccgtaaagcatggccggcccggcatcggggccacccactcctcccgcttcatccctctcaagtaatggctcagctaataaaggcgcacatgactcca

SEQ ID NO: 445703 - DNA, 492 bp, Homo sapiens
gagtgtggtggaattcggcaagatggcagaagtagagcagaagaagaagcggaccttccgcaagttcacctaccgcggcgtggacctcgaccagctgctggacatgtcctacgagcagctgatgcagctgtacagtgcgcgccagcggcggcggctgaaccggggcctgcggcggaagcagcactccctgctgaagcgcctgcgcaaggccaagaaggaggcgccgcccatggagaagccggaagtggtgaagacgcacctgcgggacatgatcatcctacccgagatggtgggcagcatggtgggcgtctacaacggcaagaccttcaaccaggtggagatcaagcccgagatgatcggccactacctgggcgagttctccatcacctacaagcccgtaaagcatggccggcccggcatcggggccacccactcctcccgcttcatccctctcaagtaatggctcagctaataaaggcgcacatgactcca

SEQ ID NO: 445704 - DNA, 750 bp, Homo sapiens
gggtctgtcagggttggaaagtccaagccgtaggacccagtttcctttcttagctgatgtctttggccagaacaccgtgggctgttacttgctttgagttggaagcggtttgcatttacgcctgtaaatgtattcattcttaatgttatgtaaggttttttttgtacgcaattctcgattctttgaagagatgacaacaaattttggttttctactgttatgtgagaacattaggccccagcaacacgtcattgtgtaaggaaaaataaaagtgcgcaagatggcagaagtagagcagaagaagaagcggaccttccgcaagttcacctaccgcggcgtggacctcgaccagctgctggacatgtcctacgagcagctgatgcagctgtacagtgcgcgccagcggcggcggctgaaccggggcctgcggcggaagcagcactccctgctgaagcgcctgcgcaaggccaagaaggaggcgccgcccatggagaagccggaagtggtgaagacgcacctgcgggacatgatcatcctacccgagatggtgggcagcatggtgggcgtctacaacggcaagaccttcaaccaggtggagatcaagcccgagatgatcggccactacctgggcgagttctccatcacctacaagcccgtaaagcatggccggcccggcatcggggccacccactcctcccgcttcatccctctcaagtaatggctcagctaataaaggcgcacatgactcca

SEQ ID NO: 445705 - DNA, 1120 bp, Homo sapiens
cgagggggcgggacatgccggcagtctcgcgataactgcgcaggcgcggaccaaagcgatctcttctgaggatccggcaagatggtgagtgttgcgatttggcgcgtctctgccgggcctatccggctccatccaacctctgaccgtctcgcgggggccgcagttcgtccccgcggctacggcggcttgctcccgaccctgcaggcggctggatgttggggcgaggggcggacttggtgggtgtcgggacgacgcggggctgggaaggcctgtccgggccttcatgtccgggtcctcgtaacccggagccgcgagtgatccccggggacgggtcgaagcggtgtgtccctgtcgggcttctgtccccggcggcgccgcgcgtcttccgcggtgtcctcgggcccggtggccccgggagatgggtgtcgggatcccgctgacgcccgatccgcgcccgcacaggcagaagtagagcagaagaagaagcggaccttccgcaagttcacctaccgcggcgtggacctcgaccagctgctggacatgtcctacgagcagctgatgcagctgtacagtgcgcgccagcggcggcggctgaaccggggcctgcggcggaagcagcactccctgctgaagcgcctgcgcaaggccaagaaggaggcgccgcccatggagaagccggaagtggtgaagacgcacctgcgggacatgatcatcctacccgagatggtgggcagcatggtgggcgtctacaacggcaagaccttcaaccaggtggagatcaagcccgagatgatcggccactacctgggcgagttctccatcacctacaagcccgtaaagcatggccggcccggcatcggggccacccactcctcccgcttcatccctctcaagtaatggctcagctaataaaggcgcacatgactccaaaaaaaaaaaaaaaaaaaaaaaaaaaaacaaaaaaaaaaaaaaaaaaaaaaaaaaaaccggggggtcttttttggggggggggaaaaaaggggttttggaaaggggccctttgggccatgtgttgtttcttggccccattttttttttcccaaggggggaaaatctcggggggtccccctattaggggggg

SEQ ID NO: 445706 - DNA, 1322 bp, Homo sapiens
cgagggggcgggacatgccggcagtctcgcgataactgcgcaggcgcggaccaaagcgatctcttctgaggatccggcaagatggtgagtgttgcgatttggcgcgtctctgccgggcctatccggctccatccaacctctgaccgtctcgcgggggccgcagttcgtccccgcggctacggcggcttgctcccgaccctgcaggcggctggatgttggggcgaggggcggacttggtgggtgtcgggacgacgcggggctgggaaggcctgtccgggccttcatgtccgggtcctcgtaacccggagccgcgagtgatccccggggacgggtcgaagcggtgtgtccctgtcgggcttctgtccccggcggcgccgcgcgtcttccgcggtgtcctcgggcccggtggccccgggagatgggtgtcgggatcccgctgacgcccgatccgcgcccgcacaggcagaagtagagcagaagaagaagcggaccttccgcaagttcacctaccgcggcgtggacctcgaccagctgctggacatgtcctacgagcagctgatgcagctgtacagtgcgcgccagcggcggcggctgaaccggggcctgcggcggaagcagcactccctgctgaagcgcctgcgcaaggccaagaaggaggcgccgcccatggagaagccggaagtggtgaagacgcacctgcgggacatgatcatcctacccgagatggtgggcagcatggtgggcgtctacaacggcaagaccttcaaccaggtggagatcaagcccgagatgatcggccactacctgggcgagttctccatcacctacaagcccgtaaagcatggccggcccggcatcggggccacccactcctcccgcttcatccctctcaagtaatggctcagctaataaaggcgcacatgactccaaaaaaaaaaaaaaaaaaaaaaaaaaaaacaaaaaaaaaaaaacaaacaaaaaaaaaaaaaaaaaaaaaaaagaaaaaaaaaaaaaaaaaaaaaaaaagagggggggcgcgcaccaagaacacacccaggagcgccacaaaacagggcaccaccgatatgggccaaaggggcccaaagaggcggccctaaaacacgaagacacggcgcgcgtaacaacacgccagacgacgggaaaccggcaacgcggacaatgggaaacgcacccaccaccggggcgggccaacactggcgcaccaccctccacgaatataccctcggggcctctcaattccagtgtatcgttgctaaccccggtatattcgctgagaactgcccacgcactgttgaaattcg

SEQ ID NO: 445707 - DNA, 894 bp, Homo sapiens
cgagggggcgggacatgccggcagtctcgcgataactgcgcaggcgcggaccaaagcgatctcttctgaggatccggcaagatggtgagtgttgcgatttggcgcgtctctgccgggcctatccggctccatccaacctctgaccgtctcgcgggggccgcagttcgtccccgcggctacggcggcttgctcccgaccctgcaggcggctggatgttggggcgaggggcggacttggcagaagtagagcagaagaagaagcggaccttccgcaagttcacctaccgcggcgtggacctcgaccagctgctggacatgtcctacgagcagctgatgcagctgtacagtgcgcgccagcggcggcggctgaaccggggcctgcggcggaagcagcactccctgctgaagcgcctgcgcaaggccaagaaggaggcgccgcccatggagaagccggaagtggtgaagacgcacctgcgggacatgatcatcctacccgagatggtgggcagcatggtgggcgtctacaacggcaagaccttcaaccaggtggagatcaagcccgagatgatcggccactacctgggcgagttctccatcacctacaagcccgtaaagcatggccggcccggcatcggggccacccactcctcccgcttcatccctctcaagtaatggctcagctaataaaggcgcacatgactccaaaaaaaaaaaaaaaaaaaaaaaaaaaaacaaaaaaaaaaaaaaaaaaaaaaaaaaaaccggggggtcttttttggggggggggaaaaaaggggttttggaaaggggccctttgggccatgtgttgtttcttggccccattttttttttcccaaggggggaaaatctcggggggtccccctattaggggggg

SEQ ID NO: 445708 - DNA, 722 bp, Homo sapiens
aagcatggtatcaacgcagagttgccattacggccgggggctcttctgaggatccggcaagatggcagaagtagagcagaagaagaagcggaccttccgcaagttcacctaccgcggcgtggacctcgaccagctgctggacatgtcctacgagcagctgatgcagctgtacagtgcgcgccagcggcggcggctgaaccggggcctgcggcggaagcagcactccctgctgaagcgcctgcgcaaggccaagaaggaggcgccgcccatggagaagccggaagtggtgaagacgcacctgcgggacatgatcatcctacccgagatggtgggcagcatggtgggcgtctacaacggcaagaccttcaaccaggtggagatcaagcccgagatgatcggccactacctgggcgagttctccatcacctacaagcccgtaaagcatggccggcccggcatcggggccacccactcctcccgcttcatccctctcaagtaatggctcagctaataaaggcgcacatgactccaaaaaaaaaaaaaaaaaaaaaaaaaaaaacaaaaaaaaaaaaaaaaaaaaaaaaaaaaccggggggtcttttttggggggggggaaaaaaggggttttggaaaggggccctttgggccatgtgttgtttcttggccccattttttttttcccaaggggggaaaatctcggggggtccccctattaggggggg

SEQ ID NO: 445709 - DNA, 845 bp, Homo sapiens
  misc_feature (745)..(745): n is a, c, g, or t
aagcatggtatcaacgcagagttgccattacggccgggggctcttctgaggatccggcaagatggcagaagtagagcagaagaagaagcggaccttccgcaagttcacctaccgcggcgtggacctcgaccagctgctggacatgtcctacgagcagctgatgcagctgtacagtgcgcgccagcggcggcggctgaaccggggcctgcggcggaagcagcactccctgctgaagcgcctgcgcaaggccaagaaggaggcgccgcccatggagaagccggaagtggtgaagacgcacctgcgggacatgatcatcctacccgagatggtgggcagcatggtgggcgtctacaacggcaagaccttcaaccaggtggagatcaagcccgagatgatcggccactacctgggcgagttctccatcacctacaagcccgtaaagcatggccggcccggcatcggggccacccactcctcccgcttcatccctctcaagtaatggctcagctaataaaggcgcacatgactccaaaaaaaaaaaaaaaaaaaaaaaaaaaaaccgcggggccataataggggggggggggaaaaagagggtatgcaaagtgcgacagtgtggccaaaggcgtgcttctcctggccccatttttttgtccccaggcggaaaactggggggaccccataggggaggggattaaaatgtgcgaaaagcggcggtgactcgttatattgttgtgaaaagacngggagagaagaaaggaaggagagggaggggataacaagtggcgacagtaaaaaggaggtgagagaagcagatctagaacagtgagaggaaataaaaaagt

SEQ ID NO: 445710 - DNA, 704 bp, Homo sapiens
gaggaaaaggggaaactaggctaggaacgaggctgggtgttagatggcagaagtagagcagaagaagaagcggaccttccgcaagttcacctaccgcggcgtggacctcgaccagctgctggacatgtcctacgagcagctgatgcagctgtacagtgcgcgccagcggcggcggctgaaccggggcctgcggcggaagcagcactccctgctgaagcgcctgcgcaaggccaagaaggaggcgccgcccatggagaagccggaagtggtgaagacgcacctgcgggacatgatcatcctacccgagatggtgggcagcatggtgggcgtctacaacggcaagaccttcaaccaggtggagatcaagcccgagatgatcggccactacctgggcgagttctccatcacctacaagcccgtaaagcatggccggcccggcatcggggccacccactcctcccgcttcatccctctcaagtaatggctcagctaataaaggcgcacatgactccaaaaaaaaaaaaaaaaaaaaaaaaaaaaacaaaaaaaaaaaaaaaaaaaaaaaaaaaaccggggggtcttttttggggggggggaaaaaaggggttttggaaaggggccctttgggccatgtgttgtttcttggccccattttttttttcccaaggggggaaaatctcggggggtccccctattaggggggg

SEQ ID NO: 445711 - DNA, 1415 bp, Homo sapiens
cgagggggcgggacatgccggcagtctcgcgataactgcgcaggcgcggaccaaagcgatctcttctgaggatccggcaagatggtgagtgttgcgatttggcgcgtctctgccgggcctatccggctccatccaacctctgaccgtctcgcgggggccgcagttcgtccccgcggctacggcggcttgctcccgaccctgcaggcggctggatgttggggcgaggggcggacttggtgggtgtcgggacgacgcggggctgggaaggcctgtccgggccttcatgtccgggtcctcgtaacccggagccgcgagtgatccccggggacgggtcgaagcggtgtgtccctgtcgggcttctgtccccggcggcgccgcgcgtcttccgcggtgtcctcgggcccggtggccccgggagatgggtgtcgggatcccgctgacgcccgatccgcgcccgcacaggcagaagtagagcagaagaagaagcggaccttccgcaagttcacctaccgcggcgtggacctcgaccagctgctggacatgtcctacgagcagctgatgcagctgtacagtgcgcgccagcggcggcggctgaaccggggcctgcggcggaagcagcactccctgctgaagcgcctgcgcaaggccaagaaggaggcgccgcccatggagaagccggaagtggtgaagacgcacctgcgggacatgatcatcctacccgagatggtgggcagcatggtgggcgtctacaacggcaagaccttcaaccaggtggagatcaagcccgagatgatcggccactacctgggcgagttctccatcacctacaagcccgtaaagcatggccggcccggcatcggggccacccactcctcccgcttcatccctctcaagtaatggctcagctaataaaggcgcacatgactccaaaaaaaaaaaaaaaaaaaaaaaaaaaaacttcgagacttagttctcctctctcggggctcacggccttgtaattcccagcactttggggaggcagaaggcgggcggactcatgaggctcgggagaattcgagacccttccttggttaacgacaggtgaaaccccggttttattagaattacaaaaaatattagcgggggcgtcggggcgggcgcttgtagtccccagtacctggggagggtgagggcagggaaaattggcgtttaaaccccgggaggggggaacttggcagttgagcccgaaaaatccgggacgaaagagggggagaactccggtcttaaaagaaaacatatgacagtcgtatattacagtccaagaggaaaacacccggggggcttatttggaggcgggaaaaacaaataataaagaggcagacgcactatgtttttcgcgcccttttttgtaaaaggggaacttgggggccaca

SEQ ID NO: 445712 - DNA, 1271 bp, Homo sapiens
cgagggggcgggacatgccggcagtctcgcgataactgcgcaggcgcggaccaaagcgatctcttctgaggatccggcaagatggtgagtgttgcgatttggcgcgtctctgccgggcctatccggctccatccaacctctgaccgtctcgcgggggccgcagttcgtccccgcggctacggcggcttgctcccgaccctgcaggcggctggatgttggggcgaggggcggacttggtgggtgtcgggacgacgcggggctgggaaggcctgtccgggccttcatgtccgggtcctcgtaacccggagccgcgagtgatccccggggacgggtcgaagcggtgtgtccctgtcgggcttctgtccccggcggcgccgcgcgtcttccgcggtgtcctcgggcccggtggccccgggagatgggtgtcgggatcccgctgacgcccgatccgcgcccgcacaggcagaagtagagcagaagaagaagcggaccttccgcaagttcacctaccgcggcgtggacctcgaccagctgctggacatgtcctacgagcagctgatgcagctgtacagtgcgcgccagcggcggcggctgaaccggggcctgcggcggaagcagcactccctgctgaagcgcctgcgcaaggccaagaaggaggcgccgcccatggagaagccggaagtggtgaagacgcacctgcgggacatgatcatcctacccgagatggtgggcagcatggtgggcgtctacaacggcaagaccttcaaccaggtggagatcaagcccgagatgatcggccactacctgggcgagttctccatcacctacaagcccgtaaagcatggccggcccggcatcggggccacccactcctcccgcttcatccctctcaagtaatggctcagctaataaaggcgcacatgactccaaaaaaaaaaaaaaaaaaaaagaaaaaaaaaaaaaaaaaaaaaaaaagagggggggcgcgcaccaagaacacacccaggagcgccacaaaacagggcaccaccgatatgggccaaaggggcccaaagaggcggccctaaaacacgaagacacggcgcgcgtaacaacacgccagacgacgggaaaccggcaacgcggacaatgggaaacgcacccaccaccggggcgggccaacactggcgcaccaccctccacgaatataccctcggggcctctcaattccagtgtatcgttgctaaccccggtatattcgctgagaactgcccacgcactgttgaaattcg

SEQ ID NO: 445713 - DNA, 1199 bp, Homo sapiens
cgagggggcgggacatgccggcagtctcgcgataactgcgcaggcgcggaccaaagcgatctcttctgaggatccggcaagatggtgagtgttgcgatttggcgcgtctctgccgggcctatccggctccatccaacctctgaccgtctcgcgggggccgcagttcgtccccgcggctacggcggcttgctcccgaccctgcaggcggctggatgttggggcgaggggcggacttggtgggtgtcgggacgacgcggggctgggaaggcctgtccgggccttcatgtccgggtcctcgtaacccggagccgcgagtgatccccggggacgggtcgaagcggtgtgtccctgtcgggcttctgtccccggcggcgccgcgcgtcttccgcggtgtcctcgggcccggtggccccgggagatgggtgtcgggatcccgctgacgcccgatccgcgcccgcacaggcagaagtagagcagaagaagaagcggaccttccgcaagttcacctaccgcggcgtggacctcgaccagctgctggacatgtcctacgagcagctgatgcagctgtacagtgcgcgccagcggcggcggctgaaccggggcctgcggcggaagcagcactccctgctgaagcgcctgcgcaaggccaagaaggaggcgccgcccatggagaagccggaagtggtgaagacgcacctgcgggacatgatcatcctacccgagatggtgggcagcatggtgggcgtctacaacggcaagaccttcaaccaggtggagatcaagcccgagatgatcggccactacctgggcgagttctccatcacctacaagcccgtaaagcatggccggcccggcatcggggccacccactcctcccgcttcatccctctcaagtaatggctcagctaataaaggcgcacatgactccatcacctacaagcccgtaaagcatggccggccggcatcggggcacccactcctcccgcttcatccctctcaagtaatggctcagctaataaaggcgcacatgactccaaaaaaaaaaaaaaaaaaaaaaaaaaaaaaccggggggtcttttttggggggggggaaaaaaggggttttggaaaggggccctttgggccatgtgttgtttcttggccccattttttttttcccaaggggggaaaatctcggggggtccccctattaggggggg

SEQ ID NO: 445714 - DNA, 1091 bp, Homo sapiens
cgagggggcgggacatgccggcagtctcgcgataactgcgcaggcgcggaccaaagcgatctcttctgaggatccggcaagatggtgagtgttgcgatttggcgcgtctctgccgggcctatccggctccatccaacctctgaccgtctcgcgggggccgcagttcgtccccgcggctacggcggcttgctcccgaccctgcaggcggctggatgttggggcgaggggcggacttggtgggtgtcgggacgacgcggggctgggaaggcctgtccgggccttcatgtccgggtcctcgtaacccggagccgcgagtgatccccggggacgggtcgaagcggtgtgtccctgtcgggcttctgtccccggcggcgccgcgcgtcttccgcggtgtcctcgggcccggtggccccgggagatgggtgtcgggatcccgctgacgcccgatccgcgcccgcacaggcagaagtagagcagaagaagaagcggaccttccgcaagttcacctaccgcggcgtggacctcgaccagctgctggacatgtcctacgagcagctgatgcagctgtacagtgcgcgccagcggcggcggctgaaccggggcctgcggcggaagcagcactccctgctgaagcgcctgcgcaaggccaagaaggaggcgccgcccatggagaagccggaagtggtgaagacgcacctgcgggacatgatcatcctacccgagatggtgggcagcatggtgggcgtctacaacggcaagaccttcaaccaggtggagatcaagcccgagatgatcggccactacctgggcgagttctccatcacctacaagcccgtaaagcatggccggcccggcatcggggccacccactcctcccgcttcatccctctcaagtaatggctcagctaataaaggcgcacatgactccaaaaaaaaaaaaaaaaaaaaaaaaaaaaaccggggggtcttttttggggggggggaaaaaaggggttttggaaaggggccctttgggccatgtgttgtttcttggccccattttttttttcccaaggggggaaaatctcggggggtccccctattaggggggg

SEQ ID NO: 445715 - DNA, 1254 bp, Homo sapiens
cgagggggcgggacatgccggcagtctcgcgataactgcgcaggcgcggaccaaagcgatctcttctgaggatccggcaagatggtgagtgttgcgatttggcgcgtctctgccgggcctatccggctccatccaacctctgaccgtctcgcgggggccgcagttcgtccccgcggctacggcggcttgctcccgaccctgcaggcggctggatgttggggcgaggggcggacttggtgggtgtcgggacgacgcggggctgggaaggcctgtccgggccttcatgtccgggtcctcgtaacccggagccgcgagtgatccccggggacgggtcgaagcggtgtgtccctgtcgggcttctgtccccggcggcgccgcgcgtcttccgcggtgtcctcgggcccggtggccccgggagatgggtgtcgggatcccgctgacgcccgatccgcgcccgcacaggcagaagtagagcagaagaagaagcggaccttccgcaagttcacctaccgcggcgtggacctcgaccagctgctggacatgtcctacgagcagctgatgcagctgtacagtgcgcgccagcggcggcggctgaaccggggcctgcggcggaagcagcactccctgctgaagcgcctgcgcaaggccaagaaggaggcgccgcccatggagaagccggaagtggtgaagacgcacctgcgggacatgatcatcctacccgagatggtgggcagcatggtgggcgtctacaacggcaagaccttcaaccaggtggagatcaagcccgagatgatcggccactacctgggcgagttctccatcacctacaagcccgtaaagcatggccggcccggcatcggggccacccactcctcccgcttcatccctctcaagtaatggctcagctaataaaggcgcacatgactccaaaaaaaaaaaaaaaaaaaaagaaaaaaaaaaaaaaaaaaaagggggggggggcctaaaagttcccccgggggggccacgaaattagacgcactaacccgcgcaattgtggaccaagaggggccccacaaaggagcgcgaataaaacgccaaagcacaggggcgagcgaaaacagtcacccagaggaacaacgccacgagtgcaattggggaggaccccactcggggatgacaaagggcccaacccccccgggataagcgccagcgccacaaacagacggtaaagggcaaacagccgatagtgcgcggacagggagcgaagcgaat

SEQ ID NO: 445716 - DNA, 1123 bp, Homo sapiens
cgagggggcgggacatgccggcagtctcgcgataactgcgcaggcgcggaccaaagcgatctcttctgaggatccggcaagatggtgagtgttgcgatttggcgcgtctctgccgggcctatccggctccatccaacctctgaccgtctcgcgggggccgcagttcgtccccgcggctacggcggcttgctcccgaccctgcaggcggctggatgttggggcgaggggcggacttggtgggtgtcgggacgacgcggggctgggaaggcctgtccgggccttcatgtccgggtcctcgtaacccggagccgcgagtgatccccggggacgggtcgaagcggtgtgtccctgtcgggcttctgtccccggcggcgccgcgcgtcttccgcggtgtcctcgggcccggtggccccgggagatgggtgtcgggatcccgctgacgcccgatccgcgcccgcacaggcagaagtagagcagaagaagaagcggaccttccgcaagttcacctaccgcggcgtggacctcgaccagctgctggacatgtcctacgagcagctgatgcagctgtacagtgcgcgccagcggcggcggctgaaccggggcctgcggcggaagcagcactccctgctgaagcgcctgcgcaaggccaagaaggaggcgccgcccatggagaagccggaagtggtgaagacgcacctgcgggacatgatcatcctacccgagatggtgggcagcatggtgggcgtctacaacggcaagaccttcaaccaggtggagatcaagcccgagatgatcggccactacctgggcgagttctccatcacctacaagcccgtaaagcatggccggcccggcatcggggccacccactcctcccgcttcatccctctcaagtaatggctcagctaataaaggcgcacatgactccaaaaaaaaaaaaaaaaaaaaaaaaaaaaaaaaaaaaaaaaaaaaaaaaaaaaaaaaaaaaaccggggggtcttttttggggggggggaaaaaaggggttttggaaaggggccctttgggccatgtgttgtttcttggccccattttttttttcccaaggggggaaaatctcggggggtccccctattaggggggg

SEQ ID NO: 445717 - DNA, 338 bp, Homo sapiens
ccgctccaacatcagaatggtaagcagcactccctgctgaagcgcctgcgcaaggccaagaaggaggcgccgcccatggagaagccggaagtggtgaagacgcacctgcgggacatgatcatcctacccgagatggtgggcagcatggtgggcgtctacaacggcaagaccttcaaccaggtggagatcaagcccgagatgatcggccactacctgggcgagttctccatcacctacaagcccgtaaagcatggccggcccggcatcggggccacccactcctcccgcttcatccctctcaagtaatggctcagctaataaaggcgcacatgactcca

SEQ ID NO: 445718 - DNA, 901 bp, Homo sapiens
  misc_feature (886)..(886): n is a, c, g, or t
cgagggggcgggacatgccggcagtctcgcgataactgcgcaggcgcggaccaaagcgatctcttctgaggatccggcaagatggtgagtgttgcgatttggcgcgtctctgccgggcctatccggctccatccaacctctgaccgtctcgcgggggccgcagttcgtccccgcggctacggcggcttgctcccgaccctgcaggcggctggatgttggggcgaggggcggacttggtgggtgtcgggacgacgcggggctgggaaggcctgtccgggccttcatgtccgggtcctcgtaacccggagccgcgagtgatccccggggacgggtcgaagcggtgtgtccctgtcgggcttctgtccccggcggcgccgcgcgtcttccgcggtgtcctcgggcccggtggccccgggagatgggtgtcgggatcccgctgacgcccgatccgcgcccgcacaggcagaagtagagcagaagaagaagcggaccttccgcaagttcacctaccgcggcgtggacctcgaccagctgctggacatgtcctacgagcagctgatgcagctgtacagtgcgcgccagcggcggcggctgaaccggggcctgcggcggaagcagcactccctgctgaagcgcctgcgcaaggccaagaaggaggcgccgcccatggagaagccggaagtggtgaagacgcacctgcgggacatgatcatcctacccgagatggtgggcagcatggtgggcgtctacaacggcaagaccttcaaccaggtggagatcaagcccgagatgatcggccactacctgggcgagttctccatcacctacaagcccgtaaagctgcgcccgcaattataaacaccgggcctcaatcgggggaacgtcncgtcccctcagcgtt

SEQ ID NO: 445719 - DNA, 1093 bp, Homo sapiens
cgagggggcgggacatgccggcagtctcgcgataactgcgcaggcgcggaccaaagcgatctcttctgaggatccggcaagatggtgagtgttgcgatttggcgcgtctctgccgggcctatccggctccatccaacctctgaccgtctcgcgggggccgcagttcgtccccgcggctacggcggcttgctcccgaccctgcaggcggctggatgttggggcgaggggcggacttggtgggtgtcgggacgacgcggggctgggaaggcctgtccgggccttcatgtccgggtcctcgtaacccggagccgcgagtgatccccggggacgggtcgaagcggtgtgtccctgtcgggcttctgtccccggcggcgccgcgcgtcttccgcggtgtcctcgggcccggtggccccgggagatgggtgtcgggatcccgctgacgcccgatccgcgcccgcacaggcagaagtagagcagaagaagaagcggaccttccgcaagttcacctaccgcggcgtggacctcgaccagctgctggacatgtcctacgagcagctgatgcagctgtacagtgcgcgccagcggcggcggctgaaccggggcctgcggcggaagcagcactccctgctgaagcgcctgcgcaaggccaagaaggaggcgccgcccatggagaagccggaagtggtgaagacgcacctgcgggacatgatcatcctacccgagatggtgggcagcatggtgggcgtctacaacggcaagaccttcaaccaggtggagatcaaggtgtgtgcggccgtccctgccggctggggtgggctggggtcgcctgatgcaggcgggatcagctgacacccagctttgctcttggtctcccgcagcccgagatgatcggccactacctgggcgagttctccatcacctacaagcccgtaaagcatggccggcccggcatcggggccacccactcctcccgcttcatccctctcaagtaatggctcagctaataaaggcgcacatgactccaaaaaaaaaggagatgaaaaaatgaaaacctcggggtttttttttgggggggggcaaaaagggttgtaag

SEQ ID NO: 445720 - DNA, 1946 bp, Homo sapiens
  misc_feature (13)..(13): n is a, c, g, or t
  misc_feature (43)..(43): n is a, c, g, or t
  misc_feature (50)..(50): n is a, c, g, or t
  misc_feature (1609)..(1609): n is a, c, g, or t
ttttaaaaccccnttttactactactactactactactactangctgctnagaagacgactgaaggggctcttctgaggatccggcaagatggcagaagtagagcagaagaagaagcggaccttccgcaagttcacctaccgcggcgtggacctcgaccagctgctggacatgtcctacgagcagctgatgcagctgtacagtgcgcgccagcggcggcggctgaaccggggcctgcggcggaagcagcactccctgctgaagcgcctgcgcaaggccaagaaggaggcgccgcccatggagaagccggaagtggtgaagacgcacctgcgggacatgatcatcctacccgagatggtgggcagcatggtgggcgtctacaacggcaagaccatcacctacaagcccgtaaagcatggccggcccggcatcggggccacccactcctcccgcttcatccctctcaagtaatggctcagctaataaaggcgcacatgactccagtcctttgcgcagcttgttcttcctggcgtcccgagctctgggaggggcctgggcctgcttcaggttcgtggtgtgaggaggttcaggttggacgttcgggggtgtgtggtagtgttgtgtggatggtctcttggtgtcgaagactgacagctgtgcgggccctgccccaactcggctgcccctgctcctgtctgcagggacagctgtggagctgggtgcccaagcccaggtgtgtagctccgtcccttttggccccctcagcgttcttgacctcggggcagctgcctggcctcactctgtcttctgggtacctcacgtagagggggccactcctgggctaagtgcagcccctcaagccctcacctggcctgggctctcctttctggcttccctcatctcctgtggagggttcccgcaggaagtgaagcagcagcaggaacctttgggccacctgagcccctcccttctatcctcacccctgcttggcttcttagaagctcctgactctcctcctgacaccacgctgctggcatctcctctcccagcaggctccatggctgcagccagccccatccgcccagcctggggctttgtgtccgggacagagccgtgtcccgtggttaggctgcaccatccgtggcctggccagctctgtctcctttgcacagaatgcttgaaagaacaggacaaagtggctgtgcctgtgggtggggggcaccgtccagccctccatgggctctctgatggccgtacgtgggttggagaacatggtgagaactaaccccgttcaatgctggagtcacctcagcccagaaggtggtaactttgctcactaagcacccagcagagtggcccagggatgtggggtgggcctccccttgggcagtggacaggagggtgagagctcagccaggcagatgggggcaggggagatgtgaggagccccaccttcaccctcaaatggcccacaacagcctcctgtgggccctcttctataatgtttctccacttttttttttaaatttgttgcccagccggagtgcagtggtgtgatcatggctcactgcagcctaaatctcatgggctcaggtgatcttcccactgcntcccaaagtgctgggatcacaggcatgagacactgcagctggctatatcttcaaatttaaacatgatttgcagccaggcgcggtggttcacgtctgtgatcctagcactttgggaggccgagatgggtggatcacctgaggtcaggagttcgagaccagcctgaccaacgtggtaaaaccttgtctctactgaaaatacaaaaaaattagcctaactgggcatggtggcatgcggctataatctcagctacttgagaggctgaagcaggagagtcacttgaacccaggaggcggaaatcgcactctagcccgggcaacaagagctagactctgcctc

SEQ ID NO: 445721 - DNA, 1079 bp, Homo sapiens
aggcagggttaatcggacgaggagatggcagaagtagagcagaagaagaagcggaccttccgcaagttcacctaccgcggcgtggacctcgaccagctgctggacatgtcctagttggtcttgaactcctgggctcaagcgaccctcccgcctcaacctcccgaagtgctgggatcacaggcgggagccactgcgccctacctgccttcccctgcgtttttagaggcctttggcccgagctgtacgctgcagcaccttgtctgaggctgtggtctccgggccgcttgttctctctgaatctctgcagtcacacggtggctcttgcatgtgagggcgagcagctgatgcagctgtacagtgcgcgccagcggcggcggctgaaccggggcctgcggcggaagcagcactccctgctgaagcgcctgcgcaaggccaagaaggaggcgccgcccatggagaagccggaagtggtgaagacgcacctgcgggacatgatcatcctacccgagatggtgggcagcatggtgggcgtctacaacggcaagaccttcaaccaggtggagatcaagcccgagatgatcggccactacctgggcgagttctccatcacctacaagcccgtaaagcatggccggcccggcatcggggccacccactcctcccgcttcatccctctcaagtaatggctcagctaataaaggcgcacatgactccaaaaaaaaaaaaaacaaacaaaaaaaaaaaaaaaaaaaaaaaagaaaaaaaaaaaaaaaaaaaaaaaaagagggggggcgcgcaccaagaacacacccaggagcgccacaaaacagggcaccaccgatatgggccaaaggggcccaaagaggcggccctaaaacacgaagacacggcgcgcgtaacaacacgccagacgacgggaaaccggcaacgcggacaatgggaaacgcacccaccaccggggcgggccaacactggcgcaccaccctccacgaatataccctcggggcctctcaattccagtgtatcgttgctaaccccggtatattcgctgagaactgcccacgcactgttgaaattcg

SEQ ID NO: 445722 - DNA, 388 bp, Homo sapiens
ttgtagacgccccccatgctgccccccatctcgggtaggatgatcatgcccgagatgatcggccactacctgggcgagttctccatcacctacaagcccgtaaagcatggccggcccggcatcggggccacccactcctcccgcttcatccctctcaagtaatggctcagctaataaaggcgcacatgactccaaaaaaaaaaaaaaaaaaaaaaaaaaaaaaaaaaaaaaaaaaaaaaaaaaaaaaaaaaaaaccggggggtcttttttggggggggggaaaaaaggggttttggaaaggggccctttgggccatgtgttgtttcttggccccattttttttttcccaaggggggaaaatctcggggggtccccctattaggggggg

SEQ ID NO: 445723 - DNA, 499 bp, Homo sapiens
aaaccctaggctaggtacgaggctgggtgtgggcagaagtagagcagaagaagaagcggaccttccgcaagttcacctaccgcggcgtggacctcgaccagctgctggacatgtcctacgagcagctgatgcagctgtacagtgcgcgccagcggcggcggctgaaccggggcctgcggcggaagcagcactccctgctgaagcgcctgcgcaaggccaagaaggaggcgccgcccatggagaagccggaagtggtgaagacgcacctgcgggacatgatcatcctacccgagatggtgggcagcatggtgggcgtctacaacggcaagaccttcaaccaggtggagatcaagcccgagatgatcggccactacctgggcgagttctccatcacctacaagcccgtaaagcatggccggcccggcatcggggccacccactcctcccgcttcatccctctcaagtaatggctcagctaataaaggcgcacatgactcca

SEQ ID NO: 445724 - DNA, 518 bp, Homo sapiens
  misc_feature (22)..(22): n is a, c, g, or t
cagccatcttaagcagctgacncctctcgtccgaattcggcacgagagatggcagaagtagagcagaagaagaagcggaccttccgcaagttcacctaccgcggcgtggacctcgaccagctgctggacatgtcctacgagcagctgatgcagctgtacagtgcgcgccagcggcggcggctgaaccggggcctgcggcggaagcagcactccctgctgaagcgcctgcgcaaggccaagaaggaggcgccgcccatggagaagccggaagtggtgaagacgcacctgcgggacatgatcatcctacccgagatggtgggcagcatggtgggcgtctacaacggcaagaccttcaaccaggtggagatcaagcccgagatgatcggccactacctgggcgagttctccatcacctacaagcccgtaaagcatggccggcccggcatcggggccacccactcctcccgcttcatccctctcaagtaatggctcagctaataaaggcgcacatgactcca

SEQ ID NO: 445725 - DNA, 501 bp, Homo sapiens
aggctggtacggccggaagttttggatcaagatggcagaagtagagcagaagaagaagcggaccttccgcaagttcacctaccgcggcgtggacctcgaccagctgctggacatgtcctacgagcagctgatgcagctgtacagtgcgcgccagcggcggcggctgaaccggggcctgcggcggaagcagcactccctgctgaagcgcctgcgcaaggccaagaaggaggcgccgcccatggagaagccggaagtggtgaagacgcacctgcgggacatgatcatcctacccgagatggtgggcagcatggtgggcgtctacaacggcaagaccttcaaccaggtggagatcaagcccgagatgatcggccactacctgggcgagttctccatcacctacaagcccgtaaagcatggccggcccggcatcggggccacccactcctcccgcttcatccctctcaagtaatggctcagctaataaaggcgcacatgactcca

SEQ ID NO: 445726 - DNA, 680 bp, Homo sapiens
  misc_feature (22)..(22): n is a, c, g, or t
cagccatcttaagcagctgacncctctcgtccgaattcggcacgagagatggcagaagtagagcagaagaagaagcggaccttccgcaagttcacctaccgcggcgtggacctcgaccagctgctggacatgtcctacgagcagctgatgcagctgtacagtgcgcgccagcggcggcggctgaaccggggcctgcggcggaagcagcactccctgctgaagcgcctgcgcaaggccaagaaggaggcgccgcccatggagaagccggaagtggtgaagacgcacctgcgggacatgatcatcctacccgagatggtgggcagcatggtgggcgtctacaacggcaagaccttcaaccaggtggagatcaagcccgagatgatcggccactacctgggcgagttctccatcacctacaagcccgtaaagcatggccggcccggcatcggggccacccactcctcccgcttcatccctctcaagtaatggctcagctaataaaggcgcacatgactccaaaaaaaaaaaaaaaaaaaaaaaaaaaaaccggggggtcttttttggggggggggaaaaaaggggttttggaaaggggccctttgggccatgtgttgtttcttggccccattttttttttcccaaggggggaaaatctcggggggtccccctattaggggggg

SEQ ID NO: 445727 - DNA, 329 bp, Homo sapiens
  misc_feature (44)..(44): n is a, c, g, or t
  misc_feature (48)..(48): n is a, c, g, or t
gacatgtcctacgagcagctgatgcagctgtacagtgtgccgcnccangctgctgaagcgccgcccatggagaagccggaagtggtgaagacgcacctgcgggacatgatcatcctacccgagatggtgggcagcatggtgggcgtctacaacggcaagaccttcaaccaggtggagatcaagcccgagatgatcggccactacctgggcgagttctccatcacctacaagcccgtaaagcatggccggcccggcatcggggccacccactcctcccgcttcatccctctcaagtaatggctcagctaataaaggcgcacatgactcca

SEQ ID NO: 445728 - DNA, 606 bp, Homo sapiens
  misc_feature (66)..(66): n is a, c, g, or t
tgatcttgggttaagtttatttaccctcccttgtatttcaagggttaacttattgaagaaaagagntttaattggctcacggttctgcaggcttgtacaggaagcacagtagcatctgcttctggggaggccctcagggagcttccagtcatacactcagggcagaagtagagcagaagaagaagcggaccttccgcaagttcacctaccgcggcgtggacctcgaccagctgctggacatgtcctacgagcagctgatgcagctgtacagtgcgcgccagcggcggcggctgaaccggggcctgcggcggaagcagcactccctgctgaagcgcctgcgcaaggccaagaaggaggcgccgcccatggagaagccggaagtggtgaagacgcacctgcgggacatgatcacatggtgggcgtctacaacggcaagaccttcaaccaggtggagatcaagcccgagatgatcggccactacctgggcgagttctccatcacctacaagcccgtaaagcatggccggcccggcatcggggccacccactcctcccgcttcatccctctcaagtaatggctcagctaataaaggcgcacatgactcca

SEQ ID NO: 445729 - DNA, 628 bp, Homo sapiens
  misc_feature (66)..(66): n is a, c, g, or t
tgatcttgggttaagtttatttaccctcccttgtatttcaagggttaacttattgaagaaaagagntttaattggctcacggttctgcaggcttgtacaggaagcacagtagcatctgcttctggggaggccctcagggagcttccagtcatacactcagggcagaagtagagcagaagaagaagcggaccttccgcaagttcacctaccgcggcgtggacctcgaccagctgctggacatgtcctacgagcagctgatgcagctgtacagtgcgcgccagcggcggcggctgaaccggggcctgcggcggaagcagcactccctgctgaagcgcctgcgcaaggccaagaaggaggcgccgcccatggagaagccggaagtggtgaagacgcacctgcgggacatgatcatcctacccgagatggtgggcagcatggtgggcgtctacaacggcaagaccttcaaccaggtggagatcaagcccgagatgatcggccactacctgggcgagttctccatcacctacaagcccgtaaagcatggccggcccggcatcggggccacccactcctcccgcttcatccctctcaagtaatggctcagctaataaaggcgcacatgactcca

SEQ ID NO: 445730 - DNA, 2373 bp, Homo sapiens
  misc_feature (2036)..(2036): n is a, c, g, or t
cgagggggcgggacatgccggcagtctcgcgataactgcgcaggcgcggaccaaagcgatctcttctgaggatccggcaagatggtgagtgttgcgatttggcgcgtctctgccgggcctatccggctccatccaacctctgaccgtctcgcgggggccgcagttcgtccccgcggctacggcggcttgctcccgaccctgcaggcggctggatgttggggcgaggggcggacttggtgggtgtcgggacgacgcggggctgggaaggcctgtccgggccttcatgtccgggtcctcgtaacccggagccgcgagtgatccccggggacgggtcgaagcggtgtgtccctgtcgggcttctgtccccggcggcgccgcgcgtcttccgcggtgtcctcgggcccggtggccccgggagatgggtgtcgggatcccgctgacgcccgatccgcgcccgcacaggcagaagtagagcagaagaagaagcggaccttccgcaagttcacctaccgcggcgtggacctcgaccagctgctggacatgtcctacgagcagctgatgcagctgtacagtgcgcgccagcggcggcggctgaaccggggcctgcggcggaagcagcactccctgctgaagcgcctgcgcaaggccaagaaggaggcgccgcccatggagaagccggaagtggtgaagacgcacctgcgggacatgatcatcctacccgagatggtgggcagcatggtgggcgtctacaacggcaagaccttcaaccaggtggagatcaagcccgagatgatcggccactacctgggcgagttctccatcacctacaagcccgtaaagcatggccggcccggcatcggggccacccactcctcccgcttcatccctctcaagtaatggctcagctaataaaggcgcacatgactccagtcctttgcgcagcttgttcttcctggcgtcccgagctctgggaggggcctgggcctgcttcaggttcgtggtgtgaggaggttcaggttggacgttcgggggtgtgtggtagtgttgtgtggatggtctcttggtgtcgaagactgacagctgtgcgggccctgccccaactcggctgcccctgctcctgtctgcagggacagctgtggagctgggtgcccaagcccaggtgtgtagctccgtcccttttggccccctcagcgttcttgacctcggggcagctgcctggcctcactctgtcttctgggtacctcacgtagagggggccactcctgggctaagtgcagcccctcaagccctcacctggcctgggctctcctttctggcttccctcatctcctgtggagggttcccgcaggaagtgaagcagcagcaggaacctttgggccacctgagcccctcccttctatcctcacccctgcttggcttcttagaagctcctgactctcctcctgacaccacgctgctggcatctcctctcccagcaggctccatggctgcagccagccccatccgcccagcctggggctttgtgtccgggacagagccgtgtcccgtggttaggctgcaccatccgtggcctggccagctctgtctcctttgcacagaatgcttgaaagaacaggacaaagtggctgtgcctgtgggtggggggcaccgtccagccctccatgggctctctgatggccgtacgtgggttggagaacatggtgagaactaaccccgttcaatgctggagtcacctcagcccagaaggtggtaactttgctcactaagcacccagcagagtggcccagggatgtggggtgggcctccccttgggcagtggacaggagggtgagagctcagccaggcagatgggggcaggggagatgtgaggagccccaccttcaccctcaaatggcccacaacagcctcctgtgggccctcttctataatgtttctccacttttttttttaaatttgttgcccagccggagtgcagtggtgtgatcatggctcactgcagcctaaatctcatgggctcaggtgatcttcccactgcntcccaaagtgctgggatcacaggcatgagacactgcagctggctatatcttcaaatttaaacatgatttgcagccaggcgcggtggttcacgtctgtgatcctagcactttgggaggccgagatgggtggatcacctgaggtcaggagttcgagaccagcctgaccaacgtggtaaaaccttgtctctactgaaaatacaaaaaaattagcctaactgggcatggtggcatgcggctataatctcagctacttgagaggctgaagcaggagagtcacttgaacccaggaggcggaaatcgcactctagcccgggcaacaagagctagactctgcctc

SEQ ID NO: 445731 - DNA, 906 bp, Homo sapiens
gaggaaaaggggaaactaggctaggaacgaggctgggtgttagatggcagaagtagagcagaagaagaagcggaccttccgcaagttcacctaccgcggcgtggacctcgaccagctgctggacatgtcctacgagcagctgatgcagctgtacagtgcgcgccagcggcggcggctgaaccggggcctgcggcggaagcagcactccctgctgaagcgcctgcgcaaggccaagaaggaggcgccgcccatggagaagccggaagtggtgaagacgcacctgcgggacatgatcatcctacccgagatggtgggcagcatggtgggcgtctacaacggcaagaccttcaaccaggtggagatcaagcccgagatgatcggccactacctgggcgagttctccatcacctacaagcccgtaaagcatggccggcccggcatcggggccacccactcctcccgcttcatccctctcaagtaatggctcagctaataaaggcgcacatgactccaaaaaaaaaaaaaaaaaaaaaaaaaaaaacaaaaaaaaaaaaacaaacaaaaaaaaaaaaaaaaaaaaaaaagaaaaaaaaaaaaaaaaaaaaaaaaagagggggggcgcgcaccaagaacacacccaggagcgccacaaaacagggcaccaccgatatgggccaaaggggcccaaagaggcggccctaaaacacgaagacacggcgcgcgtaacaacacgccagacgacgggaaaccggcaacgcggacaatgggaaacgcacccaccaccggggcgggccaacactggcgcaccaccctccacgaatataccctcggggcctctcaattccagtgtatcgttgctaaccccggtatattcgctgagaactgcccacgcactgttgaaattcg

SEQ ID NO: 445732 - DNA, 1024 bp, Homo sapiens
cgagggggcgggacatgccggcagtctcgcgataactgcgcaggcgcggaccaaagcgatctcttctgaggatccggcaagatggtgagtgttgcgatttggcgcgtctctgccgggcctatccggctccatccaacctctgaccgtctcgcgggggccgcagttcgtccccgcggctacggcggcttgctcccgaccctgcaggcggctggatgttggggcgaggggcggacttggtgggtgtcgggacgacgcggggctgggaaggcctgtccgggccttcatgtccgggtcctcgtaacccggagccgcgagtgatccccggggacgggtcgaagcggtgtgtccctgtcgggcttctgtccccggcggcgccgcgcgtcttccgcggtgtcctcgggcccggtggccccgggagatgggtgtcgggatcccgctgacgcccgatccgcgcccgcacaggcagaagtagagcagaagaagaagcggaccttccgcaagttcacctaccgcggcgtggacctcgaccagctgctggacatgtcctacgagcagctgatgcagctgtacagtgcgcgccagcggcggcggctgaaccggggcctgcggcggaagcagcactccctgctgaagcgcctgcgcaaggccaagaaggaggcgccgcccatggagaagccggaagtggtgaagacgcacctgcgggacatgatcatcctacccgagatggtgggcagcatggtgggcgtctacaacggcaagaccttcaaccaggtggagatcaaggtgtgtgcggccgtccctgccggctggggtgggctggggtcgcctgatgcaggcgggatcagctgacacccagctttgctcttggtctcccgcagcccgagatgatcggccactacctgggcgagttctccatcacctacaagcccgtaaagcatggccggcccggcatcggggccacccactcctcccgcttcatccctctcaagtaatggctcagctaataaaggcgcacatgactcca

SEQ ID NO: 445733 - DNA, 1122 bp, Homo sapiens
cgagggggcgggacatgccggcagtctcgcgataactgcgcaggcgcggaccaaagcgatctcttctgaggatccggcaagatggtgagtgttgcgatttggcgcgtctctgccgggcctatccggctccatccaacctctgaccgtctcgcgggggccgcagttcgtccccgcggctacggcggcttgctcccgaccctgcaggcggctggatgttggggcgaggggcggacttggtgggtgtcgggacgacgcggggctgggaaggcctgtccgggccttcatgtccgggtcctcgtaacccggagccgcgagtgatccccggggacgggtcgaagcggtgtgtccctgtcgggcttctgtccccggcggcgccgcgcgtcttccgcggtgtcctcgggcccggtggccccgggagatgggtgtcgggatcccgctgacgcccgatccgcgcccgcacaggcagaagtagagcagaagaagaagcggaccttccgcaagttcacctaccgcggcgtggacctcgaccagctgctggacatgtcctacgagcagctgatgcagctgtacagtgcgcgccagcggcggcggctgaaccggggcctgcggcggaagcagcactccctgctgaagcgcctgcgcaaggccaagaaggaggcgccgcccatggagaagccggaagtggtgaagacgcacctgcgggacatgatcatcctacccgagatggtgggcagcatggtgggcgtctacaacggcaagaccttcaaccaggtggagatcaagcccgagatagatcggccactaccttgggcgagttctccaattcaacccttaccaaaaggccccccggggttaaaaaaaaggccaatttgggccctgggcccccgggcaatcgggggcccacccccacttccttcccccgcttcattcccctgctgccaaaaagggttttaaaacttggggggggcgtttcccaaggcgcctttagcattacaagaaggggccggcgatctaattgaaccttccccaaaaagaagacataacacgaagaaaaacaaaatctgcccgaaggggcggcatctctatcatgtggtggcagggagatggacgggcgagagacag

SEQ ID NO: 445734 - DNA, 502 bp, Homo sapiens
  misc_feature (13)..(13): n is a, c, g, or t
  misc_feature (43)..(43): n is a, c, g, or t
  misc_feature (50)..(50): n is a, c, g, or t
ttttaaaaccccnttttactactactactactactactactangctgctnagaagacgactgaaggggctcttctgaggatccggcaagatggcagaagtagagcagaagaagaagcggaccttccgcaagttcacctaccgcggcgtggacctcgaccagctgctggacatgtcctacgagcagctgatgcagctgtacagtgcgcgccagcggcggcggctgaaccggggcctgcggcggaagcagcactccctgctgaagcgcctgcgcaaggccaagaaggaggcgccgcccatggagaagccggaagtggtgaagacgcacctgcgggacatgatcatcctacccgagatggtgggcagcatggtgggcgtctacaacggcaagaccatcacctacaagcccgtaaagcatggccggcccggcatcggggccacccactcctcccgcttcatccctctcaagtaatggctcagctaataaaggcgcacatgactcca

SEQ ID NO: 445735 - DNA, 674 bp, Homo sapiens
  misc_feature (9)..(9): n is a, c, g, or t
  misc_feature (48)..(48): n is a, c, g, or t
  misc_feature (66)..(66): n is a, c, g, or t
  misc_feature (93)..(93): n is a, c, g, or t
ttggacccnggtaaaaaaatgggggggcccggaaaggcccccccaacnggaggtcccggttaaaanatggggtaccctggaatttccccccgntacctatggacctcaaccggcccaggtataaactatatctcctagtaacattttccatttttgtttaatcaaatacttgcttatgaaggatttcagaaatttgtaataaatgtcagcttttgatagcatagcagtaattgacatttcaaaaatatatatttctttctgtgtttggttgggtgtaatgaggaaaatacctgataaaatgtctgaagacactttctaatgttatcttggtgcataagctgtaatttttattcaaaattaaatttcaaatgtttgcagttttggctaaaacattgagttgaaagaattatgaaaagtgggcccatatgaagtaccatgttcattttgaaatatagatttaagatttagaaatatattaaaagagttaatggagcctcctaaattggattttattttgtgggtgaagaattgtaggaagatgaatgtggcctacagttttagtaatctcctagtggagttttttttaacttagtacttttttatttttaagttttttaatctataaaaaatgtgatttctataaaccatgattacaataaataattatattaaac

SEQ ID NO: 445736 - DNA, 486 bp, Homo sapiens
ggtggtgtgggagtgggtacggggagggaagtggaggggagggggtaagtgatagggtaggggaggccctgggaaaggcaggacctcgaggcgcggccgcgcgaggtgaccggagtcacagttcccgcaggcggcgacagcagagcgcccactgcctccagcagattaatattaagattggaagtttgtgtcttttgctggatattggaaattgaatgtaatggcaacagaatttataaagagttgctgtggaggatgtttctatggtgaaacagaaaaacacaacttttctgtggaaagagattttaaagcagcagtcccaaatagtcaaaatgctactatctctgtacctccattgacttctgtttctgtaaagcctcagcttggctgtactgaggattatttgctttccaaattaccatcgggtggcccacgatagtacaatgtaatgtgcgtctctctgaagtaaaggcgccaggtttcgat

SEQ ID NO: 445737 - DNA, 5043 bp, Homo sapiens
ggtggtgtgggagtgggtacggggagggaagtggaggggagggggtaagtgatagggtaggggaggccctgggaaaggcaggacctcgaggcgcggccgcgcgaggtgaccggagtcacagttcccgcaggcggcgacagcagagcgcccactgcctccagcagattaatattaagattggaagtttgtgtcttttgctggatattggaaattgaatgtaatggcaacagaatttataaagagttgctgtggaggatgtttctatggtgaaacagaaaaacacaacttttctgtggaaagagattttaaagcagcagtcccaaatagtcaaaatgctactatctctgtacctccattgacttctgtttctgtaaagcctcagcttggctgtactgaggattatttgctttccaaattaccatctgatggcaaagaagtaccatttgtggtgcccaagtttaagttatcttacattcaacccaggacacaagaaactccttcacatctggaagaacttgaaggatctgccagagcatcttttggagatcgaaaggtagaactttccagttcatcccagcacggacctagctatgatgtgtataacccattctatatgtatcagcacatttcacctgatttgagtcgacgctttcctccccgttcagaagtgacgagactgtatggatcggtttgtgatttaaggacgaacaaacttcccggttcccctgggctaagcaaatctatgtttgatcttacaaactcatctcagcgattcatccagagacatgattcattgtccagtgtacccagtagttcttcttcaaggaaaaattctcaggggagtaacagaagcctggatacaattactctatcaggagatgaaagggactttgggagactgaatgtgaaattgttttataattcttcagtagaacagatctggatcacagttttacagtgcagagatttaagttggccctctagttatggagacactcctactgtttctataaaaggaatacttacattgcccaaaccagtgcatttcaaatcttcagccaaggaaggttccaacgctattgaatttatggaaacgtttgtatttgctattaaacttcaaaatctacaaactgtaagacttgtatttaagattcaaacccagactcccaggaagaaaaccattggagaatgctcaatgtcactcagaacccttagcacacaggaaatggattactctttggatataacaccaccttcaaaaatttctgtttgccatgcagaacttgaattggggacttgttttcaagcagtaaatagcagaattcagttacaaattcttgaggcacggtaccttccaagctcatcaacacctctgactttgagttttttcgtgaaggtgggaatgtttagctcgggagagttgatttataagaaaaagacacgcttactgaaggcctccaatggaagagtcaagtggggagagactatgatttttccacttatacagagtgaaaaagaaattgtttttctcattaagctttacagtcgaagctctgtaagaagaaaacactttgtgggccagatttggataagtgaagacagtaataacattgaagcagtgaaccagtggaaagagacagtaataaatccagaaaaggttgttatcaggtggcacaaattaaatccatcttgaagacttcacacattaatttggtgaagaacttgacattcttttagaagacttatgatttcaatttgctaccaatgagaagaggcaaatcaacaaatttgtcaatttatgggggctataattatggtatataatgtatctgatagaaaatttgataagaaaatgtaatgaattttatcagatatccaaagtaaaggaaatgttttaaaactgcaacaagagacacagacagtaaaatcaaagtattattaggatgactaaataaattataaagtctgtgagaatatcaaccatagatagttctttctatattatgtttttgcttttgtattttaagctttacttagatattcaaaacctggtatatcaagtctctgttagtactattggcatttagaagactttaccattatttcagtgctaggcattattgattaggtcttggctccactgtttacctcttgctatgtattttctcccggtaaaaatgaattgaaccatttcaactattttctatatttggagaaagtttgtgccctgtgttttataatttttttacccataagacatcacattatccctttgtaagctacttatctccaaaaaacttcagaaatagaaaactacattttggcaggaataattgaaaacaccagaaggttgaagtttaattggaaacccagaatatacatactttgctgttttcttccctcaaatattttactatttgttttatttggagttaaaataagagtatcatccatatggtccatcctaattcacagaattaaatgagcttaaatagaaaattcagtattttatgataatcacttcgtttttagtttttaaaatttagattattctataatttaccgtgtttgagtattttctcatttttttcataaccatacctgattatactgtgtaacaaatattttctattgcagttttctttccagtacttattagaactcagtatttggaaataatttcagcttaattgaccataagaactgtggccaaaaagaacagttttttggagaggcagatgacattatacctgattttagaaaatctcactttatttttgctaataagtagactaagtgctctgtgttctcagtcttccctttttttctgcccccattcttactttgtcccaggcatgcagagaaagatggtgatattttaggccaggagtataccttgctataacctaagcatgccttctttattccagctcctatgttctgtgtatatcattaacattttcccaaataaacacttaattctcttttccctaggtgccatctcctcaagctacaaaatgtccacatcttatatcccctttgcttctactgctctgattttgtggtaccagtactctctgccactgaacattttgaaatatttttgttttagatttgcaaaaaatgacatataggtcagtactcacatggatttttaagataaatcacctgtgtgataatattttgaatctgagacgaatacaacttttaaaaattgtttttaaaaatagacttttttttttagagcagttgtaggttaacagaaaaattgagaggaagatagagatttcctttctcccctgacaaagccctcaacagcctcccaggctatcagtatcctgcaccacaatggtacatttgttacaatcaatgaacctactctgaaacatcattatcatccaaagttcatggtttacattagagtcccctcttggtgttatacatgctagaggacaaatatatgatgatatgtatgcatcattataatatagtatagtttcgctgccctaaacatcctctgcaaatgcaactattttaatgggtaccaaagaagtaaatgtatttactggcttttagataataaataacgggctttattgtttattttaaaagctacaatttgttttagctggtttctctgttctattaatgctttgaatttccaaatttaatatatgtagtcatgcatttaacttaatatttaattatttgatttatttaattttctatattcttacaatgtatgtatgatgtataatttaagggaaagctatgacttctcagtttcttagaatcctaggtaaataaaacaataaaaagaaaacccttacatttaaaagagctttcaggtacagaagtattgatacaactaagatcctaaatgttttaattagtgtttacttaagcctttttcaggtgaggaggtactaatgctggttatttccttgaagctttatgtggacctataaataaaaatccaatctcctgctaataggtatgcatattgtgagaaaaacgttaggagctggtagtaaaaaatgagattctatgccaaaataacttctcttcatatttgcctaggcatttcttgacctttacccacttacgcaaggagaaggaaatcataatgatgtcatgtgatcaaaggaaaccatggaagggttcacgctgatagctgatagcttttacagtgctcattcctaacagtggatttacttgtaagctttcagatcaacacaaatagctgcagcctgggttaaaatataacatcactatttggcttttgttttgcatgatttttaaaagcagtactcctagggaaatggcctctgaagtatatcagtttcatctcttaccaagactgttaagaagaaactagtgggattttgaacaagttatataattgtggtctgaaaagaccctaaactgaagttctgtttaaatatagttacatgaatttctctgatactaatgtactcaacagccaggtataaactatatctcctagtaacattttccatttttgtttaatcaaatacttgcttatgaaggatttcagaaatttgtaataaatgtcagcttttgatagcatagcagtaattgacatttcaaaaatatatatttctttctgtgtttggttgggtgtaatgaggaaaatacctgataaaatgtctgaagacactttctaatgttatcttggtgcataagctgtaatttttattcaaaattaaatttcaaatgtttgcagttttggctaaaacattgagttgaaagaattatgaaaagtgggcccatatgaagtaccatgttcattttgaaatatagatttaagatttagaaatatattaaaagagttaatggagcctcctaaattggattttattttgtgggtgaagaattgtaggaagatgaatgtggcctacagttttagtaatctcctagtggagttttttttaacttagtacttttttatttttaagttttttaatctataaaaaatgtgatttctataaaccatgattacaataaataattatattaaac

SEQ ID NO: 445738 - DNA, 5025 bp, Homo sapiens
ggtggtgtgggagtgggtacggggagggaagtggaggggagggggtaagtgatagggtaggggaggccctgggaaaggcaggacctcgaggcgcggccgcgcgaggtgaccggagtcacagttcccgcaggcggcgacagcagagcgcccactgcctccagcagattaatattaagattggaagtttgtgtcttttgctggatattggaaattgaatgtaatggcaacagaatttataaagagttgctgtggaggatgtttctatggtgaaacagaaaaacacaacttttctgtggaaagagattttaaagcagcagtcccaaatagtcaaaatgctactatctctgtacctccattgacttctgtttctgtaaagcctcagcttggctgtactgaggattatttgctttccaaattaccatctgatggcaaagaagtaccatttgtggtgcccaagtttaagttatcttacattcaacccaggacacaagaaactccttcacatctggaagaacttgaaggatctgccagagcatcttttggagatcgaaaggtagaactttccagttcatcccagcacggacctagctatgatgtgtataacccattctatatgtatcagcacatttcacctgatttgagtcgacgctttcctccccgttcagaagtgacgagactgtatggatcggtttgtgatttaaggacgaacaaacttcccggttcccctgggctaagcaaatctatgtttgatcttacaaactcatctcagcgattcatccagagacatgattcattgtccagtgtacccagtagttcttcttcaaggaaaaattctcaggggagtaacagaagcctgggagatgaaagggactttgggagactgaatgtgaaattgttttataattcttcagtagaacagatctggatcacagttttacagtgcagagatttaagttggccctctagttatggagacactcctactgtttctataaaaggaatacttacattgcccaaaccagtgcatttcaaatcttcagccaaggaaggttccaacgctattgaatttatggaaacgtttgtatttgctattaaacttcaaaatctacaaactgtaagacttgtatttaagattcaaacccagactcccaggaagaaaaccattggagaatgctcaatgtcactcagaacccttagcacacaggaaatggattactctttggatataacaccaccttcaaaaatttctgtttgccatgcagaacttgaattggggacttgttttcaagcagtaaatagcagaattcagttacaaattcttgaggcacggtaccttccaagctcatcaacacctctgactttgagttttttcgtgaaggtgggaatgtttagctcgggagagttgatttataagaaaaagacacgcttactgaaggcctccaatggaagagtcaagtggggagagactatgatttttccacttatacagagtgaaaaagaaattgtttttctcattaagctttacagtcgaagctctgtaagaagaaaacactttgtgggccagatttggataagtgaagacagtaataacattgaagcagtgaaccagtggaaagagacagtaataaatccagaaaaggttgttatcaggtggcacaaattaaatccatcttgaagacttcacacattaatttggtgaagaacttgacattcttttagaagacttatgatttcaatttgctaccaatgagaagaggcaaatcaacaaatttgtcaatttatgggggctataattatggtatataatgtatctgatagaaaatttgataagaaaatgtaatgaattttatcagatatccaaagtaaaggaaatgttttaaaactgcaacaagagacacagacagtaaaatcaaagtattattaggatgactaaataaattataaagtctgtgagaatatcaaccatagatagttctttctatattatgtttttgcttttgtattttaagctttacttagatattcaaaacctggtatatcaagtctctgttagtactattggcatttagaagactttaccattatttcagtgctaggcattattgattaggtcttggctccactgtttacctcttgctatgtattttctcccggtaaaaatgaattgaaccatttcaactattttctatatttggagaaagtttgtgccctgtgttttataatttttttacccataagacatcacattatccctttgtaagctacttatctccaaaaaacttcagaaatagaaaactacattttggcaggaataattgaaaacaccagaaggttgaagtttaattggaaacccagaatatacatactttgctgttttcttccctcaaatattttactatttgttttatttggagttaaaataagagtatcatccatatggtccatcctaattcacagaattaaatgagcttaaatagaaaattcagtattttatgataatcacttcgtttttagtttttaaaatttagattattctataatttaccgtgtttgagtattttctcatttttttcataaccatacctgattatactgtgtaacaaatattttctattgcagttttctttccagtacttattagaactcagtatttggaaataatttcagcttaattgaccataagaactgtggccaaaaagaacagttttttggagaggcagatgacattatacctgattttagaaaatctcactttatttttgctaataagtagactaagtgctctgtgttctcagtcttccctttttttctgcccccattcttactttgtcccaggcatgcagagaaagatggtgatattttaggccaggagtataccttgctataacctaagcatgccttctttattccagctcctatgttctgtgtatatcattaacattttcccaaataaacacttaattctcttttccctaggtgccatctcctcaagctacaaaatgtccacatcttatatcccctttgcttctactgctctgattttgtggtaccagtactctctgccactgaacattttgaaatatttttgttttagatttgcaaaaaatgacatataggtcagtactcacatggatttttaagataaatcacctgtgtgataatattttgaatctgagacgaatacaacttttaaaaattgtttttaaaaatagacttttttttttagagcagttgtaggttaacagaaaaattgagaggaagatagagatttcctttctcccctgacaaagccctcaacagcctcccaggctatcagtatcctgcaccacaatggtacatttgttacaatcaatgaacctactctgaaacatcattatcatccaaagttcatggtttacattagagtcccctcttggtgttatacatgctagaggacaaatatatgatgatatgtatgcatcattataatatagtatagtttcgctgccctaaacatcctctgcaaatgcaactattttaatgggtaccaaagaagtaaatgtatttactggcttttagataataaataacgggctttattgtttattttaaaagctacaatttgttttagctggtttctctgttctattaatgctttgaatttccaaatttaatatatgtagtcatgcatttaacttaatatttaattatttgatttatttaattttctatattcttacaatgtatgtatgatgtataatttaagggaaagctatgacttctcagtttcttagaatcctaggtaaataaaacaataaaaagaaaacccttacatttaaaagagctttcaggtacagaagtattgatacaactaagatcctaaatgttttaattagtgtttacttaagcctttttcaggtgaggaggtactaatgctggttatttccttgaagctttatgtggacctataaataaaaatccaatctcctgctaataggtatgcatattgtgagaaaaacgttaggagctggtagtaaaaaatgagattctatgccaaaataacttctcttcatatttgcctaggcatttcttgacctttacccacttacgcaaggagaaggaaatcataatgatgtcatgtgatcaaaggaaaccatggaagggttcacgctgatagctgatagcttttacagtgctcattcctaacagtggatttacttgtaagctttcagatcaacacaaatagctgcagcctgggttaaaatataacatcactatttggcttttgttttgcatgatttttaaaagcagtactcctagggaaatggcctctgaagtatatcagtttcatctcttaccaagactgttaagaagaaactagtgggattttgaacaagttatataattgtggtctgaaaagaccctaaactgaagttctgtttaaatatagttacatgaatttctctgatactaatgtactcaacagccaggtataaactatatctcctagtaacattttccatttttgtttaatcaaatacttgcttatgaaggatttcagaaatttgtaataaatgtcagcttttgatagcatagcagtaattgacatttcaaaaatatatatttctttctgtgtttggttgggtgtaatgaggaaaatacctgataaaatgtctgaagacactttctaatgttatcttggtgcataagctgtaatttttattcaaaattaaatttcaaatgtttgcagttttggctaaaacattgagttgaaagaattatgaaaagtgggcccatatgaagtaccatgttcattttgaaatatagatttaagatttagaaatatattaaaagagttaatggagcctcctaaattggattttattttgtgggtgaagaattgtaggaagatgaatgtggcctacagttttagtaatctcctagtggagttttttttaacttagtacttttttatttttaagttttttaatctataaaaaatgtgatttctataaaccatgattacaataaataattatattaaac

SEQ ID NO: 445739 - DNA, 4001 bp, Homo sapiens
ctatgtatacattcacatgtagtatttaagttacataagtgatgggtactatgaaattactattgatcaagaatgactattagattttaattaagattacactttatttcttgtaaaaggtgatttaaaatgcacattccttaccaatctaatttgaatcatgattagcctcagtttaattatccttacaaaaatatttttgagtggttgggatcagttttaagttgagctcctagatttgttgaataggaaaggatactaataactgttctaggggaaatgattttgtaatatttcaccttgaatttttgaactgaaccttataaactagtcttcagaatgactaagcaggttaaatgttttagcatttaaatgtcaaatagagaaatcaatctgacttttggaaaaaagaaagatgtttaatttaaaatatgtaaagcaaacttccaaatttcttccatcagtaagagtaactaactgtctgaatgtagttattattattgtgtcaagttaaatgattgtacatactttcctttacagatttggataagtgaagacagtaataacattgaagcagtgaaccagtggaaagagacagtaataaatccagaaaaggttgttatcaggtggcacaaattaaatccatcttgaagacttcacacattaatttggtgaagaacttgacattcttttagaagacttatgatttcaatttgctaccaatgagaagaggcaaatcaacaaatttgtcaatttatgggggctataattatggtatataatgtatctgatagaaaatttgataagaaaatgtaatgaattttatcagatatccaaagtaaaggaaatgttttaaaactgcaacaagagacacagacagtaaaatcaaagtattattaggatgactaaataaattataaagtctgtgagaatatcaaccatagatagttctttctatattatgtttttgcttttgtattttaagctttacttagatattcaaaacctggtatatcaagtctctgttagtactattggcatttagaagactttaccattatttcagtgctaggcattattgattaggtcttggctccactgtttacctcttgctatgtattttctcccggtaaaaatgaattgaaccatttcaactattttctatatttggagaaagtttgtgccctgtgttttataatttttttacccataagacatcacattatccctttgtaagctacttatctccaaaaaacttcagaaatagaaaactacattttggcaggaataattgaaaacaccagaaggttgaagtttaattggaaacccagaatatacatactttgctgttttcttccctcaaatattttactatttgttttatttggagttaaaataagagtatcatccatatggtccatcctaattcacagaattaaatgagcttaaatagaaaattcagtattttatgataatcacttcgtttttagtttttaaaatttagattattctataatttaccgtgtttgagtattttctcatttttttcataaccatacctgattatactgtgtaacaaatattttctattgcagttttctttccagtacttattagaactcagtatttggaaataatttcagcttaattgaccataagaactgtggccaaaaagaacagttttttggagaggcagatgacattatacctgattttagaaaatctcactttatttttgctaataagtagactaagtgctctgtgttctcagtcttccctttttttctgcccccattcttactttgtcccaggcatgcagagaaagatggtgatattttaggccaggagtataccttgctataacctaagcatgccttctttattccagctcctatgttctgtgtatatcattaacattttcccaaataaacacttaattctcttttccctaggtgccatctcctcaagctacaaaatgtccacatcttatatcccctttgcttctactgctctgattttgtggtaccagtactctctgccactgaacattttgaaatatttttgttttagatttgcaaaaaatgacatataggtcagtactcacatggatttttaagataaatcacctgtgtgataatattttgaatctgagacgaatacaacttttaaaaattgtttttaaaaatagacttttttttttagagcagttgtaggttaacagaaaaattgagaggaagatagagatttcctttctcccctgacaaagccctcaacagcctcccaggctatcagtatcctgcaccacaatggtacatttgttacaatcaatgaacctactctgaaacatcattatcatccaaagttcatggtttacattagagtcccctcttggtgttatacatgctagaggacaaatatatgatgatatgtatgcatcattataatatagtatagtttcgctgccctaaacatcctctgcaaatgcaactattttaatgggtaccaaagaagtaaatgtatttactggcttttagataataaataacgggctttattgtttattttaaaagctacaatttgttttagctggtttctctgttctattaatgctttgaatttccaaatttaatatatgtagtcatgcatttaacttaatatttaattatttgatttatttaattttctatattcttacaatgtatgtatgatgtataatttaagggaaagctatgacttctcagtttcttagaatcctaggtaaataaaacaataaaaagaaaacccttacatttaaaagagctttcaggtacagaagtattgatacaactaagatcctaaatgttttaattagtgtttacttaagcctttttcaggtgaggaggtactaatgctggttatttccttgaagctttatgtggacctataaataaaaatccaatctcctgctaataggtatgcatattgtgagaaaaacgttaggagctggtagtaaaaaatgagattctatgccaaaataacttctcttcatatttgcctaggcatttcttgacctttacccacttacgcaaggagaaggaaatcataatgatgtcatgtgatcaaaggaaaccatggaagggttcacgctgatagctgatagcttttacagtgctcattcctaacagtggatttacttgtaagctttcagatcaacacaaatagctgcagcctgggttaaaatataacatcactatttggcttttgttttgcatgatttttaaaagcagtactcctagggaaatggcctctgaagtatatcagtttcatctcttaccaagactgttaagaagaaactagtgggattttgaacaagttatataattgtggtctgaaaagaccctaaactgaagttctgtttaaatatagttacatgaatttctctgatactaatgtactcaacagccaggtataaactatatctcctagtaacattttccatttttgtttaatcaaatacttgcttatgaaggatttcagaaatttgtaataaatgtcagcttttgatagcatagcagtaattgacatttcaaaaatatatatttctttctgtgtttggttgggtgtaatgaggaaaatacctgataaaatgtctgaagacactttctaatgttatcttggtgcataagctgtaatttttattcaaaattaaatttcaaatgtttgcagttttggctaaaacattgagttgaaagaattatgaaaagtgggcccatatgaagtaccatgttcattttgaaatatagatttaagatttagaaatatattaaaagagttaatggagcctcctaaattggattttattttgtgggtgaagaattgtaggaagatgaatgtggcctacagttttagtaatctcctagtggagttttttttaacttagtacttttttatttttaagttttttaatctataaaaaatgtgatttctataaaccatgattacaataaataattatattaaac

SEQ ID NO: 445740 - DNA, 4633 bp, Homo sapiens
ggtggtgtgggagtgggtacggggagggaagtggaggggagggggtaagtgatagggtaggggaggccctgggaaaggcaggacctcgaggcgcggccgcgcgaggtgaccggagtcacagttcccgcaggcggcgacagcagagcgcccactgcctccagcagattaatattaagattggaagtttgtgtcttttgctggatattggaaattgaatgtaatggcaacagaatttataaagagttgctgtggaggatgtttctatggtgaaacagaaaaacacaacttttctgtggaaagagattttaaagcagcagtcccaaatagtcaaaatgctactatctctgtacctccattgacttctgtttctgtaaagcctcagcttggctgtactgaggattatttgctttccaaattaccatctgatggcaaagaagtaccatttgtggtgcccaagtttaagttatcttacattcaacccaggacacaagaaactccttcacatctggaagaacttgaaggatctgccagagcatcttttggagatcgaaaggtagaactttccagttcatcccagcacggacctagctatgatgtgtataacccattctatatgtatcagcacatttcacctgatttgagtcgacgctttcctccccgttcagaagtgacgagactgtatggatcggtttgtgatttaaggacgaacaaacttcccggttcccctgggctaagcaaatctatgtttgatcttacaaactcatctcagcgattcatccagagacatgattcattgtccagtgtacccagtagttcttcttcaaggaaaaattctcaggggagtaacagaagcctggatacaattactctatcaggagatgaaagggactttgggagactgaatgtgaaattgttttataattcttcagtagaacagatctggatcacagttttacagtgcagagatttaagttggccctctagttatggagacactcctactgtttctataaaaggaatacttacattgcccaaaccagtgcatttcaaatcttcagccaaggaaggttccaacgctattgaatttatggaaacgtttgtatttgctattaaacttcaaaatctacaaactgtaagacttgtatttaagattcaaacccagactcccaggaagaaaaccattggagaatgctcaatgtcactcagaacccttagcacacaggaaatggattactctttggatataacaccaccttcaaaaatttctgtttgccatgcagaacttgaattggggacttgttttcaagcagtaaatagcagaattcagttacaaattcttgaggcacggtaccttccaagctcatcaacacctctgactttgagttttttcgtgaaggtgggaatgtttagctcgggagagttgatttataagaaaaagacacgcttactgaaggcctccaatggaagagtcaagtggggagagactatgatttttccacttatacagagtgaaaaagaaattgtttttctcattaagctttacagtcgaagctctgtaagaagaaaacactttgtgggccagatttggataagtgaagacagtaataacattgaagcagtgaaccagtggaaagagacagtaataaatccagaaaaggttgttatcaggtggcacaaattaaatccatcttgaagacttcacacattaatttggtgaagaacttgacattcttttagaagacttatgatttcaatttgctaccaatgagaagaggcaaatcaacaaatttgtcaatttatgggggctataattatggtatataatgtatctgatagaaaatttgataagaaaatgtaatgaattttatcagatatccaaagtaaaggaaatgttttaaaactgcaacaagagacacagacagtaaaatcaaagtattattaggatgactaaataaattataaagtctgtgagaatatcaaccatagatagttctttctatattatgtttttgcttttgtattttaagctttacttagatattcaaaacctggtatatcaagtctctgttagtactattggcatttagaagactttaccattatttcagtgctaggcattattgattaggtcttggctccactgtttacctcttgctatgtattttctcccggtaaaaatgaattgaaccatttcaactattttctatatttggagaaagtttgtgccctgtgttttataatttttttacccataagacatcacattatccctttgtaagctacttatctccaaaaaacttcagaaatagaaaactacattttggcaggaataattgaaaacaccagaaggttgaagtttaattggaaacccagaatatacatactttgctgttttcttccctcaaatattttactatttgttttatttggagttaaaataagagtatcatccatatggtccatcctaattcacagaattaaatgagcttaaatagaaaattcagtattttatgataatcacttcgtttttagtttttaaaatttagattattctataatttaccgtgtttgagtattttctcatttttttcataaccatacctgattatactgtgtaacaaatattttctattgcagttttctttccagtacttattagaactcagtatttggaaataatttcagcttaattgaccataagaactgtggccaaaaagaacagttttttggagaggcagatgacattatacctgattttagaaaatctcactttatttttgctaataagtagactaagtgctctgtgttctcagtcttccctttttttctgcccccattcttactttgtcccaggcatgcagagaaagatggtgatattttaggccaggagtataccttgctataacctaagcatgccttctttattccagctcctatgttctgtgtatatcattaacattttcccaaataaacacttaattctcttttccctaggtgccatctcctcaagctacaaaatgtccacatcttatatcccctttgcttctactgctctgattttgtggtaccagtactctctgccactgaacattttgaaatatttttgttttagatttgcaaaaaatgacatataggtcagtactcacatggatttttaagataaatcacctgtgtgataatattttgaatctgagacgaatacaacttttaaaaattgtttttaaaaatagacttttttttttagagcagttgtaggttaacagaaaaattgagaggaagatagagatttcctttctcccctgacaaagccctcaacagcctcccaggctatcagtatcctgcaccacaatggtacatttgttacaatcaatgaacctactctgaaacatcattatcatccaaagttcatggtttacattagagtcccctcttggtgttatacatgctagaggacaaatatatgatgatatgtatgcatcattataatatagtatagtttcgctgccctaaacatcctctgcaaatgcaactattttaatgggtaccaaagaagtaaatgtatttactggcttttagataataaataacgggctttattgtttattttaaaagctacaatttgttttagctggtttctctgttctattaatgctttgaatttccaaatttaatatatgtagtcatgcatttaacttaatatttaattatttgatttatttaattttctatattcttacaatgtatgtatgatgtataatttaagggaaagctatgacttctcagtttcttagaatcctaggtaaataaaacaataaaaagaaaacccttacatttaaaagagctttcaggtacagaagtattgatacaactaagatcctaaatgttttaattagtgtttacttaagcctttttcaggtgaggaggtactaatgctggttatttccttgaagctttatgtggacctataaataaaaatccaatctcctgctaataggtatgcatattgtgagaaaaacgttaggagctggtagtaaaaaatgagattctatgccaaaataacttctcttcatatttgcctaggcatttcttgacctttacccacttacgcaaggagaaggaaatcataatgatgtcatgtgatcaaaggaaaccatggaagggttcacgctgatagctgatagcttttacagtgctcattcctaacagtggatttacttatggaatcgccacttatatatgtttcagttttgcttttgaacatatttgaattttcatcaggaatagtatataataaagatgatacagagaaacgctttgcatgttctaacaaagggttccctcaagagaatgaaataatcaagttgtatcttttcttagaaaacttgaaaatccagtgtttcttccaaactgaaaatgaaattgcatcaaaagcaatgctaagtgtgttcacatcaggaggacttgctcccagcttgggaatcatgaatagtacatataatggcatcttccactttaatttaacgttgttcagtgatcggattttgtggttggttgatattcctagagaaaacatcacacaaagcacagatattgcagctgtagaagaatggttagttagaatcactttacatca

SEQ ID NO: 445741 - DNA, 831 bp, Homo sapiens
gcggccgcgcggcgccggcccagcgcgggcgtgggacgtggagacccggaggagggcggcgggacccgggcggggaaaggcgcggcgtggcttggctcaggtgcgcttctcccacctggcagctcgctcagggctgtggggggcgcctgtgagggcggccccgccttgcgggctggagattaatattaagattggaagtttgtgtcttttgctggatattggaaattgaatgtaatggcaacagaatttataaagagttgctgtggaggatgtttctatggtgaaacagaaaaacacaacttttctgtggaaagagattttaaagcagcagtcccaaatagtcaaaatgctactatctctgtacctccattgacttctgtttctgtaaagcctcagcttggctgtactgaggattatttgctttccaaattaccatctgatggcaaagaagtaccatttgtggtgcccaagtttaagttatcttacattcaacccaggacacaagaaactccttcacatctggaagaacttgaaggtaaacaataaaatagcagtatttaaaaatcgatatgtagcatttaagtgctattattttacttttatatttttaatacaaaattcatataaaatttttttattttactttttatattttgctctttctgtagaagaacttaatgtacagtagttttgaaaggtcccattttgaaatctgatcataatacaataatttgtatgtagaattggccttttttcaagaaataatatgtaattggccctccatatctttgggttccacatctgtggatttaaccaactgcacctcaaaaa

SEQ ID NO: 445742 - DNA, 284 bp, Homo sapiens
gtatcagcacatttcacctgatttgagtcgacgctttcctccccgttcagaagtgacgagactgtatggatcgggtatgaagatcttttgtgcttttcctctctgtgtttctctttaagaaatttagaaatcaaatgtaagatatgggaataaatgatttttactattaaaagcattttaaaaataagaaaacaagcttcataaatgtgataaacgttatgacatctctgtagtattatatctaatataagaattgaaagattaatgagttatatctgttggta

SEQ ID NO: 445743 - DNA, 577 bp, Homo sapiens
agctgctgattggctgttaccaaaggtgactagagtgctaagccagtcaacagggaaaacttggctcctgactttgggtctttcttctcagtctatatggaagaaaactgagaaaaaatataaaaaagaagaacacaactagttgcgcatctcctaaagagatggaatcgccacttatatatgtttcagttttgcttttgaacatatttgaattttcatcaggaatagtatataataaagatgatacagagaaacgctttgcatgttctaacaaagggttccctcaagagaatgaaataatcaagttgtatcttttcttagaaaacttgaaaatccagtgtttcttccaaactgaaaatgaaattgcatcaaaagcaatgctaagtgtgttcacatcaggaggacttgctcccagcttgggaatcatgaatagtacatataatggcatcttccactttaatttaacgttgttcagtgatcggattttgtggttggttgatattcctagagaaaacatcacacaaagcacagatattgcagctgtagaagaatggttagttagaatcactttacatca

SEQ ID NO: 445744 - DNA, 5057 bp, Homo sapiens
gcggccgcgcggcgccggcccagcgcgggcgtgggacgtggagacccggaggagggcggcgggacccgggcggggaaaggcgcggcgtggcttggctcaggtgcgcttctcccacctggcagctcgctcagggctgtggggggcgcctgtgagggcggccccgccttgcgggctggagattaatattaagattggaagtttgtgtcttttgctggatattggaaattgaatgtaatggcaacagaatttataaagagttgctgtggaggatgtttctatggtgaaacagaaaaacacaacttttctgtggaaagagattttaaagcagcagtcccaaatagtcaaaatgctactatctctgtacctccattgacttctgtttctgtaaagcctcagcttggctgtactgaggattatttgctttccaaattaccatctgatggcaaagaagtaccatttgtggtgcccaagtttaagttatcttacattcaacccaggacacaagaaactccttcacatctggaagaacttgaaggatctgccagagcatcttttggagatcgaaaggtagaactttccagttcatcccagcacggacctagctatgatgtgtataacccattctatatgtatcagcacatttcacctgatttgagtcgacgctttcctccccgttcagaagtgacgagactgtatggatcggtttgtgatttaaggacgaacaaacttcccggttcccctgggctaagcaaatctatgtttgatcttacaaactcatctcagcgattcatccagagacatgattcattgtccagtgtacccagtagttcttcttcaaggaaaaattctcaggggagtaacagaagcctggatacaattactctatcaggagatgaaagggactttgggagactgaatgtgaaattgttttataattcttcagtagaacagatctggatcacagttttacagtgcagagatttaagttggccctctagttatggagacactcctactgtttctataaaaggaatacttacattgcccaaaccagtgcatttcaaatcttcagccaaggaaggttccaacgctattgaatttatggaaacgtttgtatttgctattaaacttcaaaatctacaaactgtaagacttgtatttaagattcaaacccagactcccaggaagaaaaccattggagaatgctcaatgtcactcagaacccttagcacacaggaaatggattactctttggatataacaccaccttcaaaaatttctgtttgccatgcagaacttgaattggggacttgttttcaagcagtaaatagcagaattcagttacaaattcttgaggcacggtaccttccaagctcatcaacacctctgactttgagttttttcgtgaaggtgggaatgtttagctcgggagagttgatttataagaaaaagacacgcttactgaaggcctccaatggaagagtcaagtggggagagactatgatttttccacttatacagagtgaaaaagaaattgtttttctcattaagctttacagtcgaagctctgtaagaagaaaacactttgtgggccagatttggataagtgaagacagtaataacattgaagcagtgaaccagtggaaagagacagtaataaatccagaaaaggttgttatcaggtggcacaaattaaatccatcttgaagacttcacacattaatttggtgaagaacttgacattcttttagaagacttatgatttcaatttgctaccaatgagaagaggcaaatcaacaaatttgtcaatttatgggggctataattatggtatataatgtatctgatagaaaatttgataagaaaatgtaatgaattttatcagatatccaaagtaaaggaaatgttttaaaactgcaacaagagacacagacagtaaaatcaaagtattattaggatgactaaataaattataaagtctgtgagaatatcaaccatagatagttctttctatattatgtttttgcttttgtattttaagctttacttagatattcaaaacctggtatatcaagtctctgttagtactattggcatttagaagactttaccattatttcagtgctaggcattattgattaggtcttggctccactgtttacctcttgctatgtattttctcccggtaaaaatgaattgaaccatttcaactattttctatatttggagaaagtttgtgccctgtgttttataatttttttacccataagacatcacattatccctttgtaagctacttatctccaaaaaacttcagaaatagaaaactacattttggcaggaataattgaaaacaccagaaggttgaagtttaattggaaacccagaatatacatactttgctgttttcttccctcaaatattttactatttgttttatttggagttaaaataagagtatcatccatatggtccatcctaattcacagaattaaatgagcttaaatagaaaattcagtattttatgataatcacttcgtttttagtttttaaaatttagattattctataatttaccgtgtttgagtattttctcatttttttcataaccatacctgattatactgtgtaacaaatattttctattgcagttttctttccagtacttattagaactcagtatttggaaataatttcagcttaattgaccataagaactgtggccaaaaagaacagttttttggagaggcagatgacattatacctgattttagaaaatctcactttatttttgctaataagtagactaagtgctctgtgttctcagtcttccctttttttctgcccccattcttactttgtcccaggcatgcagagaaagatggtgatattttaggccaggagtataccttgctataacctaagcatgccttctttattccagctcctatgttctgtgtatatcattaacattttcccaaataaacacttaattctcttttccctaggtgccatctcctcaagctacaaaatgtccacatcttatatcccctttgcttctactgctctgattttgtggtaccagtactctctgccactgaacattttgaaatatttttgttttagatttgcaaaaaatgacatataggtcagtactcacatggatttttaagataaatcacctgtgtgataatattttgaatctgagacgaatacaacttttaaaaattgtttttaaaaatagacttttttttttagagcagttgtaggttaacagaaaaattgagaggaagatagagatttcctttctcccctgacaaagccctcaacagcctcccaggctatcagtatcctgcaccacaatggtacatttgttacaatcaatgaacctactctgaaacatcattatcatccaaagttcatggtttacattagagtcccctcttggtgttatacatgctagaggacaaatatatgatgatatgtatgcatcattataatatagtatagtttcgctgccctaaacatcctctgcaaatgcaactattttaatgggtaccaaagaagtaaatgtatttactggcttttagataataaataacgggctttattgtttattttaaaagctacaatttgttttagctggtttctctgttctattaatgctttgaatttccaaatttaatatatgtagtcatgcatttaacttaatatttaattatttgatttatttaattttctatattcttacaatgtatgtatgatgtataatttaagggaaagctatgacttctcagtttcttagaatcctaggtaaataaaacaataaaaagaaaacccttacatttaaaagagctttcaggtacagaagtattgatacaactaagatcctaaatgttttaattagtgtttacttaagcctttttcaggtgaggaggtactaatgctggttatttccttgaagctttatgtggacctataaataaaaatccaatctcctgctaataggtatgcatattgtgagaaaaacgttaggagctggtagtaaaaaatgagattctatgccaaaataacttctcttcatatttgcctaggcatttcttgacctttacccacttacgcaaggagaaggaaatcataatgatgtcatgtgatcaaaggaaaccatggaagggttcacgctgatagctgatagcttttacagtgctcattcctaacagtggatttacttgtaagctttcagatcaacacaaatagctgcagcctgggttaaaatataacatcactatttggcttttgttttgcatgatttttaaaagcagtactcctagggaaatggcctctgaagtatatcagtttcatctcttaccaagactgttaagaagaaactagtgggattttgaacaagttatataattgtggtctgaaaagaccctaaactgaagttctgtttaaatatagttacatgaatttctctgatactaatgtactcaacagccaggtataaactatatctcctagtaacattttccatttttgtttaatcaaatacttgcttatgaaggatttcagaaatttgtaataaatgtcagcttttgatagcatagcagtaattgacatttcaaaaatatatatttctttctgtgtttggttgggtgtaatgaggaaaatacctgataaaatgtctgaagacactttctaatgttatcttggtgcataagctgtaatttttattcaaaattaaatttcaaatgtttgcagttttggctaaaacattgagttgaaagaattatgaaaagtgggcccatatgaagtaccatgttcattttgaaatatagatttaagatttagaaatatattaaaagagttaatggagcctcctaaattggattttattttgtgggtgaagaattgtaggaagatgaatgtggcctacagttttagtaatctcctagtggagttttttttaacttagtacttttttatttttaagttttttaatctataaaaaatgtgatttctataaaccatgattacaataaataattatattaaac

SEQ ID NO: 445745 - DNA, 4182 bp, Homo sapiens
cctagttttagaagtttcaatagcacctagtttagaagtttcaatagtcctagttttagaagtttcaatagcacagatctggatcacagttttacagtgcagagatttaagttggccctctagttatggagacactcctactgtttctataaaaggaatacttacattgcccaaaccagtgcatttcaaatcttcagccaaggaaggttccaacgctattgaatttatggaaacgtttgtatttgctattaaacttcaaaatctacaaactgtaagacttgtatttaagattcaaacccagactcccaggaagaaaaccattggagaatgctcaatgtcactcagaacccttagcacacaggaaatggattactctttggatataacaccaccttcaaaaatttctgtttgccatgcagaacttgaattggggacttgttttcaagcagtaaatagcagaattcagttacaaattcttgaggcacggtaccttccaagctcatcaacacctctgactttgagttttttcgtgaaggtgggaatgtttagctcgggagagttgatttataagaaaaagacacgcttactgaaggcctccaatggaagagtcaagtggggagagactatgatttttccacttatacagagtgaaaaagaaattgtttttctcattaagctttacagtcgaagctctgtaagaagaaaacactttgtgggccagatttggataagtgaagacagtaataacattgaagcagtgaaccagtggaaagagacagtaataaatccagaaaaggttgttatcaggtggcacaaattaaatccatcttgaagacttcacacattaatttggtgaagaacttgacattcttttagaagacttatgatttcaatttgctaccaatgagaagaggcaaatcaacaaatttgtcaatttatgggggctataattatggtatataatgtatctgatagaaaatttgataagaaaatgtaatgaattttatcagatatccaaagtaaaggaaatgttttaaaactgcaacaagagacacagacagtaaaatcaaagtattattaggatgactaaataaattataaagtctgtgagaatatcaaccatagatagttctttctatattatgtttttgcttttgtattttaagctttacttagatattcaaaacctggtatatcaagtctctgttagtactattggcatttagaagactttaccattatttcagtgctaggcattattgattaggtcttggctccactgtttacctcttgctatgtattttctcccggtaaaaatgaattgaaccatttcaactattttctatatttggagaaagtttgtgccctgtgttttataatttttttacccataagacatcacattatccctttgtaagctacttatctccaaaaaacttcagaaatagaaaactacattttggcaggaataattgaaaacaccagaaggttgaagtttaattggaaacccagaatatacatactttgctgttttcttccctcaaatattttactatttgttttatttggagttaaaataagagtatcatccatatggtccatcctaattcacagaattaaatgagcttaaatagaaaattcagtattttatgataatcacttcgtttttagtttttaaaatttagattattctataatttaccgtgtttgagtattttctcatttttttcataaccatacctgattatactgtgtaacaaatattttctattgcagttttctttccagtacttattagaactcagtatttggaaataatttcagcttaattgaccataagaactgtggccaaaaagaacagttttttggagaggcagatgacattatacctgattttagaaaatctcactttatttttgctaataagtagactaagtgctctgtgttctcagtcttccctttttttctgcccccattcttactttgtcccaggcatgcagagaaagatggtgatattttaggccaggagtataccttgctataacctaagcatgccttctttattccagctcctatgttctgtgtatatcattaacattttcccaaataaacacttaattctcttttccctaggtgccatctcctcaagctacaaaatgtccacatcttatatcccctttgcttctactgctctgattttgtggtaccagtactctctgccactgaacattttgaaatatttttgttttagatttgcaaaaaatgacatataggtcagtactcacatggatttttaagataaatcacctgtgtgataatattttgaatctgagacgaatacaacttttaaaaattgtttttaaaaatagacttttttttttagagcagttgtaggttaacagaaaaattgagaggaagatagagatttcctttctcccctgacaaagccctcaacagcctcccaggctatcagtatcctgcaccacaatggtacatttgttacaatcaatgaacctactctgaaacatcattatcatccaaagttcatggtttacattagagtcccctcttggtgttatacatgctagaggacaaatatatgatgatatgtatgcatcattataatatagtatagtttcgctgccctaaacatcctctgcaaatgcaactattttaatgggtaccaaagaagtaaatgtatttactggcttttagataataaataacgggctttattgtttattttaaaagctacaatttgttttagctggtttctctgttctattaatgctttgaatttccaaatttaatatatgtagtcatgcatttaacttaatatttaattatttgatttatttaattttctatattcttacaatgtatgtatgatgtataatttaagggaaagctatgacttctcagtttcttagaatcctaggtaaataaaacaataaaaagaaaacccttacatttaaaagagctttcaggtacagaagtattgatacaactaagatcctaaatgttttaattagtgtttacttaagcctttttcaggtgaggaggtactaatgctggttatttccttgaagctttatgtggacctataaataaaaatccaatctcctgctaataggtatgcatattgtgagaaaaacgttaggagctggtagtaaaaaatgagattctatgccaaaataacttctcttcatatttgcctaggcatttcttgacctttacccacttacgcaaggagaaggaaatcataatgatgtcatgtgatcaaaggaaaccatggaagggttcacgctgatagctgatagcttttacagtgctcattcctaacagtggatttacttgtaagctttcagatcaacacaaatagctgcagcctgggttaaaatataacatcactatttggcttttgttttgcatgatttttaaaagcagtactcctagggaaatggcctctgaagtatatcagtttcatctcttaccaagactgttaagaagaaactagtgggattttgaacaagttatataattgtggtctgaaaagaccctaaactgaagttctgtttaaatatagttacatgaatttctctgatactaatgtactcaacagccaggtataaactatatctcctagtaacattttccatttttgtttaatcaaatacttgcttatgaaggatttcagaaatttgtaataaatgtcagcttttgatagcatagcagtaattgacatttcaaaaatatatatttctttctgtgtttggttgggtgtaatgaggaaaatacctgataaaatgtctgaagacactttctaatgttatcttggtgcataagctgtaatttttattcaaaattaaatttcaaatgtttgcagttttggctaaaacattgagttgaaagaattatgaaaagtgggcccatatgaagtaccatgttcattttgaaatatagatttaagatttagaaatatattaaaagagttaatggagcctcctaaattggattttattttgtgggtgaagaattgtaggaagatgaatgtggcctacagttttagtaatctcctagtggagttttttttaacttagtacttttttatttttaagttttttaatctataaaaaatgtgatttctataaaccatgattacaataaataattatattaaac

SEQ ID NO: 445746 - DNA, 2121 bp, Homo sapiens
ggtggtgtgggagtgggtacggggagggaagtggaggggagggggtaagtgatagggtaggggaggccctgggaaaggcaggacctcgaggcgcggccgcgcgaggtgaccggagtcacagttcccgcaggcggcgacagcagagcgcccactgcctccagcagattaatattaagattggaagtttgtgtcttttgctggatattggaaattgaatgtaatggcaacagaatttataaagagttgctgtggaggatgtttctatggtgaaacagaaaaacacaacttttctgtggaaagagattttaaagcagcagtcccaaatagtcaaaatgctactatctctgtacctccattgacttctgtttctgtaaagcctcagcttggctgtactgaggattatttgctttccaaattaccatcacaatggtacatttgttacaatcaatgaacctactctgaaacatcattatcatccaaagttcatggtttacattagagtcccctcttggtgttatacatgctagaggacaaatatatgatgatatgtatgcatcattataatatagtatagtttcgctgccctaaacatcctctgcaaatgcaactattttaatgggtaccaaagaagtaaatgtatttactggcttttagataataaataacgggctttattgtttattttaaaagctacaatttgttttagctggtttctctgttctattaatgctttgaatttccaaatttaatatatgtagtcatgcatttaacttaatatttaattatttgatttatttaattttctatattcttacaatgtatgtatgatgtataatttaagggaaagctatgacttctcagtttcttagaatcctaggtaaataaaacaataaaaagaaaacccttacatttaaaagagctttcaggtacagaagtattgatacaactaagatcctaaatgttttaattagtgtttacttaagcctttttcaggtgaggaggtactaatgctggttatttccttgaagctttatgtggacctataaataaaaatccaatctcctgctaataggtatgcatattgtgagaaaaacgttaggagctggtagtaaaaaatgagattctatgccaaaataacttctcttcatatttgcctaggcatttcttgacctttacccacttacgcaaggagaaggaaatcataatgatgtcatgtgatcaaaggaaaccatggaagggttcacgctgatagctgatagcttttacagtgctcattcctaacagtggatttacttgtaagctttcagatcaacacaaatagctgcagcctgggttaaaatataacatcactatttggcttttgttttgcatgatttttaaaagcagtactcctagggaaatggcctctgaagtatatcagtttcatctcttaccaagactgttaagaagaaactagtgggattttgaacaagttatataattgtggtctgaaaagaccctaaactgaagttctgtttaaatatagttacatgaatttctctgatactaatgtactcaacagccaggtataaactatatctcctagtaacattttccatttttgtttaatcaaatacttgcttatgaaggatttcagaaatttgtaataaatgtcagcttttgatagcatagcagtaattgacatttcaaaaatatatatttctttctgtgtttggttgggtgtaatgaggaaaatacctgataaaatgtctgaagacactttctaatgttatcttggtgcataagctgtaatttttattcaaaattaaatttcaaatgtttgcagttttggctaaaacattgagttgaaagaattatgaaaagtgggcccatatgaagtaccatgttcattttgaaatatagatttaagatttagaaatatattaaaagagttaatggagcctcctaaattggattttattttgtgggtgaagaattgtaggaagatgaatgtggcctacagttttagtaatctcctagtggagttttttttaacttagtacttttttatttttaagttttttaatctataaaaaatgtgatttctataaaccatgattacaataaataattatattaaac

SEQ ID NO: 445747 - DNA, 6001 bp, Homo sapiens
gtaaaagtgatggttgactcaggagaccggaagcgagccatcagttctgtgtgcacctacattgtttatcagtgtagtcggccagctcctttacactccagggatctgcactccatgatagtggcagcttttcagtgtctctgtgtctggctgacagagcaccctgatatgcttgatgaaaaggactgccttaaggaagtactggagattgtggaactgggtatctcaggaagtaagtccaagaacaatgagcaagaggtcaagtacaaaggagataaggagccaaaccctgcatctatgagggtaaaggatgctgctgaagccaccctaacatgcattatgcagttgctcggcgcatttccttcacctagtggtcctgcctctccttgtagtcttgtgaatgagaccactttgattaaatactccaggctgccaaccataaacaagcatagtttccggtactttgtcttggataacagtgtcatcctggcaatgctggaacaacctcttggaaatgagcagaatgattttttcccctctgtcactgtgctggtccggggaatgtctggaagacttgcttgggcacaacagctttgtcttttacccagaggagcaaaagcaaatcagaagctttttgtacctgaacctcgcccagttcctaaaaatgacgttggatttaaatattctgtgaaacatcggccatttcctgaagaggtggacaagattccttttgtgaaagcagatctcagcattccagatttgcatgaaatagtcactgaagaatttagaagagagacacgaaaaattaaggagtggcatggcccagcagattgcttatgaaatacaccttgagcaacagagtgaggaggaattgcagaagagaagttttcctgacccagttacggattgcaagcccccgcctcctgcccaggaattccaaacagcccgcctttttctctcacactttggatttttgtccttagaagcactgaaggaacctgcaaatagtcgtctacctcctcaccttattgcacttgattccacgatacctggattttttgatgacattgggtatctggatctcttgccatgtcgtccttttgacacagtttttattttctatatgaagccaggtcagaaaacgaaccaagagattttaaagaatgtggagtcttccagaactgttcagccacatttcctagaatttttgctttcccttggctggtcagtagatgtgggcagacaccctggttggactgggcatgtttctaccagttggtctattaattgttgtgatgatggtgaaggatctcaacaagaagtgatttcctctgaagatattggagctagcattttcaatggacagaagaaggtgctgtattatgctgatgcccttacagaaattgcttttgtggttccttctcctgtggagtccttaactgattcattggaaagtaacatctcggaccaagatagtgattcaaatatggatcttatgccaggaattctgaaacagccatccctgacacttgagcttttccccaatcatacagacaatcttaattcctcacagaggctcagtcccagttccagaatgaggaagctgcctcagggtcgccctgttcctccccttggacctgagacaagagtttctgtagtctgggtggaacgctatgatgatatagaaaactttcccctctcagagctgatgacagagatcagtactggtgtggaaactactgcaaatagtagcacttcactgagatctacaactcttgaaaaagaagttcctgtcatcttcatccaccctttaaacactggattattccggataaaaattcaaggagccactggaaaatttaatatggtcatccctcttgtggatgggatgattgtcagcaggcgagctcttggctttctggtgaggcagactgtaattaacatttgtagaagaaagagactggaaagtgactcctacagtcccccccatgtccgccggaaacagaaaatcaccgacattgtcaacaagtaccggaacaagcagctggagccagagttttatacttcacttttccaggaggttggactcaagaactgcagttcttagaccactgaatttctaagactgttgaactccagtttgggaactataacacagcagaacagtttgataggtgatcactgtaaaaataaaaacaaatcactcccaagagcttactgtttaatcaccagaatagaagaaacacattataacccatttgatagaagactttgggctatctagtgaaatgggctcccagacacaatcatactcctgctgataatgatgatatacattttagccataaactttcttttaaaagtgacaattttagttaaacataagccttttgaggagaaaggcttttatgcatctcagttaaacacgtgcattggtagtatcaacaaatttgcaatatagaagttgaagatagttttttacctcactttttaggaggttgtattcaaaattaaaatctcagaatcttacaggacatttaaagactcatgttgatagcatggaggagaaggaaagaagtcacagccttctactcagttgtaggtcttcttgtcatccagctgtcacactgacaaaaagaaaagatgatacatgttttttgctcagataagaagcctgacattaaaagatgtcatatttttttctccacatttcaaaaagttgtccttctcatcactgcacagatctgtctgaaagcctcagtttctgagtgacccaggaacagatcagaaatggagcatggccttgtcctttaatggggatgcaaataaagtttgtggggttaaaagttataagacagcagtgataccccactctctccattattgtccagcggggtgacataatgacaggttaaatatttgtgattcattgattaaatattatttaaagaaatgtaaattcacaataagggttgaaaattatttggtttcatccattgtctcttatttcaggaccaagcagcaaactgcagtagtttgtgaaggattctaatatggggttcaggaatagcctctcaacgctactaattcagatctctcccagagaactactggatttcctcataattgacaaacatgagtgaccacctctttgggtggctactgttagaaatggctgttgtcatgttttctggactttgccagccaacagatccctgccaggttttggaaatacttctattacctcgctgctacttttctgcagggataaaacttttgaggtggccagacccagaacatccaaggattcctgttacagtgctacagtatacactgctcatttatcctattctcatgtgctttcttctttagtaagattattttaagaaaataagtgatatttaaagtccaaagaggaatgatcacagttgtataaggggtgttttcccacttgaactctgatgtcagtcgactgtgggtcagagctacaaccatctgtttggtttgatgttttggtggtttacttacggagtggggatagtgtgagacctaattccctgtgcaaatgtctcttattccagaaatgtgcattttgtcatctataagcaagaaatatgggcatagcagctcttggtttaaagtttgccataacctgttcatgtttgttttaagctcaggtaaagataacctcctctttctatgactccagtttccattcaggttatagtattattcaatagttgattttctttttaagctgggcaataaattgatgtttccagatggtaacatgggagagggcatataggataaagatgagcaaattctaccctaaaaatgttctagtagttcacaggaagaagatgaggtttaataactttcaaggtaattctagattgacattttgaggggaaaatgggctcttgttctagttgaagtgagcagagaaggctataaattaatatgtaacttacagcattccagaggttaaaaataactgatgcagatgtacttcttcagtgtgattcttcagatcaaacttttacttttggcatagttaatttcagaaaaatgtgctgtatgtgtgtgtgtatgagggttggtcttgctgatccttcagttagctctaaattctggcaactccttgtaattccaatgtatttgatacatgaacaatcatgttgaatgcatttgtgatctgggagacttcctcgtcttccagggaaggaaggatgtgcagcccctgaaggcatgaaactcccagtgtgtacggagccagtggaatatgggatacccataccttaccaggcgctggttccttctgctcacaataacatctgcccaaagagggagtgggaagaacgcttagctctttcactagtatggatttgagttcatggtcactatttttacccacctgcctttgttaaaaatcactttgagtagaatagcactggaggaacatatttagcacctaatattaatatttagtagtccattgataaatttgccagcatatgttctagcctctggggggaaaccaggaccacttttgtctgtggcttaaacagttcagttgctatatctgttgggtatgccgggggtggatgagtgtggcattccgtgaagaggaaggtggtaagtaaggtttcccttctactgccttcttaagttgcaggagggagcttttctcctcccctctggttgggagcactgaggacagtgaggagggcttttaccttgttaatcctttccttatttagctagctttcctttttgtctagggcttcctcttgagaccctcttccatccattgggcctttgaaaggactaatcagacacacacacacacacacacacacacacacacacacactcgcatactcatgcacattttccttcatttccagatcctttatttcagagcagcccattttcctctggattcattgatgaatacaagtacccacacctttggccagtaatgtcagttacctgctgcaggttctgtgtatgaggccttcatgaacggttaccttctccatacactagggaagcatttgtcagactctgcagactgggttctagagaggcagagtctttaagagtattcatttcttctggaaggtggagctttacccaaagtggaagttagccttgctcaaagatgtgttttgtggtaggtggtaaaaataaataaataaataaataataaaaaaagaaacatgtattggaggtaatttgacactgctgctggcagtagttctctattcaccattttaaagcccattcaggttctctcttcctgaaaagaactgattgctgtgtttacatgaaatgacattggagtcagatggtctgttttaaagatttccatgacagcctcttttcctgagttggagagattggaggtggtctatccgtacgatgtggaatcaaacggtgggtttcttagtagctaaagaagccatgtacttctagtgtgtttctcagaatatcaactcatgttcttcagatgcttttctttttttaatggtgagggaaaaggtataatttgggattccacagtgccttgcatatagtaggcgcccagtaaatacttgttgaagcaaaccaagtttcccaagtcctcatctcttatagtgaccaagacatctttctcctctgaagggcttggcagttgtggctaaaaaataagcagtatcattatttgcttgaaatcatatatacagtttgtatgaatttcagtatgttgccaagacatgattttttcttattgtattttctgtaaatatttctggcactgaactgtaaagtaaaggcaaagtgtaaatatgaaggcgtgcccgtgccccttgcctcctgtgtttcatcttcgtcggttagggaagaaggtccagaggtttgtttgtatttatgccgatcctttgtccagaagaagcccatggaatattgaatgtaatacatttagtcaattaaattttaaggagattcttatcta

SEQ ID NO: 445748 - DNA, 4543 bp, Homo sapiens
cgagaatcgctgtcctctccttgcggccgccagtgtggtggaattcattctgaaacagccatccctgacacttgagcttttccccaatcatacagacaatcttaattcctcacagaggctcagtcccagttccagaatgaggaagctgcctcagggtcgccctgttcctccccttggacctgagacaagagtttctgtagtctgggtggaacgctatgatgatatagaaaactttcccctctcagagctgatgacagagatcagtactggtgtggaaactactgcaaatagtagcacttcactgagatctacaactcttgaaaaagaagttcctgtcatcttcatccaccctttaaacactggattattccggataaaaattcaaggagccactggaaaatttaatatggtcatccctcttgtggatgggatgattgtcagcaggcgagctcttggctttctggtgaggcagactgtaattaacatttgtagaagaaagagactggaaagtgactcctacagtcccccccatgtccgccggaaacagaaaatcaccgacattgtcaacaagtaccggaacaagcagctggagccagagttttatacttcacttttccaggaggttggactcaagaactgcagttcttagaccactgaatttctaagactgttgaactccagtttgggaactataacacagcagaacagtttgataggtgatcactgtaaaaataaaaacaaatcactcccaagagcttactgtttaatcaccagaatagaagaaacacattataacccatttgatagaagactttgggctatctagtgaaatgggctcccagacacaatcatactcctgctgataatgatgatatacattttagccataaactttcttttaaaagtgacaattttagttaaacataagccttttgaggagaaaggcttttatgcatctcagttaaacacgtgcattggtagtatcaacaaatttgcaatatagaagttgaagatagttttttacctcactttttaggaggttgtattcaaaattaaaatctcagaatcttacaggacatttaaagactcatgttgatagcatggaggagaaggaaagaagtcacagccttctactcagttgtaggtcttcttgtcatccagctgtcacactgacaaaaagaaaagatgatacatgttttttgctcagataagaagcctgacattaaaagatgtcatatttttttctccacatttcaaaaagttgtccttctcatcactgcacagatctgtctgaaagcctcagtttctgagtgacccaggaacagatcagaaatggagcatggccttgtcctttaatggggatgcaaataaagtttgtggggttaaaagttataagacagcagtgataccccactctctccattattgtccagcggggtgacataatgacaggttaaatatttgtgattcattgattaaatattatttaaagaaatgtaaattcacaataagggttgaaaattatttggtttcatccattgtctcttatttcaggaccaagcagcaaactgcagtagtttgtgaaggattctaatatggggttcaggaatagcctctcaacgctactaattcagatctctcccagagaactactggatttcctcataattgacaaacatgagtgaccacctctttgggtggctactgttagaaatggctgttgtcatgttttctggactttgccagccaacagatccctgccaggttttggaaatacttctattacctcgctgctacttttctgcagggataaaacttttgaggtggccagacccagaacatccaaggattcctgttacagtgctacagtatacactgctcatttatcctattctcatgtgctttcttctttagtaagattattttaagaaaataagtgatatttaaagtccaaagaggaatgatcacagttgtataaggggtgttttcccacttgaactctgatgtcagtcgactgtgggtcagagctacaaccatctgtttggtttgatgttttggtggtttacttacggagtggggatagtgtgagacctaattccctgtgcaaatgtctcttattccagaaatgtgcattttgtcatctataagcaagaaatatgggcatagcagctcttggtttaaagtttgccataacctgttcatgtttgttttaagctcaggtaaagataacctcctctttctatgactccagtttccattcaggttatagtattattcaatagttgattttctttttaagctgggcaataaattgatgtttccagatggtaacatgggagagggcatataggataaagatgagcaaattctaccctaaaaatgttctagtagttcacaggaagaagatgaggtttaataactttcaaggtaattctagattgacattttgaggggaaaatgggctcttgttctagttgaagtgagcagagaaggctataaattaatatgtaacttacagcattccagaggttaaaaataactgatgcagatgtacttcttcagtgtgattcttcagatcaaacttttacttttggcatagttaatttcagaaaaatgtgctgtatgtgtgtgtgtatgagggttggtcttgctgatccttcagttagctctaaattctggcaactccttgtaattccaatgtatttgatacatgaacaatcatgttgaatgcatttgtgatctgggagacttcctcgtcttccagggaaggaaggatgtgcagcccctgaaggcatgaaactcccagtgtgtacggagccagtggaatatgggatacccataccttaccaggcgctggttccttctgctcacaataacatctgcccaaagagggagtgggaagaacgcttagctctttcactagtatggatttgagttcatggtcactatttttacccacctgcctttgttaaaaatcactttgagtagaatagcactggaggaacatatttagcacctaatattaatatttagtagtccattgataaatttgccagcatatgttctagcctctggggggaaaccaggaccacttttgtctgtggcttaaacagttcagttgctatatctgttgggtatgccgggggtggatgagtgtggcattccgtgaagaggaaggtggtaagtaaggtttcccttctactgccttcttaagttgcaggagggagcttttctcctcccctctggttgggagcactgaggacagtgaggagggcttttaccttgttaatcctttccttatttagctagctttcctttttgtctagggcttcctcttgagaccctcttccatccattgggcctttgaaaggactaatcagacacacacacacacacacacacacacacacacacacactcgcatactcatgcacattttccttcatttccagatcctttatttcagagcagcccattttcctctggattcattgatgaatacaagtacccacacctttggccagtaatgtcagttacctgctgcaggttctgtgtatgaggccttcatgaacggttaccttctccatacactagggaagcatttgtcagactctgcagactgggttctagagaggcagagtctttaagagtattcatttcttctggaaggtggagctttacccaaagtggaagttagccttgctcaaagatgtgttttgtggtaggtggtaaaaataaataaataaataaataataaaaaaagaaacatgtattggaggtaatttgacactgctgctggcagtagttctctattcaccattttaaagcccattcaggttctctcttcctgaaaagaactgattgctgtgtttacatgaaatgacattggagtcagatggtctgttttaaagatttccatgacagcctcttttcctgagttggagagattggaggtggtctatccgtacgatgtggaatcaaacggtgggtttcttagtagctaaagaagccatgtacttctagtgtgtttctcagaatatcaactcatgttcttcagatgcttttctttttttaatggtgagggaaaaggtataatttgggattccacagtgccttgcatatagtaggcgcccagtaaatacttgttgaagcaaaccaagtttcccaagtcctcatctcttatagtgaccaagacatctttctcctctgaagggcttggcagttgtggctaaaaaataagcagtatcattatttgcttgaaatcatatatacagtttgtatgaatttcagtatgttgccaagacatgattttttcttattgtattttctgtaaatatttctggcactgaactgtaaagtaaaggcaaagtgtaaatatgaaggcgtgcccgtgccccttgcctcctgtgtttcatcttcgtcggttagggaagaaggtccagaggtttgtttgtatttatgccgatcctttgtccagaagaagcccatggaatattgaatgtaatacatttagtcaattaaattttaaggagattcttatcta

SEQ ID NO: 445749 - DNA, 5838 bp, Homo sapiens
gtaaaagtgatggttgactcaggagaccggaagcgagccatcagttctgtgtgcacctacattgtttatcagtgtagtcggccagctcctttacactccagggatctgcactccatgatagtggcagcttttcagtgtctctgtgtctggctgacagagcaccctgatatgcttgatgaaaaggactgccttaaggaagtactggagattgtggaactgggtatctcaggaagtaagtccaagaacaatgagcaagaggtcaagtacaaaggagataaggagccaaaccctgcatctatgagggtaaaggatgctgctgaagccaccctaacatgcattatgcagttgctcggcgcatttccttcacctagtggtcctgcctctccttgtagtcttgtgaatgagaccactttgattaaatactccaggctgccaaccataaacaagcatagtttccggtactttgtcttggataacagtgtcatcctggcaatgctggaacaacctcttggaaatgagcagaatgattttttcccctctgtcactgtgctggtccggggaatgtctggaagacttgcttgggcacaacagctttgtcttttacccagaggagcaaaagcaaatcagaagctttttgtacctgaacctcgcccagttcctaaaaatgacgttggatttaaatattctgtgaaacatcggccatttcctgaagaggtggacaagattccttttgtgaaagcagatctcagcattccagatttgcatgaaatagtcactgaagaatttagaagagagacacgaaaaattaaggagtggcatggcccagcagattgcttatgaaatacaccttgagcaacagagtgaggaggaattgcagaagagaagttttcctgacccagttacggattgcaagcccccgcctcctgcccaggaattccaaacagcccgcctttttctctcacactttggatttttgtccttagaagcactgaaggaacctgcaaatagtcgtctacctcctcaccttattgcacttgattccacgatacctggattttttgatgacattgggtatctggatctcttgccatgtcgtccttttgacacagtttttattttctatatgaagccaggtcagaaaacgaaccaagagattttaaagaatgtggagtcttccagaactgttcagccacatttcctagaatttttgctttcccttggctggtcagtagatgtgggcagacaccctggttggactgggcatgtttctaccagttggtctattaattgttgtgatgatggtgaaggatctcaacaagaagtgatttcctctgaagatattggagctagcattttcaatggacagaagaaggtgctgtattatgctgatgcccttacagaaattgcttttgtggttccttctcctgtggagtccttaactgattcattggaaagtaacatctcggaccaagatagtgattcaaatatggatcttatgccaggaattctgaaacagccatccctgacacttgagcttttccccaatcatacagacaatcttaattcctcacagaggctcagtcccagttccagaatgaggaagctgcctcagggtcgccctgttcctccccttggacctgagacaagagtttctgtagtctgggtggaacgctatgatgatatagaaaactttcccctctcagagctgatgacagagatcagtactggtgtggaaactactgcaaatagtagcacttcactgagatctacaactcttgaaaaagaagttcctgtcatcttcatccaccctttaaacactggattattccggataaaaattcaaggagccactggaaaatttaatatggtcatccctcttgtggatgggatgattgtcagcaggcgagctcttggctttctggtgaggcagactgtaattaacatttgtagaagaaagagactggaaagtgactcctacagtcccccccatgtccgccggaaacagaaaatcaccgacattgtcaacaagtaccggaacaagcagctggagccagagttttatacttcacttttccaggaggttggactcaagaactgcagttcttagaccactgaatttctaagactgttgaactccagtttgggaactataacacagcagaacagtttgataggtgatcactgtaaaaataaaaacaaatcactcccaagagcttactgtttaatcaccagaatagaagaaacacattataacccatttgatagaagactttgggctatctagtgaaatgggctcccagacacaatcatactcctgctgataatgatgatatacattttagccataaactttcttttaaaagtgacaattttagttaaacataagccttttgaggagaaaggcttttatgcatctcagttaaacacgtgcattggtagtatcaacaaatttgcaatatagaagttgaagatagttttttacctcactttttaggaggttgtattcaaaattaaaatctcagaatcttacaggacatttaaagactcatgttgatagcatggaggagaaggaaagaagtcacagccttctactcagttgtaggtcttcttgtcatccagctgtcacactgacaaaaagaaaagatgatacatgttttttgctcagataagaagcctgacattaaaagatgtcatatttttttctccacatttcaaaaagttgtccttctcatcactgcacagatctgtctgaaagcctcagtttctgagtgacccaggaacagatcagaaatggagcatggccttgtcctttaatggggatgcaaataaagtttgtggggttaaaagttataagacagcagtgataccccactctctccattattgtccagcggggtgacataatgacaggttaaatatttgtgattcattgattaaatattatttaaagaaatgtaaattcacaataagggttgaaaattatttggtttcatccattgtctcttatttcaggaccaagcagcaaactgcagtagtttgtgaaggattctaatatggggttcaggaatagcctctcaacgctactaattcagatctctcccagagaactactggatttcctcataattgacaaacatgagtgaccacctctttgggtggctactgttagaaatggctgttgtcatgttttctggactttgccagccaacagatccctgccaggttttggaaatacttctattacctcgctgctacttttctgcagggataaaacttttgaggtggccagacccagaacatccaaggattcctgttacagtgctacagtatacactgctcatttatcctattctcatgtgctttcttctttagtaagattattttaagaaaataagtgatatttaaagtccaaagaggaatgatcacagttgtataaggggtgttttcccacttgaactctgatgtcagtcgactgtgggtcagagctacaaccatctgtttggtttgatgttttggtggtttacttacggagtggggatagtgtgagacctaattccctgtgcaaatgtctcttattccagaaatgtgcattttgtcatctataagcaagaaatatgggcatagcagctcttggtttaaagtttgccataacctgttcatgtttgttttaagctcaggtaaagataacctcctctttctatgactccagtttccattcaggttatagtattattcaatagttgattttctttttaagctgggcaataaattgatgtttccagatggtaacatgggagagggcatataggataaagatgagcaaattctaccctaaaaatgttctagtagttcacaggaagaagatgaggtttaataactttcaaggtaattctagattgacattttgaggggaaaatgggctcttgttctagttgaagtgagcagagaaggctataaattaatatgtaacttacagcattccagaggttaaaaataactgatgcagatgtacttcttcagtgtgattcttcagatcaaacttttacttttggcatagttaatttcagaaaaatgtgctgtatgtgtgtgtgtatgagggttggtcttgctgatccttcagttagctctaaattctggcaactccttgtaattccaatgtatttgatacatgaacaatcatgttgaatgcatttgtgatctgggagacttcctcgtcttccagggaaggaaggatgtgcagcccctgaaggcatgaaactcccagtgtgtacggagccagtggaatatgggatacccataccttaccaggcgctggttccttctgctcacaataacatctgcccaaagagggagtgggaagaacgcttagctctttcactagtatggatttgagttcatggtcactatttttacccacctgcctttgttaaaaatcactttgagtagaatagcactggaggaacatatttagcacctaatattaatatttagtagtccattgataaatttgccagcatatgttctagcctctggggggaaaccaggaccacttttgtctgtggcttaaacagttcagttgctatatctgttgggtatgccgggggtggatgagtgtggcattccgtgaagaggaaggtggtaagtaaggtttcccttctactgccttcttaagttgcaggagggagcttttctcctcccctctggttgggagcactgaggacagtgaggagggcttttaccttgttaatcctttccttatttagctagctttcctttttgtctagggcttcctcttgagaccctcttccatccattgggcctttgaaaggactaatcagacacacacacacacacacacacacacacacacacacactcgcatactcatgcacattttccttcatttccagatcctttatttcagagcagcccattttcctctggattcattgatgaatacaagtacccacacctttggccagtaatgtcagttacctgctgcaggttctgtgtatgaggccttcatgaacggttaccttctccatacactagggaagcatttgtcagactctgcagactgggttctagagaggcagagtctttaagagtattcatttcttctggaaggtggagctttacccaaagtggaagttagccttgctcaaagatgtgttttgtggtaggtggtaaaaataaataaataaataaataataaaaaaagaaacatgtattggaggtaatttgacactgctgctggcagtagttctctattcaccattttaaagcccattcaggttctctcttcctgaaaagaactgattgctgtgtttacatgaaatgacattggagtcagatggtctgttttaaagatttccatgacagcctcttttcctgagttggagagattggaggtggtctatccgtacgatgtggaatcaaacggtgggtttcttagtagctaaagaagccatgtacttctagtgtgtttctcagaatatcaactcatgttcttcagatgcttttctttttttaatggtgagggaaaaggtataatttgggattccacagtgccttgcatatagtaggcgcccagtaaatacttgttgaagcaaaccaagtttcccaagtcctcatctcttatagtgaccaagacatctttctcctctgaagggcttggcagttgtggctaaaaaataagcagtatcattatttgcttgaaatcatatatacagtttgtatgaatttcagtatgttgccaagacatgattttttcttattgtattttctgtaaatatttctggcactgaactgtaaagtaaaggcaaagtgtaaatatga

SEQ ID NO: 445750 - DNA, 3599 bp, Homo sapiens
tgtttaacattaacgttctatgaggtatttggggccttatctcgagtcttcaggggagggggttgaagatagttttttacctcactttttaggaggttgtattcaaaattaaaatctcagaatcttacaggacatttaaagactcatgttgatagcatggaggagaaggaaagaagtcacagccttctactcagttgtaggtcttcttgtcatccagctgtcacactgacaaaaagaaaagatgatacatgttttttgctcagataagaagcctgacattaaaagatgtcatatttttttctccacatttcaaaaagttgtccttctcatcactgcacagatctgtctgaaagcctcagtttctgagtgacccaggaacagatcagaaatggagcatggccttgtcctttaatggggatgcaaataaagtttgtggggttaaaagttataagacagcagtgataccccactctctccattattgtccagcggggtgacataatgacaggttaaatatttgtgattcattgattaaatattatttaaagaaatgtaaattcacaataagggttgaaaattatttggtttcatccattgtctcttatttcaggaccaagcagcaaactgcagtagtttgtgaaggattctaatatggggttcaggaatagcctctcaacgctactaattcagatctctcccagagaactactggatttcctcataattgacaaacatgagtgaccacctctttgggtggctactgttagaaatggctgttgtcatgttttctggactttgccagccaacagatccctgccaggttttggaaatacttctattacctcgctgctacttttctgcagggataaaacttttgaggtggccagacccagaacatccaaggattcctgttacagtgctacagtatacactgctcatttatcctattctcatgtgctttcttctttagtaagattattttaagaaaataagtgatatttaaagtccaaagaggaatgatcacagttgtataaggggtgttttcccacttgaactctgatgtcagtcgactgtgggtcagagctacaaccatctgtttggtttgatgttttggtggtttacttacggagtggggatagtgtgagacctaattccctgtgcaaatgtctcttattccagaaatgtgcattttgtcatctataagcaagaaatatgggcatagcagctcttggtttaaagtttgccataacctgttcatgtttgttttaagctcaggtaaagataacctcctctttctatgactccagtttccattcaggttatagtattattcaatagttgattttctttttaagctgggcaataaattgatgtttccagatggtaacatgggagagggcatataggataaagatgagcaaattctaccctaaaaatgttctagtagttcacaggaagaagatgaggtttaataactttcaaggtaattctagattgacattttgaggggaaaatgggctcttgttctagttgaagtgagcagagaaggctataaattaatatgtaacttacagcattccagaggttaaaaataactgatgcagatgtacttcttcagtgtgattcttcagatcaaacttttacttttggcatagttaatttcagaaaaatgtgctgtatgtgtgtgtgtatgagggttggtcttgctgatccttcagttagctctaaattctggcaactccttgtaattccaatgtatttgatacatgaacaatcatgttgaatgcatttgtgatctgggagacttcctcgtcttccagggaaggaaggatgtgcagcccctgaaggcatgaaactcccagtgtgtacggagccagtggaatatgggatacccataccttaccaggcgctggttccttctgctcacaataacatctgcccaaagagggagtgggaagaacgcttagctctttcactagtatggatttgagttcatggtcactatttttacccacctgcctttgttaaaaatcactttgagtagaatagcactggaggaacatatttagcacctaatattaatatttagtagtccattgataaatttgccagcatatgttctagcctctggggggaaaccaggaccacttttgtctgtggcttaaacagttcagttgctatatctgttgggtatgccgggggtggatgagtgtggcattccgtgaagaggaaggtggtaagtaaggtttcccttctactgccttcttaagttgcaggagggagcttttctcctcccctctggttgggagcactgaggacagtgaggagggcttttaccttgttaatcctttccttatttagctagctttcctttttgtctagggcttcctcttgagaccctcttccatccattgggcctttgaaaggactaatcagacacacacacacacacacacacacacacacacacacactcgcatactcatgcacattttccttcatttccagatcctttatttcagagcagcccattttcctctggattcattgatgaatacaagtacccacacctttggccagtaatgtcagttacctgctgcaggttctgtgtatgaggccttcatgaacggttaccttctccatacactagggaagcatttgtcagactctgcagactgggttctagagaggcagagtctttaagagtattcatttcttctggaaggtggagctttacccaaagtggaagttagccttgctcaaagatgtgttttgtggtaggtggtaaaaataaataaataaataaataataaaaaaagaaacatgtattggaggtaatttgacactgctgctggcagtagttctctattcaccattttaaagcccattcaggttctctcttcctgaaaagaactgattgctgtgtttacatgaaatgacattggagtcagatggtctgttttaaagatttccatgacagcctcttttcctgagttggagagattggaggtggtctatccgtacgatgtggaatcaaacggtgggtttcttagtagctaaagaagccatgtacttctagtgtgtttctcagaatatcaactcatgttcttcagatgcttttctttttttaatggtgagggaaaaggtataatttgggattccacagtgccttgcatatagtaggcgcccagtaaatacttgttgaagcaaaccaagtttcccaagtcctcatctcttatagtgaccaagacatctttctcctctgaagggcttggcagttgtggctaaaaaataagcagtatcattatttgcttgaaatcatatatacagtttgtatgaatttcagtatgttgccaagacatgattttttcttattgtattttctgtaaatatttctggcactgaactgtaaagtaaaggcaaagtgtaaatatgaaggcgtgcccgtgccccttgcctcctgtgtttcatcttcgtcggttagggaagaaggtccagaggtttgtttgtatttatgccgatcctttgtccagaagaagcccatggaatattgaatgtaatacatttagtcaattaaattttaaggagattcttatcta

SEQ ID NO: 445751 - DNA, 3796 bp, Homo sapiens
tatcggggattcctgtcatgggccgaagctgtgttcctgcttctcctctgggattatcagccttgactatgctgaaattccttgtactctggccggccacacttttgttccctataagaagaggaactaaagtgaaagtcccatagctggttgctaaattcttaactccatgcagcagagtactcttggcctctccttccacccagtgtccctattggttttccaagcatatatattttttcagctcctttctgttagcttagaaagcttgacccagtaatggacctttaggaccagatgttatagggggtagcagcatagattcccagaaagcagattctgagcacactgaccccttggcttttctcagaccactgccaagcaacaggtccctttactaatcttaggctatatgtgggggacttcaactcttgggtgtctcggggacttcaactcttgggtgtctgagataacaattttcttttcttaagatctacaactcttgaaaaagaagttcctgtcatcttcatccaccctttaaacactggattattccggataaaaattcaaggagccactggaaaatttaatatggtcatccctcttgtggatgggatgattgtcagcaggcgagctcttggctttctggtgaggcagactgtaattaacatttgtagaagaaagagactggaaagtgactcctacagtcccccccatgtccgccggaaacagaaaatcaccgacattgtcaacaagtaccggaacaagcagctggagccagagttttatacttcacttttccaggaggaccaagcagcaaactgcagtagtttgtgaaggattctaatatggggttcaggaatagcctctcaacgctactaattcagatctctcccagagaactactggatttcctcataattgacaaacatgagtgaccacctctttgggtggctactgttagaaatggctgttgtcatgttttctggactttgccagccaacagatccctgccaggttttggaaatacttctattacctcgctgctacttttctgcagggataaaacttttgaggtggccagacccagaacatccaaggattcctgttacagtgctacagtatacactgctcatttatcctattctcatgtgctttcttctttagtaagattattttaagaaaataagtgatatttaaagtccaaagaggaatgatcacagttgtataaggggtgttttcccacttgaactctgatgtcagtcgactgtgggtcagagctacaaccatctgtttggtttgatgttttggtggtttacttacggagtggggatagtgtgagacctaattccctgtgcaaatgtctcttattccagaaatgtgcattttgtcatctataagcaagaaatatgggcatagcagctcttggtttaaagtttgccataacctgttcatgtttgttttaagctcaggtaaagataacctcctctttctatgactccagtttccattcaggttatagtattattcaatagttgattttctttttaagctgggcaataaattgatgtttccagatggtaacatgggagagggcatataggataaagatgagcaaattctaccctaaaaatgttctagtagttcacaggaagaagatgaggtttaataactttcaaggtaattctagattgacattttgaggggaaaatgggctcttgttctagttgaagtgagcagagaaggctataaattaatatgtaacttacagcattccagaggttaaaaataactgatgcagatgtacttcttcagtgtgattcttcagatcaaacttttacttttggcatagttaatttcagaaaaatgtgctgtatgtgtgtgtgtatgagggttggtcttgctgatccttcagttagctctaaattctggcaactccttgtaattccaatgtatttgatacatgaacaatcatgttgaatgcatttgtgatctgggagacttcctcgtcttccagggaaggaaggatgtgcagcccctgaaggcatgaaactcccagtgtgtacggagccagtggaatatgggatacccataccttaccaggcgctggttccttctgctcacaataacatctgcccaaagagggagtgggaagaacgcttagctctttcactagtatggatttgagttcatggtcactatttttacccacctgcctttgttaaaaatcactttgagtagaatagcactggaggaacatatttagcacctaatattaatatttagtagtccattgataaatttgccagcatatgttctagcctctggggggaaaccaggaccacttttgtctgtggcttaaacagttcagttgctatatctgttgggtatgccgggggtggatgagtgtggcattccgtgaagaggaaggtggtaagtaaggtttcccttctactgccttcttaagttgcaggagggagcttttctcctcccctctggttgggagcactgaggacagtgaggagggcttttaccttgttaatcctttccttatttagctagctttcctttttgtctagggcttcctcttgagaccctcttccatccattgggcctttgaaaggactaatcagacacacacacacacacacacacacacacacacacacactcgcatactcatgcacattttccttcatttccagatcctttatttcagagcagcccattttcctctggattcattgatgaatacaagtacccacacctttggccagtaatgtcagttacctgctgcaggttctgtgtatgaggccttcatgaacggttaccttctccatacactagggaagcatttgtcagactctgcagactgggttctagagaggcagagtctttaagagtattcatttcttctggaaggtggagctttacccaaagtggaagttagccttgctcaaagatgtgttttgtggtaggtggtaaaaataaataaataaataaataataaaaaaagaaacatgtattggaggtaatttgacactgctgctggcagtagttctctattcaccattttaaagcccattcaggttctctcttcctgaaaagaactgattgctgtgtttacatgaaatgacattggagtcagatggtctgttttaaagatttccatgacagcctcttttcctgagttggagagattggaggtggtctatccgtacgatgtggaatcaaacggtgggtttcttagtagctaaagaagccatgtacttctagtgtgtttctcagaatatcaactcatgttcttcagatgcttttctttttttaatggtgagggaaaaggtataatttgggattccacagtgccttgcatatagtaggcgcccagtaaatacttgttgaagcaaaccaagtttcccaagtcctcatctcttatagtgaccaagacatctttctcctctgaagggcttggcagttgtggctaaaaaataagcagtatcattatttgcttgaaatcatatatacagtttgtatgaatttcagtatgttgccaagacatgattttttcttattgtattttctgtaaatatttctggcactgaactgtaaagtaaaggcaaagtgtaaatatgaaggcgtgcccgtgccccttgcctcctgtgtttcatcttcgtcggttagggaagaaggtccagaggtttgtttgtatttatgccgatcctttgtccagaagaagcccatggaatattgaatgtaatacatttagtcaattaaattttaaggagattcttatcta

SEQ ID NO: 445752 - DNA, 2968 bp, Homo sapiens
gtaaaagtgatggttgactcaggagaccggaagcgagccatcagttctgtgtgcacctacattgtttatcagtgtagtcggccagctcctttacactccagggatctgcactccatgatagtggcagcttttcagtgtctctgtgtctggctgacagagcaccctgatatgcttgatgaaaaggactgccttaaggaagtactggagattgtggaactgggtatctcaggaagtaagtccaagaacaatgagcaagaggtcaagtacaaaggagataaggagccaaaccctgcatctatgagggtaaaggatgctgctgaagccaccctaacatgcattatgcagttgctcggcgcatttccttcacctagtggtcctgcctctccttgtagtcttgtgaatgagaccactttgattaaatactccaggctgccaaccataaacaagcatagtttccggtactttgtcttggataacagtgtcatcctggcaatgctggaacaacctcttggaaatgagcagaatgattttttcccctctgtcactgtgctggtccggggaatgtctggaagacttgcttgggcacaacagctttgtcttttacccagaggagcaaaagcaaatcagaagctttttgtacctgaacctcgcccagttcctaaaaatgacgttggatttaaatattctgtgaaacatcggccatttcctgaagaggtggacaagattccttttgtgaaagcagatctcagcattccagatttgcatgaaatagtcactgaagaatttagaagagagacacgaaaaattaaggagtggcatggcccagcagattgcttatgaaatacaccttgagcaacagagtgaggaggaattgcagaagagaagttttcctgacccagttacggattgcaagcccccgcctcctgcccaggaattccaaacagcccgcctttttctctcacactttggatttttgtccttagaagcactgaaggaacctgcaaatagtcgtctacctcctcaccttattgcacttgattccacgatacctggattttttgatgacattgggtatctggatctcttgccatgtcgtccttttgacacagtttttattttctatatgaagccaggtcagaaaacgaaccaagagattttaaagaatgtggagtcttccagaactgttcagccacatttcctagaatttttgctttcccttggctggtcagtagatgtgggcagacaccctggttggactgggcatgtttctaccagttggtctattaattgttgtgatgatggtgaaggatctcaacaagaagtgatttcctctgaagatattggagctagcattttcaatggacagaagaaggtgctgtattatgctgatgcccttacagaaattgcttttgtggttccttctcctgtggagtccttaactgattcattggaaagtaacatctcggaccaagatagtgattcaaatatggatcttatgccaggaattctgaaacagccatccctgacacttgagcttttccccaatcatacagacaatcttaattcctcacagaggctcagtcccagttccagaatgaggaagctgcctcagggtcgccctgttcctccccttggacctgagacaagagtttctgtagtctgggtggaacgctatgatgatatagaaaactttcccctctcagagctgatgacagagatcagtactggtgtggaaactactgcaaatagtagcacttcactgagatctacaactcttgaaaaagaagttcctgtcatcttcatccaccctttaaacactggattattccggataaaaattcaaggagccactggaaaatttaatatggtcatccctcttgtggatgggatgattgtcagcaggcgagctcttggctttctggtgaggcagactgtaattaacatttgtagaagaaagagactggaaagtgactcctacagtcccccccatgtccgccggaaacagaaaatcaccgacattgtcaacaagtaccggaacaagcagctggagccagagttttatacttcacttttccaggaggttggactcaagaactgcagttcttagaccactgaatttctaagactgttgaactccagtttgggaactataacacagcagaacagtttgataggtgatcactgtaaaaataaaaacaaatcactcccaagagcttactgtttaatcaccagaatagaagaaacacattataacccatttgatagaagactttgggctatctagtgaaatgggctcccagacacaatcatactcctgctgataatgatgatatacattttagccataaactttcttttaaaagtgacaattttagttaaacataagccttttgaggagaaaggcttttatgcatctcagttaaacacgtgcattggtagtatcaacaaatttgcaatatagaagttgaagatagttttttacctcactttttaggaggttgtattcaaaattaaaatctcagaatcttacaggacatttaaagactcatgttgatagcatggaggagaaggaaagaagtcacagccttctactcagttgtaggtcttcttgtcatccagctgtcacactgacaaaaagaaaagatgatacatgttttttgctcagataagaagcctgacattaaaagatgtcatatttttttctccacatttcaaaaagttgtccttctcatcactgcacagatctgtctgaaagcctcagtttctgagtgacccaggaacagatcagaaatggagcatggccttgtcctttaatggggatgcaaataaagtttgtggggttaaaagttataagacagcagtgataccccactctctccattattgtccagcggggtgacataatgacaggttaaatatttgtgattcattgattaaatattatttaaagaaatgtaaattcacaata

SEQ ID NO: 445753 - DNA, 3851 bp, Homo sapiens
gtaaaagtgatggttgactcaggagaccggaagcgagccatcagttctgtgtgcacctacattgtttatcagtgtagtcggccagctcctttacactccagggatctgcactccatgatagtggcagcttttcagtgtctctgtgtctggctgacagagcaccctgatatgcttgatgaaaaggactgccttaaggaagtactggagattgtggaactgggtatctcaggaagtaagtccaagaacaatgagcaagaggtcaagtacaaaggagataaggagccaaaccctgcatctatgagggtaaaggatgctgctgaagccaccctaacatgcattatgcagttgctcggcgcatttccttcacctagtggtcctgcctctccttgtagtcttgtgaatgagaccactttgattaaatactccaggctgccaaccataaacaagcatagtttccggtactttgtcttggataacagtgtcatcctggcaatgctggaacaacctcttggaaatgagcagaatgattttttcccctctgtcactgtgctggtccggggaatgtctggaagacttgcttgggcacaacagctttgtcttttacccagaggagcaaaagcaaatcagaagctttttgtacctgaacctcgcccagttcctaaaaatgacgttggatttaaatattctgtgaaacatcggccatttcctgaagaggtggacaagattccttttgtgaaagcagatctcagcattccagatttgcatgaaatagtcactgaagaatttagaagagagacacgaaaaattaaggagtggcatggcccagcagattgcttatgaaatacaccttgagcaacagagtgaggaggaattgcagaagagaagttttcctgacccagttacggattgcaagcccccgcctcctgcccaggaattccaaacagcccgcctttttctctcacactttggatttttgtccttagaagcactgaaggaacctgcaaatagtcgtctacctcctcaccttattgcacttgattccacgatacctggattttttgatgacattgggtatctggatctcttgccatgtcgtccttttgacacagtttttattttctatatgaagccaggtcagaaaacgaaccaagagattttaaagaatgtggagtcttccagaactgttcagccacatttcctagaatttttgctttcccttggctggtcagtagatgtgggcagacaccctggttggactgggcatgtttctaccagttggtctattaattgttgtgatgatggtgaaggatctcaacaagaagtgatttcctctgaagatattggagctagcattttcaatggacagaagaaggtgctgtattatgctgatgcccttacagaaattgcttttgtggttccttctcctgtggagtccttaactgattcattggaaagtaacatctcggaccaagatagtgattcaaatatggatcttatgccaggaattctgaaacagccatccctgacacttgagcttttccccaatcatacagacaatcttaattcctcacagaggctcagtcccagttccagaatgaggaagctgcctcagggtcgccctgttcctccccttggacctgagacaagagtttctgtagtctgggtggaacgctatgatgatatagaaaactttcccctctcagagctgatgacagagatcagtactggtgtggaaactactgcaaatagtagcacttcactgagatctacaactcttgaaaaagaagttcctgtcatcttcatccaccctttaaacactggattattccggataaaaattcaaggagccactggaaaatttaatatggtcatccctcttgtggatgggatgattgtcagcaggcgagctcttggctttctggtgaggcagactgtaattaacatttgtagaagaaagagactggaaagtgactcctacagtcccccccatgtccgccggaaacagaaaatcaccgacattgtcaacaagtaccggaacaagcagctggagccagagttttatacttcacttttccaggaggttggactcaagaactgcagttcttagaccactgaatttctaagactgttgaactccagtttgggaactataacacagcagaacagtttgataggtgatcactgtaaaaataaaaacaaatcactcccaagagcttactgtttaatcaccagaatagaagaaacacattataacccatttgatagaagactttgggctatctagtgaaatgggctcccagacacaatcatactcctgctgataatgatgatatacattttagccataaactttcttttaaaagtgacaattttagttaaacataagccttttgaggagaaaggcttttatgcatctcagttaaacacgtgcattggtagtatcaacaaatttgcaatatagaagttgaagatagttttttacctcactttttaggaggttgtattcaaaattaaaatctcagaatcttacaggacatttaaagactcatgttgatagcatggaggagaaggaaagaagtcacagccttctactcagttgtaggtcttcttgtcatccagctgtcacactgacaaaaagaaaagatgatacatgttttttgctcagataagaagcctgacattaaaagatgtcatatttttttctccacatttcaaaaagttgtccttctcatcactgcacagatctgtctgaaagcctcagtttctgagtgacccaggaacagatcagaaatggagcatggccttgtcctttaatggggatgcaaataaagtttgtggggttaaaagttataagacagcagtgataccccactctctccattattgtccagcggggtgacataatgacaggttaaatatttgtgattcattgattaaatattatttaaagaaatgtaaattcacaataagggttgaaaattatttggtttcatccattgtctcttatttcaggaccaagcagcaaactgcagtagtttgtgaaggattctaatatggggttcaggaatagcctctcaacgctactaattcagatctctcccagagaactactggatttcctcataattgacaaacatgagtgaccacctctttgggtggctactgttagaaatggctgttgtcatgttttctggactttgccagccaacagatccctgccaggttttggaaatacttctattacctcgctgctacttttctgcagggataaaacttttgaggtggccagacccagaacatccaaggattcctgttacagtgctacagtatacactgctcatttatcctattctcatgtgctttcttctttagtaagattattttaagaaaataagtgatatttaaagtccaaagaggaatgatcacagttgtataaggggtgttttcccacttgaactctgatgtcagtcgactgtgggtcagagctacaaccatctgtttggtttgatgttttggtggtttacttacggagtggggatagtgtgagacctaattccctgtgcaaatgtctcttattccagaaatgtgcattttgtcatctataagcaagaaatatgggcatagcagctcttggtttaaagtttgccataacctgttcatgtttgttttaagctcaggtaaagataacctcctctttctatgactccagtttccattcaggttatagtattattcaatagttgattttctttttaagctgggcaataaattgatgtttccagataggtttcacatgagtgaggcgcaatcgggaaaagaattcgccatccaagcctgccttgtagaaattg

SEQ ID NO: 445754 - DNA, 1293 bp, Homo sapiens
  misc_feature (114)..(114): n is a, c, g, or t
  misc_feature (128)..(128): n is a, c, g, or t
  misc_feature (134)..(134): n is a, c, g, or t
tagagatgataactctccactccctcttttttataccttttgacctcccaaacttcttcccaaaaccctcattcatctttttgacccttgttctttacatttcaggccagtggnccttaaaagcttcnaagtanacacacacacacacacacacacacacacacacactcgcatactcatgcacattttccttcatttccagatcctttatttcagagcagcccattttcctctggattcattgatgaatacaagtacccacacctttggccagtaatgtcagttacctgctgcaggttctgtgtatgaggccttcatgaacggttaccttctccatacactagggaagcatttgtcagactctgcagactgggttctagagaggcagagtctttaagagtattcatttcttctggaaggtggagctttacccaaagtggaagttagccttgctcaaagatgtgttttgtggtaggtggtaaaaataaataaataaataaataataaaaaaagaaacatgtattggaggtaatttgacactgctgctggcagtagttctctattcaccattttaaagcccattcaggttctctcttcctgaaaagaactgattgctgtgtttacatgaaatgacattggagtcagatggtctgttttaaagatttccatgacagcctcttttcctgagttggagagattggaggtggtctatccgtacgatgtggaatcaaacggtgggtttcttagtagctaaagaagccatgtacttctagtgtgtttctcagaatatcaactcatgttcttcagatgcttttctttttttaatggtgagggaaaaggtataatttgggattccacagtgccttgcatatagtaggcgcccagtaaatacttgttgaagcaaaccaagtttcccaagtcctcatctcttatagtgaccaagacatctttctcctctgaagggcttggcagttgtggctaaaaaataagcagtatcattatttgcttgaaatcatatatacagtttgtatgaatttcagtatgttgccaagacatgattttttcttattgtattttctgtaaatatttctggcactgaactgtaaagtaaaggcaaagtgtaaatatgaaggcgtgcccgtgccccttgcctcctgtgtttcatcttcgtcggttagggaagaaggtccagaggtttgtttgtatttatgccgatcctttgtccagaagaagcccatggaatattgaatgtaatacatttagtcaattaaattttaaggagattcttatcta

SEQ ID NO: 445755 - DNA, 1039 bp, Homo sapiens
gtaaaagtgatggttgactcaggagaccggaagcgagccatcagttctgtgtgcacctacattgtttatcagtgtagtcggccagctcctttacactccagggatctgcactccatgatagtggcagcttttcagtgtctctgtgtctggctgacagagcaccctgatatgcttgatgaaaaggactgccttaaggaagtactggagattgtggaactgggtatctcaggaagtaagtccaagaacaatgagcaagaggtcaagtacaaaggagataaggagccaaaccctgcatctatgagggtaaaggatgctgctgaagccaccctaacatgcattatgcagttgctcggcgcatttccttcacctagtggtcctgcctctccttgtagtcttgtgaatgagaccactttgattaaatactccaggctgccaaccataaacaagcatagtttccggtactttgtcttggataacagtgtcatcctggcaatgctggaacaacctcttggaaatgagcagaatgattttttcccctctgtcactgtgctggtccggggaatgtctggaagacttgcttgggcacaacagctttgtcttttacccagaggagcaaaagcaaatcagaagctttttgtacctgaacctcgcccagttcctaaaaatgacgttggatttaaatattctgtgaaacatcggccatttcctgaagaggtggacaagattccttttgtgaaagcagatctcagcattccagatttgcatgaaatagtcactgaagaataaagagactggaaagtgactcctacagtcccccccatgtccgccggaaacagaaaatcaccgacattgtcaacaagtaccggaacaagcagctggagccagagttttatacttcacttttccaggaggttggactcaagaactgcagttcttagaccactgaatttctaagactgttgaactccagtttgggaactataacacagcagaacagtttgataggtgatcactgtaaaaataaaaacaaatcactccc

SEQ ID NO: 445756 - DNA, 446 bp, Homo sapiens
gtgtgatagttacttttcaaccaagccctcaaagatcacagaacatattttctaaaaactctttgctttagatgaaattagctaaaaaatgtcttgagagagaattttttaatttgtagagaataattaagatgatatttcaggacagcacagtccatatatttgccactcacttatgtaaagcgattagaaaattagatttcctattatctgtttgggaaaatgagggagatattaattgtaatgctattattttcttccagaaaactttcccctctcagagctgatgacagagatcagtactggtgtggaaactactgcaaatagtagcacttcactgaggtacactctatttgcttgaagttcatcagcgtgtctttttttaacatattgattgcagcttaataaataaggaattatgaaacgaaagagttgtagacaactag

SEQ ID NO: 445757 - DNA, 366 bp, Homo sapiens
ccaaagaagagctttgttgcaaatgtatacactttttcctaaagtgattttccatgacctgatacttggtcactgagcaccttgacaaatgaatgactgggtagttttattaagccagttttttgttgctgttgtttttcccgctctctgtcttcttcttcttcatgtagctcagtcccagttccagaatgaggaagctgcctcagggtcgccctgttcctccccttggacctgagacaagagtttctgtagtctgggtggaacgctatgatgatataggtactgtatgaggactttgtccataaataaaatggcaatatatgacagtgacttgctaaatgtctacagggagtgggcacataagcc

SEQ ID NO: 445758 - DNA, 242 bp, Homo sapiens
ctttgattaaatactccaggctgccaaccataaacaagcatagtttccggtactttgtcttggataacagtgtcatcctggcaatgctggaacaacctcttggaaatgagcagagtaagtttatagtactttgagccttctctactgcttaatcagtgttaccagtaccatgaagctgtttccaggatcagggaaggacagcctacagattctaagtaggtcagaaagatttctagctgtgg

SEQ ID NO: 445759 - DNA, 6153 bp, Homo sapiens
gtaaaagtgatggttgactcaggagaccggaagcgagccatcagttctgtgtgcacctacattgtttatcagtgtagtcggccagctcctttacactccagggatctgcactccatgatagtggcagcttttcagtgtctctgtgtctggctgacagagcaccctgatatgcttgatgaaaaggactgccttaaggaagtactggagattgtggaactgggtatctcaggaagtaagtccaagaacaatgagcaagaggtcaagtacaaaggagataaggagccaaaccctgcatctatgagggtaaaggatgctgctgaagccaccctaacatgcattatgcagttgctcggcgcatttccttcacctagtggtcctgcctctccttgtagtcttgtgaatgagaccactttgattaaatactccaggctgccaaccataaacaagcatagtttccggtactttgtcttggataacagtgtcatcctggcaatgctggaacaacctcttggaaatgagcagaatgattttttcccctctgtcactgtgctggtccggggaatgtctggaagacttgcttgggcacaacagctttgtcttttacccagaggagcaaaagcaaatcagaagctttttgtacctgaacctcgcccagttcctaaaaatgacgttggatttaaatattctgtgaaacatcggccatttcctgaagaggtggacaagattccttttgtgaaagcagatctcagcattccagatttgcatgaaatagtcactgaagaatttagaagagagacacgaaaaattaaggagtggcatggcccagcagattgcttatgaaatacaccttgagcaacagagtgaggaggaattgcagaagagaagttttcctgacccagttacggattgcaagcccccgcctcctgcccaggaattccaaacagcccgcctttttctctcacactttggatttttgtccttagaagcactgaaggaacctgcaaatagtcgtctacctcctcaccttattgcacttgattccacgatacctggattttttgatgacattgggtatctggatctcttgccatgtcgtccttttgacacagtttttattttctatatgaagccaggtcagaaaacgaaccaagagattttaaagaatgtggagtcttccagaactgttcagccacatttcctagaatttttgctttcccttggctggtcagtagatgtgggcagacaccctggttggactgggcatgtttctaccagttggtctattaattgttgtgatgatggtgaaggatctcaacaagaagtgatttcctctgaagatattggagctagcattttcaatggacagaagaaggtgctgtattatgctgatgcccttacagaaattgcttttgtggttccttctcctgtggagtccttaactgattcattggaaagtaacatctcggaccaagatagtgattcaaatatggatcttatgccaggaattctgaaacagccatccctgacacttgagcttttccccaatcatacagacaatcttaattcctcacagaggctcagtcccagttccagaatgaggaagctgcctcagggtcgccctgttcctccccttggacctgagacaagagtttctgtagtctgggtggaacgctatgatgatatagaaaactttcccctctcagagctgatgacagagatcagtactggtgtggaaactactgcaaatagtagcacttcactgagatctacaactcttgaaaaagaagttcctgtcatcttcatccaccctttaaacactggattattccggataaaaattcaaggagccactggaaaatttaatatggtcatccctcttgtggatgggatgattgtcagcaggcgagctcttggctttctggtgaggcagactgtaattaacatttgtagaagaaagagactggaaagtgactcctacagtcccccccatgtccgccggaaacagaaaatcaccgacattgtcaacaagtaccggaacaagcagctggagccagagttttatacttcacttttccaggaggttggactcaagaactgcagttcttagaccactgaatttctaagactgttgaactccagtttgggaactataacacagcagaacagtttgataggtgatcactgtaaaaataaaaacaaatcactcccaagagcttactgtttaatcaccagaatagaagaaacacattataacccatttgatagaagactttgggctatctagtgaaatgggctcccagacacaatcatactcctgctgataatgatgatatacattttagccataaactttcttttaaaagtgacaattttagttaaacataagccttttgaggagaaaggcttttatgcatctcagttaaacacgtgcattggtagtatcaacaaatttgcaatatagaagttgaagatagttttttacctcactttttaggaggttgtattcaaaattaaaatctcagaatcttacaggacatttaaagactcatgttgatagcatggaggagaaggaaagaagtcacagccttctactcagttgtaggtcttcttgtcatccagctgtcacactgacaaaaagaaaagatgatacatgttttttgctcagataagaagcctgacattaaaagatgtcatatttttttctccacatttcaaaaagttgtccttctcatcactgcacagatctgtctgaaagcctcagtttctgagtgacccaggaacagatcagaaatggagcatggccttgtcctttaatggggatgcaaataaagtttgtggggttaaaagttataagacagcagtgataccccactctctccattattgtccagcggggtgacataatgacaggttaaatatttgtgattcattgattaaatattatttaaagaaatgtaaattcacaataagggttgaaaattatttggtttcatccattgtctcttatttcaggaccaagcagcaaactgcagtagtttgtgaaggattctaatatggggttcaggaatagcctctcaacgctactaattcagatctctcccagagaactactggatttcctcataattgacaaacatgagtgaccacctctttgggtggctactgttagaaatggctgttgtcatgttttctggactttgccagccaacagatccctgccaggttttggaaatacttctattacctcgctgctacttttctgcagggataaaacttttgaggtggccagacccagaacatccaaggattcctgttacagtgctacagtatacactgctcatttatcctattctcatgtgctttcttctttagtaagattattttaagaaaataagtgatatttaaagtccaaagaggaatgatcacagttgtataaggggtgttttcccacttgaactctgatgtcagtcgactgtgggtcagagctacaaccatctgtttggtttgatgttttggtggtttacttacggagtggggatagtgtgagacctaattccctgtgcaaatgtctcttattccagaaatgtgcattttgtcatctataagcaagaaatatgggcatagcagctcttggtttaaagtttgccataacctgttcatgtttgttttaagctcaggtaaagataacctcctctttctatgactccagtttccattcaggttatagtattattcaatagttgattttctttttaagctgggcaataaattgatgtttccagatggtaacatgggagagggcatataggataaagatgagcaaattctaccctaaaaatgttctagtagttcacaggaagaagatgaggtttaataactttcaaggtaattctagattgacattttgaggggaaaatgggctcttgttctagttgaagtgagcagagaaggctataaattaatatgtaacttacagcattccagaggttaaaaataactgatgcagatgtacttcttcagtgtgattcttcagatcaaacttttacttttggcatagttaatttcagaaaaatgtgctgtatgtgtgtgtgtatgagggttggtcttgctgatccttcagttagctctaaattctggcaactccttgtaattccaatgtatttgatacatgaacaatcatgttgaatgcatttgtgatctgggagacttcctcgtcttccagggaaggaaggatgtgcagcccctgaaggcatgaaactcccagtgtgtacggagccagtggaatatgggatacccataccttaccaggcgctggttccttctgctcacaataacatctgcccaaagagggagtgggaagaacgcttagctctttcactagtatggatttgagttcatggtcactatttttacccacctgcctttgttaaaaatcactttgagtagaatagcactggaggaacatatttagcacctaatattaatatttagtagtccattgataaatttgccagcatatgttctagcctctggggggaaaccaggaccacttttgtctgtggcttaaacagttcagttgctatatctgttgggtatgccgggggtggatgagtgtggcattccgtgaagaggaaggtggtaagtaaggtttcccttctactgccttcttaagttgcaggagggagcttttctcctcccctctggttgggagcactgaggacagtgaggagggcttttaccttgttaatcctttccttatttagctagctttcctttttgtctagggcttcctcttgagaccctcttccatccattgggcctttgaaaggactaatcagacacacacacacacacacacacacacacacacacacactcgcatactcatgcacattttccttcatttccagatcctttatttcagagcagcccattttcctctggattcattgatgaatacaagtacccacacctttggccagtaatgtcagttacctgctgcaggttctgtgtatgaggccttcatgaacggttaccttctccatacactagggaagcatttgtcagactctgcagactgggttctagagaggcagagtctttaagagtattcatttcttctggaaggtggagctttacccaaagtggaagttagccttgctcaaagatgtgttttgtggtaggtggtaaaaataaataaataaataaataataaaaaaagaaacatgtattggaggtaatttgacactgctgctggcagtagttctctattcaccattttaaagcccattcaggttctctcttcctgaaaagaactgattgctgtgtttacatgaaatgacattggagtcagatggtctgttttaaagatttccatgacagcctcttttcctgagttggagagattggaggtggtctatccgtacgatgtggaatcaaacggtgggtttcttagtagctaaagaagccatgtacttctagtgtgtttctcagaatatcaactcatgttcttcagatgcttttctttttttaatggtgagggaaaaggtataatttgggattccacagtgccttgcatatagtaggcgcccagtaaatacttgttgaagcaaaccaagtttcccaagtcctcatctcttatagtgaccaagacatctttctcctctgaagggcttggcagttgtggctaaaaaataagcagtatcattatttgcttgaaatcatatatacagtttgtatgaatttcagtatgttgccaagacatgattttttcttattgtattttctgtaaatatttctggcactgaactgtaaagtaaaggcaaagtgtaaatatgaaggcgtgcccgtgccccttgcctcctgtgtttcatcttcgtcggttagggaagaaggtccagaggtttgtttgtatttatgccgatcctttgtccagaagaagcccatggaatattgaatgtaatacatttagtcaattaaattttaaggagattcttatctaataactttgtgtgtgcttttggatacaggctgaggctttactcctacactggtgctgttaattttaccctttcaggggatgtctgctcggctttggctgccctttataatttagatctgtagtttaaatgaacattaaatgagtatttcatg

SEQ ID NO: 445760 - DNA, 4832 bp, Homo sapiens
gtaaaagtgatggttgactcaggagaccggaagcgagccatcagttctgtgtgcacctacattgtttatcagtgtagtcggccagctcctttacactccagggatctgcactccatgatagtggcagcttttcagtgtctctgtgtctggctgacagagcaccctgatatgcttgatgaaaaggactgccttaaggaagtactggagattgtggaactgggtatctcaggaagtaagtccaagaacaatgagcaagaggtcaagtacaaaggagataaggagccaaaccctgcatctatgagggtaaaggatgctgctgaagccaccctaacatgcattatgcagttgctcggcgcatttccttcacctagtggtcctgcctctccttgtagtcttgtgaatgagaccactttgattaaatactccaggctgccaaccataaacaagcatagtttccggtactttgtcttggataacagtgtcatcctggcaatgctggaacaacctcttggaaatgagcagaatgattttttcccctctgtcactgtgctggtccggggaatgtctggaagacttgcttgggcacaacagctttgtcttttacccagaggagcaaaagcaaatcagaagctttttgtacctgaacctcgcccagttcctaaaaatgacgttggatttaaatattctgtgaaacatcggccatttcctgaagaggtggacaagattccttttgtgaaagcagatctcagcattccagatttgcatgaaatagtcactgaagaataaagagactggaaagtgactcctacagtcccccccatgtccgccggaaacagaaaatcaccgacattgtcaacaagtaccggaacaagcagctggagccagagttttatacttcacttttccaggaggttggactcaagaactgcagttcttagaccactgaatttctaagactgttgaactccagtttgggaactataacacagcagaacagtttgataggtgatcactgtaaaaataaaaacaaatcactcccaagagcttactgtttaatcaccagaatagaagaaacacattataacccatttgatagaagactttgggctatctagtgaaatgggctcccagacacaatcatactcctgctgataatgatgatatacattttagccataaactttcttttaaaagtgacaattttagttaaacataagccttttgaggagaaaggcttttatgcatctcagttaaacacgtgcattggtagtatcaacaaatttgcaatatagaagttgaagatagttttttacctcactttttaggaggttgtattcaaaattaaaatctcagaatcttacaggacatttaaagactcatgttgatagcatggaggagaaggaaagaagtcacagccttctactcagttgtaggtcttcttgtcatccagctgtcacactgacaaaaagaaaagatgatacatgttttttgctcagataagaagcctgacattaaaagatgtcatatttttttctccacatttcaaaaagttgtccttctcatcactgcacagatctgtctgaaagcctcagtttctgagtgacccaggaacagatcagaaatggagcatggccttgtcctttaatggggatgcaaataaagtttgtggggttaaaagttataagacagcagtgataccccactctctccattattgtccagcggggtgacataatgacaggttaaatatttgtgattcattgattaaatattatttaaagaaatgtaaattcacaataagggttgaaaattatttggtttcatccattgtctcttatttcaggaccaagcagcaaactgcagtagtttgtgaaggattctaatatggggttcaggaatagcctctcaacgctactaattcagatctctcccagagaactactggatttcctcataattgacaaacatgagtgaccacctctttgggtggctactgttagaaatggctgttgtcatgttttctggactttgccagccaacagatccctgccaggttttggaaatacttctattacctcgctgctacttttctgcagggataaaacttttgaggtggccagacccagaacatccaaggattcctgttacagtgctacagtatacactgctcatttatcctattctcatgtgctttcttctttagtaagattattttaagaaaataagtgatatttaaagtccaaagaggaatgatcacagttgtataaggggtgttttcccacttgaactctgatgtcagtcgactgtgggtcagagctacaaccatctgtttggtttgatgttttggtggtttacttacggagtggggatagtgtgagacctaattccctgtgcaaatgtctcttattccagaaatgtgcattttgtcatctataagcaagaaatatgggcatagcagctcttggtttaaagtttgccataacctgttcatgtttgttttaagctcaggtaaagataacctcctctttctatgactccagtttccattcaggttatagtattattcaatagttgattttctttttaagctgggcaataaattgatgtttccagatggtaacatgggagagggcatataggataaagatgagcaaattctaccctaaaaatgttctagtagttcacaggaagaagatgaggtttaataactttcaaggtaattctagattgacattttgaggggaaaatgggctcttgttctagttgaagtgagcagagaaggctataaattaatatgtaacttacagcattccagaggttaaaaataactgatgcagatgtacttcttcagtgtgattcttcagatcaaacttttacttttggcatagttaatttcagaaaaatgtgctgtatgtgtgtgtgtatgagggttggtcttgctgatccttcagttagctctaaattctggcaactccttgtaattccaatgtatttgatacatgaacaatcatgttgaatgcatttgtgatctgggagacttcctcgtcttccagggaaggaaggatgtgcagcccctgaaggcatgaaactcccagtgtgtacggagccagtggaatatgggatacccataccttaccaggcgctggttccttctgctcacaataacatctgcccaaagagggagtgggaagaacgcttagctctttcactagtatggatttgagttcatggtcactatttttacccacctgcctttgttaaaaatcactttgagtagaatagcactggaggaacatatttagcacctaatattaatatttagtagtccattgataaatttgccagcatatgttctagcctctggggggaaaccaggaccacttttgtctgtggcttaaacagttcagttgctatatctgttgggtatgccgggggtggatgagtgtggcattccgtgaagaggaaggtggtaagtaaggtttcccttctactgccttcttaagttgcaggagggagcttttctcctcccctctggttgggagcactgaggacagtgaggagggcttttaccttgttaatcctttccttatttagctagctttcctttttgtctagggcttcctcttgagaccctcttccatccattgggcctttgaaaggactaatcagacacacacacacacacacacacacacacacacacacactcgcatactcatgcacattttccttcatttccagatcctttatttcagagcagcccattttcctctggattcattgatgaatacaagtacccacacctttggccagtaatgtcagttacctgctgcaggttctgtgtatgaggccttcatgaacggttaccttctccatacactagggaagcatttgtcagactctgcagactgggttctagagaggcagagtctttaagagtattcatttcttctggaaggtggagctttacccaaagtggaagttagccttgctcaaagatgtgttttgtggtaggtggtaaaaataaataaataaataaataataaaaaaagaaacatgtattggaggtaatttgacactgctgctggcagtagttctctattcaccattttaaagcccattcaggttctctcttcctgaaaagaactgattgctgtgtttacatgaaatgacattggagtcagatggtctgttttaaagatttccatgacagcctcttttcctgagttggagagattggaggtggtctatccgtacgatgtggaatcaaacggtgggtttcttagtagctaaagaagccatgtacttctagtgtgtttctcagaatatcaactcatgttcttcagatgcttttctttttttaatggtgagggaaaaggtataatttgggattccacagtgccttgcatatagtaggcgcccagtaaatacttgttgaagcaaaccaagtttcccaagtcctcatctcttatagtgaccaagacatctttctcctctgaagggcttggcagttgtggctaaaaaataagcagtatcattatttgcttgaaatcatatatacagtttgtatgaatttcagtatgttgccaagacatgattttttcttattgtattttctgtaaatatttctggcactgaactgtaaagtaaaggcaaagtgtaaatatgaaggcgtgcccgtgccccttgcctcctgtgtttcatcttcgtcggttagggaagaaggtccagaggtttgtttgtatttatgccgatcctttgtccagaagaagcccatggaatattgaatgtaatacatttagtcaattaaattttaaggagattcttatcta

SEQ ID NO: 445761 - DNA, 4877 bp, Homo sapiens
gtaaaagtgatggttgactcaggagaccggaagcgagccatcagttctgtgtgcacctacattgtttatcagtgtagtcggccagctcctttacactccagggatctgcactccatgatagtggcagcttttcagtgtctctgtgtctggctgacagagcaccctgatatgcttgatgaaaaggactgccttaaggaagtactggagattgtggaactgggtatctcaggaagtaagtccaagaacaatgagcaagaggtcaagtacaaaggagataaggagccaaaccctgcatctatgagggtaaaggatgctgctgaagccaccctaacatgcattatgcagttgctcggcgcatttccttcacctagtggtcctgcctctccttgtagtcttgtgaatgagaccactttgattaaatactccaggctgccaaccataaacaagcatagtttccggtactttgtcttggataacagtgtcatcctggcaatgctggaacaacctcttggaaatgagcagaatgattttttcccctctgtcactgtgctggtccggggaatgtctggaagacttgcttgggcacaacagctttgtcttttacccagaggagcaaaagcaaatcagaagctttttgtacctgaacctcgcccagttcctaaaaatgacgttggatttaaatattctgtgaaacatcggccatttcctgaagaggtggacaagattccttttgtgaaagcagatctcagcattccagatttgcatgaaatagtcactgaagaatttagaagagagacacgaaaaattaaggagtggcatggcccagcagattgcttatgaaatacaccttgagcaacagagtgaggaggaattgcagaagagaagttttcctgacccagttacggattgcaagcccccgcctcctgcccaggaattccaaacagcccgcctttttctctcacactttggatttttgtccttagaagcactgaaggaacctgcaaatagtcgtctacctcctcaccttattgcacttgattccacgatacctggattttttgatgacattgggtatctggatctcttgccatgtcgtccttttgacacagtttttattttctatatgaagccaggtcagaaaacgaaccaagagattttaaagaatgtggagtcttccagaactgttcagccacatttcctagaatttttgctttcccttggctggtcagtagatgtgggcagacaccctggttggactgggcatgtttctaccagttggtctattaattgttgtgatgatggtgaaggatctcaacaagaagtgatttcctctgaagatattggagctagcattttcaatggacagaagaaggtgctgtattatgctgatgcccttacagaaattgcttttgtggttccttctcctgtggagtccttaactgattcattggaaagtaacatctcggaccaagatagtgattcaaatatggatcttatgccaggaattctgaaacagccatccctgacacttgagcttttccccaatcatacagacaatcttaattcctcacagaggctcagtcccagttccagaatgaggaagctgcctcagggtcgccctgttcctccccttggacctgagacaagagtttctgtagtctgggtggaacgctatgatgatatagaaaactttcccctctcagagctgatgacagagatcagtactggtgtggaaactactgcaaatagtagcacttcactgagatctacaactcttgaaaaagaagttcctgtcatcttcatccaccctttaaacactggattattccggataaaaattcaaggagccactggaaaatttaatatggtcatccctcttgtggatgggatgattgtcagcaggcgagctcttggctttctggtgaggcagactgtaattaacatttgtagaagaaagagactggaaagtgactcctacagtcccccccatgtccgccggaaacagaaaatcaccgacattgtcaacaagtaccggaacaagcagctggagccagagttttatacttcacttttccaggaggttggactcaagaactgcagttcttagaccactgaatttctaagactgttgaactccagtttgggaactataacacagcagaacagtttgataggtgatcactgtaaaaataaaaacaaatcactcccaagagcttactgtttaatcaccagaatagaagaaacacattataacccatttgatagaagactttgggctatctagtgaaatgggctcccagacacaatcatactcctgctgataatgatgatatacattttagccataaactttcttttaaaagtgacaattttagttaaacataagccttttgaggagaaaggcttttatgcatctcagttaaacacgtgcattggtagtatcaacaaatttgcaatatagaagttgaagatagttttttacctcactttttaggaggttgtattcaaaattaaaatctcagaatcttacaggacatttaaagactcatgttgatagcatggaggagaaggaaagaagtcacagccttctactcagttgtaggtcttcttgtcatccagctgtcacactgacaaaaagaaaagatgatacatgttttttgctcagataagaagcctgacattaaaagatgtcatatttttttctccacatttcaaaaagttgtccttctcatcactgcacagatctgtctgaaagcctcagtttctgagtgacccaggaacagatcagaaatggagcatggccttgtcctttaatggggatgcaaataaagtttgtggggttaaaagttataagacagcagtgataccccactctctccattattgtccagcggggtgacataatgacaggttaaatatttgtgattcattgattaaatattatttaaagaaatgtaaattcacaataagggttgaaaattatttggtttcatccattgtctcttatttcaggaccaagcagcaaactgcagtagtttgtgaaggattctaatatggggttcaggaatagcctctcaacgctactaattcagatctctcccagagaactactggatttcctcataattgacaaacatgagtgaccacctctttgggtggctactgttagaaatggctgttgtcatgttttctggactttgccagccaacagatccctgccaggttttggaaatacttctattacctcgctgctacttttctgcagggataaaacttttgaggtggccagacccagaacatccaaggattcctgttacagtgctacagtatacactgctcatttatcctattctcatgtgctttcttctttagtaagattattttaagaaaataagtgatatttaaagtccaaagaggaatgatcacagttgtataaggggtgttttcccacttgaactctgatgtcagtcgactgtgggtcagagctacaaccatctgtttggtttgatgttttggtggtttacttacggagtggggatagtgtgagacctaattccctgtgcaaatgtctcttattccagaaatgtgcattttgtcatctataagcaagaaatatgggcatagcagctcttggtttaaagtttgccataacctgttcatgtttgttttaagctcaggtaaagataacctcctctttctatgactccagtttccattcaggttatagtattattcaatagttgattttctttttaagctgggcaataaattgatgtttccagatggtaacatgggagagggcatataggataaagatgagcaaattctaccctaaaaatgttctagtagttcacaggaagaagatgaggtttaataactttcaaggtaattctagattgacattttgaggggaaaatgggctcttgttctagttgaagtgagcagagaaggctataaattaatatgtaacttacagcattccagaggttaaaaataactgatgcagatgtacttcttcagtgtgattcttcagatcaaacttttacttttggcatagttaatttcagaaaaatgtgctgtatgtgtgtgtgtatgagggttggtcttgctgatccttcagttagctctaaattctggcaactccttgtaattccaatgtatttgatacatgaacaatcatgttgaatgcatttgtgatctgggagacttcctcgtcttccagggaaggaaggatgtgcagcccctgaaggcatgaaactcccagtgtgtacggagccagtggaatatgggatacccataccttaccaggcgctggttccttctgctcacaataacatctgcccaaagagggagtgggaagaacgcttagctctttcactagtatggatttgagttcatggtcactatttttacccacctgcctttgttaaaaatcactttgagtagaatagcactggaggaacatatttagcacctaatattaatatttagtagtccattgataaatttgccagcatatgttctagcctctggggggaaaccaggaccacttttgtttgtggctaaaaaataagcagtatcattatttgcttgaaatcatatatacagtttgtatgaatttcagtatgttgccaagacatgattttttcttattgtattttctgtaaatatttctggcactgaactgtaaagtaaaggcaaagtgtaaatatgaaggcgtgcccgtgccccttgcctcctgtgtttcatcttcgtcggttagggaagaaggtccagaggtttgtttgtatttatgccgatcctttgtccagaagaagcccatggaatattgaatgtaatacatttagtcaattaaattttaaggagattcttatcta

SEQ ID NO: 445762 - DNA, 2208 bp, Homo sapiens
gtaaaagtgatggttgactcaggagaccggaagcgagccatcagttctgtgtgcacctacattgtttatcagtgtagtcggccagctcctttacactccagggatctgcactccatgatagtggcagcttttcagtgtctctgtgtctggctgacagagcaccctgatatgcttgatgaaaaggactgccttaaggaagtactggagattgtggaactgggtatctcaggaagtaagtccaagaacaatgagcaagaggtcaagtacaaaggagataaggagccaaaccctgcatctatgagggtaaaggatgctgctgaagccaccctaacatgcattatgcagttgctcggcgcatttccttcacctagtggtcctgcctctccttgtagtcttgtgaatgagaccactttgattaaatactccaggctgccaaccataaacaagcatagtttccggtactttgtcttggataacagtgtcatcctggcaatgctggaacaacctcttggaaatgagcagaatgattttttcccctctgtcactgtgctggtccggggaatgtctggaagacttgcttgggcacaacagctttgtcttttacccagaggagcaaaagcaaatcagaagctttttgtacctgaacctcgcccagttcctaaaaatgacgttggatttaaatattctgtgaaacatcggccatttcctgaagaggtggacaagattccttttgtgaaagcagatctcagcattccagatttgcatgaaatagtcactgaagaatttagaagagagacacgaaaaattaaggagtggcatggcccagcagattgcttatgaaatacaccttgagcaacagagtgaggaggaattgcagaagagaagttttcctgacccagttacggattgcaagcccccgcctcctgcccaggaattccaaacagcccgcctttttctctcacactttggatttttgtccttagaagcactgaaggaacctgcaaatagtcgtctacctcctcaccttattgcacttgattccacgatacctggattttttgatgacattgggtatctggatctcttgccatgtcgtccttttgacacagtttttattttctatatgaagccaggtcagaaaacgaaccaagagattttaaagaatgtggagtcttccagaactgttcagccacatttcctagaatttttgctttcccttggctggtcagtagatgtgggcagacaccctggttggactgggcatgtttctaccagttggtctattaattgttgtgatgatggtgaaggatctcaacaagaagtgatttcctctgaagatattggagctagcattttcaatggacagaagaaggtgctgtattatgctgatgcccttacagaaattgcttttgtggttccttctcctgtggagtccttaactgattcattggaaagtaacatctcggaccaagatagtgattcaaatatggatcttatgccaggaattctgaaacagccatccctgacacttgagcttttccccaatcatacagacaatcttaattcctcacagaggctcagtcccagttccagaatgaggaagctgcctcagggtcgccctgttcctccccttggacctgagacaagagtttctgtagtctgggtggaacgctatgatgatatagaaaactttcccctctcagagctgatgacagagatcagtactggtgtggaaactactgcaaatagtagcacttcactgagatctacaactcttgaaaaagaagttcctgtcatcttcatccaccctttaaacactggattattccggataaaaattcaaggagccactggaaaatttaatatggtcatccctcttgtggatgggatgattgtcagcaggcgagctcttggctttctggtgaggcagactgtaattaacatttgtagaagaaagagactggaaagtgactcctacagtcccccccatgtccgccggaaacagaaaatcaccgacattgtcaacaagtaccggaacaagcagctggagccagagttttatacttcacttttccaggaggttggactcaagaactgcagttcttagaccactgaatttctaagactgttgaactccagtttgggaactataacacagcagaacagtttgataggtgatcactgtaaaaataaaaacaaatcactccc

SEQ ID NO: 445763 - DNA, 777 bp, Homo sapiens
caaagtcgtcccaccatcaatgaaggcaggccacttccggcgtagccatggcggctaacgctactaccaacccgtcgcagctgctgccgttagagcttgtggacaaatgtataggatcaagaattcacatcgtgatgaagagtgataaggaaattgttggtactcttctaggatttgatgactttgtcaatatggtactggaagatgtcactgagtttgaaatcacaccagaaggaagaaggattactaaattagatcagattttgctaaatggaaataatataacaatgctggttcctggaggagaaggacctgaagtgtgaatgagtttccttgacttacactagattttgttttggcttataatgacaagaaaatggaattttttttcccactttctaatgtttaaatcccataaagctaagtttcccgttaaagggaagtgctttgaagatgtgtacccatttttgtaagttaatcatgattatcctggaaaaagaagaaaagagcttcttctttgcagatgaaaataaaggtgtttttggttaactgtcattttgtttattctactgcagtagccagtggaacaaagtttgtagttattttgccacttacttttctgtcattatatgcttatttgttttgtcatttacgtgaccatttgattctcaaacaaaagttgttccaaacaaaatgatgaactttgatttgaacaggtgcatttaaacaaccggaaatgatcacttagaaaattcaattaaaatgctgttgttttgt

SEQ ID NO: 445764 - DNA, 549 bp, Homo sapiens
caaagtcgtcccaccatcaatgaaggcaggccacttccggcgtagccatggcggctaacgctactaccaacccgtcgcagctgctgccgttagagcttgtggacaaatgtataggatcaagaattcacatcgtgatgaagagtgataaggaaattgttggtactcttctaggatttgatgactttgtcaatatggtactggaagatgtcactgagtttgaaatcacaccagaaggaagaaggattactaaattagatcagattttgctaaatggaaataatataacaatgctggttcctggaggagaaggacctgaagtgtgaatgagtttccttgacttacactagattttgttttggcttataatgacaagaaaatggaattttttttcccactttctaatgtttaaatcccataaagctaagtttcccgttaaagggaagtgctttgaagatgtgtacccatttttgtaagttaatcatgattatcctggaaaaagaagaaaagagcttcttctttgcagatgaaaataaaggtgtttttggttaa

SEQ ID NO: 445765 - DNA, 1147 bp, Homo sapiens
tttgcttgttctgtttggttatgtgttgtgtctgcttgtgtggttctcgtttcgtgcgtgtgtgttgttctgtgcatcgttctctgtttctcgttctggtatggttgcgctgcttgtgctttctgttttctccgtctcgctcgtctgctgctcttcagtgcatactgctgtattggttgttgcctccttcgtgcttttcctgtcccttctcgctccgctcgttgtgtgggtattgtgagatgctgctctgcctcgtccatttttttatatattctcccctgagagacattgtgtgtgggcgcggatgaatagggcggggtgtgccccctcattcctcttgaggtgtgtttcctccgggcgtataatctctctgtgttgtctcgcatatggttcccccgccccgtgttgtgttctctcccaagtgtcgcccctgttagattgttctcctctgcggccgtggttttagtgccgcgcgcgttgttgctgtgttatttcgctctcttttgcgcgcctttctcaaaatctgtgtgtctattatttgtgcgcccctctggggtttttttatggcgccccccctcctttttgtgttttttttttttttttgtttttttttttttgtttttttttttttttttttttttttttttggcggctaacgctactaccaacccgtcgcagctgctgccgttagagcttgtggacaaatgtataggatcaagaattcacatcgtgatgaagagtgataaggaaattgttggtactcttctaggatttgatgactttgtcaatatggtactggaagatgtcactgagtttgaaatcacaccagaaggaagaaggattactaaattagatcagattttgctaaatggaaataatataacaatgctggttcctggaggagaaggacctgaagtgtgaatgagtttccttgacttacactagattttgttttggcttataatgacaagaaaatggaattttttttcccactttctaatgtttaaatcccataaagctaagtttcccgttaaagggaagtgctttgaagatgtgtacccatttttgtaagttaatcatgattatcctggaaaaagaagaaaagagcttcttctttgcagatgaaaataaaggtgtttttggttaa

SEQ ID NO: 445766 - DNA, 793 bp, Homo sapiens
  misc_feature (696)..(696): n is a, c, g, or t
  misc_feature (720)..(720): n is a, c, g, or t
  misc_feature (761)..(761): n is a, c, g, or t
  misc_feature (777)..(777): n is a, c, g, or t
  misc_feature (793)..(793): n is a, c, g, or t
caaagtcgtcccaccatcaatgaaggcaggccacttccggcgtagccatggcggctaacgctactaccaacccgtcgcagctgctgccgttagagcttgtggacaaatgtataggatcaagaattcacatcgtgatgaagagtgataaggaaattgttggtactcttctaggatttgatgactttgtcaatatggtactggaagatgtcactgagtttgaaatcacaccagaaggaagaaggattactaaattagatcagattttgctaaatggaaataatataacaatgctggttcctggaggagaaggacctgaagtgtgaatgagtttccttgacttacactagattttgttttggcttataatgacaagaaaatggaattttttttcccactttctaatgtttaaatcccataaagctaagtttcccgttaaagggaagtgctttgaagatgtgtacccatttttgtaagttaatcatgattatcctggaaaaagaagaaaagagcttcttctttgcagatgaaaataaaggtgtttttggttaactgtcattttgtttattctactgcagtagccagtggaacaaagtttgtagttattttgccacttacttttctgtcattatatgcttatttgttttgtcatttacgtgaccatttgattctcaaacaaaagttgttccaaacaaaaantgaatgaaactttttgaattttgnaaacaagggttggcatttttaaaaccaaaccccgggaaaantggatccacttttaanaaaaaaattcccattn

SEQ ID NO: 445767 - DNA, 532 bp, Homo sapiens
tcactggaaaaggtccacatttagtgaacgcgtcgtcggcctactttgttgtgagcccgcctctgcagtgttatagagcttgtggacaaatgtataggatcaagaattcacatcgtgatgaagagtgataaggaaattgttggtactcttctaggatttgatgactttgtcaatatggtactggaagatgtcactgagtttgaaatcacaccagaaggaagaaggattactaaattagatcagattttgctaaatggaaataatataacaatgctggttcctggaggagaaggacctgaagtgtgaatgagtttccttgacttacactagattttgttttggcttataatgacaagaaaatggaattttttttcccactttctaatgtttaaatcccataaagctaagtttcccgttaaagggaagtgctttgaagatgtgtacccatttttgtaagttaatcatgattatcctggaaaaagaagaaaagagcttcttctttgcagatgaaaataaaggtgtttttggttaa

SEQ ID NO: 445768 - DNA, 875 bp, Homo sapiens
  misc_feature (753)..(753): n is a, c, g, or t
  misc_feature (796)..(796): n is a, c, g, or t
  misc_feature (830)..(830): n is a, c, g, or t
tacgtgacccgggcggctgggcttgcagagcctgtggtgtccgcgggacctggagagcttgtggacaaatgtataggatcaagaattcacatcgtgatgaagagtgataaggaaattgttggtactcttctaggatttgatgactttgtcaatatggtactggaagatgtcactgagtttgaaatcacaccagaaggaagaaggattactaaattagatcagattttgctaaatggaaataatataacaatgctggttcctggaggagaaggacctgaagtgtgaatgagtttccttgacttacactagattttgttttggcttataatgacaagaaaatggaattttttttcccactttctaatgtttaaatcccataaagctaagtttcccgttaaagggaagtgctttgaagatgtgtacccatttttgtaagttaatcatgattatcctggaaaaagaagaaaagagcttcttctttgcagatgaaaataaaggtgtttttggttaactgtcattttgtttattctactgcagtagccagtggaacaaagtttgtagttattttgccacttacttttctgtcattatatgcttatttgttttgtcatttacgtgaccatttgattctcaaacaaaagttgttccaaacaaaatgatgaactttgatttgaacaggtgcatttaaacaaccggaaatgatcttgaaatcattaatggcggtgttgtgcaaaaaaaaaaaaaaaaaattgngggcggccgaaatttaaacttggggcggccagaagaaggaagngaacgggggaggggttccaaaacgggggtgaacnaggtgtcggtctatccccccccccgcgaaaaaaaaaaaaggagtt

SEQ ID NO: 445769 - DNA, 2212 bp, Homo sapiens
tacgtgacccgggcggctgggcttgcagagcctgtggtgtccgcgggacctggagagcttgtggacaaatgtataggatcaagaattcacatcgtgatgaagagtgataaggaaattgttggtactcttctaggatttgatgactttgtcaatatggtactggaagatgtcactgagtttgaaatcacaccagaaggaagaaggattactaaattagatcagattttgctaaatggaaataatataacaatgctggttcctggaggagaaggacctgaagtgtgaatgagtttccttgacttacactagattttgttttggcttataatgacaagaaaatggaattttttttcccactttctaatgtttaaatcccataaagctaagtttcccgttaaagggaagtgctttgaagatgtgtacccatttttgtaagttaatcatgattatcctggaaaaagaagaaaagagcttcttctttgcagatgaaaataaaggtgtttttggttaactgtcattttgtttattctactgcagtagccagtggaacaaagtttgtagttattttgccacttacttttctgtcattatatgcttatttgttttgtcatttacgtgaccatttgattctcaaacaaaagttgttccaaacaaaatgatgaactttgatttgaacaggtgcatttaaacaaccggaaatgatcacttagaaaattcaattaaaatgctgttgttttgtaatgaggatttttcttctgatttcaaattccatgaactcctattgaaaacaaacaatgtacaggtaatatatgcacattgtagaaatgcaggaattatctattggaattaccctaaagatagaaattttatctatttgcttataaaattgattcagaaggttattaccttaatgtagttattactgaattgccaggaaatgagtggagacagagctttaagataaaggatactaaaaacagctaagaactccaggactcaggtcaaatcaaggaactgataataagatcattgaactgtataaattaagtcaaagaactcctattaaaaacaaacaggtaatatatgcacattgtagaattgtaggtaagcaaaaaggagaaggttgatcatgctttgctgtatgtcttcgtagactttctcagtccactctcagtacacgttttattttacttgctcatcctgattatactgtttttaccctccacttaagtcattttttgaatttaaatggtgaatatctttctgtgtcaaatatttcaacattaatatgtacatagtattaaatggatttactataaattatttagcctattcttactggccacagtagtctaactagatctttatacatttgtatttttctagaataaactcaaaaatgtgtaagatcaaagggtatatattgtgttgccaagaaaaagtttgtgccaatgtatatttttgccaggagtctttcatagtaccatttatatccttcccagcattagctgtgttctaccttctctcctctttgccatttttacaagaaaaccgggcatgtctaaagttttcttttcctttttttttttttttttgttttttggagagtctcactggaatgcagtggcatgatcttggctccctgcaacctccagtcaggctggtgtgccttgtcgcgatatcaacgcgacctccgcctcccaggttcaagtgattgtcctgcctcaccctcctgagtagctgggattacaggtgggcgccaccactcccatctaatttttatatttttagagagatggggttttaccttgttggccaggctggtcttgaactcctgacctctagtgatccacctgcctcagcctcccaaagtgccggtattaaaggcatgagccaccaggcctggcctaaaattttcttgattaattttgatctcatttgtattttgtaaatgacttatctgttgaggcttttgccattgagatgtttgtctttttcttactaatttgtaagaattcttgatgggtttctgttagtcatgtattttgctaataatttccctagtttgtagtttgccacttagtgctatttttgacataaatgatgtattttaatgtagttgcatgttgacctagtccattatggtttttgtatttggtccacgtggattggaaaacctttgctttgattatacttttctttgggcacttta

SEQ ID NO: 445770 - DNA, 2233 bp, Homo sapiens
tcactggaaaaggtccacatttagtgaacgcgtcgtcggcctactttgttgtgagcccgcctctgcagtgttatagagcttgtggacaaatgtataggatcaagaattcacatcgtgatgaagagtgataaggaaattgttggtactcttctaggatttgatgactttgtcaatatggtactggaagatgtcactgagtttgaaatcacaccagaaggaagaaggattactaaattagatcagattttgctaaatggaaataatataacaatgctggttcctggaggagaaggacctgaagtgtgaatgagtttccttgacttacactagattttgttttggcttataatgacaagaaaatggaattttttttcccactttctaatgtttaaatcccataaagctaagtttcccgttaaagggaagtgctttgaagatgtgtacccatttttgtaagttaatcatgattatcctggaaaaagaagaaaagagcttcttctttgcagatgaaaataaaggtgtttttggttaactgtcattttgtttattctactgcagtagccagtggaacaaagtttgtagttattttgccacttacttttctgtcattatatgcttatttgttttgtcatttacgtgaccatttgattctcaaacaaaagttgttccaaacaaaatgatgaactttgatttgaacaggtgcatttaaacaaccggaaatgatcacttagaaaattcaattaaaatgctgttgttttgtaatgaggatttttcttctgatttcaaattccatgaactcctattgaaaacaaacaatgtacaggtaatatatgcacattgtagaaatgcaggaattatctattggaattaccctaaagatagaaattttatctatttgcttataaaattgattcagaaggttattaccttaatgtagttattactgaattgccaggaaatgagtggagacagagctttaagataaaggatactaaaaacagctaagaactccaggactcaggtcaaatcaaggaactgataataagatcattgaactgtataaattaagtcaaagaactcctattaaaaacaaacaggtaatatatgcacattgtagaattgtaggtaagcaaaaaggagaaggttgatcatgctttgctgtatgtcttcgtagactttctcagtccactctcagtacacgttttattttacttgctcatcctgattatactgtttttaccctccacttaagtcattttttgaatttaaatggtgaatatctttctgtgtcaaatatttcaacattaatatgtacatagtattaaatggatttactataaattatttagcctattcttactggccacagtagtctaactagatctttatacatttgtatttttctagaataaactcaaaaatgtgtaagatcaaagggtatatattgtgttgccaagaaaaagtttgtgccaatgtatatttttgccaggagtctttcatagtaccatttatatccttcccagcattagctgtgttctaccttctctcctctttgccatttttacaagaaaaccgggcatgtctaaagttttcttttcctttttttttttttttttgttttttggagagtctcactggaatgcagtggcatgatcttggctccctgcaacctccagtcaggctggtgtgccttgtcgcgatatcaacgcgacctccgcctcccaggttcaagtgattgtcctgcctcaccctcctgagtagctgggattacaggtgggcgccaccactcccatctaatttttatatttttagagagatggggttttaccttgttggccaggctggtcttgaactcctgacctctagtgatccacctgcctcagcctcccaaagtgccggtattaaaggcatgagccaccaggcctggcctaaaattttcttgattaattttgatctcatttgtattttgtaaatgacttatctgttgaggcttttgccattgagatgtttgtctttttcttactaatttgtaagaattcttgatgggtttctgttagtcatgtattttgctaataatttccctagtttgtagtttgccacttagtgctatttttgacataaatgatgtattttaatgtagttgcatgttgacctagtccattatggtttttgtatttggtccacgtggattggaaaacctttgctttgattatacttttctttgggcacttta

SEQ ID NO: 445771 - DNA, 4107 bp, Homo sapiens
tttgcttgttctgtttggttatgtgttgtgtctgcttgtgtggttctcgtttcgtgcgtgtgtgttgttctgtgcatcgttctctgtttctcgttctggtatggttgcgctgcttgtgctttctgttttctccgtctcgctcgtctgctgctcttcagtgcatactgctgtattggttgttgcctccttcgtgcttttcctgtcccttctcgctccgctcgttgtgtgggtattgtgagatgctgctctgcctcgtccatttttttatatattctcccctgagagacattgtgtgtgggcgcggatgaatagggcggggtgtgccccctcattcctcttgaggtgtgtttcctccgggcgtataatctctctgtgttgtctcgcatatggttcccccgccccgtgttgtgttctctcccaagtgtcgcccctgttagattgttctcctctgcggccgtggttttagtgccgcgcgcgttgttgctgtgttatttcgctctcttttgcgcgcctttctcaaaatctgtgtgtctattatttgtgcgcccctctggggtttttttatggcgccccccctcctttttgtgttttttttttttttttgtttttttttttttgtttttttttttttttttttttttttttttggcggctaacgctactaccaacccgtcgcagctgctgccgttagagcttgtggacaaatgtataggatcaagaattcacatcgtgatgaagagtgataaggaaattgttggtactcttctaggatttgatgactttgtcaatatggtactggaagatgtcactgagttgtgagtagtgttaaagaattggggggaatctcttcttaattaaagacagttttactacttttgagtaaaattatttatgagaaaacattacctcttggtggaataacgttaaagatagacgttttatctgtttgcttgtaaaattggatcagagtgttattaccttaatgtaattattagtaaacgcctagaatattagtggagacacagttttaaggtagaagataacaaaaagagccaggaattttagggttcaggtcaaataaaggaactgatagtaagagcatttaggctggacatggtggctcattcctgtaatcctagcactttggaaggccaaaggaggaggattaagcctgggagtttgagaccagcctgggcaacaaagggagacccctgtctctataaaaaatttaaaaattagctggttatagtagggggcagctgtagtcctagctgctctggagggtgaggatcccttgagcccaggagttctaggctgcagtgaactatgattgtaccactgtactcagcctgggcaacagagcaagaccctgtctcttaaaaaaaaaaaaaacccaaaaaacatttcatttcatatttgatctcctgggcaagctttcacttctttttatgaagctctgtctgatagacgtgggtcttagtgtcagtgagttcattctgctgcttttaatgaaggttacattacctagtggataacctttgtatctgaaaattgtggatataattgctcaacctcagtgtaatttgtatacaaggataacctttttagggagggtaagtatttccaaaatgttggctttgattttcactgtttgtcctgactgtattttatctattcatttagtgaaatcacaccagaaggaagaaggattactaaattagatcagattttgctaaatggaaataatataacaatggtaagacacattgaaactgttttattttgatgggagcccatttttggggagcagtgattacagaactaaccttaatgttgcttgcttgactaaatgatcatggcccagtggtgcataagatgggaaaggggttctctgtggtcagggtcctaaagctcagctattgaagaggcattgggtctaaaggttagtttgcttggaacttttaatcgctgttgagatagtaagtattaattgatgacgttgggaattgtaaatagatactgacaatctggagaaaatgggaacgtggagtgcaggggacaggcaaaggtggcttaatgaagagcaaggggtttttagatgacatggtggtagtgttattaataaactctttttcctctttatgcagctggttcctggaggagaaggacctgaagtgtgaatgagtttccttgacttacactagattttgttttggcttataatgacaagaaaatggaattttttttcccactttctaatgtttaaatcccataaagctaagtttcccgttaaagggaagtgctttgaagatgtgtacccatttttgtaagttaatcatgattatcctggaaaaagaagaaaagagcttcttctttgcagatgaaaataaaggtgtttttggttaactgtcattttgtttattctactgcagtagccagtggaacaaagtttgtagttattttgccacttacttttctgtcattatatgcttatttgttttgtcatttacgtgaccatttgattctcaaacaaaagttgttccaaacaaaatgatgaactttgatttgaacaggtgcatttaaacaaccggaaatgatcacttagaaaattcaattaaaatgctgttgttttgtaatgaggatttttcttctgatttcaaattccatgaactcctattgaaaacaaacaatgtacaggtaatatatgcacattgtagaaatgcaggaattatctattggaattaccctaaagatagaaattttatctatttgcttataaaattgattcagaaggttattaccttaatgtagttattactgaattgccaggaaatgagtggagacagagctttaagataaaggatactaaaaacagctaagaactccaggactcaggtcaaatcaaggaactgataataagatcattgaactgtataaattaagtcaaagaactcctattaaaaacaaacaggtaatatatgcacattgtagaattgtaggtaagcaaaaaggagaaggttgatcatgctttgctgtatgtcttcgtagactttctcagtccactctcagtacacgttttattttacttgctcatcctgattatactgtttttaccctccacttaagtcattttttgaatttaaatggtgaatatctttctgtgtcaaatatttcaacattaatatgtacatagtattaaatggatttactataaattatttagcctattcttactggccacagtagtctaactagatctttatacatttgtatttttctagaataaactcaaaaatgtgtaagatcaaagggtatatattgtgttgccaagaaaaagtttgtgccaatgtatatttttgccaggagtctttcatagtaccatttatatccttcccagcattagctgtgttctaccttctctcctctttgccatttttacaagaaaaccgggcatgtctaaagttttcttttcctttttttttttttttttgttttttggagagtctcactggaatgcagtggcatgatcttggctccctgcaacctccagtcaggctggtgtgccttgtcgcgatatcaacgcgacctccgcctcccaggttcaagtgattgtcctgcctcaccctcctgagtagctgggattacaggtgggcgccaccactcccatctaatttttatatttttagagagatggggttttaccttgttggccaggctggtcttgaactcctgacctctagtgatccacctgcctcagcctcccaaagtgccggtattaaaggcatgagccaccaggcctggcctaaaattttcttgattaattttgatctcatttgtattttgtaaatgacttatctgttgaggcttttgccattgagatgtttgtctttttcttactaatttgtaagaattcttgatgggtttctgttagtcatgtattttgctaataatttccctagtttgtagtttgccacttagtgctatttttgacataaatgatgtattttaatgtagttgcatgttgacctagtccattatggtttttgtatttggtccacgtggattggaaaacctttgctttgattatacttttctttgggcacttta

SEQ ID NO: 445772 - DNA, 996 bp, Homo sapiens
  misc_feature (861)..(861): n is a, c, g, or t
caaagtcgtcccaccatcaatgaaggcaggccacttccggcgtagccatggcggctaacgctactaccaacccgtcgcagctgctgccgttagagcttgtggacaaatgtataggatcaagaattcacatcgtgatgaagagtgataaggaaattgttggtactcttctaggatttgatgactttgtcaatatggtactggaagatgtcactgagtttgaaatcacaccagaaggaagaaggattactaaattagatcagattttgctaaatggaaataatataacaatgctggttcctggaggagaaggacctgaagtgtgaatgagtttccttgacttacactagattttgttttggcttataatgacaagaaaatggaattttttttcccactttctaatgtttaaatcccataaagctaagtttcccgttaaagggaagtgctttgaagatgtgtacccatttttgtaagttaatcatgattatcctggaaaaagaagaaaagagcttcttctttgcagatgaaaataaaggtgtttttggttaaaaaaaaaaaaaaaaaaaaaaaaaaaaaaaaaaaaaaaaaaaaaaaaaaaaaaaaaaaaaaaagaggggggggggcgcaaaaaaatctcccggggggcggcaatgagcaccccttttttggaaaaaagggggccccaaaagggggcttataaaaggggggggcgccgcgagcttattaaaacaacggccgcgagggggaaaacacagtcgtcgtatgggggagacagcatgggagaaaagaacccgccctatcgggggcggggcggcaacataatgggggaaccaccatccccccaaagaagaagatattacncaccccggagcgagtaacataaaccccgcgaggggactaatgcggtggggtcaacccaccgagccgcatataagccgtggcgaagaaaaattgctgcccggaggctttcacgtgcggcaaacattataagacgga

SEQ ID NO: 445773 - DNA, 1006 bp, Homo sapiens
tttgcttgttctgtttggttatgtgttgtgtctgcttgtgtggttctcgtttcgtgcgtgtgtgttgttctgtgcatcgttctctgtttctcgttctggtatggttgcgctgcttgtgctttctgttttctccgtctcgctcgtctgctgctcttcagtgcatactgctgtattggttgttgcctccttcgtgcttttcctgtcccttctcgctccgctcgttgtgtgggtattgtgagatgctgctctgcctcgtccatttttttatatattctcccctgagagacattgtgtgtgggcgcggatgaatagggcggggtgtgccccctcattcctcttgaggtgtgtttcctccgggcgtataatctctctgtgttgtctcgcatatggttcccccgccccgtgttgtgttctctcccaagtgtcgcccctgttagattgttctcctctgcggccgtggttttagtgccgcgcgcgttgttgctgtgttatttcgctctcttttgcgcgcctttctcaaaatctgtgtgtctattatttgtgcgcccctctggggtttttttatggcgccccccctcctttttgtgttttttttttttttttgtttttttttttttgtttttttttttttttttttttttttttttggcggctaacgctactaccaacccgtcgcagctgctgccgttagagcttgtggacaaatgtataggatcaagaattcacatcgtgatgaagagtgataaggaaattgttggtactcttctaggatttgatgactttgtcaatatggtactggaagatgtcactgagtttgaaatcacaccaaaagagaaaaagaaggattgatcagagcattgtgcaatacagtttcattaactccttccctcgctcccccaaaaatttgaatttttttttcaacactcttacacctgttatggaaaatgtcaacctttgtaagaaaaccaaaataaaaattgaaaaataaaaaccataaacatttgca

SEQ ID NO: 445774 - DNA, 713 bp, Homo sapiens
aaggcagaagctagagtaaattctgtatttattttcttaacaccaaatttcagatatggtactggaagatgtcactgagttgtgagtagtgttaaagaattggggggaatctcttcttaattaaagacagttttactacttttgagtaaaattatttatgagaaaacattacctcttggtggaataacgttaaagatagacgttttatctgtttgcttgtaaaattggatcagagtgttattaccttaatgtaattattagtaaacgcctagaatattagtggagacacagttttaaggtagaagataacaaaaagagccaggaattttagggttcaggtcaaataaaggaactgatagtaagagcatttaggctggacatggtggctcattcctgtaatcctagcactttggaaggccaaaggaggaggattaagcctgggagtttgagaccagcctgggcaacaaagggagacccctgtctctataaaaaatttaaaaattagctggttatagtagggggcagctgtagtcctagctgctctggagggtgaggatcccttgagcccaggagttctaggctgcagtgaactatgattgtaccactgtactcagcctgggcaacagagcaagaccctgtctcttaaaaaaaaaaaaaacccaaaaaacatttcatttcatatttgatctcctgggcaagctttcacttctttt

SEQ ID NO: 445775 - DNA, 511 bp, Homo sapiens
tacgtgacccgggcggctgggcttgcagagcctgtggtgtccgcgggacctggagagcttgtggacaaatgtataggatcaagaattcacatcgtgatgaagagtgataaggaaattgttggtactcttctaggatttgatgactttgtcaatatggtactggaagatgtcactgagtttgaaatcacaccagaaggaagaaggattactaaattagatcagattttgctaaatggaaataatataacaatgctggttcctggaggagaaggacctgaagtgtgaatgagtttccttgacttacactagattttgttttggcttataatgacaagaaaatggaattttttttcccactttctaatgtttaaatcccataaagctaagtttcccgttaaagggaagtgctttgaagatgtgtacccatttttgtaagttaatcatgattatcctggaaaaagaagaaaagagcttcttctttgcagatgaaaataaaggtgtttttggttaa

SEQ ID NO: 445776 - DNA, 531 bp, Homo sapiens
taccgtatctttatttcttttgctaattttatttctttttgccgctactaccaacccgtcgcagctgctgccgttagagcttgtggacaaatgtataggatcaagaattcacatcgtgatgaagagtgataaggaaattgttggtactcttctaggatttgatgactttgtcaatatggtactggaagatgtcactgagtttgaaatcacaccagaaggaagaaggattactaaattagatcagattttgctaaatggaaataatataacaatgctggttcctggaggagaaggacctgaagtgtgaagagtaaccccacaaagccagattgcagttcttgcccctttttgcgtgtgacatgagatgttaaagaattattcatagtgctcacattgggttaggggacgtctgaccgtgctatttagagccatgatcagtcgtcattcttctaagagagtggagctttgctgtttcattaactgtacagtgtagactaatggtgtttaataaaaatcattcagaatttcgaa

SEQ ID NO: 445777 - DNA, 2234 bp, Homo sapiens
taccgtatctttatttcttttgctaattttatttctttttgccgctactaccaacccgtcgcagctgctgccgttagagcttgtggacaaatgtataggatcaagaattcacatcgtgatgaagagtgataaggaaattgttggtactcttctaggatttgatgactttgtcaatatggtactggaagatgtcactgagtttgaaatcacaccagaaggaagaaggattactaaattagatcagattttgctaaatggaaataatataacaatgctggttcctggaggagaaggacctgaagtgtgaatgagtttccttgacttacactagattttgttttggcttataatgacaagaaaatggaattttttttcccactttctaatgtttaaatcccataaagctaagtttcccgttaaagggaagtgctttgaagatgtgtacccatttttgtaagttaatcatgattatcctggaaaaagaagaaaagagcttcttctttgcagatgaaaataaaggtgtttttggttaactgtcattttgtttattctactgcagtagccagtggaacaaagtttgtagttattttgccacttacttttctgtcattatatgcttatttgttttgtcatttacgtgaccatttgattctcaaacaaaagttgttccaaacaaaatgatgaactttgatttgaacaggtgcatttaaacaaccggaaatgatcacttagaaaattcaattaaaatgctgttgttttgtaatgaggatttttcttctgatttcaaattccatgaactcctattgaaaacaaacaatgtacaggtaatatatgcacattgtagaaatgcaggaattatctattggaattaccctaaagatagaaattttatctatttgcttataaaattgattcagaaggttattaccttaatgtagttattactgaattgccaggaaatgagtggagacagagctttaagataaaggatactaaaaacagctaagaactccaggactcaggtcaaatcaaggaactgataataagatcattgaactgtataaattaagtcaaagaactcctattaaaaacaaacaggtaatatatgcacattgtagaattgtaggtaagcaaaaaggagaaggttgatcatgctttgctgtatgtcttcgtagactttctcagtccactctcagtacacgttttattttacttgctcatcctgattatactgtttttaccctccacttaagtcattttttgaatttaaatggtgaatatctttctgtgtcaaatatttcaacattaatatgtacatagtattaaatggatttactataaattatttagcctattcttactggccacagtagtctaactagatctttatacatttgtatttttctagaataaactcaaaaatgtgtaagatcaaagggtatatattgtgttgccaagaaaaagtttgtgccaatgtatatttttgccaggagtctttcatagtaccatttatatccttcccagcattagctgtgttctaccttctctcctctttgccatttttacaagaaaaccgggcatgtctaaagttttcttttcctttttttttttttttttgttttttggagagtctcactggaatgcagtggcatgatcttggctccctgcaacctccagtcaggctggtgtgccttgtcgcgatatcaacgcgacctccgcctcccaggttcaagtgattgtcctgcctcaccctcctgagtagctgggattacaggtgggcgccaccactcccatctaatttttatatttttagagagatggggttttaccttgttggccaggctggtcttgaactcctgacctctagtgatccacctgcctcagcctcccaaagtgccggtattaaaggcatgagccaccaggcctggcctaaaattttcttgattaattttgatctcatttgtattttgtaaatgacttatctgttgaggcttttgccattgagatgtttgtctttttcttactaatttgtaagaattcttgatgggtttctgttagtcatgtattttgctaataatttccctagtttgtagtttgccacttagtgctatttttgacataaatgatgtattttaatgtagttgcatgttgacctagtccattatggtttttgtatttggtccacgtggattggaaaacctttgctttgattatacttttctttgggcacttta

SEQ ID NO: 445778 - DNA, 894 bp, Homo sapiens
caaagtcgtcccaccatcaatgaaggcaggccacttccggcgtagccatggcggctaacgctactaccaacccgtcgcagctgctgccgttagagcttgtggacaaatgtataggatcaagaattcacatcgtgatgaagagtgataaggaaattgttggtactcttctaggatttgatgactttgtcaatatggtactggaagatgtcactgagtttgaaatcacaccagaaggaagaaggattactaaattagatcagattttgctaaatggaaataatataacaatgctggttcctggaggagaaggacctgaagtgtgaatgagtttccttgacttacactagattttgttttggcttataatgacaagaaaatggaattttttttcccactttctaatgtttaaatcccataaagctaagtttcccgttaaagggaagtgctttgaagatgtgtacccatttttgtaagttaatcatgattatcctggaaaaagaagaaaagagcttcttctttgcagatgaaaataaaggtgtttttggttaactgtcattttgtttattctactgcagtagccagtggaacaaagtttgtagttattttgccacttacttttctgtcattatatgcttatttgttttgtcatttacgtgaccatttgattctcaacaagtgttcaacaatgtgacttggttgaaccgtcctttaacaccggaatgtcacttgaatcctatggggtgttgcccaaaacaaacaaaaaaaagtgcgggcccgcccaaatttaacaactgggggcccgaaagaagatagtaaacaggcgagggggcccacaaaccggcgcgcgacgtggtgtaccctcccgccgcgccagacccgacaaaacaacgacgt

SEQ ID NO: 445779 - DNA, 2250 bp, Homo sapiens
caaagtcgtcccaccatcaatgaaggcaggccacttccggcgtagccatggcggctaacgctactaccaacccgtcgcagctgctgccgttagagcttgtggacaaatgtataggatcaagaattcacatcgtgatgaagagtgataaggaaattgttggtactcttctaggatttgatgactttgtcaatatggtactggaagatgtcactgagtttgaaatcacaccagaaggaagaaggattactaaattagatcagattttgctaaatggaaataatataacaatgctggttcctggaggagaaggacctgaagtgtgaatgagtttccttgacttacactagattttgttttggcttataatgacaagaaaatggaattttttttcccactttctaatgtttaaatcccataaagctaagtttcccgttaaagggaagtgctttgaagatgtgtacccatttttgtaagttaatcatgattatcctggaaaaagaagaaaagagcttcttctttgcagatgaaaataaaggtgtttttggttaactgtcattttgtttattctactgcagtagccagtggaacaaagtttgtagttattttgccacttacttttctgtcattatatgcttatttgttttgtcatttacgtgaccatttgattctcaaacaaaagttgttccaaacaaaatgatgaactttgatttgaacaggtgcatttaaacaaccggaaatgatcacttagaaaattcaattaaaatgctgttgttttgtaatgaggatttttcttctgatttcaaattccatgaactcctattgaaaacaaacaatgtacaggtaatatatgcacattgtagaaatgcaggaattatctattggaattaccctaaagatagaaattttatctatttgcttataaaattgattcagaaggttattaccttaatgtagttattactgaattgccaggaaatgagtggagacagagctttaagataaaggatactaaaaacagctaagaactccaggactcaggtcaaatcaaggaactgataataagatcattgaactgtataaattaagtcaaagaactcctattaaaaacaaacaggtaatatatgcacattgtagaattgtaggtaagcaaaaaggagaaggttgatcatgctttgctgtatgtcttcgtagactttctcagtccactctcagtacacgttttattttacttgctcatcctgattatactgtttttaccctccacttaagtcattttttgaatttaaatggtgaatatctttctgtgtcaaatatttcaacattaatatgtacatagtattaaatggatttactataaattatttagcctattcttactggccacagtagtctaactagatctttatacatttgtatttttctagaataaactcaaaaatgtgtaagatcaaagggtatatattgtgttgccaagaaaaagtttgtgccaatgtatatttttgccaggagtctttcatagtaccatttatatccttcccagcattagctgtgttctaccttctctcctctttgccatttttacaagaaaaccgggcatgtctaaagttttcttttcctttttttttttttttttgttttttggagagtctcactggaatgcagtggcatgatcttggctccctgcaacctccagtcaggctggtgtgccttgtcgcgatatcaacgcgacctccgcctcccaggttcaagtgattgtcctgcctcaccctcctgagtagctgggattacaggtgggcgccaccactcccatctaatttttatatttttagagagatggggttttaccttgttggccaggctggtcttgaactcctgacctctagtgatccacctgcctcagcctcccaaagtgccggtattaaaggcatgagccaccaggcctggcctaaaattttcttgattaattttgatctcatttgtattttgtaaatgacttatctgttgaggcttttgccattgagatgtttgtctttttcttactaatttgtaagaattcttgatgggtttctgttagtcatgtattttgctaataatttccctagtttgtagtttgccacttagtgctatttttgacataaatgatgtattttaatgtagttgcatgttgacctagtccattatggtttttgtatttggtccacgtggattggaaaacctttgctttgattatacttttctttgggcacttta

SEQ ID NO: 445780 - DNA, 642 bp, Homo sapiens
agtgttttttttttttaaatttttttaaaaaatatccccaaaaaaacctcccattaaaagttgtctcccaaagggcaaaaccaagtttttaccccaaaatgaatcctttttcagttaacagatcaaatggatgagttctgagcctctcaagttcctttccccagttagagtggggaactgggcaagtgttaactgtgggactcactgcagcgtcctatcctaaaggcacgagaagacggaaatgcaacctgcggagctgggcttggttcccaggtcacagtttggcccccgctacaggatgctgccctgctcagagagagatttaatagggagctgaaggaatcgttagggggccagggagatgtgactgaggctggctttccacgtgaatgagacggggtcggtggagggtttggtgctacagccagtcagaagatttgcaaatgcgaacacattcctgtgtgaggcacgttaccctttgtcagttattgtgaatatgtgtattttaagcaataagattcagctggtcagacttttctgggcagtctcagtgacgcatttcctgtgctgtgattgttctgaagacagagtggctctaaccactgtgagaagcccaaataaaaattgatcccaaaaatgcta

SEQ ID NO: 445781 - DNA, 3172 bp, Homo sapiens
agcgggaagagggtagaggaggagagggaggaggaggagggaggtggcggcgccgtggcggaggagcaggagcaggagggggatggagaggagaaggctcctgggtggcatggcgctcctgctcctccaggcgctgcccagccccttgtcagccagggctgaacccccgcaggataaggaagcctgtgtgggtaccaacaatcaaagctacatctgtgacacaggacactgctgtggacagtctcagtgccagcacccagcaacttggcaaagcaaccagggtaggggagaaccacgagagaagcattaagtgactttcaaagactttcagagtacagccacttggttcctttttgtttgttttccttctcctctcctgcattttcctccatctccaggtacagttcggggtgtggatgcctcttcctccacaagggcacagtgttgtggagggctaagttggttctgtgactcattcctcataccctaactccatctcctttctttaaagtcaaatctcacctacctgtttgggtcagagagatgtgttttaaaagcccccaaggaaggaggctgggactgtgccctgacatgattcttggtgatggaataggtttgtgctctgattctagtttaagagaacgttgctgtatctcagtccaggagaggcagcccatcttggccctggatgaagaaggaaacccacagaggcccagggcttgtcattgggctgccagtgtctgccaagccagcattgagctaatcctgtgggaggatgagagctactgggccgttgtatgataggttggtaggggcttgttgatctgtcaaattccaggtgacaagatctatgcaccccatgcgtccttgaggggcctcttccccgcaggctctggctggccgcaggctggttctggtgtgaaaggttatactgccttttctttgtttgtttgtttttttctctaaaaacaaacagcaaaagacagctgaaaacaagaacttcaccggtgggcaggcaagaattctcttctggaaaatgacgtttgtggctctttcccaagttggccttcaaagagcctgcctgccgttgagccagaagatgtctcgtgtgaaggctggggtggcggctgtcttggaacctctgtgagcaggaggccctaagccgcagcagtggatagaggtgcagctctctgcctctctgccctttggtctatgttcacaggtgacccgtgtcagcctgcatcgcaagcacacaccctgcgggccttcaagtctcactgttccgtatgaggaaacagacagcggactgaggaagcgatggccccagagaaagggcccctgtagcctggctctcacacagtattttatctttgattctgaataaatattttttgtggggttttttttttttttggtggcagttgtttgttttaaactgaccacttggaagaaacaccttggttatctgtggttttcttgccttgtccctgcctctacccccaccccttttgagtcgggtgactcatttttctgtgtagagactcggtggcccaggcaggaggtgaaagcggccatccggaaggccctggggacccttgtgcctgttgctcgccttcaggtcaccagctgagctgcgataggaaaatctgaatggaggcagcaaacagccaaaacaaacattccccacccggccctgtgcatatgaagtcgttcttcccccaactcttgaacgatgatgatattcagacgaagcattgatgttatggaagaaagaaagaaacaaacaaaaaatatatatatatgtccaaaaacagacaaatccaagggtgtgaggtaaacgagtgtctgcatttagattccacaaaaccaaaatccatgttgaacaaagttaagtccgtacacagtgactttttgggtgagccgtgtgtgtctgtctgttgtgtgtgtgcctcaagccctgttttcctgtgaagatactttgagtggcagccattctctccacgtgaaccacacgtctggagcacagacaggcctctcaaggtcattgatcttacgcatttactgtttaccgaacaaatgtctgactgtgtactcgggtgtactccgcagcattgtcgactgcagtcccctgtgtttgccagagatactgtgctcgaagtagaggttttactctactcatcactgcgatttgcacattgctccgtggacactcggaggcctgcgttctgttccctataaatggaagcgtgctctgagcctgtctgcctccctcggctgctgctggtcctcagtaccagcgcccgggggtgtccacaaccacttgggacagaagaaggtggaatttcagacagaagcttgactgggtcttcaatgacaggcttggactagctgtggcccagacatcggccctgcccagaattgccaggaggaggctttgcaggctctagaggagccgcagggcctgcctgcctctggtgagtccaacaggcacaagcaagctggcgtgtggccagaggtagccggagtgtgtcacagcccctcagatgcctttccttccacctttttttattttttaagaatcccaaataactcactgaagtgtctcaaaggcgaacaagttttaccaaaatgaatcctttttcagttaacagatcaaatggatgagttctgagcctctcaagttcctttccccagttagagtggggaactgggcaagtgttaactgtgggactcactgcagcgtcctatcctaaaggcacgagaagacggaaatgcaacctgcggagctgggcttggttcccaggtcacagtttggcccccgctacaggatgctgccctgctcagagagagatttaatagggagctgaaggaatcgttagggggccagggagatgtgactgaggctggctttccacgtgaatgagacggggtcggtggagggtttggtgctacagccagtcagaagatttgcaaatgcgaacacattcctgtgtgaggcacgttaccctttgtcagttattgtgaatatgtgtattttaagcaataagattcagctggtcagacttttctgggcagtctcagtgacgcatttcctgtgctgtgattgttctgaagacagagtggctctaaccactgtgagaagcccaaataaaaattgatcccaaaaatgcta

SEQ ID NO: 445782 - DNA, 2950 bp, Homo sapiens
  misc_feature (18)..(18): n is a, c, g, or t
tgtattggtggtgctctngtggtcctgccagcacccagcaacttggcaaagcaaccagggtaggggagaaccacgagagaagcattaagtgactttcaaagactttcagagtacagccacttggttcctttttgtttgttttccttctcctctcctgcattttcctccatctccaggtacagttcggggtgtggatgcctcttcctccacaagggcacagtgttgtggagggctaagttggttctgtgactcattcctcataccctaactccatctcctttctttaaagtcaaatctcacctacctgtttgggtcagagagatgtgttttaaaagcccccaaggaaggaggctgggactgtgccctgacatgattcttggtgatggaataggtttgtgctctgattctagtttaagagaacgttgctgtatctcagtccaggagaggcagcccatcttggccctggatgaagaaggaaacccacagaggcccagggcttgtcattgggctgccagtgtctgccaagccagcattgagctaatcctgtgggaggatgagagctactgggccgttgtatgataggttggtaggggcttgttgatctgtcaaattccaggtgacaagatctatgcaccccatgcgtccttgaggggcctcttccccgcaggctctggctggccgcaggctggttctggtgtgaaaggttatactgccttttctttgtttgtttgtttttttctctaaaaacaaacagcaaaagacagctgaaaacaagaacttcaccggtgggcaggcaagaattctcttctggaaaatgacgtttgtggctctttcccaagttggccttcaaagagcctgcctgccgttgagccagaagatgtctcgtgtgaaggctggggtggcggctgtcttggaacctctgtgagcaggaggccctaagccgcagcagtggatagaggtgcagctctctgcctctctgccctttggtctatgttcacaggtgacccgtgtcagcctgcatcgcaagcacacaccctgcgggccttcaagtctcactgttccgtatgaggaaacagacagcggactgaggaagcgatggccccagagaaagggcccctgtagcctggctctcacacagtattttatctttgattctgaataaatattttttgtggggttttttttttttttggtggcagttgtttgttttaaactgaccacttggaagaaacaccttggttatctgtggttttcttgccttgtccctgcctctacccccaccccttttgagtcgggtgactcatttttctgtgtagagactcggtggcccaggcaggaggtgaaagcggccatccggaaggccctggggacccttgtgcctgttgctcgccttcaggtcaccagctgagctgcgataggaaaatctgaatggaggcagcaaacagccaaaacaaacattccccacccggccctgtgcatatgaagtcgttcttcccccaactcttgaacgatgatgatattcagacgaagcattgatgttatggaagaaagaaagaaacaaacaaaaaatatatatatatgtccaaaaacagacaaatccaagggtgtgaggtaaacgagtgtctgcatttagattccacaaaaccaaaatccatgttgaacaaagttaagtccgtacacagtgactttttgggtgagccgtgtgtgtctgtctgttgtgtgtgtgcctcaagccctgttttcctgtgaagatactttgagtggcagccattctctccacgtgaaccacacgtctggagcacagacaggcctctcaaggtcattgatcttacgcatttactgtttaccgaacaaatgtctgactgtgtactcgggtgtactccgcagcattgtcgactgcagtcccctgtgtttgccagagatactgtgctcgaagtagaggttttactctactcatcactgcgatttgcacattgctccgtggacactcggaggcctgcgttctgttccctataaatggaagcgtgctctgagcctgtctgcctccctcggctgctgctggtcctcagtaccagcgcccgggggtgtccacaaccacttgggacagaagaaggtggaatttcagacagaagcttgactgggtcttcaatgacaggcttggactagctgtggcccagacatcggccctgcccagaattgccaggaggaggctttgcaggctctagaggagccgcagggcctgcctgcctctggtgagtccaacaggcacaagcaagctggcgtgtggccagaggtagccggagtgtgtcacagcccctcagatgcctttccttccacctttttttattttttaagaatcccaaataactcactgaagtgtctcaaaggcgaacaagttttaccaaaatgaatcctttttcagttaacagatcaaatggatgagttctgagcctctcaagttcctttccccagttagagtggggaactgggcaagtgttaactgtgggactcactgcagcgtcctatcctaaaggcacgagaagacggaaatgcaacctgcggagctgggcttggttcccaggtcacagtttggcccccgctacaggatgctgccctgctcagagagagatttaatagggagctgaaggaatcgttagggggccagggagatgtgactgaggctggctttccacgtgaatgagacggggtcggtggagggtttggtgctacagccagtcagaagatttgcaaatgcgaacacattcctgtgtgaggcacgttaccctttgtcagttattgtgaatatgtgtattttaagcaataagattcagctggtcagacttttctgggcagtctcagtgacgcatttcctgtgctgtgattgttctgaagacagagtggctctaaccactgtgagaagcccaaataaaaattgatcccaaaaatgcta

SEQ ID NO: 445783 - DNA, 2466 bp, Homo sapiens
tatcgattgccaccctgctgcgttgagccagaagatgtctcgtgtgaaggctggggtggcggctgtcttggaacctctgtgagcaggaggccctaagccgcagcagtggatagaggtgcagctctctgcctctctgccctttggtctatgttcacaggtgacccgtgtcagcctgcatcgcaggctctggctggccgcaggctggttctggtgtgaaaggttatactgccttttctttgtttgtttgtttttttctctaaaaacaaacagcaaaagacagctgaaaacaagaacttcaccggtgggcaggcaagaattctcttctggaaaatgacgtttgtggctctttcccaagttggccttcaaagagcctgcctgccgttgagccagaagatgtctcgtgtgaaggctggggtggcggctgtcttggaacctctgtgagcaggaggccctaagccgcagcagtggatagaggtgcagctctctgcctctctgccctttggtctatgttcacaggtgacccgtgtcagcctgcatcgcaagcacacaccctgcgggccttcaagtctcactgttccgtatgaggaaacagacagcggactgaggaagcgatggccccagagaaagggcccctgtagcctggctctcacacagtattttatctttgattctgaataaatattttttgtggggttttttttttttttggtggcagttgtttgttttaaactgaccacttggaagaaacaccttggttatctgtggttttcttgccttgtccctgcctctacccccaccccttttgagtcgggtgactcatttttctgtgtagagactcggtggcccaggcaggaggtgaaagcggccatccggaaggccctggggacccttgtgcctgttgctcgccttcaggtcaccagctgagctgcgataggaaaatctgaatggaggcagcaaacagccaaaacaaacattccccacccggccctgtgcatatgaagtcgttcttcccccaactcttgaacgatgatgatattcagacgaagcattgatgttatggaagaaagaaagaaacaaacaaaaaatatatatatatgtccaaaaacagacaaatccaagggtgtgaggtaaacgagtgtctgcatttagattccacaaaaccaaaatccatgttgaacaaagttaagtccgtacacagtgactttttgggtgagccgtgtgtgtctgtctgttgtgtgtgtgcctcaagccctgttttcctgtgaagatactttgagtggcagccattctctccacgtgaaccacacgtctggagcacagacaggcctctcaaggtcattgatcttacgcatttactgtttaccgaacaaatgtctgactgtgtactcgggtgtactccgcagcattgtcgactgcagtcccctgtgtttgccagagatactgtgctcgaagtagaggttttactctactcatcactgcgatttgcacattgctccgtggacactcggaggcctgcgttctgttccctataaatggaagcgtgctctgagcctgtctgcctccctcggctgctgctggtcctcagtaccagcgcccgggggtgtccacaaccacttgggacagaagaaggtggaatttcagacagaagcttgactgggtcttcaatgacaggcttggactagctgtggcccagacatcggccctgcccagaattgccaggaggaggctttgcaggctctagaggagccgcagggcctgcctgcctctggtgagtccaacaggcacaagcaagctggcgtgtggccagaggtagccggagtgtgtcacagcccctcagatgcctttccttccacctttttttattttttaagaatcccaaataactcactgaagtgtctcaaaggcgaacaagttttaccaaaatgaatcctttttcagttaacagatcaaatggatgagttctgagcctctcaagttcctttccccagttagagtggggaactgggcaagtgttaactgtgggactcactgcagcgtcctatcctaaaggcacgagaagacggaaatgcaacctgcggagctgggcttggttcccaggtcacagtttggcccccgctacaggatgctgccctgctcagagagagatttaatagggagctgaaggaatcgttagggggccagggagatgtgactgaggctggctttccacgtgaatgagacggggtcggtggagggtttggtgctacagccagtcagaagatttgcaaatgcgaacacattcctgtgtgaggcacgttaccctttgtcagttattgtgaatatgtgtattttaagcaataagattcagctggtcagacttttctgggcagtctcagtgacgcatttcctgtgctgtgattgttctgaagacagagtggctctaaccactgtgagaagcccaaataaaaattgatcccaaaaatgcta

SEQ ID NO: 445784 - DNA, 2856 bp, Homo sapiens
agcgggaagagggtagaggaggagagggaggaggaggagggaggtggcggcgccgtggcggaggagcaggagcaggagggggatggagaggagaaggctcctgggtggcatggcgctcctgctcctccaggcgctgcccagccccttgtcagccagggctgaacccccgcaggataaggaagcctgtgtgggtaccaacaatcaaagctacatctgtgacacaggacactgctgtggacagtctcagtgctgcaactactactatgaactctggtggttctggctggtgtggaccatcatcatcatcctgagctgctgctgtgtttgccaccaccgccgagccaagcaccgccttcaggcccagcagcggcaacatgaaatcaacctgatcgcttaccgagaagcccacaattactcagcgctgccattttatttcaggtttttgccaaactatttactacctccttatgaggaagtggtgaaccgacctccaactcctcccccaccatacagtgccttccagctacagcagcagcagctgctgcctccacagtgtggccctgcaggtggcagtcccccgggcatcgatcccaccaggggatcccagggggcacagagcagccccttgtctgagcccagcagaagcagcacaagacccccaagcatcgctgaccctgatccctctgacctaccagttgaccgagcagccaccaaagccccagggatggagcccagtggctctgtggctggcctgggggagctggacccgggggccttcctggacaaagatgcagaatgtagggaggagctgctgaaagatgacagctctgaacacggcgcacccgacagcaaagagaagacgcctgggagacatcgccgcttcacaggtgactcgggcattgaagtgtgtgtgtgcaaccggggccaccatgacgatgacctcaaagagttcaacacactcatcgatgatgctctggatgggcccctggacttctgcgacagctgccatgtgcggccccctggtgatgaggaggaaggcctctgtcagccctctgaggagcaggctcgagagcctgggcacccgcacctgccacggccgcccgcatgcctgctgctgaacaccatcaacgagcaggactctcccaactcccagagcagcagctcccccagctagagcaggtcctgccagcacccagcaacttggcaaagcaaccagggtaggggagaaccacgagagaagcattaagtgactttcaaagactttcagagtacagccacttggttcctttttgtttgttttccttctcctctcctgcattttcctccatctccaggtacagttcggggtgtggatgcctcttcctccacaagggcacagtgttgtggagggctaagttggttctgtgactcattcctcataccctaactccatctcctttctttaaagtcaaatctcacctacctgtttgggtcagagagatgtgttttaaaagcccccaaggaaggaggctgggactgtgccctgacatgattcttggtgatggaataggtttgtgctctgattctagtttaagagaacgttgctgtatctcagtccaggagaggcagcccatcttggccctggatgaagaaggaaacccacagaggcccagggcttgtcattgggctgccagtgtctgccaagccagcattgagctaatcctgtgggaggatgagagctactgggccgttgtatgataggttggtaggggcttgttgatctgtcaaattccaggtgacaagatctatgcaccccatgcgtccttgaggggcctcttccccgcaggctctggctggccgcaggctggttctggtgtgaaaggttatactgccttttctttgtttgtttgtttttttctctaaaaacaaacagcaaaagacagctgaaaacaagaacttcaccggtgggcaggcaagaattctcttctggaaaatgacgtttgtggctctttcccaagttggccttcaaagagcctgcctgccgttgagccagaagatgtctcgtgtgaaggctggggtggcggctgtcttggaacctctgtgagcaggaggccctaagccgcagcagtggatagaggtgcagctctctgcctctctgccctttggtctatgttcacaggtgacccgtgtcagcctgcatcgcaagcacacaccctgcgggccttcaagtctcactgttccgtatgaggaaacagacagcggactgaggaagcgatggccccagagaaagggcccctgtagcctggctctcacacagtattttatctttgattctgaataaatattttttgtggggttttttttttttttggtggcagttgtttgttttaaactgaccacttggaagaaacaccttggttatctgtggttttcttgccttgtccctgcctctacccccaccccttttgagtcgggtgactcatttttctgtgtagagactcggtggcccaggcaggaggtgaaagcggccatccggaaggccctggggacccttgtgcctgttgctcgccttcaggtcaccagctgagctgcgataggaaaatctgaatggaggcagcaaacagccaaaacaaacattccccacccggccctgtgcatatgaagtcgttcttcccccaactcttgaacgatgatgatattcagacgaagcattgatgttatggaagaaagaaagaaacaaacaaaaaatatatatatatgtccaaaaacagacaaatccaagggtgtgaggtaaacgagtgtctgcgtaagatcaatgaccttgagaggcctgtctgtgctccagacgtgtggttcacgtggagagaatggctgcca

SEQ ID NO: 445785 - DNA, 357 bp, Homo sapiens
tgggatcaatttttatttgggcttctcacagtggttagagccactctgtcttcagaacaatcacagcacaggaaatgcgtcactgaggctggctttccacgtgaatgagacggggtcggtggagggtttggtgctacagccagtcagaagatttgcaaatgcgaacacattcctgtgtgaggcacgttaccctttgtcagttattgtgaatatgtgtattttaagcaataagattcagctggtcagacttttctgggcagtctcagtgacgcatttcctgtgctgtgattgttctgaagacagagtggctctaaccactgtgagaagcccaaataaaaattgatcccaaaaatgcta

SEQ ID NO: 445786 - DNA, 4108 bp, Homo sapiens
agcgggaagagggtagaggaggagagggaggaggaggagggaggtggcggcgccgtggcggaggagcaggagcaggagggggatggagaggagaaggctcctgggtggcatggcgctcctgctcctccaggcgctgcccagccccttgtcagccagggctgaacccccgcaggataaggaagcctgtgtgggtaccaacaatcaaagctacatctgtgacacaggacactgctgtggacagtctcagtgctgcaactactactatgaactctggtggttctggctggtgtggaccatcatcatcatcctgagctgctgctgtgtttgccaccaccgccgagccaagcaccgccttcaggcccagcagcggcaacatgaaatcaacctgatcgcttaccgagaagcccacaattactcagcgctgccattttatttcaggtttttgccaaactatttactacctccttatgaggaagtggtgaaccgacctccaactcctcccccaccatacagtgccttccagctacagcagcagcagctgctgcctccacagtgtggccctgcaggtggcagtcccccgggcatcgatcccaccaggggatcccagggggcacagagcagccccttgtctgagcccagcagaagcagcacaagacccccaagcatcgctgaccctgatccctctgacctaccagttgaccgagcagccaccaaagccccagggatggagcccagtggctctgtggctggcctgggggagctggacccgggggccttcctggacaaagatgcagaatgtagggaggagctgctgaaagatgacagctctgaacacggcgcacccgacagcaaagagaagacgcctgggagacatcgccgcttcacaggtgactcgggcattgaagtgtgtgtgtgcaaccggggccaccatgacgatgacctcaaagagttcaacacactcatcgatgatgctctggatgggcccctggacttctgcgacagctgccatgtgcggccccctggtgatgaggaggaaggcctctgtcagccctctgaggagcaggctcgagagcctgggcacccgcacctgccacggccgcccgcatgcctgctgctgaacaccatcaacgagcaggactctcccaactcccagagcagcagctcccccagctagagcaggtcctgccagcacccagcaacttggcaaagcaaccagggtaggggagaaccacgagagaagcattaagtgactttcaaagactttcagagtacagccacttggttcctttttgtttgttttccttctcctctcctgcattttcctccatctccaggtacagttcggggtgtggatgcctcttcctccacaagggcacagtgttgtggagggctaagttggttctgtgactcattcctcataccctaactccatctcctttctttaaagtcaaatctcacctacctgtttgggtcagagagatgtgttttaaaagcccccaaggaaggaggctgggactgtgccctgacatgattcttggtgatggaataggtttgtgctctgattctagtttaagagaacgttgctgtatctcagtccaggagaggcagcccatcttggccctggatgaagaaggaaacccacagaggcccagggcttgtcattgggctgccagtgtctgccaagccagcattgagctaatcctgtgggaggatgagagctactgggccgttgtatgataggttggtaggggcttgttgatctgtcaaattccaggtgacaagatctatgcaccccatgcgtccttgaggggcctcttccccgcaggctctggctggccgcaggctggttctggtgtgaaaggttatactgccttttctttgtttgtttgtttttttctctaaaaacaaacagcaaaagacagctgaaaacaagaacttcaccggtgggcaggcaagaattctcttctggaaaatgacgtttgtggctctttcccaagttggccttcaaagagcctgcctgccgttgagccagaagatgtctcgtgtgaaggctggggtggcggctgtcttggaacctctgtgagcaggaggccctaagccgcagcagtggatagaggtgcagctctctgcctctctgccctttggtctatgttcacaggtgacccgtgtcagcctgcatcgcaagcacacaccctgcgggccttcaagtctcactgttccgtatgaggaaacagacagcggactgaggaagcgatggccccagagaaagggcccctgtagcctggctctcacacagtattttatctttgattctgaataaatattttttgtggggttttttttttttttggtggcagttgtttgttttaaactgaccacttggaagaaacaccttggttatctgtggttttcttgccttgtccctgcctctacccccaccccttttgagtcgggtgactcatttttctgtgtagagactcggtggcccaggcaggaggtgaaagcggccatccggaaggccctggggacccttgtgcctgttgctcgccttcaggtcaccagctgagctgcgataggaaaatctgaatggaggcagcaaacagccaaaacaaacattccccacccggccctgtgcatatgaagtcgttcttcccccaactcttgaacgatgatgatattcagacgaagcattgatgttatggaagaaagaaagaaacaaacaaaaaatatatatatatgtccaaaaacagacaaatccaagggtgtgaggtaaacgagtgtctgcatttagattccacaaaaccaaaatccatgttgaacaaagttaagtccgtacacagtgactttttgggtgagccgtgtgtgtctgtctgttgtgtgtgtgcctcaagccctgttttcctgtgaagatactttgagtggcagccattctctccacgtgaaccacacgtctggagcacagacaggcctctcaaggtcattgatcttacgcatttactgtttaccgaacaaatgtctgactgtgtactcgggtgtactccgcagcattgtcgactgcagtcccctgtgtttgccagagatactgtgctcgaagtagaggttttactctactcatcactgcgatttgcacattgctccgtggacactcggaggcctgcgttctgttccctataaatggaagcgtgctctgagcctgtctgcctccctcggctgctgctggtcctcagtaccagcgcccgggggtgtccacaaccacttgggacagaagaaggtggaatttcagacagaagcttgactgggtcttcaatgacaggcttggactagctgtggcccagacatcggccctgcccagaattgccaggaggaggctttgcaggctctagaggagccgcagggcctgcctgcctctggtgagtccaacaggcacaagcaagctggcgtgtggccagaggtagccggagtgtgtcacagcccctcagatgcctttccttccacctttttttattttttaagaatcccaaataactcactgaagtgtctcaaaggcgaacaagttttaccaaaatgaatcctttttcagttaacagatcaaatggatgagttctgagcctctcaagttcctttccccagttagagtggggaactgggcaagtgttaactgtgggactcactgcagcgtcctatcctaaaggcacgagaagacggaaatgcaacctgcggagctgggcttggttcccaggtcacagtttggcccccgctacaggatgctgccctgctcagagagagatttaatagggagctgaaggaatcgttagggggccagggagatgtgactgaggctggctttccacgtgaatgagacggggtcggtggagggtttggtgctacagccagtcagaagatttgcaaatgcgaacacattcctgtgtgaggcacgttaccctttgtcagttattgtgaatatgtgtattttaagcaataagattcagctggtcagacttttctgggcagtctcagtgacgcatttcctgtgctgtgattgttctgaagacagagtggctctaaccactgtgagaagcccaaataaaaattgatcccaaaaatgcta

SEQ ID NO: 445787 - DNA, 4054 bp, Homo sapiens
agcgggaagagggtagaggaggagagggaggaggaggagggaggtggcggcgccgtggcggaggagcaggagcaggagggggatggagaggagaaggctcctgggtggcatggcgctcctgctcctccaggcgctgcccagccccttgtcagccagggctgaacccccgcaggataaggaagcctgtgtgggtaccaacaatcaaagctacatctgtgacacaggacactgctgtggacagtctcagtgctgcaactactactatgaactctggtggttctggctggtgtggaccatcatcatcatcctgagctgctgctgtgtttgccaccaccgccgagccaagcaccgccttcaggcccagcagcggcaacatgaaatcaacctgatcgcttaccgagaagcccacaattactcagcgctgccattttatttcaggtttttgccaaactatttactacctccttatgaggaagtggtgaaccgacctccaactcctcccccaccatacagtgccttccagctacagcagcagcagctgctgcctccacagtgtggccctgcaggtggcagtcccccgggcatcgatcccaccaggggatcccagggggcacagagcagccccttgtctgagcccagcagaagcagcacaagacccccaagcatcgctgaccctgatccctctgacctaccagttgaccgagcagccaccaaagccccagggatggagcccagtggctctgtggctggcctgggggagctggacccgggggccttcctggacaaagatgcagaatgtagggaggagctgctgaaagatgacagctctgaacacggcgcacccgacagcaaagagaagacgcctgggagacatcgccgcttcacaggtgactcgggcattgaagtgtgtgtgtgcaaccggggccaccatgacgatgacctcaaagagttcaacacactcatcgatgatgctctggatgggcccctggacttctgcgacagctgccatgtgcggccccctggtgatgaggaggaaggcctctgtcagccctctgaggagcaggctcgagagcctgggcacccgcacctgccacggccgcccgcatgcctgctgctgaacaccatcaacgagcaggactctcccaactcccagagcagcagctcccccagctagagcaggtcctgccagcacccagcaacttggcaaagcaaccagggtaggggagaaccacgagagaagcattaagtgactttcaaagactttcagagtacagccacttggttcctttttgtttgttttccttctcctctcctgcattttcctccatctccaggtacagttcggggtgtggatgcctcttcctccacaagggcacagtgttgtggagggctaagttggttctgtgactcattcctcataccctaactccatctcctttctttaaagtcaaatctcacctacctgtttgggtcagagagatgtgttttaaaagcccccaaggaaggaggctgggactgtgccctgacatgattcttggtgatggaataggtttgtgctctgattctagtttaagagaacgttgctgtatctcagtccaggagaggcagcccatcttggccctggatgaagaaggaaacccacagaggcccagggcttgtcattgggctgccagtgtctgccaagccagcattgagctaatcctgtgggaggatgagagctactgggccgttgtatgataggttggtaggggcttgttgatctgtcaaattccaggtgacaagatctatgcaccccatgcgtccttgaggggcctcttccccgcaggctctggctggccgcaggctggttctggtgtgaaaggttatactgccttttctttgtttgtttgtttttttctctaaaaacaaacagcaaaagacagctgaaaacaagaacttcaccggtgggcaggcaagaattctcttctggaaaatgacgtttgtggctctttcccaagttggccttcaaagagcctgcctgccgttgagccagaagatgtctcgtgtgaaggctggggtggcggctgtcttggaacctctgtgagcaggaggccctaagccgcagcagtggatagaggtgcagctctctgcctctctgccctttggtctatgttcacaggtgacccgtgtcagcctgcatcgcaagcacacaccctgcgggccttcaagtctcactgttccgtatgaggaaacagacagcggactgaggaagcgatggccccagagaaagggcccctgtagcctggctctcacacagtattttatctttgattctgaataaatattttttgtggggttttttttttttttggtggcagttgtttgttttaaactgaccacttggaagaaacaccttggttatctgtggttttcttgccttgtccctgcctctacccccaccccttttgagtcgggtgactcatttttctgtgtagagactcggtggcccaggcaggaggtgaaagcggccatccggaaggccctggggacccttgtgcctgttgctcgccttcaggtcaccagctgagctgcgataggaaaatctgaatggaggcagcaaacagccaaaacaaacattccccacccggccctgtgcatatgaagtcgttcttcccccaactcttgaacgatgatgatattcagacgaagcattgatgttatggaagaaagaaagaaacaaacaaaaaatatatatatatgtccaaaaacagacaaatccaagggtgtgaggtaaacgagtgtctgcatttagattccacaaaaccaaaatccatgttgaacaaagttaagtccgtacacagtgactttttgggtgagccgtgtgtgtctgtctgttgtgtgtgtgcctcaagccctgttttcctgtgaagatactttgagtggcagccattctctccacgtgaaccacacgtctggagcacagacaggcctctcaaggtcattgatcttacgcatttactgtttaccgaacaaatgtctgactgtgtactcgggtgtactccgcagcattgtcgactgcagtcccctgtgtttgccagagatactgtgctcgaagtagaggttttactctactcatcactgcgatttgcacattgctccgtggacactcggaggcctgcgttctgttccctataaatggaagcgtgctctgagcctgtctgcctccctcggctgctgctggtcctcagtaccagcgcccgggggtgtccacaaccacttgggacagaagaaggtggaatttcagacagaagcttgactgggtcttcaatgacaggcttggactagctgtggcccagacatcggccctgcccagaattgccaggaggaggctttgcaggctctagaggagccgcagggcctgcctgcctctggtgagtccaacaggcacaagcaagctggcgtgtggccagaggtagccggagtgtgtcacagcccctcagatgcctttccttccacctttttttattttttaagaatcccaaataactcactgaagtgtctcaaaggcgaacaagttttaccaattcctttccccagttagagtggggaactgggcaagtgttaactgtgggactcactgcagcgtcctatcctaaaggcacgagaagacggaaatgcaacctgcggagctgggcttggttcccaggtcacagtttggcccccgctacaggatgctgccctgctcagagagagatttaatagggagctgaaggaatcgttagggggccagggagatgtgactgaggctggctttccacgtgaatgagacggggtcggtggagggtttggtgctacagccagtcagaagatttgcaaatgcgaacacattcctgtgtgaggcacgttaccctttgtcagttattgtgaatatgtgtattttaagcaataagattcagctggtcagacttttctgggcagtctcagtgacgcatttcctgtgctgtgattgttctgaagacagagtggctctaaccactgtgagaagcccaaataaaaattgatcccaaaaatgcta

SEQ ID NO: 445788 - DNA, 763 bp, Homo sapiens
ttctggtcggggcaggcagcggcggccgcggcggggcctggggcttgggccctggagcccgggcctggggcgctggcgggaggcccctcccaactcccggcgcgcctcgcccggctgcccgcctcactgaaggtcaaggcgctttgttctgcgccgcgggcggcctcctgggcggcggccccttggaggaggcgaagacggcgagaggcgtgcggccgctcaaatctcccgctagcccagcccgccccgcgtgcgggggctgtggcggttacacggccgggcgcgccggagcgttcaggcttcccgtttttaaggtggagacgtccaggacttctttattagatgtttaggaatttgagtttttccgtagggcggttgtcatcgtgagcctctgtggggtcaggctgggctaactggggttttgatgtcagtttggtgtggccgagggcatgtctgacggggaagaaagtccttggcgttgcttcttagctgttgggagctgtgcggtgggagcgagctgggcggcgtgcgctccccgaggactggcctgagtggccttagactagttactcacgggacttggtttcccagccaaggtgggcagcaagtctgtttactatttaaaaccgtctttcacaagggaaaagcaaaatctccaaaaaaaaaaattgtacatgttatggatgggaaagtgccatgcttttctttcagttcagagatggtggaagaggtcacatttgtattttttgacctgaccagagtc

SEQ ID NO: 445789 - DNA, 475 bp, Homo sapiens
tgcactgtggccacatctcatcctggctgctgcgtggcgccaggaggctgtgcacactgtgtgaactccacaccagcacagtagggcccttctaagttccaccgaagttggctctaagcaatacatggtgtgagctcaacaaaacgggaaatgttgataaatgaagctgcattttcatgcactacccttgttatgcaaccagtagtgataaggtggttttgcttttggtgtaagtctcatgtttgaaacttgatttttagtctgaccaatgatgtatttggatgtaggagaaactgattcaagacaattgactaatggtggaggttcacctttgagcaccttattgatcactttaaagattaaacaccaaagttttaatatatttctactaaggtttcttttccctttgtatgagatgtaaaatgatacccagattcctgtatccaataacattatgctgctggttcgatcagcc

SEQ ID NO: 445790 - DNA, 575 bp, Homo sapiens
gggggagaagggactaaaaacatgttccggctaatggtgtgaatgaagttcagagacggcccggcatgtgtggccaggataaggccaagcctgctgtccctgtcacatgcaccttccagagagatgggcagtgttagagtctgtgcaagcaaaagaaaacaaggaaggaagggaggttttagtattgggagcagtctgatagaagtgaaaatcatgcttctgcccattttgaaagtatgatctagtgttgaagttgttcaccccgagttcagtatcttgcagcccttttgtatcatgagaaattgtggccgtttcctcctgtataattttgtgcatttcattttctttcatgctgacagttcctttcaatttttttccccatttaggtgtaatttttgtctgttaatcattcatacgtttctaggtaaggtggaattccattcatacctaacttccaaacttctgatctatactttatacaatgcattgttttgactttgaataaagagggagttgctgtccaggtacactcactgtgtcacaggtttgacataggtgtctgttacatgtacttt

SEQ ID NO: 445791 - DNA, 520 bp, Homo sapiens
ttaaacctcgaggtgagaaatgttacattttatctaccagcacagcttcctcctgtgtgggctttaaaattctgggagttgtcactgtaatttaaatatgttttgtcttttctttttctagcatccggggatggagaatcactggtaagatttgttgttaatagtcttattttcctgttgaagtctctcctgagtgaatgtctacttgtctacttgttaaaaaaagtccagtcctggctgtgtgtggactgggtatgccagtgatcttaatgctttgggaggctgaggtgggaggactgcacgagtccaggagtttgagaccagcctgggcaacatagcacaaccccatctccacaaaaaattaaaaccaaataaattagccagccgaacatggtggttcacgcccgtaataccagcactgtgggaggccaaggtgggtggatcaccagaggtcaggagttcaagaccagtctggtcaacatggtgaaaccccgtttctgcttaaaataccaaaaaaaaa

SEQ ID NO: 445792 - DNA, 2481 bp, Homo sapiens
ggcacgagcttgctcgcggagagaggagctaggagcctcggccaatgggagccggcgttgttggaggccacggcggcgcagccccaaagcgagcgaagctagggtcgccgccactgccgcaggaggcgtgaggggataaaaacattcagatggcagatcacagtttttcagatggggttccttcagattccgtggaagctgctaaaaatgcaagtaacacagaaaagctcacagatcaggtgatgcagaatcctcgagttctggcagctttacaggagcgacttgacaatgtccctcacaccccttccagctacatcgaaactttacctaaagcagtaaaaagaagaattaatgcattgaaacaacttcaggtgagatgtgctcacatagaagccaagttctatgaagaggtacatgacttggaaagaaagtatgcagcgctataccagcctctctttgacaagagaagagaatttatcaccggcgatgttgaaccaacagatgcggaatcggaatggcacagtgaaaatgaagaggaagagaaattggctggagacatgaaaagtaaagtagtcgtcacagaaaaagcagcggcaacggctgaagagccagatcccaaaggaattccagagttctggtttaccatcttcagaaatgtggacatgctgagtgaattagtccaggaatatgatgaaccaatcttgaaacacctgcaggatattaaagtgaaattttctgaccctggacagcctatgtcttttgtgttagagttccactttgaacccaacgactactttaccaactcagtcctgacaaaaacctacaagatgaaatcagaaccagataaggctgatcccttttcctttgaaggtcctgagattgtggactgtgacgggtgtactattgactggaagaaaggaaagaatgttactgtcaaaaccatcaagaaaaagcagaagcataagggtcgaggcactgttagaacaattacgaaacaagtacccaatgagtcctttttcaacttcttcaatccattgaaagcatccggggatggagaatcactggatgaagattctgaattcacattagcctctgattttgaaattggacactttttccgtgagcggatagtcccgcgggctgtgctgtacttcactggggaggccatagaagatgatgacaattttgaagaaggtgaagaaggagaagaggaggaattagaaggtgacgaggagggagaagacgaggatgatgcggaaattaaccccaagaaggaacccagccagccggcggaatgcaagcagcagtaggaagcggaggcgggtgcctggcagaccggctgtcgggactccaggcctgtgggcggggcctcggtccttgccgcagcacaatcccgtggacagagcttactccatctaactcgttttcaagtgcatgattttcactttcacttttcctttttccttattattttgcttaacttgtacagtggcaactgaaatgcatttcagaaataggaggtttcgtccagcaccctctgcagccttggtgcctgtagctctggacttccctgggcctttccctgtgggagggccctgtagaccacatcagggtggggtgggggtcacttggcaaaaagggccgaggtctggtgatgtggttcccaggatctggaacctctcccacccctcctgcagttggactgaattcttccctttcatccgaagaaacccacttgctgtttccagccgctgaatctgctgagtgtgcagcctgcatcacctgctgtatgccgatcatctcagaaagggctgtgtagagtagggccctgttctccttaggatgttgcttcttgatttttttttttttttaggggtgggtcagggttgtgacacaccagcccaggtgagagctgctgcgggtcacctcatatttatttatcccttcttgcctgtgaggactgcggcttttcgctgtggctcgtccttaacgtttctgaaccaccttggtgccctgagcaggaagatgtgccacttcctagcaggcgcaaggcctgtgcggaagaaacgccgctccctgccaccagggctgaagatgcgagcccgtcctcatgacgcaggcgccaccctgctgccggagccgggcttcggcagtcttctccactgagggactgggctgggaagtcctgcgtttcagtggagcgtatgagcgtcaagtcctgctttctcagtagccccattgcggggccccaccattcatcctgtctgaaggtcctgggtttggtgtgaccgcttggcggctggtgggtggggttttcaagtgggtgacggcgctctccggcagccggggatggccgtgtccgcactgaccaggcctgtggagagtgctcggcctaaccttagaacacatttgtaactgaatacagtgttttcaatttgtacagaatagttagaatattctattaaagtggtgaaacattga

SEQ ID NO: 445793 - DNA, 2444 bp, Homo sapiens
tgtgttcagaggatccctaacgatcagtcaggtgcgggggctgtggcggttacacggccgggcgcgccggagcgttcaggcttcccgtttttaaggggataaaaacattcagatggcagatcacagtttttcagatggggttccttcagattccgtggaagctgctaaaaatgcaagtaacacagaaaagctcacagatcaggtgatgcagaatcctcgagttctggcagctttacaggagcgacttgacaatgtccctcacaccccttccagctacatcgaaactttacctaaagcagtaaaaagaagaattaatgcattgaaacaacttcaggtgagatgtgctcacatagaagccaagttctatgaagaggtacatgacttggaaagaaagtatgcagcgctataccagcctctctttgacaagagaagagaatttatcaccggcgatgttgaaccaacagatgcggaatcggaatggcacagtgaaaatgaagaggaagagaaattggctggagacatgaaaagtaaagtagtcgtcacagaaaaagcagcggcaacggctgaagagccagatcccaaaggaattccagagttctggtttaccatcttcagaaatgtggacatgctgagtgaattagtccaggaatatgatgaaccaatcttgaaacacctgcaggatattaaagtgaaattttctgaccctggacagcctatgtcttttgtgttagagttccactttgaacccaacgactactttaccaactcagtcctgacaaaaacctacaagatgaaatcagaaccagataaggctgatcccttttcctttgaaggtcctgagattgtggactgtgacgggtgtactattgactggaagaaaggaaagaatgttactgtcaaaaccatcaagaaaaagcagaagcataagggtcgaggcactgttagaacaattacgaaacaagtacccaatgagtcctttttcaacttcttcaatccattgaaagcatccggggatggagaatcactggatgaagattctgaattcacattagcctctgattttgaaattggacactttttccgtgagcggatagtcccgcgggctgtgctgtacttcactggggaggccatagaagatgatgacaattttgaagaaggtgaagaaggagaagaggaggaattagaaggtgacgaggagggagaagacgaggatgatgcggaaattaaccccaagaaggaacccagccagccggcggaatgcaagcagcagtaggaagcggaggcgggtgcctggcagaccggctgtcgggactccaggcctgtgggcggggcctcggtccttgccgcagcacaatcccgtggacagagcttactccatctaactcgttttcaagtgcatgattttcactttcacttttcctttttccttattattttgcttaacttgtacagtggcaactgaaatgcatttcagaaataggaggtttcgtccagcaccctctgcagccttggtgcctgtagctctggacttccctgggcctttccctgtgggagggccctgtagaccacatcagggtggggtgggggtcacttggcaaaaagggccgaggtctggtgatgtggttcccaggatctggaacctctcccacccctcctgcagttggactgaattcttccctttcatccgaagaaacccacttgctgtttccagccgctgaatctgctgagtgtgcagcctgcatcacctgctgtatgccgatcatctcagaaagggctgtgtagagtagggccctgttctccttaggatgttgcttcttgatttttttttttttttaggggtgggtcagggttgtgacacaccagcccaggtgagagctgctgcgggtcacctcatatttatttatcccttcttgcctgtgaggactgcggcttttcgctgtggctcgtccttaacgtttctgaaccaccttggtgccctgagcaggaagatgtgccacttcctagcaggcgcaaggcctgtgcggaagaaacgccgctccctgccaccagggctgaagatgcgagcccgtcctcatgacgcaggcgccaccctgctgccggagccgggcttcggcagtcttctccactgagggactgggctgggaagtcctgcgtttcagtggagcgtatgagcgtcaagtcctgctttctcagtagccccattgcggggccccaccattcatcctgtctgaaggtcctgggtttggtgtgaccgcttggcggctggtgggtggggttttcaagtgggtgacggcgctctccggcagccggggatggccgtgtccgcactgaccaggcctgtggagagtgctcggcctaaccttagaacacatttgtaactgaatacagtgttttcaatttgtacagaatagttagaatattctattaaagtggtgaaacattga

SEQ ID NO: 445794 - DNA, 2624 bp, Homo sapiens
ggcacgagcttgctcgcggagagaggagctaggagcctcggccaatgggagccggcgttgttggaggccacggcggcgcagccccaaagcgagcgaagctagggtcgccgccactgccgcaggaggcgtgagggaaaagtgttttaggcttccagagtagaaatctgatattacttcgtttgattcttcgaccactatggtgataggaagtagctgatctctgcaggaaactgctgttacctggcctcagctgaatttttgtgggacctcctgaggggataaaaacattcagatggcagatcacagtttttcagatggggttccttcagattccgtggaagctgctaaaaatgcaagtaacacagaaaagctcacagatcaggtgatgcagaatcctcgagttctggcagctttacaggagcgacttgacaatgtccctcacaccccttccagctacatcgaaactttacctaaagcagtaaaaagaagaattaatgcattgaaacaacttcaggtgagatgtgctcacatagaagccaagttctatgaagaggtacatgacttggaaagaaagtatgcagcgctataccagcctctctttgacaagagaagagaatttatcaccggcgatgttgaaccaacagatgcggaatcggaatggcacagtgaaaatgaagaggaagagaaattggctggagacatgaaaagtaaagtagtcgtcacagaaaaagcagcggcaacggctgaagagccagatcccaaaggaattccagagttctggtttaccatcttcagaaatgtggacatgctgagtgaattagtccaggaatatgatgaaccaatcttgaaacacctgcaggatattaaagtgaaattttctgaccctggacagcctatgtcttttgtgttagagttccactttgaacccaacgactactttaccaactcagtcctgacaaaaacctacaagatgaaatcagaaccagataaggctgatcccttttcctttgaaggtcctgagattgtggactgtgacgggtgtactattgactggaagaaaggaaagaatgttactgtcaaaaccatcaagaaaaagcagaagcataagggtcgaggcactgttagaacaattacgaaacaagtacccaatgagtcctttttcaacttcttcaatccattgaaagcatccggggatggagaatcactggatgaagattctgaattcacattagcctctgattttgaaattggacactttttccgtgagcggatagtcccgcgggctgtgctgtacttcactggggaggccatagaagatgatgacaattttgaagaaggtgaagaaggagaagaggaggaattagaaggtgacgaggagggagaagacgaggatgatgcggaaattaaccccaagaaggaacccagccagccggcggaatgcaagcagcagtaggaagcggaggcgggtgcctggcagaccggctgtcgggactccaggcctgtgggcggggcctcggtccttgccgcagcacaatcccgtggacagagcttactccatctaactcgttttcaagtgcatgattttcactttcacttttcctttttccttattattttgcttaacttgtacagtggcaactgaaatgcatttcagaaataggaggtttcgtccagcaccctctgcagccttggtgcctgtagctctggacttccctgggcctttccctgtgggagggccctgtagaccacatcagggtggggtgggggtcacttggcaaaaagggccgaggtctggtgatgtggttcccaggatctggaacctctcccacccctcctgcagttggactgaattcttccctttcatccgaagaaacccacttgctgtttccagccgctgaatctgctgagtgtgcagcctgcatcacctgctgtatgccgatcatctcagaaagggctgtgtagagtagggccctgttctccttaggatgttgcttcttgatttttttttttttttaggggtgggtcagggttgtgacacaccagcccaggtgagagctgctgcgggtcacctcatatttatttatcccttcttgcctgtgaggactgcggcttttcgctgtggctcgtccttaacgtttctgaaccaccttggtgccctgagcaggaagatgtgccacttcctagcaggcgcaaggcctgtgcggaagaaacgccgctccctgccaccagggctgaagatgcgagcccgtcctcatgacgcaggcgccaccctgctgccggagccgggcttcggcagtcttctccactgagggactgggctgggaagtcctgcgtttcagtggagcgtatgagcgtcaagtcctgctttctcagtagccccattgcggggccccaccattcatcctgtctgaaggtcctgggtttggtgtgaccgcttggcggctggtgggtggggttttcaagtgggtgacggcgctctccggcagccggggatggccgtgtccgcactgaccaggcctgtggagagtgctcggcctaaccttagaacacatttgtaactgaatacagtgttttcaatttgtacagaatagttagaatattctattaaagtggtgaaacattga

SEQ ID NO: 445795 - DNA, 2501 bp, Homo sapiens
agtcaagatctagaacattttcatcactctagaaagttccctcctgtcccttctagtggactccatcccacagataaccgttgtttaaaaagtatattgaacaaacatttttgcttatgaatataattattacaactctttttaatttataggggataaaaacattcagatggcagatcacagtttttcagatggggttccttcagattccgtggaagctgctaaaaatgcaagtaacacagaaaagctcacagatcaggtgatgcagaatcctcgagttctggcagctttacaggagcgacttgacaatgtccctcacaccccttccagctacatcgaaactttacctaaagcagtaaaaagaagaattaatgcattgaaacaacttcaggtgagatgtgctcacatagaagccaagttctatgaagaggtacatgacttggaaagaaagtatgcagcgctataccagcctctctttgacaagagaagagaatttatcaccggcgatgttgaaccaacagatgcggaatcggaatggcacagtgaaaatgaagaggaagagaaattggctggagacatgaaaagtaaagtagtcgtcacagaaaaagcagcggcaacggctgaagagccagatcccaaaggaattccagagttctggtttaccatcttcagaaatgtggacatgctgagtgaattagtccaggaatatgatgaaccaatcttgaaacacctgcaggatattaaagtgaaattttctgaccctggacagcctatgtcttttgtgttagagttccactttgaacccaacgactactttaccaactcagtcctgacaaaaacctacaagatgaaatcagaaccagataaggctgatcccttttcctttgaaggtcctgagattgtggactgtgacgggtgtactattgactggaagaaaggaaagaatgttactgtcaaaaccatcaagaaaaagcagaagcataagggtcgaggcactgttagaacaattacgaaacaagtacccaatgagtcctttttcaacttcttcaatccattgaaagcatccggggatggagaatcactggatgaagattctgaattcacattagcctctgattttgaaattggacactttttccgtgagcggatagtcccgcgggctgtgctgtacttcactggggaggccatagaagatgatgacaattttgaagaaggtgaagaaggagaagaggaggaattagaaggtgacgaggagggagaagacgaggatgatgcggaaattaaccccaagaaggaacccagccagccggcggaatgcaagcagcagtaggaagcggaggcgggtgcctggcagaccggctgtcgggactccaggcctgtgggcggggcctcggtccttgccgcagcacaatcccgtggacagagcttactccatctaactcgttttcaagtgcatgattttcactttcacttttcctttttccttattattttgcttaacttgtacagtggcaactgaaatgcatttcagaaataggaggtttcgtccagcaccctctgcagccttggtgcctgtagctctggacttccctgggcctttccctgtgggagggccctgtagaccacatcagggtggggtgggggtcacttggcaaaaagggccgaggtctggtgatgtggttcccaggatctggaacctctcccacccctcctgcagttggactgaattcttccctttcatccgaagaaacccacttgctgtttccagccgctgaatctgctgagtgtgcagcctgcatcacctgctgtatgccgatcatctcagaaagggctgtgtagagtagggccctgttctccttaggatgttgcttcttgatttttttttttttttaggggtgggtcagggttgtgacacaccagcccaggtgagagctgctgcgggtcacctcatatttatttatcccttcttgcctgtgaggactgcggcttttcgctgtggctcgtccttaacgtttctgaaccaccttggtgccctgagcaggaagatgtgccacttcctagcaggcgcaaggcctgtgcggaagaaacgccgctccctgccaccagggctgaagatgcgagcccgtcctcatgacgcaggcgccaccctgctgccggagccgggcttcggcagtcttctccactgagggactgggctgggaagtcctgcgtttcagtggagcgtatgagcgtcaagtcctgctttctcagtagccccattgcggggccccaccattcatcctgtctgaaggtcctgggtttggtgtgaccgcttggcggctggtgggtggggttttcaagtgggtgacggcgctctccggcagccggggatggccgtgtccgcactgaccaggcctgtggagagtgctcggcctaaccttagaacacatttgtaactgaatacagtgttttcaatttgtacagaatagttagaatattctattaaagtggtgaaacattga

SEQ ID NO: 445796 - DNA, 2409 bp, Homo sapiens
ggcacgagcttgctcgcggagagaggagctaggagcctcggccaatgggagccggcgttgttggaggccacggcggcgcagccccaaagcgagcgaagctagggtcgccgccactgccgcaggaggcgtgaggggataaaaacattcagatggcagatcacagtttttcagatggggttccttcagattccgtggaagctgctaaaaatgcaagtaacacagaaaagctcacagatcaggtgatgcagaatcctcgagttctggcagctttacaggagcgacttgacaatgtccctcacaccccttccagctacatcgaaactttacctaaagcagtaaaaagaagaattaatgcattgaaacaacttcaggtgagatgtgctcacatagaagccaagttctatgaagaggtacatgacttggaaagaaagtatgcagcgctataccagcctctctttgacaagagaagagaatttatcaccggcgatgttgaaccaacagatgcggaatcggaatggcacagtgaaaatgaagaggaagagaaattggctggagacatgaaaagtaaagtagtcgtcacagaaaaagcagcggcaacggctgaagagccagatcccaaaggaattccagagttctggtttaccatcttcagaaatgtggacatgctgagtgaattagtccagtcttttgtgttagagttccactttgaacccaacgactactttaccaactcagtcctgacaaaaacctacaagatgaaatcagaaccagataaggctgatcccttttcctttgaaggtcctgagattgtggactgtgacgggtgtactattgactggaagaaaggaaagaatgttactgtcaaaaccatcaagaaaaagcagaagcataagggtcgaggcactgttagaacaattacgaaacaagtacccaatgagtcctttttcaacttcttcaatccattgaaagcatccggggatggagaatcactggatgaagattctgaattcacattagcctctgattttgaaattggacactttttccgtgagcggatagtcccgcgggctgtgctgtacttcactggggaggccatagaagatgatgacaattttgaagaaggtgaagaaggagaagaggaggaattagaaggtgacgaggagggagaagacgaggatgatgcggaaattaaccccaagaaggaacccagccagccggcggaatgcaagcagcagtaggaagcggaggcgggtgcctggcagaccggctgtcgggactccaggcctgtgggcggggcctcggtccttgccgcagcacaatcccgtggacagagcttactccatctaactcgttttcaagtgcatgattttcactttcacttttcctttttccttattattttgcttaacttgtacagtggcaactgaaatgcatttcagaaataggaggtttcgtccagcaccctctgcagccttggtgcctgtagctctggacttccctgggcctttccctgtgggagggccctgtagaccacatcagggtggggtgggggtcacttggcaaaaagggccgaggtctggtgatgtggttcccaggatctggaacctctcccacccctcctgcagttggactgaattcttccctttcatccgaagaaacccacttgctgtttccagccgctgaatctgctgagtgtgcagcctgcatcacctgctgtatgccgatcatctcagaaagggctgtgtagagtagggccctgttctccttaggatgttgcttcttgatttttttttttttttaggggtgggtcagggttgtgacacaccagcccaggtgagagctgctgcgggtcacctcatatttatttatcccttcttgcctgtgaggactgcggcttttcgctgtggctcgtccttaacgtttctgaaccaccttggtgccctgagcaggaagatgtgccacttcctagcaggcgcaaggcctgtgcggaagaaacgccgctccctgccaccagggctgaagatgcgagcccgtcctcatgacgcaggcgccaccctgctgccggagccgggcttcggcagtcttctccactgagggactgggctgggaagtcctgcgtttcagtggagcgtatgagcgtcaagtcctgctttctcagtagccccattgcggggccccaccattcatcctgtctgaaggtcctgggtttggtgtgaccgcttggcggctggtgggtggggttttcaagtgggtgacggcgctctccggcagccggggatggccgtgtccgcactgaccaggcctgtggagagtgctcggcctaaccttagaacacatttgtaactgaatacagtgttttcaatttgtacagaatagttagaatattctattaaagtggtgaaacattga

SEQ ID NO: 445797 - DNA, 2552 bp, Homo sapiens
ggcacgagcttgctcgcggagagaggagctaggagcctcggccaatgggagccggcgttgttggaggccacggcggcgcagccccaaagcgagcgaagctagggtcgccgccactgccgcaggaggcgtgagggaaaagtgttttaggcttccagagtagaaatctgatattacttcgtttgattcttcgaccactatggtgataggaagtagctgatctctgcaggaaactgctgttacctggcctcagctgaatttttgtgggacctcctgaggggataaaaacattcagatggcagatcacagtttttcagatggggttccttcagattccgtggaagctgctaaaaatgcaagtaacacagaaaagctcacagatcaggtgatgcagaatcctcgagttctggcagctttacaggagcgacttgacaatgtccctcacaccccttccagctacatcgaaactttacctaaagcagtaaaaagaagaattaatgcattgaaacaacttcaggtgagatgtgctcacatagaagccaagttctatgaagaggtacatgacttggaaagaaagtatgcagcgctataccagcctctctttgacaagagaagagaatttatcaccggcgatgttgaaccaacagatgcggaatcggaatggcacagtgaaaatgaagaggaagagaaattggctggagacatgaaaagtaaagtagtcgtcacagaaaaagcagcggcaacggctgaagagccagatcccaaaggaattccagagttctggtttaccatcttcagaaatgtggacatgctgagtgaattagtccagtcttttgtgttagagttccactttgaacccaacgactactttaccaactcagtcctgacaaaaacctacaagatgaaatcagaaccagataaggctgatcccttttcctttgaaggtcctgagattgtggactgtgacgggtgtactattgactggaagaaaggaaagaatgttactgtcaaaaccatcaagaaaaagcagaagcataagggtcgaggcactgttagaacaattacgaaacaagtacccaatgagtcctttttcaacttcttcaatccattgaaagcatccggggatggagaatcactggatgaagattctgaattcacattagcctctgattttgaaattggacactttttccgtgagcggatagtcccgcgggctgtgctgtacttcactggggaggccatagaagatgatgacaattttgaagaaggtgaagaaggagaagaggaggaattagaaggtgacgaggagggagaagacgaggatgatgcggaaattaaccccaagaaggaacccagccagccggcggaatgcaagcagcagtaggaagcggaggcgggtgcctggcagaccggctgtcgggactccaggcctgtgggcggggcctcggtccttgccgcagcacaatcccgtggacagagcttactccatctaactcgttttcaagtgcatgattttcactttcacttttcctttttccttattattttgcttaacttgtacagtggcaactgaaatgcatttcagaaataggaggtttcgtccagcaccctctgcagccttggtgcctgtagctctggacttccctgggcctttccctgtgggagggccctgtagaccacatcagggtggggtgggggtcacttggcaaaaagggccgaggtctggtgatgtggttcccaggatctggaacctctcccacccctcctgcagttggactgaattcttccctttcatccgaagaaacccacttgctgtttccagccgctgaatctgctgagtgtgcagcctgcatcacctgctgtatgccgatcatctcagaaagggctgtgtagagtagggccctgttctccttaggatgttgcttcttgatttttttttttttttaggggtgggtcagggttgtgacacaccagcccaggtgagagctgctgcgggtcacctcatatttatttatcccttcttgcctgtgaggactgcggcttttcgctgtggctcgtccttaacgtttctgaaccaccttggtgccctgagcaggaagatgtgccacttcctagcaggcgcaaggcctgtgcggaagaaacgccgctccctgccaccagggctgaagatgcgagcccgtcctcatgacgcaggcgccaccctgctgccggagccgggcttcggcagtcttctccactgagggactgggctgggaagtcctgcgtttcagtggagcgtatgagcgtcaagtcctgctttctcagtagccccattgcggggccccaccattcatcctgtctgaaggtcctgggtttggtgtgaccgcttggcggctggtgggtggggttttcaagtgggtgacggcgctctccggcagccggggatggccgtgtccgcactgaccaggcctgtggagagtgctcggcctaaccttagaacacatttgtaactgaatacagtgttttcaatttgtacagaatagttagaatattctattaaagtggtgaaacattga

SEQ ID NO: 445798 - DNA, 2427 bp, Homo sapiens
ggcacgagcttgctcgcggagagaggagctaggagcctcggccaatgggagccggcgttgttggaggccacggcggcgcagccccaaagcgagcgaagctagggtcgccgccactgccgcaggaggcgtgaggggataaaaacattcagatggcagatcacagtttttcagatggggttccttcagattccgtggaagctgctaaaaatgcaagtaacacagaaaagctcacagatcaggtgatgcagaatcctcgagttctggcagctttacaggagcgacttgacaatgtccctcacaccccttccagctacatcgaaactttacctaaagcagtaaaaagaagaattaatgcattgaaacaacttcaggtgagatgtgctcacatagaagccaagttctatgaagaggtacatgacttggaaagaaagtatgcagcgctataccagcctctctttgacaagagaagagaatttatcaccggcgatgttgaaccaacagatgcggaatcggaatggcacagtgaaaatgaagaggaagagaaattggctggagacatgaaaagtaaagtagtcgtcacagaaaaagcagcggcaacggctgaagagccagatcccaaaggaattccagagttctggtttaccatcttcagaaatgtggacatgctgagtgaattagtccaggaatatgatgaaccaatcttgaaacacctgcaggatattaaagtgaaattttctgaccctggacagcctatgtcttttgtgttagagttccactttgaacccaacgactactttaccaactcagtcctgacaaaaacctacaagatgaaatcagaaccagataaggctgatcccttttcctttgaaggtcctgagattgtggactgtgacgggtgtactattgactggaagaaaggaaagaatgttactgtcaaaaccatcaagaaaaagcagaagcataagggtcgaggcactgttagaacaattacgaaacaagtacccaatgagtcctttttcaacttcttcaatccattgaaagcatccggggatggagaatcactggatgaagattctgaattcacattagcctctgattttgaaattggacactttttccgtgagcggatagtcccgcgggctgtgctgtacttcactggggaggccatagaagatgatgacaattttgaagaaggtgaagaaggagaagaggaggaattagaaggtgacgaggagggagaagacgaggatgatgcggaaattaaccccaagaaggaacccagccagccggcggaatgcaagcagcagtaggaagcggaggcgggtgcctggcagaccggctgtcgggactccaggcctgtgggcggggcctcggtccttgccgcagcacaatcccgtggacagagcttactccatctaactcgttttcaagtgcatgattttcactttcacttttcctttttccttattattttgcttaacttgtacagtggcaactgaaatgcatttcagaaataggaggtttcgtccagcaccctctgcagccttggtgcctgtagctctggacttccctgggcctttccctgtgggagggccctgtagaccacatcagggtggggtgggggtcacttggccctcctgcagttggactgaattcttccctttcatccgaagaaacccacttgctgtttccagccgctgaatctgctgagtgtgcagcctgcatcacctgctgtatgccgatcatctcagaaagggctgtgtagagtagggccctgttctccttaggatgttgcttcttgatttttttttttttttaggggtgggtcagggttgtgacacaccagcccaggtgagagctgctgcgggtcacctcatatttatttatcccttcttgcctgtgaggactgcggcttttcgctgtggctcgtccttaacgtttctgaaccaccttggtgccctgagcaggaagatgtgccacttcctagcaggcgcaaggcctgtgcggaagaaacgccgctccctgccaccagggctgaagatgcgagcccgtcctcatgacgcaggcgccaccctgctgccggagccgggcttcggcagtcttctccactgagggactgggctgggaagtcctgcgtttcagtggagcgtatgagcgtcaagtcctgctttctcagtagccccattgcggggccccaccattcatcctgtctgaaggtcctgggtttggtgtgaccgcttggcggctggtgggtggggttttcaagtgggtgacggcgctctccggcagccggggatggccgtgtccgcactgaccaggcctgtggagagtgctcggcctaaccttagaacacatttgtaactgaatacagtgttttcaatttgtacagaatagttagaatattctattaaagtggtgaaacattga

SEQ ID NO: 445799 - DNA, 1313 bp, Homo sapiens
atgagaatgaactcattcagtcttggctttcattgttgattggagctaattggtgaatggagctggctttgctctctacaagccttgtctttttcattgacagaaggaacccagccagccggcggaatgcaagcagcagtaggaagcggaggcgggtgcctggcagaccggctgtcgggactccaggcctgtgggcggggcctcggtccttgccgcagcacaatcccgtggacagagcttactccatctaactcgttttcaagtgcatgattttcactttcacttttcctttttccttattattttgcttaacttgtacagtggcaactgaaatgcatttcagaaataggaggtttcgtccagcaccctctgcagccttggtgcctgtagctctggacttccctgggcctttccctgtgggagggccctgtagaccacatcagggtggggtgggggtcacttggcaaaaagggccgaggtctggtgatgtggttcccaggatctggaacctctcccacccctcctgcagttggactgaattcttccctttcatccgaagaaacccacttgctgtttccagccgctgaatctgctgagtgtgcagcctgcatcacctgctgtatgccgatcatctcagaaagggctgtgtagagtagggccctgttctccttaggatgttgcttcttgatttttttttttttttaggggtgggtcagggttgtgacacaccagcccaggtgagagctgctgcgggtcacctcatatttatttatcccttcttgcctgtgaggactgcggcttttcgctgtggctcgtccttaacgtttctgaaccaccttggtgccctgagcaggaagatgtgccacttcctagcaggcgcaaggcctgtgcggaagaaacgccgctccctgccaccagggctgaagatgcgagcccgtcctcatgacgcaggcgccaccctgctgccggagccgggcttcggcagtcttctccactgagggactgggctgggaagtcctgcgtttcagtggagcgtatgagcgtcaagtcctgctttctcagtagccccattgcggggccccaccattcatcctgtctgaaggtcctgggtttggtgtgaccgcttggcggctggtgggtggggttttcaagtgggtgacggcgctctccggcagccggggatggccgtgtccgcactgaccaggcctgtggagagtgctcggcctaaccttagaacacatttgtaactgaatacagtgttttcaatttgtacagaatagttagaatattctattaaagtggtgaaacattga

SEQ ID NO: 445800 - DNA, 1837 bp, Homo sapiens
ggcacgagcttgctcgcggagagaggagctaggagcctcggccaatgggagccggcgttgttggaggccacggcggcgcagccccaaagcgagcgaagctagggtcgccgccactgccgcaggaggcgtgaggggataaaaacattcagatggcagatcacagtttttcagatggggttccttcagattccgtggaagctgctaaaaatgcaagtaacacagaaaagctcacagatcaggtgatgcagaatcctcgagttctggcagctttacaggagcgacttgacaatgtccctcacaccccttccagctacatcgaaactttacctaaagcagtaaaaagaagaattaatgcattgaaacaacttcaggtgagatgtgctcacatagaagccaagttctatgaagaggtacatgacttggaaagaaagtatgcagcgctataccagcctctctttgacaagagaagagaatttatcaccggcgatgttgaaccaacagatgcggaatcggaatggcacagtgaaaatgaagaggaagagaaattggctggagacatgaaaagtaaagtagtcgtcacagaaaaagcagcggcaacggctgaagagccagatcccaaaggaattccagagttctggtttaccatcttcagaaatgtggacatgctgagtgaattagtccaggaatatgatgaaccaatcttgaaacacctgcaggatattaaagtgaaattttctgaccctggacagcctatgtcttttgtgttagagttccactttgaacccaacgactactttaccaactcagtcctgacaaaaacctacaagatgaaatcagaaccagataaggctgatcccttttcctttgaaggtcctgagattgtggactgtgacgggtgtactattgactggaagaaaggaaagaatgttactgtcaaaaccatcaagaaaaagcagaagcataagggtcgaggcactgttagaacaattacgaaacaagtacccaatgagtcctttttcaacttcttcaatccattgaaagcatccggggatggagaatcactggatgaagattctgaattcacattagcctctgattttgaaattggacactttttccgtgagcggatagtcccgcgggctgtgctgtacttcactggggaggccatagaagatgatgacaatgtatgaggctcggggaaggggggcttccacctgggtgcttatctctgttggtgcagagtggccctgaattgtggcttaggaaacccccatgcctaatctttttattacatcatcagccagatatgtagtccaagctgctgtccttgttgtggggggaatacgcttgaagaggagaagtctgaggaacagagcaggaaaagcaggtgtctgtgaagcagtttcagaggtgattgccagtttcctatgtgagccctgcctagtgactcaacaatattctctcaaaacctaagcttcagggaacttgtgaacacagggaatatctcttttatggaggtctggccacaacaaacatttattgacagtggacttatgctagcctgtggttcatcaacccaaaagaaatagaaattcctgaacttctatctaattaggtaaaaaggaaaaaaaagaaacccgtgctcccgaagaaaacaacaagattgcatgtcactttcctttctgggcttgagggaagccagctcttccacagtcagaacttgcgggtgcacagcccaagtaccgcttagaaactcccatcctcaccaaggctcaagcagcttcaagtcttcttgatctgtggaaaataaagttttgttttatagactgtactggaa

SEQ ID NO: 445801 - DNA, 1751 bp, Homo sapiens
  misc_feature (1524)..(1524): n is a, c, g, or t
  misc_feature (1556)..(1556): n is a, c, g, or t
  misc_feature (1572)..(1573): n is a, c, g, or t
  misc_feature (1585)..(1585): n is a, c, g, or t
  misc_feature (1588)..(1588): n is a, c, g, or t
  misc_feature (1590)..(1590): n is a, c, g, or t
  misc_feature (1609)..(1609): n is a, c, g, or t
  misc_feature (1620)..(1620): n is a, c, g, or t
ggcacgagcttgctcgcggagagaggagctaggagcctcggccaatgggagccggcgttgttggaggccacggcggcgcagccccaaagcgagcgaagctagggtcgccgccactgccgcaggaggcgtgaggggataaaaacattcagatggcagatcacagtttttcagatggggttccttcagattccgtggaagctgctaaaaatgcaagtaacacagaaaagctcacagatcaggtgatgcagaatcctcgagttctggcagctttacaggagcgacttgacaatgtccctcacaccccttccagctacatcgaaactttacctaaagcagtaaaaagaagaattaatgcattgaaacaacttcaggtgagatgtgctcacatagaagccaagttctatgaagaggtacatgacttggaaagaaagtatgcagcgctataccagcctctctttgacaagagaagagaatttatcaccggcgatgttgaaccaacagatgcggaatcggaatggcacagtgaaaatgaagaggaagagaaattggctggagacatgaaaagtaaagtagtcgtcacagaaaaagcagcggcaacggctgaagagccagatcccaaaggaattccagagttctggtttaccatcttcagaaatgtggacatgctgagtgaattagtccaggaatatgatgaaccaatcttgaaacacctgcaggatattaaagtgaaattttctgaccctggacagcctatgtcttttgtgttagagttccactttgaacccaacgactactttaccaactcagtcctgacaaaaacctacaagatgaaatcagaaccagataaggctgatcccttttcctttgaaggtcctgagattgtggactgtgacgggtgtactattgactggaagaaaggaaagaatgttactgtcaaaaccatcaagaaaaagcagaagcataagggtcgaggcactgttagaacaattacgaaacaagtacccaatgagtcctttttcaacttcttcaatccattgaaagcatccggggatggagaatcactgtttacctaaagcagtaaaaagaagaattaatgcattgaaacaacttcaggtgagatgtgctcacatagaagccaagttctatgaagaggtacatgacttggaaagaaagtatgctgtgccattccgattccgcatctgttggttcaacatcgccggtgataaattctcttctcgtgccgaattcggcacgaggggcagtgggacagggcatggccaggtggccactccagacccctggcttttcactgctggctgccttagaacctttcttacattagcagtttgctttgtatgcactttgtttttttctttgggtcttgttttttttttccacttagaaattgcatttcctgacagaaggactcaggttgtctgaagtcactgcacagtgcatctcagcccacatagtgatggttcccctgttcactctacttagcatgtccctaccgagtctcttctncactggatggaggaaaaccaagccgtggcttnccgtcagccctccctnnccctccctcaancantncccatggaaatgtcaacangtatgaataangacacctactgagaaaaaaaaaaaaacatttataaataaaaaaaaaaaacttcgggtggggcccggacccaattggcccatagtgaggcgattacaattcactgcccggggtttacaaccgtcggactggg

SEQ ID NO: 445802 - DNA, 1127 bp, Homo sapiens
  misc_feature (1093)..(1093): n is a, c, g, or t
  misc_feature (1124)..(1124): n is a, c, g, or t
ggcacgagcttgctcgcggagagaggagctaggagcctcggccaatgggagccggcgttgttggaggccacggcggcgcagccccaaagcgagcgaagctagggtcgccgccactgccgcaggaggcgtgaggggataaaaacattcagatggcagatcacagtttttcagatggggttccttcagattccgtggaagctgctaaaaatgcaagtaacacagaaaagctcacagatcaggtgatgcagaatcctcgagttctggcagctttacaggagcgacttgacaatgtccctcacaccccttccagctacatcgaaactttacctaaagcagtaaaaagaagaattaatgcattgaaacaacttcaggtgagatgtgctcacatagaagccaagttctatgaagaggtacatgacttggaaagaaagtatgcagcgctataccagcctctctttgacaagagaagagaatttatcaccggcgatgttgaaccaacagatgcggaatcggaatggcacagtgaaaatgaagaggaagagaaattggctggagacatgaaaagtaaagtagtcgtcacagaaaaagcagcggcaacggctgaagagccagatcccaaaggaattccagagttctggtttaccatcttcagaaatgtggacatgctgagtgaattagtccaggaatatgatgaaccaatcttgaaacacctgcaggatattaaagtgaaattttctgaccctggacagcctatgtcttttgtgttagagttccactttgaacccaacgactactttaccaactcagtcctgacaaaaacctacaagatgaaatcagaaccagataaggctgatcccttttcctttgaaggtcctgagattgtggactgtgacgggtgtactattgactggaagaaaggaaagaatgttactgtcaaaaccatcaagaaaaagcagaagcataagggtcgaggcactgttagaacaattacgaaacaagtacccaatgagtcctttttcaacttcttcaatccattgaaagcatccggggatggagaatcactgggatgaagatccgaattcacatttagccncggaattttttttggggaaaaaaaaattttnttg

SEQ ID NO: 445803 - DNA, 1440 bp, Homo sapiens
ggcacgagcttgctcgcggagagaggagctaggagcctcggccaatgggagccggcgttgttggaggccacggcggcgcagccccaaagcgagcgaagctagggtcgccgccactgccgcaggaggcgtgaggggataaaaacattcagatggcagatcacagtttttcagatggggttccttcagattccgtggaagctgctaaaaatgcaagtaacacagaaaagctcacagatcaggtgatgcagaatcctcgagttctggcagctttacaggagcgacttgacaatgtccctcacaccccttccagctacatcgaaactttacctaaagcagtaaaaagaagaattaatgcattgaaacaacttcaggtgagatgtgctcacatagaagccaagttctatgaagaggtacatgacttggaaagaaagtatgcagcgctataccagcctctctttgacaagagaagagaatttatcaccggcgatgttgaaccaacagatgcggaatcggaatggcacagtgaaaatgaagaggaagagaaattggctggagacatgaaaagtaaagtagtcgtcacagaaaaagcagcggcaacggctgaagagccagatcccaaaggaattccagagttctggtttaccatcttcagaaatgtggacatgctgagtgaattagtccaggaatatgatgaaccaatcttgaaacacctgcaggatattaaagtgaaattttctgaccctggacagcctatgtcttttgtgttagagttccactttgaacccaacgactactttaccaactcagtcctgacaaaaacctacaagatgaaatcagaaccagataaggctgatcccttttcctttgaaggtcctgagattgtggactgtgacgggtgtactattgactggaagaaaggaaagaatgttactgtcaaaaccatcaagaaaaagcagaagcataagggtcgaggcactgttagaacaattacgaaacaagtacccaatgagtcctttttcaacttcttcaatccattgaaagcatccggggatggagaatcactggtaagatttgttgttaatagtcttattttcctgttgaagtctctcctgagtgaatgtctacttgtctacttgttaaaaaaagtccagtcctggctgtgtgtggactgggtatgccagtgatcttaatgctttgggaggctgaggtgggaggactgcacgagtccaggagtttgagaccagcctgggcaacatagcacaaccccatctccacaaaaaattaaaaccaaataaattagccagccgaacatggtggttcacgcccgtaataccagcactgtgggaggccaaggtgggtggatcaccagaggtcaggagttcaagaccagtctggtcaacatggtgaaaccccgtttctgcttaaaataccaaaaaaaaa

SEQ ID NO: 445804 - DNA, 366 bp, Homo sapiens
tttttttcaatcctcaaaccgtttattgacagcacaaggctcaacagcaggtgagccacgtgagggtggcgagcgcttgcgaggcagtgtgggcaccaggcaggggatcccggagggaagccctctgccagggacatggtgagggcgtggccatcacccacgaagggagcataaataacactggctggtgggtggggttttcaagtgggtgacggcgctctccggcagccggggatggccgtgtccgcactgaccaggcctgtggagagtgctcggcctaaccttagaacacatttgtaactgaatacagtgttttcaatttgtacagaatagttagaatattctattaaagtggtgaaacattga

SEQ ID NO: 445805 - DNA, 667 bp, Homo sapiens
attgatcactttaaagattaaacaccaaagttttaatatatttctactaaggtttcttttccctttgtatgagatgtaaaatgatacccagattcctgtatccaataacattatgctgctggttcgatcagccttgtagaaaatttaaggaaaacaaattcatcggtttacaaaaatcttttcctgtgtgcctgctcctcggtgtgagaacagccagggcagagctgtggtgccaggttcccagctgtgtccagggtacaccctggctgaccagcttcctatcctattccttgttttgtgtgactttcaatttcctggcatgcttttaaaatgcgctgcacacaagcaaatggctcctcaggcaagcgaggcccagcaggcagcgtggctggactttctgctcctcttaggcttggtcagtgagtcacttgatgggactggtgtcttgggcaggctgctgtcatgttttgtaaacctaaaaatgtttttctgtgtttctccagtttgaagaaggtgaagaaggagaagaggaggtaagagacaggtttatgcagtgccacttacctccctgaagttgtttctttggctttctctgcttgaaggttatggactcacagggctgtgttaaacccattttttgtgacgctgtctttgattctaagaatgt

SEQ ID NO: 445806 - DNA, 192 bp, Homo sapiens
gttcacaccaccatgcctggctaattttgttttttttgttgtttttgtagagacgaggtttccccatgttgcccaggctggtctgaaactcctgagcttcaggtgatctgtgataggggtaggatttgaaaccaggctgttcagtgtgtgtctgtcttgttctaggcattgagttctgggttggttggttct

SEQ ID NO: 445807 - DNA, 2519 bp, Homo sapiens
ggcacgagcttgctcgcggagagaggagctaggagcctcggccaatgggagccggcgttgttggaggccacggcggcgcagccccaaagcgagcgaagctagggtcgccgccactgccgcaggaggcgtgaggggataaaaacattcagatggcagatcacagtttttcagatggggttccttcagattccgtggaagctgctaaaaatgcaagtaacacagaaaagctcacagatcaggtgatgcagaatcctcgagttctggcagctttacaggagcgacttgacaatgtccctcacaccccttccagctacatcgaaactttacctaaagcagtaaaaagaagaattaatgcattgaaacaacttcaggtgagatgtgctcacatagaagccaagttctatgaagaggtacatgacttggaaagaaagtatgcagcgctataccagcctctctttgacaagagaagagaatttatcaccggcgatgttgaaccaacagatgcggaatcggaatggcacagtgaaaatgaagaggaagagaaattggctggagacatgaaaagtaaagtagtcgtcacagaaaaagcagcggcaacggctgaagagccagatcccaaaggaattccagagttctggtttaccatcttcagaaatgtggacatgctgagtgaattagtccaggaatatgatgaaccaatcttgaaacacctgcaggatattaaagtgaaattttctgaccctggacagcctatgtcttttgtgttagagttccactttgaacccaacgactactttaccaactcagtcctgacaaaaacctacaagatgaaatcagaaccagataaggctgatcccttttcctttgaaggtcctgagattgtggactgtgacgggtgtactattgactggaagaaaggaaagaatgttactgtcaaaaccatcaagaaaaagcagaagcataagggtcgaggcactgttagaacaattacgaaacaagtacccaatgagtcctttttcaacttcttcaatccattgaaagcatccggggatggagaatcactggatgaagattctgaattcacattagcctctgattttgaaattggacactttttccgtgagcggatagtcccgcgggctgtgctgtacttcactggggaggccatagaagatgatgacaattttgaagaaggtgaagaaggagaagaggaggaattagaaggtgacgaggagggagaagacgaggatgatgcggaaattaaccccaaggtgtaatttttgtctgttaatcattcatacgtttctagaaggaacccagccagccggcggaatgcaagcagcagtaggaagcggaggcgggtgcctggcagaccggctgtcgggactccaggcctgtgggcggggcctcggtccttgccgcagcacaatcccgtggacagagcttactccatctaactcgttttcaagtgcatgattttcactttcacttttcctttttccttattattttgcttaacttgtacagtggcaactgaaatgcatttcagaaataggaggtttcgtccagcaccctctgcagccttggtgcctgtagctctggacttccctgggcctttccctgtgggagggccctgtagaccacatcagggtggggtgggggtcacttggcaaaaagggccgaggtctggtgatgtggttcccaggatctggaacctctcccacccctcctgcagttggactgaattcttccctttcatccgaagaaacccacttgctgtttccagccgctgaatctgctgagtgtgcagcctgcatcacctgctgtatgccgatcatctcagaaagggctgtgtagagtagggccctgttctccttaggatgttgcttcttgatttttttttttttttaggggtgggtcagggttgtgacacaccagcccaggtgagagctgctgcgggtcacctcatatttatttatcccttcttgcctgtgaggactgcggcttttcgctgtggctcgtccttaacgtttctgaaccaccttggtgccctgagcaggaagatgtgccacttcctagcaggcgcaaggcctgtgcggaagaaacgccgctccctgccaccagggctgaagatgcgagcccgtcctcatgacgcaggcgccaccctgctgccggagccgggcttcggcagtcttctccactgagggactgggctgggaagtcctgcgtttcagtggagcgtatgagcgtcaagtcctgctttctcagtagccccattgcggggccccaccattcatcctgtctgaaggtcctgggtttggtgtgaccgcttggcggctggtgggtggggttttcaagtgggtgacggcgctctccggcagccggggatggccgtgtccgcactgaccaggcctgtggagagtgctcggcctaaccttagaacacatttgtaactgaatacagtgttttcaatttgtacagaatagttagaatattctattaaagtggtgaaacattga

SEQ ID NO: 445808 - DNA, 878 bp, Homo sapiens
ctgatagaggactcgcaggtaacaacacagcgaaacgaaagatcagagtggtcctttttcaacttcttcaatccattgaaagcatccggggatggagaatcactggatgaagattctgaattcacattagcctctgattttgaaattggacactttttccgtgagcggatagtcccgcgggctgtgctgtacttcactggggaggccatagaagatgatgacaatgtatgaggctcggggaaggggggcttccacctgggtgcttatctctgttggtgcagagtggccctgaattgtggcttaggaaacccccatgcctaatctttttattacatcatcagccagatatgtagtccaagctgctgtccttgttgtggggggaatacgcttgaagaggagaagtctgaggaacagagcaggaaaagcaggtgtctgtgaagcagtttcagaggtgattgccagtttcctatgtgagccctgcctagtgactcaacaatattctctcaaaacctaagcttcagggaacttgtgaacacagggaatatctcttttatggaggtctggccacaacaaacatttattgacagtggacttatgctagcctgtggttcatcaacccaaaagaaatagaaattcctgaacttctatctaattaggtaaaaaggaaaaaaaagaaacccgtgctcccgaagaaaacaacaagattgcatgtcactttcctttctgggcttgagggaagccagctcttccacagtcagaacttgcgggtgcacagcccaagtaccgcttagaaactcccatcctcaccaaggctcaagcagcttcaagtcttcttgatctgtggaaaataaagttttgttttatagactgtactggaa

SEQ ID NO: 445809 - DNA, 2663 bp, Homo sapiens
ttctggtcggggcaggcagcggcggccgcggcggggcctggggcttgggccctggagcccgggcctggggcgctggcgggaggcccctcccaactcccggcgcgcctcgcccggctgcccgcctcactgaaggtcaaggcgctttgttctgcgccgcgggcggcctcctgggcggcggccccttggaggaggcgaagacggcgagaggcgtgcggccgctcaaatctcccgctagcccagcccgccccgcgtgcgggggctgtggcggttacacggccgggcgcgccggagcgttcaggcttcccgtttttaaggggataaaaacattcagatggcagatcacagtttttcagatggggttccttcagattccgtggaagctgctaaaaatgcaagtaacacagaaaagctcacagatcaggtgatgcagaatcctcgagttctggcagctttacaggagcgacttgacaatgtccctcacaccccttccagctacatcgaaactttacctaaagcagtaaaaagaagaattaatgcattgaaacaacttcaggtgagatgtgctcacatagaagccaagttctatgaagaggtacatgacttggaaagaaagtatgcagcgctataccagcctctctttgacaagagaagagaatttatcaccggcgatgttgaaccaacagatgcggaatcggaatggcacagtgaaaatgaagaggaagagaaattggctggagacatgaaaagtaaagtagtcgtcacagaaaaagcagcggcaacggctgaagagccagatcccaaaggaattccagagttctggtttaccatcttcagaaatgtggacatgctgagtgaattagtccaggaatatgatgaaccaatcttgaaacacctgcaggatattaaagtgaaattttctgaccctggacagcctatgtcttttgtgttagagttccactttgaacccaacgactactttaccaactcagtcctgacaaaaacctacaagatgaaatcagaaccagataaggctgatcccttttcctttgaaggtcctgagattgtggactgtgacgggtgtactattgactggaagaaaggaaagaatgttactgtcaaaaccatcaagaaaaagcagaagcataagggtcgaggcactgttagaacaattacgaaacaagtacccaatgagtcctttttcaacttcttcaatccattgaaagcatccggggatggagaatcactggatgaagattctgaattcacattagcctctgattttgaaattggacactttttccgtgagcggatagtcccgcgggctgtgctgtacttcactggggaggccatagaagatgatgacaattttgaagaaggtgaagaaggagaagaggaggaattagaaggtgacgaggagggagaagacgaggatgatgcggaaattaaccccaagaaggaacccagccagccggcggaatgcaagcagcagtaggaagcggaggcgggtgcctggcagaccggctgtcgggactccaggcctgtgggcggggcctcggtccttgccgcagcacaatcccgtggacagagcttactccatctaactcgttttcaagtgcatgattttcactttcacttttcctttttccttattattttgcttaacttgtacagtggcaactgaaatgcatttcagaaataggaggtttcgtccagcaccctctgcagccttggtgcctgtagctctggacttccctgggcctttccctgtgggagggccctgtagaccacatcagggtggggtgggggtcacttggcaaaaagggccgaggtctggtgatgtggttcccaggatctggaacctctcccacccctcctgcagttggactgaattcttccctttcatccgaagaaacccacttgctgtttccagccgctgaatctgctgagtgtgcagcctgcatcacctgctgtatgccgatcatctcagaaagggctgtgtagagtagggccctgttctccttaggatgttgcttcttgatttttttttttttttaggggtgggtcagggttgtgacacaccagcccaggtgagagctgctgcgggtcacctcatatttatttatcccttcttgcctgtgaggactgcggcttttcgctgtggctcgtccttaacgtttctgaaccaccttggtgccctgagcaggaagatgtgccacttcctagcaggcgcaaggcctgtgcggaagaaacgccgctccctgccaccagggctgaagatgcgagcccgtcctcatgacgcaggcgccaccctgctgccggagccgggcttcggcagtcttctccactgagggactgggctgggaagtcctgcgtttcagtggagcgtatgagcgtcaagtcctgctttctcagtagccccattgcggggccccaccattcatcctgtctgaaggtcctgggtttggtgtgaccgcttggcggctggtgggtggggttttcaagtgggtgacggcgctctccggcagccggggatggccgtgtccgcactgaccaggcctgtggagagtgctcggcctaaccttagaacacatttgtaactgaatacagtgttttcaatttgtacagaatagttagaatattctattaaagtggtgaaacattga

SEQ ID NO: 445810 - DNA, 2692 bp, Homo sapiens
ggcacgagcttgctcgcggagagaggagctaggagcctcggccaatgggagccggcgttgttggaggccacggcggcgcagccccaaagcgagcgaagctagggtcgccgccactgccgcaggaggcgtgagggaaaagtgttttaggcttccagagtagaaatctgatattacttcgtttgattcttcgaccactatggtgataggaagtagctgatctctgcaggaaactgctgttacctggcctcagctgaatttttgtgggacctcctgagagacgaggtttccccatgttgcccaggctggtctgaaactcctgagcttcaggtgatctgtgataggggggataaaaacattcagatggcagatcacagtttttcagatggggttccttcagattccgtggaagctgctaaaaatgcaagtaacacagaaaagctcacagatcaggtgatgcagaatcctcgagttctggcagctttacaggagcgacttgacaatgtccctcacaccccttccagctacatcgaaactttacctaaagcagtaaaaagaagaattaatgcattgaaacaacttcaggtgagatgtgctcacatagaagccaagttctatgaagaggtacatgacttggaaagaaagtatgcagcgctataccagcctctctttgacaagagaagagaatttatcaccggcgatgttgaaccaacagatgcggaatcggaatggcacagtgaaaatgaagaggaagagaaattggctggagacatgaaaagtaaagtagtcgtcacagaaaaagcagcggcaacggctgaagagccagatcccaaaggaattccagagttctggtttaccatcttcagaaatgtggacatgctgagtgaattagtccaggaatatgatgaaccaatcttgaaacacctgcaggatattaaagtgaaattttctgaccctggacagcctatgtcttttgtgttagagttccactttgaacccaacgactactttaccaactcagtcctgacaaaaacctacaagatgaaatcagaaccagataaggctgatcccttttcctttgaaggtcctgagattgtggactgtgacgggtgtactattgactggaagaaaggaaagaatgttactgtcaaaaccatcaagaaaaagcagaagcataagggtcgaggcactgttagaacaattacgaaacaagtacccaatgagtcctttttcaacttcttcaatccattgaaagcatccggggatggagaatcactggatgaagattctgaattcacattagcctctgattttgaaattggacactttttccgtgagcggatagtcccgcgggctgtgctgtacttcactggggaggccatagaagatgatgacaattttgaagaaggtgaagaaggagaagaggaggaattagaaggtgacgaggagggagaagacgaggatgatgcggaaattaaccccaagaaggaacccagccagccggcggaatgcaagcagcagtaggaagcggaggcgggtgcctggcagaccggctgtcgggactccaggcctgtgggcggggcctcggtccttgccgcagcacaatcccgtggacagagcttactccatctaactcgttttcaagtgcatgattttcactttcacttttcctttttccttattattttgcttaacttgtacagtggcaactgaaatgcatttcagaaataggaggtttcgtccagcaccctctgcagccttggtgcctgtagctctggacttccctgggcctttccctgtgggagggccctgtagaccacatcagggtggggtgggggtcacttggcaaaaagggccgaggtctggtgatgtggttcccaggatctggaacctctcccacccctcctgcagttggactgaattcttccctttcatccgaagaaacccacttgctgtttccagccgctgaatctgctgagtgtgcagcctgcatcacctgctgtatgccgatcatctcagaaagggctgtgtagagtagggccctgttctccttaggatgttgcttcttgatttttttttttttttaggggtgggtcagggttgtgacacaccagcccaggtgagagctgctgcgggtcacctcatatttatttatcccttcttgcctgtgaggactgcggcttttcgctgtggctcgtccttaacgtttctgaaccaccttggtgccctgagcaggaagatgtgccacttcctagcaggcgcaaggcctgtgcggaagaaacgccgctccctgccaccagggctgaagatgcgagcccgtcctcatgacgcaggcgccaccctgctgccggagccgggcttcggcagtcttctccactgagggactgggctgggaagtcctgcgtttcagtggagcgtatgagcgtcaagtcctgctttctcagtagccccattgcggggccccaccattcatcctgtctgaaggtcctgggtttggtgtgaccgcttggcggctggtgggtggggttttcaagtgggtgacggcgctctccggcagccggggatggccgtgtccgcactgaccaggcctgtggagagtgctcggcctaaccttagaacacatttgtaactgaatacagtgttttcaatttgtacagaatagttagaatattctattaaagtggtgaaacattga

SEQ ID NO: 445811 - DNA, 2567 bp, Homo sapiens
ggcacgagcttgctcgcggagagaggagctaggagcctcggccaatgggagccggcgttgttggaggccacggcggcgcagccccaaagcgagcgaagctagggtcgccgccactgccgcaggaggcgtgaggggataaaaacattcagatggcagatcacagtttttcagatggggttccttcagattccgtggaagctgctaaaaatgcaagtaacacagaaaagctcacagatcaggtgatgcagaatcctcgagttctggcagctttacaggagcgacttgacaatgtccctcacaccccttccagctacatcgaaactttacctaaagcagtaaaaagaagaattaatgcattgaaacaacttcaggtgagatgtgctcacatagaagccaagttctatgaagaggtacatgacttggaaagaaagtatgcagcgctataccagcctctctttgacaagagaagagaatttatcaccggcgatgttgaaccaacagatgcggaatcggaatggcacagtgaaaatgaagaggaagagaaattggctggagacatgaaaagtaaagtagtcgtcacagaaaaagcagcggcaacggctgaagagccagatcccaaaggaattccagagttctggtttaccatcttcagaaatgtggacatgctgagtgaattagtccaggaatatgatgaaccaatcttgaaacacctgcaggatattaaagtgaaattttctgaccctggacagcctatgtcttttgtgttagagttccactttgaacccaacgactactttaccaactcagtcctgacaaaaacctacaagatgaaatcagaaccagataaggctgatcccttttcctttgaaggtcctgagattgtggactgtgacgggtgtactattgactggaagaaaggaaagaatgttactgtcaaaaccatcaagaaaaagcagaagcataagggtcgaggcactgttagaacaattacgaaacaagtacccaatgagtcctttttcaacttcttcaatccattgaaagcatccggggatggagaatcactggatgaagattctgaattcacattagcctctgattttgaaattggacactttttccgtgagcggatagtcccgcgggctgtgctgtacttcactggggaggccatagaagatgatgacaattttgaagaaggtgaagaaggagaagaggaggaattagaaggtgacgaggagggagaagacgaggatgatgcggaaattaaccccaagactcctcagtagagcaacttgactttccaagtgtttcattcttttaaggtgtaatttttgtctgttaatcattcatacgtttctagaaggaacccagccagccggcggaatgcaagcagcagtaggaagcggaggcgggtgcctggcagaccggctgtcgggactccaggcctgtgggcggggcctcggtccttgccgcagcacaatcccgtggacagagcttactccatctaactcgttttcaagtgcatgattttcactttcacttttcctttttccttattattttgcttaacttgtacagtggcaactgaaatgcatttcagaaataggaggtttcgtccagcaccctctgcagccttggtgcctgtagctctggacttccctgggcctttccctgtgggagggccctgtagaccacatcagggtggggtgggggtcacttggcaaaaagggccgaggtctggtgatgtggttcccaggatctggaacctctcccacccctcctgcagttggactgaattcttccctttcatccgaagaaacccacttgctgtttccagccgctgaatctgctgagtgtgcagcctgcatcacctgctgtatgccgatcatctcagaaagggctgtgtagagtagggccctgttctccttaggatgttgcttcttgatttttttttttttttaggggtgggtcagggttgtgacacaccagcccaggtgagagctgctgcgggtcacctcatatttatttatcccttcttgcctgtgaggactgcggcttttcgctgtggctcgtccttaacgtttctgaaccaccttggtgccctgagcaggaagatgtgccacttcctagcaggcgcaaggcctgtgcggaagaaacgccgctccctgccaccagggctgaagatgcgagcccgtcctcatgacgcaggcgccaccctgctgccggagccgggcttcggcagtcttctccactgagggactgggctgggaagtcctgcgtttcagtggagcgtatgagcgtcaagtcctgctttctcagtagccccattgcggggccccaccattcatcctgtctgaaggtcctgggtttggtgtgaccgcttggcggctggtgggtggggttttcaagtgggtgacggcgctctccggcagccggggatggccgtgtccgcactgaccaggcctgtggagagtgctcggcctaaccttagaacacatttgtaactgaatacagtgttttcaatttgtacagaatagttagaatattctattaaagtggtgaaacattga

SEQ ID NO: 445812 - DNA, 2660 bp, Homo sapiens
ggcacgagcttgctcgcggagagaggagctaggagcctcggccaatgggagccggcgttgttggaggccacggcggcgcagccccaaagcgagcgaagctagggtcgccgccactgccgcaggaggcgtgagggaaaagtgttttaggcttccagagtagaaatctgatattacttcgtttgattcttcgaccactatggtgataggaagtagctgatctctgcaggaaactgctgttacctggcctcagctgaatttttgtgggacctcctgaggggataaaaacattcagatggcagatcacagtttttcagatggggttccttcagattccgtggaagctgctaaaaatgcaagtaacacagaaaagctcacagatcaggtgatgcagaatcctcgagttctggcagctttacaggagcgacttgacaatgtccctcacaccccttccagctacatcgaaacgcatgaggatgttgtatttcttactcccttttttagtttacctaaagcagtaaaaagaagaattaatgcattgaaacaacttcaggtgagatgtgctcacatagaagccaagttctatgaagaggtacatgacttggaaagaaagtatgcagcgctataccagcctctctttgacaagagaagagaatttatcaccggcgatgttgaaccaacagatgcggaatcggaatggcacagtgaaaatgaagaggaagagaaattggctggagacatgaaaagtaaagtagtcgtcacagaaaaagcagcggcaacggctgaagagccagatcccaaaggaattccagagttctggtttaccatcttcagaaatgtggacatgctgagtgaattagtccaggaatatgatgaaccaatcttgaaacacctgcaggatattaaagtgaaattttctgaccctggacagcctatgtcttttgtgttagagttccactttgaacccaacgactactttaccaactcagtcctgacaaaaacctacaagatgaaatcagaaccagataaggctgatcccttttcctttgaaggtcctgagattgtggactgtgacgggtgtactattgactggaagaaaggaaagaatgttactgtcaaaaccatcaagaaaaagcagaagcataagggtcgaggcactgttagaacaattacgaaacaagtacccaatgagtcctttttcaacttcttcaatccattgaaagcatccggggatggagaatcactggatgaagattctgaattcacattagcctctgattttgaaattggacactttttccgtgagcggatagtcccgcgggctgtgctgtacttcactggggaggccatagaagatgatgacaattttgaagaaggtgaagaaggagaagaggaggaattagaaggtgacgaggagggagaagacgaggatgatgcggaaattaaccccaagaaggaacccagccagccggcggaatgcaagcagcagtaggaagcggaggcgggtgcctggcagaccggctgtcgggactccaggcctgtgggcggggcctcggtccttgccgcagcacaatcccgtggacagagcttactccatctaactcgttttcaagtgcatgattttcactttcacttttcctttttccttattattttgcttaacttgtacagtggcaactgaaatgcatttcagaaataggaggtttcgtccagcaccctctgcagccttggtgcctgtagctctggacttccctgggcctttccctgtgggagggccctgtagaccacatcagggtggggtgggggtcacttggcaaaaagggccgaggtctggtgatgtggttcccaggatctggaacctctcccacccctcctgcagttggactgaattcttccctttcatccgaagaaacccacttgctgtttccagccgctgaatctgctgagtgtgcagcctgcatcacctgctgtatgccgatcatctcagaaagggctgtgtagagtagggccctgttctccttaggatgttgcttcttgatttttttttttttttaggggtgggtcagggttgtgacacaccagcccaggtgagagctgctgcgggtcacctcatatttatttatcccttcttgcctgtgaggactgcggcttttcgctgtggctcgtccttaacgtttctgaaccaccttggtgccctgagcaggaagatgtgccacttcctagcaggcgcaaggcctgtgcggaagaaacgccgctccctgccaccagggctgaagatgcgagcccgtcctcatgacgcaggcgccaccctgctgccggagccgggcttcggcagtcttctccactgagggactgggctgggaagtcctgcgtttcagtggagcgtatgagcgtcaagtcctgctttctcagtagccccattgcggggccccaccattcatcctgtctgaaggtcctgggtttggtgtgaccgcttggcggctggtgggtggggttttcaagtgggtgacggcgctctccggcagccggggatggccgtgtccgcactgaccaggcctgtggagagtgctcggcctaaccttagaacacatttgtaactgaatacagtgttttcaatttgtacagaatagttagaatattctattaaagtggtgaaacattga

SEQ ID NO: 445813 - DNA, 1522 bp, Homo sapiens
ctgatagaggactcgcaggtaacaacacagcgaaacgaaagatcagagtggtcctttttcaacttcttcaatccattgaaagcatccggggatggagaatcactggatgaagattctgaattcacattagcctctgattttgaaattggacactttttccgtgagcggatagtcccgcgggctgtgctgtacttcactggggaggccatagaagatgatgacaattttgaagaaggtgaagaaggagaagaggaggaattagaaggtgacgaggagggagaagacgaggatgatgcggaaattaaccccaagaaggaacccagccagccggcggaatgcaagcagcagtaggaagcggaggcgggtgcctggcagaccggctgtcgggactccaggcctgtgggcggggcctcggtccttgccgcagcacaatcccgtggacagagcttactccatctaactcgttttcaagtgcatgattttcactttcacttttcctttttccttattattttgcttaacttgtacagtggcaactgaaatgcatttcagaaataggaggtttcgtccagcaccctctgcagccttggtgcctgtagctctggacttccctgggcctttccctgtgggagggccctgtagaccacatcagggtggggtgggggtcacttggcaaaaagggccgaggtctggtgatgtggttcccaggatctggaacctctcccacccctcctgcagttggactgaattcttccctttcatccgaagaaacccacttgctgtttccagccgctgaatctgctgagtgtgcagcctgcatcacctgctgtatgccgatcatctcagaaagggctgtgtagagtagggccctgttctccttaggatgttgcttcttgatttttttttttttttaggggtgggtcagggttgtgacacaccagcccaggtgagagctgctgcgggtcacctcatatttatttatcccttcttgcctgtgaggactgcggcttttcgctgtggctcgtccttaacgtttctgaaccaccttggtgccctgagcaggaagatgtgccacttcctagcaggcgcaaggcctgtgcggaagaaacgccgctccctgccaccagggctgaagatgcgagcccgtcctcatgacgcaggcgccaccctgctgccggagccgggcttcggcagtcttctccactgagggactgggctgggaagtcctgcgtttcagtggagcgtatgagcgtcaagtcctgctttctcagtagccccattgcggggccccaccattcatcctgtctgaaggtcctgggtttggtgtgaccgcttggcggctggtgggtggggttttcaagtgggtgacggcgctctccggcagccggggatggccgtgtccgcactgaccaggcctgtggagagtgctcggcctaaccttagaacacatttgtaactgaatacagtgttttcaatttgtacagaatagttagaatattctattaaagtggtgaaacattga

SEQ ID NO: 445814 - DNA, 1522 bp, Homo sapiens
tgtatttcctccactggaataggcgtccgggggcatggagaatcactggatgatcatcttgatttcgacgactgcaggcacgtctgatttagaccagtcgggacagcgttctcacccggaagtgaatacgtcccagcctagctggtcggctgtattctccgcgtgggggcagtgccgactacgagacatgagtgtacgaaattgtcgaacaacagtgaagaatgagaactaggaggaatttacgtccccgtgactcaggtatgggacaatgacagtaagatgattgcaggagataattatagcgcgcaaggaatggatgccaaccaagcgttggaatgcaagcagcagtaggaagcggaggcgggtgcctggcagaccggctgtcgggactccaggcctgtgggcggggcctcggtccttgccgcagcacaatcccgtggacagagcttactccatctaactcgttttcaagtgcatgattttcactttcacttttcctttttccttattattttgcttaacttgtacagtggcaactgaaatgcatttcagaaataggaggtttcgtccagcaccctctgcagccttggtgcctgtagctctggacttccctgggcctttccctgtgggagggccctgtagaccacatcagggtggggtgggggtcacttggcaaaaagggccgaggtctggtgatgtggttcccaggatctggaacctctcccacccctcctgcagttggactgaattcttccctttcatccgaagaaacccacttgctgtttccagccgctgaatctgctgagtgtgcagcctgcatcacctgctgtatgccgatcatctcagaaagggctgtgtagagtagggccctgttctccttaggatgttgcttcttgatttttttttttttttaggggtgggtcagggttgtgacacaccagcccaggtgagagctgctgcgggtcacctcatatttatttatcccttcttgcctgtgaggactgcggcttttcgctgtggctcgtccttaacgtttctgaaccaccttggtgccctgagcaggaagatgtgccacttcctagcaggcgcaaggcctgtgcggaagaaacgccgctccctgccaccagggctgaagatgcgagcccgtcctcatgacgcaggcgccaccctgctgccggagccgggcttcggcagtcttctccactgagggactgggctgggaagtcctgcgtttcagtggagcgtatgagcgtcaagtcctgctttctcagtagccccattgcggggccccaccattcatcctgtctgaaggtcctgggtttggtgtgaccgcttggcggctggtgggtggggttttcaagtgggtgacggcgctctccggcagccggggatggccgtgtccgcactgaccaggcctgtggagagtgctcggcctaaccttagaacacatttgtaactgaatacagtgttttcaatttgtacagaatagttagaatattctattaaagtggtgaaacattga

SEQ ID NO: 445815 - DNA, 1239 bp, Homo sapiens
ggcacgagcttgctcgcggagagaggagctaggagcctcggccaatgggagccggcgttgttggaggccacggcggcgcagccccaaagcgagcgaagctagggtcgccgccactgccgcaggaggcgtgaggggataaaaacattcagatggcagatcacagtttttcagatggggttccttcagattccgtggaagctgctaaaaatgcaagtaacacagaaaagctcacagatcaggtgatgcagaatcctcgagttctggcagctttacaggagcgacttgacaatgtccctcacaccccttccagctacatcgaaactttacctaaagcagtaaaaagaagaattaatgcattgaaacaacttcaggtgagatgtgctcacatagaagccaagttctatgaagaggtacatgacttggaaagaaagtatgcagcgctataccagcctctctttgacaagagaagagaatttatcaccggcgatgttgaaccaacagatgcggaatcggaatggcacagtgaaaatgaagaggaagagaaattggctggagacatgaaaagtaaagtagtcgtcacagaaaaagcagcggcaacggctgaagagccagatcccaaaggaattccagagttctggtttaccatcttcagaaatgtggacatgctgagtgaattagtccaggaatatgatgaaccaatcttgaaacacctgcaggatattaaagtgaaattttctgaccctggacagcctatgtcttttgtgttagagttccactttgaacccaacgactactttaccaactcagtcctgacaaaaacctacaagatgaaatcagaaccagataaggctgatcccttttcctttgaaggtcctgagattgtggactgtgacgggtgtactattgactggaagaaaggaaagaatgttactgtcaaaaccatcaagaaaaagcagaagcataagggtcgaggcactgttagaacaattacgaaacaagtacccaatgagtcctttttcaacttcttcaatccattgaaagcatccggggatggagaatcactggatgaagattctgaattcacattagcctctgattttgaaattggacactttttccgtgagcggatagtcccgcgggctgtgctgtacttcactggggaggccatagaagatgatgacaattttgaagaaggtgatagtgttcaaagcaagcccgagccgcctggatgaccgctag

SEQ ID NO: 445816 - DNA, 1099 bp, Homo sapiens
ggcacgagcttgctcgcggagagaggagctaggagcctcggccaatgggagccggcgttgttggaggccacggcggcgcagccccaaagcgagcgaagctagggtcgccgccactgccgcaggaggcgtgaggggataaaaacattcagatggcagatcacagtttttcagatggggttccttcagattccgtggaagctgctaaaaatgcaagtaacacagaaaagctcacagatcaggtgatgcagaatcctcgagttctggcagctttacaggagcgacttgacaatgtccctcacaccccttccagctacatcgaaactttacctaaagcagtaaaaagaagaattaatgcattgaaacaacttcaggtgagatgtgctcacatagaagccaagttctatgaagaggtacatgacttggaaagaaagtatgcagcgctataccagcctctctttgacaagagaagagaatttatcaccggcgatgttgaaccaacagatgcggaatcggaatggcacagtgaaaatgaagaggaagagaaattggctggagacatgaaaagtaaagtagtcgtcacagaaaaagcagcggcaacggctgaagagccagatcccaaaggaattccagagttctggtttaccatcttcagaaatgtggacatgctgagtgaattagtccaggaatatgatgaaccaatcttgaaacacctgcaggatattaaagtgaaattttctgaccctggacagcctatgtcttttgtgttagagttccactttgaacccaacgactactttaccaactcagtcctgacaaaaacctacaagatgaaatcagaaccagataaggctgatcccttttcctttgaaggtcctgagattgtggactgtgacgggtgtactattgactggaagaaaggaaagaatgttactgtcaaaaccatcaagaaaaagcagaagcataagggtcgaggcactgttagaacaattacgaaacaagtacccaatgagtcctttttcaacttcttcaatccattgaaaggcaagtctgttggttgttaatattcattatgttcttatataaaataattttggtcacc

SEQ ID NO: 445817 - DNA, 1964 bp, Homo sapiens
ggcacgagcttgctcgcggagagaggagctaggagcctcggccaatgggagccggcgttgttggaggccacggcggcgcagccccaaagcgagcgaagctagggtcgccgccactgccgcaggaggcgtgaggggataaaaacattcagatggcagatcacagtttttcagatggggttccttcagattccgtggaagctgctaaaaatgcaagtaacacagaaaagctcacagatcaggtgatgcagaatcctcgagttctggcagctttacaggagcgacttgacaatgtccctcacaccccttccagctacatcgaaactttacctaaagcagtaaaaagaagaattaatgcattgaaacaacttcaggtgagatgtgctcacatagaagccaagttctatgaagaggtacatgacttggaaagaaagtatgcagcgctataccagcctctctttgacaagagaagagaatttatcaccggcgatgttgaaccaacagatgcggaatcggaatggcacagtgaaaatgaagaggaagagaaattggctggagacatgaaaagtaaagtagtcgtcacagaaaaagcagcggcaacggctgaagagccagatcccaaaggaattccagagttctggtttaccatcttcagaaatgtggacatgctgagtgaattagtccaggaatatgatgaaccaatcttgaaacacctgcaggatattaaagtgaaattttctgaccctggacagcctatgtcttttgtgttagagttccactttgaacccaacgactactttaccaactcagtcctgacaaaaacctacaagatgaaatcagaaccagataaggctgatcccttttcctttgaaggtcctgagattgtggactgtgacggggtgtactattgactggagaaacgcacgaatgttcctgtccaaccatcagaaaagccgaacctatggtccagcctcgtgacactcgcaacagtcccgaggtctcttcatcttaacctgaaacgggggaaacacggcgaaattatcctaccgctgaagaagccccacagaaaccccgacgcatgtggacgcacaaaaaagtaaggagcacactaaatgcgagaatccgaaatgtgatggagtcaaactctaatcgatgactaaagccaaaaacaccaccgacacaacaacaagccaccgctcacacgacagcaacaacccaccaacacacaacacaacgaacaacaacaaacagatgctaacaaccacacccccacacacaccacacaaccagacaaccagaagaacgaaggggagagcacaagggacacggagcagacaaccggcgaggcgcacagcggcggcgcacgaggaagagaaaaagaccagagcagacgacagacacagcaacagcgagcagaaagaaagacgacgaagggaggaaggcagcaccgggaaaaagaagagaggaaggacagaagacagagaagaggagaaaagaggaaggacacgaggggggaagggcagaccaggaaggcgacgcacacaccgaacgagacgcaggtcgcccacgagcaaggagacaccggcagacgaaagggcaggggcaccgacaacaccgcgccgaacgacaacgcaaagccacaacagaagaccgagcgagaccacacaagacaaacacaaccaaggggaggcggcggcaacaaagcagcggggcaaggaggaaaaaaggcgagagagaggcgaacgaagggccagaaggaacagacaagcaaaacgcgcgagaagaacaaagaagagaagaggcacagacacaaggacacacggacgggaggcacgggagcagacgagagagagacacgaaagagcgaaaaagacaacacgagggacagaggaaagcagaaacgagaacaaagcaggacgaggaaagacaacaagaccagggcaaacaaaagagcagagaggacagcc

SEQ ID NO: 445818 - DNA, 1151 bp, Homo sapiens
ggccacaaagcagcccccgagaccacgtggcctccgagcagctcagggcgcccttgaaagttcttggatctgcgggttatggccggtcccttgcagggcggtggggcccgggccctggacctactccggggcctgccgcgtgtgagcctggccaacttaaagccgaatcccggctccaagaaaccggagagaagaccaagaggtcggagaagaggtagaaaatgtggcagaggccataaaggagaaaggcaaagaggaacccggccccgcttgggctttgagggaggccagactccattttacatccgaatcccaaaatacgggtttaacgaaggacatagtttcagacgccagtataagcctttgagtctcaatagactgcagtatcttattgatttgggtcgtgttgatcctagtcaacctattgacttaacccagcttgtcaatgggagaggtgtgaccatccagccacttaaaagggattatggtgtccagctggttgaggagggtgctgacacctttacggcaaaagttaatattgaagtacagttggcttcagaactagctattgctgccattgaaaaaaatggtggtgttgttactacagccttctatgatccaagaagtctggacattgtatgcaaacctgttccattctttcttcgtggacaacccattccaaaaagaatgcttccaccagaagaactggtaccatattacactgatgcaaagaaccgtgggtacctggcggatcctgccaaatttcctgaagcacgacttgaactcgccaggaagtatggttatatcttacctgatatcactaaagatgaactcttcaaaatgctctgtactaggaaggatccaaggcagattttctttggtcttgctccaggatgggtggtgaatatggccgataagaaaatcctaaaacctacagatgaaaatctccttaagtattatacctcatgaattcccgtccaaggaagcagagttgttaaagagtactggaataggggctgaaggatctatattcccttattgcattttccttatgtataattttccagatggtgatgttacttttcagtgtactcatatgtctcattttcatctaaaattaaatggcaggaaacaaggactgcatagagaaa

SEQ ID NO: 445819 - DNA, 1192 bp, Homo sapiens
gaagaaagttagatttacgccgatgaatatgatagtgaaatggattcggacgcgtgggtcgacccacgtggcctccgagcagctcagggcgcccttgaaagttcttggatctgcgggttatggccggtcccttgcagggcggtggggcccgggccctggacctactccggggcctgccgcgtgtgagcctggccaacttaaagccgaatcccggctccaagaaaccggagagaagaccaagaggtcggagaagaggtagaaaatgtggcagaggccataaaggagaaaggcaaagaggaacccggccccgcttgggctttgagggaggccagactccattttacatccgaatcccaaaatacgggtttaacgaaggacatagtttcagacgccagtataagcctttgagtctcaatagactgcagtatcttattgatttgggtcgtgttgatcctagtcaacctattgacttaacccagcttgtcaatgggagaggtgtgaccatccagccacttaaaagggattatggtgtccagctggttgaggagggtgctgacacctttacggcaaaagttaatattgaagtacagttggcttcagaactagctattgctgccattgaaaaaaatggtggtgttgttactacagccttctatgatccaagaagtctggacattgtatgcaaacctgttccattctttcttcgtggacaacccattccaaaaagaatgcttccaccagaagaactggtaccatattacactgatgcaaagaaccgtgggtacctggcggatcctgccaaatttcctgaagcacgacttgaactcgccaggaagtatggttatatcttacctgatatcactaaagatgaactcttcaaaatgctctgtactaggaaggatccaaggcagattttctttggtcttgctccaggatgggtggtgaatatggccgataagaaaatcctaaaacctacagatgaaaatctccttaagtattatacctcatgaattcccgtccaaggaagcagagttgttaaagagtactggaataggggctgaaggatctatattcccttattgcattttccttatgtataattttccagatggtgatgttacttttcagtgtactcatatgtctcattttcatctaaaattaaatggcaggaaacaaggactgcatagagaaa

SEQ ID NO: 445820 - DNA, 877 bp, Homo sapiens
aggtacttacaggatcttacctctacccagatccgaatcttaaatacgggtttaacgaaggacatagtttcagacgccagtataagcctttgagtctcaatagactgcagtatcttattgatttgggtcgtgttgatcctagtcaacctattgacttaacccagcttgtcaatgggagaggtgtgaccatccagccacttaaaagggattatggtgtccagctggttgaggagggtgctgacacctttacggcaaaagttaatattgaagtacagttggcttcagaactagctattgctgccattgaaaaaaatggtggtgttgttactacagccttctatgatccaagaagtctggacattgtatgcaaacctgttccattctttcttcgtggacaacccattccaaaaagaatgcttccaccagaagaactggtaccatattacactgatgcaaagaaccgtgggtacctggcggatcctgccaaatttcctgaagcacgacttgaactcgccaggaagtatggttatatcttacctgatatcactaaagatgaactcttcaaaatgctctgtactaggaaggatccaaggcagattttctttggtcttgctccaggatgggtggtgaatatggccgataagaaaatcctaaaacctacagatgaaaatctccttaagtattatacctcatgaattcccgtccaaggaagcagagttgttaaagagtactggaataggggctgaaggatctatattcccttattgcattttccttatgtataattttccagatggtgatgttacttttcagtgtactcatatgtctcattttcatctaaaattaaatggcaggaaacaaggactgcatagagaaa

SEQ ID NO: 445821 - DNA, 616 bp, Homo sapiens
gaacactgccgcaataaacatacgtgtgcatgtgtctttatagtagaatgatttataatccttgtgtatatacccagtaatgggattgctgggtcaaatggtatttctcattctagagccttgaggaattgccacatgtcttccattgttgtgtcttttaattgggggcatttagcccatttacatttaaggttaatattgttatgtgtgaactggatcctgccaaatttcctgaagcacgacttgaactcgccaggaagtatggttatatcttacctgatatcactaaagatgaactcttcaaaatgctctgtactaggaaggatccaaggcagattttctttggtcttgctccaggatgggtggtgaatatggccgataagaaaatcctaaaacctacagatgaaaatctccttaagtattatacctcatgaattcccgtccaaggaagcagagttgttaaagagtactggaataggggctgaaggatctatattcccttattgcattttccttatgtataattttccagatggtgatgttacttttcagtgtactcatatgtctcattttcatctaaaattaaatggcaggaaacaaggactgcatagagaaa

SEQ ID NO: 445822 - DNA, 746 bp, Homo sapiens
catgaggcagaggttgcagtgagccgagatggtgccattgtactccagtctgggcaacaagagtgaaactgcgtctcaaaaaaaaaataataaaaattaataatcaagagaaactctgtaacatctctatggtacagagttacatctctatgttagagttacatctctaggtatgtctatgagctaatatttgcatctcactttttaaatttaaattttcttttagacattgtatgcaaacctgttccattctttcttcgtggacaacccattccaaaaagaatgcttccaccagaagaactggtaccatattacactgatgcaaagaaccgtgggtacctggcggatcctgccaaatttcctgaagcacgacttgaactcgccaggaagtatggttatatcttacctgatatcactaaagatgaactcttcaaaatgctctgtactaggaaggatccaaggcagattttctttggtcttgctccaggatgggtggtgaatatggccgataagaaaatcctaaaacctacagatgaaaatctccttaagtattatacctcatgaattcccgtccaaggaagcagagttgttaaagagtactggaataggggctgaaggatctatattcccttattgcattttccttatgtataattttccagatggtgatgttacttttcagtgtactcatatgtctcattttcatctaaaattaaatggcaggaaacaaggactgcatagagaaa

SEQ ID NO: 445823 - DNA, 1229 bp, Homo sapiens
ggccacaaagcagcccccgagaccacgtggcctccgagcagctcagggcgcccttgaaagttcttggatctgcgggttatggccggtcccttgcagggcggtggggcccgggccctggacctactccggggcctgccgcgtgtgagcctggccaacttaaagccgaatcccggctccaagaaaccggagagaagaccaagaggtcggagaagaggtagaaaatgtggcagaggccataaaggagaaaggcaaagaggaacccggccccgcttgggctttgagggaggccagactccattttacatccgaatcccaaaatacgggtttaacgaaggacatagtttcagacgccagtataagcctttgagtctcaatagactgcagtatcttattgatttgggtcgtgttgatcctagtcaacctattgacttaacccagcttgtcaatgggagaggtgtgaccatccagccacttaaaagggattatggtgtccagctggttgaggagggtgctgacacctttacggcaaaagttaatattgaagtacagttggcttcagaactagctattgctgccattgaaaaaaatggtggtgttgttactacagccttctatgatccaagaagtctggacattgtatgcaaacctgttccattctttcttcgtggacaacccattccaaaaagaatgcttccaccagaagaactggtaccatattacactgatgcaaagaaccgtgggtacctggcggatcctgccaaatttcctgaagcacgacttgaactcgccaggaagtatggttatatcttacctgatatcactaaagatgaactcttcaaaatgctctgtactaggaaggatccaaggcagattttctttggtcttgctccaggatgggtggtgaatatggccgataagaaaatcctaaaacctacagatgaaaatctccttaagtattatacctcatgaattcccgtccaaggaagcagagttgttaaagagtactggaataggggctgaaggatctatattcccttattgcattttccttatgtataattttccagatggtgatgttacttttcagtgtactcatatgtctcattttcatctaaaattaaatggcaggaaacaaggactgcatagagaaaaaaaaaaaaggggggggaaaaatccggagggccagttaggggacccggtttggaaaggggccaaagggggattaaaga

SEQ ID NO: 445824 - DNA, 1754 bp, Homo sapiens
cggacgcgtgggtcgcccacgcgtccgaaggaataaaaacttggcagagattggcaaacgcaggtcttttatagctgcaccatgccaaataatcaccaacacttctacactgctgaaaaattaccaagacaacaacaaaatgttagttttagctttggaaaatgaaaaatccaaagtgaaagaagcccaagatatcatcctacagctgagaaaagaatgttactatctcacatgtcagctatatgcattgaaaggaaaacttacatcacaacaaacagtagaacctgctcagaaccaggaaatatgttcctctggaatggaccccaatagtgatgacagctccagaaatttatttgtgaaggatttaccgcaaattcctcttgaagaaactgaacttccaggacaaggagaatcatttcaaatagaagatcagatacctactattcctcaagacacactgggagttgattttgattcaggtgaagctaagtctactgataatgtcttacctagaactgtatctgttcgtagcagtttaaagaaacattgtaacagtatatgtcagtttgatagcttggatgattttgaaaccagtcatttggcagggaagtcttttgaattcgaaagagttggatttttagacccactagtaaacatgcacatacctgaaaatgtacaacacaatgcttgtcaatggagcaaggaccaagttaacttatcaccaaagctgattcagccaggaacgtttactaaaacaaaagaagacattttagaatctaaatctgaacaaactaaaagtaagcaaagagatacacaagaaagaaaaagagaagagaaaagaaaagctaacaggagaaaatcaaaacgtatgtcaaaatataaagagaataaaagcgaaaataaaaaaactgttccccaaaaaaaaatgcacaaatctgtcagttccaatgatgcttacaattttaatttggaagagggtgttcatcttactcctttccgacaaaaagtgagcaatgactctaatagagaagaaaacaacgagtctgaagtgagcctctgtgaatcaagtggttcaggagatgattccgatgacctctatttgcccacttgcaagtacattcagaatcccacgagcaattcagatagaccagtcaccaggcctctagctaaaagagcactgaaatacacagatgaaaaagagacggagggttctaagccaacaaaaactcctaccactacaccacctgaaactcagcagtcacctcatcttagcctgaaggatatcaccaatgtctccttgtatcctgttgtgaaaatcagaagactttctctttctccaaaaaagaataaagcaagcccagcagtggctctgcctaaacgtaggtgcacagccagcgtgaactataaggagcccaccctcgcttcgaaactgagaagaggggacccttttacagatttgtgttttttgaattctcctattttcaagcagaaaaaggatttgagacgttctaaaaaaagtatgaaacaaatacaatgaaggttttgttggatattgtttaaattcaatctacacctctttctgttgcttcaggagaggatctgtaagagtacacaaacagagtgagccattgccatagaatattctcttgacaggaccctagctcataaacatttcttcagaactatacttcaaatgggatgctttgtattaaaactttaataaatttaatttattttttcttttgaatataaat

SEQ ID NO: 445825 - DNA, 4116 bp, Homo sapiens
  misc_feature (3452)..(3452): n is a, c, g, or t
  misc_feature (3539)..(3539): n is a, c, g, or t
gatttcgaatgtggcggcggtagttccaggcgacggcggacggtggtacggtcctggagggcccagtgcgcggggctagccgtggctggagagcttcgaagagccttgaaatgtgaggaggaggaagatagctgttgcagaagtagtggccaaggtatcgttctggacgcgcctgcggcaggagggtcgccgcgtccacttccgccagccccacctccccccggccttcctggagtccctgaaagaggaagaagtaggttttaaggcaaaagatggccaaggaaagatgcctgaaaaagtcctttcaagatagtcttgaagacataaagaagcgaatgaaagagaaaaggaataaaaacttggcagagattggcaaacgcaggtcttttatagctgcaccatgccaaataatcaccaacacttctacactgctgaaaaattaccaagacaacaacaaaatgttagttttagctttggaaaatgaaaaatccaaagtgaaagaagcccaagatatcatcctacagctgagaaaagaatgttactatctcacatgtcagctatatgcattgaaaggaaaacttacatcacaacaaacagtagaacctgctcagaaccaggaaatatgttcctctggaatggaccccaatagtgatgacagctccagaaatttatttgtgaaggatttaccgcaaattcctcttgaagaaactgaacttccaggacaaggagaatcatttcaaatagaagatcagatacctactattcctcaagacacactgggagttgattttgattcaggtgaagctaagtctactgataatgtcttacctagaactgtatctgttcgtagcagtttaaagaaacattgtaacagtatatgtcagtttgatagcttggatgattttgaaaccagtcatttggcagggaagtcttttgaattcgaaagagttggatttttagacccactagtaaacatgcacatacctgaaaatgtacaacacaatgcttgtcaatggagcaaggaccaagttaacttatcaccaaagctgattcagccaggaacgtttactaaaacaaaagaagacattttagaatctaaatctgaacaaactaaaagtaagcaaagagatacacaagaaagaaaaagagaagagaaaagaaaagctaacaggagaaaatcaaaacgtatgtcaaaatataaagagaataaaagcgaaaataaaaaaactgttccccaaaaaaaaatgcacaaatctgtcagttccaatgatgcttacaattttaatttggaagagggtgttcatcttactcctttccgacaaaaagtgagcaatgactctaatagagaagaaaacaacgagtctgaagtgagcctctgtgaatcaagtggttcaggagatgattccgatgacctctatttgcccacttgcaagtacattcagaatcccacgagcaattcagatagaccagtcaccaggcctctagctaaaagagcactgaaatacacagatgaaaaagagacggagggttctaagccaacaaaaactcctaccactacaccacctgaaactcagcagtcacctcatcttagcctgaaggatatcaccaatgtctccttgtatcctgttgtgaaaatcagaagactttctctttctccaaaaaagaataaagcaagcccagcagtggctctgcctaaacgtaggtgcacagccagcgtgaactataaggagcccaccctcgcttcgaaactgagaagaggggacccttttacagatttgtgttttttgaattctcctattttcaagcagaaaaaggatttgagacgttctaaaaaaagtatgaaacaaatacaatgaaggttttgttggatattgtttaaattcaatctacacctctttctgttgcttcaggagaggatctgtaagagtacacaaacagagtgagccattgccatagaatattctcttgacaggaccctagctcataaacatttcttcagaactatacttcaaatgggatgctttgtattaaaactttaataaatttaatttattttttcttttgaatataaataactgagcttaagcattatcatcatatcgatttcttatgctgcctaaacctcttaattttagtcgaaatatatctttttttttttttggaggcggaatttcattcttgttgcccaggctggagtgcaatggcacgatctcagcttaccgcaacctccgcctcccaggttcaagcgattctcctgcctcagactcccgagtagctgggactacaggcatgtgccactacgcccggctaattttgtatttttagtagagacagggtttctccatgttggtcaggttgctctcaaactcccaacctcaggtgatctgcccacctcggcctcccaaagtgctgggattactgagccactgtgcccagcccaaaatgtatcttatacaaacattgtagaaatgaataatgattactcaaataagatcttttaattataagcttctggcatctctatttttcccttaagtaggggatactaaagtgaatgattttctaagaggatcttttgaaactctttagtacaatatttgagtaaaataaattattgtggatcttttgaaactctgtgtagtattcgagtaaaataaatatttgacatttacagtagggtacaccctaagttgtttatgaattccttataccactgttatatttaatttttcagataaaatatgtatgggaaaatgactagagaaattgattcttttttaggctcagggacaagataagtgactaattgtgaaccccaagctctaattgtatgttcagagtgatgtctccataaaattacaaatgtcatgtactttcagggtagctccttatttagtcagaaatctcagagattaaatgtgtgaatatttagggtttttgcatatttttgaccaaccaatgaaagcgaattagttcagtttagaaagtttgatgtctatacttgtatatacctctttaaattttagaactttgtaggttattcatttttaaagagcaataaagtttgtataagatagtgattgctttccttctattctttaaatatcaaaaatagagtatctctctgtcttcactattctcatccttggacatttcctctcccctccccttggtattctcttttttgaggggggggtgttctaggtgagttaatccttagtattttcagtagtcattgctataaaactctcagcttcccctccatactttcaacctaacacttctctctcccaacttatctctgtgtaatctcccagttcatgattaacaaattataattttattgagggactgttctaatcctgatatctcagattttcttggctgttatctccctatctttctgtattctatgtcagtcagagccaaaatccttttcatcatcccaaatntttctatccgccacatcactgattcatacaccctagtcttccatcacagtctcttaatttttaagttttttttttcttactactccnttcatacttattctttaatttcatggaaacactagagtagctatcttaaactaagactacagaccattaaaaagtcagtttctcagccaggcacgagaaactactaacacctgtaatcccagcactttgggaggccaaggcgggcagatcacgagaggtcaaggagatcgagaccatcctggctaatacggtgaggccccgtctccactaaaaatagaaaaaattagccaggcgcctgtagtcccagctacttgggaggctgaggcaggagaacggcgtgaacccgggaggcggagcttgcagtgagccgagatggtgccactgcactccagcctgggtgacagagcgagactccatctcaaaaaaaaaaaaaaaacagtttctcagtccatgtaaccacctttcaaatgatcagtagccacatgtggctagtggttaccatattagacaattgaggaaatattgaacatttccatcatcacagaaagtacggttggactatgggccaaatctagcacaccacctgcttctgggtggtcttcaacctaagaatagtttttacgtttttaaatagttg

SEQ ID NO: 445826 - DNA, 4005 bp, Homo sapiens
  misc_feature (3341)..(3341): n is a, c, g, or t
  misc_feature (3428)..(3428): n is a, c, g, or t
gatttcgaatgtggcggcggtagttccaggcgacggcggacggtggtacggtcctggagggcccagtgcgcggggctagccgtggctggagagcttcgaagagccttgaaatgtgaggaggaggaagatagctgttgcagaagtagtggccaaggcaaaagatggccaaggaaagatgcctgaaaaagtcctttcaagatagtcttgaagacataaagaagcgaatgaaagagaaaaggaataaaaacttggcagagattggcaaacgcaggtcttttatagctgcaccatgccaaataatcaccaacacttctacactgctgaaaaattaccaagacaacaacaaaatgttagttttagctttggaaaatgaaaaatccaaagtgaaagaagcccaagatatcatcctacagctgagaaaagaatgttactatctcacatgtcagctatatgcattgaaaggaaaacttacatcacaacaaacagtagaacctgctcagaaccaggaaatatgttcctctggaatggaccccaatagtgatgacagctccagaaatttatttgtgaaggatttaccgcaaattcctcttgaagaaactgaacttccaggacaaggagaatcatttcaaatagaagatcagatacctactattcctcaagacacactgggagttgattttgattcaggtgaagctaagtctactgataatgtcttacctagaactgtatctgttcgtagcagtttaaagaaacattgtaacagtatatgtcagtttgatagcttggatgattttgaaaccagtcatttggcagggaagtcttttgaattcgaaagagttggatttttagacccactagtaaacatgcacatacctgaaaatgtacaacacaatgcttgtcaatggagcaaggaccaagttaacttatcaccaaagctgattcagccaggaacgtttactaaaacaaaagaagacattttagaatctaaatctgaacaaactaaaagtaagcaaagagatacacaagaaagaaaaagagaagagaaaagaaaagctaacaggagaaaatcaaaacgtatgtcaaaatataaagagaataaaagcgaaaataaaaaaactgttccccaaaaaaaaatgcacaaatctgtcagttccaatgatgcttacaattttaatttggaagagggtgttcatcttactcctttccgacaaaaagtgagcaatgactctaatagagaagaaaacaacgagtctgaagtgagcctctgtgaatcaagtggttcaggagatgattccgatgacctctatttgcccacttgcaagtacattcagaatcccacgagcaattcagatagaccagtcaccaggcctctagctaaaagagcactgaaatacacagatgaaaaagagacggagggttctaagccaacaaaaactcctaccactacaccacctgaaactcagcagtcacctcatcttagcctgaaggatatcaccaatgtctccttgtatcctgttgtgaaaatcagaagactttctctttctccaaaaaagaataaagcaagcccagcagtggctctgcctaaacgtaggtgcacagccagcgtgaactataaggagcccaccctcgcttcgaaactgagaagaggggacccttttacagatttgtgttttttgaattctcctattttcaagcagaaaaaggatttgagacgttctaaaaaaagtatgaaacaaatacaatgaaggttttgttggatattgtttaaattcaatctacacctctttctgttgcttcaggagaggatctgtaagagtacacaaacagagtgagccattgccatagaatattctcttgacaggaccctagctcataaacatttcttcagaactatacttcaaatgggatgctttgtattaaaactttaataaatttaatttattttttcttttgaatataaataactgagcttaagcattatcatcatatcgatttcttatgctgcctaaacctcttaattttagtcgaaatatatctttttttttttttggaggcggaatttcattcttgttgcccaggctggagtgcaatggcacgatctcagcttaccgcaacctccgcctcccaggttcaagcgattctcctgcctcagactcccgagtagctgggactacaggcatgtgccactacgcccggctaattttgtatttttagtagagacagggtttctccatgttggtcaggttgctctcaaactcccaacctcaggtgatctgcccacctcggcctcccaaagtgctgggattactgagccactgtgcccagcccaaaatgtatcttatacaaacattgtagaaatgaataatgattactcaaataagatcttttaattataagcttctggcatctctatttttcccttaagtaggggatactaaagtgaatgattttctaagaggatcttttgaaactctttagtacaatatttgagtaaaataaattattgtggatcttttgaaactctgtgtagtattcgagtaaaataaatatttgacatttacagtagggtacaccctaagttgtttatgaattccttataccactgttatatttaatttttcagataaaatatgtatgggaaaatgactagagaaattgattcttttttaggctcagggacaagataagtgactaattgtgaaccccaagctctaattgtatgttcagagtgatgtctccataaaattacaaatgtcatgtactttcagggtagctccttatttagtcagaaatctcagagattaaatgtgtgaatatttagggtttttgcatatttttgaccaaccaatgaaagcgaattagttcagtttagaaagtttgatgtctatacttgtatatacctctttaaattttagaactttgtaggttattcatttttaaagagcaataaagtttgtataagatagtgattgctttccttctattctttaaatatcaaaaatagagtatctctctgtcttcactattctcatccttggacatttcctctcccctccccttggtattctcttttttgaggggggggtgttctaggtgagttaatccttagtattttcagtagtcattgctataaaactctcagcttcccctccatactttcaacctaacacttctctctcccaacttatctctgtgtaatctcccagttcatgattaacaaattataattttattgagggactgttctaatcctgatatctcagattttcttggctgttatctccctatctttctgtattctatgtcagtcagagccaaaatccttttcatcatcccaaatntttctatccgccacatcactgattcatacaccctagtcttccatcacagtctcttaatttttaagttttttttttcttactactccnttcatacttattctttaatttcatggaaacactagagtagctatcttaaactaagactacagaccattaaaaagtcagtttctcagccaggcacgagaaactactaacacctgtaatcccagcactttgggaggccaaggcgggcagatcacgagaggtcaaggagatcgagaccatcctggctaatacggtgaggccccgtctccactaaaaatagaaaaaattagccaggcgcctgtagtcccagctacttgggaggctgaggcaggagaacggcgtgaacccgggaggcggagcttgcagtgagccgagatggtgccactgcactccagcctgggtgacagagcgagactccatctcaaaaaaaaaaaaaaaacagtttctcagtccatgtaaccacctttcaaatgatcagtagccacatgtggctagtggttaccatattagacaattgaggaaatattgaacatttccatcatcacagaaagtacggttggactatgggccaaatctagcacaccacctgcttctgggtggtcttcaacctaagaatagtttttacgtttttaaatagttg

SEQ ID NO: 445827 - DNA, 3870 bp, Homo sapiens
  misc_feature (3206)..(3206): n is a, c, g, or t
  misc_feature (3293)..(3293): n is a, c, g, or t
gatttcgaatgtggcggcggtagttccaggcgacggcggacggtggtacggtcctggagggcccagtgcgcggggctagccgtggctggagagcttcgaagagccttgaaatgtgaggaggaggaagatagctgttgcagaagtagtggccaaggcaaaagatggccaaggaaagatgcctgaaaaagtcctttcaagatagtcttgaagacataaagaagcgaatgaaagagaaaaggaataaaaacttggcagagattggcaaacgcaggtcttttatagctgcaccatgccaaataatcaccaacacttctacactgctgaaaaattaccaagacaacaacaaaatgttagttttagctttggaaaatgaaaaatccaaagtgaaagaagcccaagatatcatcctacagctgagaaaagaatgttactatctcacatgtcagctatatgcattgaaaggaaaacttacatcacaacaaacagtagaacctgctcagaaccaggaaatatgttcctctggaatggaccccaatagtgatgacagctccagaaatttatttgtgaaggatttaccgcaaattcctcttgaagaaactgaacttccaggacaaggagaatcatttcaaatagaagatcagatacctactattcctcaagacacactgggagttgattttgattcaggtgaagctaagtctactgataatgtcttacctagaactgtatctgttcgtagcagtttaaagaaacattgtaacagtatatgtcagtttgatagcttggatgattttgaaaccagtcatttggcagggaagtcttttgaattcgaaagagttggatttttagacccactagtaaacatgcacatacctgaaaatgtacaacacaatgcttgtcaatggagcaaggaccaagttaacttatcaccaaagctgattcagccaggaacgtttactaaaacaaaagaagacattttagaatctaaatctgaacaaactaaaagtaagcaaagagatacacaagaaagaaaaagagaagagaaaagaaaagctaacaggagaaaatcaaaacgtatgtcaaaatataaagagaataaaagcgaaaataaaaaaactgttccccaaaaaaaaatgcacaaatctgtcagttccaatgatgcttacaattttaatttggaagagggtgttcatcttactcctttccgacaaaaagtgagcaatgactctaatagagaagaaaacaacgagtctgaagtgagcctctgtgaatcaagtggttcaggagatgattccgatgacctctatttgcccacttgcaagtacattcagaatcccacgagcaattcagatagaccagtcaccaggcctctagctaaaagagcactgaaatacacagatgaaaaagagacggagggttctaagccaacaaaaactcctaccactacaccacctgaaactcagcagtcacctcatcttagcctgaaggatatcaccaatgtctccttgtatcctgttgtgaaaatcagaagactttctctttctccaaaaaagaataaagcaagcccagcagtggctctgcctaaacgtaggtgcacagccagcgtgaactataaggagcccaccctcgcttcgaaactgagaagaggggacccttttacagatttgtgttttttgaattctcctattttcaagcagaaaaaggatttgagacgttctaaaaaaagtatgaaacaaatacaatgaaggttttgttggatattgtttaaattcaatctacacctctttctgttgcttcaggagaggatctgtaagagtacacaaacagagtgagccattgccatagaatattctcttgacaggaccctagctcataaacatttcttcagaactatacttcaaatgggatgctttgtattaaaactttaataaatttaatttattttttcttttgaatataaataactgagcttaagcattatcatcatatcgatttcttatgctgcctaaacctcttaattttagtcgaaatatatctttttttttttttggaggcggaatttcattcttgttgcccaggctggagtgcaatggcacgatctcagcttaccgcaacctccgcctcccaggttcaagcgattctcctgcctcagactcccgagtagtgggattactgagccactgtgcccagcccaaaatgtatcttatacaaacattgtagaaatgaataatgattactcaaataagatcttttaattataagcttctggcatctctatttttcccttaagtaggggatactaaagtgaatgattttctaagaggatcttttgaaactctttagtacaatatttgagtaaaataaattattgtggatcttttgaaactctgtgtagtattcgagtaaaataaatatttgacatttacagtagggtacaccctaagttgtttatgaattccttataccactgttatatttaatttttcagataaaatatgtatgggaaaatgactagagaaattgattcttttttaggctcagggacaagataagtgactaattgtgaaccccaagctctaattgtatgttcagagtgatgtctccataaaattacaaatgtcatgtactttcagggtagctccttatttagtcagaaatctcagagattaaatgtgtgaatatttagggtttttgcatatttttgaccaaccaatgaaagcgaattagttcagtttagaaagtttgatgtctatacttgtatatacctctttaaattttagaactttgtaggttattcatttttaaagagcaataaagtttgtataagatagtgattgctttccttctattctttaaatatcaaaaatagagtatctctctgtcttcactattctcatccttggacatttcctctcccctccccttggtattctcttttttgaggggggggtgttctaggtgagttaatccttagtattttcagtagtcattgctataaaactctcagcttcccctccatactttcaacctaacacttctctctcccaacttatctctgtgtaatctcccagttcatgattaacaaattataattttattgagggactgttctaatcctgatatctcagattttcttggctgttatctccctatctttctgtattctatgtcagtcagagccaaaatccttttcatcatcccaaatntttctatccgccacatcactgattcatacaccctagtcttccatcacagtctcttaatttttaagttttttttttcttactactccnttcatacttattctttaatttcatggaaacactagagtagctatcttaaactaagactacagaccattaaaaagtcagtttctcagccaggcacgagaaactactaacacctgtaatcccagcactttgggaggccaaggcgggcagatcacgagaggtcaaggagatcgagaccatcctggctaatacggtgaggccccgtctccactaaaaatagaaaaaattagccaggcgcctgtagtcccagctacttgggaggctgaggcaggagaacggcgtgaacccgggaggcggagcttgcagtgagccgagatggtgccactgcactccagcctgggtgacagagcgagactccatctcaaaaaaaaaaaaaaaacagtttctcagtccatgtaaccacctttcaaatgatcagtagccacatgtggctagtggttaccatattagacaattgaggaaatattgaacatttccatcatcacagaaagtacggttggactatgggccaaatctagcacaccacctgcttctgggtggtcttcaacctaagaatagtttttacgtttttaaatagttg

SEQ ID NO: 445828 - DNA, 529 bp, Homo sapiens
ggttcagcctgttttctcctaaagaggtttgtttaatgtcagatgataattgtacagatatgtttgggatttcccgtatgataggttggaagcgaagtggaagcactgaacctccaggtgacatctctgtttaaggagcttcaagaggctcatacaaaactcagcgaagctgagctaatgaagaagagacttcaagaaaagtaagaatgagagagcaattttatcctcctttgaaatatacatttttacaaagtatactactatataaaaacatagttttttaactatgttatgactaaaagaaaaatagacacctaattaaaatataaattcagaatatactaatgttccagttaatgtgtgagcatgaaatacttgtaagatggggggttggggactggagaactttaattctgccatttaggggcatttgttaaatgtacgagcctgggtaagatctctacagtaaagctgtgagctagttttcctgttactgacttaagctgatgacattgatgtgagtaagcat

SEQ ID NO: 445829 - DNA, 405 bp, Homo sapiens
tactactactaaattcgcggccgcgtcgacggtacaagtaaaaactgtgtgtatctcaaggaagtagcataatgatatttagcccattcaaaaggaaaaagaggctgggcgtggtggctcatgcctgtcattccatcactttgggaggccgaggcagaaggattgcttgagtacaggagttcaagaccagcctgggcaagatggcaagacctgatctctacaaaaaattaaaaaaaaaaaaaaaaaagctgggcgtggtggtgcacgcctctggtcctagctactggggatgctgaggttggaggattgcgtgagcctgggaagttggagctgcagtgagccatgatcgtgccactgcactttagcctggatgacagagagagaccctgactcaaaaaaaaaaaa

SEQ ID NO: 445830 - DNA, 3703 bp, Homo sapiens
atgggatgggcggggccgggaaattccccggcgcgggcagggagcggctggctgtcagctgagccgcgctgggcggggtcgccaggccgcgcatcagccctaggcaccccagtcccggctgccccctccgtgggcggggtcgccaggccgcgcatcagccctaggcaccccagtcccggctgccccctccgccaccgccgccgcccgccggcaggttccctggtcagcgtcccatcccggtcgggagttctctccaggcggcacgatgccgaggaaacagtgaccctgagcgaagccaagccgggcggcaggaacttctgcaatgtcccatcaacctctcagctgcctcactgaaaaggaggacagccccagtgaaagcacaggaaatggacccccccacctggcccacccaaacctggacacgtttaccccggaggagctgctgcagcagatgaaagagctcctgaccgagaaccaccagctgaaagaagccatgaagctaaataatcaagccatgaaagggagatttgaggagctttcggcctggacagagaaacagaaggaagaacgccagttttttgagatacagagcaaagaagcaaaagagcgtctaatggccttgagtcatgagaatgagaaattgaaggaagagcttggaaaactaaaagggaaatcagaaaggtcatctgaggaccccactgatgactccaggcttcccagggccgaagcggagcaggaaaaggaccagctcaggacccaggtggtgaggctacaagcagagaaggcagacctgttgggcatcgtgtctgaactgcagctcaagctgaactccagcggctcctcagaagattcctttgttgaaattaggatggctgaaggagaagcagaagggtcagtaaaagaaatcaagcatagtcctgggcccacgagaacagtctccactggcacggcattgtctaaatataggagcagatctgcagatggggccaagaattacttcgaacatgaggagttaactgtgagccagctcctgctgtgcctaagggaagggaatcagaaggtggagagacttgaagttgcactcaaggaggccaaagaaagagtttcagattttgaaaagaaaacaagtaatcgttctgagattgaaacccagacagaggggagcacagagaaagagaatgatgaagagaaaggcccggagactgttggaagcgaagtggaagcactgaacctccaggtgacatctctgtttaaggagcttcaagaggctcatacaaaactcagcgaagctgagctaatgaagaagagacttcaagaaaagtgtcaggcccttgaaaggaaaaattctgcaattccatcagagttgaatgaaaagcaagagcttgtttatactaacaaaaagttagagctacaagtggaaagcatgctatcagaaatcaaaatggaacaggctaaaacagaggatgaaaagtccaaattaactgtgctacagatgacacacaacaagcttcttcaagaacataataatgcattgaaaacaattgaggaactaacaagaaaagagtcagaaaaagtggacagggcagtgctgaaggaactgagtgaaaaactggaactggcagagaaggctctggcttccaaacagctgcaaatggatgaaatgaagcaaaccattgccaagcaggaagaggacctggaaaccatgaccatcctcagggctcagatggaagtttactgttctgattttcatgctgaaagagcagcgagagagaaaattcatgaggaaaaggagcaactggcattgcagctggcagttctgctgaaagagaatgatgctttcgaagacggaggcaggcagtccttgatggagatgcagagtcgtcatggggcgagaacaagtgactctgaccagcaggcttaccttgttcaaagaggagctgaggacagggactggcggcaacagcggaatattccgattcattcctgccccaagtgtggagaggttctgcctgacatagacacgttacagattcacgtgatggattgcatcatttaagtgttgatgtatcacctccccaaaactgttggtaaatgtcagattttttcctccaagagttgtgcttttgtgttatttgttttcactcaaatattttgcctcattattcttgttttaaaagaaagaaaacaggccgggcacagtggctcatgcctgtaatcccagcactttgggaggtcgaggtgggtggatcacttggggtcagggtttgagaccagcctggccaacatggcggaaccctgtctctaccaaaattacaaaaattagccgagcatggtggcgcatgcctgtagtcgcagctactcgcgaggttgaggcaggagaattgcttgaacccaggaagtggcagttgcagtgagccgagacgacaccactgcactccagcctgggtgacagagggagactctgtctcgaaagaaagaaagaaaaaaaggaaggaaggagaaggaaggaaggagaagaaaaggtacctgttctacgtagaacacctttggtggagttccatcaactcgcaaagtagaatccttacctactactcttctgataataattttaatattttttatgtttggttgatgcgagcagctgcactgctcatgcagttagctagcatgtgacatcatgtgacaaagttcatgtaattagatggaagaaacctcactgattaattttaagaaccttttagggatgcaggaacaatgaagtggccacagtatgtgctgtttttgaagcatttttaaaaacgaattgtagttgtttttcttcatttaaaatggatctgttggaggttatgtgtgtatgttgtagttttattgcagccacaataattttaccaaagttttcacataggcagttagcctttacttaatatcaagacaagtgaaaaaatattggcatcgatgaaaccgataacattggcctcattggatttctttacccattcacagtgtaaagaagttaccttcatgctttcattgtacctgcaggcctgtgggcttgtacagtagataattaatttctaaaaagaacagctgcctattttcttcctaggttaggttatatcttcataatcacaagaattagtgatggcaaaataaaattttgcttatgaatcttttacattgtttatatatgattaatatcatcatatatattttctgtattaagctcatttggcttcatttaagctgtatacttagtcatatatctttcattagttctatggatatgagcagatccctttactggagcccagtatgtgctgtgtgagttagaagtcattcttgctgagaaggtgaataggtagggatttgccttgttttgtaagtctacaatttgccaagagtaaataacactggaccagctgtaaaagtaaacagtgtgtttatgcattgagatactaaagcatttaagaaaaaattaaaagatctcttttgtttaaaggtctacacaacacaccaccaaacgagacgcaatacaacatccacagatgtgaacacacccaaaaaaaacaattcccacaggagagagcgcgcgcaaaggggcaggaacacacagaggggggccgcgcacacgttgtggccccacaagaggggaaaaatgaaagcggaaacaggcaacagtatcctcgtagaaagtttccgccaa

SEQ ID NO: 445831 - DNA, 3642 bp, Homo sapiens
atgggatgggcggggccgggaaattccccggcgcgggcagggagcggctggctgtcagctgagccgcgctgggcggggtcgccaggccgcgcatcagccctaggcaccccagtcccggctgccccctccgccaccgccgccgcccgccggcaggttccctggtcagcgtcccatcccggtcgggagttctctccaggcggcacgatgccgaggaaacagtgaccctgagcgaagccaagccgggcggcaggaacttctgcaatgtcccatcaacctctcagctgcctcactgaaaaggaggacagccccagtgaaagcacaggaaatggacccccccacctggcccacccaaacctggacacgtttaccccggaggagctgctgcagcagatgaaagagctcctgaccgagaaccaccagctgaaagaagccatgaagctaaataatcaagccatgaaagggagatttgaggagctttcggcctggacagagaaacagaaggaagaacgccagttttttgagatacagagcaaagaagcaaaagagcgtctaatggccttgagtcatgagaatgagaaattgaaggaagagcttggaaaactaaaagggaaatcagaaaggtcatctgaggaccccactgatgactccaggcttcccagggccgaagcggagcaggaaaaggaccagctcaggacccaggtggtgaggctacaagcagagaaggcagacctgttgggcatcgtgtctgaactgcagctcaagctgaactccagcggctcctcagaagattcctttgttgaaattaggatggctgaaggagaagcagaagggtcagtaaaagaaatcaagcatagtcctgggcccacgagaacagtctccactggcacggcattgtctaaatataggagcagatctgcagatggggccaagaattacttcgaacatgaggagttaactgtgagccagctcctgctgtgcctaagggaagggaatcagaaggtggagagacttgaagttgcactcaaggaggccaaagaaagagtttcagattttgaaaagaaaacaagtaatcgttctgagattgaaacccagacagaggggagcacagagaaagagaatgatgaagagaaaggcccggagactgttggaagcgaagtggaagcactgaacctccaggtgacatctctgtttaaggagcttcaagaggctcatacaaaactcagcgaagctgagctaatgaagaagagacttcaagaaaagtgtcaggcccttgaaaggaaaaattctgcaattccatcagagttgaatgaaaagcaagagcttgtttatactaacaaaaagttagagctacaagtggaaagcatgctatcagaaatcaaaatggaacaggctaaaacagaggatgaaaagtccaaattaactgtgctacagatgacacacaacaagcttcttcaagaacataataatgcattgaaaacaattgaggaactaacaagaaaagagtcagaaaaagtggacagggcagtgctgaaggaactgagtgaaaaactggaactggcagagaaggctctggcttccaaacagctgcaaatggatgaaatgaagcaaaccattgccaagcaggaagaggacctggaaaccatgaccatcctcagggctcagatggaagtttactgttctgattttcatgctgaaagagcagcgagagagaaaattcatgaggaaaaggagcaactggcattgcagctggcagttctgctgaaagagaatgatgctttcgaagacggaggcaggcagtccttgatggagatgcagagtcgtcatggggcgagaacaagtgactctgaccagcaggcttaccttgttcaaagaggagctgaggacagggactggcggcaacagcggaatattccgattcattcctgccccaagtgtggagaggttctgcctgacatagacacgttacagattcacgtgatggattgcatcatttaagtgttgatgtatcacctccccaaaactgttggtaaatgtcagattttttcctccaagagttgtgcttttgtgttatttgttttcactcaaatattttgcctcattattcttgttttaaaagaaagaaaacaggccgggcacagtggctcatgcctgtaatcccagcactttgggaggtcgaggtgggtggatcacttggggtcagggtttgagaccagcctggccaacatggcggaaccctgtctctaccaaaattacaaaaattagccgagcatggtggcgcatgcctgtagtcgcagctactcgcgaggttgaggcaggagaattgcttgaacccaggaagtggcagttgcagtgagccgagacgacaccactgcactccagcctgggtgacagagggagactctgtctcgaaagaaagaaagaaaaaaaggaaggaaggagaaggaaggaaggagaagaaaaggtacctgttctacgtagaacacctttggtggagttccatcaactcgcaaagtagaatccttacctactactcttctgataataattttaatattttttatgtttggttgatgcgagcagctgcactgctcatgcagttagctagcatgtgacatcatgtgacaaagttcatgtaattagatggaagaaacctcactgattaattttaagaaccttttagggatgcaggaacaatgaagtggccacagtatgtgctgtttttgaagcatttttaaaaacgaattgtagttgtttttcttcatttaaaatggatctgttggaggttatgtgtgtatgttgtagttttattgcagccacaataattttaccaaagttttcacataggcagttagcctttacttaatatcaagacaagtgaaaaaatattggcatcgatgaaaccgataacattggcctcattggatttctttacccattcacagtgtaaagaagttaccttcatgctttcattgtacctgcaggcctgtgggcttgtacagtagataattaatttctaaaaagaacagctgcctattttcttcctaggttaggttatatcttcataatcacaagaattagtgatggcaaaataaaattttgcttatgaatcttttacattgtttatatatgattaatatcatcatatatattttctgtattaagctcatttggcttcatttaagctgtatacttagtcatatatctttcattagttctatggatatgagcagatccctttactggagcccagtatgtgctgtgtgagttagaagtcattcttgctgagaaggtgaataggtagggatttgccttgttttgtaagtctacaatttgccaagagtaaataacactggaccagctgtaaaagtaaacagtgtgtttatgcattgagatactaaagcatttaagaaaaaattaaaagatctcttttgtttaaaggtctacacaacacaccaccaaacgagacgcaatacaacatccacagatgtgaacacacccaaaaaaaacaattcccacaggagagagcgcgcgcaaaggggcaggaacacacagaggggggccgcgcacacgttgtggccccacaagaggggaaaaatgaaagcggaaacaggcaacagtatcctcgtagaaagtttccgccaa

SEQ ID NO: 445832 - DNA, 3470 bp, Homo sapiens
atgggatgggcggggccgggaaattccccggcgcgggcagggagcggctggctgtcagctgagccgcgctgggcggggtcgccaggccgcgcatcagccctaggcaccccagtcccggctgccccctccgtgggcggggtcgccaggccgcgcatcagccctaggcaccccagtcccggctgccccctccgccaccgccgccgcccgccggcaggttccctggtcagcgtcccatcccggtcgggagttctctccaggcggcacgatgccgaggaaacagtgaccctgagcgaagccaagccgggcggcaggaacttctgcaatgtcccatcaacctctcagctgcctcactgaaaaggaggacagccccagtgaaagcacaggaaatggacccccccacctggcccacccaaacctggacacgtttaccccggaggagctgctgcagcagatgaaagagctcctgaccgagaaccaccagctgaaagaagccatgaagctaaataatcaagccatgaaagggagatttgaggagctttcggcctggacagagaaacagaaggaagaacgccagttttttgagatacagagcaaagaagcaaaagagcgtctaatggccttgagtcatgagaatgagaaattgaaggaagagcttggaaaactaaaagggaaatcagaaaggtcatctgaggaccccactgatgactccaggcttcccagggccgaagcggagcaggaaaaggaccagctcaggacccaggtggtgaggctacaagcagagaaggcagacctgttgggcatcgtgtctgaactgcagctcaagctgaactccagcggctcctcagaagattcctttgttgaaattaggatggctgaaggagaagcagaagggtcagtaaaagaaatcaagcatagtcctgggcccacgagaacagtctccactggcacggcattgtctaaatataggagcagatctgcagatggggccaagaattacttcgaacatgaggagttaactgtgagccagctcctgctgtgcctaagggaagggaatcagaaggtggagagacttgaagttgcactcaaggaggccaaagaaagagtttcagattttgaaaagaaaacaagtaatcgttctgagattgaaacccagacagaggggagcacagagaaagagaatgatgaagagaaaggcccggagactgttggaagcgaagtggaagcactgaacctccaggtgacatctctgtttaaggagcttcaagaggctcatacaaaactcagcgaagctgagctaatgaagaagagacttcaagaaaagtgtcaggcccttgaaaggaaaaattctgcaattccatcagagttgaatgaaaagcaagagcttgtttatactaacaaaaagttagagctacaagtggaaagcatgctatcagaaatcaaaatggaacaggctaaaacagaggatgaaaagtccaaattaactgtgctacagatgacacacaacaagcttcttcaagaacataataatgcattgaaaacaattgaggaactaacaagaaaagagtcagaaaaagtggacagggcagtgctgaaggaactgagtgaaaaactggaactggcagagaaggctctggcttccaaacagctgcaaatggatgaaatgaagcaaaccattgccaagcaggaagaggacctggaaaccatgaccatcctcagggctcagatggaagtttactgttctgattttcatgctgaaagagcagcgagagagaaaattcatgaggaaaaggagcaactggcattgcagctggcagttctgctgaaagagaatgatgctttcgaagacggaggcaggcagtccttgatggagatgcagagtcgtcatggggcgagaacaagtgactctgaccagcaggcttaccttgttcaaagaggagctgaggacagggactggcggcaacagcggaatattccgattcattcctgccccaagtgtggagaggttctgcctgacatagacacgttacagattcacgtgatggattgcatcatttaagtgttgatgtatcacctccccaaaactgttggtaaatgtcagattttttcctccaagagttgtgcttttgtgttatttgttttcactcaaatattttgcctcattattcttgttttaaaagaaagaaaacaggccgggcacagtggctcatgcctgtaatcccagcactttgggaggtcgaggtgggtggatcacttggggtcagggtttgagaccagcctggccaacatggcggaaccctgtctctaccaaaattacaaaaattagccgagcatggtggcgcatgcctgtagtcgcagctactcgcgaggttgaggcaggagaattgcttgaacccaggaagtggcagttgcagtgagccgagacgacaccactgcactccagcctgggtgacagagggagactctgtctcgaaagaaagaaagaaaaaaaggaaggaaggagaaggaaggaaggagaagaaaaggtacctgttctacgtagaacacctttggtggagttccatcaactcgcaaagtagaatccttacctactactcttctgataataattttaatattttttatgtttggttgatgcgagcagctgcactgctcatgcagttagctagcatgtgacatcatgtgacaaagttcatgtaattagatggaagaaacctcactgattaattttaagaaccttttagggatgcaggaacaatgaagtggccacagtatgtgctgtttttgaagcatttttaaaaacgaattgtagttgtttttcttcatttaaaatggatctgttggaggttatgtgtgtatgttgtagttttattgcagccacaataattttaccaaagttttcacataggcagttagcctttacttaatatcaagacaagtgaaaaaatattggcatcgatgaaaccgataacattggcctcattggatttctttacccattcacagtgtaaagaagttaccttcatgctttcattgtacctgcaggcctgtgggcttgtacagtagataattaatttctaaaaagaacagctgcctattttcttcctaggttaggttatatcttcataatcacaagaattagtgatggcaaaataaaattttgcttatgaatcttttacattgtttatatatgattaatatcatcatatatattttctgtattaagctcatttggcttcatttaagctgtatacttagtcatatatctttcattagttctatggatatgagcagatccctttactggagcccagtatgtgctgtgtgagttagaagtcattcttgctgagaaggtgaataggtagggatttgccttgttttgtaagtctacaatttgccaagagtaaataacactggaccagctgtaaaagtaaacagtgtgtttatgcattgagatactaaagcatttaaga

SEQ ID NO: 445833 - DNA, 3624 bp, Homo sapiens
atgggatgggcggggccgggaaattccccggcgcgggcagggagcggctggctgtcagctgagccgcgctgggcggggtcgccaggccgcgcatcagccctaggcaccccagtcccggctgccccctccgccaccgccgccgcccgccggcaggttccctggtcagcgtcccatcccggtcgggagttctctccaggcggcacgatgccgaggaaacagtgaccctgagcgaagccaagccgggcggcaggaacttctgcaatgtcccatcaacctctcagctgcctcactgaaaaggaggacagccccagtgaaagcacaggaaatggacccccccacctggcccacccaaacctggacacgtttaccccggaggagctgctgcagcagatgaaagagctcctgaccgagaaccaccagctgaaagaagccatgaagctaaataatcaagccatgaaagggagatttgaggagctttcggcctggacagagaaacagaaggaagaacgccagttttttgagatacagagcaaagaagcaaaagagcgtctaatggccttgagtcatgagaatgagaaattgaaggaagagcttggaaaactaaaagggaaatcagaaaggtcatctgaggaccccactgatgactccaggcttcccagggccgaagcggagcaggaaaaggaccagctcaggacccaggtggtgaggctacaagcagagaaggcagacctgttgggcatcgtgtctgaactgcagctcaagctgaactccagcggctcctcagaagattcctttgttgaaattaggatggctgaaggagaagcagaagggtcagtaaaagaaatcaagcatagtcctgggcccacgagaacagtctccactggcacgagcagatctgcagatggggccaagaattacttcgaacatgaggagttaactgtgagccagctcctgctgtgcctaagggaagggaatcagaaggtggagagacttgaagttgcactcaaggaggccaaagaaagagtttcagattttgaaaagaaaacaagtaatcgttctgagattgaaacccagacagaggggagcacagagaaagagaatgatgaagagaaaggcccggagactgttggaagcgaagtggaagcactgaacctccaggtgacatctctgtttaaggagcttcaagaggctcatacaaaactcagcgaagctgagctaatgaagaagagacttcaagaaaagtgtcaggcccttgaaaggaaaaattctgcaattccatcagagttgaatgaaaagcaagagcttgtttatactaacaaaaagttagagctacaagtggaaagcatgctatcagaaatcaaaatggaacaggctaaaacagaggatgaaaagtccaaattaactgtgctacagatgacacacaacaagcttcttcaagaacataataatgcattgaaaacaattgaggaactaacaagaaaagagtcagaaaaagtggacagggcagtgctgaaggaactgagtgaaaaactggaactggcagagaaggctctggcttccaaacagctgcaaatggatgaaatgaagcaaaccattgccaagcaggaagaggacctggaaaccatgaccatcctcagggctcagatggaagtttactgttctgattttcatgctgaaagagcagcgagagagaaaattcatgaggaaaaggagcaactggcattgcagctggcagttctgctgaaagagaatgatgctttcgaagacggaggcaggcagtccttgatggagatgcagagtcgtcatggggcgagaacaagtgactctgaccagcaggcttaccttgttcaaagaggagctgaggacagggactggcggcaacagcggaatattccgattcattcctgccccaagtgtggagaggttctgcctgacatagacacgttacagattcacgtgatggattgcatcatttaagtgttgatgtatcacctccccaaaactgttggtaaatgtcagattttttcctccaagagttgtgcttttgtgttatttgttttcactcaaatattttgcctcattattcttgttttaaaagaaagaaaacaggccgggcacagtggctcatgcctgtaatcccagcactttgggaggtcgaggtgggtggatcacttggggtcagggtttgagaccagcctggccaacatggcggaaccctgtctctaccaaaattacaaaaattagccgagcatggtggcgcatgcctgtagtcgcagctactcgcgaggttgaggcaggagaattgcttgaacccaggaagtggcagttgcagtgagccgagacgacaccactgcactccagcctgggtgacagagggagactctgtctcgaaagaaagaaagaaaaaaaggaaggaaggagaaggaaggaaggagaagaaaaggtacctgttctacgtagaacacctttggtggagttccatcaactcgcaaagtagaatccttacctactactcttctgataataattttaatattttttatgtttggttgatgcgagcagctgcactgctcatgcagttagctagcatgtgacatcatgtgacaaagttcatgtaattagatggaagaaacctcactgattaattttaagaaccttttagggatgcaggaacaatgaagtggccacagtatgtgctgtttttgaagcatttttaaaaacgaattgtagttgtttttcttcatttaaaatggatctgttggaggttatgtgtgtatgttgtagttttattgcagccacaataattttaccaaagttttcacataggcagttagcctttacttaatatcaagacaagtgaaaaaatattggcatcgatgaaaccgataacattggcctcattggatttctttacccattcacagtgtaaagaagttaccttcatgctttcattgtacctgcaggcctgtgggcttgtacagtagataattaatttctaaaaagaacagctgcctattttcttcctaggttaggttatatcttcataatcacaagaattagtgatggcaaaataaaattttgcttatgaatcttttacattgtttatatatgattaatatcatcatatatattttctgtattaagctcatttggcttcatttaagctgtatacttagtcatatatctttcattagttctatggatatgagcagatccctttactggagcccagtatgtgctgtgtgagttagaagtcattcttgctgagaaggtgaataggtagggatttgccttgttttgtaagtctacaatttgccaagagtaaataacactggaccagctgtaaaagtaaacagtgtgtttatgcattgagatactaaagcatttaagaaaaaattaaaagatctcttttgtttaaaggtctacacaacacaccaccaaacgagacgcaatacaacatccacagatgtgaacacacccaaaaaaaacaattcccacaggagagagcgcgcgcaaaggggcaggaacacacagaggggggccgcgcacacgttgtggccccacaagaggggaaaaatgaaagcggaaacaggcaacagtatcctcgtagaaagtttccgccaa

SEQ ID NO: 445834 - DNA, 2895 bp, Homo sapiens
atgggatgggcggggccgggaaattccccggcgcgggcagggagcggctggctgtcagctgagccgcgctgggcggggtcgccaggccgcgcatcagccctaggcaccccagtcccggctgccccctccgtgggcggggtcgccaggccgcgcatcagccctaggcaccccagtcccggctgccccctccgccaccgccgccgcccgccggcaggttccctggtcagcgtcccatcccggtcgggagttctctccaggcggcacgatgccgaggaaacagtgaccctgagcgaagccaagccgggcggcaggaacttctgcaatgtcccatcaacctctcagctgcctcactgaaaaggaggacagccccagtgaaagcacaggaaatggacccccccacctggcccacccaaacctggacacgtttaccccggaggagctgctgcagcagatgaaagagctcctgaccgagaaccaccagctgaaagaagccatgaagctaaataatcaagccatgaaagggagatttgaggagctttcggcctggacagagaaacagaaggaagaacgccagttttttgagatacagagcaaagaagcaaaagagcgtctaatggccttgagtcatgagaatgagaaattgaaggaagagcttggaaaactaaaagggaaatcagaaaggtcatctgaggaccccactgatgactccaggcttcccagggccgaagcggagcaggaaaaggaccagctcaggacccaggtggtgaggctacaagcagagaaggcagacctgttgggcatcgtgtctgaactgcagctcaagctgaactccagcggctcctcagaagattcctttgttgaaattaggatggctgaaggagaagcagaagggtcagtaaaagaaatcaagcatagtcctgggcccacgagaacagtctccactggcacggcattgtctaaatataggagcagatctgcagatggggccaagaattacttcgaacatgaggagttaactgtgagccagctcctgctgtgcctaagggaagggaatcagaaggtggagagacttgaagttgcactcaaggaggccaaagaaagagtttcagattttgaaaagaaaacaagtaatcgttctgagattgaaacccagacagaggggagcacagagaaagagaatgatgaagagaaaggcccggagactgttggaagcgaagtggaagcactgaacctccaggtgacatctctgtttaaggagcttcaagaggctcatacaaaactcagcgaagctgagctaatgaagaagagacttcaagaaaagtgtcaggcccttgaaaggaaaaattctgcaattccatcagagttgaatgaaaagcaagagcttgtttatactaacaaaaagttagagctacaagtggaaagcatgctatcagaaatcaaaatggaacaggctaaaacagaggatgaaaagtccaaattaactgtgctacagatgacacacaacaagcttcttcaagaacataataatgcattgaaaacaattgaggaactaacaagaaaagagtcagaaaaagtggacagggcagtgctgaaggaactgagtgaaaaactggaactggcagagaaggctctggcttccaaacagctgcaaatggatgaaatgaagcaaaccattgccaagcaggaagaggacctggaaaccatgaccatcctcagggctcagatggaagtttactgttctgattttcatgctgaaagagcagcgagagagaaaattcatgaggaaaaggagcaactggcattgcagctggcagttctgctgaaagagaatgatgctttcgaagacggaggcaggcagtccttgatggagatgcagagtcgtcatggggcgagaacaagtgactctgaccagcaggcttaccttgttcaaagaggagctgaggacagggactggcggcaacagcggaatattccgattcattcctgccccaagtgtggagaggttctgcctgacatagacacgttacagattcacgtgatggattgcatcatttaagtgttgatgtatcacctccccaaaactgttggtaaatgtcagattttttcctccaagagttgtgcttttgtgttatttgttttcactcaaatattttgcctcattattcttgttttaaaagaaagaaaacaggccgggcacagtggctcatgcctgtaatcccagcactttgggaggtcgaggtgggtggatcacttggggtcagggtttgagaccagcctggccaacatggcggaaccctgtctctaccaaaattacaaaaattagccgagcatggtggcgcatgcctgtagtcgcagctactcgcgaggttgaggcaggagaattgcttgaacccaggaagtggcagttgcagtgagccgagacgacaccactgcactccagcctgggtgacagagggagactctgtctcgaaagaaagaaagaaaaaaaggaaggaaggagaaggaaggaaggagaagaaaaggtacctgttctacgtagaacacctttggtggagttccatcaactcgcaaagtagaatccttacctactactcttctgataataattttaatattttttatgtttggttgatgcgagcagctgcactgctcatgcagttagctagcatgtgacatcatgtgacaaagttcatgtaattagatggaagaaacctcactgattaattttaagaaccttttagggatgcaggaaacaagaccggtcttgtttcctgcacttcaaaaccaaacctctgctagcttcaaacttctcttctgcagcttcctcacctctcttagccttcacagaattgaagagagttagggccttgctctggattaggcttcggcttaagg

SEQ ID NO: 445835 - DNA, 3558 bp, Homo sapiens
atgggatgggcggggccgggaaattccccggcgcgggcagggagcggctggctgtcagctgagccgcgctgggcggggtcgccaggccgcgcatcagccctaggcaccccagtcccggctgccccctccgccaccgccgccgcccgccggcaggttccctggtcagcgtcccatcccggtcgggagttctctccaggcggcacgatgccgaggaaacagtgaccctgagcgaagccaagccgggcggcaggaacttctgcaatgtcccatcaacctctcagctgcctcactgaaaaggaggacagccccagtgaaagcacaggaaatggacccccccacctggcccacccaaacctggacacgtttaccccggaggagctgctgcagcagatgaaagagctcctgaccgagaaccaccagctgaaagaagccatgaagctaaataatcaagccatgaaagggagatttgaggagctttcggcctggacagagaaacagaaggaagaacgccagttttttgagatacagagcaaagaagcaaaagagcgtctaatggccttgagtcatgagaatgagaaattgaaggaagagcttggaaaactaaaagggaaatcagaaaggtcatctgaggaccccactgatgactccaggcttcccagggccgaagcggagcaggaaaaggaccagctcaggacccaggtggtgaggctacaagcagagaaggcagacctgttgggcatcgtgtctgaactgcagctcaagctgaactccagcggctcctcagaagattcctttgttgaaattaggatggctgaaggagaagcagaagggtcagtaaaagaaatcaagcatagtcctgggcccacgagaacagtctccactggcacgagcagatctgcagatggggccaagaattacttcgaacatgaggagttaactgtgagccagctcctgctgtgcctaagggaagggaatcagaaggtggagagacttgaagttgcactcaaggaggccaaagaaagagagaaagagaatgatgaagagaaaggcccggagactgttggaagcgaagtggaagcactgaacctccaggtgacatctctgtttaaggagcttcaagaggctcatacaaaactcagcgaagctgagctaatgaagaagagacttcaagaaaagtgtcaggcccttgaaaggaaaaattctgcaattccatcagagttgaatgaaaagcaagagcttgtttatactaacaaaaagttagagctacaagtggaaagcatgctatcagaaatcaaaatggaacaggctaaaacagaggatgaaaagtccaaattaactgtgctacagatgacacacaacaagcttcttcaagaacataataatgcattgaaaacaattgaggaactaacaagaaaagagtcagaaaaagtggacagggcagtgctgaaggaactgagtgaaaaactggaactggcagagaaggctctggcttccaaacagctgcaaatggatgaaatgaagcaaaccattgccaagcaggaagaggacctggaaaccatgaccatcctcagggctcagatggaagtttactgttctgattttcatgctgaaagagcagcgagagagaaaattcatgaggaaaaggagcaactggcattgcagctggcagttctgctgaaagagaatgatgctttcgaagacggaggcaggcagtccttgatggagatgcagagtcgtcatggggcgagaacaagtgactctgaccagcaggcttaccttgttcaaagaggagctgaggacagggactggcggcaacagcggaatattccgattcattcctgccccaagtgtggagaggttctgcctgacatagacacgttacagattcacgtgatggattgcatcatttaagtgttgatgtatcacctccccaaaactgttggtaaatgtcagattttttcctccaagagttgtgcttttgtgttatttgttttcactcaaatattttgcctcattattcttgttttaaaagaaagaaaacaggccgggcacagtggctcatgcctgtaatcccagcactttgggaggtcgaggtgggtggatcacttggggtcagggtttgagaccagcctggccaacatggcggaaccctgtctctaccaaaattacaaaaattagccgagcatggtggcgcatgcctgtagtcgcagctactcgcgaggttgaggcaggagaattgcttgaacccaggaagtggcagttgcagtgagccgagacgacaccactgcactccagcctgggtgacagagggagactctgtctcgaaagaaagaaagaaaaaaaggaaggaaggagaaggaaggaaggagaagaaaaggtacctgttctacgtagaacacctttggtggagttccatcaactcgcaaagtagaatccttacctactactcttctgataataattttaatattttttatgtttggttgatgcgagcagctgcactgctcatgcagttagctagcatgtgacatcatgtgacaaagttcatgtaattagatggaagaaacctcactgattaattttaagaaccttttagggatgcaggaacaatgaagtggccacagtatgtgctgtttttgaagcatttttaaaaacgaattgtagttgtttttcttcatttaaaatggatctgttggaggttatgtgtgtatgttgtagttttattgcagccacaataattttaccaaagttttcacataggcagttagcctttacttaatatcaagacaagtgaaaaaatattggcatcgatgaaaccgataacattggcctcattggatttctttacccattcacagtgtaaagaagttaccttcatgctttcattgtacctgcaggcctgtgggcttgtacagtagataattaatttctaaaaagaacagctgcctattttcttcctaggttaggttatatcttcataatcacaagaattagtgatggcaaaataaaattttgcttatgaatcttttacattgtttatatatgattaatatcatcatatatattttctgtattaagctcatttggcttcatttaagctgtatacttagtcatatatctttcattagttctatggatatgagcagatccctttactggagcccagtatgtgctgtgtgagttagaagtcattcttgctgagaaggtgaataggtagggatttgccttgttttgtaagtctacaatttgccaagagtaaataacactggaccagctgtaaaagtaaacagtgtgtttatgcattgagatactaaagcatttaagaaaaaattaaaagatctcttttgtttaaaggtctacacaacacaccaccaaacgagacgcaatacaacatccacagatgtgaacacacccaaaaaaaacaattcccacaggagagagcgcgcgcaaaggggcaggaacacacagaggggggccgcgcacacgttgtggccccacaagaggggaaaaatgaaagcggaaacaggcaacagtatcctcgtagaaagtttccgccaa

SEQ ID NO: 445836 - DNA, 3202 bp, Homo sapiens
gtccagagaggaggcgattcagatatgtggactttttaaacatacatagtctctggaggagtgttgttctctgcgtgtgtgtgtgtgtgtgtgtgtgtgtgtgtgtgtagagttgtaggtatgaggatttggggggcctgcaaagagagttcaggctctcagtggtgtggtgtgaggtacacagtgactgtttggaggacgtgggtgtgtgcattgtaagctggcctctccagagcctcactgagtctccacaccttccctaggaagcatggaggagcttggcactgggggtcccaggaccagctgtgcttgttcactagttgagaattagttggagaatgttctggaaagcagttcctttaagctggtcccagttatattgggttactctcttcttagtctttggaatttttctgatgaaaaccttttaacctttatactgaacagggcattgtctaaatataggagcagatctgcagatggggccaagaattacttcgaacatgaggagttaactgtgagccagctcctgctgtgcctaagggaagggaatcagaaggtggagagacttgaagttgcactcaaggaggccaaagaaagagtttcagattttgaaaagaaaacaagtaatcgttctgagattgaaacccagacagaggggagcacagagaaagagaatgatgaagagaaaggcccggagactgttggaagcgaagtggaagcactgaacctccaggtgacatctctgtttaaggagcttcaagaggctcatacaaaactcagcgaagctgagctaatgaagaagagacttcaagaaaagtgtcaggcccttgaaaggaaaaattctgcaattccatcagagttgaatgaaaagcaagagcttgtttatactaacaaaaagttagagctacaagtggaaagcatgctatcagaaatcaaaatggaacaggctaaaacagaggatgaaaagtccaaattaactgtgctacagatgacacacaacaagcttcttcaagaacataataatgcattgaaaacaattgaggaactaacaagaaaagagtcagaaaaagtggacagggcagtgctgaaggaactgagtgaaaaactggaactggcagagaaggctctggcttccaaacagctgcaaatggatgaaatgaagcaaaccattgccaagcaggaagaggacctggaaaccatgaccatcctcagggctcagatggaagtttactgttctgattttcatgctgaaagagcagcgagagagaaaattcatgaggaaaaggagcaactggcattgcagctggcagttctgctgaaagagaatgatgctttcgaagacggaggcaggcagtccttgatggagatgcagagtcgtcatggggcgagaacaagtgactctgaccagcaggcttaccttgttcaaagaggagctgaggacagggactggcggcaacagcggaatattccgattcattcctgccccaagtgtggagaggttctgcctgacatagacacgttacagattcacgtgatggattgcatcatttaagtgttgatgtatcacctccccaaaactgttggtaaatgtcagattttttcctccaagagttgtgcttttgtgttatttgttttcactcaaatattttgcctcattattcttgttttaaaagaaagaaaacaggccgggcacagtggctcatgcctgtaatcccagcactttgggaggtcgaggtgggtggatcacttggggtcagggtttgagaccagcctggccaacatggcggaaccctgtctctaccaaaattacaaaaattagccgagcatggtggcgcatgcctgtagtcgcagctactcgcgaggttgaggcaggagaattgcttgaacccaggaagtggcagttgcagtgagccgagacgacaccactgcactccagcctgggtgacagagggagactctgtctcgaaagaaagaaagaaaaaaaggaaggaaggagaaggaaggaaggagaagaaaaggtacctgttctacgtagaacacctttggtggagttccatcaactcgcaaagtagaatccttacctactactcttctgataataattttaatattttttatgtttggttgatgcgagcagctgcactgctcatgcagttagctagcatgtgacatcatgtgacaaagttcatgtaattagatggaagaaacctcactgattaattttaagaaccttttagggatgcaggaacaatgaagtggccacagtatgtgctgtttttgaagcatttttaaaaacgaattgtagttgtttttcttcatttaaaatggatctgttggaggttatgtgtgtatgttgtagttttattgcagccacaataattttaccaaagttttcacataggcagttagcctttacttaatatcaagacaagtgaaaaaatattggcatcgatgaaaccgataacattggcctcattggatttctttacccattcacagtgtaaagaagttaccttcatgctttcattgtacctgcaggcctgtgggcttgtacagtagataattaatttctaaaaagaacagctgcctattttcttcctaggttaggttatatcttcataatcacaagaattagtgatggcaaaataaaattttgcttatgaatcttttacattgtttatatatgattaatatcatcatatatattttctgtattaagctcatttggcttcatttaagctgtatacttagtcatatatctttcattagttctatggatatgagcagatccctttactggagcccagtatgtgctgtgtgagttagaagtcattcttgctgagaaggtgaataggtagggatttgccttgttttgtaagtctacaatttgccaagagtaaataacactggaccagctgtaaaagtaaacagtgtgtttatgcattgagatactaaagcatttaagaaaaaattaaaagatctcttttgtttaaaggtctacacaacacaccaccaaacgagacgcaatacaacatccacagatgtgaacacacccaaaaaaaacaattcccacaggagagagcgcgcgcaaaggggcaggaacacacagaggggggccgcgcacacgttgtggccccacaagaggggaaaaatgaaagcggaaacaggcaacagtatcctcgtagaaagtttccgccaa

SEQ ID NO: 445837 - DNA, 1785 bp, Homo sapiens
atgggatgggcggggccgggaaattccccggcgcgggcagggagcggctggctgtcagctgagccgcgctgggcggggtcgccaggccgcgcatcagccctaggcaccccagtcccggctgccccctccgtgggcggggtcgccaggccgcgcatcagccctaggcaccccagtcccggctgccccctccgccaccgccgccgcccgccggcaggttccctggtcagcgtcccatcccggtcgggagttctctccaggcggcacgatgccgaggaaacagtgaccctgagcgaagccaagccgggcggcaggaacttctgcaatgtcccatcaacctctcagctgcctcactgaaaaggaggacagccccagtgaaagcacaggaaatggacccccccacctggcccacccaaacctggacacgtttaccccggaggagctgctgcagcagatgaaagagctcctgaccgagaaccaccagctgaaagaagccatgaagctaaataatcaagccatgaaagggagatttgaggagctttcggcctggacagagaaacagaaggaagaacgccagttttttgagatacagagcaaagaagcaaaagagcgtctaatggccttgagtcatgagaatgagaaattgaaggaagagcttggaaaactaaaagggaaatcagaaaggtcatctgaggaccccactgatgactccaggcttcccagggccgaagcggagcaggaaaaggaccagctcaggacccaggtggtgaggctacaagcagagaaggcagacctgttgggcatcgtgtctgaactgcagctcaagctgaactccagcggctcctcagaagattcctttgttgaaattaggatggctgaaggagaagcagaagggtcagtaaaagaaatcaagcatagtcctgggcccacgagaacagtctccactggcacggcattgtctaaatataggagcagatctgcagatggggccaagaattacttcgaacatgaggagttaactgtgagccagctcctgctgtgcctaagggaagggaatcagaaggtggagagacttgaagttgcactcaaggaggccaaagaaagagtttcagattttgaaaagaaaacaagtaatcgttctgagattgaaacccagacagaggggagcacagagaaagagaatgatgaagagaaaggcccggagactgttggaagcgaagtggaagcactgaacctccaggtgacatctctgtttaaggagcttcaagaggctcatacaaaactcagcgaagctgagctaatgaagaagagacttcaagaaaagtgtcaggcccttgaaaggaaaaattctgcaattccatcagagttgaatgaaaagcaagagcttgtttatactaacaaaaagttagagctacaagtggaaagcatgctatcagaaatcaaaatggaacaggctaaaacagaggatgaaaagtccaaattaactgtgctacagatgacacacaacaagcttcttcaagaacataataatgcattgaaaacaattgaggaactaacaagaaaagagtcagaaaaagtggacagggcagtgctgaaggaactgagtgaaaaactggaactggcagagaaggctctggcttccaaacagctgcaaatggatgaaatgaagcaaaccattgccaagcaggaagaggacctggaaaccatgaccatcctcagggctcagatggaagtttatattcttatcctaccaggcttcggaataatctcccatattgtaacttacta

SEQ ID NO: 445838 - DNA, 1364 bp, Homo sapiens
atgggatgggcggggccgggaaattccccggcgcgggcagggagcggctggctgtcagctgagccgcgctgggcggggtcgccaggccgcgcatcagccctaggcaccccagtcccggctgccccctccgtgggcggggtcgccaggccgcgcatcagccctaggcaccccagtcccggctgccccctccgccaccgccgccgcccgccggcaggttccctggtcagcgtcccatcccggtcgggagttctctccaggcggcacgatgccgaggaaacagtgaccctgagcgaagccaagccgggcggcaggaacttctgcaatgtcccatcaacctctcagctgcctcactgaaaaggaggacagccccagtgaaagcacaggaaatggacccccccacctggcccacccaaacctggacacgtttaccccggaggagctgctgcagcagatgaaagagctcctgaccgagaaccaccagctgaaagaagccatgaagctaaataatcaagccatgaaagggagatttgaggagctttcggcctggacagagaaacagaaggaagaacgccagttttttgagatacagagcaaagaagcaaaagagcgtctaatggccttgagtcatgagaatgagaaattgaaggaagagcttggaaaactaaaagggaaatcagaaaggtcatctgaggaccccactgatgactccaggcttcccagggccgaagcggagcaggaaaaggaccagctcaggacccaggtggtgaggctacaagcagagaaggcagacctgttgggcatcgtgtctgaactgcagctcaagctgaactccagcggctcctcagaagattcctttgttgaaattaggatggctgaaggagaagcagaagggtcagtaaaagaaatcaagcatagtcctgggcccacgagaacagtctccactggcacggcattgtctaaatataggagcagatctgcagatggggccaagaattacttcgaacatgaggagttaactgtgagccagctcctgctgtgcctaagggaagggaatcagaaggtggagagacttgaagttgcactcaaggaggccaaagaaagtatgaaataggttaacttgaaatatgtgtttttttaaaacagctttcctgagatataattaagataccatacagttcacccatttaaagtatacatttcagtgttttttagaatattccaggattgtgcaaccactgttactacaatataattttagaacattttttcccccaaacagcactcactgtctgctcctccaagcaatgtgctttctgtctctatagatttggccattctagacatttcatataaatggaattata

SEQ ID NO: 445839 - DNA, 1088 bp, Homo sapiens
atgggatgggcggggccgggaaattccccggcgcgggcagggagcggctggctgtcagctgagccgcgctgggcggggtcgccaggccgcgcatcagccctaggcaccccagtcccggctgccccctccgccaccgccgccgcccgccggcaggttccctggtcagcgtcccatcccggtcgggagttctctccaggcggcacgatgccgaggaaacagtgaccctgagcgaagccaagccgggcggcaggaacttctgcaatgtcccatcaacctctcagctgcctcactgaaaaggaggacagccccagtgaaagcacaggaaatggacccccccacctggcccacccaaacctggacacgtttaccccggaggagctgctgcagcagatgaaagagctcctgaccgagaaccaccagctgaaagaagccatgaagctaaataatcaagccatgaaagggagatttgaggagctttcggcctggacagagaaacagaaggaagaacgccagttttttgagatacagagcaaagaagcaaaagagcgtctaatggccttgagtcatgagaatgagaaattgaaggaagagcttggaaaactaaaagggaaatcagaaaggtcatctgaggaccccactgatgactccaggcttcccagggccgaagcggagcaggaaaaggaccagctcaggacccaggtggtgaggctacaagcagagaaggcagacctgttgggcatcgtgtctgaactgcagctcaagctgaactccagcggctcctcagaagattcctttgttgaaattaggatggctgaaggagaagcagaagggtcagtaaaagaaatcaagcatagtcctgggcccacgagaacagtctccactggcacgtatgtgaaggaagactcgggctgtcaggcagacaggctgggcaggctcgtcactgggtgcttgtcaccggaggtcaaatgttgtgacctgaggaagtaacttctttatgatttataccaggatctttccagaatatttggtttgaatgctatttaatgttgcagctcaaactggcaaagattaaaaactgtttggttcct

SEQ ID NO: 445840 - DNA, 646 bp, Homo sapiens
ctactacttataaattagcggccgggtcaactgcctattttcttcctaggttaggttatatcttcataatcacaagaattagtgatggcaaaataaaattttgcttatgaatcttttacattgtttatatatgattaatatcatcatatatattttctgtattaagctcatttggcttcatttaagctgtatacttagtcatatatctttcattagttctatggatatgagcagatccctttactggagcccagtatgtgctgtgtgagttagaagtcattcttgctgagaaggtgaataggtagggatttgccttgttttgtaagtctacaatttgccaagagtaaataacactggaccagctgtaaaagtaaacagtgtgtttatgcattgagatactaaagcatttaagaaaaaattaaaagatctcttttgtttaaaggtctacacaacacaccaccaaacgagacgcaatacaacatccacagatgtgaacacacccaaaaaaaacaattcccacaggagagagcgcgcgcaaaggggcaggaacacacagaggggggccgcgcacacgttgtggccccacaagaggggaaaaatgaaagcggaaacaggcaacagtatcctcgtagaaagtttccgccaa

SEQ ID NO: 445841 - DNA, 801 bp, Homo sapiens
atgggatgggcggggccgggaaattccccggcgcgggcagggagcggctggctgtcagctgagccgcgctgggcggggtcgccaggccgcgcatcagccctaggcaccccagtcccggctgccccctccgccaccgccgccgcccgccggcaggttccctggtcagcgtcccatcccggtcgggagttctctccaggcggcacgatgccgaggaaacagtgaccctgagcgaagccaagccgggcggcaggaacttctgcaatgtcccatcaacctctcagctgcctcactgaaaaggaggacagccccagtgaaagcacaggaaatggacccccccacctggcccacccaaacctggacacgtttaccccggaggagctgctgcagcagatgaaagagctcctgaccgagaaccaccagctgaaaggtacaagtaaaaactgtgtgtatctcaaggaagtagcataatgatatttagcccattcaaaaggaaaaagaggctgggcgtggtggctcatgcctgtcattccatcactttgggaggccgaggcagaaggattgcttgagtacaggagttcaagaccagcctgggcaagatggcaagacctgatctctacaaaaaattaaaaaaaaaaaaaaaaaagctgggcgtggtggtgcacgcctctggtcctagctactggggatgctgaggttggaggattgcgtgagcctgggaagttggagctgcagtgagccatgatcgtgccactgcactttagcctggatgacagagagagaccctgactcaaaaaaaaaaaa

SEQ ID NO: 445842 - DNA, 996 bp, Homo sapiens
ggctaggtagaggctggtggtaatcggccgagggctgccctcgcacgccgcccgccggcaggttccctggtcagcgtcccatcccggtcgggagttctctccaggcggcacgatgccgaggaaacagtgaccctgagcgaagccaagccgggcggcaggaacttctgcaatgtcccatcaacctctcagctgcctcactgaaaaggaggacagccccagtgaaagcacaggaaatggacccccccacctggcccacccaaacctggacacgtttaccccggaggagctgctgcagcagatgaaagagctcctgaccgagaaccaccagctgaaagaagccatgaagctaaataatcaagccatgaaagggagatttgaggagctttcggcctggacagagaaacagaaggaagaacgccagttttttgagatacagagcaaagaagcaaaagagcgtctaatggccttgagtcatgagaatgagaaattgaaggaagagcttggaaaactaaaagggaaatcagaaaggtcatctgaggaccccactgatgactccaggcttcccagggccgaagcggagcaggaaaaggaccagctcaggacccaggtggtgaggctacaagcagagaaggcagacctgttgggcatcgtgtctgaactgcagctcaagctgaactccagcggctcctcagaagattcctttgttgaaattaggatggctgaaggagaagcagaagggtcagtaaaagaaatcaagcatagtcctgggcccacgagaacagtctccactggcacgtatgtgaaggaagactcgggctgtcaggcagacaggctgggcaggctcgtcactgggtgcttgtcaccggaggtcaaatgttgtgacctgaggaagtaacttctttatgatttataccaggatctttccagaatatttggtttgaatgctatttaatgttgcagctcaaactggcaaagattaaaaactgtttggttcct

SEQ ID NO: 445843 - DNA, 3841 bp, Homo sapiens
atgggatgggcggggccgggaaattccccggcgcgggcagggagcggctggctgtcagctgagccgcgctgggcggggtcgccaggccgcgcatcagccctaggcaccccagtcccggctgccccctccgcgccgcccgccggcaggttccctggtcagcgtcccatcccggtcgggagttctctccaggcggcacgatgccgaggaaacagtgaccctgagcgaagccaagccgggcggcaggtgtggctttgatagctggtggtgccacttcctggccttggatgagccgtacgcctctgtaaacccaacttcctcacctttgaaacagctgcctggttcagcattaatgaagattagtcagtgacaggcctggtgtgctgagtccgcacatagaagaatcaaaaatgtccaaaatgtaactggagagaaagtgggcaacttttggagaacttctgcaatgtcccatcaacctctcagctgcctcactgaaaaggaggacagccccagtgaaagcacaggaaatggacccccccacctggcccacccaaacctggacacgtttaccccggaggagctgctgcagcagatgaaagagctcctgaccgagaaccaccagctgaaagaagccatgaagctaaataatcaagccatgaaagggagatttgaggagctttcggcctggacagagaaacagaaggaagaacgccagttttttgagatacagagcaaagaagcaaaagagcgtctaatggccttgagtcatgagaatgagaaattgaaggaagagcttggaaaactaaaagggaaatcagaaaggtcatctgaggaccccactgatgactccaggcttcccagggccgaagcggagcaggaaaaggaccagctcaggacccaggtggtgaggctacaagcagagaaggcagacctgttgggcatcgtgtctgaactgcagctcaagctgaactccagcggctcctcagaagattcctttgttgaaattaggatggctgaaggagaagcagaagggtcagtaaaagaaatcaagcatagtcctgggcccacgagaacagtctccactggcacggcattgtctaaatataggagcagatctgcagatggggccaagaattacttcgaacatgaggagttaactgtgagccagctcctgctgtgcctaagggaagggaatcagaaggtggagagacttgaagttgcactcaaggaggccaaagaaagagtttcagattttgaaaagaaaacaagtaatcgttctgagattgaaacccagacagaggggagcacagagaaagagaatgatgaagagaaaggcccggagactgttggaagcgaagtggaagcactgaacctccaggtgacatctctgtttaaggagcttcaagaggctcatacaaaactcagcgaagctgagctaatgaagaagagacttcaagaaaagtgtcaggcccttgaaaggaaaaattctgcaattccatcagagttgaatgaaaagcaagagcttgtttatactaacaaaaagttagagctacaagtggaaagcatgctatcagaaatcaaaatggaacaggctaaaacagaggatgaaaagtccaaattaactgtgctacagatgacacacaacaagcttcttcaagaacataataatgcattgaaaacaattgaggaactaacaagaaaagagtcagaaaaagtggacagggcagtgctgaaggaactgagtgaaaaactggaactggcagagaaggctctggcttccaaacagctgcaaatggatgaaatgaagcaaaccattgccaagcaggaagaggacctggaaaccatgaccatcctcagggctcagatggaagtttactgttctgattttcatgctgaaagagcagcgagagagaaaattcatgaggaaaaggagcaactggcattgcagctggcagttctgctgaaagagaatgatgctttcgaagacggaggcaggcagtccttgatggagatgcagagtcgtcatggggcgagaacaagtgactctgaccagcaggcttaccttgttcaaagaggagctgaggacagggactggcggcaacagcggaatattccgattcattcctgccccaagtgtggagaggttctgcctgacatagacacgttacagattcacgtgatggattgcatcatttaagtgttgatgtatcacctccccaaaactgttggtaaatgtcagattttttcctccaagagttgtgcttttgtgttatttgttttcactcaaatattttgcctcattattcttgttttaaaagaaagaaaacaggccgggcacagtggctcatgcctgtaatcccagcactttgggaggtcgaggtgggtggatcacttggggtcagggtttgagaccagcctggccaacatggcggaaccctgtctctaccaaaattacaaaaattagccgagcatggtggcgcatgcctgtagtcgcagctactcgcgaggttgaggcaggagaattgcttgaacccaggaagtggcagttgcagtgagccgagacgacaccactgcactccagcctgggtgacagagggagactctgtctcgaaagaaagaaagaaaaaaaggaaggaaggagaaggaaggaaggagaagaaaaggtacctgttctacgtagaacacctttggtggagttccatcaactcgcaaagtagaatccttacctactactcttctgataataattttaatattttttatgtttggttgatgcgagcagctgcactgctcatgcagttagctagcatgtgacatcatgtgacaaagttcatgtaattagatggaagaaacctcactgattaattttaagaaccttttagggatgcaggaacaatgaagtggccacagtatgtgctgtttttgaagcatttttaaaaacgaattgtagttgtttttcttcatttaaaatggatctgttggaggttatgtgtgtatgttgtagttttattgcagccacaataattttaccaaagttttcacataggcagttagcctttacttaatatcaagacaagtgaaaaaatattggcatcgatgaaaccgataacattggcctcattggatttctttacccattcacagtgtaaagaagttaccttcatgctttcattgtacctgcaggcctgtgggcttgtacagtagataattaatttctaaaaagaacagctgcctattttcttcctaggttaggttatatcttcataatcacaagaattagtgatggcaaaataaaattttgcttatgaatcttttacattgtttatatatgattaatatcatcatatatattttctgtattaagctcatttggcttcatttaagctgtatacttagtcatatatctttcattagttctatggatatgagcagatccctttactggagcccagtatgtgctgtgtgagttagaagtcattcttgctgagaaggtgaataggtagggatttgccttgttttgtaagtctacaatttgccaagagtaaataacactggaccagctgtaaaagtaaacagtgtgtttatgcattgagatactaaagcatttaagaaaaaattaaaagatctcttttgtttaaaggtctacacaacacaccaccaaacgagacgcaatacaacatccacagatgtgaacacacccaaaaaaaacaattcccacaggagagagcgcgcgcaaaggggcaggaacacacagaggggggccgcgcacacgttgtggccccacaagaggggaaaaatgaaagcggaaacaggcaacagtatcctcgtagaaagtttccgccaa

SEQ ID NO: 445844 - DNA, 3649 bp, Homo sapiens
atgggatgggcggggccgggaaattccccggcgcgggcagggagcggctggctgtcagctgagccgcgctgggcggggtcgccaggccgcgcatcagccctaggcaccccagtcccggctgccccctccgtgggcggggtcgccaggccgcgcatcagccctaggcaccccagtcccggctgccccctccgccaccgccgccgcccgccggcaggttccctggtcagcgtcccatcccggtcgggagttctctccaggcggcacgatgccgaggaaacagtgaccctgagcgaagccaagccgggcggcaggaacttctgcaatgtcccatcaacctctcagctgcctcactgaaaaggaggacagccccagtgaaagcacaggaaatggacccccccacctggcccacccaaacctggacacgtttaccccggaggagctgctgcagcagatgaaagagctcctgaccgagaaccaccagctgaaagaagccatgaagctaaataatcaagccatgaaagggagatttgaggagctttcggcctggacagagaaacagaaggaagaacgccagttttttgagatacagagcaaagaagcaaaagagcgtctaatggccttgagtcatgagaatgagaaattgaaggaagagcttggaaaactaaaagggaaatcagaaaggtcatctgaggaccccactgatgactccaggcttcccagggccgaagcggagcaggaaaaggaccagctcaggacccaggtggtgaggctacaagcagagaaggcagacctgttgggcatcgtgtctgaactgcagctcaagctgaactccagcggctcctcagaagattcctttgttgaaattaggatggctgaaggagaagcagaagggtcagtaaaagaaatcaagcatagtcctgggcccacgagaacagtctccactggcacggcattgtctaaatataggagcagatctgcagatggggccaagaattacttcgaacatgaggagttaactgtgagccagctcctgctgtgcctaagggaagggaatcagaaggtggagagacttgaagttgcactcaaggaggccaaagaaagagtttcagattttgaaaagaaaacaagtaatcgttctgagattgaaacccagacagaggggagcacagagaaagagaatgatgaagagaaaggcccggagactgttggaagcgaagtggaagcactgaacctccaggtgacatctctgtttaaggagcttcaagaggctcatacaaaactcagcgaagctgagctaatgaagaagagacttcaagaaaagtgtcaggcccttgaaaggaaaaattctgcaattccatcagagttgaatgaaaagcaagagcttgtttatactaacaaaaagttagagctacaagtggaaagcatgctatcagaaatcaaaatggaacaggctaaaacagaggatgaaaagtccaaattaactgtgctacagatgacacacaacaagcttcttcaagaacataataatgcattgaaaacaattgaggaactaacaagaaaagagtcagaaaaagtggacagggcagtgctgaaggaactgagtgaaaaactggaactggcagagaaggctctggcttccaaacagctgcaaatggatgaaatgaagcaaaccattgccaagcaggaagaggacctggaaaccatgaccatcctcagggctcagatggaagtttactgttctgattttcatgctgaaagagcagcgagagagaaaattcatgaggaaaaggagcaactggcattgcagctggcagttctgctgaaagagaatgatgctttcgaagacggaggcaggcagtccttgatggagatgcagagtcgtcatggggcgagaacaagtgactctgaccagcaggcttaccttgttcaaagaggagctgaggacagggactggcggcaacagcggaatattccgattcattcctgccccaagtgtggagaggttctgcctgacatagacacgttacagattcacgtgatggattgcatcatttaagtgttgatgtatcacctccccaaaactgttggtaaatgtcagattttttcctccaagagttgtgcttttgtgttatttgttttcactcaaatattttgcctcattattcttgttttaaaagaaagaaaacaggccgggcacagtggctcatgcctgtaatcccagcactttgggaggtcgaggtgggtggatcacttggggtcagggtttgagaccagcctggccaacatggcggaaccctgtctctaccaaaattacaaaaattagccgagcatggtggcgcatgcctgtagtcgcagctactcgcgaggttgaggcaggagaattgcttgaacccaggaagtggcagttgcagtgagccgagacgacaccactgcactccagcctgggtgacagagggagactctgtctcgaaagaaagaaagaaaaaaaggaaggaaggagaaggaaggaaggagaagaaaaggtacctgttctacgtagaacacctttggtggagttccatcaactcgcaaagtagaatccttacctactactcttctgataataattttaatattttttatgtttggttgatgcgagcagctgcactgctcatgcagttagctagcatgtgacatcatgtgacaaagttcatgtaattagatggaagaaacctcactgattaattttaagaaccttttagggatgcaggaacaatgaagtggccacagtatgtgctgtttttgaagcatttttaaaaacgaattgtagttgtttttcttcatttataattttaccaaagttttcacataggcagttagcctttacttaatatcaagacaagtgaaaaaatattggcatcgatgaaaccgataacattggcctcattggatttctttacccattcacagtgtaaagaagttaccttcatgctttcattgtacctgcaggcctgtgggcttgtacagtagataattaatttctaaaaagaacagctgcctattttcttcctaggttaggttatatcttcataatcacaagaattagtgatggcaaaataaaattttgcttatgaatcttttacattgtttatatatgattaatatcatcatatatattttctgtattaagctcatttggcttcatttaagctgtatacttagtcatatatctttcattagttctatggatatgagcagatccctttactggagcccagtatgtgctgtgtgagttagaagtcattcttgctgagaaggtgaataggtagggatttgccttgttttgtaagtctacaatttgccaagagtaaataacactggaccagctgtaaaagtaaacagtgtgtttatgcattgagatactaaagcatttaagaaaaaattaaaagatctcttttgtttaaaggtctacacaacacaccaccaaacgagacgcaatacaacatccacagatgtgaacacacccaaaaaaaacaattcccacaggagagagcgcgcgcaaaggggcaggaacacacagaggggggccgcgcacacgttgtggccccacaagaggggaaaaatgaaagcggaaacaggcaacagtatcctcgtagaaagtttccgccaa

SEQ ID NO: 445845 - DNA, 3794 bp, Homo sapiens
atgggatgggcggggccgggaaattccccggcgcgggcagggagcggctggctgtcagctgagccgcgctgggcggggtcgccaggccgcgcatcagccctaggcaccccagtcccggctgccccctccgccaccgccgccgcccgccggcaggttccctggtcagcgtcccatcccggtcgggagttctctccaggcggcacgatgccgaggaaacagtgaccctgagcgaagccaagccgggcggcaggtgtggctttgatagctggtggtgccacttcctggccttggatgagccgtacgcctctgtaaacccaacttcctcacctttgaaacagctgcctggttcagcattaatgaagattagtcagtgacaggcctggtgtgctgagtccgcacatagaacttctgcaatgtcccatcaacctctcagctgcctcactgaaaaggaggacagccccagtgaaagcacaggaaatggacccccccacctggcccacccaaacctggacacgtttaccccggaggagctgctgcagcagatgaaagagctcctgaccgagaaccaccagctgaaagaagccatgaagctaaataatcaagccatgaaagggagatttgaggagctttcggcctggacagagaaacagaaggaagaacgccagttttttgagatacagagcaaagaagcaaaagagcgtctaatggccttgagtcatgagaatgagaaattgaaggaagagcttggaaaactaaaagggaaatcagaaaggtcatctgaggaccccactgatgactccaggcttcccagggccgaagcggagcaggaaaaggaccagctcaggacccaggtggtgaggctacaagcagagaaggcagacctgttgggcatcgtgtctgaactgcagctcaagctgaactccagcggctcctcagaagattcctttgttgaaattaggatggctgaaggagaagcagaagggtcagtaaaagaaatcaagcatagtcctgggcccacgagaacagtctccactggcacggcattgtctaaatataggagcagatctgcagatggggccaagaattacttcgaacatgaggagttaactgtgagccagctcctgctgtgcctaagggaagggaatcagaaggtggagagacttgaagttgcactcaaggaggccaaagaaagagtttcagattttgaaaagaaaacaagtaatcgttctgagattgaaacccagacagaggggagcacagagaaagagaatgatgaagagaaaggcccggagactgttggaagcgaagtggaagcactgaacctccaggtgacatctctgtttaaggagcttcaagaggctcatacaaaactcagcgaagctgagctaatgaagaagagacttcaagaaaagtgtcaggcccttgaaaggaaaaattctgcaattccatcagagttgaatgaaaagcaagagcttgtttatactaacaaaaagttagagctacaagtggaaagcatgctatcagaaatcaaaatggaacaggctaaaacagaggatgaaaagtccaaattaactgtgctacagatgacacacaacaagcttcttcaagaacataataatgcattgaaaacaattgaggaactaacaagaaaagagtcagaaaaagtggacagggcagtgctgaaggaactgagtgaaaaactggaactggcagagaaggctctggcttccaaacagctgcaaatggatgaaatgaagcaaaccattgccaagcaggaagaggacctggaaaccatgaccatcctcagggctcagatggaagtttactgttctgattttcatgctgaaagagcagcgagagagaaaattcatgaggaaaaggagcaactggcattgcagctggcagttctgctgaaagagaatgatgctttcgaagacggaggcaggcagtccttgatggagatgcagagtcgtcatggggcgagaacaagtgactctgaccagcaggcttaccttgttcaaagaggagctgaggacagggactggcggcaacagcggaatattccgattcattcctgccccaagtgtggagaggttctgcctgacatagacacgttacagattcacgtgatggattgcatcatttaagtgttgatgtatcacctccccaaaactgttggtaaatgtcagattttttcctccaagagttgtgcttttgtgttatttgttttcactcaaatattttgcctcattattcttgttttaaaagaaagaaaacaggccgggcacagtggctcatgcctgtaatcccagcactttgggaggtcgaggtgggtggatcacttggggtcagggtttgagaccagcctggccaacatggcggaaccctgtctctaccaaaattacaaaaattagccgagcatggtggcgcatgcctgtagtcgcagctactcgcgaggttgaggcaggagaattgcttgaacccaggaagtggcagttgcagtgagccgagacgacaccactgcactccagcctgggtgacagagggagactctgtctcgaaagaaagaaagaaaaaaaggaaggaaggagaaggaaggaaggagaagaaaaggtacctgttctacgtagaacacctttggtggagttccatcaactcgcaaagtagaatccttacctactactcttctgataataattttaatattttttatgtttggttgatgcgagcagctgcactgctcatgcagttagctagcatgtgacatcatgtgacaaagttcatgtaattagatggaagaaacctcactgattaattttaagaaccttttagggatgcaggaacaatgaagtggccacagtatgtgctgtttttgaagcatttttaaaaacgaattgtagttgtttttcttcatttaaaatggatctgttggaggttatgtgtgtatgttgtagttttattgcagccacaataattttaccaaagttttcacataggcagttagcctttacttaatatcaagacaagtgaaaaaatattggcatcgatgaaaccgataacattggcctcattggatttctttacccattcacagtgtaaagaagttaccttcatgctttcattgtacctgcaggcctgtgggcttgtacagtagataattaatttctaaaaagaacagctgcctattttcttcctaggttaggttatatcttcataatcacaagaattagtgatggcaaaataaaattttgcttatgaatcttttacattgtttatatatgattaatatcatcatatatattttctgtattaagctcatttggcttcatttaagctgtatacttagtcatatatctttcattagttctatggatatgagcagatccctttactggagcccagtatgtgctgtgtgagttagaagtcattcttgctgagaaggtgaataggtagggatttgccttgttttgtaagtctacaatttgccaagagtaaataacactggaccagctgtaaaagtaaacagtgtgtttatgcattgagatactaaagcatttaagaaaaaattaaaagatctcttttgtttaaaggtctacacaacacaccaccaaacgagacgcaatacaacatccacagatgtgaacacacccaaaaaaaacaattcccacaggagagagcgcgcgcaaaggggcaggaacacacagaggggggccgcgcacacgttgtggccccacaagaggggaaaaatgaaagcggaaacaggcaacagtatcctcgtagaaagtttccgccaa

SEQ ID NO: 445846 - DNA, 3257 bp, Homo sapiens
tgaattgcagctccaggctgaactccagcggctcctcagaagattcctttgttgaaattaggatggctgaaggagacgcagacgggttaggtaaaagaaatcaggcatagtcctgggcccacgtagaacagtctccactggcacgagcagatctgcagatggggccaagggccttgagtcatgagaatgagaaattgaaggaagagcttggaaaactaaaagggaaatcagaaaggtcatctgaggaccccactgatgactccaggcttcccagggccgaagcggagcaggaaaaggaccagctcaggacccaggtggtgaggctacaagcagagaaggcagacctgttgggcatcgtgtctgaactgcagctcaagctgaactccagcggctcctcagaagattcctttgttgaaattaggatggctgaaggagaagcagaagggtcagtaaaagaaatcaagcatagtcctgggcccacgagaacagtctccactggcacggcattgtctaaatataggagcagatctgcagatggggccaagaattacttcgaacatgaggagttaactgtgagccagctcctgctgtgcctaagggaagggaatcagaaggtggagagacttgaagttgcactcaaggaggccaaagaaagagtttcagattttgaaaagaaaacaagtaatcgttctgagattgaaacccagacagaggggagcacagagaaagagaatgatgaagagaaaggcccggagactgttggaagcgaagtggaagcactgaacctccaggtgacatctctgtttaaggagcttcaagaggctcatacaaaactcagcgaagctgagctaatgaagaagagacttcaagaaaagtgtcaggcccttgaaaggaaaaattctgcaattccatcagagttgaatgaaaagcaagagcttgtttatactaacaaaaagttagagctacaagtggaaagcatgctatcagaaatcaaaatggaacaggctaaaacagaggatgaaaagtccaaattaactgtgctacagatgacacacaacaagcttcttcaagaacataataatgcattgaaaacaattgaggaactaacaagaaaagagtcagaaaaagtggacagggcagtgctgaaggaactgagtgaaaaactggaactggcagagaaggctctggcttccaaacagctgcaaatggatgaaatgaagcaaaccattgccaagcaggaagaggacctggaaaccatgaccatcctcagggctcagatggaagtttactgttctgattttcatgctgaaagagcagcgagagagaaaattcatgaggaaaaggagcaactggcattgcagctggcagttctgctgaaagagaatgatgctttcgaagacggaggcaggcagtccttgatggagatgcagagtcgtcatggggcgagaacaagtgactctgaccagcaggcttaccttgttcaaagaggagctgaggacagggactggcggcaacagcggaatattccgattcattcctgccccaagtgtggagaggttctgcctgacatagacacgttacagattcacgtgatggattgcatcatttaagtgttgatgtatcacctccccaaaactgttggtaaatgtcagattttttcctccaagagttgtgcttttgtgttatttgttttcactcaaatattttgcctcattattcttgttttaaaagaaagaaaacaggccgggcacagtggctcatgcctgtaatcccagcactttgggaggtcgaggtgggtggatcacttggggtcagggtttgagaccagcctggccaacatggcggaaccctgtctctaccaaaattacaaaaattagccgagcatggtggcgcatgcctgtagtcgcagctactcgcgaggttgaggcaggagaattgcttgaacccaggaagtggcagttgcagtgagccgagacgacaccactgcactccagcctgggtgacagagggagactctgtctcgaaagaaagaaagaaaaaaaggaaggaaggagaaggaaggaaggagaagaaaaggtacctgttctacgtagaacacctttggtggagttccatcaactcgcaaagtagaatccttacctactactcttctgataataattttaatattttttatgtttggttgatgcgagcagctgcactgctcatgcagttagctagcatgtgacatcatgtgacaaagttcatgtaattagatggaagaaacctcactgattaattttaagaaccttttagggatgcaggaacaatgaagtggccacagtatgtgctgtttttgaagcatttttaaaaacgaattgtagttgtttttcttcatttaaaatggatctgttggaggttatgtgtgtatgttgtagttttattgcagccacaataattttaccaaagttttcacataggcagttagcctttacttaatatcaagacaagtgaaaaaatattggcatcgatgaaaccgataacattggcctcattggatttctttacccattcacagtgtaaagaagttaccttcatgctttcattgtacctgcaggcctgtgggcttgtacagtagataattaatttctaaaaagaacagctgcctattttcttcctaggttaggttatatcttcataatcacaagaattagtgatggcaaaataaaattttgcttatgaatcttttacattgtttatatatgattaatatcatcatatatattttctgtattaagctcatttggcttcatttaagctgtatacttagtcatatatctttcattagttctatggatatgagcagatccctttactggagcccagtatgtgctgtgtgagttagaagtcattcttgctgagaaggtgaataggtagggatttgccttgttttgtaagtctacaatttgccaagagtaaataacactggaccagctgtaaaagtaaacagtgtgtttatgcattgagatactaaagcatttaagaaaaaattaaaagatctcttttgtttaaaggtctacacaacacaccaccaaacgagacgcaatacaacatccacagatgtgaacacacccaaaaaaaacaattcccacaggagagagcgcgcgcaaaggggcaggaacacacagaggggggccgcgcacacgttgtggccccacaagaggggaaaaatgaaagcggaaacaggcaacagtatcctcgtagaaagtttccgccaa

SEQ ID NO: 445847 - DNA, 1998 bp, Homo sapiens
  misc_feature (1)..(1): n is a, c, g, or t
nctcaaggatccttaattttattaatccccccccccctttttcatgctgaaagagcagcgagagagaaaattcatgaggaaaaggagcaactggcattgcagctggcagttctgctgaaagagaatgatgctttcgaagacggaggcaggcagtccttgatggagatgcagagtcgtcatggggcgagaacaagtgactctgaccagcaggcttaccttgttcaaagaggagctgaggacagggactggcggcaacagcggaatattccgattcattcctgccccaagtgtggagaggttctgcctgacatagacacgttacagattcacgtgatggattgcatcatttaagtgttgatgtatcacctccccaaaactgttggtaaatgtcagattttttcctccaagagttgtgcttttgtgttatttgttttcactcaaatattttgcctcattattcttgttttaaaagaaagaaaacaggccgggcacagtggctcatgcctgtaatcccagcactttgggaggtcgaggtgggtggatcacttggggtcagggtttgagaccagcctggccaacatggcggaaccctgtctctaccaaaattacaaaaattagccgagcatggtggcgcatgcctgtagtcgcagctactcgcgaggttgaggcaggagaattgcttgaacccaggaagtggcagttgcagtgagccgagacgacaccactgcactccagcctgggtgacagagggagactctgtctcgaaagaaagaaagaaaaaaaggaaggaaggagaaggaaggaaggagaagaaaaggtacctgttctacgtagaacacctttggtggagttccatcaactcgcaaagtagaatccttacctactactcttctgataataattttaatattttttatgtttggttgatgcgagcagctgcactgctcatgcagttagctagcatgtgacatcatgtgacaaagttcatgtaattagatggaagaaacctcactgattaattttaagaaccttttagggatgcaggaacaatgaagtggccacagtatgtgctgtttttgaagcatttttaaaaacgaattgtagttgtttttcttcatttaaaatggatctgttggaggttatgtgtgtatgttgtagttttattgcagccacaataattttaccaaagttttcacataggcagttagcctttacttaatatcaagacaagtgaaaaaatattggcatcgatgaaaccgataacattggcctcattggatttctttacccattcacagtgtaaagaagttaccttcatgctttcattgtacctgcaggcctgtgggcttgtacagtagataattaatttctaaaaagaacagctgcctattttcttcctaggttaggttatatcttcataatcacaagaattagtgatggcaaaataaaattttgcttatgaatcttttacattgtttatatatgattaatatcatcatatatattttctgtattaagctcatttggcttcatttaagctgtatacttagtcatatatctttcattagttctatggatatgagcagatccctttactggagcccagtatgtgctgtgtgagttagaagtcattcttgctgagaaggtgaataggtagggatttgccttgttttgtaagtctacaatttgccaagagtaaataacactggaccagctgtaaaagtaaacagtgtgtttatgcattgagatactaaagcatttaagaaaaaattaaaagatctcttttgtttaaaggtctacacaacacaccaccaaacgagacgcaatacaacatccacagatgtgaacacacccaaaaaaaacaattcccacaggagagagcgcgcgcaaaggggcaggaacacacagaggggggccgcgcacacgttgtggccccacaagaggggaaaaatgaaagcggaaacaggcaacagtatcctcgtagaaagtttccgccaa

SEQ ID NO: 445848 - DNA, 1649 bp, Homo sapiens
atgggatgggcggggccgggaaattccccggcgcgggcagggagcggctggctgtcagctgagccgcgctgggcggggtcgccaggccgcgcatcagccctaggcaccccagtcccggctgccccctccgtgggcggggtcgccaggccgcgcatcagccctaggcaccccagtcccggctgccccctccgccaccgccgccgcccgccggcaggttccctggtcagcgtcccatcccggtcgggagttctctccaggcggcacgatgccgaggaaacagtgaccctgagcgaagccaagccgggcggcaggaacttctgcaatgtcccatcaacctctcagctgcctcactgaaaaggaggacagccccagtgaaagcacaggaaatggacccccccacctggcccacccaaacctggacacgtttaccccggaggagctgctgcagcagatgaaagagctcctgaccgagaaccaccagctgaaagaagccatgaagctaaataatcaagccatgaaagggagatttgaggagctttcggcctggacagagaaacagaaggaagaacgccagttttttgagatacagagcaaagaagcaaaagagcgtctaatggccttgagtcatgagaatgagaaattgaaggaagagcttggaaaactaaaagggaaatcagaaaggtcatctgaggaccccactgatgactccaggcttcccagggccgaagcggagcaggaaaaggaccagctcaggacccaggtggtgaggctacaagcagagaaggcagacctgttgggcatcgtgtctgaactgcagctcaagctgaactccagcggctcctcagaagattcctttgttgaaattaggatggctgaaggagaagcagaagggtcagtaaaagaaatcaagcatagtcctgggcccacgagaacagtctccactggcacggcattgtctaaatataggagcagatctgcagatggggccaagaattacttcgaacatgaggagttaactgtgagccagctcctgctgtgcctaagggaagggaatcagaaggtggagagacttgaagttgcactcaaggaggccaaagaaagagtttcagattttgaaaagaaaacaagtaatcgttctgagattgaaacccagacagaggggagcacagagaaagagaatgatgaagagaaaggcccggagactgttggaagcgaagtggaagcactgaacctccaggtgacatctctgtttaaggagcttcaagaggctcatacaaaactcagcgaagctgagctaatgaagaagagacttcaagaaaagtaagaatgagagagcaattttatcctcctttgaaatatacatttttacaaagtatactactatataaaaacatagttttttaactatgttatgactaaaagaaaaatagacacctaattaaaatataaattcagaatatactaatgttccagttaatgtgtgagcatgaaatacttgtaagatggggggttggggactggagaactttaattctgccatttaggggcatttgttaaatgtacgagcctgggtaagatctctacagtaaagctgtgagctagttttcctgttactgacttaagctgatgacattgatgtgagtaagcat

SEQ ID NO: 445849 - DNA, 293 bp, Homo sapiens
ttgaatacgaagttgaactgatgttaaaactcgccatctgttcttcaagtgaaacaaacacaactgcctgcaaaatggaactaatggaattatcatacttattcccaggagctgaggacagggactggcggcaacagcggaatattccgattcattcctgccccaagtgtggagaggttctgcctgacatagacacgttacagattcacgtgatggattgcatcatttaagtgttgatgtatcacctccccaaaactgttggtaaatgtcagattttttcctccaagagttgt

SEQ ID NO: 445850 - DNA, 283 bp, Homo sapiens
ggatccggttgcagtgagccgagatcgcgccattgcagtctaacctgggcaacaagagcaagactcaggctcaaaaaaaaaggagatcctgtcattggtaacaacataaatgttgttgcattcactatgcaatgttgtttcactatgttaagtgaaataagccaggcacagaaagacaaactttgaatgttcttatttctgggagataaaaagtaaagcaattgaactcatggacacagaaaaggatggttaccagaggctgtgaagggtaagggggtagtga

SEQ ID NO: 445851 - DNA, 4606 bp, Homo sapiens
  misc_feature (2395)..(2395): n is a, c, g, or t
  misc_feature (2430)..(2430): n is a, c, g, or t
  misc_feature (2595)..(2596): n is a, c, g, or t
  misc_feature (2982)..(2982): n is a, c, g, or t
  misc_feature (3347)..(3348): n is a, c, g, or t
  misc_feature (3544)..(3544): n is a, c, g, or t
  misc_feature (4157)..(4157): n is a, c, g, or t
gcctcgccaccagaggtttcccagagaggaaggcgtggctccctcccgggccagtgagccctggcgccgccgcggccgcggtcccagcagcggagtagggcggcggctgcgccccgcaccatggggggcagcccagccccagccgcggtaaacgccgacctccgccgccgcccgcgccgcgtctgccccctcccgctgcggctctctggacgccatcccctcctcacctcgaagccaacatgaaggagacccggggctacggaggggatgcccccttctgcacccgcctcaaccactcctacacaggcatgtgggcgcccgagcgttccgccgaggcgcggggcaacctcacgcgccctccagggtctggcgaggattgcggatcggtgtccgtggccttcccgatcaccatgctgctcactggtttcgtgggcaacgcactggccatgctgctcgtgtcgcgcagctaccggcgccgggagagcaagcgcaagaagtccttcctgctgtgcatcggctggctggcgctcaccgacctggtcgggcagcttctcaccaccccggtcgtcatcgtcgtgtacctgtccaagcagcgttgggagcacatcgacccgtcggggcggctctgcacctttttcgggctgaccatgactgttttcgggctctcctcgttgttcatcgccagcgccatggccgtcgagcgggcgctggccatcagggcgccgcactggtatgcgagccacatgaagacgcgtgccacccgcgctgtgctgctcggcgtgtggctggccgtgctcgccttcgccctgctgccggtgctgggcgtgggccagtacaccgtccagtggcccgggacgtggtgcttcatcagcaccgggcgagggggcaacgggactagctcttcgcataactggggcaaccttttcttcgcctctgcctttgccttcctggggctcttggcgctgacagtcaccttttcctgcaacctggccaccattaaggccctggtgtcccgctgccgggccaaggccacggcatctcagtccagtgcccagtggggccgcatcacgaccgagacggccattcagcttatggggatcatgtgcgtgctgtcggtctgctggtctccgctcctgataatgatgttgaaaatgatcttcaatcagacatcagttgagcactgcaagacacacacggagaagcagaaagaatgcaacttcttcttaatagctgttcgcctggcttcactgaaccagatcttggatccttgggtttacctgctgttaagaaagatccttcttcgaaagttttgccaggtagcaaatgctgtctccagctgctctaatgatggacagaaagggcagcctatctcattatctaatgaaataatacagacagaagcatgaaagaaaacacttaacttgcatgtgcacagcttttggtaacaaatatcgctaaaccttactgtgaatttaggcatctctggcatgccactgtttatgcattgaagtggaatttttggtataaagctaaatggtcttagaagcatagaaaatccctatgtgccaaaagtagtgaaacacaaacaaaggaaaatatattaataacagtctagtgtttttgttgagtctgccattcgtagctgaatatgtgattaattatgtgatgaaaacattttttataaatgatcttggtctattggggagcggggatagttaatattccagtacactgaatacatgaggaatttaaccacatacatcattgaagacaagggatagcagtttgtttttattcaaagacattgctgtgttctctttcattgcctctctcgctttctgtcacttttttcctccttacattaaagaaaagtttaattacagttaaaaatgtataatgtatttataatattcatcgataccattattcaaatattgctcaatacagcaaattagctcctaacctaacaaagtttaagtttacttggattgataattaggtttactctttatctgaataagaaccaattccatttgtttgaaatatggagtttgtgactacccaaattgctaattattctttcttttgaatatattttacatttctatgagcctaaggaagattcatgaaactgacctatgagagtcgtgaagtggtttttcagaatgctatgtaaggaccgatttgagcactaactataggtactctgaatatatatttcccttgattattcaccaaaagtgttccccagtctttgactctttaaattccaatactgattccaaaacaaataaatattttgaagactcaatgaatactttccatattttggcctatttatataagaaagttaataacattgacccttcacagctcttctgcctgctcctcaagnggctctatctaatatttattactaaaatgtttttnctacagtctacatgaatacaaacctcaatagctaagcttgacgtatttgtgcacaagtagatcactacattaagttttgggaattgcacttcttaaaaatgtctccccaccaaacatagtaatcctgtagttatgcctacacaaagcttgccatattctttggtnnattcattttgtaaacccattaactttttattgtgaagattttcatttgcagtttcttgcactgcttttctagttttttaaaagcttgagatttatttatacttcttgtagtaactgcatatttctgtgtgtgtttagtggtaaagaattaattttgataggtacaatatgtctatcagattgatatatacaccagcctatgtcaattggggctaattattttaaatgaccatgtcaaattgaatttggagacaaaatctgttgagagtgcttatgtaattaatgatggttctactaactaaattttggaaaaggtgataaatagactatactaaaatctctctatgccatagaattggattatcctgtaggtcatctcattgggtntaagacaaaactacctactttttttcaaaagtgcactgaaatcacataataaagaggctttacctcttggttggtcctgtgaccctaagttctagtcagatagacacagaggcaatgtgaatttgagtggcatgagcatgattaggttattccttccagcatctagtatagcacctggaatatagaaactgtctaatacatatttattcagtgaatcaatgagcagaagtttgccaggacagtacacattggcaaggcacataccatatgattgaagtgcttcatgccattacagtccatcaggctgataaagtgaattatttctgattatttaattacagaaatatgaatttatcttcaagggnntagtgtcatactgctgtacaacacagtgctttatttatactaataatttaggagactgatacttccaaatgatagtggacattactatcacaagaatatcacttttcatcaaactgcaaaaatacagaaaggcaaaaaacctgacacttattcttaactgcaaattaaattcctgcccaggggatatattttaggnggggatgaatggcagcttttgtgttttttttaacaagcttgaaagggggtggaaaacaaagaaattatgtaaatggcatatgagttttattatctaggcattcgttagtatggggaaacctgataagaaatgaaaatcccaaatgatttcagccttttcatgatggttgaggttagatttcagagatgtacagagactagagcggtggttagaaagaggatatatgtagtcacagcagaaagacgtgtctaagtttaattttattggctttcaagttcactcatgtatacttagtttgtccatacatatgtctaatcaggaaaaatgcatgtatagattatgacaattcctgaattttgaagtattggttaaaagacaattaaaggccaagaaaaccatggtggaagaagtaagcgaatgaaatgtagaaatatatgtaaaattagcaagtgtcaattttaccaagtagtgttgattttccaaacaatgaatttatatactatgctgagtcacagagaagaatgatcacatgttacttaatgagagcagtttacttttcaaataaaataggtatgatgaatgtcttaaaaatatcttgaagttgaagaaacanaaatgagttatctcaatatttaccaagttaacctagtgctgtatatatcccaagatattttaggtaaatgtaagtgtttaatcatgccagatttaaactagtctgaaatatagggtatacatatatttctacttacatttctttattttatgaaatatccgaccatgttgcagaaaataatgcaaaacctcatgtaagttaactatgaaagatcctgtgagcacattggcattgagtgacagacaaactaaaaactggcaaacagtattttaataagggggtcactctgtggcagtattctaatattggattttcaagtagattaggctttttatttattcaacgctttttataattttgttctttttgactccaaattattggtcagctttcaaccttctccacatcagcaatcactaatagttcttttggttgagatcaactcagaa

SEQ ID NO: 445852 - DNA, 1839 bp, Homo sapiens
gcctcgccaccagaggtttcccagagaggaaggcgtggctccctcccgggccagtgagccctggcgccgccgcggccgcggtcccagcagcggagtagggcggcggctgcgccccgcaccatggggggcagcccagccccagccgcggtaaacgccgacctccgccgccgcccgcgccgcgtctgccccctcccgctgcggctctctggacgccatcccctcctcacctcgaagccaacatgaaggagacccggggctacggaggggatgcccccttctgcacccgcctcaaccactcctacacaggcatgtgggcgcccgagcgttccgccgaggcgcggggcaacctcacgcgccctccagggtctggcgaggattgcggatcggtgtccgtggccttcccgatcaccatgctgctcactggtttcgtgggcaacgcactggccatgctgctcgtgtcgcgcagctaccggcgccgggagagcaagcgcaagaagtccttcctgctgtgcatcggctggctggcgctcaccgacctggtcgggcagcttctcaccaccccggtcgtcatcgtcgtgtacctgtccaagcagcgttgggagcacatcgacccgtcggggcggctctgcacctttttcgggctgaccatgactgttttcgggctctcctcgttgttcatcgccagcgccatggccgtcgagcgggcgctggccatcagggcgccgcactggtatgcgagccacatgaagacgcgtgccacccgcgctgtgctgctcggcgtgtggctggccgtgctcgccttcgccctgctgccggtgctgggcgtgggccagtacaccgtccagtggcccgggacgtggtgcttcatcagcaccgggcgagggggcaacgggactagctcttcgcataactggggcaaccttttcttcgcctctgcctttgccttcctggggctcttggcgctgacagtcaccttttcctgcaacctggccaccattaaggccctggtgtcccgctgccgggccaaggccacggcatctcagtccagtgcccagtggggccgcatcacgaccgagacggccattcagcttatggggatcatgtgcgtgctgtcggtctgctggtctccgctcctgataatgatgttgaaaatgatcttcaatcagacatcagttgagcactgcaagacacacacggagaagcagaaagaatgcaacttcttcttaatagctgttcgcctggcttcactgaaccagatcttggatccttgggtttacctgctgttaagaaagatccttcttcgaaagttttgccaggaggaattttggggaaattaaaacctgcctttctgccaggatcacatcactggaagctccatgactctctttttgtaaaagaaaaaaaaatcacagaaacacccacctcccaaactattctcttttacttcttcccccaagcccacccccaaatataactgttatccagaagctgttatgtcctgtttccatacatgtttttgtacttttactatatctacatacatcaattaaacttatgtcctattgttttgtgaatttatatttgcgtatacattatcatatgtaaaatttgcatttttttattgaaaattatgtttcttgagatttatccacattgaaacatggagctctaaatcgttaattttaaccgctatagagtattccataatttgaataaagcataatttgtttgtacaatctcccgccaagggaaaattatttccacactcatcatgacaaggagcactgcaaaaataaaaataaaaattacattcatacatgtttaactgcacccatctgc

SEQ ID NO: 445853 - DNA, 1866 bp, Homo sapiens
gcctcgccaccagaggtttcccagagaggaaggcgtggctccctcccgggccagtgagccctggcgccgccgcggccgcggtcccagcagcggagtagggcggcggctgcgccccgcaccatggggggcagcccagccccagccgcggtaaacgccgacctccgccgccgcccgcgccgcgtctgccccctcccgctgcggctctctggacgccatcccctcctcacctcgaagccaacatgaaggagacccggggctacggaggggatgcccccttctgcacccgcctcaaccactcctacacaggcatgtgggcgcccgagcgttccgccgaggcgcggggcaacctcacgcgccctccagggtctggcgaggattgcggatcggtgtccgtggccttcccgatcaccatgctgctcactggtttcgtgggcaacgcactggccatgctgctcgtgtcgcgcagctaccggcgccgggagagcaagcgcaagaagtccttcctgctgtgcatcggctggctggcgctcaccgacctggtcgggcagcttctcaccaccccggtcgtcatcgtcgtgtacctgtccaagcagcgttgggagcacatcgacccgtcggggcggctctgcacctttttcgggctgaccatgactgttttcgggctctcctcgttgttcatcgccagcgccatggccgtcgagcgggcgctggccatcagggcgccgcactggtatgcgagccacatgaagacgcgtgccacccgcgctgtgctgctcggcgtgtggctggccgtgctcgccttcgccctgctgccggtgctgggcgtgggccagtacaccgtccagtggcccgggacgtggtgcttcatcagcaccgggcgagggggcaacgggactagctcttcgcataactggggcaaccttttcttcgcctctgcctttgccttcctggggctcttggcgctgacagtcaccttttcctgcaacctggccaccattaaggccctggtgtcccgctgccgggccaaggccacggcatctcagtccagtgcccagtggggccgcatcacgaccgagacggccattcagcttatggggatcatgtgcgtgctgtcggtctgctggtctccgctcctgataatgatgttgaaaatgatcttcaatcagacatcagttgagcactgcaagacacacacggagaagcagaaagaatgcaacttcttcttaatagctgttcgcctggcttcactgaaccagatcttggatccttgggtttacctgctgttaagaaagatccttcttcgaaagttttgccagatgagaaaaagaagactcagagagcaagaggaattttggggaaattaaaacctgcctttctgccaggatcacatcactggaagctccatgactctctttttgtaaaagaaaaaaaaatcacagaaacacccacctcccaaactattctcttttacttcttcccccaagcccacccccaaatataactgttatccagaagctgttatgtcctgtttccatacatgtttttgtacttttactatatctacatacatcaattaaacttatgtcctattgttttgtgaatttatatttgcgtatacattatcatatgtaaaatttgcatttttttattgaaaattatgtttcttgagatttatccacattgaaacatggagctctaaatcgttaattttaaccgctatagagtattccataatttgaataaagcataatttgtttgtacaatctcccgccaagggaaaattatttccacactcatcatgacaaggagcactgcaaaaataaaaataaaaattacattcatacatgtttaactgcacccatctgc

SEQ ID NO: 445854 - DNA, 2035 bp, Homo sapiens
gcctcgccaccagaggtttcccagagaggaaggcgtggctccctcccgggccagtgagccctggcgccgccgcggccgcggtcccagcagcggagtagggcggcggctgcgccccgcaccatggggggcagcccagccccagccgcggtaaacgccgacctccgccgccgcccgcgccgcgtctgccccctcccgctgcggctctctggacgccatcccctcctcacctcgaagccaacatgaaggagacccggggctacggaggggatgcccccttctgcacccgcctcaaccactcctacacaggcatgtgggcgcccgagcgttccgccgaggcgcggggcaacctcacgcgccctccagggtctggcgaggattgcggatcggtgtccgtggccttcccgatcaccatgctgctcactggtttcgtgggcaacgcactggccatgctgctcgtgtcgcgcagctaccggcgccgggagagcaagcgcaagaagtccttcctgctgtgcatcggctggctggcgctcaccgacctggtcgggcagcttctcaccaccccggtcgtcatcgtcgtgtacctgtccaagcagcgttgggagcacatcgacccgtcggggcggctctgcacctttttcgggctgaccatgactgttttcgggctctcctcgttgttcatcgccagcgccatggccgtcgagcgggcgctggccatcagggcgccgcactggtatgcgagccacatgaagacgcgtgccacccgcgctgtgctgctcggcgtgtggctggccgtgctcgccttcgccctgctgccggtgctgggcgtgggccagtacaccgtccagtggcccgggacgtggtgcttcatcagcaccgggcgagggggcaacgggactagctcttcgcataactggggcaaccttttcttcgcctctgcctttgccttcctggggctcttggcgctgacagtcaccttttcctgcaacctggccaccattaaggccctggtgtcccgctgccgggccaaggccacggcatctcagtccagtgcccagtggggccgcatcacgaccgagacggccattcagcttatggggatcatgtgcgtgctgtcggtctgctggtctccgctcctgataatgatgttgaaaatgatcttcaatcagacatcagttgagcactgcaagacacacacggagaagcagaaagaatgcaacttcttcttaatagctgttcgcctggcttcactgaaccagatcttggatccttgggtttacctgctgttaagaaagatccttcttcgaaagttttgccagatgagaaaaagaagactcagagagcaagagatggggcctgatggaaggtgtttttgtcatgcatggaggcaggtccccaggacttggtgcagttctcatgatagagaaccctgcagtgtccagctaagctgatgacttgaagataaatctgcctaaccctgggatgaagtatctgtgaactattttgacagcagatgaggaattttggggaaattaaaacctgcctttctgccaggatcacatcactggaagctccatgactctctttttgtaaaagaaaaaaaaatcacagaaacacccacctcccaaactattctcttttacttcttcccccaagcccacccccaaatataactgttatccagaagctgttatgtcctgtttccatacatgtttttgtacttttactatatctacatacatcaattaaacttatgtcctattgttttgtgaatttatatttgcgtatacattatcatatgtaaaatttgcatttttttattgaaaattatgtttcttgagatttatccacattgaaacatggagctctaaatcgttaattttaaccgctatagagtattccataatttgaataaagcataatttgtttgtacaatctcccgccaagggaaaattatttccacactcatcatgacaaggagcactgcaaaaataaaaataaaaattacattcatacatgtttaactgcacccatctgc

SEQ ID NO: 445855 - DNA, 2008 bp, Homo sapiens
gcctcgccaccagaggtttcccagagaggaaggcgtggctccctcccgggccagtgagccctggcgccgccgcggccgcggtcccagcagcggagtagggcggcggctgcgccccgcaccatggggggcagcccagccccagccgcggtaaacgccgacctccgccgccgcccgcgccgcgtctgccccctcccgctgcggctctctggacgccatcccctcctcacctcgaagccaacatgaaggagacccggggctacggaggggatgcccccttctgcacccgcctcaaccactcctacacaggcatgtgggcgcccgagcgttccgccgaggcgcggggcaacctcacgcgccctccagggtctggcgaggattgcggatcggtgtccgtggccttcccgatcaccatgctgctcactggtttcgtgggcaacgcactggccatgctgctcgtgtcgcgcagctaccggcgccgggagagcaagcgcaagaagtccttcctgctgtgcatcggctggctggcgctcaccgacctggtcgggcagcttctcaccaccccggtcgtcatcgtcgtgtacctgtccaagcagcgttgggagcacatcgacccgtcggggcggctctgcacctttttcgggctgaccatgactgttttcgggctctcctcgttgttcatcgccagcgccatggccgtcgagcgggcgctggccatcagggcgccgcactggtatgcgagccacatgaagacgcgtgccacccgcgctgtgctgctcggcgtgtggctggccgtgctcgccttcgccctgctgccggtgctgggcgtgggccagtacaccgtccagtggcccgggacgtggtgcttcatcagcaccgggcgagggggcaacgggactagctcttcgcataactggggcaaccttttcttcgcctctgcctttgccttcctggggctcttggcgctgacagtcaccttttcctgcaacctggccaccattaaggccctggtgtcccgctgccgggccaaggccacggcatctcagtccagtgcccagtggggccgcatcacgaccgagacggccattcagcttatggggatcatgtgcgtgctgtcggtctgctggtctccgctcctgataatgatgttgaaaatgatcttcaatcagacatcagttgagcactgcaagacacacacggagaagcagaaagaatgcaacttcttcttaatagctgttcgcctggcttcactgaaccagatcttggatccttgggtttacctgctgttaagaaagatccttcttcgaaagttttgccaggagatggggcctgatggaaggtgtttttgtcatgcatggaggcaggtccccaggacttggtgcagttctcatgatagagaaccctgcagtgtccagctaagctgatgacttgaagataaatctgcctaaccctgggatgaagtatctgtgaactattttgacagcagatgaggaattttggggaaattaaaacctgcctttctgccaggatcacatcactggaagctccatgactctctttttgtaaaagaaaaaaaaatcacagaaacacccacctcccaaactattctcttttacttcttcccccaagcccacccccaaatataactgttatccagaagctgttatgtcctgtttccatacatgtttttgtacttttactatatctacatacatcaattaaacttatgtcctattgttttgtgaatttatatttgcgtatacattatcatatgtaaaatttgcatttttttattgaaaattatgtttcttgagatttatccacattgaaacatggagctctaaatcgttaattttaaccgctatagagtattccataatttgaataaagcataatttgtttgtacaatctcccgccaagggaaaattatttccacactcatcatgacaaggagcactgcaaaaataaaaataaaaattacattcatacatgtttaactgcacccatctgc

SEQ ID NO: 445856 - DNA, 2297 bp, Homo sapiens
  misc_feature (1609)..(1609): n is a, c, g, or t
gcctcgccaccagaggtttcccagagaggaaggcgtggctccctcccgggccagtgagccctggcgccgccgcggccgcggtcccagcagcggagtagggcggcggctgcgccccgcaccatggggggcagcccagccccagccgcggtaaacgccgacctccgccgccgcccgcgccgcgtctgccccctcccgctgcggctctctggacgccatcccctcctcacctcgaagccaacatgaaggagacccggggctacggaggggatgcccccttctgcacccgcctcaaccactcctacacaggcatgtgggcgcccgagcgttccgccgaggcgcggggcaacctcacgcgccctccagggtctggcgaggattgcggatcggtgtccgtggccttcccgatcaccatgctgctcactggtttcgtgggcaacgcactggccatgctgctcgtgtcgcgcagctaccggcgccgggagagcaagcgcaagaagtccttcctgctgtgcatcggctggctggcgctcaccgacctggtcgggcagcttctcaccaccccggtcgtcatcgtcgtgtacctgtccaagcagcgttgggagcacatcgacccgtcggggcggctctgcacctttttcgggctgaccatgactgttttcgggctctcctcgttgttcatcgccagcgccatggccgtcgagcgggcgctggccatcagggcgccgcactggtatgcgagccacatgaagacgcgtgccacccgcgctgtgctgctcggcgtgtggctggccgtgctcgccttcgccctgctgccggtgctgggcgtgggccagtacaccgtccagtggcccgggacgtggtgcttcatcagcaccgggcgagggggcaacgggactagctcttcgcataactggggcaaccttttcttcgcctctgcctttgccttcctggggctcttggcgctgacagtcaccttttcctgcaacctggccaccattaaggccctggtgtcccgctgccgggccaaggccacggcatctcagtccagtgcccagtggggccgcatcacgaccgagacggccattcagcttatggggatcatgtgcgtgctgtcggtctgctggtctccgctcctgataatgatgttgaaaatgatcttcaatcagacatcagttgagcactgcaagacacacacggagaagcagaaagaatgcaacttcttcttaatagctgttcgcctggcttcactgaaccagatcttggatccttgggtttacctgctgttaagaaagatccttcttcgaaagttttgccagatcaggtaccacacaaacaactatgcatccagctccacctccttaccctgccagtgttcctcaaccttgatgtggagcgaccatttggaaagatgagaaaaagaagactcagagagcaattctggaggccggcaagttcaggatcagggtgccagcagattcggtgtctgactggagtgcagtggagtgatttccgctcactgcaaccttcacctcctccactcactgcaatcttcgcctcctgggttcaagtgattctcctgcctcagcctcccaagtagctggaattgcangatgcgccacaagcctggctaatttttgcatttttagtagagatgagtttcaccatgtttgccaggctggtcttgaacacctgacctcaagtaacccacccaccttggcctcccaaagagctgggattacaggcatgagccaacgtgcctggccatgttctgatcgtttaatgatagcaacatttagtattatagagcatgaaaatgtcaaagtcgcaactctaaaatgtttttatttagaaatatgtgcctattagaattttagttactagaattatttaagaaaattggacgttttataataacaggtcaacattgtaattccaagctaaaatgggtgagtaattgctttaggcttgtaatttcagattaaaatcttacttgtaacatttaagagaacttcaggttcatcatacctataaatttaatttattaggcttataagagtgacttaagttcttgggaagtttcttaagtcacctaattggtatacttcaaaagaaaacagaaatatgttacattaataaatgtgcttaaatatttaaggaatttaattaagttgtgaaatcttccttcaaagtaattataaaatttgctatgtttatgaatgtgttaataagatttataaactaacctaaaagcttaagaagaacaagagtttaaataaattgaatactaattttgtacc

SEQ ID NO: 445857 - DNA, 834 bp, Homo sapiens
cactgggcattctcacatgtcttaccatgtttccacccaaggaatataggatcttcttcttttagtagatgtttgtagaaaaattttttacaccccgagtttgtggcatacataggttgtccctattcatttttcactattactgtcacacaacttcgttcttgttcttgttcttgttatactgctgtaagtgatttaccattcctgttcataatctgaaatttatgagaatttattgcctttgatttttatttaagatattaacagtgcatttattattggctatcctaattgatttgtttgttttccaggaggaattttggggaaattaaaacctgcctttctgccaggatcacatcactggaagctccatgactctctttttgtaaaagaaaaaaaaatcacagaaacacccacctcccaaactattctcttttacttcttcccccaagcccacccccaaatataactgttatccagaagctgttatgtcctgtttccatacatgtttttgtacttttactatatctacatacatcaattaaacttatgtcctattgttttgtgaatttatatttgcgtatacattatcatatgtaaaatttgcatttttttattgaaaattatgtttcttgagatttatccacattgaaacatggagctctaaatcgttaattttaaccgctatagagtattccataatttgaataaagcataatttgtttgtacaatctcccgccaagggaaaattatttccacactcatcatgacaaggagcactgcaaaaataaaaataaaaattacattcatacatgtttaactgcacccatctgc

SEQ ID NO: 445858 - DNA, 816 bp, Homo sapiens
cttccttaggtggagctggaaaggtggaggcggaagtgactgatcaattcaggggcgtggggttcgtttaggttttgccctgtgtatgacctcgtttggagccatgaaaccagataatgatgttgaaaatgatcttcaatcagacatcagttgagcactgcaagacacacacggagaagcagaaagaatgcaacttcttcttaatagctgttcgcctggcttcactgaaccagatcttggatccttgggtttacctgctgttaagaaagatccttcttcgaaagttttgccaggaggaattttggggaaattaaaacctgcctttctgccaggatcacatcactggaagctccatgactctctttttgtaaaagaaaaaaaaatcacagaaacacccacctcccaaactattctcttttacttcttcccccaagcccacccccaaatataactgttatccagaagctgttatgtcctgtttccatacatgtttttgtacttttactatatctacatacatcaattaaacttatgtcctattgttttgtgaatttatatttgcgtatacattatcatatgtaaaatttgcatttttttattgaaaattatgtttcttgagatttatccacattgaaacatggagctctaaatcgttaattttaaccgctatagagtattccataatttgaataaagcataatttgtttgtacaatctcccgccaagggaaaattatttccacactcatcatgacaaggagcactgcaaaaataaaaataaaaattacattcatacatgtttaactgcacccatctgc

SEQ ID NO: 445859 - DNA, 1942 bp, Homo sapiens
gcctcgccaccagaggtttcccagagaggaaggcgtggctccctcccgggccagtgagccctggcgccgccgcggccgcggtcccagcagcggagtagggcggcggctgcgccccgcaccatggggggcagcccagccccagccgcggtaaacgccgacctccgccgccgcccgcgccgcgtctgccccctcccgctgcggctctctggacgccatcccctcctcacctcgaagccaacatgaaggagacccggggctacggaggggatgcccccttctgcacccgcctcaaccactcctacacaggcatgtgggcgcccgagcgttccgccgaggcgcggggcaacctcacgcgccctccagggtctggcgaggattgcggatcggtgtccgtggccttcccgatcaccatgctgctcactggtttcgtgggcaacgcactggccatgctgctcgtgtcgcgcagctaccggcgccgggagagcaagcgcaagaagtccttcctgctgtgcatcggctggctggcgctcaccgacctggtcgggcagcttctcaccaccccggtcgtcatcgtcgtgtacctgtccaagcagcgttgggagcacatcgacccgtcggggcggctctgcacctttttcgggctgaccatgactgttttcgggctctcctcgttgttcatcgccagcgccatggccgtcgagcgggcgctggccatcagggcgccgcactggtatgcgagccacatgaagacgcgtgccacccgcgctgtgctgctcggcgtgtggctggccgtgctcgccttcgccctgctgccggtgctgggcgtgggccagtacaccgtccagtggcccgggacgtggtgcttcatcagcaccgggcgagggggcaacgggactagctcttcgcataactggggcaaccttttcttcgcctctgcctttgccttcctggggctcttggcgctgacagtcaccttttcctgcaacctggccaccattaaggccctggtgtcccgctgccgggccaaggccacggcatctcagtccagtgcccagtggggccgcatcacgaccgagacggccattcagcttatggggatcatgtgcgtgctgtcggtctgctggtctccgctcctgataatgatgttgaaaatgatcttcaatcagacatcagttgagcactgcaagacacacacggagaagcagaaagaatgcaacttcttcttaatagctgttcgcctggcttcactgaaccagatcttggatccttgggtttacctgctgttaagaaagatccttcttcgaaagttttgccagatgagaaaaagaagactcagagagcaagagatggggcctgatggaaggtgtttttgtcatgcatggaggcaggtccccaggacttggtgcagttctcatgatagaggaattttggggaaattaaaacctgcctttctgccaggatcacatcactggaagctccatgactctctttttgtaaaagaaaaaaaaatcacagaaacacccacctcccaaactattctcttttacttcttcccccaagcccacccccaaatataactgttatccagaagctgttatgtcctgtttccatacatgtttttgtacttttactatatctacatacatcaattaaacttatgtcctattgttttgtgaatttatatttgcgtatacattatcatatgtaaaatttgcatttttttattgaaaattatgtttcttgagatttatccacattgaaacatggagctctaaatcgttaattttaaccgctatagagtattccataatttgaataaagcataatttgtttgtacaatctcccgccaagggaaaattatttccacactcatcatgacaaggagcactgcaaaaataaaaataaaaattacattcatacatgtttaactgcacccatctgc

SEQ ID NO: 445860 - DNA, 1917 bp, Homo sapiens
gcctcgccaccagaggtttcccagagaggaaggcgtggctccctcccgggccagtgagccctggcgccgccgcggccgcggtcccagcagcggagtagggcggcggctgcgccccgcaccatggggggcagcccagccccagccgcggtaaacgccgacctccgccgccgcccgcgccgcgtctgccccctcccgctgcggctctctggacgccatcccctcctcacctcgaagccaacatgaaggagacccggggctacggaggggatgcccccttctgcacccgcctcaaccactcctacacaggcatgtgggcgcccgagcgttccgccgaggcgcggggcaacctcacgcgccctccagggtctggcgaggattgcggatcggtgtccgtggccttcccgatcaccatgctgctcactggtttcgtgggcaacgcactggccatgctgctcgtgtcgcgcagctaccggcgccgggagagcaagcgcaagaagtccttcctgctgtgcatcggctggctggcgctcaccgacctggtcgggcagcttctcaccaccccggtcgtcatcgtcgtgtacctgtccaagcagcgttgggagcacatcgacccgtcggggcggctctgcacctttttcgggctgaccatgactgttttcgggctctcctcgttgttcatcgccagcgccatggccgtcgagcgggcgctggccatcagggcgccgcactggtatgcgagccacatgaagacgcgtgccacccgcgctgtgctgctcggcgtgtggctggccgtgctcgccttcgccctgctgccggtgctgggcgtgggccagtacaccgtccagtggcccgggacgtggtgcttcatcagcaccgggcgagggggcaacgggactagctcttcgcataactggggcaaccttttcttcgcctctgcctttgccttcctggggctcttggcgctgacagtcaccttttcctgcaacctggccaccattaaggccctggtgtcccgctgccgggccaaggccacggcatctcagtccagtgcccagtggggccgcatcacgaccgagacggccattcagcttatggggatcatgtgcgtgctgtcggtctgctggtctccgctcctgataatgatgttgaaaatgatcttcaatcagacatcagttgagcactgcaagacacacacggagaagcagaaagaatgcaacttcttcttaatagctgttcgcctggcttcactgaaccagatcttggatccttgggtttacctgctgttaagaaagatccttcttcgaaagttttgccagatgagaaaaagaagactcagagagcaattctggaggccggcaagttcaggatcagggtgccagcagattcggtgtctggaggaattttggggaaattaaaacctgcctttctgccaggatcacatcactggaagctccatgactctctttttgtaaaagaaaaaaaaatcacagaaacacccacctcccaaactattctcttttacttcttcccccaagcccacccccaaatataactgttatccagaagctgttatgtcctgtttccatacatgtttttgtacttttactatatctacatacatcaattaaacttatgtcctattgttttgtgaatttatatttgcgtatacattatcatatgtaaaatttgcatttttttattgaaaattatgtttcttgagatttatccacattgaaacatggagctctaaatcgttaattttaaccgctatagagtattccataatttgaataaagcataatttgtttgtacaatctcccgccaagggaaaattatttccacactcatcatgacaaggagcactgcaaaaataaaaataaaaattacattcatacatgtttaactgcacccatctgc

SEQ ID NO: 445861 - DNA, 722 bp, Homo sapiens
tgggagcacatcgacccgtcggggcggctctgcacctttttcgggctgaccatgactgttttcgggctctcctcgttgttcatcgccagcgccatggccgtcgagcgggcgctggccatcagggcgccgcactggtatgcgagccacatgaagacgcgtgccacccgcgctgtgctgctcggcgtgtggctggccgtgctcgccttcgccctgctgccggtgctgggcgtgggccagtacaccgtccagtggcccgggacgtggtgcttcatcagcaccgggcgagggggcaacgggactagctcttcgcataactggggcaaccttttcttcgcctctgcctttgccttcctggggctcttggcgctgacagtcaccttttcctgcaacctggccaccattaaggccctggtgtcccgctgccgggccaaggccacggcatctcagtccagtgcccagtggggccgcatcacgaccgagacggccattcagcttatggggatcatgtgcgtgctgtcggtctgctggtctccgctcctggtaggtagttccagggttgggggaagtcaggatgcgtgtgcgagtaagcgggaacctaagactttgctaagtggcagcacccgcaggggtgtgtttgcaaccgcagagcgctgaagtgtcctttcctcctgcccgcgcggtcttggttacagcttcagagctgagctcctcacttactagct

SEQ ID NO: 445862 - DNA, 2382 bp, Homo sapiens
gcctcgccaccagaggtttcccagagaggaaggcgtggctccctcccgggccagtgagccctggcgccgccgcggccgcggtcccagcagcggagtagggcggcggctgcgccccgcaccatggggggcagcccagccccagccgcggtaaacgccgacctccgccgccgcccgcgccgcgtctgccccctcccgctgcggctctctggacgccatcccctcctcacctcgaagccaacatgaaggagacccggggctacggaggggatgcccccttctgcacccgcctcaaccactcctacacaggcatgtgggcgcccgagcgttccgccgaggcgcggggcaacctcacgcgccctccagggtctggcgaggattgcggatcggtgtccgtggccttcccgatcaccatgctgctcactggtttcgtgggcaacgcactggccatgctgctcgtgtcgcgcagctaccggcgccgggagagcaagcgcaagaagtccttcctgctgtgcatcggctggctggcgctcaccgacctggtcgggcagcttctcaccaccccggtcgtcatcgtcgtgtacctgtccaagcagcgttgggagcacatcgacccgtcggggcggctctgcacctttttcgggctgaccatgactgttttcgggctctcctcgttgttcatcgccagcgccatggccgtcgagcgggcgctggccatcagggcgccgcactggtatgcgagccacatgaagacgcgtgccacccgcgctgtgctgctcggcgtgtggctggccgtgctcgccttcgccctgctgccggtgctgggcgtgggccagtacaccgtccagtggcccgggacgtggtgcttcatcagcaccgggcgagggggcaacgggactagctcttcgcataactggggcaaccttttcttcgcctctgcctttgccttcctggggctcttggcgctgacagtcaccttttcctgcaacctggccaccattaaggccctggtgtcccgctgccgggccaaggccacggcatctcagtccagtgcccagtggggccgcatcacgaccgagacggccattcagcttatggggatcatgtgcgtgctgtcggtctgctggtctccgctcctgataatgatgttgaaaatgatcttcaatcagacatcagttgagcactgcaagacacacacggagaagcagaaagaatgcaacttcttcttaatagctgttcgcctggcttcactgaaccagatcttggatccttgggtttacctgctgttaagaaagatccttcttcgaaagttttgccagatcaggtaccacacaaacaactatgcatccagctccacctccttaccctgccagtgttcctcaaccttgatgtggagcgaccatttggaaagataatgaaagaacggagttggacattttattgcaattcctgcttccctgaatttgcatatttcttcccacctgagaaggataattatatattttaatttggattatttcttcatttttatctttttattttaatgattgttttgtcagtaatacccatggagatcaactttattattataatccatgcctctgaatattagattggtttcttggatgggattttgaatatgcatttaagaagttgggaagaatttcacagatgatgattggaggaaaagtgatgaaaagaaagacctgtgttccaggagttttctccaacttcaaacctttacgtgaatcttaaccaaagtggacatctttacatttcatgatagcttgcttttgcaatatgagtttgaaaaatcagtataagcttatgatggtgaaaagtcaacatattgagagtgataattcaattaataggatatgaacttaacgatataaaagataaacttaacgacatataaaagcaaatgagggcaggagggaatcgtgacaaaaaatatttgtgcccaattatgattaatgttttagagatgttgtgtccctgtgggcttagcatggaactaaaagttcctaagtctcaattctagttatgtgtcatttagtaactcaggaatctgcttaattgttatttctaagcttttgatgacaaaggagtgatgcagctaagggcatccttggagtgtcataaaaaacaaatttgaggttgaatgattagctgcgcagttagagtgataaaaaaatccaggtaggccttctgattcaccatgaccaagtcaggatttcttaatatttcttttctggcagcatatacaaaggcaaaattaataaataacagttgttgaataacaaactttattacgtttttataaaataaaagaatctattttgtctgtattaaaataaaaaactttgtggacttctaaaagat

SEQ ID NO: 445863 - DNA, 1958 bp, Homo sapiens
gcctcgccaccagaggtttcccagagaggaaggcgtggctccctcccgggccagtgagccctggcgccgccgcggccgcggtcccagcagcggagtagggcggcggctgcgccccgcaccatggggggcagcccagccccagccgcggtaaacgccgacctccgccgccgcccgcgccgcgtctgccccctcccgctgcggctctctggacgccatcccctcctcacctcgaagccaacatgaaggagacccggggctacggaggggatgcccccttctgcacccgcctcaaccactcctacacaggcatgtgggcgcccgagcgttccgccgaggcgcggggcaacctcacgcgccctccagggtctggcgaggattgcggatcggtgtccgtggccttcccgatcaccatgctgctcactggtttcgtgggcaacgcactggccatgctgctcgtgtcgcgcagctaccggcgccgggagagcaagcgcaagaagtccttcctgctgtgcatcggctggctggcgctcaccgacctggtcgggcagcttctcaccaccccggtcgtcatcgtcgtgtacctgtccaagcagcgttgggagcacatcgacccgtcggggcggctctgcacctttttcgggctgaccatgactgttttcgggctctcctcgttgttcatcgccagcgccatggccgtcgagcgggcgctggccatcagggcgccgcactggtatgcgagccacatgaagacgcgtgccacccgcgctgtgctgctcggcgtgtggctggccgtgctcgccttcgccctgctgccggtgctgggcgtgggccagtacaccgtccagtggcccgggacgtggtgcttcatcagcaccgggcgagggggcaacgggactagctcttcgcataactggggcaaccttttcttcgcctctgcctttgccttcctggggctcttggcgctgacagtcaccttttcctgcaacctggccaccattaaggccctggtgtcccgctgccgggccaaggccacggcatctcagtccagtgcccagtggggccgcatcacgaccgagacggccattcagcttatggggatcatgtgcgtgctgtcggtctgctggtctccgctcctgataatgatgttgaaaatgatcttcaatcagacatcagttgagcactgcaagacacacacggagaagcagaaagaatgcaacttcttcttaatagctgttcgcctggcttcactgaaccagatcttggatccttgggtttacctgctgttaagaaagatccttcttcgaaagttttgccagatcaggtaccacacaaacaactatgcatccagctccacctccttaccctgccagtgttcctcaaccttgatgtggagcgaccatttggaaagatgagaaaaagaagactcagagagcaagaggaattttggggaaattaaaacctgcctttctgccaggatcacatcactggaagctccatgactctctttttgtaaaagaaaaaaaaatcacagaaacacccacctcccaaactattctcttttacttcttcccccaagcccacccccaaatataactgttatccagaagctgttatgtcctgtttccatacatgtttttgtacttttactatatctacatacatcaattaaacttatgtcctattgttttgtgaatttatatttgcgtatacattatcatatgtaaaatttgcatttttttattgaaaattatgtttcttgagatttatccacattgaaacatggagctctaaatcgttaattttaaccgctatagagtattccataatttgaataaagcataatttgtttgtacaatctcccgccaagggaaaattatttccacactcatcatgacaaggagcactgcaaaaataaaaataaaaattacattcatacatgtttaactgcacccatctgc

SEQ ID NO: 445864 - DNA, 2104 bp, Homo sapiens
  misc_feature (1362)..(1362): n is a, c, g, or t
gcctcgccaccagaggtttcccagagaggaaggcgtggctccctcccgggccagtgagccctggcgccgccgcggccgcggtcccagcagcggagtagggcggcggctgcgccccgcaccatggggggcagcccagccccagccgcggtaaacgccgacctccgccgccgcccgcgccgcgtctgccccctcccgctgcggctctctggacgccatcccctcctcacctcgaagccaacatgaaggagacccggggctacggaggggatgcccccttctgcacccgcctcaaccactcctacacaggcatgtgggcgcccgagcgttccgccgaggcgcggggcaacctcacgcgccctccagggtctggcgaggattgcggatcggtgtccgtggccttcccgatcaccatgctgctcactggtttcgtgggcaacgcactggccatgctgctcgtgtcgcgcagctaccggcgccgggagagcaagcgcaagaagtccttcctgctgtgcatcggctggctggcgctcaccgacctggtcgggcagcttctcaccaccccggtcgtcatcgtcgtgtacctgtccaagcagcgttgggagcacatcgacccgtcggggcggctctgcacctttttcgggctgaccatgactgttttcgggctctcctcgttgttcatcgccagcgccatggccgtcgagcgggcgctggccatcagggcgccgcactggtatgcgagccacatgaagacgcgtgccacccgcgctgtgctgctcggcgtgtggctggccgtgctcgccttcgccctgctgccggtgctgggcgtgggccagtacaccgtccagtggcccgggacgtggtgcttcatcagcaccgggcgagggggcaacgggactagctcttcgcataactggggcaaccttttcttcgcctctgcctttgccttcctggggctcttggcgctgacagtcaccttttcctgcaacctggccaccattaaggccctggtgtcccgctgccgggccaaggccacggcatctcagtccagtgcccagtggggccgcatcacgaccgagacggccattcagcttatggggatcatgtgcgtgctgtcggtctgctggtctccgctcctgataatgatgttgaaaatgatcttcaatcagacatcagttgagcactgcaagacacacacggagaagcagaaagaatgcaacttcttcttaatagctgttcgcctggcttcactgaaccagatcttggatccttgggtttacctgctgttaagaaagatccttcttcgaaagttttgccagatgagaaaaagaagactcagagagcaagctcctcttcttcccaccnctactgtgattgatccttcaaggttctgtgctcagcccttccgttggttcttggatttgtcctttcccgccatgtcttcatcacatccacaacttccactaacacttgcgagcttcaaacttcttagagaaccctgcagtgtccagctaagctgatgacttgaagataaatctgcctaaccctgggatgaagtatctgtgaactattttgacagcagatgaggaattttggggaaattaaaacctgcctttctgccaggatcacatcactggaagctccatgactctctttttgtaaaagaaaaaaaaatcacagaaacacccacctcccaaactattctcttttacttcttcccccaagcccacccccaaatataactgttatccagaagctgttatgtcctgtttccatacatgtttttgtacttttactatatctacatacatcaattaaacttatgtcctattgttttgtgaatttatatttgcgtatacattatcatatgtaaaatttgcatttttttattgaaaattatgtttcttgagatttatccacattgaaacatggagctctaaatcgttaattttaaccgctatagagtattccataatttgaataaagcataatttgtttgtacaatctcccgccaagggaaaattatttccacactcatcatgacaaggagcactgcaaaaataaaaataaaaattacattcatacatgtttaactgcacccatctgc

SEQ ID NO: 445865 - DNA, 1970 bp, Homo sapiens
gcctcgccaccagaggtttcccagagaggaaggcgtggctccctcccgggccagtgagccctggcgccgccgcggccgcggtcccagcagcggagtagggcggcggctgcgccccgcaccatggggggcagcccagccccagccgcggtaaacgccgacctccgccgccgcccgcgccgcgtctgccccctcccgctgcggctctctggacgccatcccctcctcacctcgaagccaacatgaaggagacccggggctacggaggggatgcccccttctgcacccgcctcaaccactcctacacaggcatgtgggcgcccgagcgttccgccgaggcgcggggcaacctcacgcgccctccagggtctggcgaggattgcggatcggtgtccgtggccttcccgatcaccatgctgctcactggtttcgtgggcaacgcactggccatgctgctcgtgtcgcgcagctaccggcgccgggagagcaagcgcaagaagtccttcctgctgtgcatcggctggctggcgctcaccgacctggtcgggcagcttctcaccaccccggtcgtcatcgtcgtgtacctgtccaagcagcgttgggagcacatcgacccgtcggggcggctctgcacctttttcgggctgaccatgactgttttcgggctctcctcgttgttcatcgccagcgccatggccgtcgagcgggcgctggccatcagggcgccgcactggtatgcgagccacatgaagacgcgtgccacccgcgctgtgctgctcggcgtgtggctggccgtgctcgccttcgccctgctgccggtgctgggcgtgggccagtacaccgtccagtggcccgggacgtggtgcttcatcagcaccgggcgagggggcaacgggactagctcttcgcataactggggcaaccttttcttcgcctctgcctttgccttcctggggctcttggcgctgacagtcaccttttcctgcaacctggccaccattaaggccctggtgtcccgctgccgggccaaggccacggcatctcagtccagtgcccagtggggccgcatcacgaccgagacggccattcagcttatggggatcatgtgcgtgctgtcggtctgctggtctccgctcctgataatgatgttgaaaatgatcttcaatcagacatcagttgagcactgcaagacacacacggagaagcagaaagaatgcaacttcttcttaatagctgttcgcctggcttcactgaaccagatcttggatccttgggtttacctgctgttaagaaagatccttcttcgaaagttttgccagatgagaaaaagaagactcagagagcaattaatctgcagtttgcgaactctcagatacagagggcaactgcacattgtgggcaagtacaaacctatcgtgtgctgaacagagaagaaatggaggtactcgtgagcagcattaatgtgtacaccagaatctcaacagtaaagacagaataacatgaagaaaataactacaggagtgctgtgttttaaaaaagcaagctcctccagctgagtttgtgactctaatccctgcttattttgagcactttccatgtgttgattgactcggaaaggtgggagattaccagcaagccaggtcatttgggcaaacatgggcatatttttagcaaagctgaacaaactggttggtcactcgaactacccaatttagacttatagtaagaatagcacatggttcagaattgccaagactgctgctttagtcaacagaaattttttcatatgcatgctggtaatgcagtgcatctctggaagaaatgcaagagtattttaacatttggtccagaagaaatatgtaaagggtgtttgtagaatttgatgccctcttcagtgacataaggttatgggtttgtgaatggaaaatctgttatttgttcaggttattaaaacacattctaattcaacatca

SEQ ID NO: 445866 - DNA, 2361 bp, Homo sapiens
gcctcgccaccagaggtttcccagagaggaaggcgtggctccctcccgggccagtgagccctggcgccgccgcggccgcggtcccagcagcggagtagggcggcggctgcgccccgcaccatggggggcagcccagccccagccgcggtaaacgccgacctccgccgccgcccgcgccgcgtctgccccctcccgctgcggctctctggacgccatcccctcctcacctcgaagccaacatgaaggagacccggggctacggaggggatgcccccttctgcacccgcctcaaccactcctacacaggcatgtgggcgcccgagcgttccgccgaggcgcggggcaacctcacgcgccctccagggtctggcgaggattgcggatcggtgtccgtggccttcccgatcaccatgctgctcactggtttcgtgggcaacgcactggccatgctgctcgtgtcgcgcagctaccggcgccgggagagcaagcgcaagaagtccttcctgctgtgcatcggctggctggcgctcaccgacctggtcgggcagcttctcaccaccccggtcgtcatcgtcgtgtacctgtccaagcagcgttgggagcacatcgacccgtcggggcggctctgcacctttttcgggctgaccatgactgttttcgggctctcctcgttgttcatcgccagcgccatggccgtcgagcgggcgctggccatcagggcgccgcactggtatgcgagccacatgaagacgcgtgccacccgcgctgtgctgctcggcgtgtggctggccgtgctcgccttcgccctgctgccggtgctgggcgtgggccagtacaccgtccagtggcccgggacgtggtgcttcatcagcaccgggcgagggggcaacgggactagctcttcgcataactggggcaaccttttcttcgcctctgcctttgccttcctggggctcttggcgctgacagtcaccttttcctgcaacctggccaccattaaggccctggtgtcccgctgccgggccaaggccacggcatctcagtccagtgcccagtggggccgcatcacgaccgagacggccattcagcttatggggatcatgtgcgtgctgtcggtctgctggtctccgctcctgataatgatgttgaaaatgatcttcaatcagacatcagttgagcactgcaagacacacacggagaagcagaaagaatgcaacttcttcttaatagctgttcgcctggcttcactgaaccagatcttggatccttgggtttacctgctgttaagaaagatccttcttcgaaagttttgccagatcaggtaccacacaaacaactatgcatccagctccacctccttaccctgccagtgttcctcaaccttgatgtggagcgaccatttggaaagataatgaaagaacggagttggacattttattgcaattcctgcttccctgaatttgcatatttcttcccacctgagaaggataattatatattttaatttggattatttcttcatttttatctttttattttaatgattgttttgtcagtaatacccatggagatcaactttattattataatccatgcctctgaatattagattggtttcttggatgggattttgaatatgcatttaagaagttgggaagaatttcacagatgatgattggaggaaaagtgatgaaaagaaagacctgtgttccaggagttttctccaacttcaaacctttacgtgaatcttaaccaaagtggacatctttacatttcatgatagcttgcttttgcaatatgagtttgaaaaatcagtataagcttatgatggtgaaaagtcaacatattgagagtgataattcaattaataggatatgaacttaacgacatataaaagcaaatgagggcaggagggaatcgtgacaaaaaatatttgtgcccaattatgattaatgttttagagatgttgtgtccctgtgggcttagcatggaactaaaagttcctaagtctcaattctagttatgtgtcatttagtaactcaggaatctgcttaattgttatttctaagcttttgatgacaaaggagtgatgcagctaagggcatccttggagtgtcataaaaaacaaatttgaggttgaatgattagctgcgcagttagagtgataaaaaaatccaggtaggccttctgattcaccatgaccaagtcaggatttcttaatatttcttttctggcagcatatacaaaggcaaaattaataaataacagttgttgaataacaaactttattacgtttttataaaataaaagaatctattttgtctgtattaaaataaaaaactttgtggacttctaaaagat

SEQ ID NO: 445867 - DNA, 2074 bp, Homo sapiens
gcctcgccaccagaggtttcccagagaggaaggcgtggctccctcccgggccagtgagccctggcgccgccgcggccgcggtcccagcagcggagtagggcggcggctgcgccccgcaccatggggggcagcccagccccagccgcggtaaacgccgacctccgccgccgcccgcgccgcgtctgccccctcccgctgcggctctctggacgccatcccctcctcacctcgaagccaacatgaaggagacccggggctacggaggggatgcccccttctgcacccgcctcaaccactcctacacaggcatgtgggcgcccgagcgttccgccgaggcgcggggcaacctcacgcgccctccagggtctggcgaggattgcggatcggtgtccgtggccttcccgatcaccatgctgctcactggtttcgtgggcaacgcactggccatgctgctcgtgtcgcgcagctaccggcgccgggagagcaagcgcaagaagtccttcctgctgtgcatcggctggctggcgctcaccgacctggtcgggcagcttctcaccaccccggtcgtcatcgtcgtgtacctgtcctagctcttcgcataactggggcaaccttttcttcgcctctgcctttgccttcctggggctcttggcgctgacagtcaccttttcctgcaacctggccaccattaaggccctggtgtcccgctgccgggccaaggccacggcatctcagtccagtgcccagtggggccgcatcacgaccgagacggccattcagcttatggggatcatgtgcgtgctgtcggtctgctggtctccgctcctgataatgatgttgaaaatgatcttcaatcagacatcagttgagcactgcaagacacacacggagaagcagaaagaatgcaacttcttcttaatagctgttcgcctggcttcactgaaccagatcttggatccttgggtttacctgctgttaagaaagatccttcttcgaaagttttgccagatcaggtaccacacaaacaactatgcatccagctccacctccttaccctgccagtgttcctcaaccttgatgtggagcgaccatttggaaagataatgaaagaacggagttggacattttattgcaattcctgcttccctgaatttgcatatttcttcccacctgagaaggataattatatattttaatttggattatttcttcatttttatctttttattttaatgattgttttgtcagtaatacccatggagatcaactttattattataatccatgcctctgaatattagattggtttcttggatgggattttgaatatgcatttaagaagttgggaagaatttcacagatgatgattggaggaaaagtgatgaaaagaaagacctgtgttccaggagttttctccaacttcaaacctttacgtgaatcttaaccaaagtggacatctttacatttcatgatagcttgcttttgcaatatgagtttgaaaaatcagtataagcttatgatggtgaaaagtcaacatattgagagtgataattcaattaataggatatgaacttaacgatataaaagataaacttaacgacatataaaagcaaatgagggcaggagggaatcgtgacaaaaaatatttgtgcccaattatgattaatgttttagagatgttgtgtccctgtgggcttagcatggaactaaaagttcctaagtctcaattctagttatgtgtcatttagtaactcaggaatctgcttaattgttatttctaagcttttgatgacaaaggagtgatgcagctaagggcatccttggagtgtcataaaaaacaaatttgaggttgaatgattagctgcgcagttagagtgataaaaaaatccaggtaggccttctgattcaccatgaccaagtcaggatttcttaatatttcttttctggcagcatatacaaaggcaaaattaataaataacagttgttgaataacaaactttattacgtttttataaaataaaagaatctattttgtctgtattaaaataaaaaactttgtggacttctaaaagat

SEQ ID NO: 445868 - DNA, 1941 bp, Homo sapiens
atcaacatctcacagcctgtgaagctctcagtgtgcctctgtcctttgccacaaacatgaggttcacattccctctcatggctatagtcctggaaattgccatgattgttttatttggattatttgttgagtatgaaacggaccagactgttctcgagcagctcaacatcaccaagccaacagacatgggcatattctttgagttatatcctctgttccaagatgtacatgttatgatatttgttgggtttggcttcctcatgaccttcctgaagaaatatggcttcagcagtgtgggtatcaacctactcgttgctgctttgggcctccagtggggcactattgtacagggaatcctgcaaagccagggacagaaatttaacattggaatcaaaaacatgataaatgcagacttcagtgcagccacagttctgatatcttttggagctgtcctgggaaaaacgagccccacccaaatgctgatcatgacaattttagaaattgttttctttgcccacaatgaatacctggttagtgaaatatttaaggcctctgacattggagcatcaatgacgatccatgcctttggggcctactttggcttggctgtagcaggcatcttgtatcgatctggactgagaaaggggcatgaaaatgaagagtccgcatactactcagacttgtttgcaatgattgggactctctttctgtggatgttttggcccagctttaactcggccattgctgaacctggagacaaacagtgcagggccattgtaaacacgtacttctctctcgctgcctgtgtgctcacagcctttgccttctccagcctagtggagcaccgaggcaagctcaacatggttcacattcagaatgccacccttgctggaggagttgctgtgggcacttgtgcggatatggcaattcacccatttggttctatgattattgggagcattgcaggaatggtctctgtgcttggatacaagttcctgactccactttttactactaaactgaggatccatgatacatgtggggtccataacctccacggcttacctggtgtagtgggaggccttgcaggcattgtggcagtagcaatgggcgcctccaacacgtctatggccatgcaggcagctgcactgggttcctctatcggaacagcagttgttggaggtctgatgacaggtttaattctaaagttgcctctctggggacagccatctgaccagaactgctatgatgattctgtttattggaaggtccctaagacgagataacttgacaatcagttccatggacatggtgaccacagccagctggaacctgaagtctaaacaccattcctgctctccagcttcctttcccattatccagaatcaagtccaaataaacaaaaagggagtaaccaaagagagtatggaccagagtgaatagatcctaagtcccaaatggccagtgtaaaaatgtccttatgtctgatgctgtctcttgctcttcaatgattaattgaggggatgttactcataaaacagataatcaaatagatcttctccaggattcccaaaaagcttttggcagtgagtaaatacagagtaaacatgtcagtttcttaatgtagacactatgtcttcaatcccaaaaattataaaactgaaacccatgaagcaagaatagatgtgagaaatctatgtaaaaaaataattaaagaaatgcatgtgtgtaaagtagtaatatgatgattttaggtagtgctttttattttaaaaatagtctagttagtaatgttgtatccttgcatgaatattattcttaattccttttgcatgttgactatttgcaacgagctcaaatgctatctgatcaaagtctattttgcataaaatgtccaataattaaatattgttataaaataaaacatcagtctttgactct

SEQ ID NO: 445869 - DNA, 1231 bp, Homo sapiens
  misc_feature (1199)..(1199): n is a, c, g, or t
  misc_feature (1204)..(1204): n is a, c, g, or t
  misc_feature (1208)..(1208): n is a, c, g, or t
  misc_feature (1214)..(1214): n is a, c, g, or t
  misc_feature (1216)..(1216): n is a, c, g, or t
  misc_feature (1221)..(1221): n is a, c, g, or t
  misc_feature (1225)..(1227): n is a, c, g, or t
atcaacatctcacagcctgtgaagctctcagtgtgcctctgtcctttgccacaaacatgaggttcacattccctctcatggctatagtcctggaaattgccatgattgttttatttggattatttgttgagtatgaaacggaccagactgttctcgagcagctcaacatcaccaagccaacagacatgggcatattctttgagttatatcctctgttccaagatgtacatgttatgatatttgttgggtttggcttcctcatgaccttcctgaagaaatatggcttcagcagtgtgggtatcaacctactcgttgctgctttgggcctccagtggggcactattgtacagggaatcctgcaaagccagggacagaaatttaacattggaatcaaaaacatgataaatgcagacttcagtgcagccacagttctgatatcttttggagctgtcctgggaaaaacgagccccacccaaatgctgatcatgacaattttagaaattgttttctttgcccacaatgaatacctggttagtgaaatatttaaggcctctgacattggagcatcaatgacgatccatgcctttggggcctactttggcttggctgtagcaggcatcttgtatcgatctggactgagaaaggggcatgaaaatgaagagtccgcatactactcagacttgtttgcaatgattgggactctctttctgtggatgttttggcccagctttaactcggccattgctgaacctggagacaaacagtgcagggccattgtaaacacgtacttctctctcgctgcctgtgtgctcacagcctttgccttctccagcctagtggagcaccgaggcaagctcaacatggttcacattcagaatgccacccttgctggaggagttgctgtgggcacttgtgcggatatggcaattcacccatttggttctatgattattgggagcattgcaggaatggtctctgtgcttggatacaagttcctgactccactttttactactaaactgaggatccatgatacatgtggggtccataacctccacggcttacctggtgtagtgggaggccttgcaggcattgtggcagtagcaatgggcgcctccaacacgtctatggccatgcaggcagctgcactgggttcctctatcggaacagcagttgttggaggtctgatgacaggtccntaaanagtnaacacntncctgntctnnngctt

SEQ ID NO: 445870 - DNA, 539 bp, Homo sapiens
ctgaagcagaagaattgcttgaacctgagaggtggaagttgcagttagcagagatcaagccactgcactccagcctgggtgacagagggacactccatctcaaaaataaataaataaacaaataaataagtaaataaataaataaagcaaactgcatcctctggactgtcttccatattcagaactaatatcccctcttttggttcactacagggactctctttctgtggatgttttggcccagctttaactcggccattgctgaacctggagacaaacagtgcagggccattgtaaacacgtacttctctctcgctgcctgtgtgctcacagcctttgccttctccagcctagtggagcaccgaggcaagctcaacatggttcacattcagaatgccacccttgctggaggagttgctgtgggcacttgtgcggatatggcaattcacccatttggttctatgattattgggagcattgcaggaatggtctctgtgcttggatacaagttcctgactgttaaggtacagcagatgttc

SEQ ID NO: 445871 - DNA, 551 bp, Homo sapiens
gatgattttataatagtatataagctactatgcaagtagattttcctcttcagcgtcacaacatgactcattttccctctaccgtcacaggtttaattctaaagttgcctctctggggacagccatctgaccagaactgctatgatgattctgtttattggaaggtactgtacagtattctaaacaagaatgtaaacgatgactccattagtgaaagctttacacacttcaagcctagatatctgtgtgcataggtgtgatgaaattgagttagcctggcatggtaggtagctcacacatgtaatctcagcactttgggcggctgaggctggaggattgtttgatgccaggagtttgggtccagcctgggcaactctctacaaaaattataaataataaatttaaaatttttctttcaatgggatgtcaagtgtaaaagaaaaataaataaatgaaaagaaactgaatgaactacctatttatagaaagaaattgagatgatgtgcccagccagataaaatcagaagttatggtattttctaaagcagaag

SEQ ID NO: 445872 - DNA, 1458 bp, Homo sapiens
ctgaagcagaagaattgcttgaacctgagaggtggaagttgcagttagcagagatcaagccactgcactccagcctgggtgacagagggacactccatctcaaaaataaataaataaacaaataaataagtaaataaataaataaagcaaactgcatcctctggactgtcttccatattcagaactaatatcccctcttttggttcactacagggactctctttctgtggatgttttggcccagctttaactcggccattgctgaacctggagacaaacagtgcagggccattgtaaacacgtacttctctctcgctgcctgtgtgctcacagcctttgccttctccagcctagtggagcaccgaggcaagctcaacatggttcacattcagaatgccacccttgctggaggagttgctgtgggcacttgtgcggatatggcaattcacccatttggttctatgattattgggagcattgcaggaatggtctctgtgcttggatacaagttcctgactccactttttactactaaactgaggatccatgatacatgtggggtccataacctccacggcttacctggtgtagtgggaggccttgcaggcattgtggcagtagcaatgggcgcctccaacacgtctatggccatgcaggcagctgcactgggttcctctatcggaacagcagttgttggaggtctgatgacaggtttaattctaaagttgcctctctggggacagccatctgaccagaactgctatgatgattctgtttattggaaggtccctaagacgagataacttgacaatcagttccatggacatggtgaccacagccagctggaacctgaagtctaaacaccattcctgctctccagcttcctttcccattatccagaatcaagtccaaataaacaaaaagggagtaaccaaagagagtatggaccagagtgaatagatcctaagtcccaaatggccagtgtaaaaatgtccttatgtctgatgctgtctcttgctcttcaatgattaattgaggggatgttactcataaaacagataatcaaatagatcttctccaggattcccaaaaagcttttggcagtgagtaaatacagagtaaacatgtcagtttcttaatgtagacactatgtcttcaatcccaaaaattataaaactgaaacccatgaagcaagaatagatgtgagaaatctatgtaaaaaaataattaaagaaatgcatgtgtgtaaagtagtaatatgatgattttaggtagtgctttttattttaaaaatagtctagttagtaatgttgtatccttgcatgaatattattcttaattccttttgcatgttgactatttgcaacgagctcaaatgctatctgatcaaagtctattttgcataaaatgtccaataattaaatattgttataaaataaaacatcagtctttgactct

SEQ ID NO: 445873 - DNA, 399 bp, Homo sapiens
aaaagaaactgacagagagtggatactcaatatttattaaatgaatcagatcaggtatcaattttttgagagtgctaaaccctccctaaggaaagtcttatttccaaagtttacatgaaaagatgattctcttctttaaggtgtatctcagaattttctaacactgctcaagagtttcaaagaaaataagaatatgaaagaaaaattgtaacaaatgcttaatttgctgctgtgtaatgttacactctggcctgaagatggcagtcatccacaccctcagtgagtgagactttctttggctgagatccaggaaagacactgattcttttttgtttgcttccttaggtctatggccatgcaggcagctgcactgggttcctctatcggaacagcagttgt

SEQ ID NO: 445874 - DNA, 384 bp, Homo sapiens
acttctctctcgctgcctgtgtgctcacagcctttgccttctccagcctagtggagcaccgaggcaagctcaacatggtaagtgccgccttagccctcatggaaattttgcttcacaacactgacagttgctcagataagtagtaggtaatttctgcatcactgctgaactctcaagacaaatcagaagcagaccttgtagaatgttctaaaaacaacaacatttattcattaattcacttattcatcaaatctgtaccctgggctgggcgcagtggctaatgcctgtaatcccagcactttgggaggcctagacagggggattacctgaggtcaagagttcaagacaagcctggccaacatggagaaaccctgtgactactaa

SEQ ID NO: 445875 - DNA, 193 bp, Homo sapiens
tgcatgtgtgtaaagtagtaatatgatgattttaggtagtgctttttattttaaaaatagtctagttagtaatgttgtatccttgcatgaatattattcttaattccttttgcatgttgactatttgcaacgagctcaaatgctatctgatcaaagtctattttgcataaaatgtccaataattaaatattgt

SEQ ID NO: 445876 - DNA, 1309 bp, Homo sapiens
atcaacatctcacagcctgtgaagctctcagtgtgcctctgtcctttgccacaaacatgaggttcacattccctctcatggctatagtcctggaaattgccatgattgttttatttggattatttgttgagtatgaaacggaccagactgttctcgagcagctcaacatcaccaagccaacagacatgggcatattctttgagttatatcctctgttccaagatgtacatgttatgatatttgttgggtttggcttcctcatgaccttcctgaagaaatatggcttcagcagtgtgggtatcaacctactcgttgctgctttgggcctccagtggggcactattgtacagggaatcctgcaaagccagggacagaaatttaacattggaatcaaaaacatgataaatgcagacttcagtgcagccacagttctgatatcttttggagctgtcctgggaaaaacgagccccacccaaatgctgatcatgacaattttagaaattgttttctttgcccacaatgaatacctggttagtgaaatatttaaggcctctgacattggagcatcaatgacgatccatgcctttggggcctactttggcttggctgtagcaggcatcttgtatcgatctggactgagaaaggggcatgaaaatgaagagtccgcatactactcagacttgtttgcaatgattgggactctctttctgtggatgttttggcccagctttaactcggccattgctgaacctggagacaaacagtgcagggccattgtaaacacgtacttctctctcgctgcctgtgtgctcacagcctttgccttctccagcctagtggagcaccgaggcaagctcaacatggttcacattcagaatgccacccttgctggaggagttgctgtgggcacttgtgcggatatggcaattcacccatttggttctatgattattgggagcattgcaggaatggtctctgtgcttggatacaagttcctgactccactttttactactaaactgaggatccatgatacatgtggggtccataacctccacggcttacctggtgtagtgggaggccttgcaggcattgtggcagtagcaatgggcgcctccaacacgtctatggccatgcaggcagctgcactgggttcctctatcggaacagcagttgttggaggtctgatgacaggtttaattctaaagttgcctctctggggacagccatctgaccagaactgctatgatgattctgtttattggaaggtccctaagacgagataaacaccattcctgctctccagctt

SEQ ID NO: 445877 - DNA, 1819 bp, Homo sapiens
atcaacatctcacagcctgtgaagctctcagtgtgcctctgtcctttgccacaaacatgaggttcacattccctctcatggctatagtcctggaaattgccatgattgttttatttggattatttgttgagtatgaaacggaccagactgttctcgagcagctcaacatcaccaagccaacagacatgggcatattctttgagttatatcctctgttccaagatgtacatgttatgatatttgttgggtttggcttcctcatgaccttcctgaagaaatatggcttcagcagtgtgggtatcaacctactcgttgctgctttgggcctccagtggggcactattgtacagggaatcctgcaaagccagggacagaaatttaacattggaatcaaaaacatgataaatgcagacttcagtgcagccacagttctgatatcttttggagctgtcctgggaaaaacgagccccacccaaatgctgatcatgacaattttagaaattgttttctttgcccacaatgaatacctggttagtgaaatatttaaggcctctgacattggagcatcaatgacgatccatgcctttggggcctactttggcttggctgtagcaggcatcttgtatcgatctggactgagaaaggggcatgaaaatgaagagtccgcatactactcagacttgtttgcaatgattgggactctctttctgtggatgttttggcccagctttaactcggccattgctgaacctggagacaaacagtgcagggccattgtaaacacgtacttctctctcgctgcctgtgtgctcacagcctttgccttctccagcctagtggagcaccgaggcaagctcaacatggttcacattcagaatgccacccttgctggaggagttgctgtgggcacttgtgcggatatggcaattcacccatttggttctatgattattgggagcattgcaggaatggtctctgtgcttggatacaagttcctgactgtctatggccatgcaggcagctgcactgggttcctctatcggaacagcagttgttggaggtctgatgacaggtttaattctaaagttgcctctctggggacagccatctgaccagaactgctatgatgattctgtttattggaaggtccctaagacgagataacttgacaatcagttccatggacatggtgaccacagccagctggaacctgaagtctaaacaccattcctgctctccagcttcctttcccattatccagaatcaagtccaaataaacaaaaagggagtaaccaaagagagtatggaccagagtgaatagatcctaagtcccaaatggccagtgtaaaaatgtccttatgtctgatgctgtctcttgctcttcaatgattaattgaggggatgttactcataaaacagataatcaaatagatcttctccaggattcccaaaaagcttttggcagtgagtaaatacagagtaaacatgtcagtttcttaatgtagacactatgtcttcaatcccaaaaattataaaactgaaacccatgaagcaagaatagatgtgagaaatctatgtaaaaaaataattaaagaaatgcatgtgtgtaaagtagtaatatgatgattttaggtagtgctttttattttaaaaatagtctagttagtaatgttgtatccttgcatgaatattattcttaattccttttgcatgttgactatttgcaacgagctcaaatgctatctgatcaaagtctattttgcataaaatgtccaataattaaatattgttataaaataaaacatcagtctttgactct

SEQ ID NO: 445878 - DNA, 2894 bp, Homo sapiens
agcggacggccgtcgtgccgctcgtgtcagtcaacatggaggcagaggaatcggagaaggccgcaacggagcaagagccgctggaagggacagaacagacactagatgcggaggaggagcaggaggaatccgaagaagcggcctgtggcagcaagaagcgggtagtgccaggtattgtgtacctgggccatatcccgccgcgcttccggcccctgcacgtccgcaaccttctcagcgcctatggcgaggtcggacgcgtcttctttcaggctgaggaccggttcgtgagacgcaagaagaaggcagcagcagctgccggagggaaaaagcggtcctacaccaaggactacaccgagggatgggtggagttccgtgacaagcgcatagccaagcgcgtggcggccagtctacacaacacgcctatgggtgcccgcaggcgcagccccttccgttatgatctttggaacctcaagtacttgcaccgtttcacctggtcccacctcagcgagcacctcgcctttgagcgccaggtgcgcaggcagcgcttgagagcggaggttgctcaagccaagcgtgagaccgacttctatcttcaaagtgtggaacggggacaacgctttcttgcggccgatggggaccctgctcgcccagatggctcctggacatttgcccagcgtcctactgagcaggaactgagggcccgtaaagcagcacggccagggggacgtgaacgggctcgcctggcaactgcccaggacaaggcccgctccaacaaagggctcctggccaggatctttggagccccgccaccctcagagagcatggagggaccttcccttgtcagggactcctgagggcctgggtggccccttccatttcctggccctgctctgcttcctgtctacctcatactagaatgatcgtgactacccgggcagacattttactgtgtttctcagaccaagtgtctactgatggcccaaacatggagttttgtgggcttccactgtccccactccgaactcctgtatgtgcctggctgagtcacctaattcatactgtcatactagcataattatgactattgcatatgcttgttttgtttgactcttggctgcctacgtctgtagggtcccctgaaaatcccacttcctgcccccagaaagggcctttatttccaactaggaggataatgcctagtccaggcaatctttctctgtttagcagtcacaggtgagggtggtattagcatcttttttatgtagaaaaaattgagttaatggggtggactgggttgggaagaaatacatttcctaatgtatttatagaaaataaaaatatttttatgtgcctttttatttttgttggtggggaggtcattggacaagttccaactttcatcttgtgttcccttcaccttcatatcctgatcttagagcccccctccccctgccacccaccttactgtttaacctggatttttttttctatttaatttttgtctaatatcttagcccagtttatcaatcagttatcttaagtcagcattttctaagccattgtttgaggaaacagtgacaataggtaataacacatcttagtattaagagttttacaggccactagtataagataggcatcgtggtagatgcatataaagggtggaatgggagccatggcaggtcatagagtcctctcaatgggaacctgattgatgatcacagtcttcagtggtgagtcagtcctcaccaagttttccagatcattcctacaaagtaaactgggagaataataagtctgaaagagtgtggagtgctcccacaattacaaagaatgcttcctgggtggagtgttgagttggaaccattgtaaaggtgggcaaagcctagtagagaaaccagtgcacctcaggtgcacttacatatggtggggctgaggcaaagcagccctgtaggcttcaaagaatcagtgtaagccactaaaaggaactgaaaacctaggtgtcacaataaacagtctacacagtctcacgtagaccaaaattctgatcattttccaggctgttgcatgaagtgatagagtatgattataatttctgtttgcttgtgctgtttgtttttgtttttcatctgtcaatgtgatgatctgtgttttatagggtagagtggatttgtctactttggctgtaaaataccctaatcacattatgatcttgacaggtgcactttactggggagaataaaaaggaccatacggtaaagctggtataacatttctcacaacccacatacctcttatacttggcacacaaactacgtttccatttagaaactttcgtcttgtttctgtttttaattcttgtgggtttgtttcatgtgaattgtttcctcagatcattgatgtcttaaagtgaaacagaaatgcccattgctacttctgctagataaagagataccaaggtgaagaagaaactttccctctagttgctaacagcttagaaagtacagtagacatactggggttttatttaagactttcttgaatgaagaaataaattgcattcccacggtggacagcgttagataacagtatgttcaagggctggtatttcagggtccatctccaaaacagttctgtacaaagagctcacacctgcggccaggcaagctaagtaagtcacaggtggagtgaggaatgagaataaatgggtggaagaaaatatcctaggaactttcatcttgactttaagcccattgagtgtaggaaaataattttttacatccacaattttgtttctatttaaacagcacttgtttttttatatgaagtaactcatttaatccacaactatataatattgttatccccccattaaaactgagctcagagagatg

SEQ ID NO: 445879 - DNA, 2897 bp, Homo sapiens
agcggacggccgtcgtgccgctcgtgtcagtcaacatggaggcagaggaatcggagaaggccgcaacggagcaagagccgctggaagggacagaacagacactagatgcggaggaggagcaggaggaatccgaagaagcggcctgtggcagcaagaagcgggtagtgccaggtattgtgtacctgggccatatcccgccgcgcttccggcccctgcacgtccgcaaccttctcagcgcctatggcgaggtcggacgcgtcttctttcaggctgaggaccggttcgtgagacgcaagaagaaggcagcagcagctgccggagggaaaaagcggtcctacaccaaggactacaccgagggatgggtggagttccgtgacaagcgcatagccaagcgcgtggcggccagtctacacaacacgcctatgggtgcccgcaggcgcagccccttccgttatgatctttggaacctcaagtacttgcaccgtttcacctggtcccacctcagcgagcacctcgcctttgagcgccaggtgcgcaggcagcgcttgagagcggaggttgctcaagccaagcgtgagaccgacttctatcttcaaagtgtggaacggggacaacgctttcttgcggccgatggggaccctgctcgcccagatggctcctggacatttgcccagcgtcctactgagcaggaactgagggcccgtaaagcagcacggccagggggacgtgaacgggctcgcctggcaactgcccaggacaaggcccgctccaacaaagggctcctggccaggatctttggagccccgccaccctcagagagcatggagggaccttcccttgtcagggactcctgagggcctgggtggccccttccatttcctggccctgctctgcttcctgtctacctcatactagaatgatcgtgactacccgggcagacattttactgtgtttctcagaccaagtgtctactgatggcccaaacatggagttttgtgggcttccactgtccccactccgaactcctgtatgtgcctggctgagtcacctaattcatactgtcatactagcataattatgactattgcatatgcttgttttgtttgactcttggctgcctacgtctgtagggtcccctgaaaatcccacttcctgcccccagaaagggcctttatttccaactaggaggataatgcctagtccaggcaatctttctctgtttagcagtcacaggtgagggtggtattagcatcttttttatgtagaaaaaattgagttaatggggtggactgggttgggaagaaatacatttcctaatgtatttatagaaaataaaaatatttttatgtgcctttttatttttgttggtggggaggtcattggacaagttccaactttcatcttgtgttcccttcaccttcatatcctgatcttagagcccccctccccctgccacccaccttactgtttaacctggatttttttttctatttaatttttgtctaatatcttagcccagtttatcaatcagttatcttaagtcagcattttctaagccattgtttgaggaaacagtgacaataggtaataacacatcttagtattaagagttttacaggccactagtataagataggcatcgtggtagatgcatataaagggtggaatgggagccatggcaggtcatagagtcctctcaatgggaacctgattgatgatcacagtcttcagtggtgagtcagtcctcaccaagttttccagatcattcctacaaagtaaactgggagaataataagtctgaaagagtgtggagtgctcccacaattacaaagaatgcttcctgggtggagtgttgagttggaaccattgtaaaggtgggcaaagcctagtagagaaaccagtgcacctcaggtgcacttacatatggtggggctgaggcaaagcagccctgtaggcttcaaagaatcagtgtaagccactaaaaggaactgaaaacctaggtgtcacaataaacagtctacacagtctcacgtagaccaaaattctgatcattttccaggctgttgcatgaagtgatagagtatgattataatttctgtttgcttgtgctgtttgtttttgtttttcatctgtcaatgtgatgatctgtgttttatagggtagagtggatttgtctactttggctgtaaaataaggaccatacggtaaagctggtataacatttctcacaacccacatacctcttatacttggcacacaaactacgtttccatttagaaactttcgtcttgtttctgtttttaattcttgtgggtttgtttcatgtgaattgtttcctcagatcattgatgtcttaaagtgaaacagaaaaatccagaatcagaatttgacaggctggcatattcatttattcagaattccaagtgcccattgctacttctgctagataaagagataccaaggtgaagaagaaactttccctctagttgctaacagcttagaaagtacagtagacatactggggttttatttaagactttcttgaatgaagaaataaattgcattcccacggtggacagcgttagataacagtatgttcaagggctggtatttcagggtccatctccaaaacagttctgtacaaagagctcacacctgcggccaggcaagctaagtaagtcacaggtggagtgaggaatgagaataaatgggtggaagaaaatatcctaggaactttcatcttgactttaagcccattgagtgtaggaaaataattttttacatccacaattttgtttctatttaaacagcacttgtttttttatatgaagtaactcatttaatccacaactatataatattgttatccccccattaaaactgagctcagagagatg

SEQ ID NO: 445880 - DNA, 2938 bp, Homo sapiens
  misc_feature (1)..(1): n is a, c, g, or t
nggtccggaattcccgggattcaacatggaggcagaggaatcggagaaggccgcaacggagcaagagccgctggaagggacagaacagacactagatgcggaggaggagcaggaggaatccgaagaagcggcctgtggcagcaagaagcgggtagtgccaggtattgtgtacctgggccatatcccgccgcgcttccggcccctgcacgtccgcaaccttctcagcgcctatggcgaggtcggacgcgtcttctttcaggctgaggaccggttcgtgagacgcaagaagaaggcagcagcagctgccggagggaaaaagcggtcctacaccaaggactacaccgagggatgggtggagttccgtgacaagcgcatagccaagcgcgtggcggccagtctacacaacacgcctatgggtgcccgcaggcgcagccccttccgttatgatctttggaacctcaagtacttgcaccgtttcacctggtcccacctcagcgagcacctcgcctttgagcgccaggtgcgcaggcagcgcttgagagcggaggttgctcaagccaagcgtgagaccgacttctatcttcaaagtgtggaacggggacaacgctttcttgcggccgatggggaccctgctcgcccagatggctcctggacatttgcccagcgtcctactgagcaggaactgagggcccgtaaagcagcacggccagggggacgtgaacgggctcgcctggcaactgcccaggacaaggcccgctccaacaaagggctcctggccaggatctttggagccccgccaccctcagagagcatggagggaccttcccttgtcagggactcctgagggcctgggtggccccttccatttcctggccctgctctgcttcctgtctacctcatactagaatgatcgtgactacccgggcagacattttactgtgtttctcagaccaagtgtctactgatggcccaaacatggagttttgtgggcttccactgtccccactccgaactcctgtatgtgcctggctgagtcacctaattcatactgtcatactagcataattatgactattgcatatgcttgttttgtttgactcttggctgcctacgtctgtagggtcccctgaaaatcccacttcctgcccccagaaagggcctttatttccaactaggaggataatgcctagtccaggcaatctttctctgtttagcagtcacaggtgagggtggtattagcatcttttttatgtagaaaaaattgagttaatggggtggactgggttgggaagaaatacatttcctaatgtatttatagaaaataaaaatatttttatgtgcctttttatttttgttggtggggaggtcattggacaagttccaactttcatcttgtgttcccttcaccttcatatcctgatcttagagcccccctccccctgccacccaccttactgtttaacctggatttttttttctatttaatttttgtctaatatcttagcccagtttatcaatcagttatcttaagtcagcattttctaagccattgtttgaggaaacagtgacaataggtaataacacatcttagtattaagagttttacaggccactagtataagataggcatcgtggtagatgcatataaagggtggaatgggagccatggcaggtcatagagtcctctcaatgggaacctgattgatgatcacagtcttcagtggtgagtcagtcctcaccaagttttccagatcattcctacaaagtaaactgggagaataataagtctgaaagagtgtggagtgctcccacaattacaaagaatgcttcctgggtggagtgttgagttggaaccattgtaaaggtgggcaaagcctagtagagaaaccagtgcacctcaggtgcacttacatatggtggggctgaggcaaagcagccctgtaggcttcaaagaatcagtgtaagccactaaaaggaactgaaaacctaggtgtcacaataaacagtctacacagtctcacgtagaccaaaattctgatcattttccaggctgttgcatgaagtgatagagtatgattataatttctgtttgcttgtgctgtttgtttttgtttttcatctgtcaatgtgatgatctgtgttttatagggtagagtggatttgtctactttggctgtaaaataccctaatcacattatgatcttgacaggtgcactttactggggagaataaaaaggaccatacggtaaagctggtataacatttctcacaacccacatacctcttatacttggcacacaaactacgtttccatttagaaactttcgtcttgtttctgtttttaattcttgtgggtttgtttcatgtgaattgtttcctcagatcattgatgtcttaaagtgaaacagaaaaatccagaatcagaatttgacaggctggcatattcatttattcagaattccaagtgcccattgctacttctgctagataaagagataccaaggtgaagaagaaactttccctctagttgctaacagcttagaaagtacagtagacatactggggttttatttaagactttcttgaatgaagaaataaattgcattcccacggtggacagcgttagataacagtatgttcaagggctggtatttcagggtccatctccaaaacagttctgtacaaagagctcacacctgcggccaggcaagctaagtaagtcacaggtggagtgaggaatgagaataaatgggtggaagaaaatatcctaggaactttcatcttgactttaagcccattgagtgtaggaaaataattttttacatccacaattttgtttctatttaaacagcacttgtttttttatatgaagtaactcatttaatccacaactatataatattgttatccccccattaaaactgagctcagagagatg

SEQ ID NO: 445881 - DNA, 3628 bp, Homo sapiens
  misc_feature (1)..(1): n is a, c, g, or t
nggtccggaattcccgggattcaacatggaggcagaggaatcggagaaggccgcaacggagcaagagccgctggaagggacagaacagacactagatgcggaggaggagcaggaggaatccgaagaagcggcctgtggcagcaagaagcgggtagtgccaggtattgtgtacctgggccatatcccgccgcgcttccggcccctgcacgtccgcaaccttctcagcgcctatggcgaggtcggacgcgtcttctttcaggctgagggtaagtatgcaggccctgacggtgacaggaggaggttgtcgctcgctggcggggtgcaagcatgcatgtcctgttgcttcgctgcgcgaggctgaggcacgagttgctggatttcgggggtggggagtgcggtgcttggctcctggctggtgaatcagtctgtgaggatgctggggtgggcgggcggaggggatatggggagagtgggtagcgcagtgtgtctggtggttctttagttctcggattgttactatttgtgttcttatcccggctctgttcacctctctttccggacctgtttactggtttgttacatgaatacaacctgagtaaaagtctcgtcagcttttctacaaaactgaacataactctttagcattgctgcctaggtcaagaaactatttgatcaaccgcccctcttctttccaccctcaattttacattgaggctgaggacttgtgccggttttaagcagcgttcagggctggccagattaaggagtggacaattaaggaaagaattgagttagctagaggaaagggtgcgatttacagttcccttcctcctgggcaaaaactcttcaggtgggactcccactggcagatgtgaagaacgttgcgggcagtgggaggtgcttttgagtgagtgctgcataggcgtcctggacgggtctttgtctttggcgcgcagaccggttcgtgagacgcaagaagaaggcagcagcagctgccggagggaaaaagcggtcctacaccaaggactacaccgagggatgggtggagttccgtgacaagcgcatagccaagcgcgtggcggccagtctacacaacacgcctatgggtgcccgcaggcgcagccccttccgttatgatctttggaacctcaagtacttgcaccgtttcacctggtcccacctcagcgagcacctcgcctttgagcgccaggtgcgcaggcagcgcttgagagcggaggttgctcaagccaagcgtgagaccgacttctatcttcaaagtgtggaacggggacaacgctttcttgcggccgatggggaccctgctcgcccagatggctcctggacatttgcccagcgtcctactgagcaggaactgagggcccgtaaagcagcacggccagggggacgtgaacgggctcgcctggcaactgcccaggacaaggcccgctccaacaaagggctcctggccaggatctttggagccccgccaccctcagagagcatggagggaccttcccttgtcagggactcctgagggcctgggtggccccttccatttcctggccctgctctgcttcctgtctacctcatactagaatgatcgtgactacccgggcagacattttactgtgtttctcagaccaagtgtctactgatggcccaaacatggagttttgtgggcttccactgtccccactccgaactcctgtatgtgcctggctgagtcacctaattcatactgtcatactagcataattatgactattgcatatgcttgttttgtttgactcttggctgcctacgtctgtagggtcccctgaaaatcccacttcctgcccccagaaagggcctttatttccaactaggaggataatgcctagtccaggcaatctttctctgtttagcagtcacaggtgagggtggtattagcatcttttttatgtagaaaaaattgagttaatggggtggactgggttgggaagaaatacatttcctaatgtatttatagaaaataaaaatatttttatgtgcctttttatttttgttggtggggaggtcattggacaagttccaactttcatcttgtgttcccttcaccttcatatcctgatcttagagcccccctccccctgccacccaccttactgtttaacctggatttttttttctatttaatttttgtctaatatcttagcccagtttatcaatcagttatcttaagtcagcattttctaagccattgtttgaggaaacagtgacaataggtaataacacatcttagtattaagagttttacaggccactagtataagataggcatcgtggtagatgcatataaagggtggaatgggagccatggcaggtcatagagtcctctcaatgggaacctgattgatgatcacagtcttcagtggtgagtcagtcctcaccaagttttccagatcattcctacaaagtaaactgggagaataataagtctgaaagagtgtggagtgctcccacaattacaaagaatgcttcctgggtggagtgttgagttggaaccattgtaaaggtgggcaaagcctagtagagaaaccagtgcacctcaggtgcacttacatatggtggggctgaggcaaagcagccctgtaggcttcaaagaatcagtgtaagccactaaaaggaactgaaaacctaggtgtcacaataaacagtctacacagtctcacgtagaccaaaattctgatcattttccaggctgttgcatgaagtgatagagtatgattataatttctgtttgcttgtgctgtttgtttttgtttttcatctgtcaatgtgatgatctgtgttttatagggtagagtggatttgtctactttggctgtaaaataccctaatcacattatgatcttgacaggtgcactttactggggagaataaaaaggaccatacggtaaagctggtataacatttctcacaacccacatacctcttatacttggcacacaaactacgtttccatttagaaactttcgtcttgtttctgtttttaattcttgtgggtttgtttcatgtgaattgtttcctcagatcattgatgtcttaaagtgaaacagaaaaatccagaatcagaatttgacaggctggcatattcatttattcagaattccaagtgcccattgctacttctgctagataaagagataccaaggtgaagaagaaactttccctctagttgctaacagcttagaaagtacagtagacatactggggttttatttaagactttcttgaatgaagaaataaattgcattcccacggtggacagcgttagataacagtatgttcaagggctggtatttcagggtccatctccaaaacagttctgtacaaagagctcacacctgcggccaggcaagctaagtaagtcacaggtggagtgaggaatgagaataaatgggtggaagaaaatatcctaggaactttcatcttgactttaagcccattgagtgtaggaaaataattttttacatccacaattttgtttctatttaaacagcacttgtttttttatatgaagtaactcatttaatccacaactatataatattgttatccccccattaaaactgagctcagagagatg

SEQ ID NO: 445882 - DNA, 2741 bp, Homo sapiens
  misc_feature (1)..(1): n is a, c, g, or t
nggtccggaattcccgggattcaacatggaggcagaggaatcggagaaggccgcaacggagcaagagccgctggaagggacagaacagacactagatgcggaggaggagcaggaggaatccgaagaagcggcctgtggcagcaagaagcgggtagtgccaggtattgtgtacctgggccatatcccgccgcgcttccggcccctgcacgtccgcaaccttctcagcgcctatggcgaggtcggacgcgtcttctttcaggctgaggtacttgcaccgtttcacctggtcccacctcagcgagcacctcgcctttgagcgccaggtgcgcaggcagcgcttgagagcggaggttgctcaagccaagcgtgagaccgacttctatcttcaaagtgtggaacggggacaacgctttcttgcggccgatggggaccctgctcgcccagatggctcctggacatttgcccagcgtcctactgagcaggaactgagggcccgtaaagcagcacggccagggggacgtgaacgggctcgcctggcaactgcccaggacaaggcccgctccaacaaagggctcctggccaggatctttggagccccgccaccctcagagagcatggagggaccttcccttgtcagggactcctgagggcctgggtggccccttccatttcctggccctgctctgcttcctgtctacctcatactagaatgatcgtgactacccgggcagacattttactgtgtttctcagaccaagtgtctactgatggcccaaacatggagttttgtgggcttccactgtccccactccgaactcctgtatgtgcctggctgagtcacctaattcatactgtcatactagcataattatgactattgcatatgcttgttttgtttgactcttggctgcctacgtctgtagggtcccctgaaaatcccacttcctgcccccagaaagggcctttatttccaactaggaggataatgcctagtccaggcaatctttctctgtttagcagtcacaggtgagggtggtattagcatcttttttatgtagaaaaaattgagttaatggggtggactgggttgggaagaaatacatttcctaatgtatttatagaaaataaaaatatttttatgtgcctttttatttttgttggtggggaggtcattggacaagttccaactttcatcttgtgttcccttcaccttcatatcctgatcttagagcccccctccccctgccacccaccttactgtttaacctggatttttttttctatttaatttttgtctaatatcttagcccagtttatcaatcagttatcttaagtcagcattttctaagccattgtttgaggaaacagtgacaataggtaataacacatcttagtattaagagttttacaggccactagtataagataggcatcgtggtagatgcatataaagggtggaatgggagccatggcaggtcatagagtcctctcaatgggaacctgattgatgatcacagtcttcagtggtgagtcagtcctcaccaagttttccagatcattcctacaaagtaaactgggagaataataagtctgaaagagtgtggagtgctcccacaattacaaagaatgcttcctgggtggagtgttgagttggaaccattgtaaaggtgggcaaagcctagtagagaaaccagtgcacctcaggtgcacttacatatggtggggctgaggcaaagcagccctgtaggcttcaaagaatcagtgtaagccactaaaaggaactgaaaacctaggtgtcacaataaacagtctacacagtctcacgtagaccaaaattctgatcattttccaggctgttgcatgaagtgatagagtatgattataatttctgtttgcttgtgctgtttgtttttgtttttcatctgtcaatgtgatgatctgtgttttatagggtagagtggatttgtctactttggctgtaaaataccctaatcacattatgatcttgacaggtgcactttactggggagaataaaaaggaccatacggtaaagctggtataacatttctcacaacccacatacctcttatacttggcacacaaactacgtttccatttagaaactttcgtcttgtttctgtttttaattcttgtgggtttgtttcatgtgaattgtttcctcagatcattgatgtcttaaagtgaaacagaaaaatccagaatcagaatttgacaggctggcatattcatttattcagaattccaagtgcccattgctacttctgctagataaagagataccaaggtgaagaagaaactttccctctagttgctaacagcttagaaagtacagtagacatactggggttttatttaagactttcttgaatgaagaaataaattgcattcccacggtggacagcgttagataacagtatgttcaagggctggtatttcagggtccatctccaaaacagttctgtacaaagagctcacacctgcggccaggcaagctaagtaagtcacaggtggagtgaggaatgagaataaatgggtggaagaaaatatcctaggaactttcatcttgactttaagcccattgagtgtaggaaaataattttttacatccacaattttgtttctatttaaacagcacttgtttttttatatgaagtaactcatttaatccacaactatataatattgttatccccccattaaaactgagctcagagagatg

SEQ ID NO: 445883 - DNA, 2948 bp, Homo sapiens
agcggacggccgtcgtgccgctcgtgtcagtcaacatggaggcagaggaatcggagaaggccgcaacggagcaagagccgctggaagggacagaacagacactagatgcggaggaggagcaggaggaatccgaagaagcggcctgtggcagcaagaagcgggtagtgccaggtattgtgtacctgggccatatcccgccgcgcttccggcccctgcacgtccgcaaccttctcagcgcctatggcgaggtcggacgcgtcttctttcaggctgaggaccggttcgtgagacgcaagaagaaggcagcagcagctgccggagggaaaaagcggtcctacaccaaggactacaccgagggatgggtggagttccgtgacaagcgcatagccaagcgcgtggcggccagtctacacaacacgcctatgggtgcccgcaggcgcagccccttccgttatgatctttggaacctcaagtacttgcaccgtttcacctggtcccacctcagcgagcacctcgcctttgagcgccaggtgcgcaggcagcgcttgagagcggaggttgctcaagccaagcgtgagaccgacttctatcttcaaagtgtggaacggggacaacgctttcttgcggccgatggggaccctgctcgcccagatggctcctggacatttgcccagcgtcctactgagcaggaactgagggcccgtaaagcagcacggccagggggacgtgaacgggctcgcctggcaactgcccaggacaaggcccgctccaacaaagggctcctggccaggatctttggagccccgccaccctcagagagcatggagggaccttcccttgtcagggactcctgagggcctgggtggccccttccatttcctggccctgctctgcttcctgtctacctcatactagaatgatcgtgactacccgggcagacattttactgtgtttctcagaccaagtgtctactgatggcccaaacatggagttttgtgggcttccactgtccccactccgaactcctgtatgtgcctggctgagtcacctaattcatactgtcatactagcataattatgactattgcatatgcttgttttgtttgactcttggctgcctacgtctgtagggtcccctgaaaatcccacttcctgcccccagaaagggcctttatttccaactaggaggataatgcctagtccaggcaatctttctctgtttagcagtcacaggtgagggtggtattagcatcttttttatgtagaaaaaattgagttaatggggtggactgggttgggaagaaatacatttcctaatgtatttatagaaaataaaaatatttttatgtgcctttttatttttgttggtggggaggtcattggacaagttccaactttcatcttgtgttcccttcaccttcatatcctgatcttagagcccccctccccctgccacccaccttactgtttaacctggatttttttttctatttaatttttgtctaatatcttagcccagtttatcaatcagttatcttaagtcagcattttctaagccattgtttgaggaaacagtgacaataggtaataacacatcttagtattaagagttttacaggccactagtataagataggcatcgtggtagatgcatataaagggtggaatgggagccatggcaggtcatagagtcctctcaatgggaacctgattgatgatcacagtcttcagtggtgagtcagtcctcaccaagttttccagatcattcctacaaagtaaactgggagaataataagtctgaaagagtgtggagtgctcccacaattacaaagaatgcttcctgggtggagtgttgagttggaaccattgtaaaggtgggcaaagcctagtagagaaaccagtgcacctcaggtgcacttacatatggtggggctgaggcaaagcagccctgtaggcttcaaagaatcagtgtaagccactaaaaggaactgaaaacctaggtgtcacaataaacagtctacacagtctcacgtagaccaaaattctgatcattttccaggctgttgcatgaagtgatagagtatgattataatttctgtttgcttgtgctgtttgtttttgtttttcatctgtcaatgtgatgatctgtgttttatagggtagagtggatttgtctactttggctgtaaaataccctaatcacattatgatcttgacaggtgcactttactggggagaataaaaaggaccatacggtaaagctggtataacatttctcacaacccacatacctcttatacttggcacacaaactacgtttccatttagaaactttcgtcttgtttctgtttttaattcttgtgggtttgtttcatgtgaattgtttcctcagatcattgatgtcttaaagtgaaacagaaaaatccagaatcagaatttgacaggctggcatattcatttattcagaattccaagtgcccattgctacttctgctagataaagagataccaaggtgaagaagaaactttccctctagttgctaacagcttagaaagtacagtagacatactggggttttatttaagactttcttgaatgaagaaataaattgcattcccacggtggacagcgttagataacagtatgttcaagggctggtatttcagggtccatctccaaaacagttctgtacaaagagctcacacctgcggccaggcaagctaagtaagtcacaggtggagtgaggaatgagaataaatgggtggaagaaaatatcctaggaactttcatcttgactttaagcccattgagtgtaggaaaataattttttacatccacaattttgtttctatttaaacagcacttgtttttttatatgaagtaactcatttaatccacaactatataatattgttatccccccattaaaactgagctcagagagatg

SEQ ID NO: 445884 - DNA, 2896 bp, Homo sapiens
agcggacggccgtcgtgccgctcgtgtcagtcaacatggaggcagaggaatcggagaaggccgcaacggagcaagagccgctggaagggacagaacagacactagatgcggaggaggagcaggaggaatccgaagaagcggcctgtggcagcaagaagcgggtagtgccaggtattgtgtacctgggccatatcccgccgcgcttccggcccctgcacgtccgcaaccttctcagcgcctatggcgaggtcggacgcgtcttctttcaggctgaggaccggttcgtgagacgcaagaagaaggcagcagcagctgccggagggaaaaagcggtcctacaccaaggactacaccgagggatgggtggagttccgtgacaagcgcatagccaagcgcgtggcggccagtctacacaacacgcctatgggtgcccgcaggcgcagccccttccgttatgatctttggaacctcaagtacttgcaccgtttcacctggtcccacctcagcgagcacctcgcctttgagcgccaggtgcgcaggcagcgcttgagagcggaggttgctcaagccaagcgtgagaccgacttctatcttcaaagtgtggaacggggacaacgctttcttgcggccgatggggaccctgctcgcccagatggctcctggacatttgcccagcgtcctactgagcaggaactgagggcccgtaaagcagcacggccagggggacgtgaacgggctcgcctggcaactgcccaggacaaggcccgctccaacaaagggctcctggccaggatctttggagccccgccaccctcagagagcatggagggaccttcccttgtcagggactcctgagggcctgggtggccccttccatttcctggccctgctctgcttcctgtctacctcatactagaatgatcgtgactacccgggcagacattttactgtgtttctcagaccaagtgtctactgatggcccaaacatggagttttgtgggcttccactgtccccactccgaactcctgtatgtgcctggctgagtcacctaattcatactgtcatactagcataattatgactattgcatatgcttgttttgtttgactcttggctgcctacgtctgtagggtcccctgaaaatcccacttcctgcccccagaaagggcctttatttccaactaggaggataatgcctagtccaggcaatctttctctgtttagcagtcacaggtgagggtggtattagcatcttttttatgtagaaaaaattgagttaatggggtggactgggttgggaagaaatacatttcctaatgtatttatagaaaataaaaatatttttatgtgcctttttatttttgttggtggggaggtcattggacaagttccaactttcatcttgtgttcccttcaccttcatatcctgatcttagagcccccctccccctgccacccaccttactgtttaacctggatttttttttctatttaatttttgtctaatatcttagcccagtttatcaatcagttatcttaagtcagcattttctaagccattgtttgaggaaacagtgacaataggtaataacacatcttagtattaagagttttacaggccactagtataagataggcatcgtggtagatgcatataaagggtggaatgggagccatggcaggtcatagagtcctctcaatgggaacctgattgatgatcacagtcttcagtggtgagtcagtcctcaccaagttttccagatcattcctacaaagtaaactgggagaataataagtctgaaagagtgtggagtgctcccacaattacaaagaatgcttcctgggtggagtgttgagttggaaccattgtaaaggtgggcaaagcctagtagagaaaccagtgcacctcaggtgcacttacatatggtggggctgaggcaaagcagccctgtaggcttcaaagaatcagtgtaagccactaaaaggaactgaaaacctaggtgtcacaataaacagtctacacagtctcacgtagaccaaaattctgatcattttccaggctgttgcatgaagtgatagagtatgattataatttctgtttgcttgtgctgtttgtttttgtttttcatctgtcaatgtgatgatctgtgttttatagggtagagtggatttgtctactttggctgtaaaataccctaatcacattatgatcttgacaggtgcactttactggggagaataaatatacttggcacacaaactacgtttccatttagaaactttcgtcttgtttctgtttttaattcttgtgggtttgtttcatgtgaattgtttcctcagatcattgatgtcttaaagtgaaacagaaaaatccagaatcagaatttgacaggctggcatattcatttattcagaattccaagtgcccattgctacttctgctagataaagagataccaaggtgaagaagaaactttccctctagttgctaacagcttagaaagtacagtagacatactggggttttatttaagactttcttgaatgaagaaataaattgcattcccacggtggacagcgttagataacagtatgttcaagggctggtatttcagggtccatctccaaaacagttctgtacaaagagctcacacctgcggccaggcaagctaagtaagtcacaggtggagtgaggaatgagaataaatgggtggaagaaaatatcctaggaactttcatcttgactttaagcccattgagtgtaggaaaataattttttacatccacaattttgtttctatttaaacagcacttgtttttttatatgaagtaactcatttaatccacaactatataatattgttatccccccattaaaactgagctcagagagatg

SEQ ID NO: 445885 - DNA, 2894 bp, Homo sapiens
agcggacggccgtcgtgccgctcgtgtcagtcaacatggaggcagaggaatcggagaaggccgcaacggagcaagagccgctggaagggacagaacagacactagatgcggaggaggagcaggaggaatccgaagaagcggcctgtggcagcaagaagcgggtagtgccaggtattgtgtacctgggccatatcccgccgcgcttccggcccctgcacgtccgcaaccttctcagcgcctatggcgaggtcggacgcgtcttctttcaggctgaggaccggttcgtgagacgcaagaagaaggcagcagcagctgccggagggaaaaagcggtcctacaccaaggactacaccgagggatgggtggagttccgtgacaagcgcatagccaagcgcgtggcggccagtctacacaacacgcctatgggtgcccgcaggcgcagccccttccgttatgatctttggaacctcaagtacttgcaccgtttcacctggtcccacctcagcgagcacctcgcctttgagcgccaggtgcgcaggcagcgcttgagagcggaggttgctcaagccaagcgtgagaccgacttctatcttcaaagtgtggaacggggacaacgctttcttgcggccgatggggaccctgctcgcccagatggctcctggacatttgcccagcgtcctactgagcaggaactgagggcccgtaaagcagcacggccagggggacgtgaacgggctcgcctggcaactgcccaggacaaggcccgctccaacaaagggctcctggccaggatctttggagccccgccaccctcagagagcatggagggaccttcccttgtcagggactcctgagggcctgggtggccccttccatttcctggccctgctctgcttcctgtctacctcatactagaatgatcgtgactacccgggcagacattttactgtgtttctcagaccaagtgtctactgatggcccaaacatggagttttgtgggcttccactgtccccactccgaactcctgtatgtgcctggctgagtcacctaattcatactgtcatactagcataattatgactattgcatatgcttgttttgtttgactcttggctgcctacgtctgtagggtcccctgaaaatcccacttcctgcccccagaaagggcctttatttccaactaggaggataatgcctagtccaggcaatctttctctgtttagcagtcacaggtgagggtggtattagcatcttttttatgtagaaaaaattgagttaatggggtggactgggttgggaagaaatacatttcctaatgtatttatagaaaatattccaactttcatcttgtgttcccttcaccttcatatcctgatcttagagcccccctccccctgccacccaccttactgtttaacctggatttttttttctatttaatttttgtctaatatcttagcccagtttatcaatcagttatcttaagtcagcattttctaagccattgtttgaggaaacagtgacaataggtaataacacatcttagtattaagagttttacaggccactagtataagataggcatcgtggtagatgcatataaagggtggaatgggagccatggcaggtcatagagtcctctcaatgggaacctgattgatgatcacagtcttcagtggtgagtcagtcctcaccaagttttccagatcattcctacaaagtaaactgggagaataataagtctgaaagagtgtggagtgctcccacaattacaaagaatgcttcctgggtggagtgttgagttggaaccattgtaaaggtgggcaaagcctagtagagaaaccagtgcacctcaggtgcacttacatatggtggggctgaggcaaagcagccctgtaggcttcaaagaatcagtgtaagccactaaaaggaactgaaaacctaggtgtcacaataaacagtctacacagtctcacgtagaccaaaattctgatcattttccaggctgttgcatgaagtgatagagtatgattataatttctgtttgcttgtgctgtttgtttttgtttttcatctgtcaatgtgatgatctgtgttttatagggtagagtggatttgtctactttggctgtaaaataccctaatcacattatgatcttgacaggtgcactttactggggagaataaaaaggaccatacggtaaagctggtataacatttctcacaacccacatacctcttatacttggcacacaaactacgtttccatttagaaactttcgtcttgtttctgtttttaattcttgtgggtttgtttcatgtgaattgtttcctcagatcattgatgtcttaaagtgaaacagaaaaatccagaatcagaatttgacaggctggcatattcatttattcagaattccaagtgcccattgctacttctgctagataaagagataccaaggtgaagaagaaactttccctctagttgctaacagcttagaaagtacagtagacatactggggttttatttaagactttcttgaatgaagaaataaattgcattcccacggtggacagcgttagataacagtatgttcaagggctggtatttcagggtccatctccaaaacagttctgtacaaagagctcacacctgcggccaggcaagctaagtaagtcacaggtggagtgaggaatgagaataaatgggtggaagaaaatatcctaggaactttcatcttgactttaagcccattgagtgtaggaaaataattttttacatccacaattttgtttctatttaaacagcacttgtttttttatatgaagtaactcatttaatccacaactatataatattgttatccccccattaaaactgagctcagagagatg

SEQ ID NO: 445886 - DNA, 2884 bp, Homo sapiens
  misc_feature (1)..(1): n is a, c, g, or t
nggtccggaattcccgggattcaacatggaggcagaggaatcggagaaggccgcaacggagcaagagccgctggaagggacagaacagacactagatgcggaggaggagcaggaggaatccgaagaagcggcctgtggcagcaagaagcgggtagtgccaggtattgtgtacctgggccatatcccgccgcgcttccggcccctgcacgtccgcaaccttctcagcgcctatggcgaggtcggacgcgtcttctttcaggctgaggaccggttcgtgagacgcaagaagaaggcagcagcagctgccggagggaagcgcatagccaagcgcgtggcggccagtctacacaacacgcctatgggtgcccgcaggcgcagccccttccgttatgatctttggaacctcaagtacttgcaccgtttcacctggtcccacctcagcgagcacctcgcctttgagcgccaggtgcgcaggcagcgcttgagagcggaggttgctcaagccaagcgtgagaccgacttctatcttcaaagtgtggaacggggacaacgctttcttgcggccgatggggaccctgctcgcccagatggctcctggacatttgcccagcgtcctactgagcaggaactgagggcccgtaaagcagcacggccagggggacgtgaacgggctcgcctggcaactgcccaggacaaggcccgctccaacaaagggctcctggccaggatctttggagccccgccaccctcagagagcatggagggaccttcccttgtcagggactcctgagggcctgggtggccccttccatttcctggccctgctctgcttcctgtctacctcatactagaatgatcgtgactacccgggcagacattttactgtgtttctcagaccaagtgtctactgatggcccaaacatggagttttgtgggcttccactgtccccactccgaactcctgtatgtgcctggctgagtcacctaattcatactgtcatactagcataattatgactattgcatatgcttgttttgtttgactcttggctgcctacgtctgtagggtcccctgaaaatcccacttcctgcccccagaaagggcctttatttccaactaggaggataatgcctagtccaggcaatctttctctgtttagcagtcacaggtgagggtggtattagcatcttttttatgtagaaaaaattgagttaatggggtggactgggttgggaagaaatacatttcctaatgtatttatagaaaataaaaatatttttatgtgcctttttatttttgttggtggggaggtcattggacaagttccaactttcatcttgtgttcccttcaccttcatatcctgatcttagagcccccctccccctgccacccaccttactgtttaacctggatttttttttctatttaatttttgtctaatatcttagcccagtttatcaatcagttatcttaagtcagcattttctaagccattgtttgaggaaacagtgacaataggtaataacacatcttagtattaagagttttacaggccactagtataagataggcatcgtggtagatgcatataaagggtggaatgggagccatggcaggtcatagagtcctctcaatgggaacctgattgatgatcacagtcttcagtggtgagtcagtcctcaccaagttttccagatcattcctacaaagtaaactgggagaataataagtctgaaagagtgtggagtgctcccacaattacaaagaatgcttcctgggtggagtgttgagttggaaccattgtaaaggtgggcaaagcctagtagagaaaccagtgcacctcaggtgcacttacatatggtggggctgaggcaaagcagccctgtaggcttcaaagaatcagtgtaagccactaaaaggaactgaaaacctaggtgtcacaataaacagtctacacagtctcacgtagaccaaaattctgatcattttccaggctgttgcatgaagtgatagagtatgattataatttctgtttgcttgtgctgtttgtttttgtttttcatctgtcaatgtgatgatctgtgttttatagggtagagtggatttgtctactttggctgtaaaataccctaatcacattatgatcttgacaggtgcactttactggggagaataaaaaggaccatacggtaaagctggtataacatttctcacaacccacatacctcttatacttggcacacaaactacgtttccatttagaaactttcgtcttgtttctgtttttaattcttgtgggtttgtttcatgtgaattgtttcctcagatcattgatgtcttaaagtgaaacagaaaaatccagaatcagaatttgacaggctggcatattcatttattcagaattccaagtgcccattgctacttctgctagataaagagataccaaggtgaagaagaaactttccctctagttgctaacagcttagaaagtacagtagacatactggggttttatttaagactttcttgaatgaagaaataaattgcattcccacggtggacagcgttagataacagtatgttcaagggctggtatttcagggtccatctccaaaacagttctgtacaaagagctcacacctgcggccaggcaagctaagtaagtcacaggtggagtgaggaatgagaataaatgggtggaagaaaatatcctaggaactttcatcttgactttaagcccattgagtgtaggaaaataattttttacatccacaattttgtttctatttaaacagcacttgtttttttatatgaagtaactcatttaatccacaactatataatattgttatccccccattaaaactgagctcagagagatg

SEQ ID NO: 445887 - DNA, 2402 bp, Homo sapiens
  misc_feature (409)..(409): n is a, c, g, or t
tttgatgaaatgtgttcttactgggggttaattttatcactgacagccatttgtcctttagggatacactcctgaatgctggtataaagaaccacagtttcactaatatggattgacaaagactgtcttgaaagaactggttaaatgtgatagggaacatgtaggctgactgcaggtgaacaattaatttggaagtacaggtgaggtgtcttagaaccataaatgaaaaaagataggtcctggaaaatagctttaaaataagcattagccactaatggtatgcatttctaagtcatctttatttgattttgaactagaattttgtataacatgctctattttgttagtagagagatagatgttcgagattcccacaaacaggcaaacctacctataaacataggtattnagatttagtctttaagcacttgtcttaacacttgtttctctctctctaagaggagctatctataagcagcctatgtgattgaggatagagcagcaggaggaagcgagaaattagaaatcgaggatcctgaattcccaaataaggaaggtttcttgttcttacatttaaatgtgggtttgtctgagctgagaatttataatgcttcagaatagtagggtgtgttttactgaaatcattaggaagattatttttttctatcaaaattgccttcttaactgatacaacaaccttagtacagagcattcacagtaaaacatatgctctgtttaatacacattacactgtaaagcagtgagcaaattccattaattttgtagctgtatcataaagccaatgatgttattagactacttggttatgaaactgaattagatactttaaaaattattgaaatgaaagtcagtaattcaaacaagtgagtcattgaaggatattttgttgtatataaggaatcaaaatggtaaataattgaaggatatttttattgtatttaaggcaacaaaatttgagataattttcttcaaaattaaaataacttaaaaatagagtaagtattagttaaaatttctttacattagtttaaaatgtgaacttttaaaacctcacaacttggaaatttaattgtaaattttactctgaaaactaaaaacatctttgagacctttctggatagatatctgctggatataagagtgaggcatccttgggagttccttaaaattaggccagtctgggccgggtgtggtggctcacgcttgtaatcccaacactttgggaggccggggtgggccaatcgctttgagctcaggagttcgagaccagcctgggcaacatggcaaaacccgatctctacaaaaaattagctgggcatggtggtgcgtgcctgtagtcccaactacttgggaaactgaggtgaggccatcgcttgaacctaggaggttgaggttgcagtgagccgtgatgccgctgcactacagcctgggcaagagggtgagaccctgtttaaaaaaaaaattatgatggctgagtctgtgtcaaagaaaattaacttattttttggtgttaactaaattatctttaggtaattacattttatatagattgtgatgatatatggcagtagttttcctattactactacttttttttcttgtttttcctttgtgtttttgtaataccagtggagccttttcttaaaatgaaactaggcaaacctaagacaattatgcttaaggaaaaaaaaagggggggaatcttactcagaactgttttttgaaacggatcaaatggaatggctcagagcaggtgtgatggctcctcctgtaatcccaacactttgggaggctgaggtaggaggatcgtttgagcacaggagttcaagatgaagcctgagcaacatagtgagaccctgtctctatgaaaaaagttaaaaaaaaaaaaaaaaaaaaaagctaggcacggtgatacatgcatgtatcccagctacttgggagggtaaagtggaagaattgcttgagccccgggagttcaagcctgcagtaagctgtgatcaggtgactgcactccagcgtgggcgacagagtgaaaccctgtgttaaaaaaaaaaaaaaaaagtaacagcttagattaaaactgtcataattcaaaattgtaaaggaaggctgggtacagcagctcacgccattaacccctccaaggcaggttgatcgcttaagcccaggagtccaagaccaccctgggcaacatggtaaaaccccatctctatgaaaaatacaaaaattagctgggtatggtggcatgcacctgtagtcccagctactcaggaggctgacatgggaggatcatctgatctcagtctgggaggcaaaggccttagtgacccatgatagtgccactgcactccagcctgggggacagagcaagaccctgtctc

SEQ ID NO: 445888 - DNA, 2463 bp, Homo sapiens
agggagacgcgcagggaggggaggggagggaggaggctagacaaggcgggggaagggggagtagcggtggcttaagccgcgcggagcagcgcaacctgggtcgctccctgcttcgccgccgcctccggaccgagccagcggagtcagtgtcctagagaccctgtaacaccacaaagcggacgaaggagtccatgttggggaacttggcagcggagtgactgggacctgggaacctactgtggggccgcggccggaccgagcgcctcgacctcggtctgaggaaacccttttccaaagagaaatgaagaagaaaactgtatgtaccctaaatatgggagataagaagtatgaagacatggaaggtgaagaaaacggagataatactatttccactggtctgttgtacagtgaggctgacagatgcccaatatgtcttaattgtctattagaaaaggaagttggttttccagaaagctgtaatcatgtcttctgtatgacttgtattcttaaatgggcagagaggagctatctataagcagcctatgtgattgaggatagagcagcaggaggaagcgagaaattagaaatcgaggatcctgaattcccaaataaggaaggtttcttgttcttacatttaaatgtgggtttgtctgagctgagaatttataatgcttcagaatagtagggtgtgttttactgaaatcattaggaagattatttttttctatcaaaattgccttcttaactgatacaacaaccttagtacagagcattcacagtaaaacatatgctctgtttaatacacattacactgtaaagcagtgagcaaattccattaattttgtagctgtatcataaagccaatgatgttattagactacttggttatgaaactgaattagatactttaaaaattattgaaatgaaagtcagtaattcaaacaagtgagtcattgaaggatattttgttgtatataaggaatcaaaatggtaaataattgaaggatatttttattgtatttaaggcaacaaaatttgagataattttcttcaaaattaaaataacttaaaaatagagtaagtattagttaaaatttctttacattagtttaaaatgtgaacttttaaaacctcacaacttggaaatttaattgtaaattttactctgaaaactaaaaacatctttgagacctttctggatagatatctgctggatataagagtgaggcatccttgggagttccttaaaattaggccagtctgggccgggtgtggtggctcacgcttgtaatcccaacactttgggaggccggggtgggccaatcgctttgagctcaggagttcgagaccagcctgggcaacatggcaaaacccgatctctacaaaaaattagctgggcatggtggtgcgtgcctgtagtcccaactacttgggaaactgaggtgaggccatcgcttgaacctaggaggttgaggttgcagtgagccgtgatgccgctgcactacagcctgggcaagagggtgagaccctgtttaaaaaaaaaattatgatggctgagtctgtgtcaaagaaaattaacttattttttggtgttaactaaattatctttaggtaattacattttatatagattgtgatgatatatggcagtagttttcctattactactacttttttttcttgtttttcctttgtgtttttgtaataccagtggagccttttcttaaaatgaaactaggcaaacctaagacaattatgcttaaggaaaaaaaaagggggggaatcttactcagaactgttttttgaaacggatcaaatggaatggctcagagcaggtgtgatggctcctcctgtaatcccaacactttgggaggctgaggtaggaggatcgtttgagcacaggagttcaagatgaagcctgagcaacatagtgagaccctgtctctatgaaaaaagttaaaaaaaaaaaaaaaaaaaaaagctaggcacggtgatacatgcatgtatcccagctacttgggagggtaaagtggaagaattgcttgagccccgggagttcaagcctgcagtaagctgtgatcaggtgactgcactccagcgtgggcgacagagtgaaaccctgtgttaaaaaaaaaaaaaaaaagtaacagcttagattaaaactgtcataattcaaaattgtaaaggaaggctgggtacagcagctcacgccattaacccctccaaggcaggttgatcgcttaagcccaggagtccaagaccaccctgggcaacatggtaaaaccccatctctatgaaaaatacaaaaattagctgggtatggtggcatgcacctgtagtcccagctactcaggaggctgacatgggaggatcatctgatctcagtctgggaggcaaaggccttagtgacccatgatagtgccactgcactccagcctgggggacagagcaagaccctgtctc

SEQ ID NO: 445889 - DNA, 651 bp, Homo sapiens
tgtaaaccttgagtaacacctttgggacccacataagtgccattagtgatgtaggaagtgctcccaagaagcaaaattatggctttataagaagaagtttaattccttgataggaacagattgagatctatagctgcagttgcctgccatttcagacagatgattcatcttgtaaacaaatgatataaacttagggtatcaataaatacagtacagcattataatgtattttctcttatgatttttgtaaataacccttttcctttagcttccttttattggtaagaatacagtatgtaacacataacataaaaaatatattaattccactgttatcagtaaggagtctggtgaataacagttaagttttggggagtaaaaactgtttcaatttttgactgtgttgggggttggtgctcctaatccctgtgttgttaaagggtcgactatattgtatttttgaaaattgctagagagtggacgtaaagtgttctcactaaacaaattataactatgtgaggtagtgcatatattaagtagctagatttggtcattccacaatgtatatgtacttcaaaacatcatgttgtacatgagaaacacagttttatctgttagtcagttttaaaaataaaaaatattccaactaga

SEQ ID NO: 445890 - DNA, 813 bp, Homo sapiens
agggagacgcgcagggaggggaggggagggaggaggctagacaaggcgggggaagggggagtagcggtggcttaagccgcgcggagcagcgcaacctgggtcgctccctgcttcgccgccgcctccggaccgagccagcggagtcagtgtcctagagaccctgtaacaccacaaagcggacgaaggagtccatgttggggaacttggcagcggagtgactgggacctgggaacctactgtggggccgcggccggaccgagcgcctcgacctcggtctgaggaaacccttttccaaagagaaatgaagaagaaaactgtatgtaccctaaatatgggagataagaagtatgaagacatggaaggtgaagaaaacggagataatactatttccactggtctgttgtacagtgaggctgacagatgcccaatatgtcttaattgtctattagaaaaggaagttggttttccagaaagctgtaatcatgtcttctgtatgacttgtattcttaaatgggcagaggtaagtctgacacattaatgtattttaatttcctagcatgatttcatttcacctaaagagttgatactgcctttcataaattatttcacagtaatgtattttcttcctactttggacaaatttccttgtattattcaaattctgtcagtcattttcttctaattttcttttatcaggctttgattttgcaaataatattttaaatgcatacttttttaaaaaaagttaataaccttataggaagaacagatcaaactttttttctggtagaaatgcagtaattaatttttcag

SEQ ID NO: 445891 - DNA, 535 bp, Homo sapiens
aaattaactgaggatgtcccagaagatttaatgagtagatgatgtatgagttggtcttaaaggatagttaggaaattgttcaagtaaaaaaacagctgagagaaacaaaagacaagaaaaatgaaaactcatttgagaaacaggtctcctgtcatgaaaattctaaaagctgtataaggttagtgattaactttagaagtggaatgcaaatgagtggaacagaagttaactagtacaaaaaaggtattaaaaaaatgaagtggggtttaaatgtatttaatcacttattcaaaagcacacacttgataatttaaggagggactagctgaaatctgagaatctgatttgagctctactctgtttttggtgaagaattggttctggctgggcatggtggctcactcctataatcccagtgctttgggaggctaaggtgagaggatcacatgagaccaggagtttggtaccagcctggggaacatagtgaggaccgtcctcccctcctctgtctctactaaaaaataacacaaaataa

SEQ ID NO: 445892 - DNA, 898 bp, Homo sapiens
  misc_feature (785)..(785): n is a, c, g, or t
gaaagtgccagaaaagcgacgtcctcagggcgggagcaggggacgccgcaacgtagtctgcgagaatgcaggaaggcggcagtgaagcggtcggtcggcggggccgcggcaaagtggggaggaaactcatcccgggcaggcgtcagggtggctggagagcgcagcacgcgcgaacagaacgggggcaggcgacaggaaaacgtgtgagcgcgcggctgaaagcgactgggacctggaaacccttttccaaagagtaaacagatactgaaaatacgaagaaacagaagaaaaagtgacatccgatctagatgcgtgatgatcctaaattctgcgtgacgaaacgatagacaatggactgtccccaatgtggcataagcagaagaaaagtaaactcgttgggccgtgaatccgaagaagccgagacaatcgcatgagaaatgtttgaagagcagtcgtcattcgaggacagaacaatacgacaattgaacaatttcagggcaacattcgttgtgacatacaagaagcttcgggtatctagcgttggcgcgtattactaaacgcgatgagtaagaatggcagcagtgcaagcctgtgtgctagcagtgcacctatagcaggacagctacgttatgtggccgtagtcaataggattcagaaagtgcaagaatcagggtgagcacaagatccgcaaagaccacgctcttcacgggcacattcacaacgagtctccagggacgtgcaatctgttcaacgttccgctggaaacaagcagatccctactaagncgtagaaacacgtgcaagcaggcacgtcactcaattctcgatagcacgcacgcacgatgcgactctgcgactggaccattctcgcatccaagactgcggaccgctgaggaaca

SEQ ID NO: 445893 - DNA, 545 bp, Homo sapiens
  misc_feature (117)..(117): n is a, c, g, or t
  misc_feature (331)..(331): n is a, c, g, or t
  misc_feature (345)..(345): n is a, c, g, or t
  misc_feature (373)..(373): n is a, c, g, or t
gttcattaatcattgtgaaaaatacagaaaccaaaaccaatatggctggtttctttcccacacccctccaccctgttcaggatagtcatttgttctcacaaccggcagaggcagaanagggttggaatgaagactccgaaggcccccaggatgggaaacatgaggctgctgttgtccgaggcataggggttgggtgtgcgggggcctgactgcacccggttcttattggtctgttttttgagattagacccttcatcatattcttcttcttcttcttcctcttctttcttctccaatcccggatgaggctgaagctttggtacatctaacncaaggaagaaaacnctgttaagacccccagcatttaagtaanagagacccttaaaagcagcaaataagccccaataaagagattgcagtgattgccccagggtccatgagatattgtttgtattatgaagttggagtgctgtctactgaaattatactcttaaataaatatgtatgtagtgtgtaatattttctaataaattcttttgataaac

SEQ ID NO: 445894 - DNA, 684 bp, Homo sapiens
agggagacgcgcagggaggggaggggagggaggaggctagacaaggcgggggaagggggagtagcggtggcttaagccgcgcggagcagcgcaacctgggtcgctccctgcttcgccgccgcctccggaccgagccagcggagtcagtgtcgaaacccttttccaaagagaaatgaagaagaaaactgtatgtaccctaaatatgggagataagaagtatgaagacatggaaggtgaagaaaacggagataatactatttccactggtctgttgtacagtgaggctgacagatgcccaatatgtcttaattgtctattagaaaaggaagttggttttccagaaagctgtaatcatgtcttctgtatgacttgtattcttaaatgggcagaggtaagtctgacacattaatgtattttaatttcctagcatgatttcatttcacctaaagagttgatactgcctttcataaattatttcacagtaatgtattttcttcctactttggacaaatttccttgtattattcaaattctgtcagtcattttcttctaattttcttttatcaggctttgattttgcaaataatattttaaatgcatacttttttaaaaaaagttaataaccttataggaagaacagatcaaactttttttctggtagaaatgcagtaattaatttttcag

SEQ ID NO: 445895 - DNA, 311 bp, Homo sapiens
agggagacgcgcagggaggggaggggagggaggaggctagacaaggcgggggaagggggagtagcggtggcttaagccgcgcggagcagcgcaacctgggtcgctccctgcttcgccgccgcctccggaccgagccagcggagtcagtgtcctagagaccctgtaacaccacaaagcggacgaaggagtccatgttggggaacttggcagcggagtgactgggacctgggaacctactgtggggccgcggccggaccgagcgcctcgacctcggtctgagaaaaaaaaaaaaaaaaaaaaaaaaaaaaaaa

SEQ ID NO: 445896 - DNA, 7869 bp, Homo sapiens
tgtaaaccttgagtaacacctttgggacccacataagtgccattagtgatgtaggaagtgctcccaagaagcaaaattatggctttataagaagaagtttaattccttgataggaacagattgagatctatagctgcagttgcctgccatttcagacagatgattcatcttgtaaacaaatgatataaacttagggtatcaataaatacagtacagcattataatgtattttctcttatgatttttgtaaataacccttttcctttagcttccttttattggtaagaatacagtatgtaacacataacataaaaaatatattaattccactgttatcagtaaggagtctggtgaataacagttaagttttggggagtaaaaactgtttcaatttttgactgtgttgggggttggtgctcctaatccctgtgttgttaaagggtcgactatattgtatttttgaaaattgctagagagtggacgtaaagtgttctcactaaacaaattataactatgtgaggtagtgcatatattaagtagctagatttggtcattccacaatgtatatgtacttcaaaacatcatgttgtacatgagaaacacagttttatctgttagtcagttttaaaaataaaaaatattccaactagaaactctgttgtagtttttgaaattacaacttggaggctttgaggaactgattagaagtctcctttctgtttcaggctttcatatccaaaccatagatctttagaagtaacatctgttaattaattattaataaatagtttgagtctttattaattcatggataacttgaccattttctctctccttttgcttagataatcccagatcatggccgggcacagtagctcacgcctgtattcccagcagtttgggaggccgaggcaggcagatcacttgaactcaggagtttgagaccagcttgggcaacatggcaaaaccctgtctctattaaaaatacaaaaattagctgggcatggtagtgcatgcctgtagtcccagctacctgggaggctgaggtgggaggatcgcttgagcctgggaggttgaggcttctgtgcgcgatgattgctccagtgatcacgccattgcactccagcctgggtgacagagtgagaccctgtctccaaaaaaaaaaaaaattaagcaagtagcagttacaagaccaaaagttattttcctttttttttttctctataaaattgcccatttggaccaaatctagttataacttatttcagtgtcattaagaaagttgatgaataagtcatattactcagatgttagtagctatgcatttattaatagttttatttataagtatttagtttcactctgttgcagactattttatgctaaaattagctaaagccaaattactatttcttaaaacatattttttactttttttttttttttaaatattattaggtacttcttgcaagggatatgcattagcacatactcaagaaggggaagaaaagaagcaaacttctggtacatcaaataccagaggatcaagacgaaaacctgcaatgacaactcctacaaggaggtctacacgtaacacaagagctgaaacagccagtcagtctcagagatccccaatatcagacaattctgggtgtgatgccccaggtaacagtaatccatctttaagtgttccctcttcagctgagtcagaaaagcaaacaagacaggctccaaaacggaagtctgtaagaagaggaagaaaaccacctttactgaaaaagaaacttcggagctctgtagctgcccctgaaaaatcatcttccaatgattcagtagatgaagaaacagcagaatctgacacatcacctgtgttagaaaaagagcaccaaccagatgtagacagtagtaacatttgtactgtgcagactcatgtagaaaaccagtctgctaattgcttgaaaagttgcaatgagcaaatagaagaaagtgagaagcatactgcaaattatgatacagaggaaagagtaggatcttcatcttctgagtcttgtgctcaagatcttcctgtgctagttggtgaggaaggggaagttaaaaaactcgagaatacaggtatagaggctaatgttttgtgtttggaaagtgagatttctgaaaatattcttgaaaaaggaggtgatccattggaaaagcaagaccagatatctggactttcacaatcagaggtaaagacagatgtatgtacagttcatcttccaaatgattttcctacatgtttaacatctgaaagcaaagtgtaccaacctgtatcttgtcccctaagtgacttatctgagaatgtagagtcagtggttaatgaagaaaaaataacagagagttccctagtagaaattactgaacataaagattttacactaaaaacagaggagcttatagagagccccaagttagaatcttctgagggtgaaattatacagacagtggacagacaatctgttaagagcccagaggttcaattgcttgggcatgttgaaactgaagatgtagaaataattgcaacatgtgatacttttgggaatgaagatttcaataatattcaagactctgaaaataacttactaaaaaataatcttctgaacaccaaattggaaaaatctttagaagaaaagaatgaatcgctgaccgaacatcctagatctacagagttgcctaaaacacacattgaacagattcagaagcattttagtgaggacaacaatgaaatgatacctatggagtgtgattcattttgcagtgaccaaaatgaatctgaagttgaaccatctgtaaatgctgatcttaaacaaatgaatgaaaattctgtgacacactgttctgaaaataatatgccgtcttctgatcttgcggatgaaaaggttgaaactgtttctcaaccatctgaaagcccaaaagataccatagataaaaccaaaaagcctcgtactcgaagatctagatttcattctccatctacaacttggtcacccaacaaagacactccacaagaaaagaagcggccccagtctccatctcccagaagagaaactgggaaagaaagcaggaagtctcaatcaccatctcctaagaatgagtcagccagaggccggaaaaaatcccgttctcagtccccaaaaaaggatattgcaagagaaaggaggcaatctcagtctcggtctccaaaaagggatactactagggaaagcagaagatctgaatcactgtccccaagaagagaaacttctagagagaacaaaagatctcagccaagagtgaaagattcttccccaggagaaaaatccaggtcccagagcagagaacgagaaagtgatagagatgggcagaggagagagagagaaaggagaaccagaaagtggtctaggtccagatctcattctaggtccccctcaagatgtagaacaaaaagtaagagttcatcatttggtagaattgacagagatagttactctccccggtggaagggaagatgggcaaatgatggttggagatgtccacgaggaaatgatcggtacagaaagaatgacccagagaaacagaatgaaaatacaagaaaagaaaaaaatgacatccatctagatgctgatgatccaaattctgctgacaaacatagaaatgactgtcccaattggataacagaaaaaataaactctgggcctgatccaagaaccagaaatccagaaaagttgaaagagtctcattgggaagaaaatagaaatgaaaattcaggaaattcttggaataaaaactttggttctggttgggtatctaaccgtggtagaggcagaggcaaccgtggcagaggcacttacagaagtagttttgcctataaagatcagaatgaaaatcggtggcaaaatcgaaaacccctctcagggaattcaaacagttcagggagtgaatctttcaagtttgtggaacagcaatcctataagcgaaaaagtgaacaggagttctcatttgatacaccagcagatagatctggatggacatctgcatccagctgggccgtgagaaagactttgccagcagatgtacaaaactactactcacgacgaggcagaaattcttcaggtccacagtctggatggatgaaacaagaggaggaaacatctggacaggattctagcctaaaagaccaaacaaaccagcaagttgatggttctcagctacctataaatatgatgcaaccgcaaatgaatgtaatgcagcaacaaatgaatgcacaacaccagcctatgaatatcttcccatatccagtgggtgttcatgctcctttgatgaacatccaacgcaatccatttaacattcatcctcagctacccttgcatctccacacaggagtgcccctcatgcaggtagccactcctaccagtgtatctcagggactaccaccaccaccaccccctcccccaccatcccaacaagtcaactacattgcttcacaaccagatggaaagcaattgcagggtattcctagttcttctcatgtaagtaataacatgagtacaccagttttgcctgctccgacagcagccccaggaaatacgggaatggttcagggaccaagttctggtaatacttcgtcatcaagtcacagcaaagcctctaatgctgctgtaaaattggcagaaagcaaagtaagtgttgcagtggaagccagcgcagatagctcgaagacagacaagaaattgcaaattcaagaaaaagcagcacaagaggtaaaattggccatcaagccattttaccaaaataaagatatcaccaaggaagaatataaagaaattgtacggaaagcagtagataaagtttgtcatagtaagagtggagaagtaaattctactaaagtggcaaatctggttaaagcctatgtagacaaatacaaatattcacggaaggggagccaaaagaaaactctggaagaacctgtgtctactgaaaaaaacataggctgaaatggggaacgctgtcaaggacattatcaggatatctgcaaagtgcaatttcaacatgtaccattaactgaaaatcatacataactgtgattgaaatttggttttgataaaattatttttttaacataggatatgatgttttgttctaaataaatataggtctgcactgcaacttctgtatccttccttcccctccaccctcccccacaaaattcaagggaaagtaaagggtttaaaggaatgtgcatctttactaggactgtgttatagtgtggatactggaaaatgtatagctttttgattagggcaatggagtgcataaattagaaacttctaagtgcactggttttcaaagagatatatataatgcatttattctgtcaggttaaaatataaagtatgatctttatgattttttccctctaattatagaaagttaaataatgtattaccatgaaaaatgtttctaatattaaatagaacatatcagttgcaaagttcctaatgtgtatttttaaagcacatatctgaataaattgcctagatagaaaaaaaattatcacgagtaaaatttagtgttcaaaacattgagacactcttcacctattgtatgaccaaataaaggttatgctgcttgtttttcttttgtgcctttgtttacccctaattgagataagcagtttgacttactagattacaactttggcagttcaaagtctttgttgaagactttgaggaaaaagatttggaaaaattgttgactttcggccgggcatgatggctcacgcctgtaatcccagcactttgggaggccgaggtggcggatcacctgaggtcaggagttcgagaccagcctggccaacatggtgaaatcccgtctctactaaaaatacaaaaattagccaggcgtggtggtgggcgcctgtaatcccagctatgcgagaggctgaggcaggagaatcagttgaacccgggaggcggggattgcagtgagccgagaccatgccattgcactccagcctgggcaacaggagcaaatctccgtctcaaaaaaaagaaaaaaaaaagtgttgactttgtagaaattatgttctttcatagtatcttcttctacccgttgcagacgataaattatttgtgccaattcgagaattgctgttaggctgttatcctcccttccttggggctaagaattacaagactcatggcactggcgtaaagttgttgtttatctaatcactgatgaaatattttcacacttgaaaatccccaaatgctttacaatgaatgaagtgttaatttggtgaccaggtggtagccattagccatgttgcaaaattctagacagtaaaacctgtgttttagaaacagaggggaaatttaaataatggagtcctggttagcctttcagggattagggatttgggtttttttttttctctctttttaatactagaatatctcagtttttataaaaggtaagttttctccatgataaactgattccagtaagaattttcagtacataccaagtacctggaaagttcttcagataagttaatagatccaaggagatacatgcctcagtgagataaactgacctttttactagctaaactatttagccagagcaatactctgtagaactgtgcttttctaaagtaaagattatctgtttctcaattttatgtgcataatacttttcctggtgctagctttgataggcaaaatattttgaaatgttggtcccataatgattgtgctagttcataagctttgttgttatgagtgtaatcataaaaatatttccaagcagtttttgacctttattctacatttctgggcatttgtaatatggtattctactggtatatatttttaaagtttgcgtttagattatggtaaagaaatttcaagcatatttcttctaataaagtattaagacagtgtttcagaatatcaaggcacacctccttagttgttttagattagaactctagaaacaattttgtgaacattgaaagtattttgagttaagcctaagctgattaatcacacaatacatacttttcctgcattttctttcagtgacatttgagaattgggtgacattttaaaatgtgttttataccatttagcttttgcaaacaagttctaaagttttggagaaaaagtgatgtggtcaagagttgaagtctcatatatctttagtagcactcccatgaattatttccgtgacagtaacaagtgtgtgttccatgtctgatttggggcactggttagactgcattaatagctacttgattagaattcgaacttttaaaattttgaaatgtttaagaatgtattagaaaatgcatgctttatgttgaaaaaatacattgctttaatattcctcattcttgagttaagaaatttatgttaattttgcatgggcacaaacttaatcagaaacattttgtggagttacatttcctcttattatttatcaaggttcagtattgatctttgaaaccttggtcccgttaacttactagtcacattgaccaatgttttatagaaatgcctagaattttgagactaatagtagttatccattaacattccaaaagttttgtgctttttaaaatttgttttggtaattatcacatttttttctcttaccttcctttaaatggccacagtgtgtactgctggaatgttccatccaaaagatgtagcttcagaagcacagtgattgccccagggtccatgagatattgtttgtattatgaagttggagtgctgtctactgaaattatactcttaaataaatatgtatgtagtgtgtaatattttctaataaattcttttgataaac

SEQ ID NO: 445897 - DNA, 8078 bp, Homo sapiens
tgtaaaccttgagtaacacctttgggacccacataagtgccattagtgatgtaggaagtgctcccaagaagcaaaattatggctttataagaagaagtttaattccttgataggaacagattgagatctatagctgcagttgcctgccatttcagacagatgattcatcttgtaaacaaatgatataaacttagggtatcaataaatacagtacagcattataatgtattttctcttatgatttttgtaaataacccttttcctttagcttccttttattggtaagaatacagtatgtaacacataacataaaaaatatattaattccactgttatcagtaaggagtctggtgaataacagttaagttttggggagtaaaaactgtttcaatttttgactgtgttgggggttggtgctcctaatccctgtgttgttaaagggtcgactatattgtatttttgaaaattgctagagagtggacgtaaagtgttctcactaaacaaattataactatgtgaggtagtgcatatattaagtagctagatttggtcattccacaatgtatatgtacttcaaaacatcatgttgtacatgagaaacacagttttatctgttagtcagttttaaaaataaaaaatattccaactagaaactctgttgtagtttttgaaattacaacttggaggctttgaggaactgattagaagtctcctttctgtttcaggctttcatatccaaaccatagatctttagaagtaacatctgttaattaattattaataaatagtttgagtctttattaattcatggataacttgaccattttctctctccttttgcttagataatcccagatcatggccgggcacagtagctcacgcctgtattcccagcagtttgggaggccgaggcaggcagatcacttgaactcaggagtttgagaccagcttgggcaacatggcaaaaccctgtctctattaaaaatacaaaaattagctgggcatggtagtgcatgcctgtagtcccagctacctgggaggctgaggtgggaggatcgcttgagcctgggaggttgaggcttctgtgcgcgatgattgctccagtgatcacgccattgcactccagcctgggtgacagagtgagaccctgtctccaaaaaaaaaaaaaattaagcaagtagcagttacaagaccaaaagttattttcctttttttttttctctataaaattgcccatttggaccaaatctagttataacttatttcagtgtcattaagaaagttgatgaataagtcatattactcagatgttagtagctatgcatttattaatagttttatttataagtatttagtttcactctgttgcagactattttatgctaaaattagctaaagccaaattactatttcttaaaacatattttttactttttttttttttttaaatattattaggtacttcttgcaagggatatgcattagcacatactcaagaaggggaagaaaagaagcaaacttctggtacatcaaataccagaggatcaagacgaaaacctgcaatgacaactcctacaaggaggtctacacgtaacacaagagctgaaacagccagtcagtctcagagatccccaatatcagacaattctgggtgtgatgccccaggtaacagtaatccatctttaagtgttccctcttcagctgagtcagaaaagcaaacaagacaggctccaaaacggaagtctgtaagaagaggaagaaaaccacctttactgaaaaagaaacttcggagctctgtagctgcccctgaaaaatcatcttccaatgattcagtagatgaagaaacagcagaatctgacacatcacctgtgttagaaaaagagcaccaaccagatgtagacagtagtaacatttgtactgtgcagactcatgtagaaaaccagtctgctaattgcttgaaaagttgcaatgagcaaatagaagaaagtgagaagcatactgcaaattatgatacagaggaaagagtaggatcttcatcttctgagtcttgtgctcaagatcttcctgtgctagttggtgaggaaggggaagttaaaaaactcgagaatacaggtatagaggctaatgttttgtgtttggaaagtgagatttctgaaaatattcttgaaaaaggaggtgatccattggaaaagcaagaccagatatctggactttcacaatcagaggtaaagacagatgtatgtacagttcatcttccaaatgattttcctacatgtttaacatctgaaagcaaagtgtaccaacctgtatcttgtcccctaagtgacttatctgagaatgtagagtcagtggttaatgaagaaaaaataacagagagttccctagtagaaattactgaacataaagattttacactaaaaacagaggagcttatagagagccccaagttagaatcttctgagggtgaaattatacagacagtggacagacaatctgttaagagcccagaggttcaattgcttgggcatgttgaaactgaagatgtagaaataattgcaacatgtgatacttttgggaatgaagatttcaataatattcaagactctgaaaataacttactaaaaaataatcttctgaacaccaaattggaaaaatctttagaagaaaagaatgaatcgctgaccgaacatcctagatctacagagttgcctaaaacacacattgaacagattcagaagcattttagtgaggacaacaatgaaatgatacctatggagtgtgattcattttgcagtgaccaaaatgaatctgaagttgaaccatctgtaaatgctgatcttaaacaaatgaatgaaaattctgtgacacactgttctgaaaataatatgccgtcttctgatcttgcggatgaaaaggttgaaactgtttctcaaccatctgaaagcccaaaagataccatagataaaaccaaaaagcctcgtactcgaagatctagatttcattctccatctacaacttggtcacccaacaaagacactccacaagaaaagaagcggccccagtctccatctcccagaagagaaactgggaaagaaagcaggaagtctcaatcaccatctcctaagaatgagtcagccagaggccggaaaaaatcccgttctcagtccccaaaaaaggatattgcaagagaaaggaggcaatctcagtctcggtctccaaaaagggatactactagggaaagcagaagatctgaatcactgtccccaagaagagaaacttctagagagaacaaaagatctcagccaagagtgaaagattcttccccaggagaaaaatccaggtcccagagcagagaacgagaaagtgatagagatgggcagaggagagagagagaaaggagaaccagaaagtggtctaggtccagatctcattctaggtccccctcaagatgtagaacaaaaagtaagagttcatcatttggtagaattgacagagatagttactctccccggtggaagggaagatgggcaaatgatggttggagatgtccacgaggaaatgatcggtacagaaagaatgacccagagaaacagaatgaaaatacaagaaaagaaaaaaatgacatccatctagatgctgatgatccaaattctgctgacaaacatagaaatgactgtcccaattggataacagaaaaaataaactctgggcctgatccaagaaccagaaatccagaaaagttgaaagagtctcattgggaagaaaatagaaatgaaaattcaggaaattcttggaataaaaactttggttctggttgggtatctaaccgtggtagaggcagaggcaaccgtggcagaggcacttacagaagtagttttgcctataaagatcagaatgaaaatcggtggcaaaatcgaaaacccctctcagggaattcaaacagttcagggagtgaatctttcaagtttgtggaacagcaatcctataagcgaaaaagtgaacaggagttctcatttgatacaccagcagatagatctggatggacatctgcatccagctgggccgtgagaaagactttgccagcagatgtacaaaactactactcacgacgaggcagaaattcttcaggtccacagtctggatggatgaaacaagaggaggaaacatctggacaggattctagcctaaaagaccaaacaaaccagcaagttgatggttctcagctacctataaatatgatgcaaccgcaaatgaatgtaatgcagcaacaaatgaatgcacaacaccagcctatgaatatcttcccatatccagtgggtgttcatgctcctttgatgaacatccaacgcaatccatttaacattcatcctcagctacccttgcatctccacacaggagtgcccctcatgcaggtagccactcctaccagtgtatctcagggactaccaccaccaccaccccctcccccaccatcccaacaagtcaactacattgcttcacaaccagatggaaagcaattgcagggtattcctagttcttctcatgtaagtaataacatgagtacaccagttttgcctgctccgacagcagccccaggaaatacgggaatggttcagggaccaagttctggtaatacttcgtcatcaagtcacagcaaagcctctaatgctgctgtaaaattggcagaaagcaaagtaagtgttgcagtggaagccagcgcagatagctcgaagacagacaagaaattgcaaattcaagaaaaagcagcacaagaggtaaaattggccatcaagccattttaccaaaataaagatatcaccaaggaagaatataaagaaattgtacggaaagcagtagataaagtttgtcatagtaagagtggagaagtaaattctactaaagtggcaaatctggttaaagcctatgtagacaaatacaaatattcacggaaggggagccaaaagaaaactctggaagaacctgtgtctactgaaaaaaacataggctgaaatggggaacgctgtcaaggacattatcaggatatctgcaaagtgcaatttcaacatgtaccattaactgaaaatcatacataactgtgattgaaatttggttttgataaaattatttttttaacataggatatgatgttttgttctaaataaatataggtctgcactgcaacttctgtatccttccttcccctccaccctcccccacaaaattcaagggaaagtaaagggtttaaaggaatgtgcatctttactaggactgtgttatagtgtggatactggaaaatgtatagctttttgattagggcaatggagtgcataaattagaaacttctaagtgcactggttttcaaagagatatatataatgcatttattctgtcaggttaaaatataaagtatgatctttatgattttttccctctaattatagaaagttaaataatgtattaccatgaaaaatgtttctaatattaaatagaacatatcagttgcaaagttcctaatgtgtatttttaaagcacatatctgaataaattgcctagatagaaaaaaaattatcacgagtaaaatttagtgttcaaaacattgagacactcttcacctattgtatgaccaaataaaggttatgctgcttgtttttcttttgtgcctttgtttacccctaattgagataagcagtttgacttactagattacaactttggcagttcaaagtctttgttgaagactttgaggaaaaagatttggaaaaattgttgactttcggccgggcatgatggctcacgcctgtaatcccagcactttgggaggccgaggtggcggatcacctgaggtcaggagttcgagaccagcctggccaacatggtgaaatcccgtctctactaaaaatacaaaaattagccaggcgtggtggtgggcgcctgtaatcccagctatgcgagaggctgaggcaggagaatcagttgaacccgggaggcggggattgcagtgagccgagaccatgccattgcactccagcctgggcaacaggagcaaatctccgtctcaaaaaaaagaaaaaaaaaagtgttgactttgtagaaattatgttctttcatagtatcttcttctacccgttgcagacgataaattatttgtgccaattcgagaattgctgttaggctgttatcctcccttccttggggctaagaattacaagactcatggcactggcgtaaagttgttgtttatctaatcactgatgaaatattttcacacttgaaaatccccaaatgctttacaatgaatgaagtgttaatttggtgaccaggtggtagccattagccatgttgcaaaattctagacagtaaaacctgtgttttagaaacagaggggaaatttaaataatggagtcctggttagcctttcagggattagggatttgggtttttttttttctctctttttaatactagaatatctcagtttttataaaaggtaagtttaaaatgtttattgtgccattattttaactggcatcttgaaagaacagtaggttttctccatgataaactgattccagtaagaattttcagtacataccaagtacctggaaagttcttcagataagttaatagatccaaggagatacatgcctcagtgagataaactgacctttttactagctaaactatttagccagagcaatactctgtagaactgtgcttttctaaagtaaagattatctgtttctcaattttatgtgcataatacttttcctggtgctagctttgataggcaaaatattttgaaatgttggtcccataatgattgtgctagttcataagctttgttgttatgagtgtaatcataaaaatatttccaagcagtttttgacctttattctacatttctgggcatttgtaatatggtattctactggtatatatttttaaagtttgcgtttagattatggtaaagaaatttcaagcatatttcttctaataaagtattaagacagtgtttcagaatatcaaggcacacctccttagttgttttagattagaactctagaaacaattttgtgaacattgaaagtattttgagttaagcctaagctgattaatcacacaatacatacttttcctgcattttctttcagtgacatttgagaattgggtgacattttaaaatgtgttttataccatttagcttttgcaaacaagttctaaagttttggagaaaaagtgatgtggtcaagagttgaagtctcatatatctttagtagcactcccatgaattatttccgtgacagtaacaagtgtgtgttccatgtctgatttggggcactggttagactgcattaatagctacttgattagaattcgaacttttaaaattttgaaatgtttaagaatgtattagaaaatgcatgctttatgttgaaaaaatacattgctttaatattcctcattcttgagttaagaaatttatgttaattttgcatgggcacaaacttaatcagaaacattttgtggagttacatttcctcttattatttatcaaggttcagtattgatctttgaaaccttggtcccgttaacttactagtcacattgaccaatgttttatagaaatgcctagaattttgagactaatagtagttatccattaacattccaaaagttttgtgctttttaaaatttgttttggtaattatcacatttttttctcttaccttcctttaaatggccacagtgtgtactgctggaatgttccatccaaaagatgtagcttcagaagcacagtgattgccccagggtccatgagatattgtttgtattatgaagttggagtgctgtctactgaaattatactcttaaataaatatgtatgtagtgtgtaatattttctaataaattcttttgataaacaaaaaaaaaaaaaaagggcggccgcccttttttttttttttttctcatttaacttttttaatgggtctcaaaattctgtgacaaatttttggtcaagttgtttccattaaaaagtactgattttaaaaactaataacttaaaactgccacacgca

SEQ ID NO: 445898 - DNA, 7946 bp, Homo sapiens
gaaagtgccagaaaagcgacgtcctcagggcgggagcaggggacgccgcaacgtagtctgcgagaatgcaggaaggcggcagtgaagcggtcggtcggcggggccgcggcaaagtggggaggaaactcatcccgggcaggcgtcagggtggctggagagcgcagcacgcgcgaacagaacgggggcaggcgacaggaaaacgtgtgagcgcgcggctgaaagcgactgggacctgggaaacccttttccaaagagaaatgaagaagaaaactgtatgtaccctaaatatgggagataagaagtatgaagacatggaaggtgaagaaaacggagataatactatttccactggtctgttgtacagtgaggctgacagatgcccaatatgtcttaattgtctattagaaaaggaagttggttttccagaaagctgtaatcatgtcttctgtatgacttgtattcttaaatgggcagaggaattatttattcccataaaaaccttagagacactggcttcatgtcctattgaccgtaaaccttttcaggcagtgtttaaattcagtgcattggaaggttatgttaaggttcaagtaaaaaaacagctgagagaaacaaaagacaagaaaaatgaaaactcatttgagaaacaggtctcctgtcatgaaaattctaaaagctgtataagaagaaaagccatcgtaagagaagatctattaagtgcaaaagtttgtgacttgaagtggatacatagaaactctttatacagtgaaacaggaggaaagaaaaatgcagcaataaagataaataagcctcagagatcaaattggagtacaaatcagtgcttcagaaattttttctccaatatgttttcttctgttagccactctggagaatcttcctttacctatagagcttattgtacagaatttatagaagccagtgaaatcagtgcattgattaggcagaagagacatgaactggaattgtcatggtttcctgatacattacctggaattggaagaattggttttataccctggaatgttgaaacagaagtccttcctctcatttcttctgtgttgccaagaactatttttccaacaagtaccatatctttcgaacattttggtacttcttgcaagggatatgcattagcacatactcaagaaggggaagaaaagaagcaaacttctggtacatcaaataccagaggatcaagacgaaaacctgcaatgacaactcctacaaggaggtctacacgtaacacaagagctgaaacagccagtcagtctcagagatccccaatatcagacaattctgggtgtgatgccccaggtaacagtaatccatctttaagtgttccctcttcagctgagtcagaaaagcaaacaagacaggctccaaaacggaagtctgtaagaagaggaagaaaaccacctttactgaaaaagaaacttcggagctctgtagctgcccctgaaaaatcatcttccaatgattcagtagatgaagaaacagcagaatctgacacatcacctgtgttagaaaaagagcaccaaccagatgtagacagtagtaacatttgtactgtgcagactcatgtagaaaaccagtctgctaattgcttgaaaagttgcaatgagcaaatagaagaaagtgagaagcatactgcaaattatgatacagaggaaagagtaggatcttcatcttctgagtcttgtgctcaagatcttcctgtgctagttggtgaggaaggggaagttaaaaaactcgagaatacaggtatagaggctaatgttttgtgtttggaaagtgagatttctgaaaatattcttgaaaaaggaggtgatccattggaaaagcaagaccagatatctggactttcacaatcagaggtaaagacagatgtatgtacagttcatcttccaaatgattttcctacatgtttaacatctgaaagcaaagtgtaccaacctgtatcttgtcccctaagtgacttatctgagaatgtagagtcagtggttaatgaagaaaaaataacagagagttccctagtagaaattactgaacataaagattttacactaaaaacagaggagcttatagagagccccaagttagaatcttctgagggtgaaattatacagacagtggacagacaatctgttaagagcccagaggttcaattgcttgggcatgttgaaactgaagatgtagaaataattgcaacatgtgatacttttgggaatgaagatttcaataatattcaagactctgaaaataacttactaaaaaataatcttctgaacaccaaattggaaaaatctttagaagaaaagaatgaatcgctgaccgaacatcctagatctacagagttgcctaaaacacacattgaacagattcagaagcattttagtgaggacaacaatgaaatgatacctatggagtgtgattcattttgcagtgaccaaaatgaatctgaagttgaaccatctgtaaatgctgatcttaaacaaatgaatgaaaattctgtgacacactgttctgaaaataatatgccgtcttctgatcttgcggatgaaaaggttgaaactgtttctcaaccatctgaaagcccaaaagataccatagataaaaccaaaaagcctcgtactcgaagatctagatttcattctccatctacaacttggtcacccaacaaagacactccacaagaaaagaagcggccccagtctccatctcccagaagagaaactgggaaagaaagcaggaagtctcaatcaccatctcctaagaatgagtcagccagaggccggaaaaaatcccgttctcagtccccaaaaaaggatattgcaagagaaaggaggcaatctcagtctcggtctccaaaaagggatactactagggaaagcagaagatctgaatcactgtccccaagaagagaaacttctagagagaacaaaagatctcagccaagagtgaaagattcttccccaggagaaaaatccaggtcccagagcagagaacgagaaagtgatagagatgggcagaggagagagagagaaaggagaaccagaaagtggtctaggtccagatctcattctaggtccccctcaagatgtagaacaaaaagtaagagttcatcatttggtagaattgacagagatagttactctccccggtggaagggaagatgggcaaatgatggttggagatgtccacgaggaaatgatcggtacagaaagaatgacccagagaaacagaatgaaaatacaagaaaagaaaaaaatgacatccatctagatgctgatgatccaaattctgctgacaaacatagaaatgactgtcccaattggataacagaaaaaataaactctgggcctgatccaagaaccagaaatccagaaaagttgaaagagtctcattgggaagaaaatagaaatgaaaattcaggaaattcttggaataaaaactttggttctggttgggtatctaaccgtggtagaggcagaggcaaccgtggcagaggcacttacagaagtagttttgcctataaagatcagaatgaaaatcggtggcaaaatcgaaaacccctctcagggaattcaaacagttcagggagtgaatctttcaagtttgtggaacagcaatcctataagcgaaaaagtgaacaggagttctcatttgatacaccagcagatagatctggatggacatctgcatccagctgggccgtgagaaagactttgccagcagatgtacaaaactactactcacgacgaggcagaaattcttcaggtccacagtctggatggatgaaacaagaggaggaaacatctggacaggattctagcctaaaagaccaaacaaaccagcaagttgatggttctcagctacctataaatatgatgcaaccgcaaatgaatgtaatgcagcaacaaatgaatgcacaacaccagcctatgaatatcttcccatatccagtgggtgttcatgctcctttgatgaacatccaacgcaatccatttaacattcatcctcagctacccttgcatctccacacaggagtgcccctcatgcaggtagccactcctaccagtgtatctcagggactaccaccaccaccaccccctcccccaccatcccaacaagtcaactacattgcttcacaaccagatggaaagcaattgcagggtattcctagttcttctcatgtaagtaataacatgagtacaccagttttgcctgctccgacagcagccccaggaaatacgggaatggttcagggaccaagttctggtaatacttcgtcatcaagtcacagcaaagcctctaatgctgctgtaaaattggcagaaagcaaagtaagtgttgcagtggaagccagcgcagatagctcgaagacagacaaggcaagttcaaggttgagagcaaccttcataattctgtatatgataaaggagaaaaaatatcagctttttattgtatgagtggtgaagggaatttcttattggctgtctaaatgccattattatttgaaggattctctctagatgtgttgatgtccagtaaattactggtaatattttataattgtttttagaaatgtttgatatgttttagtaaataaactgttttatatttgtcacgttaatagttggagagtctcttattgtaaatatgaagtattttcaatttcttgtttgggattttgtgagagcagtatgactggcaaataataaattatacattttcttctcatcagaaattgcaaattcaagaaaaagcagcacaagaggtaaaattggccatcaagccattttaccaaaataaagatatcaccaaggaagaatataaagaaattgtacggaaagcagtagataaagtttgtcatagtaagagtggagaagtaaattctactaaagtggcaaatctggttaaagcctatgtagacaaatacaaatattcacggaaggggagccaaaagaaaactctggaagaacctgtgtctactgaaaaaaacataggctgaaatggggaacgctgtcaaggacattatcaggatatctgcaaagtgcaatttcaacatgtaccattaactgaaaatcatacataactgtgattgaaatttggttttgataaaattatttttttaacataggatatgatgttttgttctaaataaatataggtctgcactgcaacttctgtatccttccttcccctccaccctcccccacaaaattcaagggaaagtaaagggtttaaaggaatgtgcatctttactaggactgtgttatagtgtggatactggaaaatgtatagctttttgattagggcaatggagtgcataaattagaaacttctaagtgcactggttttcaaagagatatatataatgcatttattctgtcaggttaaaatataaagtatgatctttatgattttttccctctaattatagaaagttaaataatgtattaccatgaaaaatgtttctaatattaaatagaacatatcagttgcaaagttcctaatgtgtatttttaaagcacatatctgaataaattgcctagatagaaaaaaaattatcacgagtaaaatttagtgttcaaaacattgagacactcttcacctattgtatgaccaaataaaggttatgctgcttgtttttcttttgtgcctttgtttacccctaattgagataagcagtttgacttactagattacaactttggcagttcaaagtctttgttgaagactttgaggaaaaagatttggaaaaattgttgactttcggccgggcatgatggctcacgcctgtaatcccagcactttgggaggccgaggtggcggatcacctgaggtcaggagttcgagaccagcctggccaacatggtgaaatcccgtctctactaaaaatacaaaaattagccaggcgtggtggtgggcgcctgtaatcccagctatgcgagaggctgaggcaggagaatcagttgaacccgggaggcggggattgcagtgagccgagaccatgccattgcactccagcctgggcaacaggagcaaatctccgtctcaaaaaaaagaaaaaaaaaagtgttgactttgtagaaattatgttctttcatagtatcttcttctacccgttgcagacgataaattatttgtgccaattcgagaattgctgttaggctgttatcctcccttccttggggctaagaattacaagactcatggcactggcgtaaagttgttgtttatctaatcactgatgaaatattttcacacttgaaaatccccaaatgctttacaatgaatgaagtgttaatttggtgaccaggtggtagccattagccatgttgcaaaattctagacagtaaaacctgtgttttagaaacagaggggaaatttaaataatggagtcctggttagcctttcagggattagggatttgggtttttttttttctctctttttaatactagaatatctcagtttttataaaaggtaagtttaaaatgtttattgtgccattattttaactggcatcttgaaagaacagtaggttttctccatgataaactgattccagtaagaattttcagtacataccaagtacctggaaagttcttcagataagttaatagatccaaggagatacatgcctcagtgagataaactgacctttttactagctaaactatttagccagagcaatactctgtagaactgtgcttttctaaagtaaagattatctgtttctcaattttatgtgcataatacttttcctggtgctagctttgataggcaaaatattttgaaatgttggtcccataatgattgtgctagttcataagctttgttgttatgagtgtaatcataaaaatatttccaagcagtttttgacctttattctacatttctgggcatttgtaatatggtattctactggtatatatttttaaagtttgcgtttagattatggtaaagaaatttcaagcatatttcttctaataaagtattaagacagtgtttcagaatatcaaggcacacctccttagttgttttagattagaactctagaaacaattttgtgaacattgaaagtattttgagttaagcctaagctgattaatcacacaatacatacttttcctgcattttctttcagtgacatttgagaattgggtgacattttaaaatgtgttttataccatttagcttttgcaaacaagttctaaagttttggagaaaaagtgatgtggtcaagagttgaagtctcatatatctttagtagcactcccatgaattatttccgtgacagtaacaagtgtgtgttccatgtctgatttggggcactggttagactgcattaatagctacttgattagaattcgaacttttaaaattttgaaatgtttaagaatgtattagaaaatgcatgctttatgttgaaaaaatacattgctttaatattcctcattcttgagttaagaaatttatgttaattttgcatgggcacaaacttaatcagaaacattttgtggagttacatttcctcttattatttatcaaggttcagtattgatctttgaaaccttggtcccgttaacttactagtcacattgaccaatgttttatagaaatgcctagaattttgagactaatagtagttatccattaacattccaaaagttttgtgctttttaaaatttgttttggtaattatcacatttttttctcttaccttcctttaaatggccacagtgtgtactgctggaatgttccatccaaaagatgtagcttcagaagcacagtgattgccccagggtccatgagatattgtttgtattatgaagttggagtgctgtctactgaaattatactcttaaataaatatgtatgtagtgtgtaatattttctaataaattcttttgataaac

SEQ ID NO: 445899 - DNA, 7637 bp, Homo sapiens
agggagacgcgcagggaggggaggggagggaggaggctagacaaggcgggggaagggggagtagcggtggcttaagccgcgcggagcagcgcaacctgggtcgctccctgcttcgccgccgcctccggaccgagccagcggagtcagtgtcctagagaccctgtaacaccacaaagcggacgaaggagtccatgttggggaacttggcagcggagtgactgggacctgggaacctactgtggggccgcggccggaccgagcgcctcgacctcggtctgaggaaacccttttccaaagagaaatgaagaagaaaactgtatgtaccctaaatatgggagataagaagtatgaagacatggaaggtgaagaaaacggagataatactatttccactggtctgttgtacagtgaggctgacagatgcccaatatgtcttaattgtctattagaaaaggaagttggttttccagaaagctgtaatcatgtcttctgtatgacttgtattcttaaatgggcagaggaattatttattcccataaaaaccttagagacactggcttcatgtcctattgaccgtaaaccttttcaggcagtgtttaaattcagtgcattggaaggttatgttaaggttcaagtaaaaaaacagctgagagaaacaaaagacaagaaaaatgaaaactcatttgagaaacaggtctcctgtcatgaaaattctaaaagctgtataagaagaaaagccatcgtaagagaagatctattaagtgcaaaagtttgtgacttgaagtggatacatagaaactctttatacagtgaaacaggaggaaagaaaaatgcagcaataaagataaataagcctcagagatcaaattggagtacaaatcagtgcttcagaaattttttctccaatatgttttcttctgttagccactctggagaatcttcctttacctatagagcttattgtacagaatttatagaagccagtgaaatcagtgcattgattaggcagaagagacatgaactggaattgtcatggtttcctgatacattacctggaattggaagaattggttttataccctggaatgttgaaacagaagtccttcctctcatttcttctgtgttgccaagaactatttttccaacaagtaccatatctttcgaacattttggtacttcttgcaagggatatgcattagcacatactcaagaaggggaagaaaagaagcaaacttctggtacatcaaataccagaggatcaagacgaaaacctgcaatgacaactcctacaaggaggtctacacgtaacacaagagctgaaacagccagtcagtctcagagatccccaatatcagacaattctgggtgtgatgccccaggtaacagtaatccatctttaagtgttccctcttcagctgagtcagaaaagcaaacaagacaggctccaaaacggaagtctgtaagaagaggaagaaaaccacctttactgaaaaagaaacttcggagctctgtagctgcccctgaaaaatcatcttccaatgattcagtagatgaagaaacagcagaatctgacacatcacctgtgttagaaaaagagcaccaaccagatgtagacagtagtaacatttgtactgtgcagactcatgtagaaaaccagtctgctaattgcttgaaaagttgcaatgagcaaatagaagaaagtgagaagcatactgcaaattatgatacagaggaaagagtaggatcttcatcttctgagtcttgtgctcaagatcttcctgtgctagttggtgaggaaggggaagttaaaaaactcgagaatacaggtatagaggctaatgttttgtgtttggaaagtgagatttctgaaaatattcttgaaaaaggaggtgatccattggaaaagcaagaccagatatctggactttcacaatcagaggtaaagacagatgtatgtacagttcatcttccaaatgattttcctacatgtttaacatctgaaagcaaagtgtaccaacctgtatcttgtcccctaagtgacttatctgagaatgtagagtcagtggttaatgaagaaaaaataacagagagttccctagtagaaattactgaacataaagattttacactaaaaacagaggagcttatagagagccccaagttagaatcttctgagggtgaaattatacagacagtggacagacaatctgttaagagcccagaggttcaattgcttgggcatgttgaaactgaagatgtagaaataattgcaacatgtgatacttttgggaatgaagatttcaataatattcaagactctgaaaataacttactaaaaaataatcttctgaacaccaaattggaaaaatctttagaagaaaagaatgaatcgctgaccgaacatcctagatctacagagttgcctaaaacacacattgaacagattcagaagcattttagtgaggacaacaatgaaatgatacctatggagtgtgattcattttgcagtgaccaaaatgaatctgaagttgaaccatctgtaaatgctgatcttaaacaaatgaatgaaaattctgtgacacactgttctgaaaataatatgccgtcttctgatcttgcggatgaaaaggttgaaactgtttctcaaccatctgaaagcccaaaagataccatagataaaaccaaaaagcctcgtactcgaagatctagatttcattctccatctacaacttggtcacccaacaaagacactccacaagaaaagaagcggccccagtctccatctcccagaagagaaactgggaaagaaagcaggaagtctcaatcaccatctcctaagaatgagtcagccagaggccggaaaaaatcccgttctcagtccccaaaaaaggatattgcaagagaaaggaggcaatctcagtctcggtctccaaaaagggatactactagggaaagcagaagatctgaatcactgtccccaagaagagaaacttctagagagaacaaaagatctcagccaagagtgaaagattcttccccaggagaaaaatccaggtcccagagcagagaacgagaaagtgatagagatgggcagaggagagagagagaaaggagaaccagaaagtggtctaggtccagatctcattctaggtccccctcaagatgtagaacaaaaagtaagagttcatcatttggtagaattgacagagatagttactctccccggtggaagggaagatgggcaaatgatggttggagatgtccacgaggaaatgatcggtacagaaagaatgacccagagaaacagaatgaaaatacaagaaaagaaaaaaatgacatccatctagatgctgatgatccaaattctgctgacaaacatagaaatgactgtcccaattggataacagaaaaaataaactctgggcctgatccaagaaccagaaatccagaaaagttgaaagagtctcattgggaagaaaatagaaatgaaaattcaggaaattcttggaataaaaactttggttctggttgggtatctaaccgtggtagaggcagaggcaaccgtggcagaggcacttacagaagtagttttgcctataaagatcagaatgaaaatcggtggcaaaatcgaaaacccctctcagggaattcaaacagttcagggagtgaatctttcaagtttgtggaacagcaatcctataagcgaaaaagtgaacaggagttctcatttgatacaccagcagatagatctggatggacatctgcatccagctgggccgtgagaaagactttgccagcagatgtacaaaactactactcacgacgaggcagaaattcttcaggtccacagtctggatggatgaaacaagaggaggaaacatctggacaggattctagcctaaaagaccaaacaaaccagcaagttgatggttctcagctacctataaatatgatgcaaccgcaaatgaatgtaatgcagcaacaaatgaatgcacaacaccagcctatgaatatcttcccatatccagtgggtgttcatgctcctttgatgaacatccaacgcaatccatttaacattcatcctcagctacccttgcatctccacacaggagtgcccctcatgcaggtagccactcctaccagtgtatctcagggactaccaccaccaccaccccctcccccaccatcccaacaagtcaactacattgcttcacaaccagatggaaagcaattgcagggtattcctagttcttctcatgtaagtaataacatgagtacaccagttttgcctgctccgacagcagccccaggaaatacgggaatggttcagggaccaagttctggtaatacttcgtcatcaagtcacagcaaagcctctaatgctgctgtaaaattggcagaaagcaaagtaagtgttgcagtggaagccagcgcagatagctcgaagacagacaagaaattgcaaattcaagaaaaagcagcacaagaggtaaaattggccatcaagccattttaccaaaataaagatatcaccaaggaagaatataaagaaattgtacggaaagcagtagataaagtttgtcatagtaagagtggagaagtaaattctactaaagtggcaaatctggttaaagcctatgtagacaaatacaaatattcacggaaggggagccaaaagaaaactctggaagaacctgtgtctactgaaaaaaacataggctgaaatggggaacgctgtcaaggacattatcaggatatctgcaaagtgcaatttcaacatgtaccattaactgaaaatcatacataactgtgattgaaatttggttttgataaaattatttttttaacataggatatgatgttttgttctaaataaatataggtctgcactgcaacttctgtatccttccttcccctccaccctcccccacaaaattcaagggaaagtaaagggtttaaaggaatgtgcatctttactaggactgtgttatagtgtggatactggaaaatgtatagctttttgattagggcaatggagtgcataaattagaaacttctaagtgcactggttttcaaagagatatatataatgcatttattctgtcaggttaaaatataaagtatgatctttatgattttttccctctaattatagaaagttaaataatgtattaccatgaaaaatgtttctaatattaaatagaacatatcagttgcaaagttcctaatgtgtatttttaaagcacatatctgaataaattgcctagatagaaaaaaaattatcacgagtaaaatttagtgttcaaaacattgagacactcttcacctattgtatgaccaaataaaggttatgctgcttgtttttcttttgtgcctttgtttacccctaattgagataagcagtttgacttactagattacaactttggcagttcaaagtctttgttgaagactttgaggaaaaagatttggaaaaattgttgactttcggccgggcatgatggctcacgcctgtaatcccagcactttgggaggccgaggtggcggatcacctgaggtcaggagttcgagaccagcctggccaacatggtgaaatcccgtctctactaaaaatacaaaaattagccaggcgtggtggtgggcgcctgtaatcccagctatgcgagaggctgaggcaggagaatcagttgaacccgggaggcggggattgcagtgagccgagaccatgccattgcactccagcctgggcaacaggagcaaatctccgtctcaaaaaaaagaaaaaaaaaagtgttgactttgtagaaattatgttctttcatagtatcttcttctacccgttgcagacgataaattatttgtgccaattcgagaattgctgttaggctgttatcctcccttccttggggctaagaattacaagactcatggcactggcgtaaagttgttgtttatctaatcactgatgaaatattttcacacttgaaaatccccaaatgctttacaatgaatgaagtgttaatttggtgaccaggtggtagccattagccatgttgcaaaattctagacagtaaaacctgtgttttagaaacagaggggaaatttaaataatggagtcctggttagcctttcagggattagggatttgggtttttttttttctctctttttaatactagaatatctcagtttttataaaaggtaagtttaaaatgtttattgtgccattattttaactggcatcttgaaagaacagtaggttttctccatgataaactgattccagtaagaattttcagtacataccaagtacctggaaagttcttcagataagttaatagatccaaggagatacatgcctcagtgagataaactgacctttttactagctaaactatttagccagagcaatactctgtagaactgtgcttttctaaagtaaagattatctgtttctcaattttatgtgcataatacttttcctggtgctagctttgataggcaaaatattttgaaatgttggtcccataatgattgtgctagttcataagctttgttgttatgagtgtaatcataaaaatatttccaagcagtttttgacctttattctacatttctgggcatttgtaatatggtattctactggtatatatttttaaagtttgcgtttagattatggtaaagaaatttcaagcatatttcttctaataaagtattaagacagtgtttcagaatatcaaggcacacctccttagttgttttagattagaactctagaaacaattttgtgaacattgaaagtattttgagttaagcctaagctgattaatcacacaatacatacttttcctgcattttctttcagtgacatttgagaattgggtgacattttaaaatgtgttttataccatttagcttttgcaaacaagttctaaagttttggagaaaaagtgatgtggtcaagagttgaagtctcatatatctttagtagcactcccatgaattatttccgtgacagtaacaagtgtgtgttccatgtctgatttggggcactggttagactgcattaatagctacttgattagaattcgaacttttaaaattttgaaatgtttaagaatgtattagaaaatgcatgctttatgttgaaaaaatacattgctttaatattcctcattcttgagttaagaaatttatgttaattttgcatgggcacaaacttaatcagaaacattttgtggagttacatttcctcttattatttatcaaggttcagtattgatctttgaaaccttggtcccgttaacttactagtcacattgaccaatgttttatagaaatgcctagaattttgagactaatagtagttatccattaacattccaaaagttttgtgctttttaaaatttgttttggtaattatcacatttttttctcttaccttcctttaaatggccacagtgtgtactgctggaatgttccatccaaaagatgtagcttcagaagcacagtgattgccccagggtccatgagatattgtttgtattatgaagttggagtgctgtctactgaaattatactcttaaataaatatgtatgtagtgtgtaatattttctaataaattcttttgataaac

SEQ ID NO: 445900 - DNA, 5276 bp, Homo sapiens
agggagacgcgcagggaggggaggggagggaggaggctagacaaggcgggggaagggggagtagcggtggcttaagccgcgcggagcagcgcaacctgggtcgctccctgcttcgccgccgcctccggaccgagccagcggagtcagtgtcctagagaccctgtaacaccacaaagcggacgaaggagtccatgttggggaacttggcagcggagtgactgggacctgggaacctactgtggggccgcggccggaccgagcgcctcgacctcggtctgaggaaacccttttccaaagagaaatgaagaagaaaactgtatgtaccctaaatatgggagataagaagtatgaagacatggaaggtgaagaaaacggagataatactatttccactggtctgttgtacagtgaggctgacagatgcccaatatgtcttaattgtctattagaaaaggaagttggttttccagaaagctgtaatcatgtcttctgtatgacttgtattcttaaatgggcagaggaattatttattcccataaaaaccttagagacactggcttcatgtcctattgaccgtaaaccttttcaggcagtgtttaaattcagtgcattggaaggttatgttaaggttcaagtaaaaaaacagctgagagaaacaaaagacaagaaaaatgaaaactcatttgagaaacaggtctcctgtcatgaaaattctaaaagctgtataagaagaaaagccatcgtaagagaagatctattaagtgcaaaagtttgtgacttgaagtggatacatagaaactctttatacagtgaaacaggaggaaagaaaaatgcagcaataaagataaataagcctcagagatcaaattggagtacaaatcagtgcttcagaaattttttctccaatatgttttcttctgttagccactctggagaatcttcctttacctatagagcttattgtacagaatttatagaagccagtgaaatcagtgcattgattaggcagaagagacatgaactggaattgtcatggtttcctgatacattacctggaattggaagaattggttttataccctggaatgttgaaacagaagtccttcctctcatttcttctgtgttgccaagaactatttttccaacaagtaccatatctttcgaacattttggtacttcttgcaagggatatgcattagcacatactcaagaaggggaagaaaagaagcaaacttctggtacatcaaataccagaggatcaagacgaaaacctgcaatgacaactcctacaaggaggtctacacgtaacacaagagctgaaacagccagtcagtctcagagatccccaatatcagacaattctgggtgtgatgccccagcagatagatctggatggacatctgcatccagctgggccgtgagaaagactttgccagcagatgtacaaaactactactcacgacgaggcagaaattcttcaggtccacagtctggatggatgaaacaagaggaggaaacatctggacaggattctagcctaaaagaccaaacaaaccagcaagttgatggttctcagctacctataaatatgatgcaaccgcaaatgaatgtaatgcagcaacaaatgaatgcacaacaccagcctatgaatatcttcccatatccagtgggtgttcatgctcctttgatgaacatccaacgcaatccatttaacattcatcctcagctacccttgcatctccacacaggagtgcccctcatgcaggtagccactcctaccagtgtatctcagggactaccaccaccaccaccccctcccccaccatcccaacaagtcaactacattgcttcacaaccagatggaaagcaattgcagggtattcctagttcttctcatgtaagtaataacatgagtacaccagttttgcctgctccgacagcagccccaggaaatacgggaatggttcagggaccaagttctggtaatacttcgtcatcaagtcacagcaaagcctctaatgctgctgtaaaattggcagaaagcaaagtaagtgttgcagtggaagccagcgcagatagctcgaagacagacaagaaattgcaaattcaagaaaaagcagcacaagaggtaaaattggccatcaagccattttaccaaaataaagatatcaccaaggaagaatataaagaaattgtacggaaagcagtagataaagtttgtcatagtaagagtggagaagtaaattctactaaagtggcaaatctggttaaagcctatgtagacaaatacaaatattcacggaaggggagccaaaagaaaactctggaagaacctgtgtctactgaaaaaaacataggctgaaatggggaacgctgtcaaggacattatcaggatatctgcaaagtgcaatttcaacatgtaccattaactgaaaatcatacataactgtgattgaaatttggttttgataaaattatttttttaacataggatatgatgttttgttctaaataaatataggtctgcactgcaacttctgtatccttccttcccctccaccctcccccacaaaattcaagggaaagtaaagggtttaaaggaatgtgcatctttactaggactgtgttatagtgtggatactggaaaatgtatagctttttgattagggcaatggagtgcataaattagaaacttctaagtgcactggttttcaaagagatatatataatgcatttattctgtcaggttaaaatataaagtatgatctttatgattttttccctctaattatagaaagttaaataatgtattaccatgaaaaatgtttctaatattaaatagaacatatcagttgcaaagttcctaatgtgtatttttaaagcacatatctgaataaattgcctagatagaaaaaaaattatcacgagtaaaatttagtgttcaaaacattgagacactcttcacctattgtatgaccaaataaaggttatgctgcttgtttttcttttgtgcctttgtttacccctaattgagataagcagtttgacttactagattacaactttggcagttcaaagtctttgttgaagactttgaggaaaaagatttggaaaaattgttgactttcggccgggcatgatggctcacgcctgtaatcccagcactttgggaggccgaggtggcggatcacctgaggtcaggagttcgagaccagcctggccaacatggtgaaatcccgtctctactaaaaatacaaaaattagccaggcgtggtggtgggcgcctgtaatcccagctatgcgagaggctgaggcaggagaatcagttgaacccgggaggcggggattgcagtgagccgagaccatgccattgcactccagcctgggcaacaggagcaaatctccgtctcaaaaaaaagaaaaaaaaaagtgttgactttgtagaaattatgttctttcatagtatcttcttctacccgttgcagacgataaattatttgtgccaattcgagaattgctgttaggctgttatcctcccttccttggggctaagaattacaagactcatggcactggcgtaaagttgttgtttatctaatcactgatgaaatattttcacacttgaaaatccccaaatgctttacaatgaatgaagtgttaatttggtgaccaggtggtagccattagccatgttgcaaaattctagacagtaaaacctgtgttttagaaacagaggggaaatttaaataatggagtcctggttagcctttcagggattagggatttgggtttttttttttctctctttttaatactagaatatctcagtttttataaaaggtaagtttaaaatgtttattgtgccattattttaactggcatcttgaaagaacagtaggttttctccatgataaactgattccagtaagaattttcagtacataccaagtacctggaaagttcttcagataagttaatagatccaaggagatacatgcctcagtgagataaactgacctttttactagctaaactatttagccagagcaatactctgtagaactgtgcttttctaaagtaaagattatctgtttctcaattttatgtgcataatacttttcctggtgctagctttgataggcaaaatattttgaaatgttggtcccataatgattgtgctagttcataagctttgttgttatgagtgtaatcataaaaatatttccaagcagtttttgacctttattctacatttctgggcatttgtaatatggtattctactggtatatatttttaaagtttgcgtttagattatggtaaagaaatttcaagcatatttcttctaataaagtattaagacagtgtttcagaatatcaaggcacacctccttagttgttttagattagaactctagaaacaattttgtgaacattgaaagtattttgagttaagcctaagctgattaatcacacaatacatacttttcctgcattttctttcagtgacatttgagaattgggtgacattttaaaatgtgttttataccatttagcttttgcaaacaagttctaaagttttggagaaaaagtgatgtggtcaagagttgaagtctcatatatctttagtagcactcccatgaattatttccgtgacagtaacaagtgtgtgttccatgtctgatttggggcactggttagactgcattaatagctacttgattagaattcgaacttttaaaattttgaaatgtttaagaatgtattagaaaatgcatgctttatgttgaaaaaatacattgctttaatattcctcattcttgagttaagaaatttatgttaattttgcatgggcacaaacttaatcagaaacattttgtggagttacatttcctcttattatttatcaaggttcagtattgatctttgaaaccttggtcccgttaacttactagtcacattgaccaatgttttatagaaatgcctagaattttgagactaatagtagttatccattaacattccaaaagttttgtgctttttaaaatttgttttggtaattatcacatttttttctcttaccttcctttaaatggccacagtgtgtactgctggaatgttccatccaaaagatgtagcttcagaagcacagtgattgccccagggtccatgagatattgtttgtattatgaagttggagtgctgtctactgaaattatactcttaaataaatatgtatgtagtgtgtaatattttctaataaattcttttgataaac

SEQ ID NO: 445901 - DNA, 3793 bp, Homo sapiens
ttactacaagccatttgactttactgccttattttttccaggctttaaagtgagggcactttaatatttgttaatattcctaaagatccttgcaggaaagatataattctttaaatgctattctcctccttgtgtttagtattgctgtcaaaatgttacaatacatatatataatttaaaagtcatcttgacatatctaaataaggccccgtttaagaatgttactcatttttctttaaagggccctttagatataattacctgaaatatgcatttttctttagtactaaggttggtttgctttgtgttttttaatgttatttctaatgcatcactaaaagacttctatcgagtacaagtaattcattaactgatgataactctttaaaacagggtattcctagttcttctcatgtaagtaataacatgagtacaccagttttgcctgctccgacagcagccccaggaaatacgggaatggttcagggaccaagttctggtaatacttcgtcatcaagtcacagcaaagcctctaatgctgctgtaaaattggcagaaagcaaagtaagtgttgcagtggaagccagcgcagatagctcgaagacagacaagaaattgcaaattcaagaaaaagcagcacaagaggtaaaattggccatcaagccattttaccaaaataaagatatcaccaaggaagaatataaagaaattgtacggaaagcagtagataaagtttgtcatagtaagagtggagaagtaaattctactaaagtggcaaatctggttaaagcctatgtagacaaatacaaatattcacggaaggggagccaaaagaaaactctggaagaacctgtgtctactgaaaaaaacataggctgaaatggggaacgctgtcaaggacattatcaggatatctgcaaagtgcaatttcaacatgtaccattaactgaaaatcatacataactgtgattgaaatttggttttgataaaattatttttttaacataggatatgatgttttgttctaaataaatataggtctgcactgcaacttctgtatccttccttcccctccaccctcccccacaaaattcaagggaaagtaaagggtttaaaggaatgtgcatctttactaggactgtgttatagtgtggatactggaaaatgtatagctttttgattagggcaatggagtgcataaattagaaacttctaagtgcactggttttcaaagagatatatataatgcatttattctgtcaggttaaaatataaagtatgatctttatgattttttccctctaattatagaaagttaaataatgtattaccatgaaaaatgtttctaatattaaatagaacatatcagttgcaaagttcctaatgtgtatttttaaagcacatatctgaataaattgcctagatagaaaaaaaattatcacgagtaaaatttagtgttcaaaacattgagacactcttcacctattgtatgaccaaataaaggttatgctgcttgtttttcttttgtgcctttgtttacccctaattgagataagcagtttgacttactagattacaactttggcagttcaaagtctttgttgaagactttgaggaaaaagatttggaaaaattgttgactttcggccgggcatgatggctcacgcctgtaatcccagcactttgggaggccgaggtggcggatcacctgaggtcaggagttcgagaccagcctggccaacatggtgaaatcccgtctctactaaaaatacaaaaattagccaggcgtggtggtgggcgcctgtaatcccagctatgcgagaggctgaggcaggagaatcagttgaacccgggaggcggggattgcagtgagccgagaccatgccattgcactccagcctgggcaacaggagcaaatctccgtctcaaaaaaaagaaaaaaaaaagtgttgactttgtagaaattatgttctttcatagtatcttcttctacccgttgcagacgataaattatttgtgccaattcgagaattgctgttaggctgttatcctcccttccttggggctaagaattacaagactcatggcactggcgtaaagttgttgtttatctaatcactgatgaaatattttcacacttgaaaatccccaaatgctttacaatgaatgaagtgttaatttggtgaccaggtggtagccattagccatgttgcaaaattctagacagtaaaacctgtgttttagaaacagaggggaaatttaaataatggagtcctggttagcctttcagggattagggatttgggtttttttttttctctctttttaatactagaatatctcagtttttataaaaggtaagtttaaaatgtttattgtgccattattttaactggcatcttgaaagaacagtaggttttctccatgataaactgattccagtaagaattttcagtacataccaagtacctggaaagttcttcagataagttaatagatccaaggagatacatgcctcagtgagataaactgacctttttactagctaaactatttagccagagcaatactctgtagaactgtgcttttctaaagtaaagattatctgtttctcaattttatgtgcataatacttttcctggtgctagctttgataggcaaaatattttgaaatgttggtcccataatgattgtgctagttcataagctttgttgttatgagtgtaatcataaaaatatttccaagcagtttttgacctttattctacatttctgggcatttgtaatatggtattctactggtatatatttttaaagtttgcgtttagattatggtaaagaaatttcaagcatatttcttctaataaagtattaagacagtgtttcagaatatcaaggcacacctccttagttgttttagattagaactctagaaacaattttgtgaacattgaaagtattttgagttaagcctaagctgattaatcacacaatacatacttttcctgcattttctttcagtgacatttgagaattgggtgacattttaaaatgtgttttataccatttagcttttgcaaacaagttctaaagttttggagaaaaagtgatgtggtcaagagttgaagtctcatatatctttagtagcactcccatgaattatttccgtgacagtaacaagtgtgtgttccatgtctgatttggggcactggttagactgcattaatagctacttgattagaattcgaacttttaaaattttgaaatgtttaagaatgtattagaaaatgcatgctttatgttgaaaaaatacattgctttaatattcctcattcttgagttaagaaatttatgttaattttgcatgggcacaaacttaatcagaaacattttgtggagttacatttcctcttattatttatcaaggttcagtattgatctttgaaaccttggtcccgttaacttactagtcacattgaccaatgttttatagaaatgcctagaattttgagactaatagtagttatccattaacattccaaaagttttgtgctttttaaaatttgttttggtaattatcacatttttttctcttaccttcctttaaatggccacagtgtgtactgctggaatgttccatccaaaagatgtagcttcagaagcacagtgattgccccagggtccatgagatattgtttgtattatgaagttggagtgctgtctactgaaattatactcttaaataaatatgtatgtagtgtgtaatattttctaataaattcttttgataaac

SEQ ID NO: 445902 - DNA, 4708 bp, Homo sapiens
gaaagtgccagaaaagcgacgtcctcagggcgggagcaggggacgccgcaacgtagtctgcgagaatgcaggaaggcggcagtgaagcggtcggtcggcggggccgcggcaaagtggggaggaaactcatcccgggcaggcgtcagggtggctggagagcgcagcacgcgcgaacagaacgggggcaggcgacaggaaaacgtgtgagcgcgcggctgaaagcgactgggacctgggaaacccttttccaaagagaaatgaagaagaaaactgtatgtaccctaaatatgggagataagaagtatgaagacatggaaggtgaagaaaacggagataatactatttccactggtctgttgtacagtgaggctgacagatgcccaatatgtcttaattgtctattagaaaaggaagttggttttccagaaagctgtaatcatgtcttctgtatgacttgtattcttaaatgggcagaggaattatttattcccataaaaaccttagagacactggcttcatgtcctattgaccgtaaaccttttcaggcagtgtttaaattcagtgcattggaaggttatgttaaggttcaagtaaaaaaacagctgagagaaacaaaagacaagaaaaatgaaaactcatttgagaaacaggtctcctgtcatgaaaattctaaaagctgtataagaagaaaagccatcgtaagagaagatctattaagtgcaaaagtttgtgacttgaagtggatacatagaaactctttatacagtgaaacaggaggaaagaaaaatgcagcaataaagataaataagcctcagagatcaaattggagtacaaatcagtgcttcagaaattttttctccaatatgttttcttctgttagccactctggagaatcttcctttacctatagagcttattgtacagaatttatagaagccagtgaaatcagtgcattgattaggcagaagagacatgaactggaattgtcatggtttcctgatacattacctggaattggaagaattggttttataccctggaatgttgaaacagaagtccttcctctcatttcttctgtgttgccaagaactatttttccaacaagtaccatatctttcgaacattttggtacttcttgcaagggatatgcattagcacatactcaagaaggggaagaaaagaagcaaacttctggtacatcaaataccagaggatcaagacgaaaacctgcaatgacaactcctacaaggaggtctacacgtaacacaagagctgaaacagccagtcagtctcagagatccccaatatcagacaattctgggtgtgatgccccaggtaacagtaatccatctttaagtgttccctcttcagctgagtcagaaaagcaaacaagacaggctccaaaacggaagtctgtaagaagaggaagaaaaccacctttactgaaaaagaaacttcggagctctgtagctgcccctgaaaaatcatcttccaatgattcagtagatgaagaaacagcagaatctgacacatcacctgtgttagaaaaagagcaccaaccagatgtagacagtagtaacatttgtactgtgcagactcatgtagaaaaccagtctgctaattgcttgaaaagttgcaatgagcaaatagaagaaagtgagaagcatactgcaaattatgatacagaggaaagagtaggatcttcatcttctgagtcttgtgctcaagatcttcctgtgctagttggtgaggaaggggaagttaaaaaactcgagaatacaggtatagaggctaatgttttgtgtttggaaagtgagatttctgaaaatattcttgaaaaaggaggtgatccattggaaaagcaagaccagatatctggactttcacaatcagaggtaaagacagatgtatgtacagttcatcttccaaatgattttcctacatgtttaacatctgaaagcaaagtgtaccaacctgtatcttgtcccctaagtgacttatctgagaatgtagagtcagtggttaatgaagaaaaaataacagagagttccctagtagaaattactgaacataaagattttacactaaaaacagaggagcttatagagagccccaagttagaatcttctgagggtgaaattatacagacagtggacagacaatctgttaagagcccagaggttcaattgcttgggcatgttgaaactgaagatgtagaaataattgcaacatgtgatacttttgggaatgaagatttcaataatattcaagactctgaaaataacttactaaaaaataatcttctgaacaccaaattggaaaaatctttagaagaaaagaatgaatcgctgaccgaacatcctagatctacagagttgcctaaaacacacattgaacagattcagaagcattttagtgaggacaacaatgaaatgatacctatggagtgtgattcattttgcagtgaccaaaatgaatctgaagttgaaccatctgtaaatgctgatcttaaacaaatgaatgaaaattctgtgacacactgttctgaaaataatatgccgtcttctgatcttgcggatgaaaaggttgaaactgtttctcaaccatctgaaagcccaaaagataccatagataaaaccaaaaagcctcgtactcgaagatctagatttcattctccatctacaacttggtcacccaacaaagacactccacaagaaaagaagcggccccagtctccatctcccagaagagaaactgggaaagaaagcaggaagtctcaatcaccatctcctaagaatgagtcagccagaggccggaaaaaatcccgttctcagtccccaaaaaaggatattgcaagagaaaggaggcaatctcagtctcggtctccaaaaagggatactactagggaaagcagaagatctgaatcactgtccccaagaagagaaacttctagagagaacaaaagatctcagccaagagtgaaagattcttccccaggagaaaaatccaggtcccagagcagagaacgagaaagtgatagagatgggcagaggagagagagagaaaggagaaccagaaagtggtctaggtccagatctcattctaggtccccctcaagatgtagaacaaaaagtaagagttcatcatttggtagaattgacagagatagttactctccccggtggaagggaagatgggcaaatgatggttggagatgtccacgaggaaatgatcggtacagaaagaatgacccagagaaacagaatgaaaatacaagaaaagaaaaaaatgacatccatctagatgctgatgatccaaattctgctgacaaacatagaaatgactgtcccaattggataacagaaaaaataaactctgggcctgatccaagaaccagaaatccagaaaagttgaaagagtctcattgggaagaaaatagaaatgaaaattcaggaaattcttggaataaaaactttggttctggttgggtatctaaccgtggtagaggcagaggcaaccgtggcagaggcacttacagaagtagttttgcctataaagatcagaatgaaaatcggtggcaaaatcgaaaacccctctcagggaattcaaacagttcagggagtgaatctttcaagtttgtggaacagcaatcctataagcgaaaaagtgaacaggagttctcatttgatacaccagcagatagatctggatggacatctgcatccagctgggccgtgagaaagactttgccagcagatgtacaaaactactactcacgacgaggcagaaattcttcaggtccacagtctggatggatgaaacaagaggaggaaacatctggacaggattctagcctaaaagaccaaacaaaccagcaagttgatggttctcagctacctataaatatgatgcaaccgcaaatgaatgtaatgcagcaacaaatgaatgcacaacaccagcctatgaatatcttcccatatccagtgggtgttcatgctcctttgatgaacatccaacgcaatccatttaacattcatcctcagctacccttgcatctccacacaggagtgcccctcatgcaggtagccactcctaccagtgtatctcagggactaccaccaccaccaccccctcccccaccatcccaacaagtcaactacattgcttcacaaccagatggaaagcaattgcagggtattcctagttcttctcatgtaagtaataacatgagtacaccagttttgcctgctccgacagcagccccaggaaatacgggaatggttcagggaccaagttctggtaatacttcgtcatcaagtcacagcaaagcctctaatgctgctgtaaaattggcagaaagcaaagtaagtgttgcagtggaagccagcgcagatagctcgaagacagacaagaaattgcaaattcaagaaaaagcagcacaagaggtaaaattggccatcaagccattttaccaaaataaagatatcaccaaggaagaatataaagaaattgtacggaaagcagtagataaatgtgtactgctggaatgttccatccaaaagatgtagcttcagaagcacagtgattgccccagggtccatgagatattgtttgtattatgaagttggagtgctgtctactgaaattatactcttaaataaatatgtatgtagtgtgtaatattttctaataaattcttttgataaac

SEQ ID NO: 445903 - DNA, 4991 bp, Homo sapiens
gaaagtgccagaaaagcgacgtcctcagggcgggagcaggggacgccgcaacgtagtctgcgagaatgcaggaaggcggcagtgaagcggtcggtcggcggggccgcggcaaagtggggaggaaactcatcccgggcaggcgtcagggtggctggagagcgcagcacgcgcgaacagaacgggggcaggcgacaggaaaacgtgtgagcgcgcggctgaaagcgactgggacctgggaaacccttttccaaagagaaatgaagaagaaaactgtatgtaccctaaatatgggagataagaagtatgaagacatggaaggtgaagaaaacggagataatactatttccactggtctgttgtacagtgaggctgacagatgcccaatatgtcttaattgtctattagaaaaggaagttggttttccagaaagctgtaatcatgtcttctgtatgacttgtattcttaaatgggcagaggaattatttattcccataaaaaccttagagacactggcttcatgtcctattgaccgtaaaccttttcaggcagtgtttaaattcagtgcattggaaggttatgttaaggttcaagtaaaaaaacagctgagagaaacaaaagacaagaaaaatgaaaactcatttgagaaacaggtctcctgtcatgaaaattctaaaagctgtataagaagaaaagccatcgtaagagaagatctattaagtgcaaaagtttgtgacttgaagtggatacatagaaactctttatacagtgaaacaggaggaaagaaaaatgcagcaataaagataaataagcctcagagatcaaattggagtacaaatcagtgcttcagaaattttttctccaatatgttttcttctgttagccactctggagaatcttcctttacctatagagcttattgtacagaatttatagaagccagtgaaatcagtgcattgattaggcagaagagacatgaactggaattgtcatggtttcctgatacattacctggaattggaagaattggttttataccctggaatgttgaaacagaagtccttcctctcatttcttctgtgttgccaagaactatttttccaacaagtaccatatctttcgaacattttggtacttcttgcaagggatatgcattagcacatactcaagaaggggaagaaaagaagcaaacttctggtacatcaaataccagaggatcaagacgaaaacctgcaatgacaactcctacaaggaggtctacacgtaacacaagagctgaaacagccagtcagtctcagagatccccaatatcagacaattctgggtgtgatgccccaggtaacagtaatccatctttaagtgttccctcttcagctgagtcagaaaagcaaacaagacaggctccaaaacggaagtctgtaagaagaggaagaaaaccacctttactgaaaaagaaacttcggagctctgtagctgcccctgaaaaatcatcttccaatgattcagtagatgaagaaacagcagaatctgacacatcacctgtgttagaaaaagagcaccaaccagatgtagacagtagtaacatttgtactgtgcagactcatgtagaaaaccagtctgctaattgcttgaaaagttgcaatgagcaaatagaagaaagtgagaagcatactgcaaattatgatacagaggaaagagtaggatcttcatcttctgagtcttgtgctcaagatcttcctgtgctagttggtgaggaaggggaagttaaaaaactcgagaatacaggtatagaggctaatgttttgtgtttggaaagtgagatttctgaaaatattcttgaaaaaggaggtgatccattggaaaagcaagaccagatatctggactttcacaatcagaggtaaagacagatgtatgtacagttcatcttccaaatgattttcctacatgtttaacatctgaaagcaaagtgtaccaacctgtatcttgtcccctaagtgacttatctgagaatgtagagtcagtggttaatgaagaaaaaataacagagagttccctagtagaaattactgaacataaagattttacactaaaaacagaggagcttatagagagccccaagttagaatcttctgagggtgaaattatacagacagtggacagacaatctgttaagagcccagaggttcaattgcttgggcatgttgaaactgaagatgtagaaataattgcaacatgtgatacttttgggaatgaagatttcaataatattcaagactctgaaaataacttactaaaaaataatcttctgaacaccaaattggaaaaatctttagaagaaaagaatgaatcgctgaccgaacatcctagatctacagagttgcctaaaacacacattgaacagattcagaagcattttagtgaggacaacaatgaaatgatacctatggagtgtgattcattttgcagtgaccaaaatgaatctgaagttgaaccatctgtaaatgctgatcttaaacaaatgaatgaaaattctgtgacacactgttctgaaaataatatgccgtcttctgatcttgcggatgaaaaggttgaaactgtttctcaaccatctgaaagcccaaaagataccatagataaaaccaaaaagcctcgtactcgaagatctagatttcattctccatctacaacttggtcacccaacaaagacactccacaagaaaagaagcggccccagtctccatctcccagaagagaaactgggaaagaaagcaggaagtctcaatcaccatctcctaagaatgagtcagccagaggccggaaaaaatcccgttctcagtccccaaaaaaggatattgcaagagaaaggaggcaatctcagtctcggtctccaaaaagggatactactagggaaagcagaagatctgaatcactgtccccaagaagagaaacttctagagagaacaaaagatctcagccaagagtgaaagattcttccccaggagaaaaatccaggtcccagagcagagaacgagaaagtgatagagatgggcagaggagagagagagaaaggagaaccagaaagtggtctaggtccagatctcattctaggtccccctcaagatgtagaacaaaaagtaagagttcatcatttggtagaattgacagagatagttactctccccggtggaagggaagatgggcaaatgatggttggagatgtccacgaggaaatgatcggtacagaaagaatgacccagagaaacagaatgaaaatacaagaaaagaaaaaaatgacatccatctagatgctgatgatccaaattctgctgacaaacatagaaatgactgtcccaattggataacagaaaaaataaactctgggcctgatccaagaaccagaaatccagaaaagttgaaagagtctcattgggaagaaaatagaaatgaaaattcaggaaattcttggaataaaaactttggttctggttgggtatctaaccgtggtagaggcagaggcaaccgtggcagaggcacttacagaagtagttttgcctataaagatcagaatgaaaatcggtggcaaaatcgaaaacccctctcagggaattcaaacagttcagggagtgaatctttcaagtttgtggaacagcaatcctataagcgaaaaagtgaacaggagttctcatttgatacaccagcagatagatctggatggacatctgcatccagctgggccgtgagaaagactttgccagcagatgtacaaaactactactcacgacgaggcagaaattcttcaggtccacagtctggatggatgaaacaagaggaggaaacatctggacaggattctagcctaaaagaccaaacaaaccagcaagttgatggttctcagctacctataaatatgatgcaaccgcaaatgaatgtaatgcagcaacaaatgaatgcacaacaccagcctatgaatatcttcccatatccagtgggtgttcatgctcctttgatgaacatccaacgcaatccatttaacattcatcctcagctacccttgcatctccacacaggagtgcccctcatgcaggtagccactcctaccagtgtatctcagggactaccaccaccaccaccccctcccccaccatcccaacaagtcaactacattgcttcacaaccagatggaaagcaattgcagggtattcctagttcttctcatgtaagtaataacatgagtacaccagttttgcctgctccgacagcagccccaggaaatacgggaatggttcagggaccaagttctggtaatacttcgtcatcaagtcacagcaaagcctctaatgctgctgtaaaattggcagaaagcaaagtaagtgttgcagtggaagccagcgcagatagctcgaagacagacaaggcaagttcaaggttgagagcaaccttcataattctgtatatgataaaggagaaaaaatatcagctttttattgtatgagtggtgaagggaatttcttattggctgtctaaatgccattattatttgaaggattctctctagatgtgttgatgtccagtaaattactggtaatattttataattgtttttagaaatgtttgatatgttttagtaaataaactgttttatatttgtcacgttaatagttggagagtctcttattgtaaatatgaagtattttcaatttcttgtttgggattttgtgagagcagtatgactggcaaataataaattatacattttcttctcatcagaaattgcaaattcaagaaaaagcagcacaagaggtaaaattggccatcaagccattttaccaaaataaagatatcaccaaggaagaatataaagaaattgtacggaaagcagtagataaagtaagttatggctttagtggagtatgtgcacgttgttttgaaccacctctgttttaataaatgaatgctgaagtttaattaaaataataaaagctagctcctacta

SEQ ID NO: 445904 - DNA, 1403 bp, Homo sapiens
agggagacgcgcagggaggggaggggagggaggaggctagacaaggcgggggaagggggagtagcggtggcttaagccgcgcggagcagcgcaacctgggtcgctccctgcttcgccgccgcctccggaccgagccagcggagtcagtgtcctagagaccctgtaacaccacaaagcggacgaaggagtccatgttggggaacttggcagcggagtgactgggacctgggaacctactgtggggccgcggccggaccgagcgcctcgacctcggtctgaggaaacccttttccaaagagaaatgaagaagaaaactgtatgtaccctaaatatgggagataagaagtatgaagacatggaaggtgaagaaaacggagataatactatttccactggtctgttgtacagtgaggctgacagatgcccaatatgtcttaattgtctattagaaaaggaagttggttttccagaaagctgtaatcatgtcttctgtatgacttgtattcttaaatgggcagagggacttttcacataggttatttgatttcttctttatatcagccttgtggaataaccagagcagatacgatagtgtccttccattttacagatgaggaaacttggattttatgttctatgacttggtcaagatctcatagtttaagaggcagaagtgaatttagaactgattttctaattcctgtttttaatttagtgtggactaatttcagagtctgaattagagatattaccgtcatagacagtgaataagaaacaagacattcgtgacttttaatgtattatgttgactcaatttgggccaaatactttgaagtaaatattaatttaatataagccttattgttatgaaatgttaagtaaaaaattattggtcatattatgctatattttctaagttaatatttgtcagtctgtaaaattagtaaagaagataatatcttaaaaatattttaacattagctgcattccaattgttaatgttcttaaatatgttggaattaattgcatattacataattggggttttcaaagcgctatgttttgcttaaattttcattaatagtgtggaaaggagaatgtaactgtatagtgactctggctgagttctcaaaagaaggaagagaagatttgttatacaaattgaattaataatagtatacatataaactattttaatttagtaaaacctaaactggtctttaacaagaagtgacaggataggtgaaaatgtattttggggaaaagtattttgagttttgctgaattaatatggttggtaaatctctctctgtgtaggatcactgtttaatgaaataatgcatattttttttctgccacccaaataaagatttttatctgtgttgaatttagtgcacatggtt

SEQ ID NO: 445905 - DNA, 2209 bp, Homo sapiens
agggagacgcgcagggaggggaggggagggaggaggctagacaaggcgggggaagggggagtagcggtggcttaagccgcgcggagcagcgcaacctgggtcgctccctgcttcgccgccgcctccggaccgagccagcggagtcagtgtcctagagaccctgtaacaccacaaagcggacgaaggagtccatgttggggaacttggcagcggagtgactgggacctgggaacctactgtggggccgcggccggaccgagcgcctcgacctcggtctgaggaaacccttttccaaagagaaatgaagaagaaaactgtatgtaccctaaatatgggagataagaagtatgaagacatggaaggtgaagaaaacggagataatactatttccactggtctgttgtacagtgaggctgacagatgcccaatatgtcttaattgtctattagaaaaggaagttggttttccagaaagctgtaatcatgtcttctgtatgacttgtattcttaaatgggcagaggaattatttattcccataaaaaccttagagacactggcttcatgtcctattgaccgtaaaccttttcaggcagtgtttaaattcagtgcattggaaggttatgttaaggttcaagtaaaaaaacagctgagagaaacaaaagacaagaaaaatgaaaactcatttgagaaacaggtctcctgtcatgaaaattctaaaagctgtataagaagaaaagccatcgtaagagaagatctattaagtgcaaaagtttgtgacttgaagtggatacatagaaactctttatacagtgaaacaggaggaaagaaaaatgcagcaataaagataaataagcctcagagatcaaattggagtacaaatcagtgcttcagaaattttttctccaatatgttttcttctgttagccactctggagaatcttcctttacctatagagcttattgtacagaatttatagaagccagtgaaatcagtgcattgattaggcagaagagacatgaactggaattgtcatggtttcctgatacattacctggaattggaagaattggttttataccctggaatgttgaaacagaagtccttcctctcatttcttctgtgttgccaagaactatttttccaacaagtaccatatctttcgaacattttggtaaagttgtgaaatcattttctattttaaaaattattattattagtttcttccagtttcataaaaatgtgtgtttgatgacttagaaaagctgtaaagtaaggcatagtaacttgtaaatacgtctataaatatttggacaatgacttaactttagaattgcttcaactagagtgtatgtatatatagatagatagatacatagtctctccatatatctatatacacacacaatggaatattattctgccacaaaaagaaggaaatcttgtttgtgccaacgtggatgaacctggaggacattaggctaagtgaataaggcaggcacagaaaggcacataaccacatgatctcacttatatgtggaatctaaaaaagttgatctcgtagaactagattgtagattagggggtggggtaggtgtggtggggtggaggttgttggtcagaggatacagtttcagctggatagaataagttctaaagatcaattgtgaaacgtgatgactataataatacagttgacccttgaacaacataggttttaactgggtggcgacattatacatgaattttaaaaaataaatatatcggaaaatgtttggagatttgcaacactgaaaaaacagaaaaatcgcataacctataaatagtgaaaaaaattaagaaaaaggtatgtcattaatgtataaaatatatgtaggtactagtctatttcatcatttactaccataaaatatatacaaatctatgataacaagttaaaatttatcaaaacatatacacactcaaaccacatggttccaccatttgcagtcataagaaatgtaaacagctgtaaagatacagtattaaatcatagctgtgtaaaattaaatatagtacgtatttaccagtgtaacaatttttgtggccgccacctgttgctattctggtgtactcaagtgttgtgaatgtctgggaggttgaggctacaatgagccatgattgcaccactgcactccagcctgtgcaacagaacaacagcctgtctcaaaa

SEQ ID NO: 445906 - DNA, 1859 bp, Homo sapiens
agggagacgcgcagggaggggaggggagggaggaggctagacaaggcgggggaagggggagtagcggtggcttaagccgcgcggagcagcgcaacctgggtcgctccctgcttcgccgccgcctccggaccgagccagcggagtcagtgtcctagagaccctgtaacaccacaaagcggacgaaggagtccatgttggggaacttggcagcggagtgactgggacctgggaacctactgtggggccgcggccggaccgagcgcctcgacctcggtctgaggaaacccttttccaaagagaaatgaagaagaaaactgtatgtaccctaaatatgggagataagaagtatgaagacatggaaggtgaagaaaacggagataatactatttccactggtctgttgtacagtgaggctgacagatgcccaatatgtcttaattgtctattagaaaaggaagttggttttccagaaagctgtaatcatgtcttctgtatgacttgtattcttaaatgggcagaggaattatttattcccataaaaaccttagagacactggcttcatgtcctattgaccgtaaaccttttcaggcagtgtttaaattcagtgcattggaaggttatgttaaggttcaagtaaaaaaacagctgagagaaacaaaagacaagaaaaatgaaaactcatttgagaaacaggtctcctgtcatgaaaattctaaaagctgtataagaagaaaagccatcgtaagagaagatctattaagtgcaaaagtttgtgacttgaagtggatacatagaaactctttatacagtgaaacaggaggaaagaaaaatgcagcaataaagataaataagcctcagagatcaaattggagtacaaatcagtgcttcagaaattttttctccaatatgttttcttctgttagccactctggagaatcttcctttacctatagagcttattgtacagaatttatagaagccagtgaaatcagtgcattgattaggcagaagagacatgaactggaattgtcatggtttcctgatacattacctggaattggaagaattggttttataccctggaatgttgaaacagaagtccttcctctcatttcttctgtgttgccaagaactatttttccaacaagtaccatatctttcgaacattttggtaaagttgtgaaatcattttctattttaaaaattattattattagtttcttccagtttcataaaaatgtgtgtttgatgacttagaaaagctgtaaagtaaggcatagtaacttgtaaatacgtctataaatatttggacaatgacttaactttagaattgcttcaactagagtgtatgtatatatagatagatagatacatagtctctccatatatctatatacacacacaatggaatattattctgccacaaaaagaaggaaatcttgtttgtgccaacgtggatgaacctggaggacattaggctaagtgaataaggcaggcacagaaaggcacataaccacatgatctcacttatatgtggaatctaaaaaagttgatctcgtagaactagattgtagattagggggtggggtaggtgtggtggggtggaggttgttggtcagaggatacagtttcagctggatagaataagttctaaagatcaattgtgaaacgtgatgactataataatacagttgacccttgaacaacataggttttaactgggtggcgacattatacatgaattttaaaccaatcccacaccaccgcgacaaactgtttcgacagaattctgctaatcacctgcaacaaacactagcaaataatctgcatatacccctatcaataggagtgcaataat

SEQ ID NO: 445907 - DNA, 961 bp, Homo sapiens
agggagacgcgcagggaggggaggggagggaggaggctagacaaggcgggggaagggggagtagcggtggcttaagccgcgcggagcagcgcaacctgggtcgctccctgcttcgccgccgcctccggaccgagccagcggagtcagtgtcctagagaccctgtaacaccacaaagcggacgaaggagtccatgttggggaacttggcagcggagtgactgggacctgggaacctactgtggggccgcggccggaccgagcgcctcgacctcggtctgaggaaacccttttccaaagagaaatgaagaagaaaactgtatgtaccctaaatatgggagataagaagtatgaagacatggaaggtgaagaaaacggagataatactatttccactggtctgttgtacagtgaggctgacagatgcccaatatgtcttaattgtctattagaaaaggaagttggttttccagaaagctgtaatcatgtcttctgtatgacttgtattcttaaatgggcagaggaattatttattcccataaaaaccttagagacactggcttcatgtcctattgaccgtaaaccttttcaggcagtgtttaaattcagtgcattggaaggttatgttaaggttcaagtaaaaaaacagctgagagaaacaaaagacaagaaaaatgaaaactcatttgagaaacaggtctcctgtcatgaaaattctaaaagctgtataagaagaaaagccatcgtaagagaagatctattaagtgcaaaagtttgtgacttgaagtggatacatagtaagttactttttgcttgtggattctacctttttttttgttgttttttaatttaatggttgtgtcagagttctcatcagtaacacttcaggctggaaaatagtcctcagaactctgtacattgtgttaaatcctacataaattttgttttcatggagcaatttata

SEQ ID NO: 445908 - DNA, 531 bp, Homo sapiens
tctccagcctcctgactagctgggattacaggcgctcaccaccacgcctggctaatttttgtatttttttagtagagacggggtttcaccatgttggccaggctgctctcgaacacctgacctcaggtgatctgcccgccttggcctcccaaagtgctgggattacaggcttgagccaccgtgcctcgccaaatgttttctttcattagaaagtcagtccacattatttagaaatgacaggattaaattaagcaattggagattggtattggtatactgagcctattaattgctatttaattttactgtaaccagtggttctttgtttctctgtctaaagagatttataacatgatttttttcacaagctttttttcttttgatagattctagcctaaaagaccaaacaaaccagcaagttgatggttctcagctacctataaatatgatgcaaccgcaaatgaatgtaatgcagcaacaaatgaatgcacaacaccagcctatgaatatcttcccatatccagtgggtgt

SEQ ID NO: 445909 - DNA, 420 bp, Homo sapiens
cacagaactactgctgtcagcccaactcatctttcactatactagtagttctcaaccgggcagcatatcttaatgggattttaataacagattctgtctcgttcatcattgtattccaactatctagcatacaagaggtattcagtaaatgtttgaatgaatgaaacaaatttaaggtataaaaatatttttttctttcgaagatagagataaaaataattttatggaaaatttataattgtatttataattttgatctaaagaaacatttgtaaagatataatttgttaatcacttttcagacactggcttcatgtcctattgaccgtaaaccttttcaggcagtgtttaaattcagtgcattggaaggttatgttaaggtaagtctttttattctgcaacatgaattatatagaaatt

SEQ ID NO: 445910 - DNA, 430 bp, Homo sapiens
agaactactgctgtcagcccaactcatctttcactatactagtagttctcaaccgggcagcatatcttaatgggattttaataacagattctgtctcgttcatcattgtattccaactatctagcatacaagaggtattcagtaaatgtttgaatgaatgaaacaaatttaaggtataaaaatatttttttctttcgaagatagagataaaaataattttatggaaaatttataattgtatttataattttgatctaaagaaacatttgtaaagatataatttgttaatcacttttcagacactggcttcatgtcctattgaccgtaaaccttttcaggcagtgtttaaattcagtgcattggaaggttatgttaaggtaagtctttttattctgcaacatgaattatatagaaattaattgaagctgtt

SEQ ID NO: 445911 - DNA, 717 bp, Homo sapiens
gaacatgatgaaagctggaaaaattcttgacaaaatactacataaattatttcaaagagaaacatctgtgttaagttgctttcatcttttctttgccatgaatttatcagaaaaacatacttttaaaggtttttttctgaattttagccaattggtagctatctttagacaaggagtaaccttgaatttacatttttagctatttgggcaaaaaacatttaagcactgtattttaatattgctaacctgatttagagaattaatacttttaaattggtggtttaattttttaaaccatttaaacaaaaatgtctttattatgttttcagaattggttttataccctggaatgttgaaacagaagtccttcctctcatttcttctgtgttgccaagaactatttttccaacaagtaccatatctttcgaacattttggtaaagttgtgaaatcattttctattttaaaaattattattattagtttcttccagtttcataaaaatgtgtgtttgatgacttagaaaagctgtaaagtaaggcatagtaacttgtaaatacgtctataaatatttggacaatgacttaactttagaattgcttcaactagagtgtatgtatatatagatagatagatacatagtctctccatatatctatatacacacacaatggaatattattctgccacaaaaagaaggaaatcttgtttgtgccaa

SEQ ID NO: 445912 - DNA, 5331 bp, Homo sapiens
agggagacgcgcagggaggggaggggagggaggaggctagacaaggcgggggaagggggagtagcggtggcttaagccgcgcggagcagcgcaacctgggtcgctccctgcttcgccgccgcctccggaccgagccagcggagtcagtgtcctagagaccctgtaacaccacaaagcggacgaaggagtccatgttggggaacttggcagcggagtgactgggacctgggaacctactgtggggccgcggccggaccgagcgcctcgacctcggtctgaggaaacccttttccaaagagaaatgaagaagaaaactgtatgtaccctaaatatgggagataagaagtatgaagacatggaaggtgaagaaaacggagataatactatttccactggtctgttgtacagtgaggctgacagatgcccaatatgtcttaattgtctattagaaaaggaagttggttttccagaaagctgtaatcatgtcttctgtatgacttgtattcttaaatgggcagagacactggcttcatgtcctattgaccgtaaaccttttcaggcagtgtttaaattcagtgcattggaaggttatgttaaggttcaagtaaaaaaacagctgagagaaacaaaagacaagaaaaatgaaaactcatttgagaaacaggtctcctgtcatgaaaattctaaaagctgtataagaagaaaagccatcgtaagagaagatctattaagtgcaaaagtttgtgacttgaagtggatacatagaaactctttatacagtgaaacaggaggaaagaaaaatgcagcaataaagataaataagcctcagagatcaaattggagtacaaatcagtgcttcagaaattttttctccaatatgttttcttctgttagccactctggagaatcttcctttacctatagagcttattgtacagaatttatagaagccagtgaaatcagtgcattgattaggcagaagagacatgaactggaattgtcatggtttcctgatacattacctggaattggaagaattggttttataccctggaatgttgaaacagaagtccttcctctcatttcttctgtgttgccaagaactatttttccaacaagtaccatatctttcgaacattttggtacttcttgcaagggatatgcattagcacatactcaagaaggggaagaaaagaagcaaacttctggtacatcaaataccagaggatcaagacgaaaacctgcaatgacaactcctacaaggaggtctacacgtaacacaagagctgaaacagccagtcagtctcagagatccccaatatcagacaattctgggtgtgatgccccaggtaacagtaatccatctttaagtgttccctcttcagctgagtcagaaaagcaaacaagacaggctccaaaacggaagtctgtaagaagaggaagaaaaccacctttactgaaaaagaaacttcggagctctgtagctgcccctgaaaaatcatcttccaatgattcagtagatgaagaaacagcagaatctgacacatcacctgtgttagaaaaagagcaccaaccagatgtagacagtagtaacatttgtactgtgcagactcatgtagaaaaccagtctgctaattgcttgaaaagttgcaatgagcaaatagaagaaagtgagaagcatactgcaaattatgatacagaggaaagagtaggatcttcatcttctgagtcttgtgctcaagatcttcctgtgctagttggtgaggaaggggaagttaaaaaactcgagaatacaggtatagaggctaatgttttgtgtttggaaagtgagatttctgaaaatattcttgaaaaaggaggtgatccattggaaaagcaagaccagatatctggactttcacaatcagaggtaaagacagatgtatgtacagttcatcttccaaatgattttcctacatgtttaacatctgaaagcaaagtgtaccaacctgtatcttgtcccctaagtgacttatctgagaatgtagagtcagtggttaatgaagaaaaaataacagagagttccctagtagaaattactgaacataaagattttacactaaaaacagaggagcttatagagagccccaagttagaatcttctgagggtgaaattatacagacagtggacagacaatctgttaagagcccagaggttcaattgcttgggcatgttgaaactgaagatgtagaaataattgcaacatgtgatacttttgggaatgaagatttcaataatattcaagactctgaaaataacttactaaaaaataatcttctgaacaccaaattggaaaaatctttagaagaaaagaatgaatcgctgaccgaacatcctagatctacagagttgcctaaaacacacattgaacagattcagaagcattttagtgaggacaacaatgaaatgatacctatggagtgtgattcattttgcagtgaccaaaatgaatctgaagttgaaccatctgtaaatgctgatcttaaacaaatgaatgaaaattctgtgacacactgttctgaaaataatatgccgtcttctgatcttgcggatgaaaaggttgaaactgtttctcaaccatctgaaagcccaaaagataccatagataaaaccaaaaagcctcgtactcgaagatctagatttcattctccatctacaacttggtcacccaacaaagacactccacaagaaaagaagcggccccagtctccatctcccagaagagaaactgggaaagaaagcaggaagtctcaatcaccatctcctaagaatgagtcagccagaggccggaaaaaatcccgttctcagtccccaaaaaaggatattgcaagagaaaggaggcaatctcagtctcggtctccaaaaagggatactactagggaaagcagaagatctgaatcactgtccccaagaagagaaacttctagagagaacaaaagatctcagccaagagtgaaagattcttccccaggagaaaaatccaggtcccagagcagagaacgagaaagtgatagagatgggcagaggagagagagagaaaggagaaccagaaagtggtctaggtccagatctcattctaggtccccctcaagatgtagaacaaaaagtaagagttcatcatttggtagaattgacagagatagttactctccccggtggaagggaagatgggcaaatgatggttggagatgtccacgaggaaatgatcggtacagaaagaatgacccagagaaacagaatgaaaatacaagaaaagaaaaaaatgacatccatctagatgctgatgatccaaattctgctgacaaacatagaaatgactgtcccaattggataacagaaaaaataaactctgggcctgatccaagaaccagaaatccagaaaagttgaaagagtctcattgggaagaaaatagaaatgaaaattcaggaaattcttggaataaaaactttggttctggttgggtatctaaccgtggtagaggcagaggcaaccgtggcagaggcacttacagaagtagttttgcctataaagatcagaatgaaaatcggtggcaaaatcgaaaacccctctcagggaattcaaacagttcagggagtgaatctttcaagtttgtggaacagcaatcctataagcgaaaaagtgaacaggagttctcatttgatacaccagcagatagatctggatggacatctgcatccagctgggccgtgagaaagactttgccagcagatgtacaaaactactactcacgacgaggcagaaattcttcaggtccacagtctggatggatgaaacaagaggaggaaacatctggacaggattctagcctaaaagaccaaacaaaccagcaagttgatggttctcagctacctataaatatgatgcaaccgcaaatgaatgtaatgcagcaacaaatgaatgcacaacaccagcctatgaatatcttcccatatccagtgggtgttcatgctcctttgatgaacatccaacgcaatccatttaacattcatcctcagctacccttgcatctccacacaggagtgcccctcatgcaggtagccactcctaccagtgtatctcagggactaccaccaccaccaccccctcccccaccatcccaacaagtcaactacattgcttcacaaccagatggaaagcaattgcagggtattcctagttcttctcatgtaagtaataacatgagtacaccagttttgcctgctccgacagcagccccaggaaatacgggaatggttcagggaccaagttctggtaatacttcgtcatcaagtcacagcaaagcctctaatgctgctgtaaaattggcagaaagcaaagtaagtgttgcagtggaagccagcgcagatagctcgaagacagacaagaaattgcaaattcaagaaaaagcagcacaagaggtaaaattggccatcaagccattttaccaaaataaagatatcaccaaggaagaatataaagaaattgtacggaaagcagtagataaagtttgtcatagtaagagtggagaagtaaattctactaaagtggcaaatctggttaaagcctatgtagacaaatacaaatattcacggaaggggagccaaaagaaaactctggaagaacctgtgtctactgaaaaaaacataggctgaaatggggaacgctgtcaaggacattatcaggatatctgcaaagtgcaatttcaacatgtaccattaactgaaaatcatacataactgtgattgaaatttggttttgataaaattatttttttaacataggatatgatgttttgttctaaataaatataggtctgcactgcaacttctgtatccttccttcccctccaccctcccccacaaaattcaagggaaagtaaagggtttaaaggaatgtgcatctttactaggactgtgttatagtgtggatactggaaaatgtatagctttttgattagggcaatggagtgcataaattagaaacttctaagtgcactggttttcaaagagatatatataatgcatttattctgtcaggttaaaatataaagtatgatctttatgattttttccctctaattatagaaagttaaataatgtattaccatgaaaaatgtttctaatattaaatagaacatatcagttgcaaagttcctaatgtgtatttttaaagcacatatctgaataaattgcctagatagaaaaaaaattatcacgagtaaaatttagtgttcaaaacattgagacactcttcacctattgtatgaccaaataaaggttatgctgcttgt

SEQ ID NO: 445913 - DNA, 7923 bp, Homo sapiens
tgtaaaccttgagtaacacctttgggacccacataagtgccattagtgatgtaggaagtgctcccaagaagcaaaattatggctttataagaagaagtttaattccttgataggaacagattgagatctatagctgcagttgcctgccatttcagacagatgattcatcttgtaaacaaatgatataaacttagggtatcaataaatacagtacagcattataatgtattttctcttatgatttttgtaaataacccttttcctttagcttccttttattggtaagaatacagtatgtaacacataacataaaaaatatattaattccactgttatcagtaaggagtctggtgaataacagttaagttttggggagtaaaaactgtttcaatttttgactgtgttgggggttggtgctcctaatccctgtgttgttaaagggtcgactatattgtatttttgaaaattgctagagagtggacgtaaagtgttctcactaaacaaattataactatgtgaggtagtgcatatattaagtagctagatttggtcattccacaatgtatatgtacttcaaaacatcatgttgtacatgagaaacacagttttatctgttagtcagttttaaaaataaaaaatattccaactagaaactctgttgtagtttttgaaattacaacttggaggctttgaggaactgattagaagtctcctttctgtttcaggctttcatatccaaaccatagatctttagaagtaacatctgttaattaattattaataaatagtttgagtctttattaattcatggataacttgaccattttctctctccttttgcttagataatcccagatcatggccgggcacagtagctcacgcctgtattcccagcagtttgggaggccgaggcaggcagatcacttgaactcaggagtttgagaccagcttgggcaacatggcaaaaccctgtctctattaaaaatacaaaaattagctgggcatggtagtgcatgcctgtagtcccagctacctgggaggctgaggtgggaggatcgcttgagcctgggaggttgaggcttctgtgcgcgatgattgctccagtgatcacgccattgcactccagcctgggtgacagagtgagaccctgtctccaaaaaaaaaaaaaattaagcaagtagcagttacaagaccaaaagttattttcctttttttttttctctataaaattgcccatttggaccaaatctagttataacttatttcagtgtcattaagaaagttgatgaataagtcatattactcagatgttagtagctatgcatttattaatagttttatttataagtatttagtttcactctgttgcagactattttatgctaaaattagctaaagccaaattactatttcttaaaacatattttttactttttttttttttttaaatattattaggtacttcttgcaagggatatgcattagcacatactcaagaaggggaagaaaagaagcaaacttctggtacatcaaataccagaggatcaagacgaaaacctgcaatgacaactcctacaaggaggtctacacgtaacacaagagctgaaacagccagtcagtctcagagatccccaatatcagacaattctgggtgtgatgccccaggtaacagtaatccatctttaagtgttccctcttcagctgagtcagaaaagcaaacaagacaggctccaaaacggaagtctgtaagaagaggaagaaaaccacctttactgaaaaagaaacttcggagctctgtagctgcccctgaaaaatcatcttccaatgattcagtagatgaagaaacagcagaatctgacacatcacctgtgttagaaaaagagcaccaaccagatgtagacagtagtaacatttgtactgtgcagactcatgtagaaaaccagtctgctaattgcttgaaaagttgcaatgagcaaatagaagaaagtgagaagcatactgcaaattatgatacagaggaaagagtaggatcttcatcttctgagtcttgtgctcaagatcttcctgtgctagttggtgaggaaggggaagttaaaaaactcgagaatacaggtatagaggctaatgttttgtgtttggaaagtgagatttctgaaaatattcttgaaaaaggaggtgatccattggaaaagcaagaccagatatctggactttcacaatcagaggtaaagacagatgtatgtacagttcatcttccaaatgattttcctacatgtttaacatctgaaagcaaagtgtaccaacctgtatcttgtcccctaagtgacttatctgagaatgtagagtcagtggttaatgaagaaaaaataacagagagttccctagtagaaattactgaacataaagattttacactaaaaacagaggagcttatagagagccccaagttagaatcttctgagggtgaaattatacagacagtggacagacaatctgttaagagcccagaggttcaattgcttgggcatgttgaaactgaagatgtagaaataattgcaacatgtgatacttttgggaatgaagatttcaataatattcaagactctgaaaataacttactaaaaaataatcttctgaacaccaaattggaaaaatctttagaagaaaagaatgaatcgctgaccgaacatcctagatctacagagttgcctaaaacacacattgaacagattcagaagcattttagtgaggacaacaatgaaatgatacctatggagtgtgattcattttgcagtgaccaaaatgaatctgaagttgaaccatctgtaaatgctgatcttaaacaaatgaatgaaaattctgtgacacactgttctgaaaataatatgccgtcttctgatcttgcggatgaaaaggttgaaactgtttctcaaccatctgaaagcccaaaagataccatagataaaaccaaaaagcctcgtactcgaagatctagatttcattctccatctacaacttggtcacccaacaaagacactccacaagaaaagaagcggccccagtctccatctcccagaagagaaactgggaaagaaagcaggaagtctcaatcaccatctcctaagaatgagtcagccagaggccggaaaaaatcccgttctcagtccccaaaaaaggatattgcaagagaaaggaggcaatctcagtctcggtctccaaaaagggatactactagggaaagcagaagatctgaatcactgtccccaagaagagaaacttctagagagaacaaaagatctcagccaagagtgaaagattcttccccaggagaaaaatccaggtcccagagcagagaacgagaaagtgatagagatgggcagaggagagagagagaaaggagaaccagaaagtggtctaggtccagatctcattctaggtccccctcaagatgtagaacaaaaagtaagagttcatcatttggtagaattgacagagatagttactctccccggtggaagggaagatgggcaaatgatggttggagatgtccacgaggaaatgatcggtacagaaagaatgacccagagaaacagaatgaaaatacaagaaaagaaaaaaatgacatccatctagatgctgatgatccaaattctgctgacaaacatagaaatgactgtcccaattggataacagaaaaaataaactctgggcctgatccaagaaccagaaatccagaaaagttgaaagagtctcattgggaagaaaatagaaatgaaaattcaggaaattcttggaataaaaactttggttctggttgggtatctaaccgtggtagaggcagaggcaaccgtggcagaggcacttacagaagtagttttgcctataaagatcagaatgaaaatcggtggcaaaatcgaaaacccctctcagggaattcaaacagttcagggagtgaatctttcaagtttgtggaacagcaatcctataagcgaaaaagtgaacaggagttctcatttgatacaccagcagatagatctggatggacatctgcatccagctgggccgtgagaaagactttgccagcagatgtacaaaactactactcacgacgaggcagaaattcttcaggtccacagtctggatggatgaaacaagaggaggaaacatctggacaggattctagcctaaaagaccaaacaaaccagcaagttgatggttctcagctacctataaatatgatgcaaccgcaaatgaatgtaatgcagcaacaaatgaatgcacaacaccagcctatgaatatcttcccatatccagtgggtgttcatgctcctttgatgaacatccaacgcaatccatttaacattcatcctcagctacccttgcatctccacacaggagtgcccctcatgcaggtagccactcctaccagtgtatctcagggactaccaccaccaccaccccctcccccaccatcccaacaagtcaactacattgcttcacaaccagatggaaagcaattgcagggtattcctagttcttctcatgtaagtaataacatgagtacaccagttttgcctgctccgacagcagccccaggaaatacgggaatggttcagggaccaagttctggtaatacttcgtcatcaagtcacagcaaagcctctaatgctgctgtaaaattggcagaaagcaaagtaagtgttgcagtggaagccagcgcagatagctcgaagacagacaagaaattgcaaattcaagaaaaagcagcacaagaggtaaaattggccatcaagccattttaccaaaataaagatatcaccaaggaagaatataaagaaattgtacggaaagcagtagataaagtttgtcatagtaagagtggagaagtaaattctactaaagtggcaaatctggttaaagcctatgtagacaaatacaaatattcacggaaggggagccaaaagaaaactctggaagaacctgtgtctactgaaaaaaacataggctgaaatggggaacgctgtcaaggacattatcaggatatctgcaaagtgcaatttcaacatgtaccattaactgaaaatcatacataactgtgattgaaatttggttttgataaaattatttttttaacataggatatgatgttttgttctaaataaatataggtctgcactgcaacttctgtatccttccttcccctccaccctcccccacaaaattcaagggaaagtaaagggtttaaaggaatgtgcatctttactaggactgtgttatagtgtggatactggaaaatgtatagctttttgattagggcaatggagtgcataaattagaaacttctaagtgcactggttttcaaagagatatatataatgcatttattctgtcaggttaaaatataaagtatgatctttatgattttttccctctaattatagaaagttaaataatgtattaccatgaaaaatgtttctaatattaaatagaacatatcagttgcaaagttcctaatgtgtatttttaaagcacatatctgaataaattgcctagatagaaaaaaaattatcacgagtaaaatttagtgttcaaaacattgagacactcttcacctattgtatgaccaaataaaggttatgctgcttgtttttcttttgtgcctttgtttacccctaattgagataagcagtttgacttactagattacaactttggcagttcaaagtctttgttgaagactttgaggaaaaagatttggaaaaattgttgactttcggccgggcatgatggctcacgcctgtaatcccagcactttgggaggccgaggtggcggatcacctgaggtcaggagttcgagaccagcctggccaacatggtgaaatcccgtctctactaaaaatacaaaaattagccaggcgtggtggtgggcgcctgtaatcccagctatgcgagaggctgaggcaggagaatcagttgaacccgggaggcggggattgcagtgagccgagaccatgccattgcactccagcctgggcaacaggagcaaatctccgtctcaaaaaaaagaaaaaaaaaagtgttgactttgtagaaattatgttctttcatagtatcttcttctacccgttgcagacgataaattatttgtgccaattcgagaattgctgttaggctgttatcctcccttccttggggctaagaattacaagactcatggcactggcgtaaagttgttgtttatctaatcactgatgaaatattttcacacttgaaaatccccaaatgctttacaatgaatgaagtgttaatttggtgaccaggtggtagccattagccatgttgcaaaattctagacagtaaaacctgtgttttagaaacagaggggaaatttaaataatggagtcctggttagcctttcagggattagggatttgggtttttttttttctctctttttaatactagaatatctcagtttttataaaaggtaagtttaaaatgtttattgtgccattattttaactggcatcttgaaagaacagtaggttttctccatgataaactgattccagtaagaattttcagtacataccaagtacctggaaagttcttcagataagttaatagatccaaggagatacatgcctcagtgagataaactgacctttttactagctaaactatttagccagagcaatactctgtagaactgtgcttttctaaagtaaagattatctgtttctcaattttatgtgcataatacttttcctggtgctagctttgataggcaaaatattttgaaatgttggtcccataatgattgtgctagttcataagctttgttgttatgagtgtaatcataaaaatatttccaagcagtttttgacctttattctacatttctgggcatttgtaatatggtattctactggtatatatttttaaagtttgcgtttagattatggtaaagaaatttcaagcatatttcttctaataaagtattaagacagtgtttcagaatatcaaggcacacctccttagttgttttagattagaactctagaaacaattttgtgaacattgaaagtattttgagttaagcctaagctgattaatcacacaatacatacttttcctgcattttctttcagtgacatttgagaattgggtgacattttaaaatgtgttttataccatttagcttttgcaaacaagttctaaagttttggagaaaaagtgatgtggtcaagagttgaagtctcatatatctttagtagcactcccatgaattatttccgtgacagtaacaagtgtgtgttccatgtctgatttggggcactggttagactgcattaatagctacttgattagaattcgaacttttaaaattttgaaatgtttaagaatgtattagaaaatgcatgctttatgttgaaaaaatacattgctttaatattcctcattcttgagttaagaaatttatgttaattttgcatgggcacaaacttaatcagaaacattttgtggagttacatttcctcttattatttatcaaggttcagtattgatctttgaaaccttggtcccgttaacttactagtcacattgaccaatgttttatagaaatgcctagaattttgagactaatagtagttatccattaacattccaaaagttttgtgctttttaaaatttgttttggtaattatcacatttttttctcttaccttcctttaaatggccacagtgtgtactgctggaatgttccatccaaaagatgtagcttcagaagcacagtgattgccccagggtccatgagatattgtttgtattatgaagttggagtgctgtctactgaaattatactcttaaataaatatgtatgtagtgtgtaatattttctaataaattcttttgataaac

SEQ ID NO: 445914 - DNA, 7593 bp, Homo sapiens
gaaagtgccagaaaagcgacgtcctcagggcgggagcaggggacgccgcaacgtagtctgcgagaatgcaggaaggcggcagtgaagcggtcggtcggcggggccgcggcaaagtggggaggaaactcatcccgggcaggcgtcagggtggctggagagcgcagcacgcgcgaacagaacgggggcaggcgacaggaaaacgtgtgagcgcgcggctgaaagcgactgggacctgggaaacccttttccaaagagaaatgaagaagaaaactgtatgtaccctaaatatgggagataagaagtatgaagacatggaaggtgaagaaaacggagataatactatttccactggtctgttgtacagtgaggctgacagatgcccaatatgtcttaattgtctattagaaaaggaagttggttttccagaaagctgtaatcatgtcttctgtatgacttgtattcttaaatgggcagaggaattatttattcccataaaaaccttagagacactggcttcatgtcctattgaccgtaaaccttttcaggcagtgtttaaattcagtgcattggaaggttatgttaaggttcaagtaaaaaaacagctgagagaaacaaaagacaagaaaaatgaaaactcatttgagaaacaggtctcctgtcatgaaaattctaaaagctgtataagaagaaaagccatcgtaagagaagatctattaagtgcaaaagtttgtgacttgaagtggatacatagaaactctttatacagtgaaacaggaggaaagaaaaatgcagcaataaagataaataagcctcagagatcaaattggagtacaaatcagtgcttcagaaattttttctccaatatgttttcttctgttagccactctggagaatcttcctttacctatagagcttattgtacagaatttatagaagccagtgaaatcagtgcattgattaggcagaagagacatgaactggaattgtcatggtttcctgatacattacctggaattggaagaattggttttataccctggaatgttgaaacagaagtccttcctctcatttcttctgtgttgccaagaactatttttccaacaagtaccatatctttcgaacattttggtacttcttgcaagggatatgcattagcacatactcaagaaggggaagaaaagaagcaaacttctggtacatcaaataccagaggatcaagacgaaaacctgcaatgacaactcctacaaggaggtctacacgtaacacaagagctgaaacagccagtcagtctcagagatccccaatatcagacaattctgggtgtgatgccccaggtaacagtaatccatctttaagtgttccctcttcagctgagtcagaaaagcaaacaagacaggctccaaaacggaagtctgtaagaagaggaagaaaaccacctttactgaaaaagaaacttcggagctctgtagctgcccctgaaaaatcatcttccaatgattcagtagatgaagaaacagcagaatctgacacatcacctgtgttagaaaaagagcaccaaccagatgtagacagtagtaacatttgtactgtgcagactcatgtagaaaaccagtctgctaattgcttgaaaagttgcaatgagcaaatagaagaaagtgagaagcatactgcaaattatgatacagaggaaagagtaggatcttcatcttctgagtcttgtgctcaagatcttcctgtgctagttggtgaggaaggggaagttaaaaaactcgagaatacaggtatagaggctaatgttttgtgtttggaaagtgagatttctgaaaatattcttgaaaaaggaggtgatccattggaaaagcaagaccagatatctggactttcacaatcagaggtaaagacagatgtatgtacagttcatcttccaaatgattttcctacatgtttaacatctgaaagcaaagtgtaccaacctgtatcttgtcccctaagtgacttatctgagaatgtagagtcagtggttaatgaagaaaaaataacagagagttccctagtagaaattactgaacataaagattttacactaaaaacagaggagcttatagagagccccaagttagaatcttctgagggtgaaattatacagacagtggacagacaatctgttaagagcccagaggttcaattgcttgggcatgttgaaactgaagatgtagaaataattgcaacatgtgatacttttgggaatgaagatttcaataatattcaagactctgaaaataacttactaaaaaataatcttctgaacaccaaattggaaaaatctttagaagaaaagaatgaatcgctgaccgaacatcctagatctacagagttgcctaaaacacacattgaacagattcagaagcattttagtgaggacaacaatgaaatgatacctatggagtgtgattcattttgcagtgaccaaaatgaatctgaagttgaaccatctgtaaatgctgatcttaaacaaatgaatgaaaattctgtgacacactgttctgaaaataatatgccgtcttctgatcttgcggatgaaaaggttgaaactgtttctcaaccatctgaaagcccaaaagataccatagataaaaccaaaaagcctcgtactcgaagatctagatttcattctccatctacaacttggtcacccaacaaagacactccacaagaaaagaagcggccccagtctccatctcccagaagagaaactgggaaagaaagcaggaagtctcaatcaccatctcctaagaatgagtcagccagaggccggaaaaaatcccgttctcagtccccaaaaaaggatattgcaagagaaaggaggcaatctcagtctcggtctccaaaaagggatactactagggaaagcagaagatctgaatcactgtccccaagaagagaaacttctagagagaacaaaagatctcagccaagagtgaaagattcttccccaggagaaaaatccaggtcccagagcagagaacgagaaagtgatagagatgggcagaggagagagagagaaaggagaaccagaaagtggtctaggtccagatctcattctaggtccccctcaagatgtagaacaaaaagtaagagttcatcatttggtagaattgacagagatagttactctccccggtggaagggaagatgggcaaatgatggttggagatgtccacgaggaaatgatcggtacagaaagaatgacccagagaaacagaatgaaaatacaagaaaagaaaaaaatgacatccatctagatgctgatgatccaaattctgctgacaaacatagaaatgactgtcccaattggataacagaaaaaataaactctgggcctgatccaagaaccagaaatccagaaaagttgaaagagtctcattgggaagaaaatagaaatgaaaattcaggaaattcttggaataaaaactttggttctggttgggtatctaaccgtggtagaggcagaggcaaccgtggcagaggcacttacagaagtagttttgcctataaagatcagaatgaaaatcggtggcaaaatcgaaaacccctctcagggaattcaaacagttcagggagtgaatctttcaagtttgtggaacagcaatcctataagcgaaaaagtgaacaggagttctcatttgatacaccagcagatagatctggatggacatctgcatccagctgggccgtgagaaagactttgccagcagatgtacaaaactactactcacgacgaggcagaaattcttcaggtccacagtctggatggatgaaacaagaggaggaaacatctggacaggattctagcctaaaagaccaaacaaaccagcaagttgatggttctcagctacctataaatatgatgcaaccgcaaatgaatgtaatgcagcaacaaatgaatgcacaacaccagcctatgaatatcttcccatatccagtgggtgttcatgctcctttgatgaacatccaacgcaatccatttaacattcatcctcagctacccttgcatctccacacaggagtgcccctcatgcaggtagccactcctaccagtgtatctcagggactaccaccaccaccaccccctcccccaccatcccaacaagtcaactacattgcttcacaaccagatggaaagcaattgcagggtattcctagttcttctcatgtaagtaataacatgagtacaccagttttgcctgctccgacagcagccccaggaaatacgggaatggttcagggaccaagttctggtaatacttcgtcatcaagtcacagcaaagcctctaatgctgctgtaaaattggcagaaagcaaagtaagtgttgcagtggaagccagcgcagatagctcgaagacagacaagaaattgcaaattcaagaaaaagcagcacaagaggtaaaattggccatcaagccattttaccaaaataaagatatcaccaaggaagaatataaagaaattgtacggaaagcagtagataaagtttgtcatagtaagagtggagaagtaaattctactaaagtggcaaatctggttaaagcctatgtagacaaatacaaatattcacggaaggggagccaaaagaaaactctggaagaacctgtgtctactgaaaaaaacataggctgaaatggggaacgctgtcaaggacattatcaggatatctgcaaagtgcaatttcaacatgtaccattaactgaaaatcatacataactgtgattgaaatttggttttgataaaattatttttttaacataggatatgatgttttgttctaaataaatataggtctgcactgcaacttctgtatccttccttcccctccaccctcccccacaaaattcaagggaaagtaaagggtttaaaggaatgtgcatctttactaggactgtgttatagtgtggatactggaaaatgtatagctttttgattagggcaatggagtgcataaattagaaacttctaagtgcactggttttcaaagagatatatataatgcatttattctgtcaggttaaaatataaagtatgatctttatgattttttccctctaattatagaaagttaaataatgtattaccatgaaaaatgtttctaatattaaatagaacatatcagttgcaaagttcctaatgtgtatttttaaagcacatatctgaataaattgcctagatagaaaaaaaattatcacgagtaaaatttagtgttcaaaacattgagacactcttcacctattgtatgaccaaataaaggttatgctgcttgtttttcttttgtgcctttgtttacccctaattgagataagcagtttgacttactagattacaactttggcagttcaaagtctttgttgaagactttgaggaaaaagatttggaaaaattgttgactttcggccgggcatgatggctcacgcctgtaatcccagcactttgggaggccgaggtggcggatcacctgaggtcaggagttcgagaccagcctggccaacatggtgaaatcccgtctctactaaaaatacaaaaattagccaggcgtggtggtgggcgcctgtaatcccagctatgcgagaggctgaggcaggagaatcagttgaacccgggaggcggggattgcagtgagccgagaccatgccattgcactccagcctgggcaacaggagcaaatctccgtctcaaaaaaaagaaaaaaaaaagtgttgactttgtagaaattatgttctttcatagtatcttcttctacccgttgcagacgataaattatttgtgccaattcgagaattgctgttaggctgttatcctcccttccttggggctaagaattacaagactcatggcactggcgtaaagttgttgtttatctaatcactgatgaaatattttcacacttgaaaatccccaaatgctttacaatgaatgaagtgttaatttggtgaccaggtggtagccattagccatgttgcaaaattctagacagtaaaacctgtgttttagaaacagaggggaaatttaaataatggagtcctggttagcctttcagggattagggatttgggtttttttttttctctctttttaatactagaatatctcagtttttataaaaggtaagtttaaaatgtttattgtgccattattttaactggcatcttgaaagaacagtaggttttctccatgataaactgattccagtaagaattttcagtacataccaagtacctggaaagttcttcagataagttaatagatccaaggagatacatgcctcagtgagataaactgacctttttactagctaaactatttagccagagcaatactctgtagaactgtgcttttctaaagtaaagattatctgtttctcaattttatgtgcataatacttttcctggtgctagctttgataggcaaaatattttgaaatgttggtcccataatgattgtgctagttcataagctttgttgttatgagtgtaatcataaaaatatttccaagcagtttttgacctttattctacatttctgggcatttgtaatatggtattctactggtatatatttttaaagtttgcgtttagattatggtaaagaaatttcaagcatatttcttctaataaagtattaagacagtgtttcagaatatcaaggcacacctccttagttgttttagattagaactctagaaacaattttgtgaacattgaaagtattttgagttaagcctaagctgattaatcacacaatacatacttttcctgcattttctttcagtgacatttgagaattgggtgacattttaaaatgtgttttataccatttagcttttgcaaacaagttctaaagttttggagaaaaagtgatgtggtcaagagttgaagtctcatatatctttagtagcactcccatgaattatttccgtgacagtaacaagtgtgtgttccatgtctgatttggggcactggttagactgcattaatagctacttgattagaattcgaacttttaaaattttgaaatgtttaagaatgtattagaaaatgcatgctttatgttgaaaaaatacattgctttaatattcctcattcttgagttaagaaatttatgttaattttgcatgggcacaaacttaatcagaaacattttgtggagttacatttcctcttattatttatcaaggttcagtattgatctttgaaaccttggtcccgttaacttactagtcacattgaccaatgttttatagaaatgcctagaattttgagactaatagtagttatccattaacattccaaaagttttgtgctttttaaaatttgttttggtaattatcacatttttttctcttaccttcctttaaatggccacagtgtgtactgctggaatgttccatccaaaagatgtagcttcagaagcacagtgattgccccagggtccatgagatattgtttgtattatgaagttggagtgctgtctactgaaattatactcttaaataaatatgtatgtagtgtgtaatattttctaataaattcttttgataaac

SEQ ID NO: 445915 - DNA, 7374 bp, Homo sapiens
gaaagtgccagaaaagcgacgtcctcagggcgggagcaggggacgccgcaacgtagtctgcgagaatgcaggaaggcggcagtgaagcggtcggtcggcggggccgcggcaaagtggggaggaaactcatcccgggcaggcgtcagggtggctggagagcgcagcacgcgcgaacagaacgggggcaggcgacaggaaaacgtgtgagcgcgcggctgaaagcgactgggacctgggaaacccttttccaaagagaaatgaagaagaaaactgtatgtaccctaaatatgggagataagaagtatgaagacatggaaggtgaagaaaacggagataatactatttccactggtctgttgtacagtgaggctgacagatgcccaatatgtcttaattgtctattagaaaaggaagttggttttccagaaagctgtaatcatgtcttctgtatgacttgtattcttaaatgggcagaggaattatttattcccataaaaaccttagagacactggcttcatgtcctattgaccgtaaaccttttcaggcagtgtttaaattcagtgcattggaaggttatgttaaggttcaagtaaaaaaacagctgagagaaacaaaagacaagaaaaatgaaaactcatttgagaaacaggtctcctgtcatgaaaattctaaaagctgtataagaagaaaagccatcgtaagagaagatctattaagtgcaaaagtttgtgacttgaagtggatacatagaaactctttatacagtgaaacaggaggaaagaaaaatgcagcaataaagataaataagcctcagagatcaaattggagtacaaatcagtgcttcagaaattttttctccaatatgttttcttctgttagccactctggagaatcttcctttacctatagagcttattgtacagaatttatagaagccagtgaaatcagtgcattgattaggcagaagagacatgaactggaattgtcatggtttcctgatacattacctggaattggaagaattggttttataccctggaatgttgaaacagaagtccttcctctcatttcttctgtgttgccaagaactatttttccaacaagtaccatatctttcgaacattttggtacttcttgcaagggatatgcattagcacatactcaagaaggggaagaaaagaagcaaacttctggtacatcaaataccagaggatcaagacgaaaacctgcaatgacaactcctacaaggaggtctacacgtaacacaagagctgaaacagccagtcagtctcagagatccccaatatcagacaattctgggtgtgatgccccaggtaacagtaatccatctttaagtgttccctcttcagctgagtcagaaaagcaaacaagacaggctccaaaacggaagtctgtaagaagaggaagaaaaccacctttactgaaaaagaaacttcggagctctgtagctgcccctgaaaaatcatcttccaatgattcagtagatgaagaaacagcagaatctgacacatcacctgtgttagaaaaagagcaccaaccagatgtagacagtagtaacatttgtactgtgcagactcatgtagaaaaccagtctgctaattgcttgaaaagttgcaatgagcaaatagaagaaagtgagaagcatactgcaaattatgatacagaggaaagagtaggatcttcatcttctgagtcttgtgctcaagatcttcctgtgctagttggtgaggaaggggaagttaaaaaactcgagaatacaggtatagaggctaatgttttgtgtttggaaagtgagatttctgaaaatattcttgaaaaaggaggtgatccattggaaaagcaagaccagatatctggactttcacaatcagaggtaaagacagatgtatgtacagttcatcttccaaatgattttcctacatgtttaacatctgaaagcaaagtgtaccaacctgtatcttgtcccctaagtgacttatctgagaatgtagagtcagtggttaatgaagaaaaaataacagagagttccctagtagaaattactgaacataaagattttacactaaaaacagaggagcttatagagagccccaagttagaatcttctgagggtgaaattatacagacagtggacagacaatctgttaagagcccagaggttcaattgcttgggcatgttgaaactgaagatgtagaaataattgcaacatgtgatacttttgggaatgaagatttcaataatattcaagactctgaaaataacttactaaaaaataatcttctgaacaccaaattggaaaaatctttagaagaaaagaatgaatcgctgaccgaacatcctagatctacagagttgcctaaaacacacattgaacagattcagaagcattttagtgaggacaacaatgaaatgatacctatggagtgtgattcattttgcagtgaccaaaatgaatctgaagttgaaccatctgtaaatgctgatcttaaacaaatgaatgaaaattctgtgacacactgttctgaaaataatatgccgtcttctgatcttgcggatgaaaaggttgaaactgtttctcaaccatctgaaagcccaaaagataccatagataaaaccaaaaagcctcgtactcgaagatctagatttcattctccatctacaacttggtcacccaacaaagacactccacaagaaaagaagcggccccagtctccatctcccagaagagaaactgggaaagaaagcaggaagtctcaatcaccatctcctaagaatgagtcagccagaggccggaaaaaatcccgttctcagtccccaaaaaaggatattgcaagagaaaggaggcaatctcagtctcggtctccaaaaagggatactactagggaaagcagaagatctgaatcactgtccccaagaagagaaacttctagagagaacaaaagatctcagccaagagtgaaagattcttccccaggagaaaaatccaggtcccagagcagagaacgagaaagtgatagagatgggcagaggagagagagagaaaggagaaccagaaagtggtctaggtccagatctcattctaggtccccctcaagatgtagaacaaaaagtaagagttcatcatttggtagaattgacagagatagttactctccccggtggaagggaagatgggcaaatgatggttggagatgtccacgaggaaatgatcggtacagaaagaatgacccagagaaacagaatgaaaatacaagaaaagaaaaaaatgacatccatctagatgctgatgatccaaattctgctgacaaacatagaaatgactgtcccaattggataacagaaaaaataaactctgggcctgatccaagaaccagaaatccagaaaagttgaaagagtctcattgggaagaaaatagaaatgaaaattcaggaaattcttggaataaaaactttggttctggttgggtatctaaccgtggtagaggcagaggcaaccgtggcagaggcacttacagaagtagttttgcctataaagatcagaatgaaaatcggtggcaaaatcgaaaacccctctcagggaattcaaacagttcagggagtgaatctttcaagtttgtggaacagcaatcctataagcgaaaaagtgaacaggagttctcatttgatacaccagcagatagatctggatggacatctgcatccagctgggccgtgagaaagactttgccagcagatgtacaaaactactactcacgacgaggcagaaattcttcaggtccacagtctggatggatgaaacaagaggaggaaacatctggacaggattctagcctaaaagaccaaacaaaccagcaagttgatggttctcagctacctataaatatgatgcaaccgcaaatgaatgtaatgcagcaacaaatgaatgcacaacaccagcctatgaatatcttcccatatccagtgggtgttcatgctcctttgatgaacatccaacgcaatccatttaacattcatcctcagctacccttgcatctccacacaggagtgcccctcatgcaggtagccactcctaccagtgtatctcagggactaccaccaccaccaccccctcccccaccatcccaacaagtcaactacattgcttcacaaccagatggaaagcaattgcagaaattgcaaattcaagaaaaagcagcacaagaggtaaaattggccatcaagccattttaccaaaataaagatatcaccaaggaagaatataaagaaattgtacggaaagcagtagataaagtttgtcatagtaagagtggagaagtaaattctactaaagtggcaaatctggttaaagcctatgtagacaaatacaaatattcacggaaggggagccaaaagaaaactctggaagaacctgtgtctactgaaaaaaacataggctgaaatggggaacgctgtcaaggacattatcaggatatctgcaaagtgcaatttcaacatgtaccattaactgaaaatcatacataactgtgattgaaatttggttttgataaaattatttttttaacataggatatgatgttttgttctaaataaatataggtctgcactgcaacttctgtatccttccttcccctccaccctcccccacaaaattcaagggaaagtaaagggtttaaaggaatgtgcatctttactaggactgtgttatagtgtggatactggaaaatgtatagctttttgattagggcaatggagtgcataaattagaaacttctaagtgcactggttttcaaagagatatatataatgcatttattctgtcaggttaaaatataaagtatgatctttatgattttttccctctaattatagaaagttaaataatgtattaccatgaaaaatgtttctaatattaaatagaacatatcagttgcaaagttcctaatgtgtatttttaaagcacatatctgaataaattgcctagatagaaaaaaaattatcacgagtaaaatttagtgttcaaaacattgagacactcttcacctattgtatgaccaaataaaggttatgctgcttgtttttcttttgtgcctttgtttacccctaattgagataagcagtttgacttactagattacaactttggcagttcaaagtctttgttgaagactttgaggaaaaagatttggaaaaattgttgactttcggccgggcatgatggctcacgcctgtaatcccagcactttgggaggccgaggtggcggatcacctgaggtcaggagttcgagaccagcctggccaacatggtgaaatcccgtctctactaaaaatacaaaaattagccaggcgtggtggtgggcgcctgtaatcccagctatgcgagaggctgaggcaggagaatcagttgaacccgggaggcggggattgcagtgagccgagaccatgccattgcactccagcctgggcaacaggagcaaatctccgtctcaaaaaaaagaaaaaaaaaagtgttgactttgtagaaattatgttctttcatagtatcttcttctacccgttgcagacgataaattatttgtgccaattcgagaattgctgttaggctgttatcctcccttccttggggctaagaattacaagactcatggcactggcgtaaagttgttgtttatctaatcactgatgaaatattttcacacttgaaaatccccaaatgctttacaatgaatgaagtgttaatttggtgaccaggtggtagccattagccatgttgcaaaattctagacagtaaaacctgtgttttagaaacagaggggaaatttaaataatggagtcctggttagcctttcagggattagggatttgggtttttttttttctctctttttaatactagaatatctcagtttttataaaaggtaagtttaaaatgtttattgtgccattattttaactggcatcttgaaagaacagtaggttttctccatgataaactgattccagtaagaattttcagtacataccaagtacctggaaagttcttcagataagttaatagatccaaggagatacatgcctcagtgagataaactgacctttttactagctaaactatttagccagagcaatactctgtagaactgtgcttttctaaagtaaagattatctgtttctcaattttatgtgcataatacttttcctggtgctagctttgataggcaaaatattttgaaatgttggtcccataatgattgtgctagttcataagctttgttgttatgagtgtaatcataaaaatatttccaagcagtttttgacctttattctacatttctgggcatttgtaatatggtattctactggtatatatttttaaagtttgcgtttagattatggtaaagaaatttcaagcatatttcttctaataaagtattaagacagtgtttcagaatatcaaggcacacctccttagttgttttagattagaactctagaaacaattttgtgaacattgaaagtattttgagttaagcctaagctgattaatcacacaatacatacttttcctgcattttctttcagtgacatttgagaattgggtgacattttaaaatgtgttttataccatttagcttttgcaaacaagttctaaagttttggagaaaaagtgatgtggtcaagagttgaagtctcatatatctttagtagcactcccatgaattatttccgtgacagtaacaagtgtgtgttccatgtctgatttggggcactggttagactgcattaatagctacttgattagaattcgaacttttaaaattttgaaatgtttaagaatgtattagaaaatgcatgctttatgttgaaaaaatacattgctttaatattcctcattcttgagttaagaaatttatgttaattttgcatgggcacaaacttaatcagaaacattttgtggagttacatttcctcttattatttatcaaggttcagtattgatctttgaaaccttggtcccgttaacttactagtcacattgaccaatgttttatagaaatgcctagaattttgagactaatagtagttatccattaacattccaaaagttttgtgctttttaaaatttgttttggtaattatcacatttttttctcttaccttcctttaaatggccacagtgtgtactgctggaatgttccatccaaaagatgtagcttcagaagcacagtgattgccccagggtccatgagatattgtttgtattatgaagttggagtgctgtctactgaaattatactcttaaataaatatgtatgtagtgtgtaatattttctaataaattcttttgataaac

SEQ ID NO: 445916 - DNA, 7607 bp, Homo sapiens
agggagacgcgcagggaggggaggggagggaggaggctagacaaggcgggggaagggggagtagcggtggcttaagccgcgcggagcagcgcaacctgggtcgctccctgcttcgccgccgcctccggaccgagccagcggagtcagtgtcctagagaccctgtaacaccacaaagcggacgaaggagtccatgttggggaacttggcagcggagtgactgggacctgggaacctactgtggggccgcggccggaccgagcgcctcgacctcggtctgaggaaacccttttccaaagagaaatgaagaagaaaactgtatgtaccctaaatatgggagataagaagtatgaagacatggaaggtgaagaaaacggagataatactatttccactggtctgttgtacagtgaggctgacagatgcccaatatgtcttaattgtctattagaaaaggaagttggttttccagaaagctgtaatcatgtcttctgtatgacttgtattcttaaatgggcagagacactggcttcatgtcctattgaccgtaaaccttttcaggcagtgtttaaattcagtgcattggaaggttatgttaaggttcaagtaaaaaaacagctgagagaaacaaaagacaagaaaaatgaaaactcatttgagaaacaggtctcctgtcatgaaaattctaaaagctgtataagaagaaaagccatcgtaagagaagatctattaagtgcaaaagtttgtgacttgaagtggatacatagaaactctttatacagtgaaacaggaggaaagaaaaatgcagcaataaagataaataagcctcagagatcaaattggagtacaaatcagtgcttcagaaattttttctccaatatgttttcttctgttagccactctggagaatcttcctttacctatagagcttattgtacagaatttatagaagccagtgaaatcagtgcattgattaggcagaagagacatgaactggaattgtcatggtttcctgatacattacctggaattggaagaattggttttataccctggaatgttgaaacagaagtccttcctctcatttcttctgtgttgccaagaactatttttccaacaagtaccatatctttcgaacattttggtacttcttgcaagggatatgcattagcacatactcaagaaggggaagaaaagaagcaaacttctggtacatcaaataccagaggatcaagacgaaaacctgcaatgacaactcctacaaggaggtctacacgtaacacaagagctgaaacagccagtcagtctcagagatccccaatatcagacaattctgggtgtgatgccccaggtaacagtaatccatctttaagtgttccctcttcagctgagtcagaaaagcaaacaagacaggctccaaaacggaagtctgtaagaagaggaagaaaaccacctttactgaaaaagaaacttcggagctctgtagctgcccctgaaaaatcatcttccaatgattcagtagatgaagaaacagcagaatctgacacatcacctgtgttagaaaaagagcaccaaccagatgtagacagtagtaacatttgtactgtgcagactcatgtagaaaaccagtctgctaattgcttgaaaagttgcaatgagcaaatagaagaaagtgagaagcatactgcaaattatgatacagaggaaagagtaggatcttcatcttctgagtcttgtgctcaagatcttcctgtgctagttggtgaggaaggggaagttaaaaaactcgagaatacaggtatagaggctaatgttttgtgtttggaaagtgagatttctgaaaatattcttgaaaaaggaggtgatccattggaaaagcaagaccagatatctggactttcacaatcagaggtaaagacagatgtatgtacagttcatcttccaaatgattttcctacatgtttaacatctgaaagcaaagtgtaccaacctgtatcttgtcccctaagtgacttatctgagaatgtagagtcagtggttaatgaagaaaaaataacagagagttccctagtagaaattactgaacataaagattttacactaaaaacagaggagcttatagagagccccaagttagaatcttctgagggtgaaattatacagacagtggacagacaatctgttaagagcccagaggttcaattgcttgggcatgttgaaactgaagatgtagaaataattgcaacatgtgatacttttgggaatgaagatttcaataatattcaagactctgaaaataacttactaaaaaataatcttctgaacaccaaattggaaaaatctttagaagaaaagaatgaatcgctgaccgaacatcctagatctacagagttgcctaaaacacacattgaacagattcagaagcattttagtgaggacaacaatgaaatgatacctatggagtgtgattcattttgcagtgaccaaaatgaatctgaagttgaaccatctgtaaatgctgatcttaaacaaatgaatgaaaattctgtgacacactgttctgaaaataatatgccgtcttctgatcttgcggatgaaaaggttgaaactgtttctcaaccatctgaaagcccaaaagataccatagataaaaccaaaaagcctcgtactcgaagatctagatttcattctccatctacaacttggtcacccaacaaagacactccacaagaaaagaagcggccccagtctccatctcccagaagagaaactgggaaagaaagcaggaagtctcaatcaccatctcctaagaatgagtcagccagaggccggaaaaaatcccgttctcagtccccaaaaaaggatattgcaagagaaaggaggcaatctcagtctcggtctccaaaaagggatactactagggaaagcagaagatctgaatcactgtccccaagaagagaaacttctagagagaacaaaagatctcagccaagagtgaaagattcttccccaggagaaaaatccaggtcccagagcagagaacgagaaagtgatagagatgggcagaggagagagagagaaaggagaaccagaaagtggtctaggtccagatctcattctaggtccccctcaagatgtagaacaaaaagtaagagttcatcatttggtagaattgacagagatagttactctccccggtggaagggaagatgggcaaatgatggttggagatgtccacgaggaaatgatcggtacagaaagaatgacccagagaaacagaatgaaaatacaagaaaagaaaaaaatgacatccatctagatgctgatgatccaaattctgctgacaaacatagaaatgactgtcccaattggataacagaaaaaataaactctgggcctgatccaagaaccagaaatccagaaaagttgaaagagtctcattgggaagaaaatagaaatgaaaattcaggaaattcttggaataaaaactttggttctggttgggtatctaaccgtggtagaggcagaggcaaccgtggcagaggcacttacagaagtagttttgcctataaagatcagaatgaaaatcggtggcaaaatcgaaaacccctctcagggaattcaaacagttcagggagtgaatctttcaagtttgtggaacagcaatcctataagcgaaaaagtgaacaggagttctcatttgatacaccagcagatagatctggatggacatctgcatccagctgggccgtgagaaagactttgccagcagatgtacaaaactactactcacgacgaggcagaaattcttcaggtccacagtctggatggatgaaacaagaggaggaaacatctggacaggattctagcctaaaagaccaaacaaaccagcaagttgatggttctcagctacctataaatatgatgcaaccgcaaatgaatgtaatgcagcaacaaatgaatgcacaacaccagcctatgaatatcttcccatatccagtgggtgttcatgctcctttgatgaacatccaacgcaatccatttaacattcatcctcagctacccttgcatctccacacaggagtgcccctcatgcaggtagccactcctaccagtgtatctcagggactaccaccaccaccaccccctcccccaccatcccaacaagtcaactacattgcttcacaaccagatggaaagcaattgcagggtattcctagttcttctcatgtaagtaataacatgagtacaccagttttgcctgctccgacagcagccccaggaaatacgggaatggttcagggaccaagttctggtaatacttcgtcatcaagtcacagcaaagcctctaatgctgctgtaaaattggcagaaagcaaagtaagtgttgcagtggaagccagcgcagatagctcgaagacagacaagaaattgcaaattcaagaaaaagcagcacaagaggtaaaattggccatcaagccattttaccaaaataaagatatcaccaaggaagaatataaagaaattgtacggaaagcagtagataaagtttgtcatagtaagagtggagaagtaaattctactaaagtggcaaatctggttaaagcctatgtagacaaatacaaatattcacggaaggggagccaaaagaaaactctggaagaacctgtgtctactgaaaaaaacataggctgaaatggggaacgctgtcaaggacattatcaggatatctgcaaagtgcaatttcaacatgtaccattaactgaaaatcatacataactgtgattgaaatttggttttgataaaattatttttttaacataggatatgatgttttgttctaaataaatataggtctgcactgcaacttctgtatccttccttcccctccaccctcccccacaaaattcaagggaaagtaaagggtttaaaggaatgtgcatctttactaggactgtgttatagtgtggatactggaaaatgtatagctttttgattagggcaatggagtgcataaattagaaacttctaagtgcactggttttcaaagagatatatataatgcatttattctgtcaggttaaaatataaagtatgatctttatgattttttccctctaattatagaaagttaaataatgtattaccatgaaaaatgtttctaatattaaatagaacatatcagttgcaaagttcctaatgtgtatttttaaagcacatatctgaataaattgcctagatagaaaaaaaattatcacgagtaaaatttagtgttcaaaacattgagacactcttcacctattgtatgaccaaataaaggttatgctgcttgtttttcttttgtgcctttgtttacccctaattgagataagcagtttgacttactagattacaactttggcagttcaaagtctttgttgaagactttgaggaaaaagatttggaaaaattgttgactttcggccgggcatgatggctcacgcctgtaatcccagcactttgggaggccgaggtggcggatcacctgaggtcaggagttcgagaccagcctggccaacatggtgaaatcccgtctctactaaaaatacaaaaattagccaggcgtggtggtgggcgcctgtaatcccagctatgcgagaggctgaggcaggagaatcagttgaacccgggaggcggggattgcagtgagccgagaccatgccattgcactccagcctgggcaacaggagcaaatctccgtctcaaaaaaaagaaaaaaaaaagtgttgactttgtagaaattatgttctttcatagtatcttcttctacccgttgcagacgataaattatttgtgccaattcgagaattgctgttaggctgttatcctcccttccttggggctaagaattacaagactcatggcactggcgtaaagttgttgtttatctaatcactgatgaaatattttcacacttgaaaatccccaaatgctttacaatgaatgaagtgttaatttggtgaccaggtggtagccattagccatgttgcaaaattctagacagtaaaacctgtgttttagaaacagaggggaaatttaaataatggagtcctggttagcctttcagggattagggatttgggtttttttttttctctctttttaatactagaatatctcagtttttataaaaggtaagtttaaaatgtttattgtgccattattttaactggcatcttgaaagaacagtaggttttctccatgataaactgattccagtaagaattttcagtacataccaagtacctggaaagttcttcagataagttaatagatccaaggagatacatgcctcagtgagataaactgacctttttactagctaaactatttagccagagcaatactctgtagaactgtgcttttctaaagtaaagattatctgtttctcaattttatgtgcataatacttttcctggtgctagctttgataggcaaaatattttgaaatgttggtcccataatgattgtgctagttcataagctttgttgttatgagtgtaatcataaaaatatttccaagcagtttttgacctttattctacatttctgggcatttgtaatatggtattctactggtatatatttttaaagtttgcgtttagattatggtaaagaaatttcaagcatatttcttctaataaagtattaagacagtgtttcagaatatcaaggcacacctccttagttgttttagattagaactctagaaacaattttgtgaacattgaaagtattttgagttaagcctaagctgattaatcacacaatacatacttttcctgcattttctttcagtgacatttgagaattgggtgacattttaaaatgtgttttataccatttagcttttgcaaacaagttctaaagttttggagaaaaagtgatgtggtcaagagttgaagtctcatatatctttagtagcactcccatgaattatttccgtgacagtaacaagtgtgtgttccatgtctgatttggggcactggttagactgcattaatagctacttgattagaattcgaacttttaaaattttgaaatgtttaagaatgtattagaaaatgcatgctttatgttgaaaaaatacattgctttaatattcctcattcttgagttaagaaatttatgttaattttgcatgggcacaaacttaatcagaaacattttgtggagttacatttcctcttattatttatcaaggttcagtattgatctttgaaaccttggtcccgttaacttactagtcacattgaccaatgttttatagaaatgcctagaattttgagactaatagtagttatccattaacattccaaaagttttgtgctttttaaaatttgttttggtaattatcacatttttttctcttaccttcctttaaatggccacagtgtgtactgctggaatgttccatccaaaagatgtagcttcagaagcacagtgattgccccagggtccatgagatattgtttgtattatgaagttggagtgctgtctactgaaattatactcttaaataaatatgtatgtagtgtgtaatattttctaataaattcttttgataaac

SEQ ID NO: 445917 - DNA, 5348 bp, Homo sapiens
gaaagtgccagaaaagcgacgtcctcagggcgggagcaggggacgccgcaacgtagtctgcgagaatgcaggaaggcggcagtgaagcggtcggtcggcggggccgcggcaaagtggggaggaaactcatcccgggcaggcgtcagggtggctggagagcgcagcacgcgcgaacagaacgggggcaggcgacaggaaaacgtgtgagcgcgcggctgaaagcgactgggacctgggaaacccttttccaaagagaaatgaagaagaaaactgtatgtaccctaaatatgggagataagaagtatgaagacatggaaggtgaagaaaacggagataatactatttccactggtctgttgtacagtgaggctgacagatgcccaatatgtcttaattgtctattagaaaaggaagttggttttccagaaagctgtaatcatgtcttctgtatgacttgtattcttaaatgggcagaggaattatttattcccataaaaaccttagagacactggcttcatgtcctattgaccgtaaaccttttcaggcagtgtttaaattcagtgcattggaaggttatgttaaggttcaagtaaaaaaacagctgagagaaacaaaagacaagaaaaatgaaaactcatttgagaaacaggtctcctgtcatgaaaattctaaaagctgtataagaagaaaagccatcgtaagagaagatctattaagtgcaaaagtttgtgacttgaagtggatacatagaaactctttatacagtgaaacaggaggaaagaaaaatgcagcaataaagataaataagcctcagagatcaaattggagtacaaatcagtgcttcagaaattttttctccaatatgttttcttctgttagccactctggagaatcttcctttacctatagagcttattgtacagaatttatagaagccagtgaaatcagtgcattgattaggcagaagagacatgaactggaattgtcatggtttcctgatacattacctggaattggaagaattggttttataccctggaatgttgaaacagaagtccttcctctcatttcttctgtgttgccaagaactatttttccaacaagtaccatatctttcgaacattttggtacttcttgcaagggatatgcattagcacatactcaagaaggggaagaaaagaagcaaacttctggtacatcaaataccagaggatcaagacgaaaacctgcaatgacaactcctacaaggaggtctacacgtaacacaagagctgaaacagccagtcagtctcagagatccccaatatcagacaattctgggtgtgatgccccaggtaacagtaatccatctttaagtgttccctcttcagctgagtcagaaaagcaaacaagacaggctccaaaacggaagtctgtaagaagaggaagaaaaccacctttactgaaaaagaaacttcggagctctgtagctgcccctgaaaaatcatcttccaatgattcagtagatgaagaaacagcagaatctgacacatcacctgtgttagaaaaagagcaccaaccagatgtagacagtagtaacatttgtactgtgcagactcatgtagaaaaccagtctgctaattgcttgaaaagttgcaatgagcaaatagaagaaagtgagaagcatactgcaaattatgatacagaggaaagagtaggatcttcatcttctgagtcttgtgctcaagatcttcctgtgctagttggtgaggaaggggaagttaaaaaactcgagaatacaggtatagaggctaatgttttgtgtttggaaagtgagatttctgaaaatattcttgaaaaaggaggtgatccattggaaaagcaagaccagatatctggactttcacaatcagaggtaaagacagatgtatgtacagttcatcttccaaatgattttcctacatgtttaacatctgaaagcaaagtgtaccaacctgtatcttgtcccctaagtgacttatctgagaatgtagagtcagtggttaatgaagaaaaaataacagagagttccctagtagaaattactgaacataaagattttacactaaaaacagaggagcttatagagagccccaagttagaatcttctgagggtgaaattatacagacagtggacagacaatctgttaagagcccagaggttcaattgcttgggcatgttgaaactgaagatgtagaaataattgcaacatgtgatacttttgggaatgaagatttcaataatattcaagactctgaaaataacttactaaaaaataatcttctgaacaccaaattggaaaaatctttagaagaaaagaatgaatcgctgaccgaacatcctagatctacagagttgcctaaaacacacattgaacagattcagaagcattttagtgaggacaacaatgaaatgatacctatggagtgtgattcattttgcagtgaccaaaatgaatctgaagttgaaccatctgtaaatgctgatcttaaacaaatgaatgaaaattctgtgacacactgttctgaaaataatatgccgtcttctgatcttgcggatgaaaaggttgaaactgtttctcaaccatctgaaagcccaaaagataccatagataaaaccaaaaagcctcgtactcgaagatctagatttcattctccatctacaacttggtcacccaacaaagacactccacaagaaaagaagcggccccagtctccatctcccagaagagaaactgggaaagaaagcaggaagtctcaatcaccatctcctaagaatgagtcagccagaggccggaaaaaatcccgttctcagtccccaaaaaaggatattgcaagagaaaggaggcaatctcagtctcggtctccaaaaagggatactactagggaaagcagaagatctgaatcactgtccccaagaagagaaacttctagagagaacaaaagatctcagccaagagtgaaagattcttccccaggagaaaaatccaggtcccagagcagagaacgagaaagtgatagagatgggcagaggagagagagagaaaggagaaccagaaagtggtctaggtccagatctcattctaggtccccctcaagatgtagaacaaaaagtaagagttcatcatttggtagaattgacagagatagttactctccccggtggaagggaagatgggcaaatgatggttggagatgtccacgaggaaatgatcggtacagaaagaatgacccagagaaacagaatgaaaatacaagaaaagaaaaaaatgacatccatctagatgctgatgatccaaattctgctgacaaacatagaaatgactgtcccaattggataacagaaaaaataaactctgggcctgatccaagaaccagaaatccagaaaagttgaaagagtctcattgggaagaaaatagaaatgaaaattcaggaaattcttggaataaaaactttggttctggttgggtatctaaccgtggtagaggcagaggcaaccgtggcagaggcacttacagaagtagttttgcctataaagatcagaatgaaaatcggtggcaaaatcgaaaacccctctcagggaattcaaacagttcagggagtgaatctttcaagtttgtggaacagcaatcctataagcgaaaaagtgaacaggagttctcatttgatacaccagcagatagatctggatggacatctgcatccagctgggccgtgagaaagactttgccagcagatgtacaaaactactactcacgacgaggcagaaattcttcaggtccacagtctggatggatgaaacaagaggaggaaacatctggacaggattctagcctaaaagaccaaacaaaccagcaagttgatggttctcagctacctataaatatgatgcaaccgcaaatgaatgtaatgcagcaacaaatgaatgcacaacaccagcctatgaatatcttcccatatccagtgggtgttcatgctcctttgatgaacatccaacgcaatccatttaacattcatcctcagctacccttgcatctccacacaggagtgcccctcatgcaggtagccactcctaccagtgtatctcagggactaccaccaccaccaccccctcccccaccatcccaacaagtcaactacattgcttcacaaccagatggaaagcaattgcagggtattcctagttcttctcatgtaagtaataacatgagtacaccagttttgcctgctccgacagcagccccaggaaatacgggaatggttcagggaccaagttctggtaatacttcgtcatcaagtcacagcaaagcctctaatgctgctgtaaaattggcagaaagcaaagtaagtgttgcagtggaagccagcgcagatagctcgaagacagacaagaaattgcaaattcaagaaaaagcagcacaagaggtaaaattggccatcaagccattttaccaaaataaagatatcaccaaggaagaatataaagaaattgtacggaaagcagtagataaagtttgtcatagtaagagtggagaagtaaattctactaaagtggcaaatctggttaaagcctatgtagacaaatacaaatattcacggaaggggagccaaaagaaaactctggaagaacctgtgtctactgaaaaaaacataggctgaaatggggaacgctgtcaaggacattatcaggatatctgcaaagtgcaatttcaacatgtaccattaactgaaaatcatacataactgtgattgaaatttggttttgataaaattatttttttaacataggatatgatgttttgttctaaataaatataggtctgcactgcaacttctgtatccttccttcccctccaccctcccccacaaaattcaagggaaagtaaagggtttaaaggaatgtgcatctttactaggactgtgttatagtgtggatactggaaaatgtatagctttttgattagggcaatggagtgcataaattagaaacttctaagtgcactggttttcaaagagatatatataatgcatttattctgtcaggttaaaatataaagtatgatctttatgattttttccctctaattatagaaagttaaataatgtattaccatgaaaaatgtttctaatattaaatagaacatatcagttgcaaagttcctaatgtgtatttttaaagcacatatctgaataaattgcctagatagaaaaaaaattatcacgagtaaaatttagtgttcaaaacattgagacactcttcacctattgtatgaccaaataaaggttatgctgcttgtaaaaaaaaaaaaaaaaaaaaaaaaaaaaaaa

SEQ ID NO: 445918 - DNA, 4638 bp, Homo sapiens
gaaagtgccagaaaagcgacgtcctcagggcgggagcaggggacgccgcaacgtagtctgcgagaatgcaggaaggcggcagtgaagcggtcggtcggcggggccgcggcaaagtggggaggaaactcatcccgggcaggcgtcagggtggctggagagcgcagcacgcgcgaacagaacgggggcaggcgacaggaaaacgtgtgagcgcgcggctgaaagcgactgggacctgggaaacccttttccaaagagaaatgaagaagaaaactgtatgtaccctaaatatgggagataagaagtatgaagacatggaaggtgaagaaaacggagataatactatttccactggtctgttgtacagtgaggctgacagatgcccaatatgtcttaattgtctattagaaaaggaagttggttttccagaaagctgtaatcatgtcttctgtatgacttgtattcttaaatgggcagaggaattatttattcccataaaaaccttagagacactggcttcatgtcctattgaccgtaaaccttttcaggcagtgtttaaattcagtgcattggaaggttatgttaaggttcaagtaaaaaaacagctgagagaaacaaaagacaagaaaaatgaaaactcatttgagaaacaggtctcctgtcatgaaaattctaaaagctgtataagaagaaaagccatcgtaagagaagatctattaagtgcaaaagtttgtgacttgaagtggatacatagaaactctttatacagtgaaacaggaggaaagaaaaatgcagcaataaagataaataagcctcagagatcaaattggagtacaaatcagtgcttcagaaattttttctccaatatgttttcttctgttagccactctggagaatcttcctttacctatagagcttattgtacagaatttatagaagccagtgaaatcagtgcattgattaggcagaagagacatgaactggaattgtcatggtttcctgatacattacctggaattggaagaattggttttataccctggaatgttgaaacagaagtccttcctctcatttcttctgtgttgccaagaactatttttccaacaagtaccatatctttcgaacattttggtacttcttgcaagggatatgcattagcacatactcaagaaggggaagaaaagaagcaaacttctggtacatcaaataccagaggatcaagacgaaaacctgcaatgacaactcctacaaggaggtctacacgtaacacaagagctgaaacagccagtcagtctcagagatccccaatatcagacaattctgggtgtgatgccccaggtaacagtaatccatctttaagtgttccctcttcagctgagtcagaaaagcaaacaagacaggctccaaaacggaagtctgtaagaagaggaagaaaaccacctttactgaaaaagaaacttcggagctctgtagctgcccctgaaaaatcatcttccaatgattcagtagatgaagaaacagcagaatctgacacatcacctgtgttagaaaaagagcaccaaccagatgtagacagtagtaacatttgtactgtgcagactcatgtagaaaaccagtctgctaattgcttgaaaagttgcaatgagcaaatagaagaaagtgagaagcatactgcaaattatgatacagaggaaagagtaggatcttcatcttctgagtcttgtgctcaagatcttcctgtgctagttggtgaggaaggggaagttaaaaaactcgagaatacaggtatagaggctaatgttttgtgtttggaaagtgagatttctgaaaatattcttgaaaaaggaggtgatccattggaaaagcaagaccagatatctggactttcacaatcagaggtaaagacagatgtatgtacagttcatcttccaaatgattttcctacatgtttaacatctgaaagcaaagtgtaccaacctgtatcttgtcccctaagtgacttatctgagaatgtagagtcagtggttaatgaagaaaaaataacagagagttccctagtagaaattactgaacataaagattttacactaaaaacagaggagcttatagagagccccaagttagaatcttctgagggtgaaattatacagacagtggacagacaatctgttaagagcccagaggttcaattgcttgggcatgttgaaactgaagatgtagaaataattgcaacatgtgatacttttgggaatgaagatttcaataatattcaagactctgaaaataacttactaaaaaataatcttctgaacaccaaattggaaaaatctttagaagaaaagaatgaatcgctgaccgaacatcctagatctacagagttgcctaaaacacacattgaacagattcagaagcattttagtgaggacaacaatgaaatgatacctatggagtgtgattcattttgcagtgaccaaaatgaatctgaagttgaaccatctgtaaatgctgatcttaaacaaatgaatgaaaattctgtgacacactgttctgaaaataatatgccgtcttctgatcttgcggatgaaaaggttgaaactgtttctcaaccatctgaaagcccaaaagataccatagataaaaccaaaaagcctcgtactcgaagatctagatttcattctccatctacaacttggtcacccaacaaagacactccacaagaaaagaagcggccccagtctccatctcccagaagagaaactgggaaagaaagcaggaagtctcaatcaccatctcctaagaatgagtcagccagaggccggaaaaaatcccgttctcagtccccaaaaaaggatattgcaagagaaaggaggcaatctcagtctcggtctccaaaaagggatactactagggaaagcagaagatctgaatcactgtccccaagaagagaaacttctagagagaacaaaagatctcagccaagagtgaaagattcttccccaggagaaaaatccaggtcccagagcagagaacgagaaagtgatagagatgggcagaggagagagagagaaaggagaaccagaaagtggtctaggtccagatctcattctaggtccccctcaagatgtagaacaaaaagtaagagttcatcatttggtagaattgacagagatagttactctccccggtggaagggaagatgggcaaatgatggttggagatgtccacgaggaaatgatcggtacagaaagaatgacccagagaaacagaatgaaaatacaagaaaagaaaaaaatgacatccatctagatgctgatgatccaaattctgctgacaaacatagaaatgactgtcccaattggataacagaaaaaataaactctgggcctgatccaagaaccagaaatccagaaaagttgaaagagtctcattgggaagaaaatagaaatgaaaattcaggaaattcttggaataaaaactttggttctggttgggtatctaaccgtggtagaggcagaggcaaccgtggcagaggcacttacagaagtagttttgcctataaagatcagaatgaaaatcggtggcaaaatcgaaaacccctctcagggaattcaaacagttcagggagtgaatctttcaagtttgtggaacagcaatcctataagcgaaaaagtgaacaggagttctcatttgatacaccagcagatagatctggatggacatctgcatccagctgggccgtgagaaagactttgccagcagatgtacaaaactactactcacgacgaggcagaaattcttcaggtccacagtctggatggatgaaacaagaggaggaaacatctggacaggattctagcctaaaagaccaaacaaaccagcaagttgatggttctcagctacctataaatatgatgcaaccgcaaatgaatgtaatgcagcaacaaatgaatgcacaacaccagcctatgaatatcttcccatatccagtgggtgttcatgctcctttgatgaacatccaacgcaatccatttaacattcatcctcagctacccttgcatctccacacaggagtgcccctcatgcaggtagccactcctaccagtgtatctcagggactaccaccaccaccaccccctcccccaccatcccaacaagtcaactacattgcttcacaaccagatggaaagcaattgcagggtattcctagttcttctcatgtaagtaataacatgagtacaccagttttgcctgctccgacagcagccccaggaaatacgggaatggttcagggaccaagttctggtaatacttcgtcatcaagtcacagcaaagcctctaatgctgctgtaaaattggcagaaagcaaagtaagtgttgcagtggaagccagcgcagatagctcgaagacagacaagaaattgcaaattcaagaaaaagcagcacaagaggtaaaattggccatcaagccattttaccaaaataaagatatcaccaaggaagaatataaagaaattgtacggaaagcagtagataaagtaagttatggctttagtggagtatgtgcacgttgttttgaaccacctctgttttaataaatgaatgctgaagtttaattaaaataataaaagctagctcctacta

SEQ ID NO: 445919 - DNA, 4660 bp, Homo sapiens
gaaagtgccagaaaagcgacgtcctcagggcgggagcaggggacgccgcaacgtagtctgcgagaatgcaggaaggcggcagtgaagcggtcggtcggcggggccgcggcaaagtggggaggaaactcatcccgggcaggcgtcagggtggctggagagcgcagcacgcgcgaacagaacgggggcaggcgacaggaaaacgtgtgagcgcgcggctgaaagcgactgggacctgggaaacccttttccaaagagaaatgaagaagaaaactgtatgtaccctaaatatgggagataagaagtatgaagacatggaaggtgaagaaaacggagataatactatttccactggtctgttgtacagtgaggctgacagatgcccaatatgtcttaattgtctattagaaaaggaagttggttttccagaaagctgtaatcatgtcttctgtatgacttgtattcttaaatgggcagaggaattatttattcccataaaaaccttagagacactggcttcatgtcctattgaccgtaaaccttttcaggcagtgtttaaattcagtgcattggaaggttatgttaaggttcaagtaaaaaaacagctgagagaaacaaaagacaagaaaaatgaaaactcatttgagaaacaggtctcctgtcatgaaaattctaaaagctgtataagaagaaaagccatcgtaagagaagatctattaagtgcaaaagtttgtgacttgaagtggatacatagaaactctttatacagtgaaacaggaggaaagaaaaatgcagcaataaagataaataagcctcagagatcaaattggagtacaaatcagtgcttcagaaattttttctccaatatgttttcttctgttagccactctggagaatcttcctttacctatagagcttattgtacagaatttatagaagccagtgaaatcagtgcattgattaggcagaagagacatgaactggaattgtcatggtttcctgatacattacctggaattggaagaattggttttataccctggaatgttgaaacagaagtccttcctctcatttcttctgtgttgccaagaactatttttccaacaagtaccatatctttcgaacattttggtacttcttgcaagggatatgcattagcacatactcaagaaggggaagaaaagaagcaaacttctggtacatcaaataccagaggatcaagacgaaaacctgcaatgacaactcctacaaggaggtctacacgtaacacaagagctgaaacagccagtcagtctcagagatccccaatatcagacaattctgggtgtgatgccccaggtaacagtaatccatctttaagtgttccctcttcagctgagtcagaaaagcaaacaagacaggctccaaaacggaagtctgtaagaagaggaagaaaaccacctttactgaaaaagaaacttcggagctctgtagctgcccctgaaaaatcatcttccaatgattcagtagatgaagaaacagcagaatctgacacatcacctgtgttagaaaaagagcaccaaccagatgtagacagtagtaacatttgtactgtgcagactcatgtagaaaaccagtctgctaattgcttgaaaagttgcaatgagcaaatagaagaaagtgagaagcatactgcaaattatgatacagaggaaagagtaggatcttcatcttctgagtcttgtgctcaagatcttcctgtgctagttggtgaggaaggggaagttaaaaaactcgagaatacaggtatagaggctaatgttttgtgtttggaaagtgagatttctgaaaatattcttgaaaaaggaggtgatccattggaaaagcaagaccagatatctggactttcacaatcagaggtaaagacagatgtatgtacagttcatcttccaaatgattttcctacatgtttaacatctgaaagcaaagtgtaccaacctgtatcttgtcccctaagtgacttatctgagaatgtagagtcagtggttaatgaagaaaaaataacagagagttccctagtagaaattactgaacataaagattttacactaaaaacagaggagcttatagagagccccaagttagaatcttctgagggtgaaattatacagacagtggacagacaatctgttaagagcccagaggttcaattgcttgggcatgttgaaactgaagatgtagaaataattgcaacatgtgatacttttgggaatgaagatttcaataatattcaagactctgaaaataacttactaaaaaataatcttctgaacaccaaattggaaaaatctttagaagaaaagaatgaatcgctgaccgaacatcctagatctacagagttgcctaaaacacacattgaacagattcagaagcattttagtgaggacaacaatgaaatgatacctatggagtgtgattcattttgcagtgaccaaaatgaatctgaagttgaaccatctgtaaatgctgatcttaaacaaatgaatgaaaattctgtgacacactgttctgaaaataatatgccgtcttctgatcttgcggatgaaaaggttgaaactgtttctcaaccatctgaaagcccaaaagataccatagataaaaccaaaaagcctcgtactcgaagatctagatttcattctccatctacaacttggtcacccaacaaagacactccacaagaaaagaagcggccccagtctccatctcccagaagagaaactgggaaagaaagcaggaagtctcaatcaccatctcctaagaatgagtcagccagaggccggaaaaaatcccgttctcagtccccaaaaaaggatattgcaagagaaaggaggcaatctcagtctcggtctccaaaaagggatactactagggaaagcagaagatctgaatcactgtccccaagaagagaaacttctagagagaacaaaagatctcagccaagagtgaaagattcttccccaggagaaaaatccaggtcccagagcagagaacgagaaagtgatagagatgggcagaggagagagagagaaaggagaaccagaaagtggtctaggtccagatctcattctaggtccccctcaagatgtagaacaaaaagtaagagttcatcatttggtagaattgacagagatagttactctccccggtggaagggaagatgggcaaatgatggttggagatgtccacgaggaaatgatcggtacagaaagaatgacccagagaaacagaatgaaaatacaagaaaagaaaaaaatgacatccatctagatgctgatgatccaaattctgctgacaaacatagaaatgactgtcccaattggataacagaaaaaataaactctgggcctgatccaagaaccagaaatccagaaaagttgaaagagtctcattgggaagaaaatagaaatgaaaattcaggaaattcttggaataaaaactttggttctggttgggtatctaaccgtggtagaggcagaggcaaccgtggcagaggcacttacagaagtagttttgcctataaagatcagaatgaaaatcggtggcaaaatcgaaaacccctctcagggaattcaaacagttcagggagtgaatctttcaagtttgtggaacagcaatcctataagcgaaaaagtgaacaggagttctcatttgatacaccagcagatagatctggatggacatctgcatccagctgggccgtgagaaagactttgccagcagatgtacaaaactactactcacgacgaggcagaaattcttcaggtccacagtctggatggatgaaacaagaggaggaaacatctggacaggattctagcctaaaagaccaaacaaaccagcaagttgatggttctcagctacctataaatatgatgcaaccgcaaatgaatgtaatgcagcaacaaatgaatgcacaacaccagcctatgaatatcttcccatatccagtgggtgttcatgctcctttgatgaacatccaacgcaatccatttaacattcatcctcagctacccttgcatctccacacaggagtgcccctcatgcaggtagccactcctaccagtgtatctcagggactaccaccaccaccaccccctcccccaccatcccaacaagtcaactacattgcttcacaaccagatggaaagcaattgcagggtattcctagttcttctcatgtaagtaataacatgagtacaccagttttgcctgctccgacagcagccccaggaaatacgggaatggttcagggaccaagttctggtaatacttcgtcatcaagtcacagcaaagcctctaatgctgctgtaaaattggcagaaagcaaaaaattgcaaattcaagaaaaagcagcacaagaggtaaaattggccatcaagccattttaccaaaataaagatatcaccaaggaagaatataaagaaattgtacggaaagcagtagataaatgtgtactgctggaatgttccatccaaaagatgtagcttcagaagcacagtgattgccccagggtccatgagatattgtttgtattatgaagttggagtgctgtctactgaaattatactcttaaataaatatgtatgtagtgtgtaatattttctaataaattcttttgataaac

SEQ ID NO: 445920 - DNA, 1086 bp, Homo sapiens
agggagacgcgcagggaggggaggggagggaggaggctagacaaggcgggggaagggggagtagcggtggcttaagccgcgcggagcagcgcaacctgggtcgctccctgcttcgccgccgcctccggaccgagccagcggagtcagtgtcctagagaccctgtaacaccacaaagcggacgaaggagtccatgttggggaacttggcagcggagtgactgggacctgggaacctactgtggggccgcggccggaccgagcgcctcgacctcggtctgaggaaacccttttccaaagagaaatgaagaagaaaactgtatgtaccctaaatatgggagataagaagtatgaagacatggaaggtgaagaaaacggagataatactatttccactggtctgttgtacagtgaggctgacagatgcccaatatgtcttaattgtctattagaaaaggaagttggttttccagaaagctgtaatcatgtcttctgtatgacttgtattcttaaatgggcagaggaattatttattcccataaaaaccttagagacactggcttcatgtcctattgaccgtaaaccttttcaggcagtgtttaaattcagtgcattggaaggttatgttaaggttcaagtaaaaaaacagctgagagaaacaaaagacaagaaaaatgaaaactcatttgagaaacaggtctcctgtcatgaaaattctaaaagctgtataaggttagtgattaactttagaagtggaatgcaaatgagtggaacagaagttaactagtacaaaaaaggtattaaaaaaatgaagtggggtttaaatgtatttaatcacttattcaaaagcacacacttgataatttaaggagggactagctgaaatctgagaatctgatttgagctctactctgtttttggtgaagaattggttctggctgggcatggtggctcactcctataatcccagtgctttgggaggctaaggtgagaggatcacatgagaccaggagtttggtaccagcctggggaacatagtgaggaccgtcctcccctcctctgtctctactaaaaaataacacaaaataa

SEQ ID NO: 445921 - DNA, 734 bp, Homo sapiens
aatctggcctttgagttcaatgtcctgggaacttaactctagggatgctctttccccctttagctaccgagtcacatgctgcgtctttggaaatttcaggcaatatttagtttggtgcaaaagtcattgtggtttttgcaattaattgcaaaaataataaatggaaaaatgaatttgtggacatcaggcttgcctagggagatgacctagggagaggcctcttttggcatagctcctgaacagggagaggtcctgacatgaataccccccgttttgtgaatcctgagccagtactgtgtccccggccccctcctcccccaacctatacacacgcctcactttcccttgcaggacgttttctaccacagttcctctctcctgacatagtatgtgtttgtttcttacttgtcttgccgcatgaggatgtaagttgcctgaattcaaaaacatgtcttcttttttgtgaatgaaagagtggctggcatgtagcaggtactgaaattatttgtagagtgaatgataaatctcagttcagggcactcagtgtggcctgggctacgtggaatagccaattggtggccacagagagtggccagccattcccaggctggcaatgtgagtcttagccactctcttttacagataatgtgcttattaaaatgatatcccaggcattccccagtggtgtttgaatcgtgaatgcaaatgtcagaggctctgaagtttaaagtctt

SEQ ID NO: 445922 - DNA, 666 bp, Homo sapiens
tccagttcaggcaaagacatccaaagtagaaagtgaccagccgcaaaactccaacgatgcttccatggatgccactgatcaagtggtatacaagcattgcacagtgtctggccaaacggatgcagctaaaaacgctgctgcccctgcagcaagttctggctctgggaccagcacccccctgattccatcacccaaaccagaacctgagaagacttctccaaaacctgaatatcccgcagaaaagccaaagcagagtgacccctctcccccttctcaaggcaccaaaccagccctgccatgagcatcgacttcctcggacccaccacaggcatccacagcccagccacagccacagccacagccaccaaaacaaccccaacttatcggaagacctccctcggcctctcaaacaccggtcccttccagtccactgcaaatttccatgacgtctctccagaacagtctacctccacagttactacaataccaatgtgatcagtgtacagttgccttcccaactctggaactctggcaggaacaccagcacatgcacttccttgctgctcaaaaccaattccttcactctccgttcttggaaaggcccatggacatgccctacatgatatttgaccccaacaatccgctgatgactggacaactgctggg

SEQ ID NO: 445923 - DNA, 809 bp, Homo sapiens
agttatgagaatcaagcagaaacaaaagataatgaaaaaagagaactcactaatgaacggtacattcgaacaagcaacatgcagtaccagtgtaaaaagtgcaatgtggttttccccaggatctttgacttgattacgcatcagaaaaagcagtgttacaaggatgaagatgatgatgcccaagatgaaagccaaacagaagactccatggatgccactgatcaagtggtatacaagcattgcacagtgtctggccaaacggatgcagctaaaaacgctgctgcccctgcagcaagttctggctctgggaccagcacccccctgattccatcacccaaaccagaacctgagaagacttctccaaaacctgaatatcccgcagaaaagccaaagcagagtgacccctctcccccttctcaaggcaccaaaccagccctgccatgagcatcgacttcctcggacccaccacaggcatccacagcccagccacagccacagccacagccaccaaaacaaccccaacttatcggaagacctccctcggcctctcaaacaccggtcccttccagtccactgcaaatttccatgacgtctctccagaacagtctacctccacagttactacaataccaatgtgatcagtgtacagttgccttcccaactctggaactctggcaggaacaccagcacatgcacttccttgctgctcaaaaccaattccttcactctccgttcttggaaaggcccatggacatgccctacatgatatttgaccccaacaatccgctgatgactggacaactgctggg

SEQ ID NO: 445924 - DNA, 794 bp, Homo sapiens
tcctcttctgaaagcttaatctcagtctgagctgctgtaaccaggcttagatccgggtactctgagaggatatggttcccccaaccctggggggatatggaggtagataccttgcttttatctcttaacttatcagagttgtggtccagaaactcattcaaactgggaggcctactttaagaatacaaagttaccaaaaaaaccccacttacttagaatgagaaaagtcacacagatcactagagccttggacattcaggcctcttccgtctgagttccttaggcatcgtaccagaaattcttcgagttgctgcctgactgcaacctggctccctctccccacccacaagtgccagcaactcccagcaccagcaggggccatttaagcaagccccctggaagctttcagcaaacctctctctttccctcagcctttgctctgcctgcttcctgggcttggggccgcagaggccagcgaggctcccttcattccctccaccaaagtgaggtcttccctgcccccacagagcaaactgatccccaaggccaaggccttggtgacaatgggactgtgagtcacaaaacaaacatagccagctgtcccgaatggatttttaatttctactgcaagacctgtttcagccccactggctgcttaaagccacccccactccctgctccttccttagtcctggctggagccccattcaatcagtcaacgattcacgaattattttgacatatattaagcaatgacttctccaggcctcatactggggataaaagtatcaata

SEQ ID NO: 445925 - DNA, 878 bp, Homo sapiens
ggggccagtcttgaccaacacatttcctgcctttcctctctcctctttgtccctgggggctgtttccaaatcattctggtcttttcccctgactcagtcccagtgaaatgtctcagcccagccctgacctgcactgtctcctttgggtgtctgaccaaggccccgagagagagtagggcagaaagtgtcttctgacaggggtgcttcagaactggtatgaccttcacagattattctagagcaactctcttttgttcaggtgaggaattagagaccagagaagtttagggacttggttgagctcacactgcaaaggtcactgggagagctgggacttgaattttaggtccctgactcctaggagaggacacagagccaacttgggaagcaaagaagcagagagggaaaatggtcattgtgagccatgcgagggccgcagaggctgagggtgggtctggtcatggcaggagccagaaggaggctcaggaaggctgggactggggcttttgaggacaggtctttttgcactcttttctcattgaatagaaacaaaagcctgaagctcaggctgggccccaccctggcacacctgaggggcactggggcagtgagtgagttctgtcccctgcctgtggctgtgtgactaagcaggagtcacacattggctctagactggaggagagcaaacaaggtctctgtggagtgcccccccccaacactcccacttccctagggcaaaagtcaacaggattagtcccatagcaggtggaaccagacaggtgcagagtagggaaggtgtggggccatcattcagcccctgttgtcaggactaacgtgtgtgcatgcgtgtgtgcatacctggtgcccacccccatact

SEQ ID NO: 445926 - DNA, 626 bp, Homo sapiens
gcgacacagtgtcactctgtcacaaacaaaaaaaccccacttacttagaatgagaaaagtcacacagatcactagagccttggacattcaggcctcttccgtctgagttccttaggcatcgtaccagaaattcttcgagttgctgcctgactgcaacctggctccctctccccacccacaagtgccagcaactcccagcaccagcaggggccatttaagcaagccccctggaagctttcagcaaacctctctctttccctcagcctttgctctgcctgcttcctgggcttggggccgcagaggccagcgaggctcccttcattccctccaccaaagtgaggtcttccctgcccccacagagcaaactgatccccaaggccaaggccttggtgacaatgggactgtgagtcacaaaacaaacatagccagctgtcccgaatggatttttaatttctactgcaagacctgtttcagccccactggctgcttaaagccacccccactccctgctccttccttagtcctggctggagccccattcaatcagtcaacgattcacgaattattttgacatatattaagcaatgacttctccaggcctcatactggggataaaagtatcaata

SEQ ID NO: 445927 - DNA, 150 bp, Homo sapiens
gcggccgcctactactactactactgctcgaattcaagcttctaacgatgtacggggacatgcctggtcccaagacagtgagacagtctggaaagtgatgtcagaatagcttccaataaagcagcctcattctgaggcctgagtgatcca

SEQ ID NO: 445928 - DNA, 1662 bp, Homo sapiens
  misc_feature (5)..(5): n is a, c, g, or t
aaaantaggctagtacgaggccgggtgttaatcggccgaggagtgcgcgctcctcctcgcccgccgctaggtccatcccggcccagccaccatgtccatccacttcagctccccggtattcacctcgcgctcagccgccttctcgggccgcggcgcccaggtgcgcctgagctccgctcgccccggcggccttggcagcagcagcctctacggcctcggcgcctcgcggccgcgcgtggccgtgcgctctgcctatgggggcccggtgggcgccggcatccgcgaggtcaccattaaccagagcctgctggccccgctgcggctggacgccgacccctccctccagcgggtgcgccaggaggagagcgagcagatcaagaccctcaacaacaagtttgcctccttcatcgacaaggtgcggtttctggagcagcagaacaagctgctggagaccaagtggacgctgctgcaggagcagaagtcggccaagagcagccgcctcccagacatctttgaggcccagattgctggccttcggggtcagcttgaggcactgcaggtggatgggggccgcctggaggcggagctgcggagcatgcaggatgtggtggaggacttcaagaataagtacgaagatgaaattaaccgccgcacagctgctgagaatgagtttgtggtgctgaagaaggatgtggatgctgcctacatgagcaaggtggagctggaggccaaggtggatgccctgaatgatgagatcaacttcctcaggaccctcaatgagacggagttgacagagctgcagtcccagatctccgacacatctgtggtgctgtccatggacaacagtcgctccctggacctggacggcatcatcgctgaggtcaaggcacagtatgaggagatggccaaatgcagccgggctgaggctgaagcctggtaccagaccaagtttgagaccctccaggcccaggctgggaagcatggggacgacctccggaatacccggaatgagatttcagagatgaaccgggccatccagaggctgcaggctgagatcgacaacatcaagaaccagcgtgccaagttggaggccgccattgccgaggctgaggagcgtggggagctggcgctcaaggatgctcgtgccaagcaggaggagctggaagccgccctgcagcgggccaagcaggatatggcacggcagctgcgtgagtaccaggaactcatgagcgtgaagctggccctggacatcgagatcgccacctaccgcaagctgctggagggcgaggagagccggttggctggagatggagtgggagccgtgaatatctctgtgatgaattccactggtggcagtagcagtggcggtggcattgggctgaccctcgggggaaccatgggcagcaatgccctgagcttctccagcagtgcgggtcctgggctcctgaaggcttattccatccggaccgcatccgccagtcgcaggagtgcccgcgactgagccgcctcccaccactccactcctccagccaccacccacaatcacaagaagattcccacccctgcctcccatgcctggtcccaagacagtgagacagtctggaaagtgatgtcagaatagcttccaataaagcagcctcattctgaggcctgagtgatcca

SEQ ID NO: 445929 - DNA, 1972 bp, Homo sapiens
gagtgggaaagacaggctcgaggagggttgtctgaaaacatatgggacaaaggactacaggatcctctcacctgagcagcccatggggacctctggccaaggcctgcctgagctgtccaagtggacgctgctgcaggagcagaagtcggccaagagcagccgcctcccagacatctttgaggcccagattgctggccttcggagtcagcttgaggcactgcaggtggatgggggccgcctggaggcggagctgcggagcatgcaggatgtggtggaggacttcaagaataagtacgaagatgaaattaaccgccgcacagctgctgagaatgagtttgtggtgctgaagagagtgcgcgctcctcctcgcccgccgctaggtccatcccggcccagccaccatgtccatccacttcagctccccggtattcacctcgcgctcagccgccttctcgggccgcggcgcccaggtgcgcctgagctccgctcgccccggcggccttggcagcagcagcctctacggcctcggcgcctcgcggccgcgcgtggccgtgcgctctgcctatgggggcccggtgggcgccggcatccgcgaggtcaccattaaccagagcctgctggccccgctgcggctggacgccgacccctccctccagcgggtgcgccaggaggagagcgagcagatcaagaccctcaacaacaagtttgcctccttcatcgacaaggtgcggtttctggagcagcagaacaagctgctggagaccaagtggacgctgctgcaggagcagaagtcggccaagagcagccgcctcccagacatctttgaggcccagattgctggccttcggggtcagcttgaggcactgcaggtggatgggggccgcctggaggcggagctgcggagcatgcaggatgtggtggaggacttcaagaataagtacgaagatgaaattaaccgccgcacagctgctgagaatgagtttgtggtgctgaagaaggatgtggatgctgcctacatgagcaaggtggagctggaggccaaggtggatgccctgaatgatgagatcaacttcctcaggaccctcaatgagacggagttgacagagctgcagtcccagatctccgacacatctgtggtgctgtccatggacaacagtcgctccctggacctggacggcatcatcgctgaggtcaaggcacagtatgaggagatggccaaatgcagccgggctgaggctgaagcctggtaccagaccaagtttgagaccctccaggcccaggctgggaagcatggggacgacctccggaatacccggaatgagatttcagagatgaaccgggccatccagaggctgcaggctgagatcgacaacatcaagaaccagcgtgccaagttggaggccgccattgccgaggctgaggagcgtggggagctggcgctcaaggatgctcgtgccaagcaggaggagctggaagccgccctgcagcgggccaagcaggatatggcacggcagctgcgtgagtaccaggaactcatgagcgtgaagctggccctggacatcgagatcgccacctaccgcaagctgctggagggcgaggagagccggttggctggagatggagtgggagccgtgaatatctctgtgatgaattccactggtggcagtagcagtggcggtggcattgggctgaccctcgggggaaccatgggcagcaatgccctgagcttctccagcagtgcgggtcctgggctcctgaaggcttattccatccggaccgcatccgccagtcgcaggagtgcccgcgactgagccgcctcccaccactccactcctccagccaccacccacaatcacaagaagattcccacccctgcctcccatgcctggtcccaagacagtgagacagtctggaaagtgatgtcagaatagcttccaataaagcagcctcattctgaggcctgagtgatcca

SEQ ID NO: 445930 - DNA, 2169 bp, Homo sapiens
ccttccctcactgagtccgtttccaatgggctggaactgcggtcccccgctgttctctgcggccgtctagggatggcgctcctgcctactccggaccatccctgcttggactgaaagcctgggcttcggcggggcgggcgggcagagggcggagggcggccccaggaggggcctggcagcagagaaaggtggcccgcggcagccccgcccctacctgtggaagcccagccgcccgctcccgcggataaaaggtgcggagtgtccccgaggtcagcgaggagtgcgcgctcctcctcgcccgccgctaggtccatcccggcccagccaccatgtccatccacttcagctccccggtattcacctcgcgctcagccgccttctcgggccgcggcgcccaggtgcgcctgagctccgctcgccccggcggccttggcagcagcagcctctacggcctcggcgcctcgcggccgcgcgtggccgtgcgctctgcctatgggggcccggtgggcgccggcatccgcgaggtcaccattaaccagagcctgctggccccgctgcggctggacgccgacccctccctccagcgggtgcgccaggaggagagcgagcagatcaagaccctcaacaacaagtttgcctccttcatcgacaaggtgcggtttctggagcagcagaacaagctgctggagaccaagtggacgctgctgcaggagcagaagtcggccaagagcagccgcctcccagacatctttgaggcccagattgctggccttcggggtcagcttgaggcactgcaggtggatgggggccgcctggaggcggagctgcggagcatgcaggatgtggtggaggacttcaagaataagtacgaagatgaaattaaccgccgcacagctgctgagaatgagtttgtggtgctgaagaaggatgtggatgctgcctacatgagcaaggtggagctggaggccaaggtggatgccctgaatgatgagatcaacttcctcaggaccctcaatgagacggagttgacagagctgcagtcccagatctccgacacatctgtggtgctgtccatggacaacagtcgctccctggacctggacggcatcatcgctgaggtcaaggcacagtatgaggagatggccaaatgcagccgggctgaggctgaagcctggtaccagaccaagtttgagaccctccaggcccaggctgggaagcatggggacgacctccggaatacccggaatgagatttcagagatgaaccgggccatccagaggctgcaggctgagatcgacaacatcaagaaccagcgtgccaagttggaggccgccattgccgaggctgaggagcgtggggagctggcgctcaaggatgctcgtgccaagcaggaggagctggaagccgccctgcagcgggccaagcaggatatggcacggcagctgcgtgagtaccaggaactcatgagcgtgaagctggccctggacatcgagatcgccacctaccgcaagctgctggagggcgaggagagccggttggctggagatggagtgggagccgtgaatatctctgtgatgaattccactggtggcagtagcagtggcggtggcattgggctgaccctcgggggaaccatgggcagcaatgccctgagcttctccagcagtgcgggtcctgggctcctgaaggcttattccatccggaccgcatccgccagtcgcaggagtgcccgcgactgagccgcctcccaccactccactcctccagccaccacccacaatcacaagaagattcccacccctgcctcccatgcctggtcccaagacagtgagacagtctggaaagtgatgtcagaatagcttccaataaagcagcctcattctgaggcctgagtgatccagtggaggatgtggtggaggacttcaagaataagtaatgcccctgtgcacatgcgatgacccctgccccgggccaatgtgacctcatgagctgacctgtgcaagtccccctgcttcaggaatcagcatgcagctgctcagtccaataactccctgaggggccagtcttgaccaacacatttcctgcctttcctctctcggggccttggtcagacacccaaaggagacagtgcaggacagggctgggctgagacatttcactgggactgag

SEQ ID NO: 445931 - DNA, 1914 bp, Homo sapiens
ccttccctcactgagtccgtttccaatgggctggaactgcggtcccccgctgttctctgcggccgtctagggatggcgctcctgcctactccggaccatccctgcttggactgaaagcctgggcttcggcggggcgggcgggcagagggcggagggcggccccaggaggggcctggcagcagagaaaggtggcccgcggcagccccgcccctacctgtggaagcccagccgcccgctcccgcggataaaaggtgcggagtgtccccgaggtcagcgaggagtgcgcgctcctcctcgcccgccgctaggtccatcccggcccagccaccatgtccatccacttcagctccccggtattcacctcgcgctcagccgccttctcgggccgcggcgcccaggtgcgcctgagctccgctcgccccggcggccttggcagcagcagcctctacggcctcggcgcctcgcggccgcgcgtggccgtgcgctctgcctatgggggcccggtgggcgccggcatccgcgaggtcaccattaaccagagcctgctggccccgctgcggctggacgccgacccctccctccagcgggtgcgccaggaggagagcgagcagatcaagaccctcaacaacaagtttgcctccttcatcgacaaggtgcggtttctggagcagcagaacaagctgctggagaccaagtggacgctgctgcaggagcagaagtcggccaagagcagccgcctcccagacatctttgaggcccagattgctggccttcggggtcagcttgaggcactgcaggtggatgggggccgcctggaggcggagctgcggagcatgcaggatgtggtggaggacttcaagaataagtacgaagatgaaattaaccgccgcacagctgctgagaatgagtttgtggtgctgaagaaggatgtggatgctgcctacatgagcaaggtggagctggaggccaaggtggatgccctgaatgatgagatcaacttcctcaggaccctcaatgagacggagttgacagagctgcagtcccagatctccgacacatctgtggtgctgtccatggacaacagtcgctccctggacctggacggcatcatcgctgaggtcaaggcacagtatgaggagatggccaaatgcagccgggctgaggctgaagcctggtaccagaccaagtttgagaccctccaggcccaggctgggaagcatggggacgacctccggaatacccggaatgagatttcagagatgaaccgggccatccagaggctgcaggctgagatcgacaacatcaagaaccagcgtgccaagttggaggccgccattgccgaggctgaggagcgtggggagctggcgctcaaggatgctcgtgccaagcaggaggagctggaagccgccctgcagcgggccaagcaggatatggcacggcagctgcgtgagtaccaggaactcatgagcgtgaagctggccctggacatcgagatcgccacctaccgcaagctgctggagggcgaggagagccggttggctggagatggagtgggagccgtgaatatctctgtgatgaattccactggtggcagtagcagtggcggtggcattgggctgaccctcgggggaaccatgggcagcaatgccctgagcttctccagcagtgcgggtcctgggctcctgaaggcttattccatccggaccgcatccgccagtcgcaggagtgcccgcgactgagccgcctcccaccactccactcctccagccaccacccacaatcacaagaagattcccacccctgcctcccatgcctggtcccaagacagtgagacagtctggaaagtgatgtcagaatagaaactcctatctgctgtctatctttccgctgttttttctcgtcgctccctcttga

SEQ ID NO: 445932 - DNA, 1620 bp, Homo sapiens
  misc_feature (5)..(5): n is a, c, g, or t
aaaantaggctagtacgaggccgggtgttaatcggccgagccagccaccatgtccatccacttcagctccccggtattcacctcgcgctcagccgccttctcgggccgcggcgcccaggtgcgcctgagctccgctcgccccggcggccttggcagcagcagcctctacggcctcggcgcctcgcggccgcgcgtggccgtgcgctctgcctatgggggcccggtgggcgccggcatccgcgaggtcaccattaaccagagcctgctggccccgctgcggctggacgccgacccctccctccagcgggtgcgccaggaggagagcgagcagatcaagaccctcaacaacaagtttgcctccttcatcgacaaggtgcggtttctggagcagcagaacaagctgctggagaccaagtggacgctgctgcaggagcagaagtcggccaagagcagccgcctcccagacatctttgaggcccagattgctggccttcggggtcagcttgaggcactgcaggtggatgggggccgcctggaggcggagctgcggagcatgcaggatgtggtggaggacttcaagaataagtacgaagatgaaattaaccgccgcacagctgctgagaatgagtttgtggtgctgaagaaggatgtggatgctgcctacatgagcaaggtggagctggaggccaaggtggatgccctgaatgatgagatcaacttcctcaggaccctcaatgagacggagttgacagagctgcagtcccagatctccgacacatctgtggtgctgtccatggacaacagtcgctccctggacctggacggcatcatcgctgaggtcaaggcacagtatgaggagatggccaaatgcagccgggctgaggctgaagcctggtaccagaccaagtttgagaccctccaggcccaggctgggaagcatggggacgacctccggaatacccggaatgagatttcagagatgaaccgggccatccagaggctgcaggctgagatcgacaacatcaagaaccagcgtgccaagttggaggccgccattgccgaggctgaggagcgtggggagctggcgctcaaggatgctcgtgccaagcaggaggagctggaagccgccctgcagcgggccaagcaggatatggcacggcagctgcgtgagtaccaggaactcatgagcgtgaagctggccctggacatcgagatcgccacctaccgcaagctgctggagggcgaggagagccggttggctggagatggagtgggagccgtgaatatctctgtgatgaattccactggtggcagtagcagtggcggtggcattgggctgaccctcgggggaaccatgggcagcaatgccctgagcttctccagcagtgcgggtcctgggctcctgaaggcttattccatccggaccgcatccgccagtcgcaggagtgcccgcgactgagccgcctcccaccactccactcctccagccaccacccacaatcacaagaagattcccacccctgcctcccatgcctggtcccaagacagtgagacagtctggaaagtgatgtcagaatagcttccaataaagcagcctcattctgaggcctgagtgatcca

SEQ ID NO: 445933 - DNA, 1472 bp, Homo sapiens
  misc_feature (5)..(5): n is a, c, g, or t
aaaantaggctagtacgaggccgggtgttaatcggccgagcgcgcgtggccgtgcgctctgcctatgggggcccggtgggcgccggcatccgcgaggtcaccattaaccagagcctgctggccccgctgcggctggacgccgacccctccctccagcgggtgcgccaggaggagagcgagcagatcaagaccctcaacaacaagtttgcctccttcatcgacaaggtgcggtttctggagcagcagaacaagctgctggagaccaagtggacgctgctgcaggagcagaagtcggccaagagcagccgcctcccagacatctttgaggcccagattgctggccttcggggtcagcttgaggcactgcaggtggatgggggccgcctggaggcggagctgcggagcatgcaggatgtggtggaggacttcaagaataagtacgaagatgaaattaaccgccgcacagctgctgagaatgagtttgtggtgctgaagaaggatgtggatgctgcctacatgagcaaggtggagctggaggccaaggtggatgccctgaatgatgagatcaacttcctcaggaccctcaatgagacggagttgacagagctgcagtcccagatctccgacacatctgtggtgctgtccatggacaacagtcgctccctggacctggacggcatcatcgctgaggtcaaggcacagtatgaggagatggccaaatgcagccgggctgaggctgaagcctggtaccagaccaagtttgagaccctccaggcccaggctgggaagcatggggacgacctccggaatacccggaatgagatttcagagatgaaccgggccatccagaggctgcaggctgagatcgacaacatcaagaaccagcgtgccaagttggaggccgccattgccgaggctgaggagcgtggggagctggcgctcaaggatgctcgtgccaagcaggaggagctggaagccgccctgcagcgggccaagcaggatatggcacggcagctgcgtgagtaccaggaactcatgagcgtgaagctggccctggacatcgagatcgccacctaccgcaagctgctggagggcgaggagagccggttggctggagatggagtgggagccgtgaatatctctgtgatgaattccactggtggcagtagcagtggcggtggcattgggctgaccctcgggggaaccatgggcagcaatgccctgagcttctccagcagtgcgggtcctgggctcctgaaggcttattccatccggaccgcatccgccagtcgcaggagtgcccgcgactgagccgcctcccaccactccactcctccagccaccacccacaatcacaagaagattcccacccctgcctcccatgcctggtcccaagacagtgagacagtctggaaagtgatgtcagaatagcttccaataaagcagcctcattctgaggcctgagtgatcca

SEQ ID NO: 445934 - DNA, 2970 bp, Homo sapiens
  misc_feature (5)..(5): n is a, c, g, or t
aaaantaggctagtacgaggccgggtgttaatcggccgaggagtgcgcgctcctcctcgcccgccgctaggtccatcccggcccagccaccatgtccatccacttcagctccccggtattcacctcgcgctcagccgccttctcgggccgcggcgcccaggtgcgcctgagctccgctcgccccggcggccttggcagcagcagcctctacggcctcggcgcctcgcggccgcgcgtggccgtgcgctctgcctatgggggcccggtgggcgccggcatccgcgaggtcaccattaaccagagcctgctggccccgctgcggctggacgccgacccctccctccagcgggtgcgccaggaggagagcgagcagatcaagaccctcaacaacaagtttgcctccttcatcgacaaggtgcggtttctggagcagcagaacaagctgctggagaccaagtggacgctgctgcaggagcagaagtcggccaagagcagccgcctcccagacatctttgaggcccagattgctggccttcggggtcagcttgaggcactgcaggtggatgggggccgcctggaggcggagctgcggagcatgcaggatgtggtggaggacttcaagaataagtacgaagatgaaattaaccgccgcacagctgctgagaatgagtttgtggtgctgaagaaggatgtggatgctgcctacatgagcaaggtggagctggaggccaaggtggatgccctgaatgatgagatcaacttcctcaggaccctcaatgagacggagttgacagagctgcagtcccagatctccgacacatctgtggtgctgtccatggacaacagtcgctccctggacctggacggcatcatcgctgaggtcaaggcacagtatgaggagatggccaaatgcagccgggctgaggctgaagcctggtaccagaccaagtttgagaccctccaggcccaggctgggaagcatggggacgacctccggaatacccggaatgagatttcagagatgaaccgggccatccagaggctgcaggctgagatcgacaacatcaagaaccaggtcctggcatgggctgatgggagaaaggtcctggatgtgcacagagcctgtggagggagactcaggctggctggccagaagaaagccaccactggttccacattgatactgagcactctgcttgcacctggttctggctgcagggcgctgtccctgggagctcatcattcattgcagggacagaggacagcagaagaccttataatgactcacatggccctttcccacccactccaacctcactttccacgattcccctcactctgctctggccatgctaacctgcttcctgcatcttgcatttgccaagaatggtcatgcttcagggcctttgcacttggcgttgcctccccctggaatgtggttctcccagctctgtccatggttgttgttttctcctccctggggtttaggaaaagaccccttctcagagacggcactctcaaacaccagcccctctatcggcagcctgtctgaagttctttgaagcccctgtcactctctgaaatgttctgtcttattcattaagtgattgatggtccctacctccactggaatataacagatgcctggagagcagggaccctgtctgtctggttcactgctcctctcttccagcacctggcacatggcaggggcacgggtctcagatgagagactgcctgggaggatgagctttgctggaagctggggttggaggtgttgatgggggaagggcccccagccctggctgagtagtgtgtggccagggcagctcagcctgtgcaggtgtctgcagtggagagagggggagggcacacatgtggaagcttcggaaagctgatttccagatgagctgtgggtggtggggggatgtgagggtgatttacccacaaatgtcctccccttggagccctgtgggcctgtttacaggagggcggaggctgccttggggcacagaggcagggccgtgagtcaccccatgaagtgggccagcttccaggccaggaggggaagcacagaataacaaatggtggtttcccaaaccctgcagcctctactacatccggttctcctctcacacaacagggcggatccaggcctatagccaggtgtctaccaccactgaggggcgtcatggggagctacaaggggtctccagaggcagcggggatggcgttggctctgggggcaccagtgtgacagggcagggcaccgagctgtggccgaggggcagagtgtcagagggcctcctggggaatgctgtctctggcagagaggcagactgcctccactgagggaagaggatctgaggatagagaatggccgcgtgccaagttggaggccgccattgccgaggctgaggagcgtggggagctggcgctcaaggatgctcgtgccaagcaggaggagctggaagccgccctgcagcgggccaagcaggatatggcacggcagctgcgtgagtaccaggaactcatgagcgtgaagctggccctggacatcgagatcgccacctaccgcaagctgctggagggcgaggagagccggttggctggagatggagtgggagccgtgaatatctctgtgatgaattccactggtggcagtagcagtggcggtggcattgggctgaccctcgggggaaccatgggcagcaatgccctgagcttctccagcagtgcgggtcctgggctcctgaaggcttattccatccggaccgcatccgccagtcgcaggagtgcccgcgactgagccgcctcccaccactccactcctccagccaccacccacaatcacaagaagattcccacccctgcctcccatgcctggtcccaagacagtgagacagtctggaaagtgatgtcagaatagcttccaataaagcagcctcattctgaggcctgagtgatcca

SEQ ID NO: 445935 - DNA, 1699 bp, Homo sapiens
  misc_feature (5)..(5): n is a, c, g, or t
aaaantaggctagtacgaggccgggtgttaatcggccgaggagtgcgcgctcctcctcgcccgccgctaggtccatcccggcccagccaccatgtccatccacttcagctccccggtattcacctcgcgctcagccgccttctcgggccgcggcgcccaggtgcgcctgagctccgctcgccccggcggccttggcagcagcagcctctacggcctcggcgcctcgcggccgcgcgtggccgtgcgctctgcctatgggggcccggtgggcgccggcatccgcgaggtcaccattaaccagagcctgctggccccgctgcggctggacgccgacccctccctccagcgggtgcgccaggaggagagcgagcagatcaagaccctcaacaacaagtttgcctccttcatcgacaaggtgcggtttctggagcagcagaacaagctgctggagaccaagtggacgctgctgcaggagcagaagtcggccaagagcagccgcctcccagacatctttgaggcccagattgctggccttcggggtcagcttgaggcactgcaggtggatgggggccgcctggaggcggagctgcggagcatgcaggatgtggtggaggacttcaagaataagtacgaagatgaaattaaccgccgcacagctgctgagaatgagtttgtggtgctgaagaaggatgtggatgctgcctacatgagcaaggtggagctggaggccaaggtggatgccctgaatgatgagatcaacttcctcaggaccctcaatgagacggagttgacagagctgcagtcccagatctccgacacatctgtggtgctgtccatggacaacagtcgctccctggacctggacggcatcatcgctgaggtcaaggcacagtatgaggagatggccaaatgcagccgggctgaggctgaagcctggtaccagaccaagtttgagaccctccaggcccaggctgggaagcatggggacgacctccggaatacccggaatgagatttcagagatgaaccgggccatccagaggctgcaggctgagatcgacaacatcaagaaccagcgtgccaagttggaggccgccattgccgaggctgaggagcgtggggagctggcgctcaaggatgctcgtgccaagcaggaggagctggaagccgccctgcagcgggccaagcaggatatggcacggcagctgcgtgagtaccaggaactcatgagcgtgaagctggccctggacatcgagatcgccacctaccgcaagctgctggagggcgaggagagccggaaagagccgtcctcactgtctgtcctctgcccccaggttggctggagatggagtgggagccgtgaatatctctgtgatgaattccactggtggcagtagcagtggcggtggcattgggctgaccctcgggggaaccatgggcagcaatgccctgagcttctccagcagtgcgggtcctgggctcctgaaggcttattccatccggaccgcatccgccagtcgcaggagtgcccgcgactgagccgcctcccaccactccactcctccagccaccacccacaatcacaagaagattcccacccctgcctcccatgcctggtcccaagacagtgagacagtctggaaagtgatgtcagaatagcttccaataaagcagcctcattctgaggcctgagtgatcca

SEQ ID NO: 445936 - DNA, 1766 bp, Homo sapiens
ccttccctcactgagtccgtttccaatgggctggaactgcggtcccccgctgttctctgcggccgtctagggatggcgctcctgcctactccggaccatccctgcttggactgaaagcctgggcttcggcggggcgggcgggcagagggcggagggcggccccaggaggggcctggcagcagagaaaggtggcccgcggcagccccgcccctacctgtggaagcccagccgcccgctcccgcggataaaaggtgcggagtgtccccgaggtcagcgaggagtgcgcgctcctcctcgcccgccgctaggtccatcccggcccagccaccatgtccatccacttcagctccccggtattcacctcgcgctcagccgccttctcgggccgcggcgcccaggtgcgcctgagctccgctcgccccggcggccttggcagcagcagcctctacggcctcggcgcctcgcggccgcgcgtggccgtgcgctctgcctatgggggcccggtgggcgccggcatccgcgaggtcaccattaaccagagcctgctggccccgctgcggctggacgccgacccctccctccagcgggtgcgccaggaggagagcgagcagatcaagaccctcaacaacaagtttgcctccttcatcgacaaggtgcggtttctggagcagcagaacaagctgctggagaccaagtggacgctgctgcaggagcagaagtcggccaagagcagccgcctcccagacatctttgaggcccagattgctggccttcggggtcagcttgaggcactgcaggtggatgggggccgcctggaggcggagctgcggagcatgcaggatgtggtggaggacttcaagaataagtacgaagatgaaattaaccgccgcacagctgctgagaatgagtttgtggtgctgaagaaggatgtggatgctgcctacatgagcaaggtggagctggaggccaaggtggatgccctgaatgatgagatcaacttcctcaggaccctcaatgagacggagttgacagagctgcagtcccagatctccgacacatctgtggtgctgtccatggacaacagtcgctccctggacctggacggcatcatcgctgaggtcatgagcgtgaagctggccctggacatcgagatcgctgagatcgacaacatcaagaacccgtgccaagttggaggccgccattgccgaggctgaggagcgtggggagctggcgctcaaggatgctcgtgccaagcaggaggagctggaagccgccctgcagcgggccaagcaggatatggcacggcagctgcgtgagtaccaggaactcatgagcgtgaagctggccctggacatcgagatcgccacctaccgcaagctgctggagggcgaggagagccggttggctggagatggagtgggagccgtgaatatctctgtgatgaattccactggtggcagtagcagtggcggtggcattgggctgaccctcgggggaaccatgggcagcaatgccctgagcttctccagcagtgcgggtcctgggctcctgaaggcttattccatccggaccgcatccgccagtcgcaggagtgcccgcgactgagccgcctcccaccactccactcctccagccaccacccacaatcacaagaagattcccacccctgcctcccatgcctggtcccaagacagtgagacagtctggaaagtgatgtcagaatagcttccaataaagcagcctcattctgaggcctgagtgatcca

SEQ ID NO: 445937 - DNA, 1307 bp, Homo sapiens
ttaggccggataatccatttaaccttgagggtggaaattgccctgggcaacaaggcaaccctccgttttcaaaaaaaaaaaaaaaaaaaaagggagtttcaccacattgcccaggctggtctcaagcaatctgcccgcctccgcctcccagacatctttgaggcccagattgctggccttcggggtcagcttgaggcactgcaggtggatgggggccgcctggaggcggagctgcggagcatgcaggatgtggtggaggacttcaagaataagtacgaagatgaaattaaccgccgcacagctgctgagaatgagtttgtggtgctgaagaaggatgtggatgctgcctacatgagcaaggtggagctggaggccaaggtggatgccctgaatgatgagatcaacttcctcaggaccctcaatgagacggagttgacagagctgcagtcccagatctccgacacatctgtggtgctgtccatggacaacagtcgctccctggacctggacggcatcatcgctgaggtcaaggcacagtatgaggagatggccaaatgcagccgggctgaggctgaagcctggtaccagaccaagtttgagaccctccaggcccaggctgggaagcatggggacgacctccggaatacccggaatgagatttcagagatgaaccgggccatccagaggctgcaggctgagatcgacaacatcaagaaccagcgtgccaagttggaggccgccattgccgaggctgaggagcgtggggagctggcgctcaaggatgctcgtgccaagcaggaggagctggaagccgccctgcagcgggccaagcaggatatggcacggcagctgcgtgagtaccaggaactcatgagcgtgaagctggccctggacatcgagatcgccacctaccgcaagctgctggagggcgaggagagccggttggctggagatggagtgggagccgtgaatatctctgtgatgaattccactggtggcagtagcagtggcggtggcattgggctgaccctcgggggaaccatgggcagcaatgccctgagcttctccagcagtgcgggtcctgggctcctgaaggcttattccatccggaccgcatccgccagtcgcaggagtgcccgcgactgagccgcctcccaccactccactcctccagccaccacccacaatcacaagaagattcccacccctgcctcccatgcctggtcccaagacagtgagacagtctggaaagtgatgtcagaatagcttccaataaagcagcctcattctgaggcctgagtgatcca

SEQ ID NO: 445938 - DNA, 1052 bp, Homo sapiens
gccctcctctactgtaggtacgaagatgaaattaaccgccgcacagctgctgagaatgagtttgtggtgctgaagaaggatgtggatgctgcctacatgagcaaggtggagctggaggccaaggtggatgccctgaatgatgagatcaacttcctcaggaccctcaatgagacggagttgacagagctgcagtcccagatctccgacacatctgtggtgctgtccatggacaacagtcgctccctggacctggacggcatcatcgctgaggtcaaggcacagtatgaggagatggccaaatgcagccgggctgaggctgaagcctggtaccagaccaagtttgagaccctccaggcccaggctgggaagcatggggacgacctccggaatacccggaatgagatttcagagatgaaccgggccatccagaggctgcaggctgagatcgacaacatcaagaaccagcgtgccaagttggaggccgccattgccgaggctgaggagcgtggggagctggcgctcaaggatgctcgtgccaagcaggaggagctggaagccgccctgcagcgggccaagcaggatatggcacggcagctgcgtgagtaccaggaactcatgagcgtgaagctggccctggacatcgagatcgccacctaccgcaagctgctggagggcgaggagagccggttggctggagatggagtgggagccgtgaatatctctgtgatgaattccactggtggcagtagcagtggcggtggcattgggctgaccctcgggggaaccatgggcagcaatgccctgagcttctccagcagtgcgggtcctgggctcctgaaggcttattccatccggaccgcatccgccagtcgcaggagtgcccgcgactgagccgcctcccaccactccactcctccagccaccacccacaatcacaagaagattcccacccctgcctcccatgcctggtcccaagacagtgagacagtctggaaagtgatgtcagaatagcttccaataaagcagcctcattctgaggcctgagtgatcca

SEQ ID NO: 445939 - DNA, 1389 bp, Homo sapiens
  misc_feature (5)..(5): n is a, c, g, or t
aaaantaggctagtacgaggccgggtgttaatcggccgaggagtgcgcgctcctcctcgcccgccgctaggtccatcccggcccagccaccatgtccatccacttcagctccccggtattcacctcgcgctcagccgccttctcgggccgcggcgcccaggtgcgcctgagctccgctcgccccggcggccttggcagcagcagcctctacggcctcggcgcctcgcggccgcgcgtggccgtgcgctctgcctatgggggcccggtgggcgccggcatccgcgaggtcaccattaaccagagcctgctggccccgctgcggctggacgccgacccctccctccagcgggtgcgccaggaggagagcgagcagatcaagaccctcaacaacaagtttgcctccttcatcgacaaggtgcggtttctggagcagcagaacaagctgctggagaccaagtggacgctgctgcaggagcagaagtcggccaagagcagccgcctcccagacatctttgaggcccagattgctggccttcggggtcagcttgaggcactgcaggtggatgggggccgcctggaggcggagctgcggagcatgcaggatgtggtggaggacttcaagaataagtacgaagatgaaattaaccgccgcacagctgctgagaatgagtttgtggtgctgaagaaggatgtggatgctgcctacatgagcaaggtggagctggaggccaaggtggatgccctgaatgatgagatcaacttcctcaggaccctcaatgagacggagttgacagagctgcagtcccagatctccgacacatctgtggtgctgtccatggacaacagtcgctccctggacctggacggcatcatcgctgaggtcaaggcacagtatgaggagatggccaaatgcagccgggctgaggctgaagcctggtaccagaccaagtttgagaccctccaggcccaggctgggaagcatggggacgacctccggaatacccggaatgagatttcagagatgaaccgggccatccagaggctgcaggctgagatcgacaacatcaagaaccaggccattgccgaggctgaggagtgtggggagctggcgctcaaggatgctcgtgccaagcaggaggagctggaagccgccctgcagcgggccaagcaggatatggcacggcagctgcgtgagtaccaggaactcatgagcgtgaagctggccctggacatcgagatcgccacctaccgcaagctgctggagggcgaggagagccggttggctggagatggagtgggagccgtgaatatctctgtgatgaattccactggtggcagtagcagtggcggtggcattgggctagccctcgggggaaccatgggcagcaa

SEQ ID NO: 445940 - DNA, 1388 bp, Homo sapiens
gagtgggaaagacaggctcgaggagggttgtctgaaaacatatgggacaaaggactacaggatcctctcacctgagcagcccatggggacctctggccaaggcctgcctgagctgtccaagtggacgctgctgcaggagcagaagtcggccaagagcagccgcctcccagacatctttgaggcccagattgctggccttcggagtcagcttgaggcactgcaggtggatgggggccgcctggaggcggagctgcggagcatgcaggatgtggtggaggacttcaagaataagtacgaagatgaaattaaccgccgcacagctgctgagaatgagtttgtggtgctgaagagagtgcgcgctcctcctcgcccgccgctaggtccatcccggcccagccaccatgtccatccacttcagctccccggtattcacctcgcgctcagccgccttctcgggccgcggcgcccaggtgcgcctgaatcaacttcctcaggaccctcaatgagacggagttgacagagctgcagtcccagatctccgacacatctgtggtgctgtccatggacaacagtcgctccctggacctggacggcatcatcgctgaggtcaaggcacagtatgaggagatggccaaatgcagccgggctgaggctgaagcctggtaccagaccaagtttgagaccctccaggcccaggctgggaagcatggggacgacctccggaatacccggaatgagatttcagagatgaaccgggccatccagaggctgcaggctgagatcgacaacatcaagaaccagcgtgccaagttggaggccgccattgccgaggctgaggagcgtggggagctggcgctcaaggatgctcgtgccaagcaggaggagctggaagccgccctgcagcgggccaagcaggatatggcacggcagctgcgtgagtaccaggaactcatgagcgtgaagctggccctggacatcgagatcgccacctaccgcaagctgctggagggcgaggagagccggttggctggagatggagtgggagccgtgaatatctctgtgatgaattccactggtggcagtagcagtggcggtggcattgggctgaccctcgggggaaccatgggcagcaatgccctgagcttctccagcagtgcgggtcctgggctcctgaaggcttattccatccggaccgcatccgccagtcgcaggagtgcccgcgactgagccgcctcccaccactccactcctccagccaccacccacaatcacaagaagattcccacccctgcctcccatgcctggtcccaagacagtgagacagtctggaaagtgatgtcagaatagcttccaataaagcagcctcattctgaggcctgagtgatcca

SEQ ID NO: 445941 - DNA, 951 bp, Homo sapiens
catcattggcgcgtaacagacagctataccacttagggagcgataacataacagcaatacaatgaaaggaggtcacttgaactgcagcacgcataattaccagtacacatctgtggtgctgtccatggacaacagtcgctccctggacctggacggcatcatcgctgaggtcaaggcacagtatgaggagatggccaaatgcagccgggctgaggctgaagcctggtaccagaccaagtttgagaccctccaggcccaggctgggaagcatggggacgacctccggaatacccggaatgagatttcagagatgaaccgggccatccagaggctgcaggctgagatcgacaacatcaagaaccagcgtgccaagttggaggccgccattgccgaggctgaggagcgtggggagctggcgctcaaggatgctcgtgccaagcaggaggagctggaagccgccctgcagcgggccaagcaggatatggcacggcagctgcgtgagtaccaggaactcatgagcgtgaagctggccctggacatcgagatcgccacctaccgcaagctgctggagggcgaggagagccggttggctggagatggagtgggagccgtgaatatctctgtgatgaattccactggtggcagtagcagtggcggtggcattgggctgaccctcgggggaaccatgggcagcaatgccctgagcttctccagcagtgcgggtcctgggctcctgaaggcttattccatccggaccgcatccgccagtcgcaggagtgcccgcgactgagccgcctcccaccactccactcctccagccaccacccacaatcacaagaagattcccacccctgcctcccatgcctggtcccaagacagtgagacagtctggaaagtgatgtcagaatagcttccaataaagcagcctcattctgaggcctgagtgatcca

SEQ ID NO: 445942 - DNA, 1746 bp, Homo sapiens
gtgatctagaggatcccgacgggttcaacggaactttccacgattcccctcactctgctctggccatgctaacctgcttcctgcatcttgcatttgccaagaatggtcatgcttcagggcctttgcacttggcgttgcctccccctggaatgtggttctcccagctctgtccatggttgttgttttctcctccctggggtttaggaaaagaccccttctcagagacggcactctcaaacaccagcccctctatcggcagcctgtctgaagttctttgaagcccctgtcactctctgaaatgttctgtcttattcattaagtgattgatggtccctacctccactggaatataacagatgcctggagagcagggaccctgtctgtctggttcactgctcctctcttccagcacctggcacatggcaggggcacgggtctcagatgagagactgcctgggaggatgagctttgctggaagctggggttggaggtgttgatgggggaagggcccccagccctggctgagtagtgtgtggccagggcagctcagcctgtgcaggtgtctgcagtggagagagggggagggcacacatgtggaagcttcggaaagctgatttccagatgagctgtgggtggtggggggatgtgagggtgatttacccacaaatgtcctccccttggagccctgtgggcctgtttacaggagggcggaggctgccttggggcacagaggcagggccgtgagtcaccccatgaagtgggccagcttccaggccaggaggggaagcacagaataacaaatggtggtttcccaaaccctgcagcctctactacatccggttctcctctcacacaacagggcggatccaggcctatagccaggtgtctaccaccactgaggggcgtcatggggagctacaaggggtctccagaggcagcggggatggcgttggctctgggggcaccagtgtgacagggcagggcaccgagctgtggccgaggggcagagtgtcagagggcctcctggggaatgctgtctctggcagagaggcagactgcctccactgagggaagaggatctgaggatagagaatggccggatgggcaggcaggaaggcagactggtgagccccagcttacagctgcactgctgcccacacgtgccaagttggaggccgccattgccgaggctgaggagcgtggggagctggcgctcaaggatgctcgtgccaagcaggaggagctggaagccgccctgcagcgggccaagcaggatatggcacggcagctgcgtgagtaccaggaactcatgagcgtgaagctggccctggacatcgagatcgccacctaccgcaagctgctggagggcgaggagagccggttggctggagatggagtgggagccgtgaatatctctgtgatgaattccactggtggcagtagcagtggcggtggcattgggctgaccctcgggggaaccatgggcagcaatgccctgagcttctccagcagtgcgggtcctgggctcctgaaggcttattccatccggaccgcatccgccagtcgcaggagtgcccgcgactgagccgcctcccaccactccactcctccagccaccacccacaatcacaagaagattcccacccctgcctcccatgcctggtcccaagacagtgagacagtctggaaagtgatgtcagaatagcttccaataaagcagcctcattctgaggcctgagtgatcca

SEQ ID NO: 445943 - DNA, 625 bp, Homo sapiens
gggcccaaggcataggtgggaaatggaggccctgagacattgcctggggtcaggtggccagtggatagaagggccaaggtgaacactcccttcctgcatgcctcctcgctccttttacaaggctgaaggcaggctggaagtgtggggcaagaaggaaaaatcaatgatcctgcttggggcctggaaggagagagggctgagagcgcttccctcccacgctaggaaagagccgtcctcactgtctgtcctctgcccccaggttggctggagatggagtgggagccgtgaatatctctgtgatgaattccactggtggcagtagcagtggcggtggcattgggctgaccctcgggggaaccatgggcagcaatgccctgagcttctccagcagtgcgggtcctgggctcctgaaggcttattccatccggaccgcatccgccagtcgcaggagtgcccgcgactgagccgcctcccaccactccactcctccagccaccacccacaatcacaagaagattcccacccctgcctcccatgcctggtcccaagacagtgagacagtctggaaagtgatgtcagaatagcttccaataaagcagcctcattctgaggcctgagtgatcca

SEQ ID NO: 445944 - DNA, 378 bp, Homo sapiens
ctatgaggcactgggaccaggcatgggagtcagggctgggaatatttctgtgatgaattccactggtggcagtagcagtggcggtggcattgggctgaccctcgggggaaccatgggcagcaatgccctgagcttctccagcagtgcgggtcctgggctcctgaaggcttattccatccggaccgcatccgccagtcgcaggagtgcccgcgactgagccgcctcccaccactccactcctccagccaccacccacaatcacaagaagattcccacccctgcctcccatgcctggtcccaagacagtgagacagtctggaaagtgatgtcagaatagcttccaataaagcagcctcattctgaggcctgagtgatcca

SEQ ID NO: 445945 - DNA, 445 bp, Homo sapiens
gtgaggaccatggagctgggtgacatgtcttatcctacccattctaaccagggagccatctggtccagccccccgcctctgtgtcagtccagatatgtgtcagtgtgagaaacaaactcatccgtccaaacccaaagaatggactcagagacctggagaacagcgaaagtgagattttaatgacagtcttgcaagatgggtgtctgatgggcaggcatgcccagcacagccacaacaagcaatttatcctctagtgcacaggtccctccctccgttcctcacaggctgagtactatggggtcacgatcttcctggacgttgtctattggttgttgggttggggctttaggtgtttttttttaggttgtcttgctgcattttattgcagcctacaatgcattgcaatcctagtcagctcaagggctctttaagtatttgacttatg

SEQ ID NO: 445946 - DNA, 234 bp, Homo sapiens
caggagggtggggtgcagtgaagggatggggtccctggtagggagcctcacgctgaagagagccctcctcttttctctcccagctgtgatgaattccactggtggcagtagcagtggcggtggcattgggctgaccctcgggggaaccatgggcagcaatgccctgagcttctccagcagtgcgggtcctgggctcctgaaggcttattccatccggaccgcatccgccagtcg

SEQ ID NO: 445947 - DNA, 581 bp, Homo sapiens
ttaaaaatgatcacaatagcatttattaagcacttgctgtgtgctagacattgtgccacggacatcttgtatattatctcatttcatcctcaaaatctcctgatgttctcttagaaaagaggggactttggcttagcagggttgattcatccatggtcacacagctagtaagtggcagagccagaactggaacataggcgttggatatccaaacctatgtgtttaacccttaggattctctggtacttgggggagtaggtggtgccaatgaagccaccttaagcaagttgcccgggtgctcactgcaggatgggcaggcaggaaggcagactggtgagccccagcttacagctgcactgctgcccacacgtgccaagttggaggccgccattgccgaggctgaggagcgtggggagctggcgctcaaggatgctcgtgccaagcaggaggagctggaagccgccctgcagcgggccaagcaggatatggcacggcagctgcgtgagtaccaggaactcatgagcgtgaagctggccctggacatcgagatcgccacctaccgcaagctgctggagggcgag

SEQ ID NO: 445948 - DNA, 1900 bp, Homo sapiens
ccttccctcactgagtccgtttccaatgggctggaactgcggtcccccgctgttctctgcggccgtctagggatggcgctcctgcctactccggaccatccctgcttggactgaaagcctgggcttcggcggggcgggcgggcagagggcggagggcggccccaggaggggcctggcagcagagaaaggtggcccgcggcagccccgcccctacctgtggaagcccagccgcccgctcccgcggataaaaggtgcggagtgtccccgaggtcagcgaggagtgcgcgctcctcctcgcccgccgctaggtccatcccggcccagccaccatgtccatccacttcagctccccggtattcacctcgcgctcagccgccttctcgggccgcggcgcccaggtgcgcctgagctccgctcgccccggcggccttggcagcagcagcctctacggcctcggcgcctcgcggccgcgcgtggccgtgcgctctgcctatgggggcccggtgggcgccggcatccgcgaggtcaccattaaccagagcctgctggccccgctgcggctggacgccgacccctccctccagcgggtgcgccaggaggagagcgagcagatcaagaccctcaacaacaagtttgcctccttcatcgacaaggtgcggtttctggagcagcagaacaagctgctggagaccaagtggacgctgctgcaggagcagaagtcggccaagagcagccgcctcccagacatctttgaggcccagattgctggccttcggggtcagcttgaggcactgcaggtggatgggggccgcctggaggcggagctgcggagcatgcaggatgtggtggaggacttcaagaataagtacgaagatgaaattaaccgccgcacagctgctgagaatgagtttgtggtgctgaagaaggatgtggatgctgcctacatgagcaaggtggagctggaggccaaggtggatgccctgaatgatgagatcaacttcctcaggaccctcaatgagacggagttgacagagctgcagtcccagatctccgacacatctgtggtgctgtccatggacaacagtcgctccctggacctggacggcatcatcgctgaggtcaaggcacagtatgaggagatggccaaatgcagccgggctgaggctgaagcctggtaccagaccaagtttgagaccctccaggcccaggctgggaagcatggggacgacctccggaatacccggaatgagatttcagagatgaaccgggccatccagaggctgcaggctgagatcgacaacatcaagaaccagcgtgccaagttggaggccgccattgccgaggctgaggagcgtggggagctggcgctcaaggatgctcgtgccaagcaggaggagctggaagccgccctgcagcgggccaagcaggatatggcacggcagctgcgtgagtaccaggaactcatgagcgtgaagctggccctggacatcgagatcgccacctaccgcaagctgctggagggcgaggagagccggttggctggagatggagtgggagccgtgaatatctctgtgatgaattccactggtggcagtagcagtggcggtggcattgggctgaccctcgggggaaccatgggcagcaatgccctgagcttctccagcagtgcgggtcctgggctcctgaaggcttattccatccggaccgcatccgccagtcgcaggagtgcccgcgactgagccgcctcccaccactccactcctccagccaccacccacaatcacaagaagattcccacccctgcctcccatgcctggtcccaagacagtgagacagtctggaaagtgatgtcagaatagcttccaataaagcagcctcattctgaggcctgagtgatcca

SEQ ID NO: 445949 - DNA, 2149 bp, Homo sapiens
ccttccctcactgagtccgtttccaatgggctggaactgcggtcccccgctgttctctgcggccgtctagggatggcgctcctgcctactccggaccatccctgcttggactgaaagcctgggcttcggcggggcgggcgggcagagggcggagggcggccccaggaggggcctggcagcagagaaaggtggcccgcggcagccccgcccctacctgtggaagcccagccgcccgctcccgcggataaaaggtgcggagtgtccccgaggtcagcgaggagtgcgcgctcctcctcgcccgccgctaggtccatcccggcccagccaccatgtccatccacttcagctccccggtattcacctcgcgctcagccgccttctcgggccgcggcgcccaggtgcgcctgagctccgctcgccccggcggccttggcagcagcagcctctacggcctcggcgcctcgcggccgcgcgtggccgtgcgctctgcctatgggggcccggtgggcgccggcatccgcgaggtcaccattaaccagagcctgctggccccgctgcggctggacgccgacccctccctccagcgggtgcgccaggaggagagcgagcagatcaagaccctcaacaacaagtttgcctccttcatcgacaaggtgcggtttctggagcagcagaacaagctgctggagaccaagtggacgctgctgcaggagcagaagtcggccaagagcagccgcctcccagacatctttgaggcccagattgctggccttcggggtcagcttgaggcactgcaggtggatgggggccgcctggaggcggagctgcggagcatgcaggatgtggtggaggacttcaagaataagtacgaagatgaaattaaccgccgcacagctgctgagaatgagtttgtggtgctgaagaaggatgtggatgctgcctacatgagcaaggtggagctggaggccaaggtggatgccctgaatgatgagatcaacttcctcaggaccctcaatgagacggagttgacagagctgcagtcccagatctccgacacatctgtggtgctgtccatggacaacagtcgctccctggacctggacggcatcatcgctgaggtcaaggcacagtatgaggagatggccaaatgcagccgggctgaggctgaagcctggtaccagaccaagtttgagaccctccaggcccaggctgggaagcatggggacgacctccggaatacccggaatgagatttcagagatgaaccgggccatccagaggctgcaggctgagatcgacaacatcaagaaccagcgtgccaagttggaggccgccattgccgaggctgaggagcgtggggagctggcgctcaaggatgctcgtgccaagcaggaggagctggaagccgccctgcagcgggccaagcaggatatggcacggcagctgcgtgagtaccaggaactcatgagcgtgaagctggccctggacatcgagatcgccacctaccgcaagctgctggagggcgaggagagccggttggctggagatggagtgggagccgtgaatatctctgtgatgaattccactggtggcagtagcagtggcggtggcattgggctgaccctcgggggaaccatgggcagcaatgccctgagcttctccagcagtgcgggtcctgggctcctgaaggcttattccatccggaccgcatccgccagtcgcaggagtgcccgcgactgagccgcctcccaccactccactcctccagccaccacccacaatcacaagaagattcccacccctgcctcccatgcctggtcccaagacagtgagacagtctggaaagtgatgtcagaatagcttccaataaagcagcctcattctgaggcctgagtgatccaaaaaaaaaaaaaaaaacaaaaaaaaaaataaaaaaaaaaaaaaaaaaaaaaaaaaaaaaaaaaaaaaacaaaacaaaaggagagaccaaccaaagaagaaataataccaataaggagaggcggcaacaacgagtagcaggaagacgaacagaggagacaactagtgaagacacacgaggggccaccacaaagagggaggaggacgaagatatcggacctacaaaaagaggggcccgggcataccacagg

SEQ ID NO: 445950 - DNA, 1916 bp, Homo sapiens
  misc_feature (1902)..(1902): n is a, c, g, or t
  misc_feature (1905)..(1905): n is a, c, g, or t
ccttccctcactgagtccgtttccaatgggctggaactgcggtcccccgctgttctctgcggccgtctagggatggcgctcctgcctactccggaccatccctgcttggactgaaagcctgggcttcggcggggcgggcgggcagagggcggagggcggccccaggaggggcctggcagcagagaaaggtggcccgcggcagccccgcccctacctgtggaagcccagccgcccgctcccgcggataaaaggtgcggagtgtccccgaggtcagcgaggagtgcgcgctcctcctcgcccgccgctaggtccatcccggcccagccaccatgtccatccacttcagctccccggtattcacctcgcgctcagccgccttctcgggccgcggcgcccaggtgcgcctgagctccgctcgccccggcggccttggcagcagcagcctctacggcctcggcgcctcgcggccgcgcgtggccgtgcgctctgcctatgggggcccggtgggcgccggcatccgcgaggtcaccattaaccagagcctgctggccccgctgcggctggacgccgacccctccctccagcgggtgcgccaggaggagagcgagcagatcaagaccctcaacaacaagtttgcctccttcatcgacaaggtgcggtttctggagcagcagaacaagctgctggagaccaagtggacgctgctgcaggagcagaagtcggccaagagcagccgcctcccagacatctttgaggcccagattgctggccttcggggtcagcttgaggcactgcaggtggatgggggccgcctggaggcggagctgcggagcatgcaggatgtggtggaggacttcaagaataagtacgaagatgaaattaaccgccgcacagctgctgagaatgagtttgtggtgctgaagaaggatgtggatgctgcctacatgagcaaggtggagctggaggccaaggtggatgccctgaatgatgagatcaacttcctcaggaccctcaatgagacggagttgacagagctgcagtcccagatctccgacacatctgtggtgctgtccatggacaacagtcgctccctggacctggacggcatcatcgctgaggtcaaggcacagtatgaggagatggccaaatgcagccgggctgaggctgaagcctggtaccagaccaagtttgagaccctccaggcccaggctgggaagcatggggacgacctccggaatacccggaatgagatttcagagatgaaccgggccatccagaggctgcaggctgagatcgacaacatcaagaaccagcgtgccaagttggaggccgccattgccgaggctgaggagcgtggggagctggcgctcaaggatgctcgtgccaagcaggaggagctggaagccgccctgcagcgggccaagcaggatatggcacggcagctgcgtgagtaccaggaactcatgagcgtgaagctggccctggacatcgagatcgccacctaccgcaagctgctggagggcgaggagagccggttggctggagatggagtgggagccgtgaatatctctgtgatgaattccactggtggcagtagcagtggcggtggcattgggctgaccctcgggggaaccatgggcagcaatgccctgagcttctccagcagtgcgggtcctgggctcctgaaggcttattccatccggaccgcatccgccagtcgcaggagtgcccgcgactgagccgcctcccaccactccactcctccagccaccacccacaatcacaagaagattcccacccctgcctcccatgcctggtcccaagacagtgagacagtctggaaagtgatgtcagaatactatgagaatattaaaatccgcggagtggagagcaagccttcanttnctaggccctgg

SEQ ID NO: 445951 - DNA, 2095 bp, Homo sapiens
ccttccctcactgagtccgtttccaatgggctggaactgcggtcccccgctgttctctgcggccgtctagggatggcgctcctgcctactccggaccatccctgcttggactgaaagcctgggcttcggcggggcgggcgggcagagggcggagggcggccccaggaggggcctggcagcagagaaaggtggcccgcggcagccccgcccctacctgtggaagcccagccgcccgctcccgcggataaaaggtgcggagtgtccccgaggtcagcgaggagtgcgcgctcctcctcgcccgccgctaggtccatcccggcccagccaccatgtccatccacttcagctccccggtattcacctcgcgctcagccgccttctcgggccgcggcgcccaggtgcgcctgagctccgctcgccccggcggccttggcagcagcagcctctacggcctcggcgcctcgcggccgcgcgtggccgtgcgctctgcctatgggggcccggtgggcgccggcatccgcgaggtcaccattaaccagagcctgctggccccgctgcggctggacgccgacccctccctccagcgggtgcgccaggaggagagcgagcagatcaagaccctcaacaacaagtttgcctccttcatcgacaaggtgcggtttctggagcagcagaacaagctgctggagaccaagtggacgctgctgcaggagcagaagtcggccaagagcagccgcctcccagacatctttgaggcccagattgctggccttcggggtcagcttgaggcactgcaggtggatgggggccgcctggaggcggagctgcggagcatgcaggatgtggtggaggacttcaagaataagtacgaagatgaaattaaccgccgcacagctgctgagaatgagtttgtggtgctgaagaaggatgtggatgctgcctacatgagcaaggtggagctggaggccaaggtggatgccctgaatgatgagatcaacttcctcaggaccctcaatgagacggagttgacagagctgcagtcccagatctccgacacatctgtggtgctgtccatggacaacagtcgctccctggacctggacggcatcatcgctgaggtcaaggcacagtatgaggagatggccaaatgcagccgggctgaggctgaagcctggtaccagaccaagtttgagaccctccaggcccaggctgggaagcatggggacgacctccggaatacccggaatgagatttcagagatgaaccgggccatccagaggctgcaggctgagatcgacaacatcaagaaccagcgtgccaagttggaggccgccattgccgaggctgaggagcgtggggagctggcgctcaaggatgctcgtgccaagcaggaggagctggaagccgccctgcagcgggccaagcaggatatggcacggcagctgcgtgagtaccaggaactcatgagcgtgaagctggccctggacatcgagatcgccacctaccgcaagctgctggagggcgaggagagccggttggctggagatggagtgggagccgtgaatatctctgtgatgaattccactggtggcagtagcagtggcggtggcattgggctgaccctcgggggaaccatgggcagcaatgccctgagcttctccagcagtgcgggtcctgggctcctgaaggcttattccatccggaccgcatccgccagtcgcaggagtgcccgcgactgagccgcctcccaccactccactcctccagccaccacccacaatgccattgccgaggctgaggagtgtggggagctggcgctcaaggatgctcgtgccaagcaggaggagctggaagccgccctgcagcgggccaagcaggatatggcacggcagctgcgtgagtaccaggaactcatgagcgtgaagctggccctggacatcgagatcgccacctaccgcaagctgctggagggcgaggagagccggttggctggagatggagtgggagccgtgaatatctctgtgatgaattccactggtggcagtagcagtggcggtggcattgggctagccctcgggggaaccatgggcagcaa

SEQ ID NO: 445952 - DNA, 3030 bp, Homo sapiens
  misc_feature (5)..(5): n is a, c, g, or t
aaaantaggctagtacgaggccgggtgttaatcggccgaggagtgcgcgctcctcctcgcccgccgctaggtccatcccggcccagccaccatgtccatccacttcagctccccggtattcacctcgcgctcagccgccttctcgggccgcggcgcccaggtgcgcctgagctccgctcgccccggcggccttggcagcagcagcctctacggcctcggcgcctcgcggccgcgcgtggccgtgcgctctgcctatgggggcccggtgggcgccggcatccgcgaggtcaccattaaccagagcctgctggccccgctgcggctggacgccgacccctccctccagcgggtgcgccaggaggagagcgagcagatcaagaccctcaacaacaagtttgcctccttcatcgacaaggtgcggtttctggagcagcagaacaagctgctggagaccaagtggacgctgctgcaggagcagaagtcggccaagagcagccgcctcccagacatctttgaggcccagattgctggccttcggggtcagcttgaggcactgcaggtggatgggggccgcctggaggcggagctgcggagcatgcaggatgtggtggaggacttcaagaataagtacgaagatgaaattaaccgccgcacagctgctgagaatgagtttgtggtgctgaagaaggatgtggatgctgcctacatgagcaaggtggagctggaggccaaggtggatgccctgaatgatgagatcaacttcctcaggaccctcaatgagacggagttgacagagctgcagtcccagatctccgacacatctgtggtgctgtccatggacaacagtcgctccctggacctggacggcatcatcgctgaggtcaaggcacagtatgaggagatggccaaatgcagccgggctgaggctgaagcctggtaccagaccaagtttgagaccctccaggcccaggctgggaagcatggggacgacctccggaatacccggaatgagatttcagagatgaaccgggccatccagaggctgcaggctgagatcgacaacatcaagaaccaggtcctggcatgggctgatgggagaaaggtcctggatgtgcacagagcctgtggagggagactcaggctggctggccagaagaaagccaccactggttccacattgatactgagcactctgcttgcacctggttctggctgcagggcgctgtccctgggagctcatcattcattgcagggacagaggacagcagaagaccttataatgactcacatggccctttcccacccactccaacctcactttccacgattcccctcactctgctctggccatgctaacctgcttcctgcatcttgcatttgccaagaatggtcatgcttcagggcctttgcacttggcgttgcctccccctggaatgtggttctcccagctctgtccatggttgttgttttctcctccctggggtttaggaaaagaccccttctcagagacggcactctcaaacaccagcccctctatcggcagcctgtctgaagttctttgaagcccctgtcactctctgaaatgttctgtcttattcattaagtgattgatggtccctacctccactggaatataacagatgcctggagagcagggaccctgtctgtctggttcactgctcctctcttccagcacctggcacatggcaggggcacgggtctcagatgagagactgcctgggaggatgagctttgctggaagctggggttggaggtgttgatgggggaagggcccccagccctggctgagtagtgtgtggccagggcagctcagcctgtgcaggtgtctgcagtggagagagggggagggcacacatgtggaagcttcggaaagctgatttccagatgagctgtgggtggtggggggatgtgagggtgatttacccacaaatgtcctccccttggagccctgtgggcctgtttacaggagggcggaggctgccttggggcacagaggcagggccgtgagtcaccccatgaagtgggccagcttccaggccaggaggggaagcacagaataacaaatggtggtttcccaaaccctgcagcctctactacatccggttctcctctcacacaacagggcggatccaggcctatagccaggtgtctaccaccactgaggggcgtcatggggagctacaaggggtctccagaggcagcggggatggcgttggctctgggggcaccagtgtgacagggcagggcaccgagctgtggccgaggggcagagtgtcagagggcctcctggggaatgctgtctctggcagagaggcagactgcctccactgagggaagaggatctgaggatagagaatggccggatgggcaggcaggaaggcagactggtgagccccagcttacagctgcactgctgcccacacgtgccaagttggaggccgccattgccgaggctgaggagcgtggggagctggcgctcaaggatgctcgtgccaagcaggaggagctggaagccgccctgcagcgggccaagcaggatatggcacggcagctgcgtgagtaccaggaactcatgagcgtgaagctggccctggacatcgagatcgccacctaccgcaagctgctggagggcgaggagagccggttggctggagatggagtgggagccgtgaatatctctgtgatgaattccactggtggcagtagcagtggcggtggcattgggctgaccctcgggggaaccatgggcagcaatgccctgagcttctccagcagtgcgggtcctgggctcctgaaggcttattccatccggaccgcatccgccagtcgcaggagtgcccgcgactgagccgcctcccaccactccactcctccagccaccacccacaatcacaagaagattcccacccctgcctcccatgcctggtcccaagacagtgagacagtctggaaagtgatgtcagaatagcttccaataaagcagcctcattctgaggcctgagtgatcca

SEQ ID NO: 445953 - DNA, 3196 bp, Homo sapiens
  misc_feature (5)..(5): n is a, c, g, or t
aaaantaggctagtacgaggccgggtgttaatcggccgaggagtgcgcgctcctcctcgcccgccgctaggtccatcccggcccagccaccatgtccatccacttcagctccccggtattcacctcgcgctcagccgccttctcgggccgcggcgcccaggtgcgcctgagctccgctcgccccggcggccttggcagcagcagcctctacggcctcggcgcctcgcggccgcgcgtggccgtgcgctctgcctatgggggcccggtgggcgccggcatccgcgaggtcaccattaaccagagcctgctggccccgctgcggctggacgccgacccctccctccagcgggtgcgccaggaggagagcgagcagatcaagaccctcaacaacaagtttgcctccttcatcgacaaggtgcggtttctggagcagcagaacaagctgctggagaccaagtggacgctgctgcaggagcagaagtcggccaagagcagccgcctcccagacatctttgaggcccagattgctggccttcggggtcagcttgaggcactgcaggtggatgggggccgcctggaggcggagctgcggagcatgcaggatgtggtggaggacttcaagaataagtacgaagatgaaattaaccgccgcacagctgctgagaatgagtttgtggtgctgaagaaggatgtggatgctgcctacatgagcaaggtggagctggaggccaaggtggatgccctgaatgatgagatcaacttcctcaggaccctcaatgagacggagttgacagagctgcagtcccagatctccgacacatctgtggtgctgtccatggacaacagtcgctccctggacctggacggcatcatcgctgaggtcaaggcacagtatgaggagatggccaaatgcagccgggctgaggctgaagcctggtaccagaccaagtttgagaccctccaggcccaggctgggaagcatggggacgacctccggaatacccggaatgagatttcagagatgaaccgggccatccagaggctgcaggctgagatcgacaacatcaagaaccaggtgggacaagtcctcctggcttcccctgctacttggggcatgcaggggtggccagctgaggccaaactcaggatgtggagcaggaggttcccatctcccggccaaagctggtgccactgtctcagacccccttgtgagatctccagcacagaatgttcttggccaggtcctggcatgggctgatgggagaaaggtcctggatgtgcacagagcctgtggagggagactcaggctggctggccagaagaaagccaccactggttccacattgatactgagcactctgcttgcacctggttctggctgcagggcgctgtccctgggagctcatcattcattgcagggacagaggacagcagaagaccttataatgactcacatggccctttcccacccactccaacctcactttccacgattcccctcactctgctctggccatgctaacctgcttcctgcatcttgcatttgccaagaatggtcatgcttcagggcctttgcacttggcgttgcctccccctggaatgtggttctcccagctctgtccatggttgttgttttctcctccctggggtttaggaaaagaccccttctcagagacggcactctcaaacaccagcccctctatcggcagcctgtctgaagttctttgaagcccctgtcactctctgaaatgttctgtcttattcattaagtgattgatggtccctacctccactggaatataacagatgcctggagagcagggaccctgtctgtctggttcactgctcctctcttccagcacctggcacatggcaggggcacgggtctcagatgagagactgcctgggaggatgagctttgctggaagctggggttggaggtgttgatgggggaagggcccccagccctggctgagtagtgtgtggccagggcagctcagcctgtgcaggtgtctgcagtggagagagggggagggcacacatgtggaagcttcggaaagctgatttccagatgagctgtgggtggtggggggatgtgagggtgatttacccacaaatgtcctccccttggagccctgtgggcctgtttacaggagggcggaggctgccttggggcacagaggcagggccgtgagtcaccccatgaagtgggccagcttccaggccaggaggggaagcacagaataacaaatggtggtttcccaaaccctgcagcctctactacatccggttctcctctcacacaacagggcggatccaggcctatagccaggtgtctaccaccactgaggggcgtcatggggagctacaaggggtctccagaggcagcggggatggcgttggctctgggggcaccagtgtgacagggcagggcaccgagctgtggccgaggggcagagtgtcagagggcctcctggggaatgctgtctctggcagagaggcagactgcctccactgagggaagaggatctgaggatagagaatggccggatgggcaggcaggaaggcagactggtgagccccagcttacagctgcactgctgcccacacgtgccaagttggaggccgccattgccgaggctgaggagcgtggggagctggcgctcaaggatgctcgtgccaagcaggaggagctggaagccgccctgcagcgggccaagcaggatatggcacggcagctgcgtgagtaccaggaactcatgagcgtgaagctggccctggacatcgagatcgccacctaccgcaagctgctggagggcgaggagagccggttggctggagatggagtgggagccgtgaatatctctgtgatgaattccactggtggcagtagcagtggcggtggcattgggctgaccctcgggggaaccatgggcagcaatgccctgagcttctccagcagtgcgggtcctgggctcctgaaggcttattccatccggaccgcatccgccagtcgcaggagtgcccgcgactgagccgcctcccaccactccactcctccagccaccacccacaatcacaagaagattcccacccctgcctcccatgcctggtcccaagacagtgagacagtctggaaagtgatgtcagaatagcttccaataaagcagcctcattctgaggcctgagtgatcca

SEQ ID NO: 445954 - DNA, 1658 bp, Homo sapiens
aatctctgccacccggattcaagcaattctcctgtctcagcctcccgagtagctggaatgcagacacccatcaccacgcccagctaattttatgtatttttagtagagatggggtttcaccatgtggtcaggctggtcttgaactcctgacctcaggtgatccacccacgtcaggctcccaaagtgctgagattacaggcatgaaccactgtgcccagccgaaaacaaccaagaattttttaacaataaaatgaccagcaagtaaacttgaaacaaaaatggacaaatatctaaaatatttttaaatgtatgtattttaattggcaaataatacttgtatatattgtttacaacttgttttaaagtatgaatacattgtggaatggctaaatcaagttaattaacatgcattaactcacataaaaaaaaaagaacaagctgctggagaccaagtggacgctgctgcaggagcagaagtcggccaagagcagccgcctcccagacatctttgaggcccagattgctggccttcggggtcagcttgaggcactgcaggtggatgggggccgcctggaggcggagctgcggagcatgcaggatgtggtggaggacttcaagaataagtacgaagatgaaattaaccgccgcacagctgctgagaatgagtttgtggtgctgaagaaggatgtggatgctgcctacatgagcaaggtggagctggaggccaaggtggatgccctgaatgatgagatcaacttcctcaggaccctcaatgagacggagttgacagagctgcagtcccagatctccgacacatctgtggtgctgtccatggacaacagtcgctccctggacctggacggcatcatcgctgaggtcaaggcacagtatgaggagatggccaaatgcagccgggctgaggctgaagcctggtaccagaccaagtttgagaccctccaggcccaggctgggaagcatggggacgacctccggaatacccggaatgagatttcagagatgaaccgggccatccagaggctgcaggctgagatcgacaacatcaagaaccagcgtgccaagttggaggccgccattgccgaggctgaggagcgtggggagctggcgctcaaggatgctcgtgccaagcaggaggagctggaagccgccctgcagcgggccaagcaggatatggcacggcagctgcgtgagtaccaggaactcatgagcgtgaagctggccctggacatcgagatcgccacctaccgcaagctgctggagggcgaggagagccggttggctggagatggagtgggagccgtgaatatctctgtgatgaattccactggtggcagtagcagtggcggtggcattgggctgaccctcgggggaaccatgggcagcaatgccctgagcttctccagcagtgcgggtcctgggctcctgaaggcttattccatccggaccgcatccgccagtcgcaggagtgcccgcgactgagccgcctcccaccactccactcctccagccaccacccacaatcacaagaagattcccacccctgcctcccatgcctggtcccaagacagtgagacagtctggaaagtgatgtcagaatagcttccaataaagcagcctcattctgaggcctgagtgatcca

SEQ ID NO: 445955 - DNA, 2562 bp, Homo sapiens
  misc_feature (5)..(5): n is a, c, g, or t
aaaantaggctagtacgaggccgggtgttaatcggccgaggagtgcgcgctcctcctcgcccgccgctaggtccatcccggcccagccaccatgtccatccacttcagctccccggtattcacctcgcgctcagccgccttctcgggccgcggcgcccaggtgcgcctgagctccgctcgccccggcggccttggcagcagcagcctctacggcctcggcgcctcgcggccgcgcgtggccgtgcgctctgcctatgggggcccggtgggcgccggcatccgcgaggtcaccattaaccagagcctgctggccccgctgcggctggacgccgacccctccctccagcgggtgcgccaggaggagagcgagcagatcaagaccctcaacaacaagtttgcctccttcatcgacaaggtgcggtttctggagcagcagaacaagctgctggagaccaagtggacgctgctgcaggagcagaagtcggccaagagcagccgcctcccagacatctttgaggcccagattgctggccttcggggtcagcttgaggcactgcaggtggatgggggccgcctggaggcggagctgcggagcatgcaggatgtggtggaggacttcaagaataagtacgaagatgaaattaaccgccgcacagctgctgagaatgagtttgtggtgctgaagaaggatgtggatgctgcctacatgagcaaggtggagctggaggccaaggtggatgccctgaatgatgagatcaacttcctcaggaccctcaatgagacggagttgacagagctgcagtcccagatctccgacacatctgtggtgctgtccatggacaacagtcgctccctggacctggacggcatcatcgctgaggtcaaggcacagtatgaggagatggccaaatgcagccgggctgaggctgaagcctggtaccagaccaagtttgagaccctccaggcccaggctgggaagcatggggacgacctccggaatacccggaatgagatttcagagatgaaccgggccatccagaggctgcaggctgagatcgacaacatcaagaaccaggtcctggcatgggctgatgggagaaaggtcctggatgtgcacagagcctgtggagggagactcaggctggctggccagaagaaagccaccactggttccacattgatactgagcactctgcttgcacctggttctggctgcagggcgctgtccctgggagctcatcattcattgcagggacagaggacagcagaagaccttataatgactcacatggccctttcccacccactccaacctcactttccacgattcccctcactctgctctggccatgctaacctgcttcctgcatcttgcatttgccaagaatggtcatgcttcagggcctttgcacttggcgttgcctccccctggaatgtggttctcccagctctgtccatggttgttgttttctcctccctggggtttaggaaaagaccccttctcagagacggcactctcaaacaccagcccctctatcggcagcctgtctgaagttctttgaagcccctgtcactctctgaaatgttctgtcttattcattaagtgattgatggtccctacctccactggaatataacagatgcctggagagcagggaccctgtctgtctggttcactgctcctctcttccagcacctggcacatggcaggggcacgggtctcagatgagagactgcctgggaggatgagctttgctggaagctggggttggaggtgttgatgggggaagggcccccagccctggctgagtagtgtgtggccagggcagctcagcctgtgcaggtgtctgcagtggagagagggggagggcacacatgtggaagcttcggaaagctgatttccagatgagctgtgggtggtggggggatgtgagggtgatttacccacaaatgtcctccccttggagccctgtgggcctgtttacaggagggcggaggctgccttggggcacagaggcagggccgtgagtcaccccatgaagtgggccagcttccaggccaggaggggaagcacagaataacaaatggtggtttcccaaaccctgcagcctctactacatccggttctcctctcacacaacagggcggatccaggcctatagccaggtgtctaccaccactgaggggcgtcatggggagctacaaggggtctccagaggcagcggggatggcgttggctctgggggcaccagtgtgacagggcagggcaccgagctgtggccgaggggcagagtgtcagagggcctcctggggaatgctgtctctggcagagaggcagactgcctccactgagggaagaggatctgaggatagagaatggccgcgtgccaagttggaggccgccattgccgaggctgaggagcgtggggagctggcgctcaaggatgctcgtgccaagcaggctggagagctcttattgcccaggctggagtagctcttattggccaagctggagtagctcttattgcccaggctgaagtagctcttattgtccaggctgga

SEQ ID NO: 445956 - DNA, 1286 bp, Homo sapiens
  misc_feature (5)..(5): n is a, c, g, or t
  misc_feature (1101)..(1102): n is a, c, g, or t
  misc_feature (1107)..(1108): n is a, c, g, or t
aaaantaggctagtacgaggccgggtgttaatcggccgaggagtgcgcgctcctcctcgcccgccgctaggtccatcccggcccagccaccatgtccatccacttcagctccccggtattcacctcgcgctcagccgccttctcgggccgcggcgcccaggtgcgcctgagctccgctcgccccggcggccttggcagcagcagcctctacggcctcggcgcctcgcggccgcgcgtggccgtgcgctctgcctatgggggcccggtgggcgccggcatccgcgaggtcaccattaaccagagcctgctggccccgctgcggctggacgccgacccctccctccagcgggtgcgccaggaggagagcgagcagatcaagaccctcaacaacaagtttgcctccttcatcgacaaggtgcggtttctggagcagcagaacaagctgctggagaccaagtggacgctgctgcaggagcagaagtcggccaagagcagccgcctcccagacatctttgaggcccagattgctggccttcggggtcagcttgaggcactgcaggtggatgggggccgcctggaggcggagctgcggagcatgcaggatgtggtggaggacttcaagaataagtacgaagatgaaattaaccgccgcacagctgctgagaatgagtttgtggtgctgaagaaggatgtggatgctgcctacatgagcaaggtggagctggaggccaaggtggatgccctgaatgatgagatcaacttcctcaggaccctcaatgagacggagttgacagagctgcagtcccagatctccgacacatctgtggtgctgtccatggacaacagtcgctccctggacctggacggcatcatcgctgaggtcaaggcacagtatgaggagatggccaaatgcagccgggctgaggctgaagcctggtaccagaccaagtttgagaccctccaggcccaggctgggaagcatggggacgacctccggaatacccggaatgagatttcagagatgaaccgggccatccagaggctgcaggctgagatcgacaacatcaagaaccagcgtgcaagtggaggcgcatgccgagnngaganngtgggaacaggggcccagcatgtcggccaagagaggacgtgggaaccgccgtaagggcaaacgacatgtcgcgactggcgaacagcgacataggcaaaggcgcgaaaacaaaaaccacacaagggggacgagaccagcgagcaaaggaaggaaacaagacaacagtcaaacgaagaga

SEQ ID NO: 445957 - DNA, 1024 bp, Homo sapiens
cggaacctgcgacctttcacacgggacaagttatagctactccagcctggagcaaccagagctactccagcctgggcaataagagggaggccaaggtggatgccctgaatgatgagatcaacttcctcaggaccctcaatgagacggagttgacagagctgcagtcccagatctccgacacatctgtggtgctgtccatggacaacagtcgctccctggacctggacggcatcatcgctgaggtcaaggcacagtatgaggagatggccaaatgcagccgggctgaggctgaagcctggtaccagaccaagtttgagaccctccaggcccaggctgggaagcatggggacgacctccggaatacccggaatgagatttcagagatgaaccgggccatccagaggctgcaggctgagatcgacaacatcaagaaccagcgtgccaagttggaggccgccattgccgaggctgaggagcgtggggagctggcgctcaaggatgctcgtgccaagcaggaggagctggaagccgccctgcagcgggccaagcaggatatggcacggcagctgcgtgagtaccaggaactcatgagcgtgaagctggccctggacatcgagatcgccacctaccgcaagctgctggagggcgaggagagccggttggctggagatggagtgggagccgtgaatatctctgtgatgaattccactggtggcagtagcagtggcggtggcattgggctgaccctcgggggaaccatgggcagcaatgccctgagcttctccagcagtgcgggtcctgggctcctgaaggcttattccatccggaccgcatccgccagtcgcaggagtgcccgcgactgagccgcctcccaccactccactcctccagccaccacccacaatcacaagaagattcccacccctgcctcccatgcctggtcccaagacagtgagacagtctggaaagtgatgtcagaatagcttccaataaagcagcctcattctgaggcctgagtgatcca

SEQ ID NO: 445958 - DNA, 784 bp, Homo sapiens
ggtcaggcactgaagcactggtcaggcactgaagcctggtcaggcactgaagcctggtaccaagacacaagtttgagaccctccaggcccaggctgggaagcatggggacgacctccggaatacccggaatgagatttcagagatgaaccgggccatccagaggctgcaggctgagatcgacaacatcaagaaccagcgtgccaagttggaggccgccattgccgaggctgaggagcgtggggagctggcgctcaaggatgctcgtgccaagcaggaggagctggaagccgccctgcagcgggccaagcaggatatggcacggcagctgcgtgagtaccaggaactcatgagcgtgaagctggccctggacatcgagatcgccacctaccgcaagctgctggagggcgaggagagccggttggctggagatggagtgggagccgtgaatatctctgtgatgaattccactggtggcagtagcagtggcggtggcattgggctgaccctcgggggaaccatgggcagcaatgccctgagcttctccagcagtgcgggtcctgggctcctgaaggcttattccatccggaccgcatccgccagtcgcaggagtgcccgcgactgagccgcctcccaccactccactcctccagccaccacccacaatcacaagaagattcccacccctgcctcccatgcctggtcccaagacagtgagacagtctggaaagtgatgtcagaatagcttccaataaagcagcctcattctgaggcctgagtgatcca

SEQ ID NO: 445959 - DNA, 462 bp, Homo sapiens
cgctcttggaagtagtcgctcttggctgtagtcgctactggccctggacatcgagatcgccacctaccgcaagctgctggagggcgaggagagccggttggctggagatggagtgggagccgtgaatatctctgtgatgaattccactggtggcagtagcagtggcggtggcattgggctgaccctcgggggaaccatgggcagcaatgccctgagcttctccagcagtgcgggtcctgggctcctgaaggcttattccatccggaccgcatccgccagtcgcaggagtgcccgcgactgagccgcctcccaccactccactcctccagccaccacccacaatcacaagaagattcccacccctgcctcccatgcctggtcccaagacagtgagacagtctggaaagtgatgtcagaatagcttccaataaagcagcctcattctgaggcctgagtgatcca

SEQ ID NO: 445960 - DNA, 399 bp, Homo sapiens
ctcttcgcgtggctctttgtgcggctcatggtgtggctcatcgggtggtgtgggagccgtgaatatctctgtgatgaattccactggtggcagtagcagtggcggtggcattgggctgaccctcgggggaaccatgggcagcaatgccctgagcttctccagcagtgcgggtcctgggctcctgaaggcttattccatccggaccgcatccgccagtcgcaggagtgcccgcgactgagccgcctcccaccactccactcctccagccaccacccacaatcacaagaagattcccacccctgcctcccatgcctggtcccaagacagtgagacagtctggaaagtgatgtcagaatagcttccaataaagcagcctcattctgaggcctgagtgatcca

SEQ ID NO: 445961 - DNA, 3793 bp, Homo sapiens
gttcacagttgaggaccacacaatgcaaagagattttagatggctgtgggtctacgaaataggctatgcagccgataacagtagaactctgaacgtggattccactgcaatgacactacctatgtctgatccaactgcatgggccacagcaatgaataatcttggaatggcaccgctgggaattgccggacaaccaattttacctgactttgatcctgctcttggaatgatgactggaattccaccaataactccaatgatgcctggtttgggaatagtacctccaccaattcctccagatatgccagtagtaaaagagatcatacactgtaaaagctgcacgctcttccctccaaatccaaatctcccacctcctgcaacccgagaaagaccaccaggatgcaaaacagtatttgtgggtggtctgcctgaaaatgggacagagcaaatcattgtggaagttttcgagcagtgtggagagatcattgccattcgcaagagcaagaagaacttctgccacattcgctttgctgaggagtacatggtggacaaagccctgtatctgtctggttaccgcattcgcctgggctctagtactgacaagaaggacacaggcagactccacgttgatttcgcacaggctcgagatgacctgtatgagtgggagtgtaaacagcgtatgctagccagagaggagcgccatcgtagaagaatggaagaagaaagattgcgtccaccatctccacccccagtggtccactattcagatcatgaatgcagcattgttgctgaaaaattaaaagatgattccaaattctcagaagctgtacagaccttgcttacctggatagagcgaggagaggtcaaccgtcgtagcgccaataacttctactccatgatccagtcggccaacagccatgtccgccgcctggtgaacgagaaagctgcccatgagaaagatatggaagaagcaaaggagaagttcaagcaggccctttctggaattctcattcaatttgagcagatagtggctgtgtaccattccgcctccaagcagaaggcatgggaccacttcacaaaagcccagcggaagaacatcagcgtgtggtgcaaacaagctgaggaaattcgcaacattcataatgatgaattaatgggaatcaggcgagaagaagaaatggaaatgtctgatgatgaaatagaagaaatgacagaaacaaaagaaactgaggaatcagccttagtatcacaggcagaagctctgaaggaagaaaatgacagcctccgttggcagctcgatgcctaccggaatgaagtagaactgctcaagcaagaacaaggcaaagtccacagagaagatgaccctaacaaagaacagcagctgaaactcctgcaacaagccctgcaaggaatgcaacagcatctactcaaagtccaagaggaatacaaaaagaaagaagctgaacttgaaaaactcaaagatgacaagttacaggtggaaaaaatgttggaaaatcttaaagaaaaggaaagctgtgcttctaggctgtgtgcctcaaaccaggatagcgaataccctcttgagaagaccatgaacagcagtcctatcaaatctgaacgtgaagcactgctagtggggattatctccacattccttcatgttcacccatttggagcaagcattgaatacatctgttcctacttgcaccgtcttgataataagatctgcaccagcgatgtggagtgtctcatgggtagactccagcataccttcaagcaggaaatgactggagttggagccagcctggaaaagagatggaaattctgtggcttcgagggcttgaagctgacctaaatctctttgcctaacaacttgggatcctgaagataaatatgtgttggacaagcatagaaagtgatttatatttttaatggttttcaagtggaagttcctttgaatttgtcagttcattcctggaaaatcttttgagttaaaataaggatcctaggacagcacctcgaactacaggccctaaagagaaattgcctcaaaccacaagtgctgtaacttcctcccctttctgtcaattggttgtctttaaatattgcaaaagtcctgatgctaaacagtatttggagtgttttcagtgtctgtactactgttgtagaccttggtatttttttaaacactgttaactgaaatgttttgatgatttgtatgtgatttgtgtttctaaacttctctttacattaatgttgttactggtgaaaggcatgagagcagcactaagtcctctgtgtaactgccattgtctttccaatccccagtagaccagtaaataaataacacatcagtgtcttctagaaggtgcctgaccaggttcaccttttaaacgacaaagcatggtttgtggctttttgcaaaattactatgaaccaaaagttgacaaatgttccaaagttattttctctaacatatcacattaaagatctgtttcagaattgtaaaaagtacatctagatgtgtttacagaaagcaagtatccagtatgactggcatgtgttcatgctattcagaatcacttgtaaatagtctgcttttaaaggagggcatgttcagttttctgtgaattaaaatatgctcatgtgtgggcacacacgcacaaacacacacacgcacgcacacagtggcagaagggatttatattaatattctttcccctctggccttcttacagtctgttggtccctttgcttctgttgtcagtgtgttgaattgcaaaccgagtactgctgtaaatactatgtttacttcatgctgaatgtttgcaaagacttgatataagtattaatagtaatgaatcaatgaataaataatgagctagggtttgtgaggctttctacaaataggtcagctccacctggagtgcgaattgccagagacaccttggtagtgcccatcggcaaatcgcaatggcagcatgtgagtggaccattcagaaacttctgcttggtggaaagtaaacagagaggatggaggtttggggcgaatgtcctgaggcagagatggtctttattgtgtgtggtggtggttgtggtatttataataatgcaagcataccctcccttgagtctcaattgaagataaaagaatgtactgagcaagcaaagccaatggagagtatttcacaaaaatactttgtaaatgagatgccagtagtgttcaaagttgtatttttaaaagataaatattcctttttatacctcagttttgtgtcctgtttttaatgacttacgctctaagtaatccattagtagttatctcagttccttcctttgggttactagaatgttggaaaaagatgccaagtctgtcttgacaactggaaacagggttccacagcagcccattcgtgctgaaaactggcttccccctgaagcaccctgctgtggcaccagcaggaagctcaggttaattttacactagcttgctcactgatgcatctctcatcaatgctacggaaggctttgattcatcagtctcgggctcttggaatacctaattttaataatatctatgaaatcaagggaaactttccatttacagttatttcttgtttaaataaactaaattaatttttaggggagagcagtaggaaaaagagctaatgcatgcggggtttaatacctaggtgatgggttgaggtgcagcaaaaccaccatggcacacgttcacctatgtaacaaacctgcacatcctgcacatgtaccccggaacttacttaaaaaaaaa

SEQ ID NO: 445962 - DNA, 3575 bp, Homo sapiens
gtgtgtgagagtccagccttgggccagagtgccgggtctaggcctggaagcgcgaggcgggcatttcggaagagagtggcgcggcgtggggcgccgcgagggcactacgagcccaggaactgccgcgccggcccgattttccgcggctgtataaggactagcgcttcggtagccggggagctggagggaacctgatttgagatcaattcttggagaacacaaagaagtgtgatggattgaaccagctgccctttgaccctgctaacaacaacgagcccctgcagtttggtagtgccagtggccctctggtcacagaaggcctcattgagaatggaggggaatcaagcaagaaaagaaagagaacaaatactccttcagccgataacagtagaactctgaacgtggattccactgcaatgacactacctatgtctgatccaactgcatgggccacagcaatgaataatcttggaatggcaccgctgggaattgccggacaaccaattttacctgactttgatcctgctcttggaatgatgactggaattccaccaataactccaatgatgcctggtttgggaatagtacctccaccaattcctccagatatgccagtagtaaaagagatcatacactgtaaaagctgcacgctcttccctccaaatccaaatctcccacctcctgcaacccgagaaagaccaccaggatgcaaaacagtatttgtgggtggtctgcctgaaaatgggacagagcaaatcattgtggaagttttcgagcagtgtggagagatcattgccattcgcaagagcaagaagaacttctgccacattcgctttgctgaggagtacatggtggacaaagccctgtatctgtctggttaccgcattcgcctgggctctagtactgacaagaaggacacaggcagactccacgttgatttcgcacaggctcgagatgacctgtatgagtgggagtgtaaacagcgtatgctagccagagaggagcgccatcgtagaagaatggaagaagaaagattgcgtccaccatctccacccccagtggtccactattcagatcatgaatgcagcattgttgctgaaaaattaaaagatgattccaaattctcagaagctgtacagaccttgcttacctggatagagcgaggagaggtcaaccgtcgtagcgccaataacttctactccatgatccagtcggccaacagccatgtccgccgcctggtgaacgagaaagctgcccatgagaaagatatggaagaagcaaaggagaagttcaagcaggccctttctggaattctcattcaatttgagcagatagtggctgtgtaccattccgcctccaagcagaaggcatgggaccacttcacaaaagcccagcggaagaacatcagcgtgtggtgcaaacaagctgaggaaattcgcaacattcataatgatgaattaatgggaatcaggcgagaagaagaaatggaaatgtctgatgatgaaatagaagaaatgacagaaacaaaagaaactgaggaatcagccttagtatcacaggcagaagctctgaaggaagaaaatgacagcctccgttggcagctcgatgcctaccggaatgaagtagaactgctcaagcaagaacaaggcaaagtccacagagaagatgaccctaacaaagaacagcagctgaaactcctgcaacaagccctgcaaggaatgcaacagcatctactcaaagtccaagaggaatacaaaaagaaagaagctgaacttgaaaaactcaaagatgacaagttacaggtggaaaaaatgttggaaaatcttaaagaaaaggaaagctgtgcttctaggctgtgtgcctcaaaccaggatagcgaataccctcttgagaagaccatgaacagcagtcctatcaaatctgaacgtgaagcactgctagtggggattatctccacattccttcatgttcacccatttggagcaagcattgaatacatctgttcctacttgcaccgtcttgataataagatctgcaccagcgatgtggagtgtctcatgggtagactccagcataccttcaagcaggaaatgactggagttggagccagcctggaaaagagatggaaattctgtggcttcgagggcttgaagctgacctaaatctctttgcctaacaacttgggatcctgaagataaatatgtgttggacaagcatagaaagtgatttatatttttaatggttttcaagtggaagttcctttgaatttgtcagttcattcctggaaaatcttttgagttaaaataaggatcctaggacagcacctcgaactacaggccctaaagagaaattgcctcaaaccacaagtgctgtaacttcctcccctttctgtcaattggttgtctttaaatattgcaaaagtcctgatgctaaacagtatttggagtgttttcagtgtctgtactactgttgtagaccttggtatttttttaaacactgttaactgaaatgttttgatgatttgtatgtgatttgtgtttctaaacttctctttacattaatgttgttactggtgaaaggcatgagagcagcactaagtcctctgtgtaactgccattgtctttccaatccccagtagaccagtaaataaataacacatcagtgtcttctagaaggtgcctgaccaggttcaccttttaaacgacaaagcatggtttgtggctttttgcaaaattactatgaaccaaaagttgacaaatgttccaaagttattttctctaacatatcacattaaagatctgtttcagaattgtaaaaagtacatctagatgtgtttacagaaagcaagtatccagtatgactggcatgtgttcatgctattcagaatcacttgtaaatagtctgcttttaaaggagggcatgttcagttttctgtgaattaaaatatgctcatgtgtgggcacacacgcacaaacacacacacgcacgcacacagtggcagaagggatttatattaatattctttcccctctggccttcttacagtctgttggtccctttgcttctgttgtcagtgtgttgaattgcaaaccgagtactgctgtaaatactatgtttacttcatgctgaatgtttgcaaagacttgatataagtattaatagtaatgaatcaatgaataaataatgagctagggtttgtgaggctttctacaaataggtcagctccacctggagtgcgaattgccagagacaccttggtagtgcccatcggcaaatcgcaatggcagcatgtgagtggaccattcagaaacttctgcttggtggaaagtaaacagagaggatggaggtttggggcgaatgtcctgaggcagagatggtctttattgtgtgtggtggtggttgtggtatttataataatgcaagcataccctcccttgagtctcaattgaagataaaagaatgtactgagcaagcaaagccaatggagagtatttcacaaaaatactttgtaaatgagatgccagtagtgttcaaagttgtatttttaaaagataaatattcctttttatacctca

SEQ ID NO: 445963 - DNA, 2212 bp, Homo sapiens
tgtggaccttaaacttttttaaaaaaacaatggtccttttaacagtgggatgaaatcctggctccacttccttgcagtgtgatcttagccaatttacctgagcctcactttcctcatctgtagaatggagattatacttacctaaccgtgcctagcatcttgttagtataccataaatgttgggtctagttgccccgattgcttgtataaagtccagatgaaggcaggaaaaaaaaaaaaaaactggtgaaggtaaatgtttaaatgtttctgtgttttggagccctataaataaactttggaatatctgtgatgcttttgtaatttatgctattttctctcccattcagtaatccaaattgaatggtattgtttttatggtcctgtgttaagttacctgttgtgtagttaattgaaaccaactctattgccaaataaagtgaactgacctagaagcatgttgtgtccacaggaaagctgtgcttctaggctgtgtgcctcaaaccaggatagcgaataccctcttgagaagaccatgaacagcagtcctatcaaatctgaacgtgaagcactgctagtggggattatctccacattccttcatgttcacccatttggagcaagcattgaatacatctgttcctacttgcaccgtcttgataataagatctgcaccagcgatgtggagtgtctcatgggtagactccagcataccttcaagcaggaaatgactggagttggagccagcctggaaaagagatggaaattctgtggcttcgagggcttgaagctgacctaaatctctttgcctaacaacttgggatcctgaagataaatatgtgttggacaagcatagaaagtgatttatatttttaatggttttcaagtggaagttcctttgaatttgtcagttcattcctggaaaatcttttgagttaaaataaggatcctaggacagcacctcgaactacaggccctaaagagaaattgcctcaaaccacaagtgctgtaacttcctcccctttctgtcaattggttgtctttaaatattgcaaaagtcctgatgctaaacagtatttggagtgttttcagtgtctgtactactgttgtagaccttggtatttttttaaacactgttaactgaaatgttttgatgatttgtatgtgatttgtgtttctaaacttctctttacattaatgttgttactggtgaaaggcatgagagcagcactaagtcctctgtgtaactgccattgtctttccaatccccagtagaccagtaaataaataacacatcagtgtcttctagaaggtgcctgaccaggttcaccttttaaacgacaaagcatggtttgtggctttttgcaaaattactatgaaccaaaagttgacaaatgttccaaagttattttctctaacatatcacattaaagatctgtttcagaattgtaaaaagtacatctagatgtgtttacagaaagcaagtatccagtatgactggcatgtgttcatgctattcagaatcacttgtaaatagtctgcttttaaaggagggcatgttcagttttctgtgaattaaaatatgctcatgtgtgggcacacacgcacaaacacacacacgcacgcacacagtggcagaagggatttatattaatattctttcccctctggccttcttacagtctgttggtccctttgcttctgttgtcagtgtgttgaattgcaaaccgagtactgctgtaaatactatgtttacttcatgctgaatgtttgcaaagacttgatataagtattaatagtaatgaatcaatgaataaataatgagctagggtttgtgaggctttctacaaataggtcagctccacctggagtgcgaattgccagagacaccttggtagtgcccatcggcaaatcgcaatggcagcatgtgagtggaccattcagaaacttctgcttggtggaaagtaaacagagaggatggaggtttggggcgaatgtcctgaggcagagatggtctttattgtgtgtggtggtggttgtggtatttataataatgcaagcataccctcccttgagtctcaattgaagataaaagaatgtactgagcaagcaaagccaatggagagtatttcacaaaaatactttgtaaatgagatgccagtagtgttcaaagttgtatttttaaaagataaatattcctttttatacctca

SEQ ID NO: 445964 - DNA, 3431 bp, Homo sapiens
gtgtgtgagagtccagccttgggccagagtgccgggtctaggcctggaagcgcgaggcgggcatttcggaagagagtggcgcggcgtggggcgccgcgagggcactacgagcccaggaactgccgcgccggcccgattttccgcggctgtataaggactagcgcttcggtagccggggagctggagggaacctgatttgagatcaattcttggagaacacaaagaagtgtgatgccgataacagtagaactctgaacgtggattccactgcaatgacactacctatgtctgatccaactgcatgggccacagcaatgaataatcttggaatggcaccgctgggaattgccggacaaccaattttacctgactttgatcctgctcttggaatgatgactggaattccaccaataactccaatgatgcctggtttgggaatagtacctccaccaattcctccagatatgccagtagtaaaagagatcatacactgtaaaagctgcacgctcttccctccaaatccaaatctcccacctcctgcaacccgagaaagaccaccaggatgcaaaacagtatttgtgggtggtctgcctgaaaatgggacagagcaaatcattgtggaagttttcgagcagtgtggagagatcattgccattcgcaagagcaagaagaacttctgccacattcgctttgctgaggagtacatggtggacaaagccctgtatctgtctggttaccgcattcgcctgggctctagtactgacaagaaggacacaggcagactccacgttgatttcgcacaggctcgagatgacctgtatgagtgggagtgtaaacagcgtatgctagccagagaggagcgccatcgtagaagaatggaagaagaaagattgcgtccaccatctccacccccagtggtccactattcagatcatgaatgcagcattgttgctgaaaaattaaaagatgattccaaattctcagaagctgtacagaccttgcttacctggatagagcgaggagaggtcaaccgtcgtagcgccaataacttctactccatgatccagtcggccaacagccatgtccgccgcctggtgaacgagaaagctgcccatgagaaagatatggaagaagcaaaggagaagttcaagcaggccctttctggaattctcattcaatttgagcagatagtggctgtgtaccattccgcctccaagcagaaggcatgggaccacttcacaaaagcccagcggaagaacatcagcgtgtggtgcaaacaagctgaggaaattcgcaacattcataatgatgaattaatgggaatcaggcgagaagaagaaatggaaatgtctgatgatgaaatagaagaaatgacagaaacaaaagaaactgaggaatcagccttagtatcacaggcagaagctctgaaggaagaaaatgacagcctccgttggcagctcgatgcctaccggaatgaagtagaactgctcaagcaagaacaaggcaaagtccacagagaagatgaccctaacaaagaacagcagctgaaactcctgcaacaagccctgcaaggaatgcaacagcatctactcaaagtccaagaggaatacaaaaagaaagaagctgaacttgaaaaactcaaagatgacaagttacaggtggaaaaaatgttggaaaatcttaaagaaaaggaaagctgtgcttctaggctgtgtgcctcaaaccaggatagcgaataccctcttgagaagaccatgaacagcagtcctatcaaatctgaacgtgaagcactgctagtggggattatctccacattccttcatgttcacccatttggagcaagcattgaatacatctgttcctacttgcaccgtcttgataataagatctgcaccagcgatgtggagtgtctcatgggtagactccagcataccttcaagcaggaaatgactggagttggagccagcctggaaaagagatggaaattctgtggcttcgagggcttgaagctgacctaaatctctttgcctaacaacttgggatcctgaagataaatatgtgttggacaagcatagaaagtgatttatatttttaatggttttcaagtggaagttcctttgaatttgtcagttcattcctggaaaatcttttgagttaaaataaggatcctaggacagcacctcgaactacaggccctaaagagaaattgcctcaaaccacaagtgctgtaacttcctcccctttctgtcaattggttgtctttaaatattgcaaaagtcctgatgctaaacagtatttggagtgttttcagtgtctgtactactgttgtagaccttggtatttttttaaacactgttaactgaaatgttttgatgatttgtatgtgatttgtgtttctaaacttctctttacattaatgttgttactggtgaaaggcatgagagcagcactaagtcctctgtgtaactgccattgtctttccaatccccagtagaccagtaaataaataacacatcagtgtcttctagaaggtgcctgaccaggttcaccttttaaacgacaaagcatggtttgtggctttttgcaaaattactatgaaccaaaagttgacaaatgttccaaagttattttctctaacatatcacattaaagatctgtttcagaattgtaaaaagtacatctagatgtgtttacagaaagcaagtatccagtatgactggcatgtgttcatgctattcagaatcacttgtaaatagtctgcttttaaaggagggcatgttcagttttctgtgaattaaaatatgctcatgtgtgggcacacacgcacaaacacacacacgcacgcacacagtggcagaagggatttatattaatattctttcccctctggccttcttacagtctgttggtccctttgcttctgttgtcagtgtgttgaattgcaaaccgagtactgctgtaaatactatgtttacttcatgctgaatgtttgcaaagacttgatataagtattaatagtaatgaatcaatgaataaataatgagctagggtttgtgaggctttctacaaataggtcagctccacctggagtgcgaattgccagagacaccttggtagtgcccatcggcaaatcgcaatggcagcatgtgagtggaccattcagaaacttctgcttggtggaaagtaaacagagaggatggaggtttggggcgaatgtcctgaggcagagatggtctttattgtgtgtggtggtggttgtggtatttataataatgcaagcataccctcccttgagtctcaattgaagataaaagaatgtactgagcaagcaaagccaatggagagtatttcacaaaaatactttgtaaatgagatgccagtagtgttcaaagttgtatttttaaaagataaatattcctttttatacctca

SEQ ID NO: 445965 - DNA, 1473 bp, Homo sapiens
gtgtgtgagagtccagccttgggccagagtgccgggtctaggcctggaagcgcgaggcgggcatttcggaagagagtggcgcggcgtggggcgccgcgagggcactacgagcccaggaactgccgcgccggcccgattttccgcggctgtataaggactagcgcttcggtagccggggagctggaggtcagagaggcagaaagccccggtggccgtggctggggactgtgggactgagggggcctagggaggagggtgcttccggggccgcggtcctcagcgcctaactccacccagctccacctctgcaggggagggggtatcgggactgggagtcgggggtgggcttttgagctctaggcgccagttctcttgagcccgggagcgcgctgtctttgctcttttttttttttttttttggtccaactcgcccgcccctttttttttttcccacgacgccgcccccctccccctggctctgtgcctcctcagaggtccgaagttggggtttgcgtccagggttttgcctaggcggtgactggactctaattcttaccgcaggaattgggtgatctctttcctcttttccctcaatttgtatttcaggtttgggcacataaccctccctgcgctacactccccattttctttggggcatgggaattccttgccacgctcagggcgtgacttttttttttcaaactttctctttttgcctccttaattgatcgccatctctttactggcccctcagccacctgccacttcccccaccaggtctttgaagtggggagagtttcccctcaatttctagaagggatgggaagcaaaagagggaaggaatcttgcttttgagaaatgtgtgtttaaggttcagtgcagggttctggtgagagtaaaaggcaagttagactggttataaaaatccagcgctttaggggtttccagcaaagactgatagcactaatgttgacaaacatttagggggcacacctttattctacagaataaagtagaccgtgtgaaacagaccatattaatcattgtattattacaaacgtgtgcaaaaaacgctaagaggggtcagtggaagagcatactgatgggggtggtgagttcatctatggaagttcaagcctaacccgggaagtgctgaagccctcatccggctttcaggctttgtgaaggaggtgaattttaatctgggctccagcagagtacaggggatttgaagttgtcaaagaggagggagaaaatgcttcctgctactgagattggactttgagaagggtaaacagaagagggagcactgtgagacaggtgggcttgcctgattggaataaaagatatcagcacaaatatactgggaaataaatagggtggagaagcttggggtcataataacatgatactttgaaacatacacatagtttggatattattctgtatcaaataaaattgaaggcaaaaatt

SEQ ID NO: 445966 - DNA, 3268 bp, Homo sapiens
gttcacagttgaggaccacacaatgcaaagagattttagatggctgtgggtctacgaaataggctatgcagccgataacagtagaactctgaacgtggattccactgcaatgacactacctatgtctgatccaactgcatgggccacagcaatgaataatcttggaatggcaccgctgggaattgccggacaaccaattttacctgactttgatcctgctcttggaatgatgactggaattccaccaataactccaatgatgcctggtttgggaatagtacctccaccaattcctccagatatgccagtagtaaaagagatcatacactgtaaaagctgcacgctcttccctccaaatccaaatctcccacctcctgcaacccgagaaagaccaccaggatgcaaaacagtatttgtgggtggtctgcctgaaaatgggacagagcaaatcattgtggaagttttcgagcagtgtggagagatcattgccattcgcaagagcaagaagaacttctgccacattcgctttgctgaggagtacatggtggacaaagccctgtatctgtctggttaccgcattcgcctgggctctagtactgacaagaaggacacaggcagactccacgttgatttcgcacaggctcgagatgacctgtatgagtgggagtgtaaacagcgtatgctagccagagaggagcgccatcgtagaagaatggaagaagaaagattgcgtccaccatctccacccccagtggtccactattcagatcatgaatgcagcattgttgctgaaaaattaaaagatgattccaaattctcagaagctgtacagaccttgcttacctggatagagcgaggagaggtcaaccgtcgtagcgccaataacttctactccatgatccagtcggccaacagccatgtccgccgcctggtgaacgagaaagctgcccatgagaaagatatggaagaagcaaaggagaagttcaagcaggccctttctggaattctcattcaatttgagcagatagtggctgtgtaccattccgcctccaagcagaaggcatgggaccacttcacaaaagcccagcggaagaacatcagcgtgtggtgcaaacaagctgaggaaattcgcaacattcataatgatgaattaatgggaatcaggcgagaagaagaaatggaaatgtctgatgatgaaatagaagaaatgacagaaacaaaagaaactgaggaatcagccttagtatcacaggcagaagctctgaaggaagaaaatgacagcctccgttggcagctcgatgcctaccggaatgaagtagaactgctcaagcaagaacaaggcaaagtccacagagaagatgaccctaacaaagaacagcagctgaaactcctgcaacaagccctgcaaggaatgcaacagcatctactcaaagtccaagaggaatacaaaaagaaagaagctgaacttgaaaaactcaaagatgacaagttacaggtggaaaaaatgttggaaaatcttaaagaaaaggaaagctgtgcttctaggctgtgtgcctcaaaccaggatagcgaataccctcttgagaagaccatgaacagcagtcctatcaaatctgaacgtgaagcactgctagtggggattatctccacattccttcatgttcacccatttggagcaagcattgaatacatctgttcctacttgcaccgtcttgataataagatctgcaccagcgatgtggagtgtctcatgggtagactccagcataccttcaagcaggaaatgactggagttggagccagcctggaaaagagatggaaattctgtggcttcgagggcttgaagctgacctaaatctctttgcctaacaacttgggatcctgaagataaatatgtgttggacaagcatagaaagtgatttatatttttaatggttttcaagtggaagttcctttgaatttgtcagttcattcctggaaaatcttttgagttaaaataaggatcctaggacagcacctcgaactacaggccctaaagagaaattgcctcaaaccacaagtgctgtaacttcctcccctttctgtcaattggttgtctttaaatattgcaaaagtcctgatgctaaacagtatttggagtgttttcagtgtctgtactactgttgtagaccttggtatttttttaaacactgttaactgaaatgttttgatgatttgtatgtgatttgtgtttctaaacttctctttacattaatgttgttactggtgaaaggcatgagagcagcactaagtcctctgtgtaactgccattgtctttccaatccccagtagaccagtaaataaataacacatcagtgtcttctagaaggtgcctgaccaggttcaccttttaaacgacaaagcatggtttgtggctttttgcaaaattactatgaaccaaaagttgacaaatgttccaaagttattttctctaacatatcacattaaagatctgtttcagaattgtaaaaagtacatctagatgtgtttacagaaagcaagtatccagtatgactggcatgtgttcatgctattcagaatcacttgtaaatagtctgcttttaaaggagggcatgttcagttttctgtgaattaaaatatgctcatgtgtgggcacacacgcacaaacacacacacgcacgcacacagtggcagaagggatttatattaatattctttcccctctggccttcttacagtctgttggtccctttgcttctgttgtcagtgtgttgaattgcaaaccgagtactgctgtaaatactatgtttacttcatgctgaatgtttgcaaagacttgatataagtattaatagtaatgaatcaatgaataaataatgagctagggtttgtgaggctttctacaaataggtcagctccacctggagtgcgaattgccagagacaccttggtagtgcccatcggcaaatcgcaatggcagcatgtgagtggaccattcagaaacttctgcttggtggaaagtaaacagagaggatggaggtttggggcgaatgtcctgaggcagagatggtctttattgtgtgtggtggtggttgtggtatttataataatgcaagcataccctcccttgagtctcaattgaagataaaagaatgtactgagcaagcaaagccaatggagagtatttcacaaaaatactttgtaaatgagatgccagtagtgttcaaagttgtatttttaaaagataaatattcctttttatacctca

SEQ ID NO: 445967 - DNA, 1340 bp, Homo sapiens
gacccgccctcactcgcgcgttaggaggctcgggtcgttgtggtgcgctgtcttcccgcttgcgtcagggacctgcccgactcagtggccgccatggcatcagatgaaggcaaactttttgttggagggctgagttttgacaccaatgagcagtcgctggagcaggtcttctcaaagtacggacagatctctgaagtggtggttgtgaaagacagggagacccagagatctcggggatttgggtttgtcacctttgagaacattgacgacgctaaggatgccatgatggccatgaatgggaagtctgtagatggacggcagatccgagtagaccaggcaggcaagtcgtcagacaaccgatcccgtgggtaccgtggtggctctgccgggggccggggcttcttccgtgggggccgaggacggggccgtgggttctctagaggaggaggggaccgaggctatggggggaaccggttcgagtccaggagtgggggctacggaggctccagagactactatagcagccggagtcagagtggtggctacagtgaccggagctcgggcgggtcctacagagacagttacgacagttacgctacacacaacgagtaaaaacccttcctgctcaagatcgtccttccaatggctgtgtgtttaaagattgtgggagcttcgctgaacgttaatgtgtagtaaatgcacctccttgtattcccactttcgtagtcatttcggttctgatcttgtcaaacccagcctgaccgcttctgacgccgggatggcctcgttactagacttttctttttaaggaagtgctgtttttttttgagggttttcaaaacattttgaaaagcatttacttttttgaccacgagccatgagttttcaaaaaaatcgggggttgtgtgggtttttggtttttgttttagtttttggttgcgttgcctttttttttttagtggggttggccccatgaagtgggtgccccactcacttctctgagatcgaacggactgtgaatccgctctttgtcggaagctgagcaagctgtggcttttttccaactccgtgtgacgtttctgagtgtagtgtggtaggaccccggcgggtgtggcagcaactgccctggagccccagcccctgcgtccatctgtgctgtgcgccccacagtagacgtgcagacgtccctgagaggttcttgaagatgtttatttatattgtccttttttactggaagacgtacgcatactccatcgatgttgtatttgcagtggctgaggaattcttgtacgcagttttctttggctttacgaagccgattaaaagaccgtgtgaaatga

SEQ ID NO: 445968 - DNA, 1097 bp, Homo sapiens
gacccgccctcactcgcgcgttaggaggctcgggtcgttgtggtgcgctgtcttcccgcttgcgtcagggacctgcccgactcagtggccgccatggcatcagatgaaggcaaactttttgttggagggctgagttttgacaccaatgagcagtcgctggagcaggtcttctcaaagtacggacagatctctgaagtggtggttgtgaaagacagggagacccagagatctcggggatttgggtttgtcacctttgagaacattgacgacgctaaggatgccatgatggccatgaatgggaagtctgtagatggacggcagatccgagtagaccaggcaggcaagtcgtcagacaaccgatcccgtgggtaccgtggtggctctgccgggggccggggcttcttccgtgggggccgaggacggggccgtgggttctctagaggaggaggggaccgaggctatggggggaaccggttcgagtccaggagtgggggctacggaggctccagagactactatagcagccggagtcagagtggtggctacagtgaccggagctcgggcgggtcctacagagacagttacgacagttacggttgaaggggcccggccaggactcggggaagggtggcctgagagcagcgatgacctctggggtcactgtcccaggagggacttcacctggaacaagagctggaggcagccgcttgcccaggaggcttgtcccctgtaagtgctttcgggaagagtggcatgtggcgctgagccctgtcccgggcggcacctgggcgtttcagtgagtcctgctctcccgcacctatggccccacggcgggcgcctttcggtgtgtgttgggtgcagggcagcgcctcccgggagcgccgggtccctcgcctggagcccgcgcctgttctccctcccttcctcctccttccgaggcgcttcgccagtgaggtgcgggctcagggcctcgagtctctcctggagcacgggctgcggtgcgccggcagcttacggggcggccagtccttgcccacaacgatgtggagccctgtgaaagtcggattcgaataaagggccacgtgtgcacccagaaa

SEQ ID NO: 445969 - DNA, 371 bp, Homo sapiens
ccaatcaagagtgagctactcatgattattcagatggaaaccccaattcagcatgaggaaaaaagtttgtgatattgcggcagaactggccaggaatttaatagatgaggatggcaataaagcgatgacctctggggtcactgtcccaggagggacttcacctggaacaagagctggaggcagccgcttgcccaggaggcttgtcccctgaggcgcttcgccagtgaggtgcgggctcagggcctcgagtctctcctggagcacgggctgcggtgcgccggcagcttacggggcggccagtccttgcccacaacgatgtggagccctgtgaaagtcggattcgaataaagggccacgtgtgcacccagaaa

SEQ ID NO: 445970 - DNA, 288 bp, Homo sapiens
tataaaaatttgcctcagagaaggttaatcatgtattcgcaagaagacaaagcttcagttcacatttaagtggtggaaaatgaatccactttcggaccttagaatcgtcttaagtcgaattaacaagaggcgcttcgccagtgaggtgcgggctcagggcctcgagtctctcctggagcacgggctgcggtgcgccggcagcttacggggcggccagtccttgcccacaacgatgtggagccctgtgaaagtcggattcgaataaagggccacgtgtgcacccagaaa

SEQ ID NO: 445971 - DNA, 836 bp, Homo sapiens
tcacggagcccgcacccaggaacccgctcgtagccgccatggcatcagatgaaggcaaactttttgttggagggctgagttttgacaccaatgagcagtcgctggagcaggtcttctcaaagtacggacagatctctgaagtggtggttgtgaaagacagggagacccagagatctcggggatttgggtttgtcacctttgagaacattgacgacgctaaggatgccatgatggccatgaatgggaagtctgtagatggacggcagatccgagtagaccaggcaggcaagtcgtcagacaaccgatcccgtgggtaccgtggtggctctgccgggggccggggcttcttccgtgggggccgaggacggggccgtgggttctctagaggaggaggggaccgaggctatggggggaaccggttcgagtccaggagtgggggctacggaggctccagagactactatagcagccggagtcagagtggtggctacagtgaccggagctcgggcgggtcctacagagacagttacgacagttacggttgaaggggcccggccaggactcggggaagggtggcctgagagcagcgatgacctctggggtcactgtcccaggagggacttcacctggaacaagagctggaggcagccgcttgcccaggaggcttgtcccctgaggcgcttcgccagtgaggtgcgggctcagggcctcgagtctctcctggagcacgggctgcggtgcgccggcagcttacggggcggccagtccttgcccacaacgatgtggagccctgtgaaagtcggattcgaataaagggccacgtgtgcacccagaaa

SEQ ID NO: 445972 - DNA, 2771 bp, Homo sapiens
gacccgccctcactcgcgcgttaggaggctcgggtcgttgtggtgcgctgtcttcccgcttgcgtcagggacctgcccgactcagtggccgccatggcatcagatgaaggcaaactttttgttggagggctgagttttgacaccaatgagcagtcgctggagcaggtcttctcaaagtacggacagatctctgaagtggtggttgtgaaagacagggagacccagagatctcggggatttgggtttgtcacctttgagaacattgacgacgctaaggatgccatgatggccatgaatgggaagtctgtagatggacggcagatccgagtagaccaggcaggcaagtcgtcagacaaccgatcccgtgggtaccgtggtggctctgccgggggccggggcttcttccgtgggggccgaggacggggccgtgggttctctagaggaggaggggaccgaggctatggggggaaccggttcgagtccaggagtgggggctacggaggctccagagactactatagcagccggagtcagagtggtggctacagtgaccggagctcgggcgggtcctacagagacagttacgacagttacgctacacacaacgagtaaaaacccttcctgctcaagatcgtccttccaatggctgtgtgtttaaagattgtgggagcttcgctgaacgttaatgtgtagtaaatgcacctccttgtattcccactttcgtagtcatttcggttctgatcttgtcaaacccagcctgaccgcttctgacgccgggatggcctcgttactagacttttctttttaaggaagtgctgtttttttttgagggttttcaaaacattttgaaaagcatttacttttttgaccacgagccatgagttttcaaaaaaatcgggggttgtgtgggtttttggtttttgttttagtttttggttgcgttgcctttttttttttagtggggttggccccatgaagtgggtgccccactcacttctctgagatcgaacggactgtgaatccgctctttgtcggaagctgagcaagctgtggcttttttccaactccgtgtgacgtttctgagtgtagtgtggtaggaccccggcgggtgtggcagcaactgccctggagccccagcccctgcgtccatctgtgctgtgcgccccacagtagacgtgcagacgtccctgagaggttcttgaagatgtttatttatattgtccttttttactggaagacgtacgcatactccatcgatgttgtatttgcagtggctgaggaattcttgtacgcagttttctttggctttacgaagccgattaaaagaccgtgtgaaatgaaccttgctctgacaattcccttgcattgcaccacacactccttgctgcgggctcctgcagccagacctgagcagagagagaaggtggagaagcagcgggtctgcaagccttccctggggcctgcagagctagaaagggaggcccagcagactggcgctggtcagggtaggggagccaggcgggggacgggagcgggcagctcaggcctcagggcagccctgggaggcttctggcagtggtggccagagggctggactgtgcgggcagcttagcagggacagtggacgtgcacctgacgctgacctggactgcctcagtctagaagcaggccagagagcagaggcacgtggcatcccagggcgacctcagacggccagccggttagctagttctgctgttgcttcacgagttctgagcattctctgctagcctatggaagctgcagccctcggaggacagaagtgttgtgcgcccaacagaaccctctgagacgcaagctgctcccttggctagctcatatgtggaaatagccctgtaattcgaggtaactccttccgctcgtgtccacatccctcttgttgagagctcactgaaagtcatgtgcccggggaatgttcctgtgactgttttttgtttttccttttttttttaactttgtttttgtttttttcaattaagctggaactaaagtcaggcccagccattacgctccccacgtgcagccaggtgcagcctgggcccagtcatgcctggctcatagatgaaatcccttaagcaggattgaagaccagtgaacgcccccgccttttggattttttgctcaattgaccgtcttttccagacctctttaagtcacactcttaacttagctttctctgatgtctgttgccgccattagtttttttctagagcccacactggcccacatagctccatcccatacgggtagctggctccagctgcgccaaggtgcagacccgccctgggcatgctggcctgtgacggagcctgaggtcacagccccctgactagcctgagaccttcctaggggctgtggctgtttccggggaggccgggaggggcagctgtgagccctgtggaggacgttgggagtaacgctgctttgctttggcaggttgaaggggcccggccaggactcggggaagggtggcctgagagcagcgatgacctctggggtcactgtcccaggagggacttcacctggaacaagagctggaggcagccgcttgcccaggaggcttgtcccctgaggcgcttcgccagtgaggtgcgggctcagggcctcgagtctctcctggagcacgggctgcggtgcgccggcagcttacggggcggccagtccttgcccacaacgatgtggagccctgtgaaagtcggattcgaataaagggccacgtgtgcacccagaaa

SEQ ID NO: 445973 - DNA, 2977 bp, Homo sapiens
gacccgccctcactcgcgcgttaggaggctcgggtcgttgtggtgcgctgtcttcccgcttgcgtcagggacctgcccgactcagtggccgccatggcatcagatgaaggcaaactttttgttggagggctgagttttgacaccaatgagcagtcgctggagcaggtcttctcaaagtacggacagatctctgaagtggtggttgtgaaagacagggagacccagagatctcggggatttgggtttgtcacctttgagaacattgacgacgctaaggatgccatgatggccatgaatgggaagtctgtagatggacggcagatccgagtagaccaggcaggcaagtcgtcagacaaccgatcccgtgggtaccgtggtggctctgccgggggccggggcttcttccgtgggggccgaggacggggccgtgggttctctagaggaggaggggaccgaggctatggggggaaccggttcgagtccaggagtgggggctacggaggctccagagactactatagcagccggagtcagagtggtggctacagtgaccggagctcgggcgggtcctacagagacagttacgacagttacgctacacacaacgagtaaaaacccttcctgctcaagatcgtccttccaatggctgtgtgtttaaagattgtgggagcttcgctgaacgttaatgtgtagtaaatgcacctccttgtattcccactttcgtagtcatttcggttctgatcttgtcaaacccagcctgaccgcttctgacgccgggatggcctcgttactagacttttctttttaaggaagtgctgtttttttttgagggttttcaaaacattttgaaaagcatttacttttttgaccacgagccatgagttttcaaaaaaatcgggggttgtgtgggtttttggtttttgttttagtttttggttgcgttgcctttttttttttagtggggttggccccatgaagtgggtgccccactcacttctctgagatcgaacggactgtgaatccgctctttgtcggaagctgagcaagctgtggcttttttccaactccgtgtgacgtttctgagtgtagtgtggtaggaccccggcgggtgtggcagcaactgccctggagccccagcccctgcgtccatctgtgctgtgcgccccacagtagacgtgcagacgtccctgagaggttcttgaagatgtttatttatattgtccttttttactggaagacgtacgcatactccatcgatgttgtatttgcagtggctgaggaattcttgtacgcagttttctttggctttacgaagccgattaaaagaccgtgtgaaatgaaccttgctctgacaattcccttgcattgcaccacacactccttgctgcgggctcctgcagccagacctgagcagagagagaaggtggagaagcagcgggtctgcaagccttccctggggcctgcagagctagaaagggaggcccagcagactggcgctggtcagggtaggggagccaggcgggggacgggagcgggcagctcaggcctcagggcagccctgggaggcttctggcagtggtggccagagggctggactgtgcgggcagcttagcagggacagtggacgtgcacctgacgctgacctggactgcctcagtctagaagcaggccagagagcagaggcacgtggcatcccagggcgacctcagacggccagccggttagctagttctgctgttgcttcacgagttctgagcattctctgctagcctatggaagctgcagccctcggaggacagaagtgttgtgcgcccaacagaaccctctgagacgcaagctgctcccttggctagctcatatgtggaaatagccctgtaattcgaggtaactccttccgctcgtgtccacatccctcttgttgagagctcactgaaagtcatgtgcccggggaatgttcctgtgactgttttttgtttttccttttttttttaactttgtttttgtttttttcaattaagctggaactaaagtcaggcccagccattacgctccccacgtgcagccaggtgcagcctgggcccagtcatgcctggctcatagatgaaatcccttaagcaggattgaagaccagtgaacgcccccgccttttggattttttgctcaattgaccgtcttttccagacctctttaagtcacactcttaacttagctttctctgatgtctgttgccgccattagtttttttctagagcccacactggcccacatagctccatcccatacgggtagctggctccagctgcgccaaggtgcagacccgccctgggcatgctggcctgtgacggagcctgaggtcacagccccctgactagcctgagaccttcctaggggctgtggctgtttccggggaggccgggaggggcagctgtgagccctgtggaggacgttgggagtaacgctgctttgctttggcaggttgaaggggcccggccaggactcggggaagggtggcctgagagcagcgatgacctctggggtcactgtcccaggagggacttcacctggaacaagagctggaggcagccgcttgcccaggaggcttgtcccctgtaagtgctttcgggaagagtggcatgtggcgctgagccctgtcccgggcggcacctgggcgtttcagtgagtcctgctctcccgcacctatggccccacggcgggcgcctttcggtgtgtgttgggtgcagggcagcgcctcccgggagcgccgggtccctcgcctggagcccgcgcctgttctccctcccttcctcctccttccgaggcgcttcgccagtgaggtgcgggctcagggcctcgagtctctcctggagcacgggctgcggtgcgccggcagcttacggggcggccagtccttgcccacaacgatgtggagccctgtgaaagtcggattcgaataaagggccacgtgtgcacccagaaa

SEQ ID NO: 445974 - DNA, 3625 bp, Homo sapiens
gacccgccctcactcgcgcgttaggaggctcgggtcgttgtggtgcgctgtcttcccgcttgcgtcagggacctgcccgactcagtggccgccatggcatcagatgaaggcaaactttttgttggagggctgagttttgacaccaatgagcagtcgctggagcaggtcttctcaaagtacggacagatctctgaagtggtggttgtgaaagacagggagacccagagatctcggggatttgggtttgtcacctttgagaacattgacgacgctaaggatgccatgatggccatgaatgggaagtctgtagatggacggcagatccgagtagaccaggcaggcaagtcgtcagacaaccgatcccgtgggtaccgtggtggctctgccgggggccggggcttcttccgtgggggccgaggacggggccgtgggttctctagaggaggaggggaccgaggctatggggggaaccggttcgagtccaggagtgggggctacggaggctccagagactactatagcagccggagtcagagtggtggctacagtgaccggagctcgggcgggtcctacagagacagttacgacagttacgctacacacaacgagtaaaaacccttcctgctcaagatcgtccttccaatggctgtgtgtttaaagattgtgggagcttcgctgaacgttaatgtgtagtaaatgcacctccttgtattcccactttcgtagtcatttcggttctgatcttgtcaaacccagcctgaccgcttctgacgccgggatggcctcgttactagacttttctttttaaggaagtgctgtttttttttgagggttttcaaaacattttgaaaagcatttacttttttgaccacgagccatgagttttcaaaaaaatcgggggttgtgtgggtttttggtttttgttttagtttttggttgcgttgcctttttttttttagtggggttggccccatgaagtgggtgccccactcacttctctgagatcgaacggactgtgaatccgctctttgtcggaagctgagcaagctgtggcttttttccaactccgtgtgacgtttctgagtgtagtgtggtaggaccccggcgggtgtggcagcaactgccctggagccccagcccctgcgtccatctgtgctgtgcgccccacagtagacgtgcagacgtccctgagaggttcttgaagatgtttatttatattgtccttttttactggaagacgtacgcatactccatcgatgttgtatttgcagtggctgaggaattcttgtacgcagttttctttggctttacgaagccgattaaaagaccgtgtgaaatgaaccttgctctgacaattcccttgcattgcaccacacactccttgctgcgggctcctgcagccagacctgagcagagagagaaggtggagaagcagcgggtctgcaagccttccctggggcctgcagagctagaaagggaggcccagcagactggcgctggtcagggtaggggagccaggcgggggacgggagcgggcagctcaggcctcagggcagccctgggaggcttctggcagtggtggccagagggctggactgtgcgggcagcttagcagggacagtggacgtgcacctgacgctgacctggactgcctcagtctagaagcaggccagagagcagaggcacgtggcatcccagggcgacctcagacggccagccggttagctagttctgctgttgcttcacgagttctgagcattctctgctagcctatggaagctgcagccctcggaggacagaagtgttgtgcgcccaacagaaccctctgagacgcaagctgctcccttggctagctcatatgtggaaatagccctgtaattcgaggtaactccttccgctcgtgtccacatccctcttgttgagagctcactgaaagtcatgtgcccggggaatgttcctgtgactgttttttgtttttccttttttttttaactttgtttttgtttttttcaattaagctggaactaaagtcaggcccagccattacgctccccacgtgcagccaggtgcagcctgggcccagtcatgcctggctcatagatgaaatcccttaagcaggattgaagaccagtgaacgcccccgccttttggattttttgctcaattgaccgtcttttccagacctctttaagtcacactcttaacttagctttctctgatgtctgttgccgccattagtttttttctagagcccacactggcccacatagctccatcccatacgggtagctggctccagctgcgccaaggtgcagacccgccctgggcatgctggcctgtgacggagcctgaggtcacagccccctgactagcctgagaccttcctaggggctgtggctgtttccggggaggccgggaggggcagctgtgagccctgtggaggacgttgggagtaacgctgctttgctttggcaggttgaaggggcccggccaggactcggggaagggtggcctgagagcagcgatgacctctggggtcactgtcccaggagggacttcacctggaacaagagctggaggcagccgcttgcccaggaggcttgtcccctgtaagtgctttcgggaagagtggcatgtggcgctgagccctgtcccgggcggcacctgggcgtttcagtgagtcctgctctcccgcacctatggccccacggcgggcgcctttcggtgtgtgttgggtgcagggcagcgcctcccgggagcgccgggtccctcgcctggagcccgcgcctgttctccctcccttcctcctccttccgaggcgcttcgccagtgaggtgcgggctcagggcctcgagtctctcctggagcacgggctgcggtgcgccggcagcttacggggcggccagtccttgcccacaacgatgtggagccctgtgaaagtcggattcgaataaagggccacgtgtgcacccagaaagccgagtctgtggttcaggggggtctgtcggcggagcggggccactggaagaaaagcctgcggacctcggttcagcgcacgagtaggacccgacagggaagactgcaagggtcattgtccgagcagtgaccgcggggggctcgccactgagggggttcgcagcgcggagactccagtctcgcgggatctgaggcgcactcggcttcgagggagcggcggccgcgcagccgctgtcaggccccgtcttgggccgagtcccgggttccctgtagcaggcttgggagcggggcgccaccttcctgggccctggacgtggccgacgcgttctcagtgtccgtgaggccggggcaggagtggcgggggtcgccccgaagtgggtgggaatgagcggcccgaggtcctgaagtcggggtccgccccgtctccccgctgccagcccgatttcctcggaagccgcgaccccccacgctgggctggcagttctgggctctgccggctgcgccttgccgggactcccacgggcgggctccgggcctccgtcctgatcccttggagcggttcgacgaagcaagttccgcggcgggcgcgcggggcactgtgggtagcgccggggctcaccaggcggaggcggggcccggcgtcaagctc

SEQ ID NO: 445975 - DNA, 2263 bp, Homo sapiens
  misc_feature (2223)..(2223): n is a, c, g, or t
gacccgccctcactcgcgcgttaggaggctcgggtcgttgtggtgcgctgtcttcccgcttgcgtcagggacctgcccgactcagtggccgccatggcatcagatgaaggcaaactttttgttggagggctgagttttgacaccaatgagcagtcgctggagcaggtcttctcaaagtacggacagatctctgaagtggtggttgtgaaagacagggagacccagagatctcggggatttgggtttgtcacctttgagaacattgacgacgctaaggatgccatgatggccatgaatgggaagtctgtagatggacggcagatccgagtagaccaggcaggcaagtcgtcagacaaccgatcccgtgggtaccgtggtggctctgccgggggccggggcttcttccgtgggggccgaggacggggccgtgggttctctagaggaggaggggaccgaggctatggggggaaccggttcgagtccaggagtgggggctacggaggctccagagactactatagcagccggagtcagagtggtggctacagtgaccggagctcgggcgggtcctacagagacagttacgacagttacgctacacacaacgagtaaaaacccttcctgctcaagatcgtccttccaatggctgtgtgtttaaagattgtgggagcttcgctgaacgttaatgtgtagtaaatgcacctccttgtattcccactttcgtagtcatttcggttctgatcttgtcaaacccagcctgaccgcttctgacgccgggatggcctcgttactagacttttctttttaaggaagtgctgtttttttttgagggttttcaaaacattttgaaaagcatttacttttttgaccacgagccatgagttttcaaaaaaatcgggggttgtgtgggtttttggtttttgttttagtttttggttgcgttgcctttttttttttagtggggttggccccatgaagtgggtgccccactcacttctctgagatcgaacggactgtgaatccgctctttgtcggaagctgagcaagctgtggcttttttccaactccgtgtgacgtttctgagtgtagtgtggtaggaccccggcgggtgtggcagcaactgccctggagccccagcccctgcgtccatctgtgctgtgcgccccacagtagacgtgcagacgtccctgagaggttcttgaagatgtttatttatattgtccttttttactggaagacgtacgcatactccatcgatgttgtatttgcagtggctgaggaattcttgtacgcagttttctttggctttacgaagccgattaaaagaccgtgtgaaatgaaccttgctctgacaattcccttgcattgcaccacacactccttgctgcgggctcctgcagccagacctgagcagagagagaaggtggagaagcagcgggtctgcaagccttccctggggcctgcagagctagaaagggaggcccagcagactggcgctggtcagggtaggggagccaggcgggggacgggagcgggcagctcaggcctcagggcagccctgggaggcttctggcagtggtggccagagggctggactgtgcgggcagcttagcagggacagtggacgtgcacctgacgctgacctggactgcctcagtctagaagcaggccagagagcagaggcacgtggcatcccagggcgacctcagacggccagccggttagctagttctgctgttgcttcacgagttctgagcattctctgctagcctatggaagctgcagccctcggaggacagaagtgttgtgcgcccaacagaaccctctgagacgcaagctgctcccttggctagctcatatgtggaaatagccctgtaattcgaggtaactccttccgctcgtgtccacatccctcttgttgagagctcactgaaagtcatgtgcccggggaatgttcctgtgactgttttttgtttttccttttttttttaactttgtttttgtttttttcaattaagctggaactaaagtcaggcccagccattacgctccccacgtgcagccaggtgcagcctgggcccagtcatgcctggctcatagatgaaatcccttaagcaggattgaagaccagtgaacgcccccgccttttggattttttgctcaattgaccgtcttttccagacctctttaagtcacactcttaacttagctttctctgatgtnagtgcccgccaatcgaagggtcctctagctcggacagcag

SEQ ID NO: 445976 - DNA, 2180 bp, Homo sapiens
gacccgccctcactcgcgcgttaggaggctcgggtcgttgtggtgcgctgtcttcccgcttgcgtcagggacctgcccgactcagtggccgccatggcatcagatgaaggcaaactttttgttggagggctgagttttgacaccaatgagcagtcgctggagcaggtcttctcaaagtacggacagatctctgaagtggtggttgtgaaagacagggagacccagagatctcggggatttgggtttgtcacctttgagaacattgacgacgctaaggatgccatgatggccatgaatgggaagtctgtagatggacggcagatccgagtagaccaggcaggcaagtcgtcagacaaccgatcccgtgggtaccgtggtggctctgccgggggccggggcttcttccgtgggggccgaggacggggccgtgggttctctagaggaggaggggaccgaggctatggggggaaccggttcgagtccaggagtgggggctacggaggctccagagactactatagcagccggagtcagagtggtggctacagtgaccggagctcgggcgggtcctacagagacagttacgacagttacgctacacacaacgagtaaaaacccttcctgctcaagatcgtccttccaatggctgtgtgtttaaagattgtgggagcttcgctgaacgttaatgtgtagtaaatgcacctccttgtattcccactttcgtagtcatttcggttctgatcttgtcaaacccagcctgaccgcttctgacgccgggatggcctcgttactagacttttctttttaaggaagtgctgtttttttttgagggttttcaaaacattttgaaaagcatttacttttttgaccacgagccatgagttttcaaaaaaatcgggggttgtgtgggtttttggtttttgttttagtttttggttgcgttgcctttttttttttagtggggttggccccatgaagtgggtgccccactcacttctctgagatcgaacggactgtgaatccgctctttgtcggaagctgagcaagctgtggcttttttccaactccgtgtgacgtttctgagtgtagtgtggtaggaccccggcgggtgtggcagcaactgccctggagccccagcccctgcgtccatctgtgctgtgcgccccacagtagacgtgcagacgtccctgagaggttcttgaagatgtttatttatattgtccttttttactggaagacgtacgcatactccatcgatgttgtatttgcagtggctgaggaattcttgtacgcagttttctttggctttacgaagccgattaaaagaccgtgtgaaatgaaccttgctctgacaattcccttgcattgcaccacacactccttgctgcgggctcctgcagccagacctgagcagagagagaaggtggagaagcagcgggtctgcaagccttccctggggcctgcagagctagaaagggaggcccagcagactggcgctggtcagggtaggggagccaggcgggggacgggagcgggcagctcaggcctcagggcagccctgggaggcttctggcagtggtggccagagggctggactgtgcgggcagcttagcagggacagtggacgtgcacctgacgctgacctggactgcctcagtctagaagcaggccagagagcagaggcacgtggcatcccagggcgacctcagacggccagccggttagctagttctgctgttgcttcacgagttctgagcattctctgctagcctatggaagctgcagccctcggaggacagaagtgttgtgcgcccaacagaaccctctgagacgcaagctgctcccttggctagctcatatgtggaaatagccctgtaattcgaggttgaaggggcccggccaggactcggggaagggtggcctgagagcagcgatgacctctggggtcactgtcccaggagggacttcacctggaacaagagctggaggcagccgcttgcccaggaggcttgtcccctgaggcgcttcgccagtgaggtgcgggctcagggcctcgagtctctcctggagcacgggctgcggtgcgccggcagcttacggggcggccagtccttgcccacaacgatgtggagccctgtgaaagtcggattcgaataaagggccacgtgtgcacccagaaa

SEQ ID NO: 445977 - DNA, 1453 bp, Homo sapiens
gacccgccctcactcgcgcgttaggaggctcgggtcgttgtggtgcgctgtcttcccgcttgcgtcagggacctgcccgactcagtggccgccatggcatcagatgaaggcaaactttttgttggagggctgagttttgacaccaatgagcagtcgctggagcaggtcttctcaaagtacggacagatctctgaagtggtggttgtgaaagacagggagacccagagatctcggggatttgggtttgtcacctttgagaacattgacgacgctaaggatgccatgatggccatgaatgggaagtctgtagatggacggcagatccgagtagaccaggcaggcaagtcgtcagacaaccgatcccgtgggtaccgtggtggctctgccgggggccggggcttcttccgtgggggccgaggacggggccgtgggttctctagaggaggaggggaccgaggctatggggggaaccggttcgagtccaggagtgggggctacggaggctccagagactactatagcagccggagtcagagtggtggctacagtgaccggagctcgggcgggtcctacagagacagttacgacagttacgctacacacaacgagtaaaaacccttcctgctcaagatcgtccttccaatggctgtgtgtttaaagattgtgggagcttcgctgaacgttaatgtgtagtaaatgcacctccttgtattcccactttcgtagtcatttcggttctgatcttgtcaaacccagcctgaccgcttctgacgccgggatggcctcgttactagacttttctttttaaggaagtgctgtttttttttgagggttttcaaaacattttgaaaagcatttacttttttgaccacgagccatgagttttcaaaaaaatcgggggttgtgtgggtttttggtttttgttttagtttttggttgcgttgcctttttttttttagtggggttggccccatgaagtgggtgccccactcacttctctgagatcgaacggactgtgaatccgctctttgtcggaagctgagcaagctgtggcttttttccaactccgtgtgacgtttctgagtgtagtgtggtaggaccccggcgggtgtggcagcaactgccctggagccccagcccctgcgtccatctgtgctgtgcgccccacagtagacgtgcagacgtccctgagaggttcttgaagcgatgacctctggggtcactgtcccaggagggacttcacctggaacaagagctggaggcagccgcttgcccaggaggcttgtcccctgaggcgcttcgccagtgaggtgcgggctcagggcctcgagtctctcctggagcacgggctgcggtgcgccggcagcttacggggcggccagtccttgcccacaacgatgtggagccctgtgaaagtcggattcgaataaagggccacgtgtgcacccagaaa

SEQ ID NO: 445978 - DNA, 2831 bp, Homo sapiens
gacccgccctcactcgcgcgttaggaggctcgggtcgttgtggtgcgctgtcttcccgcttgcgtcagggacctgcccgactcagtggaagcggggagaggtggtgagagatgacccctgttgaggatttcattggtgtctgccacagccgccatggcatcagatgaaggcaaactttttgttggagggctgagttttgacaccaatgagcagtcgctggagcaggtcttctcaaagtacggacagatctctgaagtggtggttgtgaaagacagggagacccagagatctcggggatttgggtttgtcacctttgagaacattgacgacgctaaggatgccatgatggccatgaatgggaagtctgtagatggacggcagatccgagtagaccaggcaggcaagtcgtcagacaaccgatcccgtgggtaccgtggtggctctgccgggggccggggcttcttccgtgggggccgaggacggggccgtgggttctctagaggaggaggggaccgaggctatggggggaaccggttcgagtccaggagtgggggctacggaggctccagagactactatagcagccggagtcagagtggtggctacagtgaccggagctcgggcgggtcctacagagacagttacgacagttacgctacacacaacgagtaaaaacccttcctgctcaagatcgtccttccaatggctgtgtgtttaaagattgtgggagcttcgctgaacgttaatgtgtagtaaatgcacctccttgtattcccactttcgtagtcatttcggttctgatcttgtcaaacccagcctgaccgcttctgacgccgggatggcctcgttactagacttttctttttaaggaagtgctgtttttttttgagggttttcaaaacattttgaaaagcatttacttttttgaccacgagccatgagttttcaaaaaaatcgggggttgtgtgggtttttggtttttgttttagtttttggttgcgttgcctttttttttttagtggggttggccccatgaagtgggtgccccactcacttctctgagatcgaacggactgtgaatccgctctttgtcggaagctgagcaagctgtggcttttttccaactccgtgtgacgtttctgagtgtagtgtggtaggaccccggcgggtgtggcagcaactgccctggagccccagcccctgcgtccatctgtgctgtgcgccccacagtagacgtgcagacgtccctgagaggttcttgaagatgtttatttatattgtccttttttactggaagacgtacgcatactccatcgatgttgtatttgcagtggctgaggaattcttgtacgcagttttctttggctttacgaagccgattaaaagaccgtgtgaaatgaaccttgctctgacaattcccttgcattgcaccacacactccttgctgcgggctcctgcagccagacctgagcagagagagaaggtggagaagcagcgggtctgcaagccttccctggggcctgcagagctagaaagggaggcccagcagactggcgctggtcagggtaggggagccaggcgggggacgggagcgggcagctcaggcctcagggcagccctgggaggcttctggcagtggtggccagagggctggactgtgcgggcagcttagcagggacagtggacgtgcacctgacgctgacctggactgcctcagtctagaagcaggccagagagcagaggcacgtggcatcccagggcgacctcagacggccagccggttagctagttctgctgttgcttcacgagttctgagcattctctgctagcctatggaagctgcagccctcggaggacagaagtgttgtgcgcccaacagaaccctctgagacgcaagctgctcccttggctagctcatatgtggaaatagccctgtaattcgaggtaactccttccgctcgtgtccacatccctcttgttgagagctcactgaaagtcatgtgcccggggaatgttcctgtgactgttttttgtttttccttttttttttaactttgtttttgtttttttcaattaagctggaactaaagtcaggcccagccattacgctccccacgtgcagccaggtgcagcctgggcccagtcatgcctggctcatagatgaaatcccttaagcaggattgaagaccagtgaacgcccccgccttttggattttttgctcaattgaccgtcttttccagacctctttaagtcacactcttaacttagctttctctgatgtctgttgccgccattagtttttttctagagcccacactggcccacatagctccatcccatacgggtagctggctccagctgcgccaaggtgcagacccgccctgggcatgctggcctgtgacggagcctgaggtcacagccccctgactagcctgagaccttcctaggggctgtggctgtttccggggaggccgggaggggcagctgtgagccctgtggaggacgttgggagtaacgctgctttgctttggcaggttgaaggggcccggccaggactcggggaagggtggcctgagagcagcgatgacctctggggtcactgtcccaggagggacttcacctggaacaagagctggaggcagccgcttgcccaggaggcttgtcccctgaggcgcttcgccagtgaggtgcgggctcagggcctcgagtctctcctggagcacgggctgcggtgcgccggcagcttacggggcggccagtccttgcccacaacgatgtggagccctgtgaaagtcggattcgaataaagggccacgtgtgcacccagaaa

SEQ ID NO: 445979 - DNA, 2790 bp, Homo sapiens
atgaaggggtcccagccgcctgagacccccggtggggacacaggatcgcggtgagatacctgggagtcacgggtgctcgcagacgcagctgaccccagaggcacaggccgccatggcatcagatgaaggcaaactttttgttggagggctgagttttgacaccaatgagcagtcgctggagcaggtcttctcaaagtacggacagatctctgaagtggtggttgtgaaagacagggagacccagagatctcggggatttgggtttgtcacctttgagaacattgacgacgctaaggatgccatgatggccatgaatgggaagtctgtagatggacggcagatccgagtagaccaggcaggcaagtcgtcagacaaccgatcccgtgggtaccgtggtggctctgccgggggccggggcttcttccgtgggggccgaggacggggccgtgggttctctagaggaggaggggaccgaggctatggggggaaccggttcgagtccaggagtgggggctacggaggctccagagactactatagcagccggagtcagagtggtggctacagtgaccggagctcgggcgggtcctacagagacagttacgacagttacgctacacacaacgagtaaaaacccttcctgctcaagatcgtccttccaatggctgtgtgtttaaagattgtgggagcttcgctgaacgttaatgtgtagtaaatgcacctccttgtattcccactttcgtagtcatttcggttctgatcttgtcaaacccagcctgaccgcttctgacgccgggatggcctcgttactagacttttctttttaaggaagtgctgtttttttttgagggttttcaaaacattttgaaaagcatttacttttttgaccacgagccatgagttttcaaaaaaatcgggggttgtgtgggtttttggtttttgttttagtttttggttgcgttgcctttttttttttagtggggttggccccatgaagtgggtgccccactcacttctctgagatcgaacggactgtgaatccgctctttgtcggaagctgagcaagctgtggcttttttccaactccgtgtgacgtttctgagtgtagtgtggtaggaccccggcgggtgtggcagcaactgccctggagccccagcccctgcgtccatctgtgctgtgcgccccacagtagacgtgcagacgtccctgagaggttcttgaagatgtttatttatattgtccttttttactggaagacgtacgcatactccatcgatgttgtatttgcagtggctgaggaattcttgtacgcagttttctttggctttacgaagccgattaaaagaccgtgtgaaatgaaccttgctctgacaattcccttgcattgcaccacacactccttgctgcgggctcctgcagccagacctgagcagagagagaaggtggagaagcagcgggtctgcaagccttccctggggcctgcagagctagaaagggaggcccagcagactggcgctggtcagggtaggggagccaggcgggggacgggagcgggcagctcaggcctcagggcagccctgggaggcttctggcagtggtggccagagggctggactgtgcgggcagcttagcagggacagtggacgtgcacctgacgctgacctggactgcctcagtctagaagcaggccagagagcagaggcacgtggcatcccagggcgacctcagacggccagccggttagctagttctgctgttgcttcacgagttctgagcattctctgctagcctatggaagctgcagccctcggaggacagaagtgttgtgcgcccaacagaaccctctgagacgcaagctgctcccttggctagctcatatgtggaaatagccctgtaattcgaggtaactccttccgctcgtgtccacatccctcttgttgagagctcactgaaagtcatgtgcccggggaatgttcctgtgactgttttttgtttttccttttttttttaactttgtttttgtttttttcaattaagctggaactaaagtcaggcccagccattacgctccccacgtgcagccaggtgcagcctgggcccagtcatgcctggctcatagatgaaatcccttaagcaggattgaagaccagtgaacgcccccgccttttggattttttgctcaattgaccgtcttttccagacctctttaagtcacactcttaacttagctttctctgatgtctgttgccgccattagtttttttctagagcccacactggcccacatagctccatcccatacgggtagctggctccagctgcgccaaggtgcagacccgccctgggcatgctggcctgtgacggagcctgaggtcacagccccctgactagcctgagaccttcctaggggctgtggctgtttccggggaggccgggaggggcagctgtgagccctgtggaggacgttgggagtaacgctgctttgctttggcaggttgaaggggcccggccaggactcggggaagggtggcctgagagcagcgatgacctctggggtcactgtcccaggagggacttcacctggaacaagagctggaggcagccgcttgcccaggaggcttgtcccctgaggcgcttcgccagtgaggtgcgggctcagggcctcgagtctctcctggagcacgggctgcggtgcgccggcagcttacggggcggccagtccttgcccacaacgatgtggagccctgtgaaagtcggattcgaataaagggccacgtgtgcacccagaaa

SEQ ID NO: 445980 - DNA, 3078 bp, Homo sapiens
gacccgccctcactcgcgcgttaggaggctcgggtcgttgtggtgcgctgtcttcccgcttgcgtcagggacctgcccgactcagtggccgccatggcatcagatgaaggcaaactttttgttggagggctgagttttgacaccaatgagcagtcgctggagcaggtcttctcaaagtacggacagatctctgaagtggtggttgtgaaagacagggagacccagagatctcggggatttgggtttgtcacctttgagaacattgacgacgctaaggatgccatgatggccatgaatgggaagtctgtagatggacggcagatccgagtagaccaggcaggcaagtcgtcagacaaccgatcccgtgggtaccgtggtggctctgccgggggccggggcttcttccgtgggggccgaggacggggccgtgggttctctagaggaggaggggaccgaggctatggggggaaccggttcgagtccaggagtgggggctacggaggctccagagactactatagcagccggagtcagagtggtggctacagtgaccggagctcgggcgggtcctacagagacagttacgacagttacggtaagtcacactccgagggcgccacgctgctgtggcctgcggtgggagctcggttcaccttggtgccctctccaagcactttaggctggacactcagaccttgtcactgtgcttgcccagaagaggcgcatctgtcctctcagagccatttctatcgcaggacgcaaaagccaaatgagactgaccaaaaaggcaagggagagcgagggcccgctgggcagtcagctaggtgcatgtgtggcctctggggtgaagctgcctcttgttgcttcggtgcctttacactgtgcctgcttcttgtcctcagctacacacaacgagtaaaaacccttcctgctcaagatcgtccttccaatggctgtgtgtttaaagattgtgggagcttcgctgaacgttaatgtgtagtaaatgcacctccttgtattcccactttcgtagtcatttcggttctgatcttgtcaaacccagcctgaccgcttctgacgccgggatggcctcgttactagacttttctttttaaggaagtgctgtttttttttgagggttttcaaaacattttgaaaagcatttacttttttgaccacgagccatgagttttcaaaaaaatcgggggttgtgtgggtttttggtttttgttttagtttttggttgcgttgcctttttttttttagtggggttggccccatgaagtgggtgccccactcacttctctgagatcgaacggactgtgaatccgctctttgtcggaagctgagcaagctgtggcttttttccaactccgtgtgacgtttctgagtgtagtgtggtaggaccccggcgggtgtggcagcaactgccctggagccccagcccctgcgtccatctgtgctgtgcgccccacagtagacgtgcagacgtccctgagaggttcttgaagatgtttatttatattgtccttttttactggaagacgtacgcatactccatcgatgttgtatttgcagtggctgaggaattcttgtacgcagttttctttggctttacgaagccgattaaaagaccgtgtgaaatgaaccttgctctgacaattcccttgcattgcaccacacactccttgctgcgggctcctgcagccagacctgagcagagagagaaggtggagaagcagcgggtctgcaagccttccctggggcctgcagagctagaaagggaggcccagcagactggcgctggtcagggtaggggagccaggcgggggacgggagcgggcagctcaggcctcagggcagccctgggaggcttctggcagtggtggccagagggctggactgtgcgggcagcttagcagggacagtggacgtgcacctgacgctgacctggactgcctcagtctagaagcaggccagagagcagaggcacgtggcatcccagggcgacctcagacggccagccggttagctagttctgctgttgcttcacgagttctgagcattctctgctagcctatggaagctgcagccctcggaggacagaagtgttgtgcgcccaacagaaccctctgagacgcaagctgctcccttggctagctcatatgtggaaatagccctgtaattcgaggtaactccttccgctcgtgtccacatccctcttgttgagagctcactgaaagtcatgtgcccggggaatgttcctgtgactgttttttgtttttccttttttttttaactttgtttttgtttttttcaattaagctggaactaaagtcaggcccagccattacgctccccacgtgcagccaggtgcagcctgggcccagtcatgcctggctcatagatgaaatcccttaagcaggattgaagaccagtgaacgcccccgccttttggattttttgctcaattgaccgtcttttccagacctctttaagtcacactcttaacttagctttctctgatgtctgttgccgccattagtttttttctagagcccacactggcccacatagctccatcccatacgggtagctggctccagctgcgccaaggtgcagacccgccctgggcatgctggcctgtgacggagcctgaggtcacagccccctgactagcctgagaccttcctaggggctgtggctgtttccggggaggccgggaggggcagctgtgagccctgtggaggacgttgggagtaacgctgctttgctttggcaggttgaaggggcccggccaggactcggggaagggtggcctgagagcagcgatgacctctggggtcactgtcccaggagggacttcacctggaacaagagctggaggcagccgcttgcccaggaggcttgtcccctgaggcgcttcgccagtgaggtgcgggctcagggcctcgagtctctcctggagcacgggctgcggtgcgccggcagcttacggggcggccagtccttgcccacaacgatgtggagccctgtgaaagtcggattcgaataaagggccacgtgtgcacccagaaa

SEQ ID NO: 445981 - DNA, 2853 bp, Homo sapiens
gacccgccctcactcgcgcgttaggaggctcgggtcgttgtggtgcgctgtcttcccgcttgcgtcagggacctgcccgactcagtggccgccatggcatcagatgaaggcaaactttttgttggagggctgagttttgacaccaatgagcagtcgctggagcaggtcttctcaaagtacggacagatctctgaagtggtggttgtgaaagacagggagacccagagatctcggggatttgggtttgtcacctttgagaacattgacgacgctaaggatgccatgatggccatgaatgggaaggtgaggatcagggtgctgagcaggagtctcgtctcgaggatggggcacccacctgctaacccgtcccgccctctgtctccagtctgtagatggacggcagatccgagtagaccaggcaggcaagtcgtcagacaaccgatcccgtgggtaccgtggtggctctgccgggggccggggcttcttccgtgggggccgaggacggggccgtgggttctctagaggaggaggggaccgaggctatggggggaaccggttcgagtccaggagtgggggctacggaggctccagagactactatagcagccggagtcagagtggtggctacagtgaccggagctcgggcgggtcctacagagacagttacgacagttacgctacacacaacgagtaaaaacccttcctgctcaagatcgtccttccaatggctgtgtgtttaaagattgtgggagcttcgctgaacgttaatgtgtagtaaatgcacctccttgtattcccactttcgtagtcatttcggttctgatcttgtcaaacccagcctgaccgcttctgacgccgggatggcctcgttactagacttttctttttaaggaagtgctgtttttttttgagggttttcaaaacattttgaaaagcatttacttttttgaccacgagccatgagttttcaaaaaaatcgggggttgtgtgggtttttggtttttgttttagtttttggttgcgttgcctttttttttttagtggggttggccccatgaagtgggtgccccactcacttctctgagatcgaacggactgtgaatccgctctttgtcggaagctgagcaagctgtggcttttttccaactccgtgtgacgtttctgagtgtagtgtggtaggaccccggcgggtgtggcagcaactgccctggagccccagcccctgcgtccatctgtgctgtgcgccccacagtagacgtgcagacgtccctgagaggttcttgaagatgtttatttatattgtccttttttactggaagacgtacgcatactccatcgatgttgtatttgcagtggctgaggaattcttgtacgcagttttctttggctttacgaagccgattaaaagaccgtgtgaaatgaaccttgctctgacaattcccttgcattgcaccacacactccttgctgcgggctcctgcagccagacctgagcagagagagaaggtggagaagcagcgggtctgcaagccttccctggggcctgcagagctagaaagggaggcccagcagactggcgctggtcagggtaggggagccaggcgggggacgggagcgggcagctcaggcctcagggcagccctgggaggcttctggcagtggtggccagagggctggactgtgcgggcagcttagcagggacagtggacgtgcacctgacgctgacctggactgcctcagtctagaagcaggccagagagcagaggcacgtggcatcccagggcgacctcagacggccagccggttagctagttctgctgttgcttcacgagttctgagcattctctgctagcctatggaagctgcagccctcggaggacagaagtgttgtgcgcccaacagaaccctctgagacgcaagctgctcccttggctagctcatatgtggaaatagccctgtaattcgaggtaactccttccgctcgtgtccacatccctcttgttgagagctcactgaaagtcatgtgcccggggaatgttcctgtgactgttttttgtttttccttttttttttaactttgtttttgtttttttcaattaagctggaactaaagtcaggcccagccattacgctccccacgtgcagccaggtgcagcctgggcccagtcatgcctggctcatagatgaaatcccttaagcaggattgaagaccagtgaacgcccccgccttttggattttttgctcaattgaccgtcttttccagacctctttaagtcacactcttaacttagctttctctgatgtctgttgccgccattagtttttttctagagcccacactggcccacatagctccatcccatacgggtagctggctccagctgcgccaaggtgcagacccgccctgggcatgctggcctgtgacggagcctgaggtcacagccccctgactagcctgagaccttcctaggggctgtggctgtttccggggaggccgggaggggcagctgtgagccctgtggaggacgttgggagtaacgctgctttgctttggcaggttgaaggggcccggccaggactcggggaagggtggcctgagagcagcgatgacctctggggtcactgtcccaggagggacttcacctggaacaagagctggaggcagccgcttgcccaggaggcttgtcccctgaggcgcttcgccagtgaggtgcgggctcagggcctcgagtctctcctggagcacgggctgcggtgcgccggcagcttacggggcggccagtccttgcccacaacgatgtggagccctgtgaaagtcggattcgaataaagggccacgtgtgcacccagaaa

SEQ ID NO: 445982 - DNA, 2453 bp, Homo sapiens
agtcatgggcaacgcatcgttcaggaacagaacgcggaaatccgcaggtggtggcgtggtggctctgccgggggccggggcttcttccgtgggggccgaggacggggccgtgggttctctagaggaggaggggaccgaggctatggggggaaccggttcgagtccaggagtgggggctacggaggctccagagactactatagcagccggagtcagagtggtggctacagtgaccggagctcgggcgggtcctacagagacagttacgacagttacgctacacacaacgagtaaaaacccttcctgctcaagatcgtccttccaatggctgtgtgtttaaagattgtgggagcttcgctgaacgttaatgtgtagtaaatgcacctccttgtattcccactttcgtagtcatttcggttctgatcttgtcaaacccagcctgaccgcttctgacgccgggatggcctcgttactagacttttctttttaaggaagtgctgtttttttttgagggttttcaaaacattttgaaaagcatttacttttttgaccacgagccatgagttttcaaaaaaatcgggggttgtgtgggtttttggtttttgttttagtttttggttgcgttgcctttttttttttagtggggttggccccatgaagtgggtgccccactcacttctctgagatcgaacggactgtgaatccgctctttgtcggaagctgagcaagctgtggcttttttccaactccgtgtgacgtttctgagtgtagtgtggtaggaccccggcgggtgtggcagcaactgccctggagccccagcccctgcgtccatctgtgctgtgcgccccacagtagacgtgcagacgtccctgagaggttcttgaagatgtttatttatattgtccttttttactggaagacgtacgcatactccatcgatgttgtatttgcagtggctgaggaattcttgtacgcagttttctttggctttacgaagccgattaaaagaccgtgtgaaatgaaccttgctctgacaattcccttgcattgcaccacacactccttgctgcgggctcctgcagccagacctgagcagagagagaaggtggagaagcagcgggtctgcaagccttccctggggcctgcagagctagaaagggaggcccagcagactggcgctggtcagggtaggggagccaggcgggggacgggagcgggcagctcaggcctcagggcagccctgggaggcttctggcagtggtggccagagggctggactgtgcgggcagcttagcagggacagtggacgtgcacctgacgctgacctggactgcctcagtctagaagcaggccagagagcagaggcacgtggcatcccagggcgacctcagacggccagccggttagctagttctgctgttgcttcacgagttctgagcattctctgctagcctatggaagctgcagccctcggaggacagaagtgttgtgcgcccaacagaaccctctgagacgcaagctgctcccttggctagctcatatgtggaaatagccctgtaattcgaggtaactccttccgctcgtgtccacatccctcttgttgagagctcactgaaagtcatgtgcccggggaatgttcctgtgactgttttttgtttttccttttttttttaactttgtttttgtttttttcaattaagctggaactaaagtcaggcccagccattacgctccccacgtgcagccaggtgcagcctgggcccagtcatgcctggctcatagatgaaatcccttaagcaggattgaagaccagtgaacgcccccgccttttggattttttgctcaattgaccgtcttttccagacctctttaagtcacactcttaacttagctttctctgatgtctgttgccgccattagtttttttctagagcccacactggcccacatagctccatcccatacgggtagctggctccagctgcgccaaggtgcagacccgccctgggcatgctggcctgtgacggagcctgaggtcacagccccctgactagcctgagaccttcctaggggctgtggctgtttccggggaggccgggaggggcagctgtgagccctgtggaggacgttgggagtaacgctgctttgctttggcaggttgaaggggcccggccaggactcggggaagggtggcctgagagcagcgatgacctctggggtcactgtcccaggagggacttcacctggaacaagagctggaggcagccgcttgcccaggaggcttgtcccctgaggcgcttcgccagtgaggtgcgggctcagggcctcgagtctctcctggagcacgggctgcggtgcgccggcagcttacggggcggccagtccttgcccacaacgatgtggagccctgtgaaagtcggattcgaataaagggccacgtgtgcacccagaaa

SEQ ID NO: 445983 - DNA, 3206 bp, Homo sapiens
gacccgccctcactcgcgcgttaggaggctcgggtcgttgtggtgcgctgtcttcccgcttgcgtcagggacctgcccgactcagtggaagcggggagaggtggtgagagatgacccctgttgaggatttcattggtgtctgccacagccgccatggcatcagatgaaggcaaactttttgttggagggctgagttttgacaccaatgagcagtcgctggagcaggtcttctcaaagtacggacagatctctgaagtggtggttgtgaaagacagggagacccagagatctcggggatttgggtttgtcacctttgagaacattgacgacgctaaggatgccatgatggccatgaatgggaagtctgtagatggacggcagatccgagtagaccaggcaggcaagtcgtcagacaaccgatcccgtgggtaccgtggtggctctgccgggggccggggcttcttccgtgggggccgaggacggggccgtgggttctctagaggaggaggggaccgaggctatggggggaaccggttcgagtccaggagtgggggctacggaggctccagagactactatagcagccggagtcagagtggtggctacagtgaccggagctcgggcgggtcctacagagacagttacgacagttacggtaagtcacactccgagggcgccacgctgctgtggcctgcggtgggagctcggttcaccttggtgccctctccaagcactttaggctggacactcagaccttgtcactgtgcttgcccagaagaggcgcatctgtcctctcagagccatttctatcgcaggacgcaaaagccaaatgagactgaccaaaaaggcaagggagagcgagggcccgctgggcagtcagctaggtgcatgtgtggccgcaggccagcctccctcggctgtggggggtggttgctccccggccgcaggccgcgccctggtctggcctctggggtgaagctgcctcttgttgcttcggtgcctttacactgtgcctgcttcttgtcctcagctacacacaacgagtaaaaacccttcctgctcaagatcgtccttccaatggctgtgtgtttaaagattgtgggagcttcgctgaacgttaatgtgtagtaaatgcacctccttgtattcccactttcgtagtcatttcggttctgatcttgtcaaacccagcctgaccgcttctgacgccgggatggcctcgttactagacttttctttttaaggaagtgctgtttttttttgagggttttcaaaacattttgaaaagcatttacttttttgaccacgagccatgagttttcaaaaaaatcgggggttgtgtgggtttttggtttttgttttagtttttggttgcgttgcctttttttttttagtggggttggccccatgaagtgggtgccccactcacttctctgagatcgaacggactgtgaatccgctctttgtcggaagctgagcaagctgtggcttttttccaactccgtgtgacgtttctgagtgtagtgtggtaggaccccggcgggtgtggcagcaactgccctggagccccagcccctgcgtccatctgtgctgtgcgccccacagtagacgtgcagacgtccctgagaggttcttgaagatgtttatttatattgtccttttttactggaagacgtacgcatactccatcgatgttgtatttgcagtggctgaggaattcttgtacgcagttttctttggctttacgaagccgattaaaagaccgtgtgaaatgaaccttgctctgacaattcccttgcattgcaccacacactccttgctgcgggctcctgcagccagacctgagcagagagagaaggtggagaagcagcgggtctgcaagccttccctggggcctgcagagctagaaagggaggcccagcagactggcgctggtcagggtaggggagccaggcgggggacgggagcgggcagctcaggcctcagggcagccctgggaggcttctggcagtggtggccagagggctggactgtgcgggcagcttagcagggacagtggacgtgcacctgacgctgacctggactgcctcagtctagaagcaggccagagagcagaggcacgtggcatcccagggcgacctcagacggccagccggttagctagttctgctgttgcttcacgagttctgagcattctctgctagcctatggaagctgcagccctcggaggacagaagtgttgtgcgcccaacagaaccctctgagacgcaagctgctcccttggctagctcatatgtggaaatagccctgtaattcgaggtaactccttccgctcgtgtccacatccctcttgttgagagctcactgaaagtcatgtgcccggggaatgttcctgtgactgttttttgtttttccttttttttttaactttgtttttgtttttttcaattaagctggaactaaagtcaggcccagccattacgctccccacgtgcagccaggtgcagcctgggcccagtcatgcctggctcatagatgaaatcccttaagcaggattgaagaccagtgaacgcccccgccttttggattttttgctcaattgaccgtcttttccagacctctttaagtcacactcttaacttagctttctctgatgtctgttgccgccattagtttttttctagagcccacactggcccacatagctccatcccatacgggtagctggctccagctgcgccaaggtgcagacccgccctgggcatgctggcctgtgacggagcctgaggtcacagccccctgactagcctgagaccttcctaggggctgtggctgtttccggggaggccgggaggggcagctgtgagccctgtggaggacgttgggagtaacgctgctttgctttggcaggttgaaggggcccggccaggactcggggaagggtggcctgagagcagcgatgacctctggggtcactgtcccaggagggacttcacctggaacaagagctggaggcagccgcttgcccaggaggcttgtcccctgaggcgcttcgccagtgaggtgcgggctcagggcctcgagtctctcctggagcacgggctgcggtgcgccggcagcttacggggcggccagtccttgcccacaacgatgtggagccctgtgaaagtcggattcgaataaagggccacgtgtgcacccagaaa

SEQ ID NO: 445984 - DNA, 3039 bp, Homo sapiens
gacccgccctcactcgcgcgttaggaggctcgggtcgttgtggtgcgctgtcttcccgcttgcgtcagggacctgcccgactcagtggccgccatggcatcagatgaaggcaaactttttgttggagggctgagttttgacaccaatgagcagtcgctggagcaggtcttctcaaagtacggacagatctctgaagtctgtagatggacggcagatccgagtagaccaggcaggcaagtcgtcagacaaccgatcccgtgggtaccgtggtggctctgccgggggccggggcttcttccgtgggggccgaggacggggccgtgggttctctagaggaggaggggaccgaggctatggggggaaccggttcgagtccaggagtgggggctacggaggctccagagactactatagcagccggagtcagagtggtggctacagtgaccggagctcgggcgggtcctacagagacagttacgacagttacggtaagtcacactccgagggcgccacgctgctgtggcctgcggtgggagctcggttcaccttggtgccctctccaagcactttaggctggacactcagaccttgtcactgtgcttgcccagaagaggcgcatctgtcctctcagagccatttctatcgcaggacgcaaaagccaaatgagactgaccaaaaaggcaagggagagcgagggcccgctgggcagtcagctaggtgcatgtgtggccgcaggccagcctccctcggctgtggggggtggttgctccccggccgcaggccgcgccctggtctggcctctggggtgaagctgcctcttgttgcttcggtgcctttacactgtgcctgcttcttgtcctcagctacacacaacgagtaaaaacccttcctgctcaagatcgtccttccaatggctgtgtgtttaaagattgtgggagcttcgctgaacgttaatgtgtagtaaatgcacctccttgtattcccactttcgtagtcatttcggttctgatcttgtcaaacccagcctgaccgcttctgacgccgggatggcctcgttactagacttttctttttaaggaagtgctgtttttttttgagggttttcaaaacattttgaaaagcatttacttttttgaccacgagccatgagttttcaaaaaaatcgggggttgtgtgggtttttggtttttgttttagtttttggttgcgttgcctttttttttttagtggggttggccccatgaagtgggtgccccactcacttctctgagatcgaacggactgtgaatccgctctttgtcggaagctgagcaagctgtggcttttttccaactccgtgtgacgtttctgagtgtagtgtggtaggaccccggcgggtgtggcagcaactgccctggagccccagcccctgcgtccatctgtgctgtgcgccccacagtagacgtgcagacgtccctgagaggttcttgaagatgtttatttatattgtccttttttactggaagacgtacgcatactccatcgatgttgtatttgcagtggctgaggaattcttgtacgcagttttctttggctttacgaagccgattaaaagaccgtgtgaaatgaaccttgctctgacaattcccttgcattgcaccacacactccttgctgcgggctcctgcagccagacctgagcagagagagaaggtggagaagcagcgggtctgcaagccttccctggggcctgcagagctagaaagggaggcccagcagactggcgctggtcagggtaggggagccaggcgggggacgggagcgggcagctcaggcctcagggcagccctgggaggcttctggcagtggtggccagagggctggactgtgcgggcagcttagcagggacagtggacgtgcacctgacgctgacctggactgcctcagtctagaagcaggccagagagcagaggcacgtggcatcccagggcgacctcagacggccagccggttagctagttctgctgttgcttcacgagttctgagcattctctgctagcctatggaagctgcagccctcggaggacagaagtgttgtgcgcccaacagaaccctctgagacgcaagctgctcccttggctagctcatatgtggaaatagccctgtaattcgaggtaactccttccgctcgtgtccacatccctcttgttgagagctcactgaaagtcatgtgcccggggaatgttcctgtgactgttttttgtttttccttttttttttaactttgtttttgtttttttcaattaagctggaactaaagtcaggcccagccattacgctccccacgtgcagccaggtgcagcctgggcccagtcatgcctggctcatagatgaaatcccttaagcaggattgaagaccagtgaacgcccccgccttttggattttttgctcaattgaccgtcttttccagacctctttaagtcacactcttaacttagctttctctgatgtctgttgccgccattagtttttttctagagcccacactggcccacatagctccatcccatacgggtagctggctccagctgcgccaaggtgcagacccgccctgggcatgctggcctgtgacggagcctgaggtcacagccccctgactagcctgagaccttcctaggggctgtggctgtttccggggaggccgggaggggcagctgtgagccctgtggaggacgttgggagtaacgctgctttgctttggcaggttgaaggggcccggccaggactcggggaagggtggcctgagagcagcgatgacctctggggtcactgtcccaggagggacttcacctggaacaagagctggaggcagccgcttgcccaggaggcttgtcccctgaggcgcttcgccagtgaggtgcgggctcagggcctcgagtctctcctggagcacgggctgcggtgcgccggcagcttacggggcggccagtccttgcccacaacgatgtggagccctgtgaaagtcggattcgaataaagggccacgtgtgcacccagaaa

SEQ ID NO: 445985 - DNA, 2299 bp, Homo sapiens
  misc_feature (22)..(22): n is a, c, g, or t
tgtttatcgatgccaccactcnggtacggaggctcagagactactatagcagccggagtcagagtggtggctacagtgaccggagctcgggcgggtcctacagagacagttacgacagttacgctacacacaacgagtaaaaacccttcctgctcaagatcgtccttccaatggctgtgtgtttaaagattgtgggagcttcgctgaacgttaatgtgtagtaaatgcacctccttgtattcccactttcgtagtcatttcggttctgatcttgtcaaacccagcctgaccgcttctgacgccgggatggcctcgttactagacttttctttttaaggaagtgctgtttttttttgagggttttcaaaacattttgaaaagcatttacttttttgaccacgagccatgagttttcaaaaaaatcgggggttgtgtgggtttttggtttttgttttagtttttggttgcgttgcctttttttttttagtggggttggccccatgaagtgggtgccccactcacttctctgagatcgaacggactgtgaatccgctctttgtcggaagctgagcaagctgtggcttttttccaactccgtgtgacgtttctgagtgtagtgtggtaggaccccggcgggtgtggcagcaactgccctggagccccagcccctgcgtccatctgtgctgtgcgccccacagtagacgtgcagacgtccctgagaggttcttgaagatgtttatttatattgtccttttttactggaagacgtacgcatactccatcgatgttgtatttgcagtggctgaggaattcttgtacgcagttttctttggctttacgaagccgattaaaagaccgtgtgaaatgaaccttgctctgacaattcccttgcattgcaccacacactccttgctgcgggctcctgcagccagacctgagcagagagagaaggtggagaagcagcgggtctgcaagccttccctggggcctgcagagctagaaagggaggcccagcagactggcgctggtcagggtaggggagccaggcgggggacgggagcgggcagctcaggcctcagggcagccctgggaggcttctggcagtggtggccagagggctggactgtgcgggcagcttagcagggacagtggacgtgcacctgacgctgacctggactgcctcagtctagaagcaggccagagagcagaggcacgtggcatcccagggcgacctcagacggccagccggttagctagttctgctgttgcttcacgagttctgagcattctctgctagcctatggaagctgcagccctcggaggacagaagtgttgtgcgcccaacagaaccctctgagacgcaagctgctcccttggctagctcatatgtggaaatagccctgtaattcgaggtaactccttccgctcgtgtccacatccctcttgttgagagctcactgaaagtcatgtgcccggggaatgttcctgtgactgttttttgtttttccttttttttttaactttgtttttgtttttttcaattaagctggaactaaagtcaggcccagccattacgctccccacgtgcagccaggtgcagcctgggcccagtcatgcctggctcatagatgaaatcccttaagcaggattgaagaccagtgaacgcccccgccttttggattttttgctcaattgaccgtcttttccagacctctttaagtcacactcttaacttagctttctctgatgtctgttgccgccattagtttttttctagagcccacactggcccacatagctccatcccatacgggtagctggctccagctgcgccaaggtgcagacccgccctgggcatgctggcctgtgacggagcctgaggtcacagccccctgactagcctgagaccttcctaggggctgtggctgtttccggggaggccgggaggggcagctgtgagccctgtggaggacgttgggagtaacgctgctttgctttggcaggttgaaggggcccggccaggactcggggaagggtggcctgagagcagcgatgacctctggggtcactgtcccaggagggacttcacctggaacaagagctggaggcagccgcttgcccaggaggcttgtcccctgaggcgcttcgccagtgaggtgcgggctcagggcctcgagtctctcctggagcacgggctgcggtgcgccggcagcttacggggcggccagtccttgcccacaacgatgtggagccctgtgaaagtcggattcgaataaagggccacgtgtgcacccagaaa

SEQ ID NO: 445986 - DNA, 2647 bp, Homo sapiens
gacccgccctcactcgcgcgttaggaggctcgggtcgttgtggtgcgctgtcttcccgcttgcgtcagggacctgcccgactcagtggccgccatggcatcagatgaaggcaaactttttgttggagggctgagttttgacaccaatgagcagtcgctggagcaggtcttctcaaagtacggacagatctctgaagtggtggttgtgaaagacagggagacccagagatctcggggatttgggtttgtcacctttgagaacattgacgacgctaaggatgccatgatggccatgaatgggaagtctgtagatggacggcagatccgagtagaccaggcaggcaagtcgtcagacaaccgatcccgtgggtaccgtggtggctctgccgggggccggggcttcttccgtgggggccgaggacggggccgtgggttctctagaggaggaggggaccgaggctatggggggaaccggttcgagtccaggagtgggggctacggaggctccagagactactatagcagccggagtcagagtggtggctacagtgaccggagctcgggcgggtcctacagagacagttacgacagttacgctacacacaatctttaaacacacagccattggaaggacgatcttgagtctgacgccgggatggcctcgttactagacttttctttttaaggaagtgctgtttttttttgagggttttcaaaacattttgaaaagcatttacttttttgaccacgagccatgagttttcaaaaaaatcgggggttgtgtgggtttttggtttttgttttagtttttggttgcgttgcctttttttttttagtggggttggccccatgaagtgggtgccccactcacttctctgagatcgaacggactgtgaatccgctctttgtcggaagctgagcaagctgtggcttttttccaactccgtgtgacgtttctgagtgtagtgtggtaggaccccggcgggtgtggcagcaactgccctggagccccagcccctgcgtccatctgtgctgtgcgccccacagtagacgtgcagacgtccctgagaggttcttgaagatgtttatttatattgtccttttttactggaagacgtacgcatactccatcgatgttgtatttgcagtggctgaggaattcttgtacgcagttttctttggctttacgaagccgattaaaagaccgtgtgaaatgaaccttgctctgacaattcccttgcattgcaccacacactccttgctgcgggctcctgcagccagacctgagcagagagagaaggtggagaagcagcgggtctgcaagccttccctggggcctgcagagctagaaagggaggcccagcagactggcgctggtcagggtaggggagccaggcgggggacgggagcgggcagctcaggcctcagggcagccctgggaggcttctggcagtggtggccagagggctggactgtgcgggcagcttagcagggacagtggacgtgcacctgacgctgacctggactgcctcagtctagaagcaggccagagagcagaggcacgtggcatcccagggcgacctcagacggccagccggttagctagttctgctgttgcttcacgagttctgagcattctctgctagcctatggaagctgcagccctcggaggacagaagtgttgtgcgcccaacagaaccctctgagacgcaagctgctcccttggctagctcatatgtggaaatagccctgtaattcgaggtaactccttccgctcgtgtccacatccctcttgttgagagctcactgaaagtcatgtgcccggggaatgttcctgtgactgttttttgtttttccttttttttttaactttgtttttgtttttttcaattaagctggaactaaagtcaggcccagccattacgctccccacgtgcagccaggtgcagcctgggcccagtcatgcctggctcatagatgaaatcccttaagcaggattgaagaccagtgaacgcccccgccttttggattttttgctcaattgaccgtcttttccagacctctttaagtcacactcttaacttagctttctctgatgtctgttgccgccattagtttttttctagagcccacactggcccacatagctccatcccatacgggtagctggctccagctgcgccaaggtgcagacccgccctgggcatgctggcctgtgacggagcctgaggtcacagccccctgactagcctgagaccttcctaggggctgtggctgtttccggggaggccgggaggggcagctgtgagccctgtggaggacgttgggagtaacgctgctttgctttggcaggttgaaggggcccggccaggactcggggaagggtggcctgagagcagcgatgacctctggggtcactgtcccaggagggacttcacctggaacaagagctggaggcagccgcttgcccaggaggcttgtcccctgaggcgcttcgccagtgaggtgcgggctcagggcctcgagtctctcctggagcacgggctgcggtgcgccggcagcttacggggcggccagtccttgcccacaacgatgtggagccctgtgaaagtcggattcgaataaagggccacgtgtgcacccagaaa

SEQ ID NO: 445987 - DNA, 1222 bp, Homo sapiens
gacccgccctcactcgcgcgttaggaggctcgggtcgttgtggtgcgctgtcttcccgcttgcgtcagggacctgcccgactcagtggccgccatggcatcagatgaaggcaaactttttgttggagggctgagttttgacaccaatgagcagtcgctggagcaggtcttctcaaagtacggacagatctctgaagtggtggttgtgaaagacagggagacccagagatctcggggatttgggtttgtcacctttgagaacattgacgacgctaaggatgccatgatggccatgaatgggaagtctgtagatggacggcagatccgagtagaccaggcaggcaagtcgtcagacaaccgatcccgtgggtaccgtggtggctctgccgggggccggggcttcttccgtgggggccgaggacggggccgtgggttctctagaggaggaggggaccgaggctatggggggaaccggttcgagtccaggagtgggggctacggaggctccagagactactatagcagccggagtcagagtggtggctacagtgaccggagctcgggcgggtcctacagagacagttacgacagttacgctacacacaacgagtaaaaacccttcctgctcaagatcgtccttccaatggctgtgtgtttaaagattgtgggagcttcgctgaacgttaatgtgtagtaaatgcacctccttgtattcccactttcgtagtcatttcggttctgatcttgtcaaacccagcctgaccgctcctagaccccttcctaagaccctaagggtcttagggagagacagggaatgtagtttaagaaaagcaagcatttatgtctgccagtgttctcaaatgagctcatgtatgaagtgggacatggaactcgctgacctttatttggcctctgcattcagactacctggggttgaattctaactcctctgccttctgactttatgagcttgggctgtttacctaacttctcagggtgtcttagtctatttttggtttcttataacagaatacctgaaacttggcaatttatgaggaaaaggaattcatttcttacagttatggaggctgagaagttcaaggtccaggggcataacaggtgagagccttcttactgtcgaggactctgctagagtcccaaggtagtacagggggtgagggggctgatacgctagctgagtctctcttcatcctcttataagc

SEQ ID NO: 445988 - DNA, 1964 bp, Homo sapiens
gacccgccctcactcgcgcgttaggaggctcgggtcgttgtggtgcgctgtcttcccgcttgcgtcagggacctgcccgactcagtggccgccatggcatcagatgaaggcaaactttttgttggagggctgagttttgacaccaatgagcagtcgctggagcaggtcttctcaaagtacggacagatctctgaagtggtggttgtgaaagacagggagacccagagatctcggggatttgggtttgtcacctttgagaacattgacgacgctaaggatgccatgatggccatgaatgggaagtctgtagatggacggcagatccgagtagaccagcgtccatctgtgctgtgcgccccacagtagacgtgcagacgtccctgagaggttcttgaagatgtttatttatattgtccttttttactggaagacgtacgcatactccatcgatgttgtatttgcagtggctgaggaattcttgtacgcagttttctttggctttacgaagccgattaaaagaccgtgtgaaatgaaccttgctctgacaattcccttgcattgcaccacacactccttgctgcgggctcctgcagccagacctgagcagagagagaaggtggagaagcagcgggtctgcaagccttccctggggcctgcagagctagaaagggaggcccagcagactggcgctggtcagggtaggggagccaggcgggggacgggagcgggcagctcaggcctcagggcagccctgggaggcttctggcagtggtggccagagggctggactgtgcgggcagcttagcagggacagtggacgtgcacctgacgctgacctggactgcctcagtctagaagcaggccagagagcagaggcacgtggcatcccagggcgacctcagacggccagccggttagctagttctgctgttgcttcacgagttctgagcattctctgctagcctatggaagctgcagccctcggaggacagaagtgttgtgcgcccaacagaaccctctgagacgcaagctgctcccttggctagctcatatgtggaaatagccctgtaattcgaggtaactccttccgctcgtgtccacatccctcttgttgagagctcactgaaagtcatgtgcccggggaatgttcctgtgactgttttttgtttttccttttttttttaactttgtttttgtttttttcaattaagctggaactaaagtcaggcccagccattacgctccccacgtgcagccaggtgcagcctgggcccagtcatgcctggctcatagatgaaatcccttaagcaggattgaagaccagtgaacgcccccgccttttggattttttgctcaattgaccgtcttttccagacctctttaagtcacactcttaacttagctttctctgatgtctgttgccgccattagtttttttctagagcccacactggcccacatagctccatcccatacgggtagctggctccagctgcgccaaggtgcagacccgccctgggcatgctggcctgtgacggagcctgaggtcacagccccctgactagcctgagaccttcctaggggctgtggctgtttccggggaggccgggaggggcagctgtgagccctgtggaggacgttgggagtaacgctgctttgctttggcaggttgaaggggcccggccaggactcggggaagggtggcctgagagcagcgatgacctctggggtcactgtcccaggagggacttcacctggaacaagagctggaggcagccgcttgcccaggaggcttgtcccctgaggcgcttcgccagtgaggtgcgggctcagggcctcgagtctctcctggagcacgggctgcggtgcgccggcagcttacggggcggccagtccttgcccacaacgatgtggagccctgtgaaagtcggattcgaataaagggccacgtgtgcacccagaaa

SEQ ID NO: 445989 - DNA, 1899 bp, Homo sapiens
gacccgccctcactcgcgcgttaggaggctcgggtcgttgtggtgcgctgtcttcccgcttgcgtcagggacctgcccgactcagtggccgccatggcatcagatgaaggcaaactttttgttggagggctgagttttgacaccaatgagcagtcgctggagcaggtcttctcaaagtacggacagatctctgaagtggtggttgtgaaagacagggagacccagagatctcggggatttgggtttgtcacctttgagaacattgacgacgctaaggatgccatgatggccatgaatgggaagcgtccatctgtgctgtgcgccccacagtagacgtgcagacgtccctgagaggttcttgaaagacgtacgcatactccatcgatgttgtatttgcagtggctgaggaattcttgtacgcagttttctttggctttacgaagccgattaaaagaccgtgtgaaatgaaccttgctctgacaattcccttgcattgcaccacacactccttgctgcgggctcctgcagccagacctgagcagagagagaaggtggagaagcagcgggtctgcaagccttccctggggcctgcagagctagaaagggaggcccagcagactggcgctggtcagggtaggggagccaggcgggggacgggagcgggcagctcaggcctcagggcagccctgggaggcttctggcagtggtggccagagggctggactgtgcgggcagcttagcagggacagtggacgtgcacctgacgctgacctggactgcctcagtctagaagcaggccagagagcagaggcacgtggcatcccagggcgacctcagacggccagccggttagctagttctgctgttgcttcacgagttctgagcattctctgctagcctatggaagctgcagccctcggaggacagaagtgttgtgcgcccaacagaaccctctgagacgcaagctgctcccttggctagctcatatgtggaaatagccctgtaattcgaggtaactccttccgctcgtgtccacatccctcttgttgagagctcactgaaagtcatgtgcccggggaatgttcctgtgactgttttttgtttttccttttttttttaactttgtttttgtttttttcaattaagctggaactaaagtcaggcccagccattacgctccccacgtgcagccaggtgcagcctgggcccagtcatgcctggctcatagatgaaatcccttaagcaggattgaagaccagtgaacgcccccgccttttggattttttgctcaattgaccgtcttttccagacctctttaagtcacactcttaacttagctttctctgatgtctgttgccgccattagtttttttctagagcccacactggcccacatagctccatcccatacgggtagctggctccagctgcgccaaggtgcagacccgccctgggcatgctggcctgtgacggagcctgaggtcacagccccctgactagcctgagaccttcctaggggctgtggctgtttccggggaggccgggaggggcagctgtgagccctgtggaggacgttgggagtaacgctgctttgctttggcaggttgaaggggcccggccaggactcggggaagggtggcctgagagcagcgatgacctctggggtcactgtcccaggagggacttcacctggaacaagagctggaggcagccgcttgcccaggaggcttgtcccctgaggcgcttcgccagtgaggtgcgggctcagggcctcgagtctctcctggagcacgggctgcggtgcgccggcagcttacggggcggccagtccttgcccacaacgatgtggagccctgtgaaagtcggattcgaataaagggccacgtgtgcacccagaaa

SEQ ID NO: 445990 - DNA, 1060 bp, Homo sapiens
gacccgccctcactcgcgcgttaggaggctcgggtcgttgtggtgcgctgtcttcccgcttgcgtcagggacctgcccgactcagtggccgccatggcatcagatgaaggcaaactttttgttggagggctgagttttgacaccaatgagcagtcgctggagcaggtcttctcaaagtacggacagatctctgaagtggtggttgtgaaagacagggagacccagagatctcggggatttgggtttgtcacctttgagaacattgacgacgctaaggatgccatgatggccatgaatgggaagtctgtagatggacggcagatccgagtagaccaggcaggcaagtcgtcagacaaccgatcccgtgggtaccgtggtggctctgccgggggccggggcttcttccgtgggggccgaggacggggccgtgggttctctagaggaggaggggaccgaggctatggggggaaccggttcgagtccaggagtgggggctacggaggctccagagactactatagcagccggagtcagagtggtggctacagtgaccggagctcgggcgggtcctacagagacagttacgacagttacggtaagtcacactccgagggcgccacgctgctgtggcctgcggtgggagctcggttcaccttggtgccctctccaagcactttaggctggacactcagaccttgtcactgtgcttgcccagaagaggcgcatctgtcctctcagagccatttctatcgcaggacgcaaaagccaaatgagactgaccaaaaaggcaagggagagcgagggcccgctgggcagtcagctaggtgcatgtgtggccgcaggccagcctccctcggctggagcccgcgcctgttctccctcccttcctcctccttccgaggcgcttcgccagtgaggtgcgggctcagggcctcgagtctctcctggagcacgggctgcggtgcgccggcagcttacggggcggccagtccttgcccacaacgatgtggagccctgtgaaagtcggattcgaataaagggccacgtgtgcacccagaaa

SEQ ID NO: 445991 - DNA, 1113 bp, Homo sapiens
gacccgccctcactcgcgcgttaggaggctcgggtcgttgtggtgcgctgtcttcccgcttgcgtcagggacctgcccgactcagtggccgccatggcatcagatgaaggcaaactttttgttggagggctgagttttgacaccaatgagcagtcgctggagcaggtcttctcaaagtacggacagatctctgaagtggtggttgtgaaagacagggagacccagagatctcggggatttgggtttgtcacctttgagaacattgacgacgctaaggatgccatgatggccatgaatgggaagtctgtagatggacggcagatccgagtagaccaggcaggcaagtcgtcagacaaccgatcccgtgggtaccgtggtggctctgccgggggccggggcttcttccgtgggggccgaggacggggccgtgggttctctagaggaggaggggaccgaggctatggggggaaccggttcgagtccaggagtgggggctacggaggctccagagactactatagcagccggagtcagagtggtggctacagtgaccggagctcgggcgggtcctacagagacagttacgacagttacgaagcaggccagagagcagaggcacgtggcatcccagggcgacctcagacggccagccggttagctagttctgctgttgcttcacgagttctgagcattctctgctagcctatggaagctgcagccctcggaggacagaagtgttgtgcgcccaacagaaccctctgagacgcaagctgctcccttggctagctcatatgtggaaatagccctgtaattcgaggttgaaggggcccggccaggactcggggaagggtggcctgagagcagcgatgacctctggggtcactgtcccaggagggacttcacctggaacaagagctggaggcagccgcttgcccaggaggcttgtcccctgaggcgcttcgccagtgaggtgcgggctcagggcctcgagtctctcctggagcacgggctgcggtgcgccggcagcttacggggcggccagtccttgcccacaacgatgtggagccctgtgaaagtcggattcgaataaagggccacgtgtgcacccagaaa

SEQ ID NO: 445992 - DNA, 1157 bp, Homo sapiens
gacccgccctcactcgcgcgttaggaggctcgggtcgttgtggtgcgctgtcttcccgcttgcgtcagggacctgcccgactcagtggaagcggggagaggtggtgagagatgacccctgttgaggatttcattggtgtctgccacagccgccatggcatcagatgaaggcaaactttttgttggagggctgagttttgacaccaatgagcagtcgctggagcaggtcttctcaaagtacggacagatctctgaagtggtggttgtgaaagacagggagacccagagatctcggggatttgggtttgtcacctttgagaacattgacgacgctaaggatgccatgatggccatgaatgggaagtctgtagatggacggcagatccgagtagaccaggcaggcaagtcgtcagacaaccgatcccgtgggtaccgtggtggctctgccgggggccggggcttcttccgtgggggccgaggacggggccgtgggttctctagaggaggaggggaccgaggctatggggggaaccggttcgagtccaggagtgggggctacggaggctccagagactactatagcagccggagtcagagtggtggctacagtgaccggagctcgggcgggtcctacagagacagttacgacagttacggttgaaggggcccggccaggactcggggaagggtggcctgagagcagcgatgacctctggggtcactgtcccaggagggacttcacctggaacaagagctggaggcagccgcttgcccaggaggcttgtcccctgtaagtgctttcgggaagagtggcatgtggcgctgagccctgtcccgggcggcacctgggcgtttcagtgagtcctgctctcccgcacctatggccccacggcgggcgcctttcggtgtgtgttgggtgcagggcagcgcctcccgggagcgccgggtccctcgcctggagcccgcgcctgttctccctcccttcctcctccttccgaggcgcttcgccagtgaggtgcgggctcagggcctcgagtctctcctggagcacgggctgcggtgcgccggcagcttacggggcggccagtccttgcccacaacgatgtggagccctgtgaaagtcggattcgaataaagggccacgtgtgcacccagaaa

SEQ ID NO: 445993 - DNA, 494 bp, Homo sapiens
ctggagcaggtcttctcaaagtacggacagatctctgaaggtgaggctgctgctgggcccgcggccctgggcgggggggcttgtgctcctcctacctggaagtacagctgggtgctgactgcagacctctctcccctgcacagtggtggttgtgaaagacagggagacccagagatctcggggatttgggtttgtcacctttgagaacattgacgacgctaaggatgccatgatggccatgaatgggaaggtgaggatcagggtgctgagcaggagtctcgtctcgaggatggggcacccacctgctaacccgtcccgccctctgtctccagtctgtagatggacggcagatccgagtagaccaggcaggcaagtcgtcagacaaccgatcccgtgggtaccgtggtggctctgccgggggccggggcttcttccgtgggggccgaggacggggccgtgggttctctagaggtgagtgccatgagtgggtccct

SEQ ID NO: 445994 - DNA, 891 bp, Homo sapiens
gacccgccctcactcgcgcgttaggaggctcgggtcgttgtggtgcgctgtcttcccgcttgcgtcagggacctgcccgactcagtggccgccatggcatcagatgaaggcaaactttttgttggagggctgagttttgacaccaatgagcagtcgctggagcaggtcttctcaaagtacggacagatctctgaagtggtggttgtgaaagacagggagacccagagatctcggggatttgggtttgtcacctttgagaacattgacgacgctaaggatgccatgatggccatgaatgggaagtctgtagatggacggcagatccgagtagaccaggcaggcaagtcgtcagacaaccgatcccgtgggtaccgtggtggctctgccgggggccggggcttcttccgtgggggccgaggacggggccgtgggttctctagaggaggaggggaccgaggctatggggggaaccggttcgagtccaggagtgggggctacggaggctccagagactactatagcagccggagtcagagtggtggctacagtgaccggagctcgggcgggtcctacagagacagttacgacagttacggttgaaggggcccggccaggactcggggaagggtggcctgagagcagcgatgacctctggggtcactgtcccaggagggacttcacctggaacaagagctggaggcagccgcttgcccaggaggcttgtcccctgaggcgcttcgccagtgaggtgcgggctcagggcctcgagtctctcctggagcacgggctgcggtgcgccggcagcttacggggcggccagtccttgcccacaacgatgtggagccctgtgaaagtcggattcgaataaagggccacgtgtgcacccagaaa

SEQ ID NO: 445995 - DNA, 302 bp, Homo sapiens
  misc_feature (17)..(17): n is a, c, g, or t
aggtgatctaaggatcncataaggcgcgtttctgagtgtagtgtggtaggaccccggcgggtgtggcagcaactgccctggagccccagcccctgcgtccatctgtgctgtgcgccccacagtagacgtgcagacgtccctgagaggttcttgaagatgtttatttatattgtccttttttactggaagacgtacgcatactccatcgatgttgtatttgcagtggctgaggaattcttgtacgcagaacgcgcctaattaggcgcgttctgcgtggcgggggtgcgtcgggtctgcgagag

SEQ ID NO: 445996 - DNA, 167 bp, Homo sapiens
tactcactttttcctgtatgtgcaggaggaggggaccgaggctatggggggaaccggttcgagtccaggagtgggggctacggaggctccagagactactatagcagccggagtcagagtgtggctacagtagtctctgagcctccgtagcccccaacgaaggtaca

SEQ ID NO: 445997 - DNA, 2922 bp, Homo sapiens
gacccgccctcactcgcgcgttaggaggctcgggtcgttgtggtgcgctgtcttcccgcttgcgtcagggacctgcccgactcagtggccgccatggcatcagatgaaggcaaactttttgttggagggctgagttttgacaccaatgagcagtcgctggagcaggtcttctcaaagtacggacagatctctgaagtggtggttgtgaaagacagggagacccagagatctcggggatttgggtttgtcacctttgagaacattgacgacgctaaggatgccatgatggccatgaatgggaagtctgtagatggacggcagatccgagtagaccaggcaggcaagtcgtcagacaaccgatcccgtgggtaccgtggtggctctgccgggggccggggcttcttccgtgggggccgaggacggggccgtgggttctctagaggaggaggggaccgaggctatggggggaaccggttcgagtccaggagtgggggctacggaggctccagagactactatagcagccggagtcagagtggtggctacagtgaccggagctcgggcgggtcctacagagacagttacgacagttacgctacacacaacgagtaaaaacccttcctgctcaagatcgtccttccaatggctgtgtgtttaaagattgtgggagcttcgctgaacgttaatgtgtagtaaatgcacctccttgtattcccactttcgtagtcatttcggttctgatcttgtcaaacccagcctgaccgcttctgacgccgggatggcctcgttactagacttttctttttaaggaagtgctgtttttttttgagggttttcaaaacattttgaaaagcatttacttttttgaccacgagccatgagttttcaaaaaaatcgggggttgtgtgggtttttggtttttgttttagtttttggttgcgttgcctttttttttttagtggggttggccccatgaagtgggtgccccactcacttctctgagatcgaacggactgtgaatccgctctttgtcggaagctgagcaagctgtggcttttttccaactccgtgtgacgtttctgagtgtagtgtggtaggaccccggcgggtgtggcagcaactgccctggagccccagcccctgcgtccatctgtgctgtgcgccccacagtagacgtgcagacgtccctgagaggttcttgaagatgtttatttatattgtccttttttactggaagacgtacgcatactccatcgatgttgtatttgcagtggctgaggaattcttgtacgcagttttctttggctttacgaagccgattaaaagaccgtgtgaaatgaaccttgctctgacaattcccttgcattgcaccacacactccttgctgcgggctcctgcagccagacctgagcagagagagaaggtggagaagcagcgggtctgcaagccttccctggggcctgcagagctagaaagggaggcccagcagactggcgctggtcagggtaggggagccaggcgggggacgggagcgggcagctcaggcctcagggcagccctgggaggcttctggcagtggtggccagagggctggactgtgcgggcagcttagcagggacagtggacgtgcacctgacgctgacctggactgcctcagtctagaagcaggccagagagcagaggcacgtggcatcccagggcgacctcagacggccagccggttagctagttctgctgttgcttcacgagttctgagcattctctgctagcctatggaagctgcagccctcggaggacagaagtgttgtgcgcccaacagaaccctctgagacgcaagctgctcccttggctagctcatatgtggaaatagccctgtaattcgaggtaactccttccgctcgtgtccacatccctcttgttgagagctcactgaaagtcatgtgcccggggaatgttcctgtgactgttttttgtttttccttttttttttaactttgtttttgtttttttcaattaagctggaactaaagtcaggcccagccattacgctccccacgtgcagccaggtgcagcctgggcccagtcatgcctggctcatagatgaaatcccttaagcaggattgaagaccagtgaacgcccccgccttttggattttttgctcaattgaccgtcttttccagacctctttaagtcacactcttaacttagctttctctgatgtctgttgccgccattagtttttttctagagcccacactggcccacatagctccatcccatacgggtagctggctccagctgcgccaaggtgcagacccgccctgggcatgctggcctgtgacggagcctgaggtcacagccccctgactagcctgagaccttcctaggggctgtggctgtttccggggaggccgggaggggcagctgtgagccctgtggaggacgttgggagtaacgctgctttgctttggcaggttgaaggggcccggccaggactcggggaagggtggcctgagagcagcgatgacctctggggtcactgtcccaggagggacttcacctggaacaagagctggaggcagccgcttgcccaggaggcttgtcccctgaggcgcttcgccagtgaggtgcgggctcagggcctcgagtctctcctggagcacgggctgcggtgcgccggcagcttacggggcggccagtccttgcccacaacgatgtggagccctgtgaaagtcggattcgaataaagggccacgtgtgcacccagaaaaacacaaaacgaacacaagcaataagaaaaaaagaaacaagcaagaaaacaccaaacaataacaagcagacagaaaaaaaagaaagcacacaagacagagaaaaaaaacagcgacaggaggacaaagaaaccccgacgaaggccaaccaac

SEQ ID NO: 445998 - DNA, 2562 bp, Homo sapiens
gacccgccctcactcgcgcgttaggaggctcgggtcgttgtggtgcgctgtcttcccgcttgcgtcagggacctgcccgactcagtggccgccatggcatcagatgaaggcaaactttttgttggagggctgagttttgacaccaatgagcagtcgctggagcaggtcttctcaaagtacggacagatctctgaagtggtggttgtgaaagacagggagacccagagatctcggggatttgggtttgtcacctttgagaacattgacgacgctaaggatgccatgatggccatgaatgggaagtctgtagatggacggcagatccgagtagaccaggcaggcaagtcgtcagacaaccgatcccgtgggtaccgtggtggctctgccgggggccggggcttcttccgtgggggccgaggacggggccgtgggttctctagaggaggaggggaccgaggctatggggggaaccggttcgagtccaggagtgggggctacggaggctccagagactactatagcagccggagtcagagtggtggctacagtgaccggagctcgggcgggtcctacagagacagttacgacagttacgctacacacaacgagtaaaaacccttcctgctcaagatcgtccttccaatggctgtgtgtttaaagattgtgggagcttcgctgaacgttaatgtgtagtaaatgcacctccttgtattcccactttcgtagtcatttcggttctgatcttgtcaaacccagcctgaccgcttctgacgccgggatggcctcgttactagacttttctttttaaggaagtgctgtttttttttgagggttttcaaaacattttgaaaagcatttacttttttgaccacgagccatgagttttcaaaaaaatcgggggttgtgtgggtttttggtttttgttttagtttttggttgcgttgcctttttttttttagtggggttggccccatgaagtgggtgccccactcacttctctgagatcgaacggactgtgaatccgctctttgtcggaagctgagcaagctgtggcttttttccaactccgtgtgacgtttctgagtgtagtgtggtaggaccccggcgggtgtggcagcaactgccctggagccccagcccctgcgtccatctgtgctgtgcgccccacagtagacgtgcagacgtccctgagaggttcttgaagatgtttatttatattgtccttttttactggaagacgtacgcatactccatcgatgttgtatttgcagtggctgaggaattcttgtacgcagttttctttggctttacgaagccgattaaaagaccgtgtgaaatgaaccttgctctgacaattcccttgcattgcaccacacactccttgctgcgggctcctgcagccagacctgagcagagagagaaggtggagaagcagcgggtctgcaagccttccctggggcctgcagagctagaaagggaggcccagcagactggcgctggtcagggtaggggagccaggcgggggacgggagcgggcagctcaggcctcagggcagccctgggaggcttctggcagtggtggccagagggctggactgtgcgggcagcttagcagggacagtggacgtgcacctgacgctgacctggactgcctcagtctagaagcaggccagagagcagaggcacgtggcatcccagggcgacctcagacggccagccggttagctagttctgctgttgcttcacgagttctgagcattctctgctagcctatggaagctgcagccctcggaggacagaagtgttgtgcgcccaacagaaccctctgagacgcaagctgctcccttggctagctcatatgtggaaatagccctgtaattcgaggtaactccttccgctcgtgtccacatccctcttgttgagagctcactgaaagtcatgtgcccggggaatgttcctgtgactgttttttgtttttccttttttttttaactttgtttttgtttttttcaattaagctggaactaaagtcaggcccagccattacgctccccacgtgcagccaggtgcagcctgggcccagtcatgcctggctcatagatgaaatcccttaagcaggattgaagaccagtgaacgcccccgccttttggattttttgctcaattgaccgtcttttccagacctctttaagtcacactcttaacttagctttctctgatgtctgttgccgccattagtttttttctagagcccacactggcccacatagctccatcccatacgggtagctggctccagctgcgccaaggtgcagacccgccctgggcatgctggcctgtgacggagcctgaggtcacagccccctgactagcctgagaccttcctaggggctgtggctgtttccggggaggccgggaggggcagctgtgagccctgtggaggacgttgggagtaacgctgctttgctttggcagcttacggggcggccagtccttgcccacaacgatgtggagccctgtgaaagtcggattcgaataaagggccacgtgtgcacccagaaa

SEQ ID NO: 445999 - DNA, 2860 bp, Homo sapiens
gacccgccctcactcgcgcgttaggaggctcgggtcgttgtggtgcgctgtcttcccgcttgcgtcagggacctgcccgactcagtggccgccatggcatcagatgaaggcaaactttttgttggagggctgagttttgacaccaatgagcagtcgctggagcaggtcttctcaaagtacggacagatctctgaagtggtggttgtgaaagacagggagacccagagatctcggggatttgggtttgtcacctttgagaacattgacgacgctaaggatgccatgatggccatgaatgggaagtctgtagatggacggcagatccgagtagaccaggcaggcaagtcgtcagacaaccgatcccgtgggtaccgtggtggctctgccgggggccggggcttcttccgtgggggccgaggacggggccgtgggttctctagaggaggaggggaccgaggctatggggggaaccggttcgagtccaggagtgggggctacggaggctccagagactactatagcagccggagtcagagtggtggctacagtgaccggagctcgggcgggtcctacagagacagttacgacagttacgctacacacaacgagtaaaaacccttcctgctcaagatcgtccttccaatggctgtgtgtttaaagattgtgggagcttcgctgaacgttaatgtgtagtaaatgcacctccttgtattcccactttcgtagtcatttcggttctgatcttgtcaaacccagcctgaccgcttctgacgccgggatggcctcgttactagacttttctttttaaggaagtgctgtttttttttgagggttttcaaaacattttgaaaagcatttacttttttgaccacgagccatgagttttcaaaaaaatcgggggttgtgtgggtttttggtttttgttttagtttttggttgcgttgcctttttttttttagtggggttggccccatgaagtgggtgccccactcacttctctgagatcgaacggactgtgaatccgctctttgtcggaagctgagcaagctgtggcttttttccaactccgtgtgacgtttctgagtgtagtgtggtaggaccccggcgggtgtggcagcaactgccctggagccccagcccctgcgtccatctgtgctgtgcgccccacagtagacgtgcagacgtccctgagaggttcttgaagatgtttatttatattgtccttttttactggaagacgtacgcatactccatcgatgttgtatttgcagtggctgaggaattcttgtacgcagttttctttggctttacgaagccgattaaaagaccgtgtgaaatgaaccttgctctgacaattcccttgcattgcaccacacactccttgctgcgggctcctgcagccagacctgagcagagagagaaggtggagaagcagcgggtctgcaagccttccctggggcctgcagagctagaaagggaggcccagcagactggcgctggtcagggtaggggagccaggcgggggacgggagcgggcagctcaggcctcagggcagccctgggaggcttctggcagtggtggccagagggctggactgtgcgggcagcttagcagggacagtggacgtgcacctgacgctgacctggactgcctcagtctagaagcaggccagagagcagaggcacgtggcatcccagggcgacctcagacggccagccggttagctagttctgctgttgcttcacgagttctgagcattctctgctagcctatggaagctgcagccctcggaggacagaagtgttgtgcgcccaacagaaccctctgagacgcaagctgctcccttggctagctcatatgtggaaatagccctgtaattcgaggtaactccttccgctcgtgtccacatccctcttgttgagagctcactgaaagtcatgtgcccggggaatgttcctgtgactgttttttgtttttccttttttttttaactttgtttttgtttttttcaattaagctggaactaaagtcaggcccagccattacgctccccacgtgcagccaggtgcagcctgggcccagtcatgcctggctcatagatgaaatcccttaagcaggattgaagaccagtgaacgcccccgccttttggattttttgctcaattgaccgtcttttccagacctctttaagtcacactcttaacttagctttctctgatgtctgttgccgccattagtttttttctagagcccacatggaagaaaagcctgcggacctcggttcagcgcacgagtaggacccgacagggaagactgcaagggtcattgtccgagcagtgaccgcggggggctcgccactgagggggttcgcagcgcggagactccagtctcgcgggatctgaggcgcactcggcttcgagggagcggcggccgcgcagccgctgtcaggccccgtcttgggccgagtcccgggttccctgtagcaggcttgggagcggggcgccaccttcctgggccctggacgtggccgacgcgttctcagtgtccgtgaggccggggcaggagtggcgggggtcgccccgaagtgggtgggaatgagcggcccgaggtcctgaagtcggggtccgccccgtctccccgctgccagcccgatttcctcggaagccgcgaccccccacgctgggctggcagttctgggctctgccggctgcgccttgccgggactcccacgggcgggctccgggcctccgtcctgatcccttggagcggttcgacgaagcaagttccgcggcgggcgcgcggggcactgtgggtagcgccggggctcaccaggcggaggcggggcccggcgtcaagctc

SEQ ID NO: 446000 - DNA, 3146 bp, Homo sapiens
gacccgccctcactcgcgcgttaggaggctcgggtcgttgtggtgcgctgtcttcccgcttgcgtcagggacctgcccgactcagtggccgccatggcatcagatgaaggcaaactttttgttggagggctgagttttgacaccaatgagcagtcgctggagcaggtcttctcaaagtacggacagatctctgaagtggtggttgtgaaagacagggagacccagagatctcggggatttgggtttgtcacctttgagaacattgacgacgctaaggatgccatgatggccatgaatgggaagtctgtagatggacggcagatccgagtagaccaggcaggcaagtcgtcagacaaccgatcccgtgggtaccgtggtggctctgccgggggccggggcttcttccgtgggggccgaggacggggccgtgggttctctagaggaggaggggaccgaggctatggggggaaccggttcgagtccaggagtgggggctacggaggctccagagactactatagcagccggagtcagagtggtggctacagtgaccggagctcgggcgggtcctacagagacagttacgacagttacggtaagtcacactccgagggcgccacgctgctgtggcctgcggtgggagctcggttcaccttggtgccctctccaagcactttaggctggacactcagaccttgtcactgtgcttgcccagaagaggcgcatctgtcctctcagagccatttctatcgcaggacgcaaaagccaaatgagactgaccaaaaaggcaagggagagcgagggcccgctgggcagtcagctaggtgcatgtgtggccgcaggccagcctccctcggctgtggggggtggttgctccccggccgcaggccgcgccctggtctggcctctggggtgaagctgcctcttgttgcttcggtgcctttacactgtgcctgcttcttgtcctcagctacacacaacgagtaaaaacccttcctgctcaagatcgtccttccaatggctgtgtgtttaaagattgtgggagcttcgctgaacgttaatgtgtagtaaatgcacctccttgtattcccactttcgtagtcatttcggttctgatcttgtcaaacccagcctgaccgcttctgacgccgggatggcctcgttactagacttttctttttaaggaagtgctgtttttttttgagggttttcaaaacattttgaaaagcatttacttttttgaccacgagccatgagttttcaaaaaaatcgggggttgtgtgggtttttggtttttgttttagtttttggttgcgttgcctttttttttttagtggggttggccccatgaagtgggtgccccactcacttctctgagatcgaacggactgtgaatccgctctttgtcggaagctgagcaagctgtggcttttttccaactccgtgtgacgtttctgagtgtagtgtggtaggaccccggcgggtgtggcagcaactgccctggagccccagcccctgcgtccatctgtgctgtgcgccccacagtagacgtgcagacgtccctgagaggttcttgaagatgtttatttatattgtccttttttactggaagacgtacgcatactccatcgatgttgtatttgcagtggctgaggaattcttgtacgcagttttctttggctttacgaagccgattaaaagaccgtgtgaaatgaaccttgctctgacaattcccttgcattgcaccacacactccttgctgcgggctcctgcagccagacctgagcagagagagaaggtggagaagcagcgggtctgcaagccttccctggggcctgcagagctagaaagggaggcccagcagactggcgctggtcagggtaggggagccaggcgggggacgggagcgggcagctcaggcctcagggcagccctgggaggcttctggcagtggtggccagagggctggactgtgcgggcagcttagcagggacagtggacgtgcacctgacgctgacctggactgcctcagtctagaagcaggccagagagcagaggcacgtggcatcccagggcgacctcagacggccagccggttagctagttctgctgttgcttcacgagttctgagcattctctgctagcctatggaagctgcagccctcggaggacagaagtgttgtgcgcccaacagaaccctctgagacgcaagctgctcccttggctagctcatatgtggaaatagccctgtaattcgaggtaactccttccgctcgtgtccacatccctcttgttgagagctcactgaaagtcatgtgcccggggaatgttcctgtgactgttttttgtttttccttttttttttaactttgtttttgtttttttcaattaagctggaactaaagtcaggcccagccattacgctccccacgtgcagccaggtgcagcctgggcccagtcatgcctggctcatagatgaaatcccttaagcaggattgaagaccagtgaacgcccccgccttttggattttttgctcaattgaccgtcttttccagacctctttaagtcacactcttaacttagctttctctgatgtctgttgccgccattagtttttttctagagcccacactggcccacatagctccatcccatacgggtagctggctccagctgcgccaaggtgcagacccgccctgggcatgctggcctgtgacggagcctgaggtcacagccccctgactagcctgagaccttcctaggggctgtggctgtttccggggaggccgggaggggcagctgtgagccctgtggaggacgttgggagtaacgctgctttgctttggcaggttgaaggggcccggccaggactcggggaagggtggcctgagagcagcgatgacctctggggtcactgtcccaggagggacttcacctggaacaagagctggaggcagccgcttgcccaggaggcttgtcccctgaggcgcttcgccagtgaggtgcgggctcagggcctcgagtctctcctggagcacgggctgcggtgcgccggcagcttacggggcggccagtccttgcccacaacgatgtggagccctgtgaaagtcggattcgaataaagggccacgtgtgcacccagaaa

SEQ ID NO: 446001 - DNA, 2734 bp, Homo sapiens
cgacgccccgcaggggaggaggcccgggaggagtatcagggtgcagtgaggccgccatggcatcagatgaaggcaaactttttgttggagggctgagttttgacaccaatgagcagtcgctggagcaggtcttctcaaagtacggacagatctctgaagtggtggttgtgaaagacagggagacccagagatctcggggatttgggtttgtcacctttgagaacattgacgacgctaaggatgccatgatggccatgaatgggaagtctgtagatggacggcagatccgagtagaccaggcaggcaagtcgtcagacaaccgatcccgtgggtaccgtggtggctctgccgggggccggggcttcttccgtgggggccgaggacggggccgtgggttctctagaggaggaggggaccgaggctatggggggaaccggttcgagtccaggagtgggggctacggaggctccagagactactatagcagccggagtcagagtggtggctacagtgaccggagctcgggcgggtcctacagagacagttacgacagttacgctacacacaacgagtaaaaacccttcctgctcaagatcgtccttccaatggctgtgtgtttaaagattgtgggagcttcgctgaacgttaatgtgtagtaaatgcacctccttgtattcccactttcgtagtcatttcggttctgatcttgtcaaacccagcctgaccgcttctgacgccgggatggcctcgttactagacttttctttttaaggaagtgctgtttttttttgagggttttcaaaacattttgaaaagcatttacttttttgaccacgagccatgagttttcaaaaaaatcgggggttgtgtgggtttttggtttttgttttagtttttggttgcgttgcctttttttttttagtggggttggccccatgaagtgggtgccccactcacttctctgagatcgaacggactgtgaatccgctctttgtcggaagctgagcaagctgtggcttttttccaactccgtgtgacgtttctgagtgtagtgtggtaggaccccggcgggtgtggcagcaactgccctggagccccagcccctgcgtccatctgtgctgtgcgccccacagtagacgtgcagacgtccctgagaggttcttgaagatgtttatttatattgtccttttttactggaagacgtacgcatactccatcgatgttgtatttgcagtggctgaggaattcttgtacgcagttttctttggctttacgaagccgattaaaagaccgtgtgaaatgaaccttgctctgacaattcccttgcattgcaccacacactccttgctgcgggctcctgcagccagacctgagcagagagagaaggtggagaagcagcgggtctgcaagccttccctggggcctgcagagctagaaagggaggcccagcagactggcgctggtcagggtaggggagccaggcgggggacgggagcgggcagctcaggcctcagggcagccctgggaggcttctggcagtggtggccagagggctggactgtgcgggcagcttagcagggacagtggacgtgcacctgacgctgacctggactgcctcagtctagaagcaggccagagagcagaggcacgtggcatcccagggcgacctcagacggccagccggttagctagttctgctgttgcttcacgagttctgagcattctctgctagcctatggaagctgcagccctcggaggacagaagtgttgtgcgcccaacagaaccctctgagacgcaagctgctcccttggctagctcatatgtggaaatagccctgtaattcgaggtaactccttccgctcgtgtccacatccctcttgttgagagctcactgaaagtcatgtgcccggggaatgttcctgtgactgttttttgtttttccttttttttttaactttgtttttgtttttttcaattaagctggaactaaagtcaggcccagccattacgctccccacgtgcagccaggtgcagcctgggcccagtcatgcctggctcatagatgaaatcccttaagcaggattgaagaccagtgaacgcccccgccttttggattttttgctcaattgaccgtcttttccagacctctttaagtcacactcttaacttagctttctctgatgtctgttgccgccattagtttttttctagagcccacactggcccacatagctccatcccatacgggtagctggctccagctgcgccaaggtgcagacccgccctgggcatgctggcctgtgacggagcctgaggtcacagccccctgactagcctgagaccttcctaggggctgtggctgtttccggggaggccgggaggggcagctgtgagccctgtggaggacgttgggagtaacgctgctttgctttggcaggttgaaggggcccggccaggactcggggaagggtggcctgagagcagcgatgacctctggggtcactgtcccaggagggacttcacctggaacaagagctggaggcagccgcttgcccaggaggcttgtcccctgaggcgcttcgccagtgaggtgcgggctcagggcctcgagtctctcctggagcacgggctgcggtgcgccggcagcttacggggcggccagtccttgcccacaacgatgtggagccctgtgaaagtcggattcgaataaagggccacgtgtgcacccagaaa

SEQ ID NO: 446002 - DNA, 3052 bp, Homo sapiens
actctgactgatccccgcgcctcgccgggcaggggcgagccccgcgcgtcgggcccggaatagcagtctcgcccccgcccggcgcggctattttgagctcctccgttggggccgaggcgcgggggcggcgggaggctgggggtcgacacgcaggctgcgtcctcgccccgcgagattggacccctcgaggactgtgcgctgtggccgcgcagggctgggcggcggggccccctctcccacgcgaggcgtctgcgtggagcggcggcaccgggagcccggccgctcgagccaaacgccgcggacggagcgaggccgcagcgccccctggtgtccgcaacgggcagcgcgtcccggtcgggtcccgcatggccgccatggcatcagatgaaggcaaactttttgttggagggctgagttttgacaccaatgagcagtcgctggagcaggtcttctcaaagtacggacagatctctgaagtggtggttgtgaaagacagggagacccagagatctcggggatttgggtttgtcacctttgagaacattgacgacgctaaggatgccatgatggccatgaatgggaagtctgtagatggacggcagatccgagtagaccaggcaggcaagtcgtcagacaaccgatcccgtgggtaccgtggtggctctgccgggggccggggcttcttccgtgggggccgaggacggggccgtgggttctctagaggaggaggggaccgaggctatggggggaaccggttcgagtccaggagtgggggctacggaggctccagagactactatagcagccggagtcagagtggtggctacagtgaccggagctcgggcgggtcctacagagacagttacgacagttacgctacacacaacgagtaaaaacccttcctgctcaagatcgtccttccaatggctgtgtgtttaaagattgtgggagcttcgctgaacgttaatgtgtagtaaatgcacctccttgtattcccactttcgtagtcatttcggttctgatcttgtcaaacccagcctgaccgcttctgacgccgggatggcctcgttactagacttttctttttaaggaagtgctgtttttttttgagggttttcaaaacattttgaaaagcatttacttttttgaccacgagccatgagttttcaaaaaaatcgggggttgtgtgggtttttggtttttgttttagtttttggttgcgttgcctttttttttttagtggggttggccccatgaagtgggtgccccactcacttctctgagatcgaacggactgtgaatccgctctttgtcggaagctgagcaagctgtggcttttttccaactccgtgtgacgtttctgagtgtagtgtggtaggaccccggcgggtgtggcagcaactgccctggagccccagcccctgcgtccatctgtgctgtgcgccccacagtagacgtgcagacgtccctgagaggttcttgaagatgtttatttatattgtccttttttactggaagacgtacgcatactccatcgatgttgtatttgcagtggctgaggaattcttgtacgcagttttctttggctttacgaagccgattaaaagaccgtgtgaaatgaaccttgctctgacaattcccttgcattgcaccacacactccttgctgcgggctcctgcagccagacctgagcagagagagaaggtggagaagcagcgggtctgcaagccttccctggggcctgcagagctagaaagggaggcccagcagactggcgctggtcagggtaggggagccaggcgggggacgggagcgggcagctcaggcctcagggcagccctgggaggcttctggcagtggtggccagagggctggactgtgcgggcagcttagcagggacagtggacgtgcacctgacgctgacctggactgcctcagtctagaagcaggccagagagcagaggcacgtggcatcccagggcgacctcagacggccagccggttagctagttctgctgttgcttcacgagttctgagcattctctgctagcctatggaagctgcagccctcggaggacagaagtgttgtgcgcccaacagaaccctctgagacgcaagctgctcccttggctagctcatatgtggaaatagccctgtaattcgaggtaactccttccgctcgtgtccacatccctcttgttgagagctcactgaaagtcatgtgcccggggaatgttcctgtgactgttttttgtttttccttttttttttaactttgtttttgtttttttcaattaagctggaactaaagtcaggcccagccattacgctccccacgtgcagccaggtgcagcctgggcccagtcatgcctggctcatagatgaaatcccttaagcaggattgaagaccagtgaacgcccccgccttttggattttttgctcaattgaccgtcttttccagacctctttaagtcacactcttaacttagctttctctgatgtctgttgccgccattagtttttttctagagcccacactggcccacatagctccatcccatacgggtagctggctccagctgcgccaaggtgcagacccgccctgggcatgctggcctgtgacggagcctgaggtcacagccccctgactagcctgagaccttcctaggggctgtggctgtttccggggaggccgggaggggcagctgtgagccctgtggaggacgttgggagtaacgctgctttgctttggcaggttgaaggggcccggccaggactcggggaagggtggcctgagagcagcgatgacctctggggtcactgtcccaggagggacttcacctggaacaagagctggaggcagccgcttgcccaggaggcttgtcccctgaggcgcttcgccagtgaggtgcgggctcagggcctcgagtctctcctggagcacgggctgcggtgcgccggcagcttacggggcggccagtccttgcccacaacgatgtggagccctgtgaaagtcggattcgaataaagggccacgtgtgcacccagaaa

SEQ ID NO: 446003 - DNA, 2724 bp, Homo sapiens
gacccgccctcactcgcgcgttaggaggctcgggtcgttgtggtgcgctgtcttcccgcttgcgtcagggacctgcccgactcagtggaagcggggagaggtggtgagagatgacccctgttgaggatttcattggtgtctgccacagccgccatggcatcagatgaaggcaaactttttgttggagggctgagttttgacaccaatgagcagtcgctggagcaggtcttctcaaagtacggacagatctctgaagtctgtagatggacggcagatccgagtagaccaggcaggcaagtcgtcagacaaccgatcccgtgggtaccgtggtggctctgccgggggccggggcttcttccgtgggggccgaggacggggccgtgggttctctagaggaggaggggaccgaggctatggggggaaccggttcgagtccaggagtgggggctacggaggctccagagactactatagcagccggagtcagagtggtggctacagtgaccggagctcgggcgggtcctacagagacagttacgacagttacgctacacacaacgagtaaaaacccttcctgctcaagatcgtccttccaatggctgtgtgtttaaagattgtgggagcttcgctgaacgttaatgtgtagtaaatgcacctccttgtattcccactttcgtagtcatttcggttctgatcttgtcaaacccagcctgaccgcttctgacgccgggatggcctcgttactagacttttctttttaaggaagtgctgtttttttttgagggttttcaaaacattttgaaaagcatttacttttttgaccacgagccatgagttttcaaaaaaatcgggggttgtgtgggtttttggtttttgttttagtttttggttgcgttgcctttttttttttagtggggttggccccatgaagtgggtgccccactcacttctctgagatcgaacggactgtgaatccgctctttgtcggaagctgagcaagctgtggcttttttccaactccgtgtgacgtttctgagtgtagtgtggtaggaccccggcgggtgtggcagcaactgccctggagccccagcccctgcgtccatctgtgctgtgcgccccacagtagacgtgcagacgtccctgagaggttcttgaagatgtttatttatattgtccttttttactggaagacgtacgcatactccatcgatgttgtatttgcagtggctgaggaattcttgtacgcagttttctttggctttacgaagccgattaaaagaccgtgtgaaatgaaccttgctctgacaattcccttgcattgcaccacacactccttgctgcgggctcctgcagccagacctgagcagagagagaaggtggagaagcagcgggtctgcaagccttccctggggcctgcagagctagaaagggaggcccagcagactggcgctggtcagggtaggggagccaggcgggggacgggagcgggcagctcaggcctcagggcagccctgggaggcttctggcagtggtggccagagggctggactgtgcgggcagcttagcagggacagtggacgtgcacctgacgctgacctggactgcctcagtctagaagcaggccagagagcagaggcacgtggcatcccagggcgacctcagacggccagccggttagctagttctgctgttgcttcacgagttctgagcattctctgctagcctatggaagctgcagccctcggaggacagaagtgttgtgcgcccaacagaaccctctgagacgcaagctgctcccttggctagctcatatgtggaaatagccctgtaattcgaggtaactccttccgctcgtgtccacatccctcttgttgagagctcactgaaagtcatgtgcccggggaatgttcctgtgactgttttttgtttttccttttttttttaactttgtttttgtttttttcaattaagctggaactaaagtcaggcccagccattacgctccccacgtgcagccaggtgcagcctgggcccagtcatgcctggctcatagatgaaatcccttaagcaggattgaagaccagtgaacgcccccgccttttggattttttgctcaattgaccgtcttttccagacctctttaagtcacactcttaacttagctttctctgatgtctgttgccgccattagtttttttctagagcccacactggcccacatagctccatcccatacgggtagctggctccagctgcgccaaggtgcagacccgccctgggcatgctggcctgtgacggagcctgaggtcacagccccctgactagcctgagaccttcctaggggctgtggctgtttccggggaggccgggaggggcagctgtgagccctgtggaggacgttgggagtaacgctgctttgctttggcaggttgaaggggcccggccaggactcggggaagggtggcctgagagcagcgatgacctctggggtcactgtcccaggagggacttcacctggaacaagagctggaggcagccgcttgcccaggaggcttgtcccctgaggcgcttcgccagtgaggtgcgggctcagggcctcgagtctctcctggagcacgggctgcggtgcgccggcagcttacggggcggccagtccttgcccacaacgatgtggagccctgtgaaagtcggattcgaataaagggccacgtgtgcacccagaaa

SEQ ID NO: 446004 - DNA, 2382 bp, Homo sapiens
  misc_feature (21)..(21): n is a, c, g, or t
  misc_feature (24)..(25): n is a, c, g, or t
  misc_feature (40)..(40): n is a, c, g, or t
aggctgattctagaggatccnatnnaggcaggacgaggcntgggttcctagaggaggaggggaccgaggctatggggggaaccggttcgagtccaggagtgggggctacggaggctccagagactactatagcagccggagtcagagtggtggctacagtgaccggagctcgggcgggtcctacagagacagttacgacagttacgctacacacaacgagtaaaaacccttcctgctcaagatcgtccttccaatggctgtgtgtttaaagattgtgggagcttcgctgaacgttaatgtgtagtaaatgcacctccttgtattcccactttcgtagtcatttcggttctgatcttgtcaaacccagcctgaccgcttctgacgccgggatggcctcgttactagacttttctttttaaggaagtgctgtttttttttgagggttttcaaaacattttgaaaagcatttacttttttgaccacgagccatgagttttcaaaaaaatcgggggttgtgtgggtttttggtttttgttttagtttttggttgcgttgcctttttttttttagtggggttggccccatgaagtgggtgccccactcacttctctgagatcgaacggactgtgaatccgctctttgtcggaagctgagcaagctgtggcttttttccaactccgtgtgacgtttctgagtgtagtgtggtaggaccccggcgggtgtggcagcaactgccctggagccccagcccctgcgtccatctgtgctgtgcgccccacagtagacgtgcagacgtccctgagaggttcttgaagatgtttatttatattgtccttttttactggaagacgtacgcatactccatcgatgttgtatttgcagtggctgaggaattcttgtacgcagttttctttggctttacgaagccgattaaaagaccgtgtgaaatgaaccttgctctgacaattcccttgcattgcaccacacactccttgctgcgggctcctgcagccagacctgagcagagagagaaggtggagaagcagcgggtctgcaagccttccctggggcctgcagagctagaaagggaggcccagcagactggcgctggtcagggtaggggagccaggcgggggacgggagcgggcagctcaggcctcagggcagccctgggaggcttctggcagtggtggccagagggctggactgtgcgggcagcttagcagggacagtggacgtgcacctgacgctgacctggactgcctcagtctagaagcaggccagagagcagaggcacgtggcatcccagggcgacctcagacggccagccggttagctagttctgctgttgcttcacgagttctgagcattctctgctagcctatggaagctgcagccctcggaggacagaagtgttgtgcgcccaacagaaccctctgagacgcaagctgctcccttggctagctcatatgtggaaatagccctgtaattcgaggtaactccttccgctcgtgtccacatccctcttgttgagagctcactgaaagtcatgtgcccggggaatgttcctgtgactgttttttgtttttccttttttttttaactttgtttttgtttttttcaattaagctggaactaaagtcaggcccagccattacgctccccacgtgcagccaggtgcagcctgggcccagtcatgcctggctcatagatgaaatcccttaagcaggattgaagaccagtgaacgcccccgccttttggattttttgctcaattgaccgtcttttccagacctctttaagtcacactcttaacttagctttctctgatgtctgttgccgccattagtttttttctagagcccacactggcccacatagctccatcccatacgggtagctggctccagctgcgccaaggtgcagacccgccctgggcatgctggcctgtgacggagcctgaggtcacagccccctgactagcctgagaccttcctaggggctgtggctgtttccggggaggccgggaggggcagctgtgagccctgtggaggacgttgggagtaacgctgctttgctttggcaggttgaaggggcccggccaggactcggggaagggtggcctgagagcagcgatgacctctggggtcactgtcccaggagggacttcacctggaacaagagctggaggcagccgcttgcccaggaggcttgtcccctgaggcgcttcgccagtgaggtgcgggctcagggcctcgagtctctcctggagcacgggctgcggtgcgccggcagcttacggggcggccagtccttgcccacaacgatgtggagccctgtgaaagtcggattcgaataaagggccacgtgtgcacccagaaa

SEQ ID NO: 446005 - DNA, 3165 bp, Homo sapiens
gacccgccctcactcgcgcgttaggaggctcgggtcgttgtggtgcgctgtcttcccgcttgcgtcagggacctgcccgactcagtggccgccatggcatcagatgaaggcaaactttttgttggagggctgagttttgacaccaatgagcagtcgctggagcaggtcttctcaaagtacggacagatctctgaagacctctctcccctgcacagtggtggttgtgaaagacagggagacccagagatctcggggatttgggtttgtcacctttgagaacattgacgacgctaaggatgccatgatggccatgaatgggaagtctgtagatggacggcagatccgagtagaccaggcaggcaagtcgtcagacaaccgatcccgtgggtaccgtggtggctctgccgggggccggggcttcttccgtgggggccgaggacggggccgtgggttctctagaggaggaggggaccgaggctatggggggaaccggttcgagtccaggagtgggggctacggaggctccagagactactatagcagccggagtcagagtggtggctacagtgaccggagctcgggcgggtcctacagagacagttacgacagttacggtaagtcacactccgagggcgccacgctgctgtggcctgcggtgggagctcggttcaccttggtgccctctccaagcactttaggctggacactcagaccttgtcactgtgcttgcccagaagaggcgcatctgtcctctcagagccatttctatcgcaggacgcaaaagccaaatgagactgaccaaaaaggcaagggagagcgagggcccgctgggcagtcagctaggtgcatgtgtggccgcaggccagcctccctcggctgtggggggtggttgctccccggccgcaggccgcgccctggtctggcctctggggtgaagctgcctcttgttgcttcggtgcctttacactgtgcctgcttcttgtcctcagctacacacaacgagtaaaaacccttcctgctcaagatcgtccttccaatggctgtgtgtttaaagattgtgggagcttcgctgaacgttaatgtgtagtaaatgcacctccttgtattcccactttcgtagtcatttcggttctgatcttgtcaaacccagcctgaccgcttctgacgccgggatggcctcgttactagacttttctttttaaggaagtgctgtttttttttgagggttttcaaaacattttgaaaagcatttacttttttgaccacgagccatgagttttcaaaaaaatcgggggttgtgtgggtttttggtttttgttttagtttttggttgcgttgcctttttttttttagtggggttggccccatgaagtgggtgccccactcacttctctgagatcgaacggactgtgaatccgctctttgtcggaagctgagcaagctgtggcttttttccaactccgtgtgacgtttctgagtgtagtgtggtaggaccccggcgggtgtggcagcaactgccctggagccccagcccctgcgtccatctgtgctgtgcgccccacagtagacgtgcagacgtccctgagaggttcttgaagatgtttatttatattgtccttttttactggaagacgtacgcatactccatcgatgttgtatttgcagtggctgaggaattcttgtacgcagttttctttggctttacgaagccgattaaaagaccgtgtgaaatgaaccttgctctgacaattcccttgcattgcaccacacactccttgctgcgggctcctgcagccagacctgagcagagagagaaggtggagaagcagcgggtctgcaagccttccctggggcctgcagagctagaaagggaggcccagcagactggcgctggtcagggtaggggagccaggcgggggacgggagcgggcagctcaggcctcagggcagccctgggaggcttctggcagtggtggccagagggctggactgtgcgggcagcttagcagggacagtggacgtgcacctgacgctgacctggactgcctcagtctagaagcaggccagagagcagaggcacgtggcatcccagggcgacctcagacggccagccggttagctagttctgctgttgcttcacgagttctgagcattctctgctagcctatggaagctgcagccctcggaggacagaagtgttgtgcgcccaacagaaccctctgagacgcaagctgctcccttggctagctcatatgtggaaatagccctgtaattcgaggtaactccttccgctcgtgtccacatccctcttgttgagagctcactgaaagtcatgtgcccggggaatgttcctgtgactgttttttgtttttccttttttttttaactttgtttttgtttttttcaattaagctggaactaaagtcaggcccagccattacgctccccacgtgcagccaggtgcagcctgggcccagtcatgcctggctcatagatgaaatcccttaagcaggattgaagaccagtgaacgcccccgccttttggattttttgctcaattgaccgtcttttccagacctctttaagtcacactcttaacttagctttctctgatgtctgttgccgccattagtttttttctagagcccacactggcccacatagctccatcccatacgggtagctggctccagctgcgccaaggtgcagacccgccctgggcatgctggcctgtgacggagcctgaggtcacagccccctgactagcctgagaccttcctaggggctgtggctgtttccggggaggccgggaggggcagctgtgagccctgtggaggacgttgggagtaacgctgctttgctttggcaggttgaaggggcccggccaggactcggggaagggtggcctgagagcagcgatgacctctggggtcactgtcccaggagggacttcacctggaacaagagctggaggcagccgcttgcccaggaggcttgtcccctgaggcgcttcgccagtgaggtgcgggctcagggcctcgagtctctcctggagcacgggctgcggtgcgccggcagcttacggggcggccagtccttgcccacaacgatgtggagccctgtgaaagtcggattcgaataaagggccacgtgtgcacccagaaa

SEQ ID NO: 446006 - DNA, 2305 bp, Homo sapiens
cccgggaatctcacggagccagggaatcgcacggaggctccagagactactatagcagccggagtcagagtggtggctacagtgaccggagctcgggcgggtcctacagagacagttacgacagttacgctacacacaacgagtaaaaacccttcctgctcaagatcgtccttccaatggctgtgtgtttaaagattgtgggagcttcgctgaacgttaatgtgtagtaaatgcacctccttgtattcccactttcgtagtcatttcggttctgatcttgtcaaacccagcctgaccgcttctgacgccgggatggcctcgttactagacttttctttttaaggaagtgctgtttttttttgagggttttcaaaacattttgaaaagcatttacttttttgaccacgagccatgagttttcaaaaaaatcgggggttgtgtgggtttttggtttttgttttagtttttggttgcgttgcctttttttttttagtggggttggccccatgaagtgggtgccccactcacttctctgagatcgaacggactgtgaatccgctctttgtcggaagctgagcaagctgtggcttttttccaactccgtgtgacgtttctgagtgtagtgtggtaggaccccggcgggtgtggcagcaactgccctggagccccagcccctgcgtccatctgtgctgtgcgccccacagtagacgtgcagacgtccctgagaggttcttgaagatgtttatttatattgtccttttttactggaagacgtacgcatactccatcgatgttgtatttgcagtggctgaggaattcttgtacgcagttttctttggctttacgaagccgattaaaagaccgtgtgaaatgaaccttgctctgacaattcccttgcattgcaccacacactccttgctgcgggctcctgcagccagacctgagcagagagagaaggtggagaagcagcgggtctgcaagccttccctggggcctgcagagctagaaagggaggcccagcagactggcgctggtcagggtaggggagccaggcgggggacgggagcgggcagctcaggcctcagggcagccctgggaggcttctggcagtggtggccagagggctggactgtgcgggcagcttagcagggacagtggacgtgcacctgacgctgacctggactgcctcagtctagaagcaggccagagagcagaggcacgtggcatcccagggcgacctcagacggccagccggttagctagttctgctgttgcttcacgagttctgagcattctctgctagcctatggaagctgcagccctcggaggacagaagtgttgtgcgcccaacagaaccctctgagacgcaagctgctcccttggctagctcatatgtggaaatagccctgtaattcgaggtaactccttccgctcgtgtccacatccctcttgttgagagctcactgaaagtcatgtgcccggggaatgttcctgtgactgttttttgtttttccttttttttttaactttgtttttgtttttttcaattaagctggaactaaagtcaggcccagccattacgctccccacgtgcagccaggtgcagcctgggcccagtcatgcctggctcatagatgaaatcccttaagcaggattgaagaccagtgaacgcccccgccttttggattttttgctcaattgaccgtcttttccagacctctttaagtcacactcttaacttagctttctctgatgtctgttgccgccattagtttttttctagagcccacactggcccacatagctccatcccatacgggtagctggctccagctgcgccaaggtgcagacccgccctgggcatgctggcctgtgacggagcctgaggtcacagccccctgactagcctgagaccttcctaggggctgtggctgtttccggggaggccgggaggggcagctgtgagccctgtggaggacgttgggagtaacgctgctttgctttggcaggttgaaggggcccggccaggactcggggaagggtggcctgagagcagcgatgacctctggggtcactgtcccaggagggacttcacctggaacaagagctggaggcagccgcttgcccaggaggcttgtcccctgaggcgcttcgccagtgaggtgcgggctcagggcctcgagtctctcctggagcacgggctgcggtgcgccggcagcttacggggcggccagtccttgcccacaacgatgtggagccctgtgaaagtcggattcgaataaagggccacgtgtgcacccagaaa

SEQ ID NO: 446007 - DNA, 2068 bp, Homo sapiens
cccctggcagcccctccgggtctagttccgcctgttccaggtcttccgcttccgccatgaggttctgacgccgggatggcctcgttactagacttttctttttaaggaagtgctgtttttttttgagggttttcaaaacattttgaaaagcatttacttttttgaccacgagccatgagttttcaaaaaaatcgggggttgtgtgggtttttggtttttgttttagtttttggttgcgttgcctttttttttttagtggggttggccccatgaagtgggtgccccactcacttctctgagatcgaacggactgtgaatccgctctttgtcggaagctgagcaagctgtggcttttttccaactccgtgtgacgtttctgagtgtagtgtggtaggaccccggcgggtgtggcagcaactgccctggagccccagcccctgcgtccatctgtgctgtgcgccccacagtagacgtgcagacgtccctgagaggttcttgaagatgtttatttatattgtccttttttactggaagacgtacgcatactccatcgatgttgtatttgcagtggctgaggaattcttgtacgcagttttctttggctttacgaagccgattaaaagaccgtgtgaaatgaaccttgctctgacaattcccttgcattgcaccacacactccttgctgcgggctcctgcagccagacctgagcagagagagaaggtggagaagcagcgggtctgcaagccttccctggggcctgcagagctagaaagggaggcccagcagactggcgctggtcagggtaggggagccaggcgggggacgggagcgggcagctcaggcctcagggcagccctgggaggcttctggcagtggtggccagagggctggactgtgcgggcagcttagcagggacagtggacgtgcacctgacgctgacctggactgcctcagtctagaagcaggccagagagcagaggcacgtggcatcccagggcgacctcagacggccagccggttagctagttctgctgttgcttcacgagttctgagcattctctgctagcctatggaagctgcagccctcggaggacagaagtgttgtgcgcccaacagaaccctctgagacgcaagctgctcccttggctagctcatatgtggaaatagccctgtaattcgaggtaactccttccgctcgtgtccacatccctcttgttgagagctcactgaaagtcatgtgcccggggaatgttcctgtgactgttttttgtttttccttttttttttaactttgtttttgtttttttcaattaagctggaactaaagtcaggcccagccattacgctccccacgtgcagccaggtgcagcctgggcccagtcatgcctggctcatagatgaaatcccttaagcaggattgaagaccagtgaacgcccccgccttttggattttttgctcaattgaccgtcttttccagacctctttaagtcacactcttaacttagctttctctgatgtctgttgccgccattagtttttttctagagcccacactggcccacatagctccatcccatacgggtagctggctccagctgcgccaaggtgcagacccgccctgggcatgctggcctgtgacggagcctgaggtcacagccccctgactagcctgagaccttcctaggggctgtggctgtttccggggaggccgggaggggcagctgtgagccctgtggaggacgttgggagtaacgctgctttgctttggcaggttgaaggggcccggccaggactcggggaagggtggcctgagagcagcgatgacctctggggtcactgtcccaggagggacttcacctggaacaagagctggaggcagccgcttgcccaggaggcttgtcccctgaggcgcttcgccagtgaggtgcgggctcagggcctcgagtctctcctggagcacgggctgcggtgcgccggcagcttacggggcggccagtccttgcccacaacgatgtggagccctgtgaaagtcggattcgaataaagggccacgtgtgcacccagaaa

SEQ ID NO: 446008 - DNA, 2107 bp, Homo sapiens
gacccgccctcactcgcgcgttaggaggctcgggtcgttgtggtgcgctgtcttcccgcttgcgtcagggacctgcccgactcagtggccgccatggcatcagatgaaggcaaactttttgttggagggctgagttttgacaccaatgagcagtcgctggagcaggtcttctcaaagtacggacagatctctgaagtggtggttgtgaaagacagggagacccagagatctcggggatttgggtttgtcacctttgagaacattgacgacgctaaggatgccatgatggccatgaatgggaagtctgtagatggacggcagatccgagtagaccaggcaggcaagtcgtcagacaaccgatcccgtgggtaccgtggtggctctgccgggggccggggcttcttccgtgggggccgaggacggggccgtgggttctctagaggaggaggggaccgaggctatggggggaaccggttcgacgtccatctgtgctgtgcgccccacagtagacgtgcagacgtccctgagaggttcttgaagatgtttatttatattgtccttttttactggaagacgtacgcatactccatcgatgttgtatttgcagtggctgaggaattcttgtacgcagttttctttggctttacgaagccgattaaaagaccgtgtgaaatgaaccttgctctgacaattcccttgcattgcaccacacactccttgctgcgggctcctgcagccagacctgagcagagagagaaggtggagaagcagcgggtctgcaagccttccctggggcctgcagagctagaaagggaggcccagcagactggcgctggtcagggtaggggagccaggcgggggacgggagcgggcagctcaggcctcagggcagccctgggaggcttctggcagtggtggccagagggctggactgtgcgggcagcttagcagggacagtggacgtgcacctgacgctgacctggactgcctcagtctagaagcaggccagagagcagaggcacgtggcatcccagggcgacctcagacggccagccggttagctagttctgctgttgcttcacgagttctgagcattctctgctagcctatggaagctgcagccctcggaggacagaagtgttgtgcgcccaacagaaccctctgagacgcaagctgctcccttggctagctcatatgtggaaatagccctgtaattcgaggtaactccttccgctcgtgtccacatccctcttgttgagagctcactgaaagtcatgtgcccggggaatgttcctgtgactgttttttgtttttccttttttttttaactttgtttttgtttttttcaattaagctggaactaaagtcaggcccagccattacgctccccacgtgcagccaggtgcagcctgggcccagtcatgcctggctcatagatgaaatcccttaagcaggattgaagaccagtgaacgcccccgccttttggattttttgctcaattgaccgtcttttccagacctctttaagtcacactcttaacttagctttctctgatgtctgttgccgccattagtttttttctagagcccacactggcccacatagctccatcccatacgggtagctggctccagctgcgccaaggtgcagacccgccctgggcatgctggcctgtgacggagcctgaggtcacagccccctgactagcctgagaccttcctaggggctgtggctgtttccggggaggccgggaggggcagctgtgagccctgtggaggacgttgggagtaacgctgctttgctttggcaggttgaaggggcccggccaggactcggggaagggtggcctgagagcagcgatgacctctggggtcactgtcccaggagggacttcacctggaacaagagctggaggcagccgcttgcccaggaggcttgtcccctgaggcgcttcgccagtgaggtgcgggctcagggcctcgagtctctcctggagcacgggctgcggtgcgccggcagcttacggggcggccagtccttgcccacaacgatgtggagccctgtgaaagtcggattcgaataaagggccacgtgtgcacccagaaa

SEQ ID NO: 446009 - DNA, 2046 bp, Homo sapiens
agttttgacaccaatgagcagtcgctggagcaggtcttctcaaagtacggacagatctctgaagtggtggttgtgaaagacagggagacccagagatctcggggatttgggtttgtcacctttgagaacattgacgacgctaaggatgccatgatggccatgaatgggaagtctgtagatggacggcagatccgagtagactgccgccatggcatcagatgaaggcaaactttttgttggagggctgagttttgacaccaatgagcagtcgctggagcaggtcttctcaaagtacggacagatctctgaagtggtggttgtgaaagacagggagacccagagatctcggggatttgggtttgtcacctttgagaacattgacgacgctaaggatgccatgatggccatgaatgggaagcgtccatctgtgctgtgcgccccacagtagacgtgcagacgtccctgagaggttcttgaagatgtttatttatattgtccttttttactggaagacgtacgcatactccatcgatgttgtatttgcagtggctgaggaattcttgtacgcagttttctttggctttacgaagccgattaaaagaccgtgtgaaatgaaccttgctctgacaattcccttgcattgcaccacacactccttgctgcgggctcctgcagccagacctgagcagagagagaaggtggagaagcagcgggtctgcaagccttccctggggcctgcagagctagaaagggaggcccagcagactggcgctggtcagggtaggggagccaggcgggggacgggagcgggcagctcaggcctcagggcagccctgggaggcttctggcagtggtggccagagggctggactgtgcgggcagcttagcagggacagtggacgtgcacctgacgctgacctggactgcctcagtctagaagcaggccagagagcagaggcacgtggcatcccagggcgacctcagacggccagccggttagctagttctgctgttgcttcacgagttctgagcattctctgctagcctatggaagctgcagccctcggaggacagaagtgttgtgcgcccaacagaaccctctgagacgcaagctgctcccttggctagctcatatgtggaaatagccctgtaattcgaggtaactccttccgctcgtgtccacatccctcttgttgagagctcactgaaagtcatgtgcccggggaatgttcctgtgactgttttttgtttttccttttttttttaactttgtttttgtttttttcaattaagctggaactaaagtcaggcccagccattacgctccccacgtgcagccaggtgcagcctgggcccagtcatgcctggctcatagatgaaatcccttaagcaggattgaagaccagtgaacgcccccgccttttggattttttgctcaattgaccgtcttttccagacctctttaagtcacactcttaacttagctttctctgatgtctgttgccgccattagtttttttctagagcccacactggcccacatagctccatcccatacgggtagctggctccagctgcgccaaggtgcagacccgccctgggcatgctggcctgtgacggagcctgaggtcacagccccctgactagcctgagaccttcctaggggctgtggctgtttccggggaggccgggaggggcagctgtgagccctgtggaggacgttgggagtaacgctgctttgctttggcaggttgaaggggcccggccaggactcggggaagggtggcctgagagcagcgatgacctctggggtcactgtcccaggagggacttcacctggaacaagagctggaggcagccgcttgcccaggaggcttgtcccctgaggcgcttcgccagtgaggtgcgggctcagggcctcgagtctctcctggagcacgggctgcggtgcgccggcagcttacggggcggccagtccttgcccacaacgatgtggagccctgtgaaagtcggattcgaataaagggccacgtgtgcacccagaaa

SEQ ID NO: 446010 - DNA, 717 bp, Homo sapiens
gacccgccctcactcgcgcgttaggaggctcgggtcgttgtggtgcgctgtcttcccgcttgcgtcagggacctgcccgactcagtggccgccatggcatcagatgaaggcaaactttttgttggagggctgagttttgacaccaatgagcagtcgctggagcaggtcttctcaaagtacggacagatctctgaagtggtggttgtgaaagacagggagacccagagatctcggggatttgggtttgtcacctttgagaacattgacgacgctaaggatgccatgatggccatgaatgggaagtctgtagatggacggcagatccgagtagaccaggcaggcaagtcgtcagacaaccgatcccgtgggtaccgtggtggctctgccgggggccggggcttcttccgtgggggccgaggacggggccgtgggttctctagaggaggaggggaccgaggctatggggggaaccggttcgagtccaggagtgggggctacggaggctccagagactactatagcagccggagtcagagtggtggctacagtgaccggagctcgggcgggtcctacagagacagttacgacagttacgctacacacaacgagtaaaaacccttcctcacagttgccatgtagaccccttgaagaggggaggggcctagggagccgcaccttgtcatgtaccatcaataaagtaccctgtgctcaaccaaa

SEQ ID NO: 446011 - DNA, 1116 bp, Homo sapiens
atgaaggggtcccagccgcctgagacccccggtggggacacaggatcgcggtgagatacctgggagtcacgggtgctcgcagacgcagctgaccccagaggcacaggccgccatggcatcagatgaaggcaaactttttgttggagggctgagttttgacaccaatgagcagtcgctggagcaggtcttctcaaagtacggacagatctctgaagtggtggttgtgaaagacagggagacccagagatctcggggatttgggtttgtcacctttgagaacattgacgacgctaaggatgccatgatggccatgaatgggaagtctgtagatggacggcagatccgagtagaccaggcaggcaagtcgtcagacaaccgatcccgtgggtaccgtggtggctctgccgggggccggggcttcttccgtgggggccgaggacggggccgtgggttctctagaggaggaggggaccgaggctatggggggaaccggttcgagtccaggagtgggggctacggaggctccagagactactatagcagccggagtcagagtggtggctacagtgaccggagctcgggcgggtcctacagagacagttacgacagttacggttgaaggggcccggccaggactcggggaagggtggcctgagagcagcgatgacctctggggtcactgtcccaggagggacttcacctggaacaagagctggaggcagccgcttgcccaggaggcttgtcccctgtaagtgctttcgggaagagtggcatgtggcgctgagccctgtcccgggcggcacctgggcgtttcagtgagtcctgctctcccgcacctatggccccacggcgggcgcctttcggtgtgtgttgggtgcagggcagcgcctcccgggagcgccgggtccctcgcctggagcccgcgcctgttctccctcccttcctcctccttccgaggcgcttcgccagtgaggtgcgggctcagggcctcgagtctctcctggagcacgggctgcggtgcgccggcagcttacggggcggccagtccttgcccacaacgatgtggagccctgtgaaagtcggattcgaataaagggccacgtgtgcacccagaaa

SEQ ID NO: 446012 - DNA, 307 bp, Homo sapiens
ggcggccgcgggcggagccagcccccatttcgagcggggcttctccctgcgccgagcctgacaaaatgggggcggcggcggcgcgggcctgcagggcctgccgggcgcacgtggcggcctcgggcctgggagccgggccgcgtcctctctcctcggccgcgcggccaccggcgaagttctaggggcggggggctcgccccgcgcaggagtcaccccaactttcacggctccaaaaaatacttccccattaggggccggtcattgcccagacaattgcgcaccacaattaaggtgttccaaggttcgc

SEQ ID NO: 446013 - DNA, 2323 bp, Homo sapiens
  misc_feature (17)..(17): n is a, c, g, or t
  misc_feature (22)..(23): n is a, c, g, or t
aggctaggtacgaggcnggtgnntgaatcggccggtgaggaggctgcgtctggctcccgctctcacagccattgcagtacattgagctccatagagacagcgccggggcaagtgagagccggacgggcactgggcgactctgtgcctcgctgaggaaaaataactaaacatgggcaaaggagatcctaagaagccgagaggcaaaatgtcatcatatgcattttttgtgcaaacttgtcgggaggagcataagaagaagcacccagatgcttcagtcaacttctcagagttttctaagaagtgctcagagaggtggaagaccatgtctgctaaagagaaaggaaaatttgaagatatggcaaaagcggacaaggcccgttatgaaagagaaatgaaaacctatatccctcccaaaggggagacaaaaaagaagttcaaggatcccaatgcacccaagaggcctccttcggccttcttcctcttctgctctgagtatcgcccaaaaatcaaaggagaacatcctggcctgtccattggtgatgttgcgaagaaactgggagagatgtggaataacactgctgcagatgacaagcagccttatgaaaagaaggctgcgaagctgaaggaaaaatacgaaaaggatattgctgcatatcgagctaaaggaaagcctgatgcagcaaaaaagggagttgtcaaggctgaaaaaagcaagaaaaagaaggaagaggaggaagatgaggaagatgaagaggatgaggaggaggaggaagatgaagaagatgaagatgaagaagaagatgatgatgatgaataagttggttctagcgcagtttttttttttcttgtctataaagcatttaacccccctgtacacaactcactccttttaaagaaaaaaattgaaatgtaaggctgtgtaagatttgtttttaaactgtacagtgtctttttttgtatagttaacacactaccgaatgtgtctttagatagccctgtcctggtggtattttcaatagccactaaccttgcctggtacagtatgggggttgtaaattggcatggaaatttaaagcaggttcttgttggtgcacagcacaaattagttatatatggggatggtagttttttcatcttcagttgtctctgatgcagcttatacgaaataattgttgttctgttaactgaataccactctgtaattgcaaaaaaaaaaaaaagttgcagctgttttgttgacattctgaatgcttctaagtaaatacaattttttttattagtattgttgtccttttcataggtctgaaatttttcttcttgaggggaagctagtcttttgcttttgcccattttgaatcacatgaattattacagtgtttatcctttcatatagttagctaataaaaagctttgtctacacaccctgcatatcataatgggggtaaagttaagttgagatagttttcatccataactgaacatccaaaatcttgatcagttaagaaatttcacatagcccacttacatttacaaactgaagagtaatcaatctactcaaagcatgggattattagaatcaaacattttgaaagtctgtccttgaaggactaatagaaaagtatgttctaacctttacatgaggactctattctttaactcccattaccatgtaatggcagttatattttgcagttcccacattaaagaagacctgagaatgtatccccaaaagcgtgagcttaaaatacaagactgccatattaaattttttgttgacattagtctcagtgaagactatgaaaatgctggctatagatgtcttttcccatttatctaaatatggactgctcaggaaacgagactttccattacaagtatttttaattaattgggccagcttttcaaacaaagatgccacattcaaaatagggtatattttcctatattacggtttgcccctttataaatccaagtagataggaagaaagaagacaaactttgcatctcagtatgaattattcaatttatttgaatgatttttctttacaaaacaaactcattcattagtcatgtttatctgcttaggagtttagggaacaatttggcaattttgtggttttcgagattatcgttttcttaaagtgccagtattttaaaatagcgttcttgtaattttacacgcttttgtgatggagtgctgttttgttatataatttagacttggattctttccatttgcatttgtttatgtaatttcaggaggaatactgaacatctgagtcctggatgatactaataaactaataattgcagaggttttaaa

SEQ ID NO: 446014 - DNA, 2271 bp, Homo sapiens
  misc_feature (17)..(17): n is a, c, g, or t
  misc_feature (22)..(23): n is a, c, g, or t
aggctaggtacgaggcnggtgnntgaatcggccggtgaggaggctgcgtctggctcccgctctcacagccattgcagtacattgagctccatagagacagcgccggggcaagtgagagccggacgggcactgggcgactctgtgcctcgctgaggaaaaataactaaacatgggcaaaggagatcctaagaagccgagaggcaaaatgtcatcatatgcattttttgtgcaaacttgtcgggaggagcataagaagaagcacccagatgcttcagtcaacttctcagagttttctaagaagtgctcagagaggtggaagaccatgtctgctaaagagaaaggaaaatttgaagatatggcaaaagcggacaaggcccgttatgaaagagaaatgaaaacctatatccctcccaaaggggagacaaaaaagaagttcaaggatcccaatgcacccaagaggcctccttcggccttcttcctcttctgctctgagtatcgcccaaaaatcaaaggagaacatcctggcctgtccattggtgatgttgcgaagaaactgggagagatgtggaataacactgctgcagatgacaagcagccttatgaaaagaaggctgcgaagctgaaggaaaaatacgaaaaggatattgctgcatatcgagctaaaggaaagcctgatgcagcaaaaaagggagttgtcaaggctgaaaaaagcaagaaaaagaaggaagaggaggaagatgaggaagatgaagaggatgaggaggaggaggaagatgaagaagatgaagatgaagaagaagatgatgatgatgaataagttggttctagcgcagtttttttttttcttgtctataaagcatttaacccccctgtacacaactcactccttttaaagaaaaaaattgaaatgtaaggctgtgtaagatttgtttttaaactgtacagtgtctttttttgtatagttaacacactaccgaatgtgtctttagatagccctgtcctggtggtattttcaatagccactaaccttgcctggtacagtatgggggttgtaaattggcatggaaatttaaagcaggttcttgttggtgcacagcacaaattagttatatatggggatggtagttttttcatcttcagttgtctctgatgcagcttatacgaaataattgttgttctgttaactgaataccactctgtaattgcaaaaaaaaaaaaaagttgcagctgttttgttgacattctgaatgcttctaagtaaatacaattttttttattagtattgttgtccttttcataggtctgaaatttttcttcttgaggggaagctagtcttttgcttttgcccattttgaatcacatgaattattacagtgtttatcctttcatatagttagctaataaaaagctttgtctacacaccctgcatatcataatgggggtaaagttaagttgagatagttttcatccataactgaacatccaaaatcttgatcagttaagaaatttcacatagcccacttacatttacaaactgaagagtaatcaatctactcaaagcatgggattattagaatcaaacattttgaaagtctgtccttgaaggactaatagcatgtaatggcagttatattttgcagttcccacattaaagaagacctgagaatgtatccccaaaagcgtgagcttaaaatacaagactgccatattaaattttttgttgacattagtctcagtgaagactatgaaaatgctggctatagatgtcttttcccatttatctaaatatggactgctcaggaaacgagactttccattacaagtatttttaattaattgggccagcttttcaaacaaagatgccacattcaaaatagggtatattttcctatattacggtttgcccctttataaatccaagtagataggaagaaagaagacaaactttgcatctcagtatgaattattcaatttatttgaatgatttttctttacaaaacaaactcattcattagtcatgtttatctgcttaggagtttagggaacaatttggcaattttgtggttttcgagattatcgttttcttaaagtgccagtattttaaaatagcgttcttgtaattttacacgcttttgtgatggagtgctgttttgttatataatttagacttggattctttccatttgcatttgtttatgtaatttcaggaggaatactgaacatctgagtcctggatgatactaataaactaataattgcagaggttttaaa

SEQ ID NO: 446015 - DNA, 1907 bp, Homo sapiens
  misc_feature (17)..(17): n is a, c, g, or t
  misc_feature (22)..(23): n is a, c, g, or t
aggctaggtacgaggcnggtgnntgaatcggccggtgaggaggctgcgtctggctcccgctctcacagccattgcagtacattgagctccatagagacagcgccggggcaagtgagagccggacgggcactgggcgactctgtgcctcgctgaggaaaaataactaaacatgggcaaaggagatcctaagaagccgagaggcaaaatgtcatcatatgcattttttgtgcaaacttgtcgggaggagcataagaagaagcacccagatgcttcagtcaacttctcagagttttctaagaagtgctcagagaggtggaagaccatgtctgctaaagagaaaggaaaatttgaagatatggcaaaagcggacaaggcccgttatgaaagagaaatgaaaacctatatccctcccaaaggggagacaaaaaagaagttcaaggatcccaatgcacccaagaggcctccttcggccttcttcctcttctgctctgagtatcgcccaaaaatcaaaggagaacatcctggcctgtccattggtgatgttgcgaagaaactgggagagatgtggaataacactgctgcagatgacaagcagccttatgaaaagaaggctgcgaagctgaaggaaaaatacgaaaaggatattgctgcatatcgagctaaaggaaagcctgatgcagcaaaaaagggagttgtcaaggctgaaaaaagcaagaaaaagaaggaagaggaggaagatgaggaagatgaagaggatgaggaggaggaggaagatgaagaagatgaagatgaagaagaagatgatgatgatgaataagttggttctagcgcagtttttttttttcttgtctataaagcatttaacccccctgtacacaactcactccttttaaagaaaaaaattgaaatgtaaggctgtgtaagatttgtttttaaactgtacagtgtctttttttgtatagttaacacactaccgaatgtgtctttagatagccctgtcctggtggtattttcaatagccactaaccttgcctggtacagtatgggggttgtaaattggcatggaaatttaaagcaggttcttgttggtgcacagcacaaattagttatatatggggatggtagttttttcatcttcagttgtctctgatgcagcttatacgaaataattgttgttctgttaactgaataccactctgtaattgcaaaaaaaaaaaaaagttgcagctgttttgttgacattctgaatgcttctaagtaaatacaattttttttattagagtatgtggtggtcccttttcaatagggtctcgtggaaaatttttccttccttggagaaggggaagacctagagtctctttgtggcctttgtggccccattttgggattctcacctgtgtgatttattttaaccggggggtttaatccccttctcaatatatatggttaggcctataatataaaaggctttgggttctatacacaacccgcgggaatatattacatatagtgggcggtgtaaaaggttgaaggttggacaatataggttttcaatctcaatatactgtgaatcatctcaaaaaatcctgggaaccaggtgaagaaacatttccaaattggcccaatttacactttttacacaaacgtggtagcacacgtcatccatatctcttaatctcaaaggcatggcggattcattgagagaatctcaaccatctttgggaacggtctgggcccttggagagggactatattgagaaaaaggttttggggttctaaacccttttaacctgtagaggaactctaaattctttaaaattcccaattaaccacgtgttaggggcggctaattaatttggagaggttcccccagttttaaggaaggaacctgggaatggttttcccca

SEQ ID NO: 446016 - DNA, 2269 bp, Homo sapiens
  misc_feature (17)..(17): n is a, c, g, or t
  misc_feature (22)..(23): n is a, c, g, or t
aggctaggtacgaggcnggtgnntgaatcggccggtgaggaggctgcgtctggctcccgctctcacagccattgcagtacattgagctccatagagacagcgccggggcaagtgagagccggacgggcactgggcgactctgtgcctcgctgaggaaaaataactaaacatgggcaaaggagatcctaagaagccgagaggcaaaatgtcatcatatgcattttttgtgcaaacttgtcgggaggagcataagaagaagcacccagatgcttcagtcaacttctcagagttttctaagaagtgctcagagaggtggaagaccatgtctgctaaagagaaaggaaaatttgaagatatggcaaaagcggacaaggcccgttatgaaagagaaatgaaaacctatatccctcccaaaggggagacaaaaaagaagttcaaggatcccaatgcacccaagaggcctccttcggccttcttcctcttctgctctgagtatcgcccaaaaatcaaaggagaacatcctggcctgtccattggtgatgttgcgaagaaactgggagagatgtggaataacactgctgcagatgacaagcagccttatgaaaagaaggctgcgaagctgaaggaaaaatacgaaaaggatattgctgcatatcgagctaaaggaaagcctgatgcagcaaaaaagggagttgtcaaggctgaaaaaagcaagaaaaagaaggaagaggaggaagatgaggaagatgaagaggatgaggaggaggaggaagatgaagaagatgaagatgaagaagaagatgatgatgatgaataagttggttctagcgcagtttttttttttcttgtctataaagcatttaacccccctgtacacaactcactccttttaaagaaattttgtatagttaacacactaccgaatgtgtctttagatagccctgtcctggtggtattttcaatagccactaaccttgcctggtacagtatgggggttgtaaattggcatggaaatttaaagcaggttcttgttggtgcacagcacaaattagttatatatggggatggtagttttttcatcttcagttgtctctgatgcagcttatacgaaataattgttgttctgttaactgaataccactctgtaattgcaaaaaaaaaaaaaagttgcagctgttttgttgacattctgaatgcttctaagtaaatacaattttttttattagtattgttgtccttttcataggtctgaaatttttcttcttgaggggaagctagtcttttgcttttgcccattttgaatcacatgaattattacagtgtttatcctttcatatagttagctaataaaaagctttgtctacacaccctgcatatcataatgggggtaaagttaagttgagatagttttcatccataactgaacatccaaaatcttgatcagttaagaaatttcacatagcccacttacatttacaaactgaagagtaatcaatctactcaaagcatgggattattagaatcaaacattttgaaagtctgtccttgaaggactaatagaaaagtatgttctaacctttacatgaggactctattctttaactcccattaccatgtaatggcagttatattttgcagttcccacattaaagaagacctgagaatgtatccccaaaagcgtgagcttaaaatacaagactgccatattaaattttttgttgacattagtctcagtgaagactatgaaaatgctggctatagatgtcttttcccatttatctaaatatggactgctcaggaaacgagactttccattacaagtatttttaattaattgggccagcttttcaaacaaagatgccacattcaaaatagggtatattttcctatattacggtttgcccctttataaatccaagtagataggaagaaagaagacaaactttgcatctcagtatgaattattcaatttatttgaatgatttttctttacaaaacaaactcattcattagtcatgtttatctgcttaggagtttagggaacaatttggcaattttgtggttttcgagattatcgttttcttaaagtgccagtattttaaaatagcgttcttgtaattttacacgcttttgtgatggagtgctgttttgttatataatttagacttggattctttccatttgcatttgtttatgtaatttcaggaggaatactgaacatctgagtcctggatgatactaataaactaataattgcagaggttttaaa

SEQ ID NO: 446017 - DNA, 2272 bp, Homo sapiens
cggacgcgtgggtccggacgcgtgggtacattgagctccatagagacagcgccggggcaagtgagagccggacgggcactgggcgactctgtgcctcgctgaggaaaaataactaaacatgggcaaaggagatcctaagaagccgagaggcaaaatgtcatcatatgcattttttgtgcaaacttgtcgggaggagcataagaagaagcacccagatgcttcagtcaacttctcagagttttctaagaagtgctcagagaggtggaagaccatgtctgctaaagagaaaggaaaatttgaagatatggcaaaagcggacaaggcccgttatgaaagagaaatgaaaacctatatccctcccaaaggggagacaaaaaagaagttcaaggatcccaatgcacccaagaggcctccttcggccttcttcctcttctgctctgagtatcgcccaaaaatcaaaggagaacatcctggcctgtccattggtgatgttgcgaagaaactgggagagatgtggaataacactgctgcagatgacaagcagccttatgaaaagaaggctgcgaagctgaaggaaaaatacgaaaaggatattgctgcatatcgagctaaaggaaagcctgatgcagcaaaaaagggagttgtcaaggctgaaaaaagcaagaaaaagaaggaagaggaggaagatgaggaagatgaagaggatgaggaggaggaggaagatgaagaagatgaagatgaagaagaagatgatgatgatgaataagttggttctagcgcagtttttttttttcttgtctataaagcatttaacccccctgtacacaactcactccttttaaagaaaaaaattgaaatgtaaggctgtgtaagatttgtttttaaactgtacagtgtctttttttgtatagttaacacactaccgaatgtgtctttagatagccctgtcctggtggtattttcaatagccactaaccttgcctggtacagtatgggggttgtaaattggcatggaaatttaaagcaggttcttgttggtgcacagcacaaattagttatatatggggatggtagttttttcatcttcagttgtctctgatgcagcttatacgaaataattgttgttctgttaactgaataccactctgtaattgcaaaaaaaaaaaaaagttgcagctgttttgttgacattctgaatgcttctaagtaaatacaattttttttattagtattgttgtccttttcataggtctgaaatttttcttcttgaggggaagctagtcttttgcttttgcccattttgaatcacatgaattattacagtgtttatcctttcatatagttagctaataaaaagctttgtctacacaccctgcatatcataatgggggtaaagttaagttgagatagttttcatccataactgaacatccaaaatcttgatcagttaagaaatttcacatagcccacttacatttacaaactgaagagtaatcaatctactcaaagcatgggattattagaatcaaacattttgaaagtctgtccttgaaggactaatagaaaagtatgttctaacctttacatgaggactctattctttaactcccattaccatgtaatggcagttatattttgcagttcccacattaaagaagacctgagaatgtatccccaaaagcgtgagcttaaaatacaagactgccatattaaattttttgttgacattagtctcagtgaagactatgaaaatgctggctatagatgtcttttcccatttatctaaatatggactgctcaggaaacgagactttccattacaagtatttttaattaattgggccagcttttcaaacaaagatgccacattcaaaatagggtatattttcctatattacggtttgcccctttataaatccaagtagataggaagaaagaagacaaactttgcatctcagtatgaattattcaatttatttgaatgatttttctttacaaaacaaactcattcattagtcatgtttatctgcttaggagtttagggaacaatttggcaattttgtggttttcgagattatcgttttcttaaagtgccagtattttaaaatagcgttcttgtaattttacacgcttttgtgatggagtgctgttttgttatataatttagacttggattctttccatttgcatttgtttatgtaatttcaggaggaatactgaacatctgagtcctggatgatactaataaactaataattgcagaggttttaaa

SEQ ID NO: 446018 - DNA, 1227 bp, Homo sapiens
  misc_feature (17)..(17): n is a, c, g, or t
  misc_feature (22)..(23): n is a, c, g, or t
aggctaggtacgaggcnggtgnntgaatcggccggtgaggaggctgcgtctggctcccgctctcacagccattgcagtacattgagctccatagagacagcgccggggcaagtgagagccggacgggcactgggcgactctgtgcctcgctgaggaaaaataactaaacatgggcaaaggagatcctaagaagccgagaggcaaaatgtcatcatatgcattttttgtgcaaacttgtcgggaggagcataagaagaagcacccagatgcttcagtcaacttctcagagttttctaagaagtgctcagagaggtggaagaccatgtctgctaaagagaaaggaaaatttgaagatatggcaaaagcggacaaggcccgttatgaaagagaaatgaaaacctatatccctcccaaaggggagacaaaaaagaagttcaaggatcccaatgcacccaagaggcctccttcggccttcttcctcttctgctctgagtatcgcccaaaaatcaaaggagaacatcctggcctgtccattggtgatgttgcgaagaaactgggagagatgtggaataacactgctgcagatgacaagcagccttatgaaaagaaggctgcgaagctgaaggaaaaatacgaaaaggatattgctgcatatcgagctaaaggaaagcctgatgcagcaaaaaagggagttgtcaaggctgaaaaaagcaagaaaaagaaggaagaggaggaagatgaggaagatgaagaggatgaggaggaggaggaagatgaagaagatgaagatgaagaagaagatgatgatgatgaataagttggttctagcgcagtttttttttttcttgtctataaagcatttaacccccctgtacacaactcactccttttaaagaaaaaaattgaaatgtaaggctgtgtaagatttgtttttaaactgtacagtgtctttttttgtatagttaacacactaccgaatgtgtctttagatattttatctgaaggctgcctattctcccaggaaccaaatggcctccgtcttaagaaagtatgcttactaggaaataccctgcctaccttaggaataaatgctacttaaggaaaaaataagagagctgaaaaagctggtgccatttgaaaaaaaaagggacggacatgagatttaactggtgctcaaagcttctccgatacaacatattgggtcatgtattcataatgtgcttgaca

SEQ ID NO: 446019 - DNA, 1015 bp, Homo sapiens
  misc_feature (17)..(17): n is a, c, g, or t
  misc_feature (22)..(23): n is a, c, g, or t
aggctaggtacgaggcnggtgnntgaatcggccggtgaggaggctgcgtctggctcccgctctcacagccattgcagtacattgagctccatagagacagcgccggggcaagtgagagccggacgggcactgggcgactctgtgcctcgctgaggaaaaataactaaacatgggcaaaggagatcctaagaagccgagaggcaaaatgtcatcatatgcattttttgtgcaaacttgtcgggaggagcataagaagaagcacccagatgcttcagtcaacttctcagagttttctaagaagtgctcagagaggtggaagaccatgtctgctaaagagaaaggaaaatttgaagatatggcaaaagcggacaaggcccgttatgaaagagaaatgaaaacctatatccctcccaaaggggagacaaaaaagaagttcaaggatcccaatgcacccaagaggcctccttcggccttcttcctcttctgctctgagtatcgcccaaaaatcaaaggagaacatcctggcctgtccattggtgatgttgcgaagaaactgggagagatgtggaataacactgctgcagatgacaagcagccttatgaaaagaaggctgcgaagctgaaggaaaaatacgaaaaggatattgctgcatatcgagctaaaggaaagcctgatgcagcaaaaaagggagttgtcaaggctgaaaaaagcaagaaaaagaaggaagaggaggaagatgaggaagatgaagaggatgaggaggaggaggaagatgaagaagatgaagatgaagaagaagatgatgatgatgaataagttggttctagcgcagtttttttttttcttgtctataaagcatttaacccccctgtacacaactcactccttttaaagaaaaaaattgaagtataaagcgttgagaaagtataaagcgttgaggaagtataaagcgttgagctcaacgctttatacttctccatgcatacttaatattatacttgagattcatacggg

SEQ ID NO: 446020 - DNA, 1232 bp, Homo sapiens
  misc_feature (17)..(17): n is a, c, g, or t
  misc_feature (22)..(23): n is a, c, g, or t
aggctaggtacgaggcnggtgnntgaatcggccggtgaggaggctgcgtctggctcccgctctcacagccattgcagtacattgagctccatagagacagcgccggggcaagtgagagccggacgggcactgggcgactctgtgcctcgctgaggaaaaataactaaacatgggcaaaggagatcctaagaagccgagaggcaaaatgtcatcatatgcattttttgtgcaaacttgtcgggaggagcataagaagaagcacccagatgcttcagtcaacttctcagagttttctaagaagtgctcagagaggtggaagaccatgtctgctaaagagaaaggaaaatttgaagatatggcaaaagcggacaaggcccgttatgaaagagaaatgaaaacctatatccctcccaaaggggagacaaaaaagaagttcaaggatcccaatgcacccaagaggcctccttcggccttcttcctcttctgctctgagtatcgcccaaaaatcaaaggagaacatcctggcctgtccattggtgatgttgcgaagaaactgggagagatgtggaataacactgctgcagatgacaagcagccttatgaaaagaaggctgcgaagctgaaggaaaaatacgaaaaggatattgctgcatatcgagctaaaggaaagcctgatgcagcaaaaaagggagttgtcaaggctgaaaaaagcaagaaaaagaaggaagaggaggaagatgaggaagatgaagaggatgaggaggaggaggaagatgaagaagatgaagatgaagaagaagatgatgatgatgaataagttggttctagcgcagtgtgcgctactgctcgtgtatctagcaaccaaccgtctggctcacagcttcctcctgtttaagacgtgaccagcactgtatcgctgagtgagattaggaatacacagccagcatgccttctgcttactatcacactaccgatagtgtctctgatcgacttgactgattcaattctcaatagccactaaccttgcctggcacgagattatggtggttaattgaccttggaatcctgaggatgacccagatgggtcacactccattgtaggaatatttagtgtatatcctactgtcacactatcatctattagatacagtgatagccctgggtttgtccccaatccggcctattccgcgtcctatcaccattgactgcccctcaccttccaccgtcggaac

SEQ ID NO: 446021 - DNA, 2270 bp, Homo sapiens
  misc_feature (17)..(17): n is a, c, g, or t
  misc_feature (22)..(23): n is a, c, g, or t
aggctaggtacgaggcnggtgnntgaatcggccggtgaggaggctgcgtctggctcccgctctcacagccattgcagtacattgagctccatagagacagcgccggggcaagtgagagccggacgggcactgggcgactctgtgcctcgctgaggaaaaataactaaacatgggcaaaggagatcctaagaagccgagaggcaaaatgtcatcatatgcattttttgtgcaaacttgtcgggaggagcataagaagaagcacccagatgcttcagtcaacttctcagagttttctaagaagtgctcagagaggtggaagaccatgtctgctaaagagaaaggaaaatttgaagatatggcaaaagcggacaaggcccgttatgaaagagaaatgaaaacctatatccctcccaaaggggagacaaaaaagaagttcaaggatcccaatgcacccaagaggcctccttcggccttcttcctcttctgctctgagtatcgcccaaaaatcaaaggagaacatcctggcctgtccattggtgatgttgcgaagaaactgggagagatgtggaataacactgctgcagatgacaagcagccttatgaaaagaaggctgcgaagctgaaggaaaaatacgaaaaggatattgctgcatatcgagctaaaggaaagcctgatgcagcaaaaaagggagttgtcaaggctgaaaaaagcaagaaaagatgaagaagatgaagatgaagaagaagatgatgatgatgaataagttggttctagcgcagtttttttttttcttgtctataaagcatttaacccccctgtacacaactcactccttttaaagaaaaaaattgaaatgtaaggctgtgtaagatttgtttttaaactgtacagtgtctttttttgtatagttaacacactaccgaatgtgtctttagatagccctgtcctggtggtattttcaatagccactaaccttgcctggtacagtatgggggttgtaaattggcatggaaatttaaagcaggttcttgttggtgcacagcacaaattagttatatatggggatggtagttttttcatcttcagttgtctctgatgcagcttatacgaaataattgttgttctgttaactgaataccactctgtaattgcaaaaaaaaaaaaaagttgcagctgttttgttgacattctgaatgcttctaagtaaatacaattttttttattagtattgttgtccttttcataggtctgaaatttttcttcttgaggggaagctagtcttttgcttttgcccattttgaatcacatgaattattacagtgtttatcctttcatatagttagctaataaaaagctttgtctacacaccctgcatatcataatgggggtaaagttaagttgagatagttttcatccataactgaacatccaaaatcttgatcagttaagaaatttcacatagcccacttacatttacaaactgaagagtaatcaatctactcaaagcatgggattattagaatcaaacattttgaaagtctgtccttgaaggactaatagaaaagtatgttctaacctttacatgaggactctattctttaactcccattaccatgtaatggcagttatattttgcagttcccacattaaagaagacctgagaatgtatccccaaaagcgtgagcttaaaatacaagactgccatattaaattttttgttgacattagtctcagtgaagactatgaaaatgctggctatagatgtcttttcccatttatctaaatatggactgctcaggaaacgagactttccattacaagtatttttaattaattgggccagcttttcaaacaaagatgccacattcaaaatagggtatattttcctatattacggtttgcccctttataaatccaagtagataggaagaaagaagacaaactttgcatctcagtatgaattattcaatttatttgaatgatttttctttacaaaacaaactcattcattagtcatgtttatctgcttaggagtttagggaacaatttggcaattttgtggttttcgagattatcgttttcttaaagtgccagtattttaaaatagcgttcttgtaattttacacgcttttgtgatggagtgctgttttgttatataatttagacttggattctttccatttgcatttgtttatgtaatttcaggaggaatactgaacatctgagtcctggatgatactaataaactaataattgcagaggttttaaa

SEQ ID NO: 446022 - DNA, 3328 bp, Homo sapiens
  misc_feature (17)..(17): n is a, c, g, or t
  misc_feature (22)..(23): n is a, c, g, or t
aggctaggtacgaggcnggtgnntgaatcggccggtgaggaggctgcgtctggctcccgctctcacagccattgcagtacattgagctccatagagacagcgccggggcaagtgagagccggacgggcactgggcgactctgtgcctcgctgaggaaaaataactaaacatgggcaaaggagatcctaagaagccgagaggcaaaatgtcatcatatgcattttttgtgcaaacttgtcgggaggagcataagaagaagcacccagatgcttcagtcaacttctcagagttttctaagaagtgctcagagaggtggaagaccatgtctgctaaagagaaaggaaaatttgaagatatggcaaaagcggacaaggcccgttatgaaagagaaatgaaaacctatatccctcccaaaggggagacaaaaaagaagttcaaggatcccaatgcacccaagaggcctccttcggccttcttcctcttctgctctgagtatcgcccaaaaatcaaaggagaacatcctggcctgtccattggtgatgttgcgaagaaactgggagagatgtggaataacactgctgcagatgacaagcagccttatgaaaagaaggctgcgaagctgaaggaaaaatacgaaaagggtaagaagtgtgggtttgcttggtaaaatgatgacaagtacgccagatgtatgattgtacttagtttgaggtgtaataagtttttagggtaacagctacattaagtatggtgttgatataagtcctcatccttcaaagaatgcagaggaccaaataaattagggtttttttgactaaaatgtaatcagactcagacaaaggctgtgtacatttatgttggttttgttattccccagtatcttgaagttcatgaaaatgttggtagtcacttcaagtcaaaaatgagcattttcaaatggcttggcatacagtacaaaaacaggctagacaaagtaatataggctatatttttcttagtcatatcctgaaacatttatgttcttttcctttagatactcaaaaaaccacagcatcactaagttaaattacaagtctgctgctctgtccagtaaattaataagattaaggaaatctataactcttatagttcagtaaattgaaatattaaatacttaattttcagctttagtcattctgaaaagtgtttatttctagatgtttcttaacctaattgcatgtttattgacaaattaccttttttttttaagaccacatttcctactaaggattaaggtctgacagtgtaaacctgtagagtgcttttttgcattcagaaggtggcagtgtctaccctttaatcaaagtctctacattctggttttaatagagttaggatgtggtacataattgcacctcaatgaggcataactttgcaaatattagactatgccatttcatgagttatagattgttataatgatcttgtatttttatgttcatttattgaagttctagttatttctggagttgctgtggatctacagatacgtgatattttggtataactagaatcttgatttctttcataaagttctgccatgttctatttctttccttaatgtttttttcttccctactgttttatcctccctttgctttggaaggatattgctgcatatcgagctaaaggaaagcctgatgcagcaaaaaagggagttgtcaaggctgaaaaaagcaagaaaaagaaggaagaggaggaagatgaggaagatgaagaggatgaggaggaggaggaagatgaagaagatgaagatgaagaagaagatgatgatgatgaataagttggttctagcgcagtttttttttttcttgtctataaagcatttaacccccctgtacacaactcactccttttaaagaaaaaaattgaaatgtaaggctgtgtaagatttgtttttaaactgtacagtgtctttttttgtatagttaacacactaccgaatgtgtctttagatagccctgtcctggtggtattttcaatagccactaaccttgcctggtacagtatgggggttgtaaattggcatggaaatttaaagcaggttcttgttggtgcacagcacaaattagttatatatggggatggtagttttttcatcttcagttgtctctgatgcagcttatacgaaataattgttgttctgttaactgaataccactctgtaattgcaaaaaaaaaaaaaagttgcagctgttttgttgacattctgaatgcttctaagtaaatacaattttttttattagtattgttgtccttttcataggtctgaaatttttcttcttgaggggaagctagtcttttgcttttgcccattttgaatcacatgaattattacagtgtttatcctttcatatagttagctaataaaaagctttgtctacacaccctgcatatcataatgggggtaaagttaagttgagatagttttcatccataactgaacatccaaaatcttgatcagttaagaaatttcacatagcccacttacatttacaaactgaagagtaatcaatctactcaaagcatgggattattagaatcaaacattttgaaagtctgtccttgaaggactaatagaaaagtatgttctaacctttacatgaggactctattctttaactcccattaccatgtaatggcagttatattttgcagttcccacattaaagaagacctgagaatgtatccccaaaagcgtgagcttaaaatacaagactgccatattaaattttttgttgacattagtctcagtgaagactatgaaaatgctggctatagatgtcttttcccatttatctaaatatggactgctcaggaaacgagactttccattacaagtatttttaattaattgggccagcttttcaaacaaagatgccacattcaaaatagggtatattttcctatattacggtttgcccctttataaatccaagtagataggaagaaagaagacaaactttgcatctcagtatgaattattcaatttatttgaatgatttttctttacaaaacaaactcattcattagtcatgtttatctgcttaggagtttagggaacaatttggcaattttgtggttttcgagattatcgttttcttaaagtgccagtattttaaaatagcgttcttgtaattttacacgcttttgtgatggagtgctgttttgttatataatttagacttggattctttccatttgcatttgtttatgtaatttcaggaggaatactgaacatctgagtcctggatgatactaataaactaataattgcagaggttttaaa

SEQ ID NO: 446023 - DNA, 2501 bp, Homo sapiens
  misc_feature (17)..(17): n is a, c, g, or t
  misc_feature (22)..(23): n is a, c, g, or t
aggctaggtacgaggcnggtgnntgaatcggccggtgaggaggctgcgtctggctcccgctctcacagccattgcagtacattgagctccatagagacagcgccggggcaagtgagagccggacgggcactgggcgactctgtgcctcgctgaggaaaaataactaaacatgggcaaaggagatcctaagaagccgagaggcaaaatgtcatcatatgcattttttgtgcaaacttgtcgggaggagcataagaagaagcacccagatgcttcagtcaacttctcagagttttctaagaagtgctcagagaggtggaaggtaagagggcttaaaacatgctaacaaggtaattaaaagacagtttccaattgaggatgcaaaaaaaagcctagttggcattctcgtagtgggacgctattacatagcaaaagacattggttttgaggataatttacttaaatgttacaacttaaacttacaaataattattttgtagaccatgtctgctaaagagaaaggaaaatttgaagatatggcaaaagcggacaaggcccgttatgaaagagaaatgaaaacctatatccctcccaaaggggagacaaaaaagaagttcaaggatcccaatgcacccaagaggcctccttcggccttcttcctcttctgctctgagtatcgcccaaaaatcaaaggagaacatcctggcctgtccattggtgatgttgcgaagaaactgggagagatgtggaataacactgctgcagatgacaagcagccttatgaaaagaaggctgcgaagctgaaggaaaaatacgaaaaggatattgctgcatatcgagctaaaggaaagcctgatgcagcaaaaaagggagttgtcaaggctgaaaaaagcaagaaaaagaaggaagaggaggaagatgaggaagatgaagaggatgaggaggaggaggaagatgaagaagatgaagatgaagaagaagatgatgatgatgaataagttggttctagcgcagtttttttttttcttgtctataaagcatttaacccccctgtacacaactcactccttttaaagaaaaaaattgaaatgtaaggctgtgtaagatttgtttttaaactgtacagtgtctttttttgtatagttaacacactaccgaatgtgtctttagatagccctgtcctggtggtattttcaatagccactaaccttgcctggtacagtatgggggttgtaaattggcatggaaatttaaagcaggttcttgttggtgcacagcacaaattagttatatatggggatggtagttttttcatcttcagttgtctctgatgcagcttatacgaaataattgttgttctgttaactgaataccactctgtaattgcaaaaaaaaaaaaaagttgcagctgttttgttgacattctgaatgcttctaagtaaatacaattttttttattagtattgttgtccttttcataggtctgaaatttttcttcttgaggggaagctagtcttttgcttttgcccattttgaatcacatgaattattacagtgtttatcctttcatatagttagctaataaaaagctttgtctacacaccctgcatatcataatgggggtaaagttaagttgagatagttttcatccataactgaacatccaaaatcttgatcagttaagaaatttcacatagcccacttacatttacaaactgaagagtaatcaatctactcaaagcatgggattattagaatcaaacattttgaaagtctgtccttgaaggactaatagaaaagtatgttctaacctttacatgaggactctattctttaactcccattaccatgtaatggcagttatattttgcagttcccacattaaagaagacctgagaatgtatccccaaaagcgtgagcttaaaatacaagactgccatattaaattttttgttgacattagtctcagtgaagactatgaaaatgctggctatagatgtcttttcccatttatctaaatatggactgctcaggaaacgagactttccattacaagtatttttaattaattgggccagcttttcaaacaaagatgccacattcaaaatagggtatattttcctatattacggtttgcccctttataaatccaagtagataggaagaaagaagacaaactttgcatctcagtatgaattattcaatttatttgaatgatttttctttacaaaacaaactcattcattagtcatgtttatctgcttaggagtttagggaacaatttggcaattttgtggttttcgagattatcgttttcttaaagtgccagtattttaaaatagcgttcttgtaattttacacgcttttgtgatggagtgctgttttgttatataatttagacttggattctttccatttgcatttgtttatgtaatttcaggaggaatactgaacatctgagtcctggatgatactaataaactaataattgcagaggttttaaa

SEQ ID NO: 446024 - DNA, 2443 bp, Homo sapiens
  misc_feature (17)..(17): n is a, c, g, or t
  misc_feature (22)..(23): n is a, c, g, or t
aggctaggtacgaggcnggtgnntgaatcggccggtgaggaggctgcgtctggctcccgctctcacagccattgcagtacattgagctccatagagacagcgccggggcaagtgagagccggacgggcactgggcgactctgtgcctcgctgaggaaaaataactaaacatgggcaaaggagatcctaagaagccgagaggcaaaatgtcatcatatgcattttttgtgcaaacttgtcgggaggagcataagaagaagcacccagatgcttcagtcaacttctcagagttttctaagaagtgctcagagaggtggaaggtaagagggcttaaaacatgctaacaaggtaattaaaagacagtttccaattgaggatgcggttttgaggataatttacttaaatgttacaacttaaacttacaaataattattttgtagaccatgtctgctaaagagaaaggaaaatttgaagatatggcaaaagcggacaaggcccgttatgaaagagaaatgaaaacctatatccctcccaaaggggagacaaaaaagaagttcaaggatcccaatgcacccaagaggcctccttcggccttcttcctcttctgctctgagtatcgcccaaaaatcaaaggagaacatcctggcctgtccattggtgatgttgcgaagaaactgggagagatgtggaataacactgctgcagatgacaagcagccttatgaaaagaaggctgcgaagctgaaggaaaaatacgaaaaggatattgctgcatatcgagctaaaggaaagcctgatgcagcaaaaaagggagttgtcaaggctgaaaaaagcaagaaaaagaaggaagaggaggaagatgaggaagatgaagaggatgaggaggaggaggaagatgaagaagatgaagatgaagaagaagatgatgatgatgaataagttggttctagcgcagtttttttttttcttgtctataaagcatttaacccccctgtacacaactcactccttttaaagaaaaaaattgaaatgtaaggctgtgtaagatttgtttttaaactgtacagtgtctttttttgtatagttaacacactaccgaatgtgtctttagatagccctgtcctggtggtattttcaatagccactaaccttgcctggtacagtatgggggttgtaaattggcatggaaatttaaagcaggttcttgttggtgcacagcacaaattagttatatatggggatggtagttttttcatcttcagttgtctctgatgcagcttatacgaaataattgttgttctgttaactgaataccactctgtaattgcaaaaaaaaaaaaaagttgcagctgttttgttgacattctgaatgcttctaagtaaatacaattttttttattagtattgttgtccttttcataggtctgaaatttttcttcttgaggggaagctagtcttttgcttttgcccattttgaatcacatgaattattacagtgtttatcctttcatatagttagctaataaaaagctttgtctacacaccctgcatatcataatgggggtaaagttaagttgagatagttttcatccataactgaacatccaaaatcttgatcagttaagaaatttcacatagcccacttacatttacaaactgaagagtaatcaatctactcaaagcatgggattattagaatcaaacattttgaaagtctgtccttgaaggactaatagaaaagtatgttctaacctttacatgaggactctattctttaactcccattaccatgtaatggcagttatattttgcagttcccacattaaagaagacctgagaatgtatccccaaaagcgtgagcttaaaatacaagactgccatattaaattttttgttgacattagtctcagtgaagactatgaaaatgctggctatagatgtcttttcccatttatctaaatatggactgctcaggaaacgagactttccattacaagtatttttaattaattgggccagcttttcaaacaaagatgccacattcaaaatagggtatattttcctatattacggtttgcccctttataaatccaagtagataggaagaaagaagacaaactttgcatctcagtatgaattattcaatttatttgaatgatttttctttacaaaacaaactcattcattagtcatgtttatctgcttaggagtttagggaacaatttggcaattttgtggttttcgagattatcgttttcttaaagtgccagtattttaaaatagcgttcttgtaattttacacgcttttgtgatggagtgctgttttgttatataatttagacttggattctttccatttgcatttgtttatgtaatttcaggaggaatactgaacatctgagtcctggatgatactaataaactaataattgcagaggttttaaa

SEQ ID NO: 446025 - DNA, 2283 bp, Homo sapiens
  misc_feature (17)..(17): n is a, c, g, or t
  misc_feature (22)..(23): n is a, c, g, or t
aggctaggtacgaggcnggtgnntgaatcggccggtgaggaggctgcgtctggctcccgctctcacagccattgcagtacattgagctccatagagacagcgccggggcaagtgagagccggacgggcactgggcgactctgtgcctcgctgaggaaaaataactaaacatgggcaaaggagatcctaagaagccgagaggcaaaatgtcatcatatgcattttttgtgcaaacttgtcgggaggagcataagaagaagcacccagatgcttcagtcaacttctcagagttttctaagaagtgctcagagaggtggaagaccatgtctgctaaagagaaaggaaaatttgaagatatggcaaaagcggacaaggcccgttatgaaagagaaatgaaaacctatatccctcccaaaggggagacaattcggccttcttcctcttctgctctgagtatcgcccaaaaatcaaaggagaacatcctggcctgtccattggtgatgttgcgaagaaactgggagagatgtggaataacactgctgcagatgacaagcagccttatgaaaagaaggctgcgaagctgaaggaaaaatacgaaaaggatattgctgcatatcgagctaaaggaaagcctgatgcagcaaaaaagggagttgtcaaggctgaaaaaagcaagaaaaagaaggaagaggaggaagatgaggaagatgaagaggatgaggaggaggaggaagatgaagaagatgaagatgaagaagaagatgatgatgatgaataagttggttctagcgcagtttttttttttcttgtctataaagcatttaacccccctgtacacaactcactccttttaaagaaaaaaattgaaatgtaaggctgtgtaagatttgtttttaaactgtacagtgtctttttttgtatagttaacacactaccgaatgtgtctttagatagccctgtcctggtggtattttcaatagccactaaccttgcctggtacagtatgggggttgtaaattggcatggaaatttaaagcaggttcttgttggtgcacagcacaaattagttatatatggggatggtagttttttcatcttcagttgtctctgatgcagcttatacgaaataattgttgttctgttaactgaataccactctgtaattgcaaaaaaaaaaaaaagttgcagctgttttgttgacattctgaatgcttctaagtaaatacaattttttttattagtattgttgtccttttcataggtctgaaatttttcttcttgaggggaagctagtcttttgcttttgcccattttgaatcacatgaattattacagtgtttatcctttcatatagttagctaataaaaagctttgtctacacaccctgcatatcataatgggggtaaagttaagttgagatagttttcatccataactgaacatccaaaatcttgatcagttaagaaatttcacatagcccacttacatttacaaactgaagagtaatcaatctactcaaagcatgggattattagaatcaaacattttgaaagtctgtccttgaaggactaatagaaaagtatgttctaacctttacatgaggactctattctttaactcccattaccatgtaatggcagttatattttgcagttcccacattaaagaagacctgagaatgtatccccaaaagcgtgagcttaaaatacaagactgccatattaaattttttgttgacattagtctcagtgaagactatgaaaatgctggctatagatgtcttttcccatttatctaaatatggactgctcaggaaacgagactttccattacaagtatttttaattaattgggccagcttttcaaacaaagatgccacattcaaaatagggtatattttcctatattacggtttgcccctttataaatccaagtagataggaagaaagaagacaaactttgcatctcagtatgaattattcaatttatttgaatgatttttctttacaaaacaaactcattcattagtcatgtttatctgcttaggagtttagggaacaatttggcaattttgtggttttcgagattatcgttttcttaaagtgccagtattttaaaatagcgttcttgtaattttacacgcttttgtgatggagtgctgttttgttatataatttagacttggattctttccatttgcatttgtttatgtaatttcaggaggaatactgaacatctgagtcctggatgatactaataaactaataattgcagaggttttaaa

SEQ ID NO: 446026 - DNA, 910 bp, Homo sapiens
  misc_feature (17)..(17): n is a, c, g, or t
  misc_feature (22)..(23): n is a, c, g, or t
aggctaggtacgaggcnggtgnntgaatcggccggtgaggaggctgcgtctggctcccgctctcacagccattgcagtacattgagctccatagagacagcgccggggcaagtgagagccggacgggcactgggcgactctgtgcctcgctgaggaaaaataactaaacatgggcaaaggagatcctaagaagccgagaggcaaaatgtcatcatatgcattttttgtgcaaacttgtcgggaggagcataagaagaagcacccagatgcttcagtcaacttctcagagttttctaagaagtgctcagagaggtggaagaccatgtctgctaaagagaaaggaaaatttgaagatatggcaaaagcggacaaggcccgttatgaaagagaaatgaaaacctatatccctcccaaaggggagacaaaaaagaagttcaaggatcccaatgcacccaagaggcctccttcggccttcttcctcttctgctctgagtatcgcccaaaaatcaaaggagaacatcctggcctgtccattggtgatgttgcgaagaaactgggagagatgtggaataacactgctgcagatgacaagcagccttatgaaaagaaggctgcgaagctgaaggaaaaatacgaaaaggatattgctgcatatcgagctaaaggaaagcctgatgcagcaaaaaagggagttgtcaaggctgaaaaaagcaagaaaaagaaggaagaggaggaagatgaggaagatgaagaggatgaggaggaggaggactctcctttctattgtcttgacattctttctcttatttatctctttttttctaatgtattgatttttttttcagttacacgtgtggccctcttatgtattcttatttctattacttatccttcgctcctttgtctctgc

SEQ ID NO: 446027 - DNA, 2269 bp, Homo sapiens
  misc_feature (17)..(17): n is a, c, g, or t
  misc_feature (22)..(23): n is a, c, g, or t
aggctaggtacgaggcnggtgnntgaatcggccggtgaggaggctgcgtctggctcccgctctcacagccattgcagtacattgagctccatagagacagcgccggggcaagtgagagccggacgggcactgggcgactctgtgcctcgctgaggaaaaataactaaacatgggcaaaggagatcctaagaagccgagaggcaaaatgtcatcatatgcattttttgtgcaaacttgtcgggaggagcataagaagaagcacccagatgcttcagtcaacttctcagagttttctaagaagtgctcagagaggtggaagaccatgtctgctaaagagaaaggaaaatttgaagatatggcaaaagcggacaaggcccgttatgaaagagaaatgaaaacctatatccctcccaaaggggagacaaaaaagaagttcaaggatcccaatgcacccaagaggcctccttcggccttcttcctcttctgctctgagtatcgcccaggagagatgtggaataacactgctgcagatgacaagcagccttatgaaaagaaggctgcgaagctgaaggaaaaatacgaaaaggatattgctgcatatcgagctaaaggaaagcctgatgcagcaaaaaagggagttgtcaaggctgaaaaaagcaagaaaaagaaggaagaggaggaagatgaggaagatgaagaggatgaggaggaggaggaagatgaagaagatgaagatgaagaagaagatgatgatgatgaataagttggttctagcgcagtttttttttttcttgtctataaagcatttaacccccctgtacacaactcactccttttaaagaaaaaaattgaaatgtaaggctgtgtaagatttgtttttaaactgtacagtgtctttttttgtatagttaacacactaccgaatgtgtctttagatagccctgtcctggtggtattttcaatagccactaaccttgcctggtacagtatgggggttgtaaattggcatggaaatttaaagcaggttcttgttggtgcacagcacaaattagttatatatggggatggtagttttttcatcttcagttgtctctgatgcagcttatacgaaataattgttgttctgttaactgaataccactctgtaattgcaaaaaaaaaaaaaagttgcagctgttttgttgacattctgaatgcttctaagtaaatacaattttttttattagtattgttgtccttttcataggtctgaaatttttcttcttgaggggaagctagtcttttgcttttgcccattttgaatcacatgaattattacagtgtttatcctttcatatagttagctaataaaaagctttgtctacacaccctgcatatcataatgggggtaaagttaagttgagatagttttcatccataactgaacatccaaaatcttgatcagttaagaaatttcacatagcccacttacatttacaaactgaagagtaatcaatctactcaaagcatgggattattagaatcaaacattttgaaagtctgtccttgaaggactaatagaaaagtatgttctaacctttacatgaggactctattctttaactcccattaccatgtaatggcagttatattttgcagttcccacattaaagaagacctgagaatgtatccccaaaagcgtgagcttaaaatacaagactgccatattaaattttttgttgacattagtctcagtgaagactatgaaaatgctggctatagatgtcttttcccatttatctaaatatggactgctcaggaaacgagactttccattacaagtatttttaattaattgggccagcttttcaaacaaagatgccacattcaaaatagggtatattttcctatattacggtttgcccctttataaatccaagtagataggaagaaagaagacaaactttgcatctcagtatgaattattcaatttatttgaatgatttttctttacaaaacaaactcattcattagtcatgtttatctgcttaggagtttagggaacaatttggcaattttgtggttttcgagattatcgttttcttaaagtgccagtattttaaaatagcgttcttgtaattttacacgcttttgtgatggagtgctgttttgttatataatttagacttggattctttccatttgcatttgtttatgtaatttcaggaggaatactgaacatctgagtcctggatgatactaataaactaataattgcagaggttttaaa

SEQ ID NO: 446028 - DNA, 2219 bp, Homo sapiens
cggacgcgtgggtccggacgcgtgggtacattgagctccatagagacagcgccggggcaagtgagagccggacgggcactgggcgactctgtgcctcgctgaggaaaaataactaaacatgggcaaaggagatcctaagaagccgagaggcaaaatgtcatcatatgcattttttgtgcaaacttgtcgggaggagcataagaagaagcacccagatgcttcagtcaacttctcagagttttctaagaagtgctcagagaggtggaagaccatgtctgctaaagagaaaggaaaatttgaagatatggcaaaagcggacaaggcccgttatgaaagagaaatgaaaacctatatccctcccaaaggggagacaaaaaagaagttcaaggatcccaatgcacccaagaggcctccttcggccttcttcctcttctgctctgagtatcgcccaaaaatcaaaggagaacatcctggcctgtccattggtgatgttgcgaagaaactgggagagatgtggaataacactgctgcagatgacaagcagccttatgaaaagaaggctgcgaagctgaaggaaaaatacgaaaaggatattgctgcatatcgagctaaaggaaagcctgatgcagcaaaaaagggagttgtcaaggctgaaaaaagcaagaaaagatgaagaagatgaagatgaagaagaagatgatgatgatgaataagttggttctagcgcagtttttttttttcttgtctataaagcatttaacccccctgtacacaactcactccttttaaagaaaaaaattgaaatgtaaggctgtgtaagatttgtttttaaactgtacagtgtctttttttgtatagttaacacactaccgaatgtgtctttagatagccctgtcctggtggtattttcaatagccactaaccttgcctggtacagtatgggggttgtaaattggcatggaaatttaaagcaggttcttgttggtgcacagcacaaattagttatatatggggatggtagttttttcatcttcagttgtctctgatgcagcttatacgaaataattgttgttctgttaactgaataccactctgtaattgcaaaaaaaaaaaaaagttgcagctgttttgttgacattctgaatgcttctaagtaaatacaattttttttattagtattgttgtccttttcataggtctgaaatttttcttcttgaggggaagctagtcttttgcttttgcccattttgaatcacatgaattattacagtgtttatcctttcatatagttagctaataaaaagctttgtctacacaccctgcatatcataatgggggtaaagttaagttgagatagttttcatccataactgaacatccaaaatcttgatcagttaagaaatttcacatagcccacttacatttacaaactgaagagtaatcaatctactcaaagcatgggattattagaatcaaacattttgaaagtctgtccttgaaggactaatagaaaagtatgttctaacctttacatgaggactctattctttaactcccattaccatgtaatggcagttatattttgcagttcccacattaaagaagacctgagaatgtatccccaaaagcgtgagcttaaaatacaagactgccatattaaattttttgttgacattagtctcagtgaagactatgaaaatgctggctatagatgtcttttcccatttatctaaatatggactgctcaggaaacgagactttccattacaagtatttttaattaattgggccagcttttcaaacaaagatgccacattcaaaatagggtatattttcctatattacggtttgcccctttataaatccaagtagataggaagaaagaagacaaactttgcatctcagtatgaattattcaatttatttgaatgatttttctttacaaaacaaactcattcattagtcatgtttatctgcttaggagtttagggaacaatttggcaattttgtggttttcgagattatcgttttcttaaagtgccagtattttaaaatagcgttcttgtaattttacacgcttttgtgatggagtgctgttttgttatataatttagacttggattctttccatttgcatttgtttatgtaatttcaggaggaatactgaacatctgagtcctggatgatactaataaactaataattgcagaggttttaaa

SEQ ID NO: 446029 - DNA, 1669 bp, Homo sapiens
atgtacagcccagagctgattcttgagtatcccggtcatcttgctacacaagacacagagagtgaagaaggaagaggaggaagatgaggaagatgaagaggatgaggaggaggaggaagatgaagaagatgaagatgaagaagaagatgatgatgatgaataagttggttctagcgcagtttttttttttcttgtctataaagcatttaacccccctgtacacaactcactccttttaaagaaaaaaattgaaatgtaaggctgtgtaagatttgtttttaaactgtacagtgtctttttttgtatagttaacacactaccgaatgtgtctttagatagccctgtcctggtggtattttcaatagccactaaccttgcctggtacagtatgggggttgtaaattggcatggaaatttaaagcaggttcttgttggtgcacagcacaaattagttatatatggggatggtagttttttcatcttcagttgtctctgatgcagcttatacgaaataattgttgttctgttaactgaataccactctgtaattgcaaaaaaaaaaaaaagttgcagctgttttgttgacattctgaatgcttctaagtaaatacaattttttttattagtattgttgtccttttcataggtctgaaatttttcttcttgaggggaagctagtcttttgcttttgcccattttgaatcacatgaattattacagtgtttatcctttcatatagttagctaataaaaagctttgtctacacaccctgcatatcataatgggggtaaagttaagttgagatagttttcatccataactgaacatccaaaatcttgatcagttaagaaatttcacatagcccacttacatttacaaactgaagagtaatcaatctactcaaagcatgggattattagaatcaaacattttgaaagtctgtccttgaaggactaatagaaaagtatgttctaacctttacatgaggactctattctttaactcccattaccatgtaatggcagttatattttgcagttcccacattaaagaagacctgagaatgtatccccaaaagcgtgagcttaaaatacaagactgccatattaaattttttgttgacattagtctcagtgaagactatgaaaatgctggctatagatgtcttttcccatttatctaaatatggactgctcaggaaacgagactttccattacaagtatttttaattaattgggccagcttttcaaacaaagatgccacattcaaaatagggtatattttcctatattacggtttgcccctttataaatccaagtagataggaagaaagaagacaaactttgcatctcagtatgaattattcaatttatttgaatgatttttctttacaaaacaaactcattcattagtcatgtttatctgcttaggagtttagggaacaatttggcaattttgtggttttcgagattatcgttttcttaaagtgccagtattttaaaatagcgttcttgtaattttacacgcttttgtgatggagtgctgttttgttatataatttagacttggattctttccatttgcatttgtttatgtaatttcaggaggaatactgaacatctgagtcctggatgatactaataaactaataattgcagaggttttaaa

SEQ ID NO: 446030 - DNA, 1578 bp, Homo sapiens
  misc_feature (17)..(17): n is a, c, g, or t
  misc_feature (22)..(23): n is a, c, g, or t
aggctaggtacgaggcnggtgnntgaatcggccggtgaggaggctgcgtctggctcccgctctcacagccattgcagtacattgagctccatagagacagcgccggggcaagtgagagccggacgggcactgggcgactctgtgcctcgctgaggaaaaataactaaacatgggcaaaggagatcctaagaagccgagaggcaaaatgtcatcatatgcattttttgtgcaaacttgtcgggaggagcataagaagaagcacccagatgcttcagtcaacttctcagagttttctaagaagtgctcagagaggtggaagaccatgtctgctaaagagaaaggaaaatttgaagatatggcaaaagcggacaaggcccgttatgaaagagaaatgaaaacctatatccctcccaaaggggagacaaaaaagaagttcaaggatcccaatgcacccaagaggcctccttcggccttcttcctcttctgctctgagtatcgcccaaaaatcaaaggagaacatcctggcctgtccattggtgatgttgcgaagaaactgggagagatgtggaataacactgctgcagatgacaagcagccttatgaaaagaaggctgcgaagctgaaggaaaaatacgaaaagggtaagaagtgtgggtttgcttggtaaaatgatgacaagtacgccagatgtatgattgtacttagtttgaggtgtaataagtttttagggtaacagctacattaagtatggtgttgatataagtcctcatccttcaaagaatgcagaggaccaaataaattagggtttttttgactaaaatgtaatcagactcagacaaaggctgtgtacatttatgttggttttgttattccccagtatcttgaagttcatgaaaatgttggtagtcacttcaagtcaaaaatgagcattttcaaatggcttggcatacagtacaaaaacaggctagacaaagtaatataggctatatttttcttagtcatatcctgaaacatttatgttcttttcctttagatactcaaaaaaccacagcatcactaagttaaattacaagtctgctgctctgtccagtaaattaataagattaaggaaatctataactcttatagttcagtaaattgaaatattaaatacttaattttcagctttagtcattctgaaaagtgtttatttctagatgtttcttaacctaattgcatgtttattgacaaattaccttttttttttaagaccacatttcctactaaggattaaggtctgacagtgtaaacctgtagagtgcttttttgcattcagaaggtggcagtgtctaccctttaatcaaagtctctacattctggttttaatagagttaggatgtggtacataattgcacctcaatgaggcataactttgcaaatattagactatgccatttcatgagttatagattgttataatgatcttgtattttaacttagtgatgctgtggttttttgagtatctaaaggaaaagaacataaatgtttcaggatatgactaagaaaaatatagcctatattactttgtctagcctgttt

SEQ ID NO: 446031 - DNA, 722 bp, Homo sapiens
  misc_feature (17)..(17): n is a, c, g, or t
  misc_feature (22)..(23): n is a, c, g, or t
aggctaggtacgaggcnggtgnntgaatcggccggtgaggaggctgcgtctggctcccgctctcacagccattgcagtacattgagctccatagagacagcgccggggcaagtgagagccggacgggcactgggcgactctgtgcctcgctgaggaaaaataactaaacatgggcaaaggagatcctaagaagccgagaggcaaaatgtcatcatatgcattttttgtgcaaacttgtcgggaggagcataagaagaagcacccagatgcttcagtcaacttctcagagttttctaagaagtgctcagagaggtggaagaccatgtctgctaaagagaaaggaaaatttgaagatatggcaaaagcggacaaggcccgttatgaaagagaaatgaaaacctatatccctcccaaaggggagacaaaaaagaagttcaaggatcccaatgcacccaagaggcctccttcggccttcttcctcttctgctctgagtatcgcccaaaaatcaaaggagaacatcctggcctgtccattggtgatgttgcgaagaaactgggagagatgtggaataacactgctgcagatgacaagcagccttatgagacgctttccaccctgaaggcataatcccaaaaggcttttcgctgatattgagctaaagaaagccctgtgccacacaaagggactttcaaggctgtaaaagcccgatcgaacccccccg

SEQ ID NO: 446032 - DNA, 663 bp, Homo sapiens
tcaactctttatacttcctcacgctttatacttccgtattgaattcaagtataatattaagtatgcatggacgaagtataaagcgttgagctcaacgctttatacttcctcatttcggccttcttcctcttctgctctgagtatcgcccaaaaatcaaaggagaacatcctggcctgtccattggtgatgttgcgaagaaactgggagagatgtggaataacactgctgcagatgacaagcagccttatgaaaagaaggctgcgaagctgaaggaaaaatacgaaaaggatattgctgcatatcgagctaaaggaaagcctgatgcagcaaaaaagggagttgtcaaggctgaaaaaagcaagaaaaagaaggaagaggaggaagatgaggaagatgaagaggatgaggaggaggaggaagatgaagaagatgaagatgaagaagaagatgatgatgatgaataagttggttctagcgcagtttttttttttcttgtctataaagcatttaacccccctgtacacaactcactccttttaaagaaaaaaattgaagtataaagcgttgagaaagtataaagcgttgaggaagtataaagcgttgagctcaacgctttatacttctccatgcatacttaatattatacttgagattcatacggg

SEQ ID NO: 446033 - DNA, 857 bp, Homo sapiens
  misc_feature (17)..(17): n is a, c, g, or t
  misc_feature (22)..(23): n is a, c, g, or t
aggctaggtacgaggcnggtgnntgaatcggccggtgaggaggctgcgtctggctcccgctctcacagccattgcagtacattgagctccatagagacagcgccggggcaagtgagagccggacgggcactgggcgactctgtgcctcgctgaggaaaaataactaaacatgggcaaaggagatcctaagaagccgagaggcaaaatgtcatcatatgcattttttgtgcaaacttgtcgggaggagcataagaagaagcacccagatgcttcagtcaacttctcagagttttctaagaagtgctcagagaggtggaaggaccatggtctggttaagaggaagggaaatttggaggattgtggcaaagagcggacaaggcgcggttatgaaaaaaaaaaaaaaaaaaaaaaaaaaaaaaaaaaaaaaaaaaaaaaaaaaaaaaaaaaaaaaaaaaaaaaaaaaacaaaaaaaaaagagaggagggggcgggcggcgaagaaaaaactactcccgggggggagcggccacaccgttacgagcgcgaccacgaacatctttttttagacagagggggctccccctatggggggacgacgttcaataatacaggccgagggagggcggcgggacggccccgtttataaaaaaccacaggcggcgcggcgaggggcacaaacaacgtcgaagcgccgcagcactattcttgggggaaggcaagaacacccccacgcgggggggggaggccaacaagagtggcggcaaccaccctacccccaaacacacttaaccacgccgggaggaagataacaaaacacagcaacaaatcgagaggtgtgacaacccgacggccaacatc

SEQ ID NO: 446034 - DNA, 1046 bp, Homo sapiens
gacgctgacgaaagagacctgcttgcgcgtcgctgttccgtggtccgcgcgagcgtggtcgggagccgctggttcctggggtgacccgcggaggtgggagagggaagggcttccgaagccggcgggggtgccatggaccctctccgccggcgcggccttcacagctgggccgcgccgggcatccgtagtccgctctcccaaagcctcggtggagctgaagctgccacagagtgcatgttcacaaagggtcatcacacacggagctgcccctccctgtctccctagagcccatcttcgaggccagggcttttctaccaggattctggggtgtttctcctcctttcctccctcccagatcttctcacggtaaggggagcagcgaaagcgcagggactttgcattccacgacccgttctgactagtcaacagccgatctgtccctgctgctctaattccagctgccctgccttgttttaacttcagagaaagggggagttctcatttgataagtttaagcctttgctttcgtaggaaggtcatgtggcttaagggacatcgtgaccgcgtatgctatttctgcctgtgcattctaaatcttgggggcagcatattccagaagtccttttggtcgattggttctgtgtcctaggataacaatttgtagtttctgaccatttctttacagaaaaaccacaattggtattttggactgcggggtttttagtggtctcaaactaaatgattatattctggaataatgctgacaatttggatagggtggtgtggaggaaacaagtctcgtgtagaagaaattatttagtaaaaaggattttagtttttggtacttctgaatgcaaatggccaaggaatccagcagtttgttggggtttctccagacaaaaataggctggttagtttgtttacctttttctgttgctttactagattgttaatgtatttgtatatttaagatctagctagttaggtttttcttttttatgaattgtgattaaaattggagaaagtagtacttcctcctgaaatag

SEQ ID NO: 446035 - DNA, 3826 bp, Homo sapiens
  misc_feature (17)..(17): n is a, c, g, or t
  misc_feature (22)..(23): n is a, c, g, or t
aggctaggtacgaggcnggtgnntgaatcggccggtgaggaggctgcgtctggctcccgctctcacagccattgcagtacattgagctccatagagacagcgccggggcaagtgagagccggacgggcactgggcgactctgtgcctcgctgaggaaaaataactaaacatgggcaaaggagatcctaagaagccgagaggcaaaatgtcatcatatgcattttttgtgcaaacttgtcgggaggagcataagaagaagcacccagatgcttcagtcaacttctcagagttttctaagaagtgctcagagaggtggaagaccatgtctgctaaagagaaaggaaaatttgaagatatggcaaaagcggacaaggcccgttatgaaagagaaatgaaaacctatatccctcccaaaggggagacaaaaaagaagttcaaggatcccaatgcacccaagaggcctccttcggccttcttcctcttctgctctgagtatcgcccaaaaatcaaaggagaacatcctggcctgtccattggtgatgttgcgaagaaactgggagagatgtggaataacactgctgcagatgacaagcagccttatgaaaagaaggctgcgaagctgaaggaaaaatacgaaaaggatattgctgcatatcgagctaaaggaaagcctgatgcagcaaaaaagggagttgtcaaggctgaaaaaagcaagaaaaagaaggaagaggaggaagatgaggaagatgaagaggatgaggaggaggaggaagatgaagaagatgaagatgaagaagaagatgatgatgatgaataagttggttctagcgcagtttttttttttcttgtctataaagcatttaacccccctgtacacaactcactccttttaaagaaaaaaattgaaatgtaaggctgtgtaagatttgtttttaaactgtacagtgtctttttttgtatagttaacacactaccgaatgtgtctttagatagccctgtcctggtggtattttcaatagccactaaccttgcctggtacagtatgggggttgtaaattggcatggaaatttaaagcaggttcttgttggtgcacagcacaaattagttatatatggggatggtagttttttcatcttcagttgtctctgatgcagcttatacgaaataattgttgttctgttaactgaataccactctgtaattgcaaaaaaaaaaaaaagttgcagctgttttgttgacattctgaatgcttctaagtaaatacaattttttttattagtattgttgtccttttcataggtctgaaatttttcttcttgaggggaagctagtcttttgcttttgcccattttgaatcacatgaattattacagtgtttatcctttcatatagttagctaataaaaagctttgtctacacaccctgcatatcataatgggggtaaagttaagttgagatagttttcatccataactgaacatccaaaatcttgatcagttaagaaatttcacatagcccacttacatttacaaactgaagagtaatcaatctactcaaagcatgggattattagaatcaaacattttgaaagtctgtccttgaaggactaatagaaaagtatgttctaacctttacatgaggactctattctttaactcccattaccatgtaatggcagttatattttgcagttcccacattaaagaagacctgagaatgtatccccaaaagcgtgagcttaaaatacaagactgccatattaaattttttgttgacattagtctcagtgaagactatgaaaatgctggctatagatgtcttttcccatttatctaaatatggactgctcaggaaacgagactttccattacaagtatttttaattaattgggccagcttttcaaacaaagatgccacattcaaaatagggtatattttcctatattacggtttgcccctttataaatccaagtagataggaagaaagaagacaaactttgcatctcagtatgaattattcaatttatttgaatgatttttctttacaaaacaaactcattcattagtcatgtttatctgcttaggagtttagggaacaatttggcaattttgtggttttcgagattatcgttttcttaaagtgccagtattttaaaatagcgttcttgtaattttacacgcttttgtgatggagtgctgttttgttatataatttagacttggattctttccatttgcatttgtttatgtaatttcaggaggaatactgaacatctgagtcctggatgatactaataaactaataattgcagaggttttaaatactagttaaatggctttcacttaagaacttaagattttgttacatatttttaaatcttgtttctaataatacctcttagcagtaccttttaaataagtataagggatggcaaagtttttccctttaaaaatactcactttatgcttataaataggttaatgggctgataaaaggttttgtcaaacattgcaagtattcggtgctatatataaaggaggaaaaactagttttactttcagaatgatttaaacaagatttttaaaaacaagatacatgcaagcgaacagcagggttagtgataggctgcaattgtgtcgaacatcagattttttgttaagaggagcaaatgactcaatctgatttagatggaagtttctactgtatagaaatcaccattaatcaccaacattaataattctgatccatttaaaatgaattctggctcaaggagaatttgtaactttagtaggtacgtcatgacaactaccatttttttaagatgttgagaatgggaacagtttttttagggtttattcttgaccacagatcttaagaaaatggacaaaacccctcttcaatctgaagattagtatggtttggtgttctaacagtatcccctagaagttggatgtctaaaactcaagtaaatggaagtgggaggcaatttagaataagtgtaaagccttgtaactgaagatgattttttttagaaagtgtatagaaactattttaatgccaagatagttacagtgctgtggggtttaaagactttgttgacatcaagaaaagactaaatctataattaattgggccaacttttaaaatgaagatgctttttaaaactaatgaactaagatgtataaatcttagtttttttgtattttaaagataggcatatggcatattgattaacgagtcaaatttcctaactttgctgtgcaaaggttgagagctattgctgattagttaccacagttctgatgatcgtcccatcacagtgttgttaatgtttgctgtatttattaattttcttaaagtgaaatctgaaaaatgaaatttgtgtgtcctgtgtacccgaggggtaatgattaaatgataaagataagaaaagcgcccatgtaacacaaactgccattcaacaggtatttcccttactacctaaggaattgtaaccattgctcagacattgtaggatttaactatgttgaaaactacaggagaggccgggcgcagtggctcacgcctgtaatcccagcactttgggaggccaaggcgggcagatcacgaggtcaggagattgagaccatcctggctaacgtggtgaaaccccgcctctactaaaaatacaaaaaattagccaagcgtggtgctgggcgcctgtagtcccagtaactcaggaggctgaggcaggagaatggcgtgaacccgggaggcggaggttgcagtgagccgagattgtgccactgcactccagcctgggtgacagagcaagactccatctc

SEQ ID NO: 446036 - DNA, 1748 bp, Homo sapiens
  misc_feature (17)..(17): n is a, c, g, or t
  misc_feature (22)..(23): n is a, c, g, or t
aggctaggtacgaggcnggtgnntgaatcggccggtgaggaggctgcgtctggctcccgctctcacagccattgcagtacattgagctccatagagacagcgccggggcaagtgagagccggacgggcactgggcgactctgtgcctcgctgaggaaaaataactaaacatgggcaaaggagatcctaagaagccgagaggcaaaatgtcatcatatgcattttttgtgcaaacttgtcgggaggagcataagaagaagcacccagatgcttcagtcaacttctcagagttttctaagaagtgctcagagaggtggaagaccatgtctgctaaagagaaaggaaaatttgaagatatggcaaaagcggacaaggcccgttatgaaagagaaatgaaaacctatatccctcccaaaggggagacaaaaaagaagttcaaggatcccaatgcacccaagaggcctccttcggccttcttcctcttctgctctgagtatcgcccaaaaatcaaaggagaacatcctggcctgtccattggtgatgttgcgaagaaactgggagagatgtggaataacactgctgcagatgacaagcagccttatgaaaagaaggctgcgaagctgaaggaaaaatacgaaaaggatattgctgcatatcgagctaaaggaaagcctgatgcagcaaaaaagggagttgtcaaggctgaaaaaagcaagaaaaagaaggaagaggaggaagatgaggaagatgaagaggatgaggaggaggaggaagatgaagaagatgaagatgaagaagaagatgatgatgatgaataagttggttctagcgcagtttttttttttcttgtctataaagcatttaacccccctgtacacaactcactccttttaaagaaaaaaattgaaatgtaaggctgtgtaagatttgtttttaaactgtacagtgtctttttttgtatagttaacacactaccgaatgtgtctttagatagccctgtcctggtggtattttcaatagccactaaccttgcctggtacagtatgggggttgtaaattggcatggaaatttaaagcaggttcttgttggtgcacagcacaaattagttatatatggggatggtagttttttcatcttcagttgtctctgatgcagcttatacgaaataattgttgttctgttaactgaataccactctgtaattgcaaaaaaaaaaaaaagttgcagctgttttgttgacattctgaatgcttctaagtaaatacaattttttttattagaaaaaaaaaaaaaaaaaaaaaaaaaaaaaaaaaaaaaaaaaaaaaaaaaaaaaaaaaaaaaaaaaaaaaaaaaaacaaaaaaaaaagagaggagggggcgggcggcgaagaaaaaactactcccgggggggagcggccacaccgttacgagcgcgaccacgaacatctttttttagacagagggggctccccctatggggggacgacgttcaataatacaggccgagggagggcggcgggacggccccgtttataaaaaaccacaggcggcgcggcgaggggcacaaacaacgtcgaagcgccgcagcactattcttgggggaaggcaagaacacccccacgcgggggggggaggccaacaagagtggcggcaaccaccctacccccaaacacacttaaccacgccgggaggaagataacaaaacacagcaacaaatcgagaggtgtgacaacccgacggccaacatc

SEQ ID NO: 446037 - DNA, 1513 bp, Homo sapiens
  misc_feature (17)..(17): n is a, c, g, or t
  misc_feature (22)..(23): n is a, c, g, or t
aggctaggtacgaggcnggtgnntgaatcggccggtgaggaggctgcgtctggctcccgctctcacagccattgcagtacattgagctccatagagacagcgccggggcaagtgagagccggacgggcactgggcgactctgtgcctcgctgaggaaaaataactaaacatgggcaaaggagatcctaagaagccgagaggcaaaatgtcatcatatgcattttttgtgcaaacttgtcgggaggagcataagaagaagcacccagatgcttcagtcaacttctcagagttttctaagaagtgctcagagaggtggaagaccatgtctgctaaagagaaaggaaaatttgaagatatggcaaaagcggacaaggcccgttatgaaagagaaatgaaaacctatatccctcccaaaggggagacaaaaaagaagttcaaggatcccaatgcacccaagaggcctccttcggccttcttcctcttctgctctgagtatcgcccaaaaatcaaaggagaacatcctggcctgtccattggtgatgttgcgaagaaactgggagagatgtggaataacactgctgcagatgacaagcagccttatgaaaagaaggctgcgaagctgaaggaaaaatacgaaaaggatattgctgcatatcgagctaaaggaaagcctgatgcagcaaaaaagggagttgtcaaggctgaaaaaagcaagaaaaagaaggaagaggaggaagatgaggaagatgaagaggatgaggaggaggaggaagatgaagaagatgaagatgaagaagaagatgatgatgatgaataagttggttctagcgcagtttttttttttcttgtctataaagcatttaacccccctgtacacaactcactccttttaaagaaaaaaattgaaatgtaaggctgtgtaagatttgtttttaaactgtacagtgtctttttttgtatagttaacacactaccgaatgtgtctttagatagccctgtcctggtggtattttcaatagccactaaccttgcctggtacagtatgggggttgtaaattggcatggaaatttaaagcaggttcttgttggtgcacagcacaaattagttatatatggggatggtagttttttcatcttcagttgtctctgatgcagcttatacgaaataattgttgttctgttaactgaataccactctgtaattgcaaaaaaaaaaaaaagttgcagctgttttgttgacattctgaatgcttctaagtaaactcacccatcgtttcataaagtatggtggccctttcatagggtccggacattttccttcgcgagggggagagcgcagcctttgggctttgggccacttcgtgatccaccatgacttatcacgggggtgaccctttcaataataggtgggcaatctaaaagggttgtggtgtaaccccggggttatacaaacggggggagggcaagctcggaaaagtcccccatcaggggagacccacacctgtctccggaa

SEQ ID NO: 446038 - DNA, 1076 bp, Homo sapiens
  misc_feature (17)..(17): n is a, c, g, or t
  misc_feature (22)..(23): n is a, c, g, or t
aggctaggtacgaggcnggtgnntgaatcggccggtgaggaggctgcgtctggctcccgctctcacagccattgcagtacattgagctccatagagacagcgccggggcaagtgagagccggacgggcactgggcgactctgtgcctcgctgaggaaaaataactaaacatgggcaaaggagatcctaagaagccgagaggcaaaatgtcatcatatgcattttttgtgcaaacttgtcgggaggagcataagaagaagcacccagatgcttcagtcaacttctcagagttttctaagaagtgctcagagaggtggaagaccatgtctgctaaagagaaaggaaaatttgaagatatggcaaaagcggacaaggcccgttatgaaagagaaatgaaaacctatatccctcccaaaggggagacaaaaaagaagttcaaggatcccaatgcacccaagaggcctccttcggccttcttcctcttctgctctgagtatcgcccaaaaatcaaaggagaacatcctggcctgtccattggtgatgttgcgaagaaactgggagagatgtggaataacactgctgcagatgacaagcagccttatgaaaagaaggctgcgaagctgaaggaaaaatacgaaaaggatattgctgcatatcgagctaaaggaaagcctgatgcagcaaaaaagggagttgtcaaggctgaaaaaagcaagaaaaagaaggaagaggaggaagatgaggaagatgaagaggatgaggaggaggaggaagatgaagaagatgaagatgaagaagaagatgatgatgatgaataagttggttctagcgcagtttttttttttcttgtctataaagcatttaacccccctgtacacaactcactccttttaaagaaaaaaattgaaatgtaaggctgtgtaagatttgtttttaaactgtacagtgtctttttttgtatagttaacacactaccgaatgtgtctttagatagccctgtcctggtggtattttcaatagccactaaccttgcctggtacagtcaggaagttgctaggtaagaagtgcgaggggacg

SEQ ID NO: 446039 - DNA, 2260 bp, Homo sapiens
  misc_feature (17)..(17): n is a, c, g, or t
  misc_feature (22)..(23): n is a, c, g, or t
aggctaggtacgaggcnggtgnntgaatcggccggtgaggaggctgcgtctggctcccgctctcacagccattgcagtacattgagctccatagagacagcgccggggcaagtgagagccggacgggcactgggcgactctgtgcctcgctgaggaaaaataactaaacatgggcaaaggagatcctaagaagccgagaggcaaaatgtcatcatatgcattttttgtgcaaacttgtcgggaggagcataagaagaagcacccagatgcttcagtcaacttctcagagttttctaagaagtgctcagagaggtggaagaccatgtctgctaaagagaaaggaaaatttgaagatatggcaaaagcggacaaggcccgttatgaaagagaaatgaaaacctatatccctcccaaaggggagacaaaaaagaagttcaaggatcccaatgcacccaagaggcctccttcggccttcttcctcttctgctctgagtatcgcccaaaaatcaaaggagaacatcctggcctgtccattggtgatgttgcgaagaaactgggagagatgtggaataacactgctgcagatgacaagcagccttatgaaaagaaggctgcgaagctgaaggaaaaatacgaaaaggatattgctgcatatcgagctaaaggaaagcctgatgcagcaaaaaagggagttgtcaaggctgaaaaaagcaagaaaaagaaggaagaggaggaagatgaggaagatgaagaggatgaggaggaggaggattttttttttcttgtctataaagcatttaacccccctgtacacaactcactccttttaaagaaaaaaattgaaatgtaaggctgtgtaagatttgtttttaaactgtacagtgtctttttttgtatagttaacacactaccgaatgtgtctttagatagccctgtcctggtggtattttcaatagccactaaccttgcctggtacagtatgggggttgtaaattggcatggaaatttaaagcaggttcttgttggtgcacagcacaaattagttatatatggggatggtagttttttcatcttcagttgtctctgatgcagcttatacgaaataattgttgttctgttaactgaataccactctgtaattgcaaaaaaaaaaaaaagttgcagctgttttgttgacattctgaatgcttctaagtaaatacaattttttttattagtattgttgtccttttcataggtctgaaatttttcttcttgaggggaagctagtcttttgcttttgcccattttgaatcacatgaattattacagtgtttatcctttcatatagttagctaataaaaagctttgtctacacaccctgcatatcataatgggggtaaagttaagttgagatagttttcatccataactgaacatccaaaatcttgatcagttaagaaatttcacatagcccacttacatttacaaactgaagagtaatcaatctactcaaagcatgggattattagaatcaaacattttgaaagtctgtccttgaaggactaatagaaaagtatgttctaacctttacatgaggactctattctttaactcccattaccatgtaatggcagttatattttgcagttcccacattaaagaagacctgagaatgtatccccaaaagcgtgagcttaaaatacaagactgccatattaaattttttgttgacattagtctcagtgaagactatgaaaatgctggctatagatgtcttttcccatttatctaaatatggactgctcaggaaacgagactttccattacaagtatttttaattaattgggccagcttttcaaacaaagatgccacattcaaaatagggtatattttcctatattacggtttgcccctttataaatccaagtagataggaagaaagaagacaaactttgcatctcagtatgaattattcaatttatttgaatgatttttctttacaaaacaaactcattcattagtcatgtttatctgcttaggagtttagggaacaatttggcaattttgtggttttcgagattatcgttttcttaaagtgccagtattttaaaatagcgttcttgtaattttacacgcttttgtgatggagtgctgttttgttatataatttagacttggattctttccatttgcatttgtttatgtaatttcaggaggaatactgaacatctgagtcctggatgatactaataaactaataattgcagaggttttaaa

SEQ ID NO: 446040 - DNA, 2230 bp, Homo sapiens
ttaattcggcggccgcggatccgagccggacgggcactgggcgactctgtgcctcgctgaggaaaaataactaaacatgggcaaaggagatcctaagaagccgagaggcaaaatgtcatcatatgcattttttgtgcaaacttgtcgggaggagcataagaagaagcacccagatgcttcagtcaacttctcagagttttctaagaagtgctcagagaggtggaagaccatgtctgctaaagagaaaggaaaatttgaagatatggcaaaagcggacaaggcccgttatgaaagagaaatgaaaacctatatccctcccaaaggggagacaaaaaagaagttcaaggatcccaatgcacccaagaggcctccttcggccttcttcctcttctgctctgagtatcgcccaaaaatcaaaggagaacatcctggcctgtccattggtgatgttgcgaagaaactgggagagatgtggaataacactgctgcagatgacaagcagccttatgaaaagaaggctgcgaagctgaaggaaaaatacgaaaaggatattgctgcatatcgagctaaaggaaagcctgatgcagcaaaaaagggagttgtcaaggctgaaaaaagcaagaaaaagaaggaagaggaggaagatgaggaagatgaagaggatgaggaggaggaggaagatgaagaagatgaagatgaagaagaagatgatgatgatgaataagttggttctagcgcagtttttttttttcttgtctataaagcatttaacccccctgtacacaactcactccttttaaagaaaaaaattgaaatgtaaggctgtgtaagatttgtttttaaactgtacagtgtctttttttgtatagttaacacactaccgaatgtgtctttagatagccctgtcctggtggtattttcaatagccactaaccttgcctggtacagtatgggggttgtaaattggcatggaaatttaaagcaggttcttgttggtgcacagcacaaattagttatatatggggatggtagttttttcatcttcagttgtctctgatgcagcttatacgaaataattgttgttctgttaactgaataccactctgtaattgcaaaaaaaaaaaaaagttgcagctgttttgttgacattctgaatgcttctaagtaaatacaattttttttattagtattgttgtccttttcataggtctgaaatttttcttcttgaggggaagctagtcttttgcttttgcccattttgaatcacatgaattattacagtgtttatcctttcatatagttagctaataaaaagctttgtctacacaccctgcatatcataatgggggtaaagttaagttgagatagttttcatccataactgaacatccaaaatcttgatcagttaagaaatttcacatagcccacttacatttacaaactgaagagtaatcaatctactcaaagcatgggattattagaatcaaacattttgaaagtctgtccttgaaggactaatagaaaagtatgttctaacctttacatgaggactctattctttaactcccattaccatgtaatggcagttatattttgcagttcccacattaaagaagacctgagaatgtatccccaaaagcgtgagcttaaaatacaagactgccatattaaattttttgttgacattagtctcagtgaagactatgaaaatgctggctatagatgtcttttcccatttatctaaatatggactgctcaggaaacgagactttccattacaagtatttttaattaattgggccagcttttcaaacaaagatgccacattcaaaatagggtatattttcctatattacggtttgcccctttataaatccaagtagataggaagaaagaagacaaactttgcatctcagtatgaattattcaatttatttgaatgatttttctttacaaaacaaactcattcattagtcatgtttatctgcttaggagtttagggaacaatttggcaattttgtggttttcgagattatcgttttcttaaagtgccagtattttaaaatagcgttcttgtaattttacacgcttttgtgatggagtgctgttttgttatataatttagacttggattctttccatttgcatttgtttatgtaatttcaggaggaatactgaacatctgagtcctggatgatactaataaactaataattgcagaggttttaaa

SEQ ID NO: 446041 - DNA, 2281 bp, Homo sapiens
tcaactctttatacttcctcacgctttatacttccgtattgaattcaagtataatattaagtatgcatggacgaagtataaagcgttgagctcaacgctttatacttcctcataaaaataactaaacatgggcaaaggagatcctaagaagccgagaggcaaaatgtcatcatatgcattttttgtgcaaacttgtcgggaggagcataagaagaagcacccagatgcttcagtcaacttctcagagttttctaagaagtgctcagagaggtggaagaccatgtctgctaaagagaaaggaaaatttgaagatatggcaaaagcggacaaggcccgttatgaaagagaaatgaaaacctatatccctcccaaaggggagacaaaaaagaagttcaaggatcccaatgcacccaagaggcctccttcggccttcttcctcttctgctctgagtatcgcccaaaaatcaaaggagaacatcctggcctgtccattggtgatgttgcgaagaaactgggagagatgtggaataacactgctgcagatgacaagcagccttatgaaaagaaggctgcgaagctgaaggaaaaatacgaaaaggatattgctgcatatcgagctaaaggaaagcctgatgcagcaaaaaagggagttgtcaaggctgaaaaaagcaagaaaaagaaggaagaggaggaagatgaggaagatgaagaggatgaggaggaggaggaagatgaagaagatgaagatgaagaagaagatgatgatgatgaataagttggttctagcgcagtttttttttttcttgtctataaagcatttaacccccctgtacacaactcactccttttaaagaaaaaaattgaaatgtaaggctgtgtaagatttgtttttaaactgtacagtgtctttttttgtatagttaacacactaccgaatgtgtctttagatagccctgtcctggtggtattttcaatagccactaaccttgcctggtacagtatgggggttgtaaattggcatggaaatttaaagcaggttcttgttggtgcacagcacaaattagttatatatggggatggtagttttttcatcttcagttgtctctgatgcagcttatacgaaataattgttgttctgttaactgaataccactctgtaattgcaaaaaaaaaaaaaagttgcagctgttttgttgacattctgaatgcttctaagtaaatacaattttttttattagtattgttgtccttttcataggtctgaaatttttcttcttgaggggaagctagtcttttgcttttgcccattttgaatcacatgaattattacagtgtttatcctttcatatagttagctaataaaaagctttgtctacacaccctgcatatcataatgggggtaaagttaagttgagatagttttcatccataactgaacatccaaaatcttgatcagttaagaaatttcacatagcccacttacatttacaaactgaagagtaatcaatctactcaaagcatgggattattagaatcaaacattttgaaagtctgtccttgaaggactaatagaaaagtatgttctaacctttacatgaggactctattctttaactcccattaccatgtaatggcagttatattttgcagttcccacattaaagaagacctgagaatgtatccccaaaagcgtgagcttaaaatacaagactgccatattaaattttttgttgacattagtctcagtgaagactatgaaaatgctggctatagatgtcttttcccatttatctaaatatggactgctcaggaaacgagactttccattacaagtatttttaattaattgggccagcttttcaaacaaagatgccacattcaaaatagggtatattttcctatattacggtttgcccctttataaatccaagtagataggaagaaagaagacaaactttgcatctcagtatgaattattcaatttatttgaatgatttttctttacaaaacaaactcattcattagtcatgtttatctgcttaggagtttagggaacaatttggcaattttgtggttttcgagattatcgttttcttaaagtgccagtattttaaaatagcgttcttgtaattttacacgcttttgtgatggagtgctgttttgttatataatttagacttggattctttccatttgcatttgtttatgtaatttcaggaggaatactgaacatctgagtcctggatgatactaataaactaataattgcagaggttttaaa

SEQ ID NO: 446042 - DNA, 2478 bp, Homo sapiens
  misc_feature (17)..(17): n is a, c, g, or t
  misc_feature (22)..(23): n is a, c, g, or t
aggctaggtacgaggcnggtgnntgaatcggccggtgaggaggctgcgtctggctcccgctctcacagccattgcagtacattgagctccatagagacagcgccggggcaagtgagagccggacgggcactgggcgactctgtgcctcgctgaggaaaaataactaaacatgggcaaaggagatcctaagaagccgagaggcaaaatgtcatcatatgcattttttgtgcaaacttgtcgggaggagcataagaagaagcacccagatgcttcagtcaacttctcagagttttctaagaagtgctcagagaggtggaagaccatgtctgctaaagagaaaggaaaatttgaagatatggcaaaagcggacaaggcccgttatgaaagagaaatgaaaacctatatccctcccaaaggggagacaaaaaagaagttcaaggatcccaatgcacccaagaggcctccttcggccttcttcctcttctgctctgagtatcgcccaaaaatcaaaggagaacatcctggcctgtccattggtgatgttgcgaagaaactgggagagatgtggaataacactgctgcagatgacaagcagccttatgaaaagaaggctgcgaagctgaaggaaaaatacgaaaagttctagttatttctggagttgctgtggatctacagatacgtgatattttggtataactagaatcttgatttctttcataaagttctgccatgttctatttctttccttaatgtttttttcttccctactgttttatcctccctttgctttggaaggatattgctgcatatcgagctaaaggaaagcctgatgcagcaaaaaagggagttgtcaaggctgaaaaaagcaagaaaaagaaggaagaggaggaagatgaggaagatgaagaggatgaggaggaggaggaagatgaagaagatgaagatgaagaagaagatgatgatgatgaataagttggttctagcgcagtttttttttttcttgtctataaagcatttaacccccctgtacacaactcactccttttaaagaaaaaaattgaaatgtaaggctgtgtaagatttgtttttaaactgtacagtgtctttttttgtatagttaacacactaccgaatgtgtctttagatagccctgtcctggtggtattttcaatagccactaaccttgcctggtacagtatgggggttgtaaattggcatggaaatttaaagcaggttcttgttggtgcacagcacaaattagttatatatggggatggtagttttttcatcttcagttgtctctgatgcagcttatacgaaataattgttgttctgttaactgaataccactctgtaattgcaaaaaaaaaaaaaagttgcagctgttttgttgacattctgaatgcttctaagtaaatacaattttttttattagtattgttgtccttttcataggtctgaaatttttcttcttgaggggaagctagtcttttgcttttgcccattttgaatcacatgaattattacagtgtttatcctttcatatagttagctaataaaaagctttgtctacacaccctgcatatcataatgggggtaaagttaagttgagatagttttcatccataactgaacatccaaaatcttgatcagttaagaaatttcacatagcccacttacatttacaaactgaagagtaatcaatctactcaaagcatgggattattagaatcaaacattttgaaagtctgtccttgaaggactaatagaaaagtatgttctaacctttacatgaggactctattctttaactcccattaccatgtaatggcagttatattttgcagttcccacattaaagaagacctgagaatgtatccccaaaagcgtgagcttaaaatacaagactgccatattaaattttttgttgacattagtctcagtgaagactatgaaaatgctggctatagatgtcttttcccatttatctaaatatggactgctcaggaaacgagactttccattacaagtatttttaattaattgggccagcttttcaaacaaagatgccacattcaaaatagggtatattttcctatattacggtttgcccctttataaatccaagtagataggaagaaagaagacaaactttgcatctcagtatgaattattcaatttatttgaatgatttttctttacaaaacaaactcattcattagtcatgtttatctgcttaggagtttagggaacaatttggcaattttgtggttttcgagattatcgttttcttaaagtgccagtattttaaaatagcgttcttgtaattttacacgcttttgtgatggagtgctgttttgttatataatttagacttggattctttccatttgcatttgtttatgtaatttcaggaggaatactgaacatctgagtcctggatgatactaataaactaataattgcagaggttttaaa

SEQ ID NO: 446043 - DNA, 989 bp, Homo sapiens
  misc_feature (17)..(17): n is a, c, g, or t
  misc_feature (22)..(23): n is a, c, g, or t
aggctaggtacgaggcnggtgnntgaatcggccggtgaggaggctgcgtctggctcccgctctcacagccattgcagtacattgagctccatagagacagcgccggggcaagtgagagccggacgggcactgggcgactctgtgcctcgctgaggaaaaataactaaacatgggcaaaggagatcctaagaagccgagaggcaaaatgtcatcatatgcattttttgtgcaaacttgtcgggaggagcataagaagaagcacccagatgcttcagtcaacttctcagagttttctaagaagtgctcagagaggtggaagaccatgtctgctaaagagaaaggaaaatttgaagatatggcaaaagcggacaaggcccgttatgaaagagaaatgaaaacctatatccctcccaaaggggagacaaaaaagaagttcaaggatcccaatgcacccaagaggcctccttcggccttcttcctcttctgctctgagtatcgcccaaaaatcaaaggagaacatcctggcctgtccattggtgatgttgcgaagaaactgggagagatgtggaataacactgctgcagatgacaagcagccttatgaaaagaaggctgcgaagctgaaggaaaaatacgaaaaggatattgctgcatatcgagctaaaggaaagcctgatgcagcaaaaaagggagttgtcaaggctgaaaaaagcaagaaaaagaaggaagaggaggaagatgaggaagatgaagaggatgaggaggaggaggaaatgatcggggcatcgaagcagtgggtctcatagtcgtcggtagctgagacaactgtctcgttgcccagctgggttggcaaatgggggtcgcatttctgttcagggatacgggataggtgggaccaggtgatagaagtatggtgtagagggtgatgagcgagggctgcagcagatctgagttgggctgtacgtactgtagcttgggatggacaggagc

SEQ ID NO: 446044 - DNA, 1971 bp, Homo sapiens
tcaactctttatacttcctcacgctttatacttccgtattgaattcaagtataatattaagtatgcatggacgaagtataaagcgttgagctcaacgctttatacttcctcatttcggccttcttcctcttctgctctgagtatcgcccaaaaatcaaaggagaacatcctggcctgtccattggtgatgttgcgaagaaactgggagagatgtggaataacactgctgcagatgacaagcagccttatgaaaagaaggctgcgaagctgaaggaaaaatacgaaaaggatattgctgcatatcgagctaaaggaaagcctgatgcagcaaaaaagggagttgtcaaggctgaaaaaagcaagaaaaagaaggaagaggaggaagatgaggaagatgaagaggatgaggaggaggaggaagatgaagaagatgaagatgaagaagaagatgatgatgatgaataagttggttctagcgcagtttttttttttcttgtctataaagcatttaacccccctgtacacaactcactccttttaaagaaaaaaattgaaatgtaaggctgtgtaagatttgtttttaaactgtacagtgtctttttttgtatagttaacacactaccgaatgtgtctttagatagccctgtcctggtggtattttcaatagccactaaccttgcctggtacagtatgggggttgtaaattggcatggaaatttaaagcaggttcttgttggtgcacagcacaaattagttatatatggggatggtagttttttcatcttcagttgtctctgatgcagcttatacgaaataattgttgttctgttaactgaataccactctgtaattgcaaaaaaaaaaaaaagttgcagctgttttgttgacattctgaatgcttctaagtaaatacaattttttttattagtattgttgtccttttcataggtctgaaatttttcttcttgaggggaagctagtcttttgcttttgcccattttgaatcacatgaattattacagtgtttatcctttcatatagttagctaataaaaagctttgtctacacaccctgcatatcataatgggggtaaagttaagttgagatagttttcatccataactgaacatccaaaatcttgatcagttaagaaatttcacatagcccacttacatttacaaactgaagagtaatcaatctactcaaagcatgggattattagaatcaaacattttgaaagtctgtccttgaaggactaatagaaaagtatgttctaacctttacatgaggactctattctttaactcccattaccatgtaatggcagttatattttgcagttcccacattaaagaagacctgagaatgtatccccaaaagcgtgagcttaaaatacaagactgccatattaaattttttgttgacattagtctcagtgaagactatgaaaatgctggctatagatgtcttttcccatttatctaaatatggactgctcaggaaacgagactttccattacaagtatttttaattaattgggccagcttttcaaacaaagatgccacattcaaaatagggtatattttcctatattacggtttgcccctttataaatccaagtagataggaagaaagaagacaaactttgcatctcagtatgaattattcaatttatttgaatgatttttctttacaaaacaaactcattcattagtcatgtttatctgcttaggagtttagggaacaatttggcaattttgtggttttcgagattatcgttttcttaaagtgccagtattttaaaatagcgttcttgtaattttacacgcttttgtgatggagtgctgttttgttatataatttagacttggattctttccatttgcatttgtttatgtaatttcaggaggaatactgaacatctgagtcctggatgatactaataaactaataattgcagaggttttaaa

SEQ ID NO: 446045 - DNA, 1882 bp, Homo sapiens
ctcgaccgatacattctgctctatctatcatcgatatctgctgttgtgtatcgcccgagcggatcagggcgtgagaattctggtctagtccaaaggggaggtattaaagcaatctggagagatgtggaataacactgctgcagatgacaagcagccttatgaaaagaaggctgcgaagctgaaggaaaaatacgaaaaggatattgctgcatatcgagctaaaggaaagcctgatgcagcaaaaaagggagttgtcaaggctgaaaaaagcaagaaaaagaaggaagaggaggaagatgaggaagatgaagaggatgaggaggaggaggaagatgaagaagatgaagatgaagaagaagatgatgatgatgaataagttggttctagcgcagtttttttttttcttgtctataaagcatttaacccccctgtacacaactcactccttttaaagaaaaaaattgaaatgtaaggctgtgtaagatttgtttttaaactgtacagtgtctttttttgtatagttaacacactaccgaatgtgtctttagatagccctgtcctggtggtattttcaatagccactaaccttgcctggtacagtatgggggttgtaaattggcatggaaatttaaagcaggttcttgttggtgcacagcacaaattagttatatatggggatggtagttttttcatcttcagttgtctctgatgcagcttatacgaaataattgttgttctgttaactgaataccactctgtaattgcaaaaaaaaaaaaaagttgcagctgttttgttgacattctgaatgcttctaagtaaatacaattttttttattagtattgttgtccttttcataggtctgaaatttttcttcttgaggggaagctagtcttttgcttttgcccattttgaatcacatgaattattacagtgtttatcctttcatatagttagctaataaaaagctttgtctacacaccctgcatatcataatgggggtaaagttaagttgagatagttttcatccataactgaacatccaaaatcttgatcagttaagaaatttcacatagcccacttacatttacaaactgaagagtaatcaatctactcaaagcatgggattattagaatcaaacattttgaaagtctgtccttgaaggactaatagaaaagtatgttctaacctttacatgaggactctattctttaactcccattaccatgtaatggcagttatattttgcagttcccacattaaagaagacctgagaatgtatccccaaaagcgtgagcttaaaatacaagactgccatattaaattttttgttgacattagtctcagtgaagactatgaaaatgctggctatagatgtcttttcccatttatctaaatatggactgctcaggaaacgagactttccattacaagtatttttaattaattgggccagcttttcaaacaaagatgccacattcaaaatagggtatattttcctatattacggtttgcccctttataaatccaagtagataggaagaaagaagacaaactttgcatctcagtatgaattattcaatttatttgaatgatttttctttacaaaacaaactcattcattagtcatgtttatctgcttaggagtttagggaacaatttggcaattttgtggttttcgagattatcgttttcttaaagtgccagtattttaaaatagcgttcttgtaattttacacgcttttgtgatggagtgctgttttgttatataatttagacttggattctttccatttgcatttgtttatgtaatttcaggaggaatactgaacatctgagtcctggatgatactaataaactaataattgcagaggttttaaa

SEQ ID NO: 446046 - DNA, 780 bp, Homo sapiens
  misc_feature (17)..(17): n is a, c, g, or t
  misc_feature (22)..(23): n is a, c, g, or t
aggctaggtacgaggcnggtgnntgaatcggccggtgaggaggctgcgtctggctcccgctctcacagccattgcagtacattgagctccatagagacagcgccggggcaagtgagagccggacgggcactgggcgactctgtgcctcgctgaggaaaaataactaaacatgggcaaaggagatcctaagaagccgagaggcaaaatgtcatcatatgcattttttgtgcaaacttgtcgggaggagcataagaagaagcacccagatgcttcagtcaacttctcagagttttctaagaagtgctcagagaggtggaagaccatgtctgctaaagagaaaggaaaatttgaagatatggcaaaagcggacaaggcccgttatgaaagagaaatgaaaacctatatccctcccaaaggggagacaaaaaagaagttcaaggatcccaatgcacccaagaggcctccttcggccttcttcctcttctgctctgagtatcgcccaaaaatcaaaggagaacatcctggcctgtccattggtgatgttgcgaagaaactgggagagatgtggaataacactgctgcagatgacaagcagccttatgaaaagaaggctgcgaagctgaaggaaaaatacgaaaagcaatcaacgacgaagaatatgcgggcggaattcgggcccattgggcaatcggcctatagagagtcgtattacattactgggcggcgtttaacacgtcgtgctgggacaccctgggtatcccattaacggctggagaactc

SEQ ID NO: 446047 - DNA, 2103 bp, Homo sapiens
ctccagcgtcgccggccccgttccatttccacagctcctcctccccggccgcgcgcccctcccgccccgcgcgcgcctcctctttctcgcggccgagttcagcccgggcagccatatgggggatacgccagcaacagacgccggccgccaagatctgcatccctaggccacgctaagaccctggggaagagcgcaggagcccgggagaagggctggaaggaggggactggacgtgcggagaattcccccctaaaaggcagaagcccccgcccccaccctcgagctccgctcgggcagagcgcctgcctgcctgccgctgctgcgggcgcccacctcgcccagccatgccaggcccggccaccgacgcggggaagatccctttctgcgacgccaaggaagaaatccgtgccgggctcgaaagctctgagggcggcggcggcccggagaggccaggcgcgcgcgggcagcggcagaacatcgtctggaggaatgtcgtcctgatgagcttgctccacttgggggccgtgtactccctggtgctcatccccaaagccaagccactcactctgctctgggcctacttctgcttcctcctggccgctctgggtgtgacagctggtgcccatcgcttgtggagccacaggtcctaccgggccaagctgcctctgaggatatttctggctgtcgccaactccatggctttccagaatgacatcttcgagtggtccagggaccaccgagcccaccacaagtactcagagacggatgctgacccccacaatgcccgccggggcttcttcttctcccatattgggtggctgtttgttcgcaagcatcgagatgttattgagaaggggagaaagcttgacgtcactgacctgcttgctgatcctgtggtccggatccagagaaatacacagcacatccagaaagaaggaagagctctcaatcaagaggcagcgtgtgagatgcttcgtgagtggcatcaagggcatatattgaaagtcacccttcccggattacacattttagctttgttacatactcattgtaaccactccgaaaagtgctgcttgatgctgcgtgctctttctgtgtccctggaggtattctgaaggtcagaagagagatatacaacagcgaggcttggtgataacgtatagaataacagacggggactccacacccaggccttttttaacggtgtgaagcatagacagagctgcagtctgtgctaacattaggttatttattgattcaatcagttgacacaaggaggcagctacggggaggtaaaatatggtcctaaaatcaaaaagatttcagttttgtcattctgtctctgagattctatttccacatctagagcagggtaataatgatacctaccttacaaaattattgggagaatacattagttaatatatgtgaaagtatggaggagatgtgcaataaatatttgtgttattaactacacatacagcactctataggagatattccatttataaaaactttaggttctaaaaacctgtacacgttgattatttttgtaagtcaaaagtgattaagaggagtttaagctatcatttccagatgtatttctataaataaaaacataagtatattcagttgatttggggtggagagttccatagatgtctgttaggtccgcttggtccagagctgagttcaagtcctgaatatccttgttaattttctgtcttgttgatctgtctaatattgacagtggggtattaaagtctcccactattattatatgggagtctaagtctccttgtaggtctctaagaacttgctttatgaatctgggtgctcctgtattaggtgcatacatatttaggatagttagctcttcttgctgcattgatcccattaccattatataatgcccttctttgtcttttttgatctttgttggtttaaagtctgttttattagagactaggattgcaacccctgctatttttttttttttttttgcttgataaatattcctgtatccctttattttgagcctatatgtgtctttgcacgtgaggtgggtctcctgaatacagcacaccgatgggttttgactct

SEQ ID NO: 446048 - DNA, 3154 bp, Homo sapiens
tcgctcagttcgacaaacctcgccccgcctcccgcaacgaacgcccgggggcagatatcaatacagcacagacgcccagggacgccctctccacgacacgcagtagcccaggacgccaaattaaattgcgcgggagcacttaagctgggggatacgccagcaacagacgccggccgccaagatctgcatccctaggccacgctaagaccctggggaagagcgcaggagcccgggagaagggctggaaggaggggactggacgtgcggagaattcccccctaaaaggcagaagcccccgcccccaccctcgagctccgctcgggcagagcgcctgcctgcctgccgctgctgcgggcgcccacctcgcccagccatgccaggcccggccaccgacgcggggaagatccctttctgcgacgccaaggaagaaatccgtgccgggctcgaaagctctgagggcggcggcggcccggagaggccaggcgcgcgcgggcagcggcagaacatcgtctggaggaatgtcgtcctgatgagcttgctccacttgggggccgtgtactccctggtgctcatccccaaagccaagccactcactctgctctgggcctacttctgcttcctcctggccgctctgggtgtgacagctggtgcccatcgcttgtggagccacaggtcctaccgggccaagctgcctctgaggatatttctggctgtcgccaactccatggctttccagaatgacatcttcgagtggtccagggaccaccgagcccaccacaagtactcagagacggatgctgacccccacaatgcccgccggggcttcttcttctcccatattgggtggctgtttgttcgcaagcatcgagatgttattgagaaggggagaaagcttgacgtcactgacctgcttgctgatcctgtggtccggatccagagaaagtactataagatctccgtggtgctcatgtgctttgtggtccccacgctggtgccctggtacatctggggagagagtctgtggaattcctacttcttggcctctattctccgctataccatctcactcaacatcagctggctggtcaacagcgccgcccacatgtatggaaaccggccctatgacaagcacatcagccctcggcagaacccactcgtcgctctgggtgccattggtgaaggcttccataattaccatcacacctttccctttgactactctgcgagtgaatttggcttaaattttaacccaaccacctggttcattgatttcatgtgctggctggggctggccactgaccgcaaacgggcaaccaagccgatgatcgaggcccggaaggccaggactggagacagcagtgcttgaacttggaacagccatcccacatgtctgccgttgcaacctcggttcatggctttggttacaatagctctcttgtacattggatcgtgggagggggcagagggtggggaaggaacgagtcaatgtggtttgggaatgttttgtttatctcaaaataatgttgaaatacaattatcaatgaaaaaactttcgtttttttttttggttggtttggtttttgagacagagtctcactctgtcacccaggctggagtgcagtggcgcagtctcggctcactgcagcctccacctacctggttcaagcaattctcctgcctcagcctcctgagtagctgagattacaggagcctgccaccacacccagctaattttttggtatttttagtagagacagggtttcatcatgttggccagactggcctcgaattcctgacctcaggcaatccacccgcctcggcctcccaaagagctgggattacaggcgtgagccaccgcaccctgccgaaaaaaactttttttttttggagacggaggctcgctctgtcccccaggctggagtgcagtggcgagatctcagctcactgcaagctccgcctcccgggttcacgccattctcctgcctcagcctcccgagtagctgggagccagcgcgcccagcctaaaaaacttttcaagtcaatattactacgatttaacattagagtgtggacatgtgatttaatcgctatagctaaaatacgtcaaatatacgttgtcatgtgcttgaacatgatgctaaccctgacaggatgaaggaaagtaatattctttcagtgtagttcaggagagcatttgttttcttttctaccaattaacccatcattgcttttaaacaaccatctgaaggagcagagaggcagggtagaagacagaagggggatctatgtggtaactaaagaatgtttctgttttgttaattattgtgtgtgtgtggttttattgtttgcttaagagaatcaaaaactgaaaaaaatgagaatacaggaaatggctcttgtttatttttttgctgtgtttacagcttgttaatgctctactgtctttgtttcaagagagatttgttcactgcccagctcgttttgtgtcctgagccctatgcccagcccaccttataaatcatgcctgtttagatgtttgattttgttctgtttgctattgttatcttaaaggtgtataactctgacatgccagacatcaaattaagctcaaattaagctctcgtttaaatgtttaaacacctaatttatattctaattgatcccagccactgatgcatgtactttagctacttctgctaaataagcatattaattttccacatcaggccatcagatcttgagaaccaacagttatctagaattccgtgtctactaatgtttcacctgcatgcagccttcattaattttgtagcaaaatataaagtgatcattatgtagtttctggattaaaaaaatttgtgtgtgaagttgctttgtaaagtgcatgtggaattaatgggacagtgtgccctttgtgttagatgttagagcaaaagaaagggcttatagtgttagtattggagcactttgaagatagatattttcagaaaagatgtaggatttaaaagttaaattttaaattttagaaaaagatatgatggcaattggaaatagtcacaatgaagttcttcatccagtaggtgtttaacagtgttattttgccactggtaatgtgtaaactgtgagtgatttacaataaatgattatgaattca

SEQ ID NO: 446049 - DNA, 2892 bp, Homo sapiens
ctccagcgtcgccggccccgttccatttccacagctcctcctccccggccgcgcgcccctcccgccccgcgcgcgcctcctctttctcgcggccgagttcagcccgggcagccatatgggggatacgccagcaacagacgccggccgccaagatctgcatccctaggccacgctaagaccctggggaagagcgcaggagcccgggagaagggctggaaggaggggactggacgtgcggagaattcccccctaaaaggcagaagcccccgcccccaccctcgagctccgctcgggcagagcgcctgcctgcctgccgctgctgcgggcgcccacctcgcccagccatgccaggcccggccaccgacgcggggaagatccctttctgcgacgccaaggaagaaatccgtgccgggctcgaaagctctgagggcggcggcggcccggagaggccaggcgcgcgcgggcagcggcagaacatcgtctggaggaatgtcgtcctgatgagcttgctccacttgggggccgtgtactccctggtgctcatccccaaagccaagccactcactctgctctgggcctacttctgcttcctcctggccgctctgggtgtgacagctggtgcccatcgcttgtggagccacaggtcctaccgggccaagctgcctctgaggatatttctggctgtcgccaactccatggctttccagaatgacatcttcgagtggtccagggaccaccgagcccaccacaagtactcagagacggatgctgacccccacaatgcccgccggggcttcttcttctcccatattgggtggctgtttgttcgcaagcatcgagatgttattgagaaggggagaaagcttgacgtcactgacctgcttgctgatcctgtggtccggatccagagaaagtgaaggcttccataattaccatcacacctttccctttgactactctgcgagtgaatttggcttaaattttaacccaaccacctggttcattgatttcatgtgctggctggggctggccactgaccgcaaacgggcaaccaagccgatgatcgaggcccggaaggccaggactggagacagcagtgcttgaacttggaacagccatcccacatgtctgccgttgcaacctcggttcatggctttggttacaatagctctcttgtacattggatcgtgggagggggcagagggtggggaaggaacgagtcaatgtggtttgggaatgttttgtttatctcaaaataatgttgaaatacaattatcaatgaaaaaactttcgtttttttttttggttggtttggtttttgagacagagtctcactctgtcacccaggctggagtgcagtggcgcagtctcggctcactgcagcctccacctacctggttcaagcaattctcctgcctcagcctcctgagtagctgagattacaggagcctgccaccacacccagctaattttttggtatttttagtagagacagggtttcatcatgttggccagactggcctcgaattcctgacctcaggcaatccacccgcctcggcctcccaaagagctgggattacaggcgtgagccaccgcaccctgccgaaaaaaactttttttttttggagacggaggctcgctctgtcccccaggctggagtgcagtggcgagatctcagctcactgcaagctccgcctcccgggttcacgccattctcctgcctcagcctcccgagtagctgggagccagcgcgcccagcctaaaaaacttttcaagtcaatattactacgatttaacattagagtgtggacatgtgatttaatcgctatagctaaaatacgtcaaatatacgttgtcatgtgcttgaacatgatgctaaccctgacaggatgaaggaaagtaatattctttcagtgtagttcaggagagcatttgttttcttttctaccaattaacccatcattgcttttaaacaaccatctgaaggagcagagaggcagggtagaagacagaagggggatctatgtggtaactaaagaatgtttctgttttgttaattattgtgtgtgtgtggttttattgtttgcttaagagaatcaaaaactgaaaaaaatgagaatacaggaaatggctcttgtttatttttttgctgtgtttacagcttgttaatgctctactgtctttgtttcaagagagatttgttcactgcccagctcgttttgtgtcctgagccctatgcccagcccaccttataaatcatgcctgtttagatgtttgattttgttctgtttgctattgttatcttaaaggtgtataactctgacatgccagacatcaaattaagctcaaattaagctctcgtttaaatgtttaaacacctaatttatattctaattgatcccagccactgatgcatgtactttagctacttctgctaaataagcatattaattttccacatcaggccatcagatcttgagaaccaacagttatctagaattccgtgtctactaatgtttcacctgcatgcagccttcattaattttgtagcaaaatataaagtgatcattatgtagtttctggattaaaaaaatttgtgtgtgaagttgctttgtaaagtgcatgtggaattaatgggacagtgtgccctttgtgttagatgttagagcaaaagaaagggcttatagtgttagtattggagcactttgaagatagatattttcagaaaagatgtaggatttaaaagttaaattttaaattttagaaaaagatatgatggcaattggaaatagtcacaatgaagttcttcatccagtaggtgtttaacagtgttattttgccactggtaatgtgtaaactgtgagtgatttacaataaatgattatgaattca

SEQ ID NO: 446050 - DNA, 3163 bp, Homo sapiens
tgtctaggccggtataactgcagttctttcattacagttagtaccgagacgtcatggtgagtcaggcgctatctccggactgaatgcgtctgcacgttccgtcggacgacgctggagaccctagtggcgagatagcgccagactacaataacgccggtcgcacaagtatctgacattccctagtgctacgctcaggaccctggggtaaagagcgcagagatgccgccgcgtgataaatgggctcggtaattgaggtgacatggccgctgtgtgttacatcaaccccctagaatggcagaagcccccgcccccaccctcgagctccgctcgggcagagcgcctgcctgcctgccgctgctgcgggcgcccacctcgcccagccatgccaggcccggccaccgacgcggggaagatccctttctgcgacgccaaggaagaaatccgtgccgggctcgaaagctctgagggcggcggcggcccggagaggccaggcgcgcgcgggcagcggcagaacatcgtctggaggaatgtcgtcctgatgagcttgctccacttgggggccgtgtactccctggtgctcatccccaaagccaagccactcactctgctctgggcctacttctgcttcctcctggccgctctgggtgtgacagctggtgcccatcgcttgtggagccacaggtcctaccgggccaagctgcctctgaggatatttctggctgtcgccaactccatggctttccagaatgacatcttcgagtggtccagggaccaccgagcccaccacaagtactcagagacggatgctgacccccacaatgcccgccggggcttcttcttctcccatattgggtggctgtttgttcgcaagcatcgagatgttattgagaaggggagaaagcttgacgtcactgacctgcttgctgatcctgtggtccggatccagagaaagtactataagatctccgtggtgctcatgtgctttgtggtccccacgctggtgccctggtacatctggggagagagtctgtggaattcctacttcttggcctctattctccgctataccatctcactcaacatcagctggctggtcaacagcgccgcccacatgtatggaaaccggccctatgacaagcacatcagccctcggcagaacccactcgtcgctctgggtgccattggtgaaggcttccataattaccatcacacctttccctttgactactctgcgagtgaatttggcttaaattttaacccaaccacctggttcattgatttcatgtgctggctggggctggccactgaccgcaaacgggcaaccaagccgatgatcgaggcccggaaggccaggactggagacagcagtgcttgaacttggaacagccatcccacatgtctgccgttgcaacctcggttcatggctttggttacaatagctctcttgtacattggatcgtgggagggggcagagggtggggaaggaacgagtcaatgtggtttgggaatgttttgtttatctcaaaataatgttgaaatacaattatcaatgaaaaaactttcgtttttttttttggttggtttggtttttgagacagagtctcactctgtcacccaggctggagtgcagtggcgcagtctcggctcactgcagcctccacctacctggttcaagcaattctcctgcctcagcctcctgagtagctgagattacaggagcctgccaccacacccagctaattttttggtatttttagtagagacagggtttcatcatgttggccagactggcctcgaattcctgacctcaggcaatccacccgcctcggcctcccaaagagctgggattacaggcgtgagccaccgcaccctgccgaaaaaaactttttttttttggagacggaggctcgctctgtcccccaggctggagtgcagtggcgagatctcagctcactgcaagctccgcctcccgggttcacgccattctcctgcctcagcctcccgagtagctgggagccagcgcgcccagcctaaaaaacttttcaagtcaatattactacgatttaacattagagtgtggacatgtgatttaatcgctatagctaaaatacgtcaaatatacgttgtcatgtgcttgaacatgatgctaaccctgacaggatgaaggaaagtaatattctttcagtgtagttcaggagagcatttgttttcttttctaccaattaacccatcattgcttttaaacaaccatctgaaggagcagagaggcagggtagaagacagaagggggatctatgtggtaactaaagaatgtttctgttttgttaattattgtgtgtgtgtggttttattgtttgcttaagagaatcaaaaactgaaaaaaatgagaatacaggaaatggctcttgtttatttttttgctgtgtttacagcttgttaatgctctactgtctttgtttcaagagagatttgttcactgcccagctcgttttgtgtcctgagccctatgcccagcccaccttataaatcatgcctgtttagatgtttgattttgttctgtttgctattgttatcttaaaggtgtataactctgacatgccagacatcaaattaagctcaaattaagctctcgtttaaatgtttaaacacctaatttatattctaattgatcccagccactgatgcatgtactttagctacttctgctaaataagcatattaattttccacatcaggccatcagatcttgagaaccaacagttatctagaattccgtgtctactaatgtttcacctgcatgcagccttcattaattttgtagcaaaatataaagtgatcattatgtagtttctggattaaaaaaatttgtgtgtgaagttgctttgtaaagtgcatgtggaattaatgggacagtgtgccctttgtgttagatgttagagcaaaagaaagggcttatagtgttagtattggagcactttgaagatagatattttcagaaaagatgtaggatttaaaagttaaattttaaattttagaaaaagatatgatggcaattggaaatagtcacaatgaagttcttcatccagtaggtgtttaacagtgttattttgccactggtaatgtgtaaactgtgagtgatttacaataaatgattatgaattca

SEQ ID NO: 446051 - DNA, 2919 bp, Homo sapiens
ctccagcgtcgccggccccgttccatttccacagctcctcctccccggccgcgcgcccctcccgccccgcgcgcgcctcctctttctcgcggccgagttcagcccgggcagccatatgggggatacgccagcaacagacgccggccgccaagatctgcatccctaggccacgctaagaccctggggaagagcgcaggagcccgggagaagggctggaaggaggggactggacgtgcggagaattcccccctaaaaggcagaagcccccgcccccaccctcgagctccgctcgggcagagcgcctgcctgcctgccgctgctgcgggcgcccacctcgcccagccatgccaggcccggccaccgacgcggggaagatccctttctgcgacgccaaggaagaaatccgtgccgggctcgaaagctctgagggcggcggcggcccggagaggccaggcgcgcgcgggcagcggcagaacatcgtctggaggaatgtcgtcctgatgagcttgctccacttgggggccgtgtactccctggtgctcatccccaaagccaagccactcactctgctctgggcctacttctgcttcctcctggccgctctgggtgtgacagctggtgcccatcgcttgtggagccacaggtcctaccgggccaagctgcctctgaggatatttctggctgtcgccaactccatggctttccaggtactataagatctccgtggtgctcatgtgctttgtggtccccacgctggtgccctggtacatctggggagagagtctgtggaattcctacttcttggcctctattctccgctataccatctcactcaacatcagctggctggtcaacagcgccgcccacatgtatggaaaccggccctatgacaagcacatcagccctcggcagaacccactcgtcgctctgggtgccattggtgaaggcttccataattaccatcacacctttccctttgactactctgcgagtgaatttggcttaaattttaacccaaccacctggttcattgatttcatgtgctggctggggctggccactgaccgcaaacgggcaaccaagccgatgatcgaggcccggaaggccaggactggagacagcagtgcttgaacttggaacagccatcccacatgtctgccgttgcaacctcggttcatggctttggttacaatagctctcttgtacattggatcgtgggagggggcagagggtggggaaggaacgagtcaatgtggtttgggaatgttttgtttatctcaaaataatgttgaaatacaattatcaatgaaaaaactttcgtttttttttttggttggtttggtttttgagacagagtctcactctgtcacccaggctggagtgcagtggcgcagtctcggctcactgcagcctccacctacctggttcaagcaattctcctgcctcagcctcctgagtagctgagattacaggagcctgccaccacacccagctaattttttggtatttttagtagagacagggtttcatcatgttggccagactggcctcgaattcctgacctcaggcaatccacccgcctcggcctcccaaagagctgggattacaggcgtgagccaccgcaccctgccgaaaaaaactttttttttttggagacggaggctcgctctgtcccccaggctggagtgcagtggcgagatctcagctcactgcaagctccgcctcccgggttcacgccattctcctgcctcagcctcccgagtagctgggagccagcgcgcccagcctaaaaaacttttcaagtcaatattactacgatttaacattagagtgtggacatgtgatttaatcgctatagctaaaatacgtcaaatatacgttgtcatgtgcttgaacatgatgctaaccctgacaggatgaaggaaagtaatattctttcagtgtagttcaggagagcatttgttttcttttctaccaattaacccatcattgcttttaaacaaccatctgaaggagcagagaggcagggtagaagacagaagggggatctatgtggtaactaaagaatgtttctgttttgttaattattgtgtgtgtgtggttttattgtttgcttaagagaatcaaaaactgaaaaaaatgagaatacaggaaatggctcttgtttatttttttgctgtgtttacagcttgttaatgctctactgtctttgtttcaagagagatttgttcactgcccagctcgttttgtgtcctgagccctatgcccagcccaccttataaatcatgcctgtttagatgtttgattttgttctgtttgctattgttatcttaaaggtgtataactctgacatgccagacatcaaattaagctcaaattaagctctcgtttaaatgtttaaacacctaatttatattctaattgatcccagccactgatgcatgtactttagctacttctgctaaataagcatattaattttccacatcaggccatcagatcttgagaaccaacagttatctagaattccgtgtctactaatgtttcacctgcatgcagccttcattaattttgtagcaaaatataaagtgatcattatgtagtttctggattaaaaaaatttgtgtgtgaagttgctttgtaaagtgcatgtggaattaatgggacagtgtgccctttgtgttagatgttagagcaaaagaaagggcttatagtgttagtattggagcactttgaagatagatattttcagaaaagatgtaggatttaaaagttaaattttaaattttagaaaaagatatgatggcaattggaaatagtcacaatgaagttcttcatccagtaggtgtttaacagtgttattttgccactggtaatgtgtaaactgtgagtgatttacaataaatgattatgaattca

SEQ ID NO: 446052 - DNA, 2878 bp, Homo sapiens
agcgagcgggctgtaggaggggactggccgtccgtgaaatcccccctaaaggcaaagcccgcgccaccctcactccatcggcaacgcctgctgcctgcgtgtgggccccactgccacatgcgccgcacgagcgaatcccttctgcacagaagaaatccgtgccgggctcgaaagctctgagggcggcggcggcccggagaggccaggcgcgcgcgggcagcggcagaacatcgtctggaggaatgtcgtcctgatgagcttgctccacttgggggccgtgtactccctggtgctcatccccaaagccaagccactcactctgctctgggcctacttctgcttcctcctggccgctctgggtgtgacagctggtgcccatcgcttgtggagccacaggtcctaccgggccaagctgcctctgaggatatttctggctgtcgccaactccatggctttccagaatgacatcttcgagtggtccagggaccaccgagcccaccacaagtactcagagacggatgctgacccccacaatgcccgccggggcttcttcttctcccatattgggtggctgtttgttcgcaagcatcgagatgttattgagaaggggagaaagcttgacgtcactgacctgcttgctgatcctgtggtccggatccagagaaagtactataagatctccgtggtgctcatgtgctttgtggtccccacgctggtgccctggtacatctggggagagagtctgtggaattcctacttcttggcctctattctccgctataccatctcactcaacatcagctggctggtcaacagcgccgcccacatgtatggaaaccggccctatgacaagcacatcagccctcggcagaacccactcgtcgctctgggtgccattggtgaaggcttccataattaccatcacacctttccctttgactactctgcgagtgaatttggcttaaattttaacccaaccacctggttcattgatttcatgtgctggctggggctggccactgaccgcaaacgggcaaccaagccgatgatcgaggcccggaaggccaggactggagacagcagtgcttgaacttggaacagccatcccacatgtctgccgttgcaacctcggttcatggctttggttacaatagctctcttgtacattggatcgtgggagggggcagagggtggggaaggaacgagtcaatgtggtttgggaatgttttgtttatctcaaaataatgttgaaatacaattatcaatgaaaaaactttcgtttttttttttggttggtttggtttttgagacagagtctcactctgtcacccaggctggagtgcagtggcgcagtctcggctcactgcagcctccacctacctggttcaagcaattctcctgcctcagcctcctgagtagctgagattacaggagcctgccaccacacccagctaattttttggtatttttagtagagacagggtttcatcatgttggccagactggcctcgaattcctgacctcaggcaatccacccgcctcggcctcccaaagagctgggattacaggcgtgagccaccgcaccctgccgaaaaaaactttttttttttggagacggaggctcgctctgtcccccaggctggagtgcagtggcgagatctcagctcactgcaagctccgcctcccgggttcacgccattctcctgcctcagcctcccgagtagctgggagccagcgcgcccagcctaaaaaacttttcaagtcaatattactacgatttaacattagagtgtggacatgtgatttaatcgctatagctaaaatacgtcaaatatacgttgtcatgtgcttgaacatgatgctaaccctgacaggatgaaggaaagtaatattctttcagtgtagttcaggagagcatttgttttcttttctaccaattaacccatcattgcttttaaacaaccatctgaaggagcagagaggcagggtagaagacagaagggggatctatgtggtaactaaagaatgtttctgttttgttaattattgtgtgtgtgtggttttattgtttgcttaagagaatcaaaaactgaaaaaaatgagaatacaggaaatggctcttgtttatttttttgctgtgtttacagcttgttaatgctctactgtctttgtttcaagagagatttgttcactgcccagctcgttttgtgtcctgagccctatgcccagcccaccttataaatcatgcctgtttagatgtttgattttgttctgtttgctattgttatcttaaaggtgtataactctgacatgccagacatcaaattaagctcaaattaagctctcgtttaaatgtttaaacacctaatttatattctaattgatcccagccactgatgcatgtactttagctacttctgctaaataagcatattaattttccacatcaggccatcagatcttgagaaccaacagttatctagaattccgtgtctactaatgtttcacctgcatgcagccttcattaattttgtagcaaaatataaagtgatcattatgtagtttctggattaaaaaaatttgtgtgtgaagttgctttgtaaagtgcatgtggaattaatgggacagtgtgccctttgtgttagatgttagagcaaaagaaagggcttatagtgttagtattggagcactttgaagatagatattttcagaaaagatgtaggatttaaaagttaaattttaaattttagaaaaagatatgatggcaattggaaatagtcacaatgaagttcttcatccagtaggtgtttaacagtgttattttgccactggtaatgtgtaaactgtgagtgatttacaataaatgattatgaattca

SEQ ID NO: 446053 - DNA, 2474 bp, Homo sapiens
  misc_feature (45)..(45): n is a, c, g, or t
  misc_feature (52)..(52): n is a, c, g, or t
actcacgcgtacgaccacgcgtccgctggcatgtcgccaaatccntggcttnccagaatgacatcttcgagtggtccagggaccaccgagcccaccacaagtactcagagacggatgctgacccccacaatgcccgccggggcttcttcttctcccatattgggtggctgtttgttcgcaagcatcgagatgttattgagaaggggagaaagcttgacgtcactgacctgcttgctgatcctgtggtccggatccagagaaagtactataagatctccgtggtgctcatgtgctttgtggtccccacgctggtgccctggtacatctggggagagagtctgtggaattcctacttcttggcctctattctccgctataccatctcactcaacatcagctggctggtcaacagcgccgcccacatgtatggaaaccggccctatgacaagcacatcagccctcggcagaacccactcgtcgctctgggtgccattggtgaaggcttccataattaccatcacacctttccctttgactactctgcgagtgaatttggcttaaattttaacccaaccacctggttcattgatttcatgtgctggctggggctggccactgaccgcaaacgggcaaccaagccgatgatcgaggcccggaaggccaggactggagacagcagtgcttgaacttggaacagccatcccacatgtctgccgttgcaacctcggttcatggctttggttacaatagctctcttgtacattggatcgtgggagggggcagagggtggggaaggaacgagtcaatgtggtttgggaatgttttgtttatctcaaaataatgttgaaatacaattatcaatgaaaaaactttcgtttttttttttggttggtttggtttttgagacagagtctcactctgtcacccaggctggagtgcagtggcgcagtctcggctcactgcagcctccacctacctggttcaagcaattctcctgcctcagcctcctgagtagctgagattacaggagcctgccaccacacccagctaattttttggtatttttagtagagacagggtttcatcatgttggccagactggcctcgaattcctgacctcaggcaatccacccgcctcggcctcccaaagagctgggattacaggcgtgagccaccgcaccctgccgaaaaaaactttttttttttggagacggaggctcgctctgtcccccaggctggagtgcagtggcgagatctcagctcactgcaagctccgcctcccgggttcacgccattctcctgcctcagcctcccgagtagctgggagccagcgcgcccagcctaaaaaacttttcaagtcaatattactacgatttaacattagagtgtggacatgtgatttaatcgctatagctaaaatacgtcaaatatacgttgtcatgtgcttgaacatgatgctaaccctgacaggatgaaggaaagtaatattctttcagtgtagttcaggagagcatttgttttcttttctaccaattaacccatcattgcttttaaacaaccatctgaaggagcagagaggcagggtagaagacagaagggggatctatgtggtaactaaagaatgtttctgttttgttaattattgtgtgtgtgtggttttattgtttgcttaagagaatcaaaaactgaaaaaaatgagaatacaggaaatggctcttgtttatttttttgctgtgtttacagcttgttaatgctctactgtctttgtttcaagagagatttgttcactgcccagctcgttttgtgtcctgagccctatgcccagcccaccttataaatcatgcctgtttagatgtttgattttgttctgtttgctattgttatcttaaaggtgtataactctgacatgccagacatcaaattaagctcaaattaagctctcgtttaaatgtttaaacacctaatttatattctaattgatcccagccactgatgcatgtactttagctacttctgctaaataagcatattaattttccacatcaggccatcagatcttgagaaccaacagttatctagaattccgtgtctactaatgtttcacctgcatgcagccttcattaattttgtagcaaaatataaagtgatcattatgtagtttctggattaaaaaaatttgtgtgtgaagttgctttgtaaagtgcatgtggaattaatgggacagtgtgccctttgtgttagatgttagagcaaaagaaagggcttatagtgttagtattggagcactttgaagatagatattttcagaaaagatgtaggatttaaaagttaaattttaaattttagaaaaagatatgatggcaattggaaatagtcacaatgaagttcttcatccagtaggtgtttaacagtgttattttgccactggtaatgtgtaaactgtgagtgatttacaataaatgattatgaattca

SEQ ID NO: 446054 - DNA, 1558 bp, Homo sapiens
ctccagcgtcgccggccccgttccatttccacagctcctcctccccggccgcgcgcccctcccgccccgcgcgcgcctcctctttctcgcggccgagttcagcccgggcagccatatgggggatacgccagcaacagacgccggccgccaagatctgcatccctaggccacgctaagaccctggggaagagcgcaggagcccgggagaagggctggaaggaggggactggacgtgcggagaattcccccctaaaaggcagaagcccccgcccccaccctcgagctccgctcgggcagagcgcctgcctgcctgccgctgctgcgggcgcccacctcgcccagccatgccaggcccggccaccgacgcggggaagatccctttctgcgacgccaaggaagaaatccgtgccgggctcgaaagctctgagggcggcggcggcccggagaggccaggcgcgcgcgggcagcggcagaacatcgtctggaggaatgtcgtcctgatgagcttgctccacttgggggccgtgtactccctggtgctcatccccaaagccaagccactcactctgctctgggcctacttctgcttcctcctggccgctctgggtgtgacagctggtgcccatcgcttgtggagccacaggtcctaccgggccaagctgcctctgaggatatttctggctgtcgccaactccatggctttccagaatgacatcttcgagtggtccagggaccaccgagcccaccacaagtactcagagacggatgctgacccccacaatgcccgccggggcttcttcttctcccagcctaaaaaacttttcaagtcaatattactacgatttaacattagagtgtggacatgtgatttaatcgctatagctaaaatacgtcaaatatacgttgtcatgtgcttgaacatgatgctaaccctgacaggatgaaggaaagtaatattctttcagtgtagttcaggagagcatttgttttcttttctaccaattaacccatcattgcttttaaacaaccatctgaaggagcagagaggcagggtagaagacagaagggggatctatgtggtaactaaagaatgtttctgttttgttaattattgtgtgtgtgtggttttattgtttgcttaagagaatcaaaaactgaaaaaaatgagaatacaggaaatggctcttgtttatttttttgctgtgtttacagcttgttaatgctctactgtctttgtttcaagagagatttgttcactgcccagctcgttttgtgtcctgagccctatgcccagcccaccttataaatcatgcctgtttagatgttgaatcgggcagaggcgaaggatctacggtgttatctgacatgccgaattcaataaggcaataaggtcgtaatgttaagcgcatttattttattggtccgctagtgtggtagaatgtgggttattactatgggaggtttggaccggttatccgtgtattaggcggcaaatagaaagatgatcggatatatggctgtgttttttggttgttgtattgttatgataggtaggggt

SEQ ID NO: 446055 - DNA, 318 bp, Homo sapiens
ttgtgtgtgaagttgctttgtaaagtgcatgtggaattaatgggacagtgtgccctttgtgttagatgttagagcaaaagaaagggcttatagtgttagtattggagcactttgaagatagatattttcagaaaagatgtaggatttaaaagttaaattttaaattttagaaaaagatatgatggcaattggaaatagtcacaatgaagttcttcatccagtaggtgtttaacagtgttattttgccactggtaatgtgtaaactgtgagtgatttacaataaatgattatgaattcattggtgttcttgtccagata

SEQ ID NO: 446056 - DNA, 3125 bp, Homo sapiens
ctccagcgtcgccggccccgttccatttccacagctcctcctccccggccgcgcgcccctcccgccccgcgcgcgcctcctctttctcgcggccgagttcagcccgggcagccatatgggggatacgccagcaacagacgccggccgccaagatctgcatccctaggccacgctaagaccctggggaagagcgcaggagcccgggagaagggctggaaggaggggactggacgtgcggagaattcccccctaaaaggcagaagcccccgcccccaccctcgagctccgctcgggcagagcgcctgcctgcctgccgctgctgcgggcgcccacctcgcccagccatgccaggcccggccaccgacgcggggaagatccctttctgcgacgccaaggaagaaatccgtgccgggctcgaaagctctgagggcggcggcggcccggagaggccaggcgcgcgcgggcagcggcagaacatcgtctggaggaatgtcgtcctgatgagcttgctccacttgggggccgtgtactccctggtgctcatccccaaagccaagccactcactctgctctgggcctacttctgcttcctcctggccgctctgggtgtgacagctggtgcccatcgcttgtggagccacaggtcctaccgggccaagctgcctctgaggatatttctggctgtcgccaactccatggctttccagaatgacatcttcgagtggtccagggaccaccgagcccaccacaagtactcagagacggatgctgacccccacaatgcccgccggggcttcttcttctcccatattgggtggctgtttgttcgcaagcatcgagatgttattgagaaggggagaaagcttgacgtcactgacctgcttgctgatcctgtggtccggatccagagaaagtactataagatctccgtggtgctcatgtgctttgtggtccccacgctggtgccctggtacatctggggagagagtctgtggaattcctacttcttggcctctattctccgctataccatctcactcaacatcagctggctggtcaacagcgccgcccacatgtatggaaaccggccctatgacaagcacatcagccctcggcagaacccactcgtcgctctgggtgccattggtgaaggcttccataattaccatcacacctttccctttgactactctgcgagtgaatttggcttaaattttaacccaaccacctggttcattgatttcatgtgctggctggggctggccactgaccgcaaacgggcaaccaagccgatgatcgaggcccggaaggccaggactggagacagcagtgcttgaacttggaacagccatcccacatgtctgccgttgcaacctcggttcatggctttggttacaatagctctcttgtacattggatcgtgggagggggcagagggtggggaaggaacgagtcaatgtggtttgggaatgttttgtttatctcaaaataatgttgaaatacaattatcaatgaaaaaactttcgtttttttttttggttggtttggtttttgagacagagtctcactctgtcacccaggctggagtgcagtggcgcagtctcggctcactgcagcctccacctacctggttcaagcaattctcctgcctcagcctcctgagtagctgagattacaggagcctgccaccacacccagctaattttttggtatttttagtagagacagggtttcatcatgttggccagactggcctcgaattcctgacctcaggcaatccacccgcctcggcctcccaaagagctgggattacaggcgtgagccaccgcaccctgccgaaaaaaactttttttttttggagacggaggctcgctctgtcccccaggctggagtgcagtggcgagatctcagctcactgcaagctccgcctcccgggttcacgccattctcctgcctcagcctcccgagtagctgggagccagcgcgcccagcctaaaaaacttttcaagtcaatattactacgatttaacattagagtgtggacatgtgatttaatcgctatagctaaaatacgtcaaatatacgttgtcatgtgcttgaacatgatgctaaccctgacaggatgaaggaaagtaatattctttcagtgtagttcaggagagcatttgttttcttttctaccaattaacccatcattgcttttaaacaaccatctgaaggagcagagaggcagggtagaagacagaagggggatctatgtggtaactaaagaatgtttctgttttgttaattattgtgtgtgtgtggttttattgtttgcttaagagaatcaaaaactgaaaaaaatgagaatacaggaaatggctcttgtttatttttttgctgtgtttacagcttgttaatgctctactgtctttgtttcaagagagatttgttcactgcccagctcgttttgtgtcctgagccctatgcccagcccaccttataaatcatgcctgtttagatgtttgattttgttctgtttgctattgttatcttaaaggtgtataactctgacatgccagacatcaaattaagctcaaattaagctctcgtttaaatgtttaaacacctaatttatattctaattgatcccagccactgatgcatgtactttagctacttctgctaaataagcatattaattttccacatcaggccatcagatcttgagaaccaacagttatctagaattccgtgtctactaatgtttcacctgcatgcagccttcattaattttgtagcaaaatataaagtgatcattatgtagtttctggattaaaaaaatttgtgtgtgaagttgctttgtaaagtgcatgtggaattaatgggacagtgtgccctttgtgttagatgttagagcaaaagaaagggcttatagtgttagtattggagcactttgaagatagatattttcagaaaagatgtaggatttaaaagttaaattttaaattttagaaaaagatatgatggcaattggaaatagtcacaatgaagttcttcatccagtaggtgtttaacagtgttattttgccactggtaatgtgtaaactgtgagtgatttacaataaatgattatgaattca

SEQ ID NO: 446057 - DNA, 3177 bp, Homo sapiens
ctccagcgtcgccggccccgttccatttccacagctcctcctccccggccgcgcgcccctcccgccccgcgcgcgcctcctctttctcgcggccgagttcagcccgggcagccatatgggggatacgccagcaacagacgccggccgccaagatctgcatccctaggccacgctaagaccctggggaagagcgcaggagcccgggagaagggctggaaggaggggactggacgtgcggagaattcccccctaaaaggcagaagcccccgcccccaccctcgagctccgctcgggcagagcgcctgcctgcctgccgctgctgcgggcgcccacctcgcccagccatgccaggcccggccaccgacgcggggaagatccctttctgcgacgccaaggaagaaatccgtgccgggctcgaaagctctgagggcggcggcggcccggagaggccaggcgcgcgcgggcagcggcagaacatcgtctggaggaatgtcgtcctgatgagcttgctccacttgggggccgtgtactccctggtgctcatccccaaagccaagccactcactctgctctgggcctacttctgcttcctcctggccgctctgggtgtgacagctggtgcccatcgcttgtggagccacaggtcctaccgggccaagctgcctctgaggatatttctggctgtcgccaactccatggctttccagaatgacatcttcgagtggtccagggaccaccgagcccaccacaagtactcagagacggatgctgacccccacaatgcccgccggggcttcttcttctcccatattgggtggctgtttgttcgcaagcatcgagatgttattgagaaggggagaaagcttgacgtcactgacctgcttgctgatcctgtggtccggatccagagaaagtactataagatctccgtggtgctcatgtgctttgtggtccccacgctggtgccctggtacatctggggagagagtctgtggaattcctacttcttggcctctattctccgctataccatctcactcaacatcagctggctggtcaacagcgccgcccacatgtatggaaaccggccctatgacaagcacatcagccctcggcagaacccactcgtcgctctgggtgccattggtgaaggcttccataattaccatcacacctttccctttgactactctgcgagtgaatttggcttaaattttaacccaaccacctggttcattgatttcatgtgctggctggggctggccactgaccgcaaacgggcaaccaagccgatgatcgaggcccggaaggccaggactggagacagcagtgcttgaacttggaacagccatcccacatgtctgccgttgcaacctcggttcatggctttggttacaatagctctcttgtacattggatcgtgggagggggcagagggtggggaaggaacgagtcaatgtggtttgggaatgttttgtttatctcaaaataatgttgaaatacaattatcaatgaaaaaactttcgtttttttttttggttggtttggtttttgagacagagtctcactctgtcacccaggctggagtgcagtggcgcagtctcggctcactgcagcctccacctacctggttcaagcaattctcctgcctcagcctcctgagtagctgagattacaggagcctgccaccacacccagctaattttttggtatttttagtagagacagggtttcatcatgttggccagactggcctcgaattcctgacctcaggcaatccacccgcctcggcctcccaaagagctgggattacaggcgtgagccaccgcaccctgccgaaaaaaactttttttttttggagacggaggctcgctctgtcccccaggctggagtgcagtggcgagatctcagctcactgcaagctccgcctcccgggttcacgccattctcctgcctcagcctcccgagtagctgggagccagcgcgcccagcctaaaaaacttttcaagtcaatattactacgatttaacattagagtgtggacatgtgatttaatcgctatagctaaaatacgtcaaatatacgttgtcatgtgcttgaacatgatgctaaccctgacaggatgaaggaaagtaatattctttcagtgtagttcaggagagcatttgttttcttttctaccaattaacccatcattgcttttaaacaaccatctgaaggagcagagaggcagggtagaagacagaagggggatctatgtggtaactaaagaatgtttctgttttgttaattattgtgtgtgtgtggttttattgtttgcttaagagaatcaaaaactgaaaaaaatgagaatacaggaaatggctcttgtttatttttttgctgtgtttacagcttgttaatgctctactgtctttgtttcaagagagatttgttcactgcccagctcgttttgtgtcctgagccctatgcccagcccaccttataaatcatgcctgtttagatgtttgattttgttctgtttgctattgttatcttaaaggtgtataactctgacatgccagacatcaaattaagctcaaattaagctctcgtttaaatgtttaaacacctaatttatattctaattgatcccagccactgatgcatgtactttagctacttctgctaaataagcatattaattttccacatcaggccatcagatcttgagaaccaacagttatctagaattccgtgtctactaatgtttcacctgcatgcagccttcattaattttgtagcaaaatataaagtgatcattatgtagtttctggattaaaaaaatttgtgtgtgaagttgctttgtaaagtgcatgtggaattaatgggacagtgtgccctttgtgttagatgttagagcaaaagaaagggcttatagtgttagtattggagcactttgaagatagatattttcagaaaagatgtaggatttaaaagttaaattttaaattttagaaaaagatatgatggcaattggaaatagtcacaatgaagttcttcatccagtaggtgtttaacagtgttattttgccactggtaatgtgtaaactgtgagtgatttacaataaatgattatgaattcaaaaaaaaaaagggggggctaaaaatccccagggggcaagttacgtccgtttt

SEQ ID NO: 446058 - DNA, 3016 bp, Homo sapiens
ctccagcgtcgccggccccgttccatttccacagctcctcctccccggccgcgcgcccctcccgccccgcgcgcgcctcctctttctcgcggccgagttcagcccgggcagccatatgggggatacgccagcaacagacgccggccgccaagatctgcatccctaggccacgctaagaccctggggaagagcgcaggagcccgggagaagggctggaaggaggggactggacgtgcggagaattcccccctaaaaggcagaagcccccgcccccaccctcgagctccgctcgggcagagcgcctgcctgcctgccgctgctgcgggcgcccacctcgcccagccatgccaggcccggccaccgacgcggggaagatccctttctgcgacgccaaggaagaaatccgtgccgggctcgaaagctctgagggcggcggcggcccggagaggccaggcgcgcgcgggcagcggcagaacatcgtctggaggaatgtcgtcctgatgagcttgctccacttgggggccgtgtactccctggtgctcatccccaaagccaagccactcactctgctctgggcctacttctgcttcctcctggccgctctgggtgtgacagctggtgcccatcgcttgtggagccacagtactcagagacggatgctgacccccacaatgcccgccggggcttcttcttctcccatattgggtggctgtttgttcgcaagcatcgagatgttattgagaaggggagaaagcttgacgtcactgacctgcttgctgatcctgtggtccggatccagagaaagtactataagatctccgtggtgctcatgtgctttgtggtccccacgctggtgccctggtacatctggggagagagtctgtggaattcctacttcttggcctctattctccgctataccatctcactcaacatcagctggctggtcaacagcgccgcccacatgtatggaaaccggccctatgacaagcacatcagccctcggcagaacccactcgtcgctctgggtgccattggtgaaggcttccataattaccatcacacctttccctttgactactctgcgagtgaatttggcttaaattttaacccaaccacctggttcattgatttcatgtgctggctggggctggccactgaccgcaaacgggcaaccaagccgatgatcgaggcccggaaggccaggactggagacagcagtgcttgaacttggaacagccatcccacatgtctgccgttgcaacctcggttcatggctttggttacaatagctctcttgtacattggatcgtgggagggggcagagggtggggaaggaacgagtcaatgtggtttgggaatgttttgtttatctcaaaataatgttgaaatacaattatcaatgaaaaaactttcgtttttttttttggttggtttggtttttgagacagagtctcactctgtcacccaggctggagtgcagtggcgcagtctcggctcactgcagcctccacctacctggttcaagcaattctcctgcctcagcctcctgagtagctgagattacaggagcctgccaccacacccagctaattttttggtatttttagtagagacagggtttcatcatgttggccagactggcctcgaattcctgacctcaggcaatccacccgcctcggcctcccaaagagctgggattacaggcgtgagccaccgcaccctgccgaaaaaaactttttttttttggagacggaggctcgctctgtcccccaggctggagtgcagtggcgagatctcagctcactgcaagctccgcctcccgggttcacgccattctcctgcctcagcctcccgagtagctgggagccagcgcgcccagcctaaaaaacttttcaagtcaatattactacgatttaacattagagtgtggacatgtgatttaatcgctatagctaaaatacgtcaaatatacgttgtcatgtgcttgaacatgatgctaaccctgacaggatgaaggaaagtaatattctttcagtgtagttcaggagagcatttgttttcttttctaccaattaacccatcattgcttttaaacaaccatctgaaggagcagagaggcagggtagaagacagaagggggatctatgtggtaactaaagaatgtttctgttttgttaattattgtgtgtgtgtggttttattgtttgcttaagagaatcaaaaactgaaaaaaatgagaatacaggaaatggctcttgtttatttttttgctgtgtttacagcttgttaatgctctactgtctttgtttcaagagagatttgttcactgcccagctcgttttgtgtcctgagccctatgcccagcccaccttataaatcatgcctgtttagatgtttgattttgttctgtttgctattgttatcttaaaggtgtataactctgacatgccagacatcaaattaagctcaaattaagctctcgtttaaatgtttaaacacctaatttatattctaattgatcccagccactgatgcatgtactttagctacttctgctaaataagcatattaattttccacatcaggccatcagatcttgagaaccaacagttatctagaattccgtgtctactaatgtttcacctgcatgcagccttcattaattttgtagcaaaatataaagtgatcattatgtagtttctggattaaaaaaatttgtgtgtgaagttgctttgtaaagtgcatgtggaattaatgggacagtgtgccctttgtgttagatgttagagcaaaagaaagggcttatagtgttagtattggagcactttgaagatagatattttcagaaaagatgtaggatttaaaagttaaattttaaattttagaaaaagatatgatggcaattggaaatagtcacaatgaagttcttcatccagtaggtgtttaacagtgttattttgccactggtaatgtgtaaactgtgagtgatttacaataaatgattatgaattca

SEQ ID NO: 446059 - DNA, 3472 bp, Homo sapiens
catgtgtgcgttattcattctgttccttgtctttggtcgtgtctggcgttgcccgttcttctgtgcgtcaccggcatgcttcattcgcatgtgctggtccttgtcccgattcctcctgtttttccagtgtactgggtgatgcgatttagtgtaccttctctgggctgcctgtgccgttcttggttcctcgccgggcttctttcgctcttccttgggccccgttgccagatcctctgggtcggcgctttgtcccttgccgcttgattatgcgtgatatggtatactcggacgtcgaagatgcccaagcagtaggagttcccagatctctctccgcagatgtaccaggcaccagcgtgggtaccacgaagcacatgagcaccacggagatcttatagtactttctctgaatccgggaccacaggatcatccaagcaaggtcagttgacgttcaagcatttctcccagtttctcaataactatcctcgatgcttgctgaacggacagccactcatatgggagaagaagaagccccggcgggcattgtgggggtcagtcatccgtctcttgagtactttgtgtgggctcgatggtccctggaccactcgaagatgtcattctggaaagccatggatttggctgacagccagaaatatcctcagaggcagcttggcccggtaggacctgtggctccacaagcgatgggcaccatctgtcacacctcagagcggccaggaggaagcagaagtaggcccagagcagagtgagtggcttggctttggggatgagcaccagggagccaggcgcgcgcgggcagcggcagaacatcgtctggaggaatgtcgtcctgatgagcttgctccacttgggggccgtgtactccctggtgctcatccccaaagccaagccactcactctgctctgggcctacttctgcttcctcctggccgctctgggtgtgacagctggtgcccatcgcttgtggagccacaggtcctaccgggccaagctgcctctgaggatatttctggctgtcgccaactccatggctttccagaatgacatcttcgagtggtccagggaccaccgagcccaccacaagtactcagagacggatgctgacccccacaatgcccgccggggcttcttcttctcccatattgggtggctgtttgttcgcaagcatcgagatgttattgagaaggggagaaagcttgacgtcactgacctgcttgctgatcctgtggtccggatccagagaaagtactataagatctccgtggtgctcatgtgctttgtggtccccacgctggtgccctggtacatctggggagagagtctgtggaattcctacttcttggcctctattctccgctataccatctcactcaacatcagctggctggtcaacagcgccgcccacatgtatggaaaccggccctatgacaagcacatcagccctcggcagaacccactcgtcgctctgggtgccattggtgaaggcttccataattaccatcacacctttccctttgactactctgcgagtgaatttggcttaaattttaacccaaccacctggttcattgatttcatgtgctggctggggctggccactgaccgcaaacgggcaaccaagccgatgatcgaggcccggaaggccaggactggagacagcagtgcttgaacttggaacagccatcccacatgtctgccgttgcaacctcggttcatggctttggttacaatagctctcttgtacattggatcgtgggagggggcagagggtggggaaggaacgagtcaatgtggtttgggaatgttttgtttatctcaaaataatgttgaaatacaattatcaatgaaaaaactttcgtttttttttttggttggtttggtttttgagacagagtctcactctgtcacccaggctggagtgcagtggcgcagtctcggctcactgcagcctccacctacctggttcaagcaattctcctgcctcagcctcctgagtagctgagattacaggagcctgccaccacacccagctaattttttggtatttttagtagagacagggtttcatcatgttggccagactggcctcgaattcctgacctcaggcaatccacccgcctcggcctcccaaagagctgggattacaggcgtgagccaccgcaccctgccgaaaaaaactttttttttttggagacggaggctcgctctgtcccccaggctggagtgcagtggcgagatctcagctcactgcaagctccgcctcccgggttcacgccattctcctgcctcagcctcccgagtagctgggagccagcgcgcccagcctaaaaaacttttcaagtcaatattactacgatttaacattagagtgtggacatgtgatttaatcgctatagctaaaatacgtcaaatatacgttgtcatgtgcttgaacatgatgctaaccctgacaggatgaaggaaagtaatattctttcagtgtagttcaggagagcatttgttttcttttctaccaattaacccatcattgcttttaaacaaccatctgaaggagcagagaggcagggtagaagacagaagggggatctatgtggtaactaaagaatgtttctgttttgttaattattgtgtgtgtgtggttttattgtttgcttaagagaatcaaaaactgaaaaaaatgagaatacaggaaatggctcttgtttatttttttgctgtgtttacagcttgttaatgctctactgtctttgtttcaagagagatttgttcactgcccagctcgttttgtgtcctgagccctatgcccagcccaccttataaatcatgcctgtttagatgtttgattttgttctgtttgctattgttatcttaaaggtgtataactctgacatgccagacatcaaattaagctcaaattaagctctcgtttaaatgtttaaacacctaatttatattctaattgatcccagccactgatgcatgtactttagctacttctgctaaataagcatattaattttccacatcaggccatcagatcttgagaaccaacagttatctagaattccgtgtctactaatgtttcacctgcatgcagccttcattaattttgtagcaaaatataaagtgatcattatgtagtttctggattaaaaaaatttgtgtgtgaagttgctttgtaaagtgcatgtggaattaatgggacagtgtgccctttgtgttagatgttagagcaaaagaaagggcttatagtgttagtattggagcactttgaagatagatattttcagaaaagatgtaggatttaaaagttaaattttaaattttagaaaaagatatgatggcaattggaaatagtcacaatgaagttcttcatccagtaggtgtttaacagtgttattttgccactggtaatgtgtaaactgtgagtgatttacaataaatgattatgaattca

SEQ ID NO: 446060 - DNA, 3071 bp, Homo sapiens
ctccagcgtcgccggccccgttccatttccacagctcctcctccccggccgcgcgcccctcccgccccgcgcgcgcctcctctttctcgcggccgagttcagcccgggcagccatatgggggatacgccagcaacagacgccggccgccaagatctgcatccctaggccacgctaagaccctggggaagagcgcaggagcccgggagaagggctggaaggaggggactggacgtgcggagaattcccccctaaaaggcagaagcccccgcccccaccctcgagctccgctcgggcagagcgcctgcctgcctgccgctgctgcgggcgcccacctcgcccagccatgccaggcccggccaccgacgcggggaagatccctttctgcgacgccaaggaagaaatccgtgccgggctcgaaagctctgagggcggcggcggcccggagaggccaggcgcgcgcgggcagcggcagaacatcgtctggaggaatgtcgtcctgatgagcttgctccacttgggggccgtgtactccctggtgctcatccccaaagccaagccactcactctgctctgggcctacttctgcttcctcctggccgctctgggtgtgacagctggtgcccatcgcttgtggagccacaggtcctaccgggccaagctgcctctgaggatatttctggctgtcgccaactccatggctttccagaatgacatcttcgagtggtccagggaccaccgagcccaccacaagtactcagagacggatgctgacccccacaatgcccgccggggcttcttcttctcccatattgggtggctgtttgttcgcaagcatcgagatgttattgagaaggggagaaagcttgacgtcactgacctgcttgctgatcctgtggtccggatccagagaaagtactataagatctccgtggtgctcatgtgctttgtggtccccacgctggtgccctggtacatctggggagagagtctgtggaattcctacttcttggcctctattctccgctataccatctcactcaacatcagctggctggtcaacagcgccgcccacatgtatggaaaccggccctatgacaagcacatcagccctcggcagaacccactcgtcgctctgggtgccattggtgaaggcttccataattaccatcacacctttccctttgactactctgcgagtgaatttggcttaaattttaacccaaccacctggttcattgatttcatgtgctggctggggctggccactgaccgcaaacgggcaaccaagccgatgatcgaggcccggaaggccaggactggagacagcagtgcttgaacttggaacagccatcccacatgtctgccgttgcaacctcggttcatggctttggttacaatagctctcttgtacattggatcgtgggagggggcagagggtggggaaggaacgagtcaatgtggtttgggaatgttttgtttatctcaaaataatgttgaaatacaattatcaatgaaaaaactttcgtttttttttttggttggtttggtttttgagacagagtctcactctgtcacccaggctggagtgcagtggcgcagtctcggctcactgcagcctccacctacctggttcaagcaattctcctgcctcagcctcctgagtagctgagattacaggagcctgccaccacacccagctaattttttggtatttttagtagagacagggtttcatcatgttggccagactggcctcgaattcctgacctcaggcaatccacccgcctcggcctcccaaagagctgggattacaggcgtgagccaccgcaccctgccgaaaaaaactttttttttttggagacggaggctcgctctgtcccccaggctggagtgcagtggcgagatctcagctcactgcaagctccgcctcccgggttcacgccattctcctgcctcagcctcccgagtagctgggagccagcgcgcccagcctaaaaaacttttcaagtcaatattactacgatttaacattagagtgtggacatgtgatttaatcgctatagctaaaatacgtcaaatatacgttgtcatgtgcttgaacatgatgctaaccctgacaggatgaaggaaagtaatattctttcagtgtagttcaggagagcatttgttttcttttctaccaattaacccatcattgcttttaaacaaccatctgaaggagcagagaggcagggtagaagacagaagggggatctatgtggtaactaaagaatgtttctgttttgttaattattgtgtgtgtgtggttttattgtttgcttaagagaatcaaaaactgaaatgttaatgctctactgtctttgtttcaagagagatttgttcactgcccagctcgttttgtgtcctgagccctatgcccagcccaccttataaatcatgcctgtttagatgtttgattttgttctgtttgctattgttatcttaaaggtgtataactctgacatgccagacatcaaattaagctcaaattaagctctcgtttaaatgtttaaacacctaatttatattctaattgatcccagccactgatgcatgtactttagctacttctgctaaataagcatattaattttccacatcaggccatcagatcttgagaaccaacagttatctagaattccgtgtctactaatgtttcacctgcatgcagccttcattaattttgtagcaaaatataaagtgatcattatgtagtttctggattaaaaaaatttgtgtgtgaagttgctttgtaaagtgcatgtggaattaatgggacagtgtgccctttgtgttagatgttagagcaaaagaaagggcttatagtgttagtattggagcactttgaagatagatattttcagaaaagatgtaggatttaaaagttaaattttaaattttagaaaaagatatgatggcaattggaaatagtcacaatgaagttcttcatccagtaggtgtttaacagtgttattttgccactggtaatgtgtaaactgtgagtgatttacaataaatgattatgaattca

SEQ ID NO: 446061 - DNA, 970 bp, Homo sapiens
ctccagcgtcgccggccccgttccatttccacagctcctcctccccggccgcgcgcccctcccgccccgcgcgcgcctcctctttctcgcggccgagttcagcccgggcagccatatgggggatacgccagcaacagacgccggccgccaagatctgcatccctaggccacgctaagaccctggggaagagcgcaggagcccgggagaagggctggaaggaggggactggacgtgcggagaattcccccctaaaaggcagaagcccccgcccccaccctcgagctccgctcgggcagagcgcctgcctgcctgccgctgctgcgggcgcccacctcgcccagccatgccaggcccggccaccgacgcggggaagatccctttctgcgacgccaaggaagaaatccgtgccgggctcgaaagctctgagggcggcggcggcccggagaggccaggcgcgcgcgggcagcggcagaacatcgtctggaggaatgtcgtcctgatgagcttgctccacttgggggccgtgtactccctggtgctcatccccaaagccaagccactcactctgctctgggcctacttctgcttcctcctggccgctctgggtgtgacagctggtgcccatcgcttgtggagccacaggtcctaccgggccaagctgcctctgaggatatttctggctgtcgccaactccatggctttccaggcagcagcagaagtggtcctgacccagatgccctgacagcttttcctggtgtgattttggaagttaacccttgaacagaatgggtttgaactgcgcagcttcacttaaatgcatggattttcttctgcctccaccacctctgagacagcaagatcagcccctcctcctctcagcctactcaatgcaaagaagacaaggatgaagacctttatgatgatccacttccacttaatgaatagtaaatatattttctcttcttatga

SEQ ID NO: 446062 - DNA, 506 bp, Homo sapiens
cgtgactctagcaggatccttaagtttacagcggtcaggggccagctgtgggcgcagagagactgtggctgtggcccagtggtgacgctcaatgctccgtgcacccagggccatcctaggttttgtgaataagcaacaggcccacgacctgctcatcaacaagcccgacgggaccttcttgttgcgctttagtgactcagaaatcgggggcatcaccatcgcctggaagtttgactccccggaacgcaacctgtggaacctgaaaccattcaccacgcgggatttctccatcaggtccctggctgaccggctgggggacctgagctatctcatctatgtgtttcctgaccgccccaaggatgaggtcttctccaagtactacactcctgtgctggctaaagctgttgatggatatgtgaaaccacagatcaagcaagtggtccctgagtaagtgtccaggtggctgtggctctccttctgcctctttcctcctcccccagaccctg

SEQ ID NO: 446063 - DNA, 1990 bp, Homo sapiens
cgtgactctagcaggatccttaagtttacagcggtcaggggccagctgtgggcgcagagagactgtggctgtggcccagtggtgacgctcaatgctccgtgcacccagggccatcctaggttttgtgaataagcaacaggcccacgacctgctcatcaacaagcccgacgggaccttcttgttgcgctttagtgactcagaaatcgggggcatcaccatcgcctggaagtttgactccccggaacgcaacctgtggaacctgaaaccattcaccacgcgggatttctccatcaggtccctggctgaccggctgggggacctgagctatctcatctatgtgtttcctgaccgccccaaggatgaggtcttctccaagtactacactcctgtgctggctaaagctgttgatggatatgtgaaaccacagatcaagcaagtggtccctgagtttgtgaatgcatctgcagatgctgggggcagcagcgccacgtacatggaccaggccccctccccagctgtgtgcccccaggctccctataacatgtacccacagaaccctgaccatgtactcgatcaggatggagaattcgacctggatgagaccatggatgtggccaggcacgtggaggaactcttacgccgaccaatggacagtcttgactcccgcctctcgccccctgccggtcttttcacctctgccagaggctccctctcatgaatgtttgaatcccacgcttctctttggaaacaatatgcaatgtgaagcggtcgtgttgtgagtttagtaaggctgtgtacactgacacctttgcaggcatgcatgtgcttgtgtgtgtgtgtgtgtgtgtccttgtgcatgagctacgcctgcctcccctgtgcagtcctgggatgtggctgcagcagcggtggcctcttttcagatcatggcatccaagagtgcgccgagtctgtctctgtcatggtagagaccgagcctctgtcactgcaggcactcaatgcagccagacctattcctcctgggcccctcatctgctcagcagctatttgaatgagatgattcagaaggggaggggagacaggtaacgtctgtaagctgaagtttcactccggagtgagaagctttgccctcctaagagagagagacagagagacagagagagagaaagagagagtgtgtgggtctatgtaaatgcatctgtcctcatgtgttgatgtaaccgattcatctctcagaagggaggctggggttcattttcgagtagtattttatactttagtgaacgtggactccagactctctgtgaaccctatgagagcgcgtctgggcccggccatgtccttagcacaggggggccgccggtttgagtgagggtttctgagctgctctgaattagtccttgcttggctgcttggccttgggcttcattcaagtctatgatgctgttgcccacgtttcccgggatatatattctctcccctccgttgggccccagccttctttgcttgcctctctgtttgtaaccttgtcgacaaagaggtagaaaagattgggtctaggatatggtgggtggacaggggccccgggacttggagggttggtcctcttgcctcctggaaaaaacaaaaacaaaaaactgcagtgaaagacaagctgcaaatcagccatgtgctgcgtgcctgtggaatctggagtgaggggtaaaagctgatctggtttgactccgctggaggtggggcctggagcaggccttgcgctgttgcgtaactggctgtgttctggtgaggccttgctcccaaccccacacgctcctccctctgaggctgtaggactcgcagtcaggggcagctgaccatggaagattgagagcccaaggtttaaacttctctgaagggaggtggggatgagaagaggggtttttttgtactttgtacaaagaccacacatttgtgtaaacagtgttttggaataaaatatttttttcataaa

SEQ ID NO: 446064 - DNA, 317 bp, Homo sapiens
gtgagtccccgtgggagccctaccccagcacccccaggccctaggactcacctggggtcagccccaccccttgggcccctgctgagtggtccttcctcaccccagggccagcccagaggtgaggtgaggccagaagggctggggtgctgggcgcctgccttccaccatggccttggcactctgggttccaggttcctggactggggtctgtgaggactgtgagcttggtctttggatcctggtctgggatcctcctttggcagatggcttgggtccttgctctctgttttctgtttcctggtctgcatctctgtccc

SEQ ID NO: 446065 - DNA, 273 bp, Homo sapiens
aggatcaagcgtgctgaccggcggggtgcagagtccgtgacagaggagaagttcacagtcctgtttgagtctcagttcagtgttggcagcaatgagcttgtgttccaggtgaaggtgagacccccagccctcctgcccccactgctccaggtcacccaagaggtggaggggcctgcctcaggactcctggcagcaatgccatcggacagcctgctttgactctgtgggtccctgtttgataggttataatctgggactaacccagacaattta

SEQ ID NO: 446066 - DNA, 452 bp, Homo sapiens
tctgctggagtgtggtggcaagcaggggtgaagaactgggagaagactgggtgggggcaggagggccctgactttcctgggccacctgtgacctggggcaccagccctgactcgggggttcctgggccctcaggagaacttgccgggctggaactacaccttctggcagtggtttgacggggtgatggaggtgttgaagaagcaccacaagccccactggaatgatgggtaaggaacgggggctgcagggtcaggggccagctgtgggcgcagagagactgtggctgtggcccagtggtgacgctcaatgctccgtgcacccagggccatcctaggttttgtgaataagcaacaggcccacgacctgctcatcaacaagcccgacgggaccttcttgttgcgctttagtgactcagaaatcgggggcatcaccatcgcctggaagtttgact

SEQ ID NO: 446067 - DNA, 453 bp, Homo sapiens
gcgctgttgcgtaactggctgtgttctggtgaggccttgctcccaaccccacacgctcctccctctgaggctgtaggactcgcagtcaggggcagctgaccatggaagattgagagcccaaggtttaaacttctctgaagggaggtggggatgagaagaggggtttttttgtactttgtacaaagaccacacatttgtgtaaacagtgttttggaataaaatatttttttcataaatttgctgctatggctcctggttggggcgttggtggcctccctgggtgatgggaacccctggagctggttgttctgttccttcccgcgtgcatgcctgatgctgtcatttttagtcttaaattttaactctgcccgctttgctgtggttttcagggtgctggccacccctggaatactgtcaatgcttctcagaagggtaaggagccagtttaggggg

SEQ ID NO: 446068 - DNA, 517 bp, Homo sapiens
aattcggcacgagggcatccaagagtgcgccgagtctctctctgtttgtaaccttgtcgacaaagaggtagaaaagattgggtctaggatatggtgggtggacaggggccccgggacttggagggttggtcctcttgcctcctggaaaaaacaaaaacaaaaaactgcagtgaaagacaagctgcaaatcagccatgtgctgcgtgcctgtggaatctggagtgaggggtaaaagctgatctggtttgactccgctggaggtggggcctggagcaggccttgcgctgttgcgtaactggctgtgttctggtgaggccttgctcccaaccccacacgctcctccctctgaggctgtaggactcgcagtcaggggcagctgaccatggaagattgagagcccaaggtttaaacttctctgaagggaggtggggatgagaagaggggtttttttgtactttgtacaaagaccacacatttgtgtaaacagtgttttggaataaaatatttttttcataaa

SEQ ID NO: 446069 - DNA, 2903 bp, Homo sapiens
tgatccagtggaagcggcggcagcagctggccgggaacggcgggccccccgagggcagcctggacgtgctacagtcctggtgtgagaagttggccgagatcatctggcagaaccggcagcagatccgcagggctgagcacctctgccagcagctgcccatccccggcccagtggaggagatgctggccgaggtcaacgccaccatcacggacattatctcagccctggtgaccagcacattcatcattgagaagcagcctcctcaggtcctgaagacccagaccaagtttgcagccaccgtacgcctgctggtgggcgggaagctgaacgtgcacatgaatcccccccaggtgaaggccaccatcatcagtgagcagcaggccaagtctctgcttaaaaatgagaacacccgcaacgagtgcagtggtgagatcctgaacaactgctgcgtgatggagtaccaccaagccacgggcaccctcagtgcccacttcaggaacatgtcactgaagaggatcaagcgtgctgaccggcggggtgcagagtccgtgacagaggagaagttcacagtcctgtttgagtctcagttcagtgttggcagcaatgagcttgtgttccaggtgaagactctgtccctacctgtggttgtcatcgtccacggcagccaggaccacaatgccacggctactgtgctgtgggacaatgcctttgctgagccgggcagggtgccatttgccgtgcctgacaaagtgctgtggccgcagctgtgtgaggcgctcaacatgaaattcaaggccgaagtgcagagcaaccggggcctgaccaaggagaacctcgtgttcctggcgcagaaactgttcaacaacagcagcagccacctggaggactacagtggcctgtccgtgtcctggtcccagttcaacagggagaacttgccgggctggaactacaccttctggcagtggtttgacggggtgatggaggtgttgaagaagcaccacaagccccactggaatgatggggccatcctaggttttgtgaataagcaacaggcccacgacctgctcatcaacaagcccgacgggaccttcttgttgcgctttagtgactcagaaatcgggggcatcaccatcgcctggaagtttgactccccggaacgcaacctgtggaacctgaaaccattcaccacgcgggatttctccatcaggtccctggctgaccggctgggggacctgagctatctcatctatgtgtttcctgaccgccccaaggatgaggtcttctccaagtactacactcctgtgctggctaaagctgttgatggatatgtgaaaccacagatcaagcaagtggtccctgagtttgtgaatgcatctgcagatgctgggggcagcagcgccacgtacatggaccaggccccctccccagctgtgtgcccccaggctccctataacatgtacccacagaaccctgaccatgtactcgatcaggatggagaattcgacctggatgagaccatggatgtggccaggcacgtggaggaactcttacgccgaccaatggacagtcttgactcccgcctctcgccccctgccggtcttttcacctctgccagaggctccctctcatgaatgtttgaatcccacgcttctctttggaaacaatatgcaatgtgaagcggtcgtgttgtgagtttagtaaggctgtgtacactgacacctttgcaggcatgcatgtgcttgtgtgtgtgtgtgtgtgtgtccttgtgcatgagctacgcctgcctcccctgtgcagtcctgggatgtggctgcagcagcggtggcctcttttcagatcatggcatccaagagtgcgccgagtctgtctctgtcatggtagagaccgagcctctgtcactgcaggcactcaatgcagccagacctattcctcctgggcccctcatctgctcagcagctatttgaatgagatgattcagaaggggaggggagacaggtaacgtctgtaagctgaagtttcactccggagtgagaagctttgccctcctaagagagagagacagagagacagagagagagaaagagagagtgtgtgggtctatgtaaatgcatctgtcctcatgtgttgatgtaaccgattcatctctcagaagggaggctggggttcattttcgagtagtattttatactttagtgaacgtggactccagactctctgtgaaccctatgagagcgcgtctgggcccggccatgtccttagcacaggggggccgccggtttgagtgagggtttctgagctgctctgaattagtccttgcttggctgcttggccttgggcttcattcaagtctatgatgctgttgcccacgtttcccgggatatatattctctcccctccgttgggccccagccttctttgcttgcctctctgtttgtaaccttgtcgacaaagaggtagaaaagattgggtctaggatatggtgggtggacaggggccccgggacttggagggttggtcctcttgcctcctggaaaaaacaaaaacaaaaaactgcagtgaaagacaagctgcaaatcagccatgtgctgcgtgcctgtggaatctggagtgaggggtaaaagctgatctggtttgactccgctggaggtggggcctggagcaggccttgcgctgttgcgtaactggctgtgttctggtgaggccttgctcccaaccccacacgctcctccctctgaggctgtaggactcgcagtcaggggcagctgaccatggaagattgagagcccaaggtttaaacttctctgaagggaggtggggatgagaagaggggtttttttgtactttgtacaaagaccacacatttgtgtaaacagtgttttggaataaaatatttttttcataaa

SEQ ID NO: 446070 - DNA, 2980 bp, Homo sapiens
tgatccagtggaagcggcggcagcagctggccgggaacggcgggccccccgagggcagcctggacgtgctacagtcctggtgtgagaagttggccgagatcatctggcagaaccggcagcagatccgcagggctgagcacctctgccagcagctgcccatccccggcccagtggaggagatgctggccgaggtcaacgccaccatcacggacattatctcagccctggtgaccagcacattcatcattgagaagcagcctcctcaggtcctgaagacccagaccaagtttgcagccaccgtacgcctgctggtgggcgggaagctgaacgtgcacatgaatcccccccaggtgaaggccaccatcatcagtgagcagcaggccaagtctctgcttaaaaatgagaacacccgcaacgagtgcagtggtgagatcctgaacaactgctgcgtgatggagtaccaccaagccacgggcaccctcagtgcccacttcaggaacatgtcactgaagaggatcaagcgtgctgaccggcggggtgcagagtccgtgacagaggagaagttcacagtcctgtttgagtctcagttcagtgttggcagcaatgagcttgtgttccaggtgaagactctgtccctacctgtggttgtcatcgtccacggcagccaggaccacaatgccacggctactgtgctgtgggacaatgcctttgctgagccgggcagggtgccatttgccgtgcctgacaaagtgctgtggccgcagctgtgtgaggcgctcaacatgaaattcaaggccgaagtgcagagcaaccggggcctgaccaaggagaacctcgtgttcctggcgcagaaactgttcaacaacagcagcagccacctggaggactacagtggcctgtccgtgtcctggtcccagttcaacagggagaacttgccgggctggaactacaccttctggcagtggtttgacggggtgatggaggtgttgaagaagcaccacaagccccactggaatgatggggccatcctaggttttgtgaataagcaacaggcccacgacctgctcatcaacaagcccgacgggaccttcttgttgcgctttagtgactcagaaatcgggggcatcaccatcgcctggaagtttgactccccggaacgcaacctgtggaacctgaaaccattcaccacgcgggatttctccatcaggtccctggctgaccggctgggggacctgagctatctcatctatgtgtttcctgaccgccccaaggatgaggtcttctccaagtactacactcctgtgctggctaaagctgttgatggatatgtgaaaccacagatcaagcaagtggtccctgagtttgtgaatgcatctgcagatgctgggggcagcagcgccacgtacatggaccaggccccctccccagctgtgtgcccccaggctccctataacatgtacccacagaaccctgaccatgtactcgatcaggatggagaattcgacctggatgagaccatggatgtggccaggcacgtggaggaactcttacgccgaccaatggacagtcttgactcccgcctctcgccccctgccggtcttttcacctctgccagaggctccctctcatgaatgtttgaatcccacgcttctctttggaaacaatatgcaatgtgaagcggtcgtgttgtgagtttagtaaggctgtgtacactgacacctttgcaggcatgcatgtgcttgtgtgtgtgtgtgtgtgtgtccttgtgcatgagctacgcctgcctcccctgtgcagtcctgggatgtggctgcagcagcggtggcctcttttcagatcatggcatccaagagtgcgccgagtctgtctctgtcatggtagagaccgagcctctgtcactgcaggcactcaatgcagccagacctattcctcctgggcccctcatctgctcagcagctatttgaatgagatgattcagaaggggaggggagacaggtaacgtctgtaagctgaagtttcactccggagtgagaagctttgccctcctaagagagagagacagagagacagagagagagaaagagagagtgtgtgggtctatgtaaatgcatctgtcctcatgtgttgatgtaaccgattcatctctcagaagggaggctggggttcattttcgagtagtattttatactttagtgaacgtggactccagactctctgtgaaccctatgagagcgcgtctgggcccggccatgtccttagcacaggggggccgccggtttgagtgagggtttctgagctgctctgaattagtccttgcttggctgcttggccttgggcttcattcaagtctatgatgctgttgcccacgtttcccgggatatatattctctcccctccgttgggccccagccttctttgcttgcctctctgtttgtaaccttgtcgacaaagaggtagaaaagattgggtctaggatatggtgggtggacaggggccccgggacttggagggttggtcctcttgcctcctggaaaaaacaaaaacaaaaaactgcagtgaaagacaagctgcaaatcagccatgtgctgcgtgcctgtggaatctggagtgaggggtaaaagctgatctggtttgactccgctggaggtggggcctggagcaggccttgcgctgttgcgtaactggctgtgttctggtgaggccttgctcccaaccccacacgctcctccctctgaggctgtaggactcgcagtcaggggcagctgaccatggaagattgagagcccaaggtttaaacttctctgaagggaggtggggatgagaagaggggtttttttgtactttgtacaaagaccacacatttgtgtaaacagtgttttggaataaaatatttttttcataaaaaaaaaaaatcaaaacacccagcgaacgcaaagtagagaagacgtgtagacgtaaagaacacataatatagtgcggg

SEQ ID NO: 446071 - DNA, 819 bp, Homo sapiens
gaattcggcacgagcggcacgagttggatttggggcccaggttccccctgactggcaggtctcgcatgaatttgccttgaatttcaaccccagtaacccctactgtgcaggcatccagggcattgtggatgcctaccgccaagccctgccccaagttcgcctctatggccctaccaactttgcacccatcatcaaccatgtggccaggtttgcagcccaggctgcacatcaggggactgcctcgcaatacttcatgctgttgctgctgactgatggtgctgtgacggatgtggaagccacacgtgaggctgtggtgcgtgcctcgaacctgcccatgtcagtgatcattgtgggtgtgggtggtgctgactttgaggccatggagcagctggacgctgatggtggacccctgcatacacgttctgggcaggctgctgcccgcgacattgtgcagtttgtaccctaccgccggttccagaatgcccctcgggaggcattggcacagaccgtgctcgcagaagtgcccacacaactggtctcatacttcagggcccagggttgggccccgctcaagccacttccaccctcagccaaggatcctgcacaggccccccaggcctaggttcccttggaggctgtggcaagtcctcaatcctgtgtcccagaggtccctctgggccacaacccaacccttctcactctcctcagtgctagcactttgtattttttgatacttttatacttgtttctgcttttgctgctcttgatcccacctttgctcctgacaaccctcattcaataaagaccagtgaagaccaa

SEQ ID NO: 446072 - DNA, 730 bp, Homo sapiens
tcagtaattaatccatagtacggatccttattgtatcaaatggatcattattaaataggttataatctgatgctcaaactctcctggatttgtccaggagaatccctctcatctgggtgctaattcaagctgtgatttagggcaagtcccctcctctctttgaaccttagtttcctcatgtgtaggagacagttaagtaccctggtttacaagggtgaatgaatgaaatgcacccaggttccgagatctcctgggctgggatggggtgatttcaggactggtgtagtcctgagaggtccaggattttacggtatttcttgctctcctctgcaggcatccagggcattgtggatgcctaccgccaagccctgccccaagttcgcctctatggccctaccaactttgcacccatcatcaaccatgtggccaggtttgcagcccaggctgcacatcaggggactgcctcgggtgagagtcgtgggtggcagtggcagtggtggcaatcaagggcttccttgagggttatggaacaaaggacttttttttttttttttttttttgagatggactcttgctctgtcacccaggctggagtgcagtgacgcgatctcagctcactgcaacctgcacctcctgggttcaagtgattctcctgcctcagccttcctagtagcttggattacaggcgtgtgccaccatgcccagctaatttttatatttttagtagaga

SEQ ID NO: 446073 - DNA, 3935 bp, Homo sapiens
ctcgacgagccggactttctgtgacaacgtgcgacacggacggctggctggcctgcgctcgcggcatccaggcgacagctcgatatcgcggacatgagaggcccgtggctgcgttgggctccgggaagccgttcgggctggggctgtcggccgcggggcggaggcactcgcgcggggggggtaattcggggtctgggttctggtgccgcgcagctttccccgtctaaaagttggttttaattggttgcccacaggattgacttggcctctacttcttgttaaggaaattcatctcttgttttatcaggtgtgtgtggtttcagcgcagcatggctgtggtcatccgtttgcaaggtctcccaattgtggcggggaccatggacattcgccacttcttctctggattgaccattcctgatgggggcgtgcatattgtagggggtgaactgggtgaggctttcatcgtttttgccactgatgaagatgcaaggcttggtatgatgcgcacaggtggtacaattaaagggtcaaaagtaacactattgttgagtagtaagacggaaatgcagaatatgattgaactgagtcgtaggcgttttgaaactgccaacttagatataccaccagcaaatgccagtagatcaggaccaccacctagctcaggaatgagtagcagggtaaacttgcccacaacagtatccaactttaataatccatcacccagtgtagttactgccaccacttctgttcatgaaagcaacaaaaacatacagacattttccacagccagcgtaggaacagctcctccaaatatgggggcttcctttgggagcccaacgtttagctcaactgttccaagcacagcctctccaatgaacacagtcccgccgccaccaattcctccaattccagcgatgccatctctgccaccaatgccatccattcccccaattccagttcctcctccagtacctacattgcctcctgtgcctcctgtgcccccgattcccccagttccttctgtgccacccatgaccccactgccacccatgtcgggcatgccgcccttgaatccgccacctgtggcacctctacctgctggaatgaatggctctggagcacctatgaatttgaacaataatctgaatcctatgtttcttggtccgttgaatcctgttaaccctatccagatgaactctcagagcagtgtgaagccactccccatcaaccctgatgatctgtatgtcagtgtgcatggaatgcccttttctgcaatggaaaatgatgtcagagatttttttcatgggctccgtgttgatgcagtgcatttgttgaaagatcatgtaggtcgaaataatgggaatggattggttaagtttctctcccctcaagatacatttgaagctttgaaacgaaacagaatgctgatgattcaacgctatgtggaagttagccctgccacagaaagacagtgggtagctgctggaggccatatcacttttaagcaaaatatgggaccttctggacaaactcatccccctcctcagacacttcccaggtcaaaatcgcccagtgggcagaaaagatcaaggtcaagatcaccacatgaggctggtttttgtgtttacttgaaagggctaccatttgaagcagaaaacaaacatgtcattgatttttttaaaaagctggatattgtggaagatagtatttatatagcttatggacccaatgggaaagcaactggcgaaggctttgtagagttcagaaatgaggctgactataaggctgctctgtgtcgtcataaacagtacatgggcaatcgctttattcaagttcatccaattactaagaaaggtatgctagaaaagatagatatgattcgaaaaagactgcagaacttcagctatgaccagagggaaatgatactaaatccagagggggatgtcaactctgccaaagtctgtgcccacataacaaatattccattcagcattacaaagatggatgttcttcagttcctagaaggaatcccagtggatgaaaatgctgtacatgttcttgttgataacaatgggcaaggtctaggacaggcattggttcagtttaaaaatgaagatgatgcacatggcccactgcgtgaccttggttcagctgtccatttcctgtgaccatctcattgacaaggacatcggctccaagtctgacccactctgcgtccttttacaggatgtgggagggggcagctgggctgagcttggccggactgaacgggtgcggaactgctcaagccctgagttctccaagactctacagcttgagtaccgctttgagacagtccagaagctacgctttggaatctatgacatagacaacaagacgccagagctgagggatgatgacttcctagggggtgctgagtgttccctaggacagattgtgtccagccaggtactgactctccccttgatgctgaagcctggaaaacctgctgggcgggggaccatcacggtctcagctcaggaattaaaggacaatcgtgtagtaaccatggaggtagaggccagaaacctagataagaaggacttcctgggaaaatcagatccatttctggagttcttccgccagggtgatgggaaatggcacctggtgtacagatctgaggtcatcaagaacaacctgaaccctacatggaagcgtttctcagtccccgttcagcatttctgtggtgggaaccccagcacacccatccaggtgcaatgctccgattatgacagtgacgggtcacatgatctcatcggtaccttccacaccagcttggcccagctgcaggcagtcccggctgagtttgaatgcatccaccctgagaagcagcagaaaaagaaaagctacaagaactctggaactatccgtgtcaagatttgtcgggtagaaacagagtactcctttctggactatgtgatgggaggctgtcagatcaacttcactgtgggcgtggacttcactggctccaatggagacccctcctcacctgactccctacactacctgagtccaacaggggtcaatgagtacctgatggcactgtggagtgtgggcagcgtggttcaggactatgactcagacaagctgttccctgcatttggatttggggcccaggttccccctgactggcaggtctcgcatgaatttgccttgaatttcaaccccagtaacccctactgtgcaggcatccagggcattgtggatgcctaccgccaagccctgccccaagttcgcctctatggccctaccaactttgcacccatcatcaaccatgtggccaggtttgcagcccaggctgcacatcaggggactgcctcgcaatacttcatgctgttgctgctgactgatggtgctgtgacggatgtggaagccacacgtgaggctgtggtgcgtgcctcgaacctgcccatgtcagtgatcattgtgggtgtgggtggtgctgactttgaggccatggagcagctggacgctgatggtggacccctgcatacacgttctgggcaggctgctgcccgcgacattgtgcagtttgtaccctaccgccggttccagaatgcccctcgggaggcattggcacagaccgtgctcgcagaagtgcccacacaactggtctcatacttcagggcccagggttgggccccgctcaagccacttccaccctcagccaaggatcctgcacaggccccccaggcctaggttcccttggaggctgtggcaagtcctcaatcctgtgtcccagaggtccctctgggccacaacccaacccttctcactctcctcagtgctagcactttgtattttttgatacttttatacttgtttctgcttttgctgctcttgatcccacctttgctcctgacaaccctcattcaataaagaccagtgaagaccaa

SEQ ID NO: 446074 - DNA, 3903 bp, Homo sapiens
ctcgacgagccggactttctgtgacaacgtgcgacacggacggctggctggcctgcgctcgcggcatccaggcgacagctcgatatcgcggacatgagaggcccgtggctgcgttgggctccgggaagccgttcgggctggggctgtcggccgcggggcggaggcactcgcgcggggggggtaattcggggtctgggttctggtgccgcgcagctttccccggattgacttggcctctacttcttgttaaggaaattcatctcttgttttatcaggtgtgtgtggtttcagcgcagcatggctgtggtcatccgtttgcaaggtctcccaattgtggcggggaccatggacattcgccacttcttctctggattgaccattcctgatgggggcgtgcatattgtagggggtgaactgggtgaggctttcatcgtttttgccactgatgaagatgcaaggcttggtatgatgcgcacaggtggtacaattaaagggtcaaaagtaacactattgttgagtagtaagacggaaatgcagaatatgattgaactgagtcgtaggcgttttgaaactgccaacttagatataccaccagcaaatgccagtagatcaggaccaccacctagctcaggaatgagtagcagggtaaacttgcccacaacagtatccaactttaataatccatcacccagtgtagttactgccaccacttctgttcatgaaagcaacaaaaacatacagacattttccacagccagcgtaggaacagctcctccaaatatgggggcttcctttgggagcccaacgtttagctcaactgttccaagcacagcctctccaatgaacacagtcccgccgccaccaattcctccaattccagcgatgccatctctgccaccaatgccatccattcccccaattccagttcctcctccagtacctacattgcctcctgtgcctcctgtgcccccgattcccccagttccttctgtgccacccatgaccccactgccacccatgtcgggcatgccgcccttgaatccgccacctgtggcacctctacctgctggaatgaatggctctggagcacctatgaatttgaacaataatctgaatcctatgtttcttggtccgttgaatcctgttaaccctatccagatgaactctcagagcagtgtgaagccactccccatcaaccctgatgatctgtatgtcagtgtgcatggaatgcccttttctgcaatggaaaatgatgtcagagatttttttcatgggctccgtgttgatgcagtgcatttgttgaaagatcatgtaggtcgaaataatgggaatggattggttaagtttctctcccctcaagatacatttgaagctttgaaacgaaacagaatgctgatgattcaacgctatgtggaagttagccctgccacagaaagacagtgggtagctgctggaggccatatcacttttaagcaaaatatgggaccttctggacaaactcatccccctcctcagacacttcccaggtcaaaatcgcccagtgggcagaaaagatcaaggtcaagatcaccacatgaggctggtttttgtgtttacttgaaagggctaccatttgaagcagaaaacaaacatgtcattgatttttttaaaaagctggatattgtggaagatagtatttatatagcttatggacccaatgggaaagcaactggcgaaggctttgtagagttcagaaatgaggctgactataaggctgctctgtgtcgtcataaacagtacatgggcaatcgctttattcaagttcatccaattactaagaaaggtatgctagaaaagatagatatgattcgaaaaagactgcagaacttcagctatgaccagagggaaatgatactaaatccagagggggatgtcaactctgccaaagtctgtgcccacataacaaatattccattcagcattacaaagatggatgttcttcagttcctagaaggaatcccagtggatgaaaatgctgtacatgttcttgttgataacaatgggcaaggtctaggacaggcattggttcagtttaaaaatgaagatgatgcacatggcccactgcgtgaccttggttcagctgtccatttcctgtgaccatctcattgacaaggacatcggctccaagtctgacccactctgcgtccttttacaggatgtgggagggggcagctgggctgagcttggccggactgaacgggtgcggaactgctcaagccctgagttctccaagactctacagcttgagtaccgctttgagacagtccagaagctacgctttggaatctatgacatagacaacaagacgccagagctgagggatgatgacttcctagggggtgctgagtgttccctaggacagattgtgtccagccaggtactgactctccccttgatgctgaagcctggaaaacctgctgggcgggggaccatcacggtctcagctcaggaattaaaggacaatcgtgtagtaaccatggaggtagaggccagaaacctagataagaaggacttcctgggaaaatcagatccatttctggagttcttccgccagggtgatgggaaatggcacctggtgtacagatctgaggtcatcaagaacaacctgaaccctacatggaagcgtttctcagtccccgttcagcatttctgtggtgggaaccccagcacacccatccaggtgcaatgctccgattatgacagtgacgggtcacatgatctcatcggtaccttccacaccagcttggcccagctgcaggcagtcccggctgagtttgaatgcatccaccctgagaagcagcagaaaaagaaaagctacaagaactctggaactatccgtgtcaagatttgtcgggtagaaacagagtactcctttctggactatgtgatgggaggctgtcagatcaacttcactgtgggcgtggacttcactggctccaatggagacccctcctcacctgactccctacactacctgagtccaacaggggtcaatgagtacctgatggcactgtggagtgtgggcagcgtggttcaggactatgactcagacaagctgttccctgcatttggatttggggcccaggttccccctgactggcaggtctcgcatgaatttgccttgaatttcaaccccagtaacccctactgtgcaggcatccagggcattgtggatgcctaccgccaagccctgccccaagttcgcctctatggccctaccaactttgcacccatcatcaaccatgtggccaggtttgcagcccaggctgcacatcaggggactgcctcgcaatacttcatgctgttgctgctgactgatggtgctgtgacggatgtggaagccacacgtgaggctgtggtgcgtgcctcgaacctgcccatgtcagtgatcattgtgggtgtgggtggtgctgactttgaggccatggagcagctggacgctgatggtggacccctgcatacacgttctgggcaggctgctgcccgcgacattgtgcagtttgtaccctaccgccggttccagaatgcccctcgggaggcattggcacagaccgtgctcgcagaagtgcccacacaactggtctcatacttcagggcccagggttgggccccgctcaagccacttccaccctcagccaaggatcctgcacaggccccccaggcctaggttcccttggaggctgtggcaagtcctcaatcctgtgtcccagaggtccctctgggccacaacccaacccttctcactctcctcagtgctagcactttgtattttttgatacttttatacttgtttctgcttttgctgctcttgatcccacctttgctcctgacaaccctcattcaataaagaccagtgaagaccaa

SEQ ID NO: 446075 - DNA, 2033 bp, Homo sapiens
ctcgacgagccggactttctgtgacaacgtgcgacacggacggctggctggcctgcgctcgcggcatccaggcgacagctcgatatcgcggacatgagaggcccgtggctgcgttgggctccgggaagccgttcgggctggggctgtcggccgcggggcggaggcactcgcgcggggggggtaattcggggtctgggttctggtgccgcgcagctttccccgatggcccactgcgtgaccttggttcagctgtccatttcctgtgaccatctcattgacaaggacatcggctccaagtctgacccactctgcgtccttttacaggatgtgggagggggcagctgggctgagcttggccggactgaacgggtgcggaactgctcaagccctgagttctccaagactctacagcttgagtaccgctttgagacagtccagaagctacgctttggaatctatgacatagacaacaagacgccagagctgagggatgatgacttcctagggggtgctgagtgttccctaggacagattgtgtccagccaggtactgactctccccttgatgctgaagcctggaaaacctgctgggcgggggaccatcacggtctcagctcaggaattaaaggacaatcgtgtagtaaccatggaggtagaggccagaaacctagataagaaggacttcctgggaaaatcagatccatttctggagttcttccgccagggtgatgggaaatggcacctggtgtacagatctgaggtcatcaagaacaacctgaaccctacatggaagcgtttctcagtccccgttcagcatttctgtggtgggaaccccagcacacccatccaggtgcaatgctccgattatgacagtgacgggtcacatgatctcatcggtaccttccacaccagcttggcccagctgcaggcagtcccggctgagtttgaatgcatccaccctgagaagcagcagaaaaagaaaagctacaagaactctggaactatccgtgtcaagatttgtcgggtagaaacagagtactcctttctggactatgtgatgggaggctgtcagatcaacttcactgtgggcgtggacttcactggctccaatggagacccctcctcacctgactccctacactacctgagtccaacaggggtcaatgagtacctgatggcactgtggagtgtgggcagcgtggttcaggactatgactcagacaagctgttccctgcatttggatttggggcccaggttccccctgactggcaggtctcgcatgaatttgccttgaatttcaaccccagtaacccctactgtgcaggcatccagggcattgtggatgcctaccgccaagccctgccccaagttcgcctctatggccctaccaactttgcacccatcatcaaccatgtggccaggtttgcagcccaggctgcacatcaggggactgcctcgcaatacttcatgctgttgctgctgactgatggtgctgtgacggatgtggaagccacacgtgaggctgtggtgcgtgcctcgaacctgcccatgtcagtgatcattgtgggtgtgggtggtgctgactttgaggccatggagcagctggacgctgatggtggacccctgcatacacgttctgggcaggctgctgcccgcgacattgtgcagtttgtaccctaccgccggttccagaatgcccctcgggaggcattggcacagaccgtgctcgcagaagtgcccacacaactggtctcatacttcagggcccagggttgggccccgctcaagccacttccaccctcagccaaggatcctgcacaggccccccaggcctaggttcccttggaggctgtggcaagtcctcaatcctgtgtcccagaggtccctctgggccacaacccaacccttctcactctcctcagtgctagcactttgtattttttgatacttttatacttgtttctgcttttgctgctcttgatcccacctttgctcctgacaaccctcattcaataaagaccagtgaagaccaa

SEQ ID NO: 446076 - DNA, 2261 bp, Homo sapiens
ctcgacgagccggactttctgtgacaacgtgcgacacggacggctggctggcctgcgctcgcggcatccaggcgacagctcgatatcgcggacatgagaggcccgtggctgcgttgggctccgggaagccgttcgggctggggctgtcggccgcggggcggaggcactcgcgcggggggggtaattcggggtctgggttctggtgccgcgcagctttccccgtctaaaagttggttttaattggttgcccacaggattgacttggcctctacttcttgttaaggaaattcatctcttgttttatcaggtgtgtgtggtttcagcgcagcatggctgtggtcatccgtttgcaaggtctcccaattgtggcggggaccatggacattcgccacttcttctctggattgaccattcctgatgggggcgtgcatattgtagggggtgaactggatggcccactgcgtgaccttggttcagctgtccatttcctgtgaccatctcattgacaaggacatcggctccaagtctgacccactctgcgtccttttacaggatgtgggagggggcagctgggctgagcttggccggactgaacgggtgcggaactgctcaagccctgagttctccaagactctacagcttgagtaccgctttgagacagtccagaagctacgctttggaatctatgacatagacaacaagacgccagagctgagggatgatgacttcctagggggtgctgagtgttccctaggacagattgtgtccagccaggtactgactctccccttgatgctgaagcctggaaaacctgctgggcgggggaccatcacggtctcagctcaggaattaaaggacaatcgtgtagtaaccatggaggtagaggccagaaacctagataagaaggacttcctgggaaaatcagatccatttctggagttcttccgccagggtgatgggaaatggcacctggtgtacagatctgaggtcatcaagaacaacctgaaccctacatggaagcgtttctcagtccccgttcagcatttctgtggtgggaaccccagcacacccatccaggtgcaatgctccgattatgacagtgacgggtcacatgatctcatcggtaccttccacaccagcttggcccagctgcaggcagtcccggctgagtttgaatgcatccaccctgagaagcagcagaaaaagaaaagctacaagaactctggaactatccgtgtcaagatttgtcgggtagaaacagagtactcctttctggactatgtgatgggaggctgtcagatcaacttcactgtgggcgtggacttcactggctccaatggagacccctcctcacctgactccctacactacctgagtccaacaggggtcaatgagtacctgatggcactgtggagtgtgggcagcgtggttcaggactatgactcagacaagctgttccctgcatttggatttggggcccaggttccccctgactggcaggtctcgcatgaatttgccttgaatttcaaccccagtaacccctactgtgcaggcatccagggcattgtggatgcctaccgccaagccctgccccaagttcgcctctatggccctaccaactttgcacccatcatcaaccatgtggccaggtttgcagcccaggctgcacatcaggggactgcctcgcaatacttcatgctgttgctgctgactgatggtgctgtgacggatgtggaagccacacgtgaggctgtggtgcgtgcctcgaacctgcccatgtcagtgatcattgtgggtgtgggtggtgctgactttgaggccatggagcagctggacgctgatggtggacccctgcatacacgttctgggcaggctgctgcccgcgacattgtgcagtttgtaccctaccgccggttccagaatgcccctcgggaggcattggcacagaccgtgctcgcagaagtgcccacacaactggtctcatacttcagggcccagggttgggccccgctcaagccacttccaccctcagccaaggatcctgcacaggccccccaggcctaggttcccttggaggctgtggcaagtcctcaatcctgtgtcccagaggtccctctgggccacaacccaacccttctcactctcctcagtgctagcactttgtattttttgatacttttatacttgtttctgcttttgctgctcttgatcccacctttgctcctgacaaccctcattcaataaagaccagtgaagaccaa

SEQ ID NO: 446077 - DNA, 3863 bp, Homo sapiens
ctcgacgagccggactttctgtgacaacgtgcgacacggacggctggctggcctgcgctcgcggcatccaggcgacagctcgatatcgcggacatgagaggcccgtggctgcgttgggctccgggaagccgttcgggctggggctgtcggccgcggggcggaggcactcgcgcggggggggtaattcggggtctgggttctggtgccgcgcagctttccccgtctaaaagttggttttaattggttgcccacaggattgacttggcctctacttcttgttaaggaaattcatctcttgttttatcaggtgtgtgtggtttcagcgcagcatggctgtggtcatccgtttgcaaggtctcccaattgtggcggggaccatggacattcgccacttcttctctggattgaccattcctgatgggggcgtgcatattgtagggggtgaactgggtgaggctttcatcgtttttgccactgatgaagatgcaaggcttggtatgatgcgcacaggtggtacaattaaagggtcaaaagtaacactattgttgagtagtaagacggaaatgcagaatatgattgaactgagtcgtaggcgttttgaaactgccaacttagatataccaccagcaaatgccagtagatcaggaccaccacctagctcaggaatgagtagcagggtaaacttgcccacaacagtatccaactttaataatccatcacccagtgtagttactgccaccacttctgttcatgaaagcaacaaaaacatacagacattttccacagccagcgtaggaacagctcctccaaatatgggggcttcctttgggagcccaacgtttagctcaactgttccaagcacagcctctccaatgaacacagtcccgccgccaccaattcctccaattccagcgatgccatctctgccaccaatgccatccattcccccaattccagttcctcctccagtacctacattgcctcctgtgcctcctgtgcccccgattcccccagttccttctgtgccacccatgaccccactgccacccatgtcgggcatgccgcccttgaatccgccacctgtggcacctctacctgctggaatgaatggctctggagcacctatgaatttgaacaataatctgaatcctatgtttcttggtccgttgaatcctgttaaccctatccagatgaactctcagagcagtgtgaagccactccccatcaaccctgatgatctgtatgtcagtgtgcatggaatgcccttttctgcaatggaaaatgatgtcagagatttttttcatgggctccgtgttgatgcagtgcatttgttgaaagatcatgtaggtcgaaataatgggaatggattggttaagtttctctcccctcaagatacatttgaagctttgaaacgaaacagaatgctgatgattcaacgctatgtggaagttagccctgccacagaaagacagtgggtagctgctggaggccatatcacttttaagcaaaatatgggaccttctggacaaactcatccccctcctcagacacttcccaggtcaaaatcgcccagtgggcagaaaagatcaaggtcaagatcaccacatgaggctggtttttgtgtttacttgaaagggctaccatttgaagcagaaaacaaacatgtcattgatttttttaaaaagctggatattgtggaagatagtatttatatagcttatggacccaatgggaaagcaactggcgaaggctttgtagagttcagaaatgaggctgactataaggctgctctgtgtcgtcataaacagtacatgggcaatcgctttattcaagttcatccaattactaagaaaggtatgctagaaaagatagatatgattcgaaaaagactgcagaacttcagctatgaccagagggaaatgatactaaatccagagggggatgtcaactctgccaaagtctgtgcccacataacaaatattccattcagcattacaaagatggatgttcttcagttcctagaaggaatcccagtggatgaaaatgctgtacatgttcttgttgataacaatgggcaaggtctaggacaggcattggttcagtttaaaaatgaagatgatgcacatggcccactgcgtgaccttggttcagctgtccatttcctgtgaccatctcattgacaaggacatcggctccaagtctgacccactctgcgtccttttacaggatgtgggagggggcagctgggctgagcttggccggactgaacgggtgcggaactgctcaagccctgagttctccaagactctacagcttgagtaccgctttgagacagtccagaagctacgctttggaatctatgacatagacaacaagacgccagagctgagggatgatgacttcctagggggtgctgagtgttccctaggacagattgtgtccagccaggtactgactctccccttgatgctgaagcctggaaaacctgctgggcgggggaccatcacggacttcctgggaaaatcagatccatttctggagttcttccgccagggtgatgggaaatggcacctggtgtacagatctgaggtcatcaagaacaacctgaaccctacatggaagcgtttctcagtccccgttcagcatttctgtggtgggaaccccagcacacccatccaggtgcaatgctccgattatgacagtgacgggtcacatgatctcatcggtaccttccacaccagcttggcccagctgcaggcagtcccggctgagtttgaatgcatccaccctgagaagcagcagaaaaagaaaagctacaagaactctggaactatccgtgtcaagatttgtcgggtagaaacagagtactcctttctggactatgtgatgggaggctgtcagatcaacttcactgtgggcgtggacttcactggctccaatggagacccctcctcacctgactccctacactacctgagtccaacaggggtcaatgagtacctgatggcactgtggagtgtgggcagcgtggttcaggactatgactcagacaagctgttccctgcatttggatttggggcccaggttccccctgactggcaggtctcgcatgaatttgccttgaatttcaaccccagtaacccctactgtgcaggcatccagggcattgtggatgcctaccgccaagccctgccccaagttcgcctctatggccctaccaactttgcacccatcatcaaccatgtggccaggtttgcagcccaggctgcacatcaggggactgcctcgcaatacttcatgctgttgctgctgactgatggtgctgtgacggatgtggaagccacacgtgaggctgtggtgcgtgcctcgaacctgcccatgtcagtgatcattgtgggtgtgggtggtgctgactttgaggccatggagcagctggacgctgatggtggacccctgcatacacgttctgggcaggctgctgcccgcgacattgtgcagtttgtaccctaccgccggttccagaatgcccctcgggaggcattggcacagaccgtgctcgcagaagtgcccacacaactggtctcatacttcagggcccagggttgggccccgctcaagccacttccaccctcagccaaggatcctgcacaggccccccaggcctaggttcccttggaggctgtggcaagtcctcaatcctgtgtcccagaggtccctctgggccacaacccaacccttctcactctcctcagtgctagcactttgtattttttgatacttttatacttgtttctgcttttgctgctcttgatcccacctttgctcctgacaaccctcattcaataaagaccagtgaagaccaa

SEQ ID NO: 446078 - DNA, 4029 bp, Homo sapiens
ctcgacgagccggactttctgtgacaacgtgcgacacggacggctggctggcctgcgctcgcggcatccaggcgacagctcgatatcgcggacatgagaggcccgtggctgcgttgggctccgggaagccgttcgggctggggctgtcggccgcggggcggaggcactcgcgcggggggggtaattcggggtctgggttctggtgccgcgcagctttccccgtctaaaagttggttttaattggttgcccacaggattgacttggcctctacttcttgttaaggaaattcatctcttgttttatcaggtgtgtgtggtttcagcgcagcatggctgtggtcatccgtttgcaaggtctcccaattgtggcggggaccatggacattcgccacttcttctctggattgaccattcctgatgggggcgtgcatattgtagggggtgaactgggtgaggctttcatcgtttttgccactgatgaagatgcaaggcttggtatgatgcgcacaggtggtacaattaaagggtcaaaagtaacactattgttgagtagtaagacggaaatgcagaatatgattgaactgagtcgtaggcgttttgaaactgccaacttagatataccaccagcaaatgccagtagatcaggaccaccacctagctcaggaatgagtagcagggtaaacttgcccacaacagtatccaactttaataatccatcacccagtgtagttactgccaccacttctgttcatgaaagcaacaaaaacatacagacattttccacagccagcgtaggaacagctcctccaaatatgggggcttcctttgggagcccaacgtttagctcaactgttccaagcacagcctctccaatgaacacagtcccgccgccaccaattcctccaattccagcgatgccatctctgccaccaatgccatccattcccccaattccagttcctcctccagtacctacattgcctcctgtgcctcctgtgcccccgattcccccagttccttctgtgccacccatgaccccactgccacccatgtcgggcatgccgcccttgaatccgccacctgtggcacctctacctgctggaatgaatggctctggagcacctatgaatttgaacaataatctgaatcctatgtttcttggtccgttgaatcctgttaaccctatccagatgaactctcagagcagtgtgaagccactccccatcaaccctgatgatctgtatgtcagtgtgcatggaatgcccttttctgcaatggaaaatgatgtcagagatttttttcatgggctccgtgttgatgcagtgcatttgttgaaagatcatgtaggtcgaaataatgggaatggattggttaagtttctctcccctcaagatacatttgaagctttgaaacgaaacagaatgctgatgattcaacgctatgtggaagttagccctgccacagaaagacagtgggtagctgctggaggccatatcacttttaagcaaaatatgggaccttctggacaaactcatccccctcctcagacacttcccaggtcaaaatcgcccagtgggcagaaaagatcaaggtcaagatcaccacatgaggctggtttttgtgtttacttgaaagggctaccatttgaagcagaaaacaaacatgtcattgatttttttaaaaagctggatattgtggaagatagtatttatatagcttatggacccaatgggaaagcaactggcgaaggctttgtagagttcagaaatgaggctgactataaggctgctctgtgtcgtcataaacagtacatgggcaatcgctttattcaagttcatccaattactaagaaaggtatgctagaaaagatagatatgattcgaaaaagactgcagaacttcagctatgaccagagggaaatgatactaaatccagagggggatgtcaactctgccaaagtctgtgcccacataacaaatattccattcagcattacaaagatggatgttcttcagttcctagaaggaatcccagtggatgaaaatgctgtacatgttcttgttgataacaatgggcaaggtctaggacaggcattggttcagtttaaaaatgaagatgatgcacatggcccactgcgtgaccttggttcagctgtccatttcctgtgaccatctcattgacaaggacatcggctccaagtctgacccactctgcgtccttttacaggatgtgggagggggcagctgggctgagcttggccggactgaacgggtgcggaactgctcaagccctgagttctccaagactctacagcttgagtaccgctttgagacagtccagaagctacgctttggaatctatgacatagacaacaagacgccagagctgagggatgatgacttcctagggggtgctgagtgttccctaggacagattgtgtccagccaggtactgactctccccttgatgctgaagcctggaaaacctgctgggcgggggaccatcacggtctcagctcaggaattaaaggacaatcgtgtagtaaccatggaggtagaggccagaaacctagataagaaggacttcctgggaaaatcagatccatttctggagttcttccgccagggtgatgggaaatggcacctggtgtacagatctgaggtcatcaagaacaacctgaaccctacatggaagcgtttctcagtccccgttcagcatttctgtggtgggaaccccagcacacccatccaggtgcaatgctccgattatgacagtgacgggtcacatgatctcatcggtaccttccacaccagcttggcccagctgcaggcagtcccggctgagtttgaatgcatccaccctgagaagcagcagaaaaagaaaagctacaagaactctggaactatccgtgtcaagatttgtcgggtgagacaaaagcccatgtaaccaaggctctgattcctgagctccatgacaccaactgctatcaccccaggcatgaccctggtttcatttgcaggtagaaacagagtactcctttctggactatgtgatgggaggctgtcagatcaacttcactgtgggcgtggacttcactggctccaatggagacccctcctcacctgactccctacactacctgagtccaacaggggtcaatgagtacctgatggcactgtggagtgtgggcagcgtggttcaggactatgactcagacaagctgttccctgcatttggatttggggcccaggttccccctgactggcaggtctcgcatgaatttgccttgaatttcaaccccagtaacccctactgtgcaggcatccagggcattgtggatgcctaccgccaagccctgccccaagttcgcctctatggccctaccaactttgcacccatcatcaaccatgtggccaggtttgcagcccaggctgcacatcaggggactgcctcgcaatacttcatgctgttgctgctgactgatggtgctgtgacggatgtggaagccacacgtgaggctgtggtgcgtgcctcgaacctgcccatgtcagtgatcattgtgggtgtgggtggtgctgactttgaggccatggagcagctggacgctgatggtggacccctgcatacacgttctgggcaggctgctgcccgcgacattgtgcagtttgtaccctaccgccggttccagaatgcccctcgggaggcattggcacagaccgtgctcgcagaagtgcccacacaactggtctcatacttcagggcccagggttgggccccgctcaagccacttccaccctcagccaaggatcctgcacaggccccccaggcctaggttcccttggaggctgtggcaagtcctcaatcctgtgtcccagaggtccctctgggccacaacccaacccttctcactctcctcagtgctagcactttgtattttttgatacttttatacttgtttctgcttttgctgctcttgatcccacctttgctcctgacaaccctcattcaataaagaccagtgaagaccaa

SEQ ID NO: 446079 - DNA, 3913 bp, Homo sapiens
ctcgacgagccggactttctgtgacaacgtgcgacacggacggctggctggcctgcgctcgcggcatccaggcgacagctcgatatcgcggacatgagaggcccgtggctgcgttgggctccgggaagccgttcgggctggggctgtcggccgcggggcggaggcactcgcgcggggggggtaattcggggtctgggttctggtgccgcgcagctttccccgtctaaaagttggttttaattggttgcccacaggattgacttggcctctacttcttgttaaggaaattcatctcttgttttatcaggtgtgtgtggtttcagcgcagcatggctgtggtcatccgtttgcaaggtctcccaattgtggcggggaccatggacattcgccacttcttctctggattgaccattcctgatgggggcgtgcatattgtagggggtgaactgggtgaggctttcatcgtttttgccactgatgaagatgcaaggcttggtatgatgcgcacaggtggtacaattaaagggtcaaaagtaacactattgttgagtagtaagacggaaatgcagaatatgattgaactgagtcgtaggcgttttgaaactgccaacttagatataccaccagcaaatgccagtagatcaggaccaccacctagctcaggaatgagtagcagggtaaacttgcccacaacagtatccaactttaataatccatcacccagtgtagttactgccaccacttctgttcatgaaagcaacaaaaacatacagacattttccacagccagcgtaggaacagctcctccaaatatgggggcttcctttgggagcccaacgtttagctcaactgttccaagcacagcctctccaatgaacacagtcccgccgccaccaattcctccaattccagcgatgccatctctgccaccaatgccatccattcccccaattccagttcctcctccagtacctacattgcctcctgtgcctcctgtgcccccgattcccccagttccttctgtgccacccatgaccccactgccacccatgtcgggcatgccgcccttgaatccgccacctgtggcacctctacctgctggaatgaatggctctggagcacctatgaatttgaacaataatctgaatcctatgtttcttggtccgttgaatcctgttaaccctatccagatgaactctcagagcagtgtgaagccactccccatcaaccctgatgatctgtatgtcagtgtgcatggaatgcccttttctgcaatggaaaatgatgtcagagatttttttcatgggctccgtgttgatgcagtgcatttgttgaaagatcatgtaggtcgaaataatgggaatggattggttaagtttctctcccctcaagatacatttgaagctttgaaacgaaacagaatgctgatgattcaacgctatgtggaagttagccctgccacagaaagacagtgggtagctgctggaggccatatcacttttaagcaaaatatgggaccttctggacaaactcatccccctcctcagacacttcccaggtcaaaatcgcccagtgggcagaaaagatcaaggtcaagatcaccacatgaggctggtttttgtgtttacttgaaagggctaccatttgaagcagaaaacaaacatgtcattgatttttttaaaaagctggatattgtggaagatagtatttatatagcttatggacccaatgggaaagcaactggcgaaggctttgtagagttcagaaatgaggctgactataaggctgctctgtgtcgtcataaacagtacatgggcaatcgctttattcaagttcatccaattactaagaaaggtatgctagaaaagatagatatgattcgaaaaagactgcagaacttcagctatgaccagagggaaatgatactaaatccagagggggatgtcaactctgccaaagtctgtgcccacataacaaatattccattcagcattacaaagatggatgttcttcagttcctagaaggaatcccagtggatgaaaatgctgtacatgttcttgttgataacaatgggcaaggtctaggacaggcattggttcagtttaaaaatgaagatgatgcacatggcccactgcgtgaccttggttcagctgtccatttcctgtgaccatctcattgacaaggacatcggctccaagtctgacccactctgcgtccttttacaggatgtgggagggggcagctgggctgagcttggccggactgaacgggtgcggaactgctcaagccctgagttctccaagactctacagcttgagtaccgctttgagacagtccagaagctacgctttggaatctatgacatagacaacaagacgccagagctgagggatgatgacttcctagggggtgctgagtgttccctaggacagattgtgtccagccaggtactgactctccccttgatgctgaagcctggaaaacctgctgggcgggggaccatcacggtctcagctcaggaattaaaggacaatcgtgtagtaaccatggaggtagaggccagaaacctagataagaaggacttcctgggaaaatcagatccatttctggagttcttccgccagggtgatgggaaatggcacctggtgtacagatctgaggtcatcaagaacaacctgaaccctacatggaagcgtttctcagtccccgttcagcatttctgtggtgggaaccccagcacacccatccaggtgcaatgctccgattatgacagtgacgggtcacatgatctcatcggtaccttccacaccagcttggcccagctgcaggcagtcccggctgagtttgaatgcatccaccctgagaagcagcagaaaaagaaaagctacaagaactctggaactatccgtgtcaagatttgtcgggtagaaacagagtactcctttctggactatgtgatgggaggctgtcagatcaacttcactgtgggcgtggacttcactggctccaatggagacccctcctcacctgactccctacactacctgagtccaacaggggtcaatgagtacctgatggcactgtggagtgtgggcagcgtggttcaggactatgactcagacaagctgttccctgcatttggatttggggcccaggttccccctgactggcaggtctcgcatgaatttgccttgaatttcaaccccagtaacccctactgtgcagctaccgccaagccctgccccaagttcgcctctatggccctaccaactttgcacccatcatcaaccatgtggccaggtttgcagcccaggctgcacatcaggggactgcctcgcaatacttcatgctgttgctgctgactgatggtgctgtgacggatgtggaagccacacgtgaggctgtggtgcgtgcctcgaacctgcccatgtcagtgatcattgtgggtgtgggtggtgctgactttgaggccatggagcagctggacgctgatggtggacccctgcatacacgttctgggcaggctgctgcccgcgacattgtgcagtttgtaccctaccgccggttccagaatgcccctcgggaggcattggcacagaccgtgctcgcagaagtgcccacacaactggtctcatacttcagggcccagggttgggccccgctcaagccacttccaccctcagccaaggatcctgcacaggccccccaggcctaggttcccttggaggctgtggcaagtcctcaatcctgtgtcccagaggtccctctgggccacaacccaacccttctcactctcctcagtgctagcactttgtattttttgatacttttatacttgtttctgcttttgctgctcttgatcccacctttgctcctgacaaccctcattcaataaagaccagtgaagaccaa

SEQ ID NO: 446080 - DNA, 4290 bp, Homo sapiens
ctcgacgagccggactttctgtgacaacgtgcgacacggacggctggctggcctgcgctcgcggcatccaggcgacagctcgatatcgcggacatgagaggcccgtggctgcgttgggctccgggaagccgttcgggctggggctgtcggccgcggggcggaggcactcgcgcggggggggtaattcggggtctgggttctggtgccgcgcagctttccccgtctaaaagttggttttaattggttgcccacaggattgacttggcctctacttcttgttaaggaaattcatctcttgttttatcaggtgtgtgtggtttcagcgcagcatggctgtggtcatccgtttgcaaggtctcccaattgtggcggggaccatggacattcgccacttcttctctggattgaccattcctgatgggggcgtgcatattgtagggggtgaactgggtgaggctttcatcgtttttgccactgatgaagatgcaaggcttggtatgatgcgcacaggtggtacaattaaagggtcaaaagtaacactattgttgagtagtaagacggaaatgcagaatatgattgaactgagtcgtaggcgttttgaaactgccaacttagatataccaccagcaaatgccagtagatcaggaccaccacctagctcaggaatgagtagcagggtaaacttgcccacaacagtatccaactttaataatccatcacccagtgtagttactgccaccacttctgttcatgaaagcaacaaaaacatacagacattttccacagccagcgtaggaacagctcctccaaatatgggggcttcctttgggagcccaacgtttagctcaactgttccaagcacagcctctccaatgaacacagtcccgccgccaccaattcctccaattccagcgatgccatctctgccaccaatgccatccattcccccaattccagttcctcctccagtacctacattgcctcctgtgcctcctgtgcccccgattcccccagttccttctgtgccacccatgaccccactgccacccatgtcgggcatgccgcccttgaatccgccacctgtggcacctctacctgctggaatgaatggctctggagcacctatgaatttgaacaataatctgaatcctatgtttcttggtccgttgaatcctgttaaccctatccagatgaactctcagagcagtgtgaagccactccccatcaaccctgatgatctgtatgtcagtgtgcatggaatgcccttttctgcaatggaaaatgatgtcagagatttttttcatgggctccgtgttgatgcagtgcatttgttgaaagatcatgtaggtcgaaataatgggaatggattggttaagtttctctcccctcaagatacatttgaagctttgaaacgaaacagaatgctgatgattcaacgctatgtggaagttagccctgccacagaaagacagtgggtagctgctggaggccatatcacttttaagcaaaatatgggaccttctggacaaactcatccccctcctcagacacttcccaggtcaaaatcgcccagtgggcagaaaagatcaaggtcaagatcaccacatgaggctggtttttgtgtttacttgaaagggctaccatttgaagcagaaaacaaacatgtcattgatttttttaaaaagctggatattgtggaagatagtatttatatagcttatggacccaatgggaaagcaactggcgaaggctttgtagagttcagaaatgaggctgactataaggctgctctgtgtcgtcataaacagtacatgggcaatcgctttattcaagttcatccaattactaagaaaggtatgctagaaaagatagatatgattcgaaaaagactgcagaacttcagctatgaccagagggaaatgatactaaatccagagggggatgtcaactctgccaaagtctgtgcccacataacaaatattccattcagcattacaaagatggatgttcttcagttcctagaaggaatcccagtggatgaaaatgctgtacatgttcttgttgataacaatgggcaaggtctaggacaggcattggttcagtttaaaaatgaagatgatgcacatggcccactgcgtgaccttggttcagctgtccatttcctgtgaccatctcattgacaaggacatcggctccaagtctgacccactctgcgtccttttacaggatgtgggagggggcagctgggctgagcttggccggactgaacgggtgcggaactgctcaagccctgagttctccaagactctacagcttgagtaccgctttgagacagtccagaagctacgctttggaatctatgacatagacaacaagacgccagagctgagggatgatgacttcctagggggtgctgagtgttccctaggacagattgtgtccagccaggtactgactctccccttgatgctgaagcctggaaaacctgctgggcgggggaccatcacggtctcagctcaggaattaaaggacaatcgtgtagtaaccatggaggtagaggccagaaacctagataagaaggacttcctgggaaaatcagatccatttctggagttcttccgccagggtgatgggaaatggcacctggtgtacagatctgaggtcatcaagaacaacctgaaccctacatggaagcgtttctcagtccccgttcagcatttctgtggtgggaaccccagcacacccatccaggtgcaatgctccgattatgacagtgacgggtcacatgatctcatcggtaccttccacaccagcttggcccagctgcaggcagtcccggctgagtttgaatgcatccaccctgagaagcagcagaaaaagaaaagctacaagaactctggaactatccgtgtcaagatttgtcgggtagaaacagagtactcctttctggactatgtgatgggaggctgtcagatcaacttcactgtgggcgtggacttcactggctccaatggagacccctcctcacctgactccctacactacctgagtccaacaggggtcaatgagtacctgatggcactgtggagtgtgggcagcgtggttcaggactatgactccgtgagtacctgcttctctgggctatacccgctccctgcagatgcttcagcctctgagcttacagtcccctcactgccttttgcccaatacactgtcctcccacagagacaagctgttccctgcatttggatttggggcccaggttccccctgactggcagtgagctccctctctttctgccactcctgttttcagtttcagggtcctgattttgggggatgtggtaaatttacttgctacttggcactcagctttaagaggagatgcagggttggattcctgcaggcacgtagacagcaagtgctcaggactccatagctcctataggaatcttggcacacgccagtgtcctttttcattcttagcagaggtcatggggaaagaacctcattttcattcttgtctccaggtctcgcatgaatttgccttgaatttcaaccccagtaacccctactgtgcaggcatccagggcattgtggatgcctaccgccaagccctgccccaagttcgcctctatggccctaccaactttgcacccatcatcaaccatgtggccaggtttgcagcccaggctgcacatcaggggactgcctcgcaatacttcatgctgttgctgctgactgatggtgctgtgacggatgtggaagccacacgtgaggctgtggtgcgtgcctcgaacctgcccatgtcagtgatcattgtgggtgtgggtggtgctgactttgaggccatggagcagctggacgctgatggtggacccctgcatacacgttctgggcaggctgctgcccgcgacattgtgcagtttgtaccctaccgccggttccagaatgcccctcgggaggcattggcacagaccgtgctcgcagaagtgcccacacaactggtctcatacttcagggcccagggttgggccccgctcaagccacttccaccctcagccaaggatcctgcacaggccccccaggcctaggttcccttggaggctgtggcaagtcctcaatcctgtgtcccagaggtccctctgggccacaacccaacccttctcactctcctcagtgctagcactttgtattttttgatacttttatacttgtttctgcttttgctgctcttgatcccacctttgctcctgacaaccctcattcaataaagaccagtgaagaccaa

SEQ ID NO: 446081 - DNA, 3958 bp, Homo sapiens
ctcgacgagccggactttctgtgacaacgtgcgacacggacggctggctggcctgcgctcgcggcatccaggcgacagctcgatatcgcggacatgagaggcccgtggctgcgttgggctccgggaagccgttcgggctggggctgtcggccgcggggcggaggcactcgcgcggggggggtaattcggggtctgggttctggtgccgcgcagctttccccgtctaaaagttggttttaattggttgcccacaggattgacttggcctctacttcttgttaaggaaattcatctcttgttttatcaggtgtgtgtggtttcagcgcagcatggctgtggtcatccgtttgcaaggtctcccaattgtggcggggaccatggacattcgccacttcttctctggattgaccattcctgatgggggcgtgcatattgtagggggtgaactgggtgaggctttcatcgtttttgccactgatgaagatgcaaggcttggtatgatgcgcacaggtggtacaattaaagggtcaaaagtaacactattgttgagtagtaagacggaaatgcagaatatgattgaactgagtcgtaggcgttttgaaactgccaacttagatataccaccagcaaatgccagtagatcaggaccaccacctagctcaggaatgagtagcagggtaaacttgcccacaacagtatccaactttaataatccatcacccagtgtagttactgccaccacttctgttcatgaaagcaacaaaaacatacagacattttccacagccagcgtaggaacagctcctccaaatatgggggcttcctttgggagcccaacgtttagctcaactgttccaagcacagcctctccaatgaacacagtcccgccgccaccaattcctccaattccagcgatgccatctctgccaccaatgccatccattcccccaattccagttcctcctccagtacctacattgcctcctgtgcctcctgtgcccccgattcccccagttccttctgtgccacccatgaccccactgccacccatgtcgggcatgccgcccttgaatccgccacctgtggcacctctacctgctggaatgaatggctctggagcacctatgaatttgaacaataatctgaatcctatgtttcttggtccgttgaatcctgttaaccctatccagatgaactctcagagcagtgtgaagccactccccatcaaccctgatgatctgtatgtcagtgtgcatggaatgcccttttctgcaatggaaaatgatgtcagagatttttttcatgggctccgtgttgatgcagtgcatttgttgaaagatcatgtaggtcgaaataatgggaatggattggttaagtttctctcccctcaagatacatttgaagctttgaaacgaaacagaatgctgatgattcaacgctatgtggaagttagccctgccacagaaagacagtgggtagctgctggaggccatatcacttttaagcaaaatatgggaccttctggacaaactcatccccctcctcagacacttcccaggtcaaaatcgcccagtgggcagaaaagatcaaggtcaagatcaccacatgaggctggtttttgtgtttacttgaaagggctaccatttgaagcagaaaacaaacatgtcattgatttttttaaaaagctggatattgtggaagatagtatttatatagcttatggacccaatgggaaagcaactggcgaaggctttgtagagttcagaaatgaggctgactataaggctgctctgtgtcgtcataaacagtacatgggcaatcgctttattcaagttcatccaattactaagaaaggtatgctagaaaagatagatatgattcgaaaaagactgcagaacttcagctatgaccagagggaaatgatactaaatccagagggggatgtcaactctgccaaagtctgtgcccacataacaaatattccattcagcattacaaagatggatgttcttcagttcctagaaggaatcccagtggatgaaaatgctgtacatgttcttgttgataacaatgggcaaggtctaggacaggcattggttcagtttaaaaatgaagatgatgcacatggcccactgcgtgaccttggttcagctgtccatttcctgtgaccatctcattgacaaggacatcggctccaagtctgacccactctgcgtccttttacaggatgtgggagggggcagctgggctgagcttggccggactgaacgggtgcggaactgctcaagccctgagttctccaagactctacagcttgagtaccgctttgagacagtccagaagctacgctttggaatctatgacatagacaacaagacgccagagctgagggatgatgacttcctagggggtgctgagtgttccctaggacagattgtgtccagccaggtactgactctccccttgatgctgaagcctggaaaacctgctgggcgggggaccatcacggtctcagctcaggaattaaaggacaatcgtgtagtaaccatggaggtagaggccagaaacctagataagaaggacttcctgggaaaatcagatccatttctggagttcttccgccagggtgatgggaaatggcacctggtgtacagatctgaggtcatcaagaacaacctgaaccctacatggaagcgtttctcagtccccgttcagcatttctgtggtgggaaccccagcacacccatccaggtgcaatgctccgattatgacagtgacgggtcacatgatctcatcggtaccttccacaccagcttggcccagctgcaggcagtcccggctgagtttgaatgcatccaccctgagaagcagcagaaaaagaaaagctacaagaactctggaactatccgtgtcaagatttgtcgggtagaaacagagtactcctttctggactatgtgatgggaggctgtcagatcaacttcactgtgggcgtggacttcactggctccaatggagacccctcctcacctgactccctacactacctgagtccaacaggggtcaatgagtacctgatggcactgtggagtgtgggcagcgtggttcaggactatgactcagacaagctgttccctgcatttggatttggggcccaggttccccctgactggcaggtctcgcatgaatttgccttgaatttcaaccccagtaacccctactgtgcaggcatccagggcattgtggatgcctaccgccaagccctgccccaagttcgcctctatggccctaccaactttgcacccatcatcaaccatgtggccaggtttgcagcccaggctgcacatcaggggactgcctcggacatgaatgggcttgtccccagcaatacttcatgctgttgctgctgactgatggtgctgtgacggatgtggaagccacacgtgaggctgtggtgcgtgcctcgaacctgcccatgtcagtgatcattgtgggtgtgggtggtgctgactttgaggccatggagcagctggacgctgatggtggacccctgcatacacgttctgggcaggctgctgcccgcgacattgtgcagtttgtaccctaccgccggttccagaatgcccctcgggaggcattggcacagaccgtgctcgcagaagtgcccacacaactggtctcatacttcagggcccagggttgggccccgctcaagccacttccaccctcagccaaggatcctgcacaggccccccaggcctaggttcccttggaggctgtggcaagtcctcaatcctgtgtcccagaggtccctctgggccacaacccaacccttctcactctcctcagtgctagcactttgtattttttgatacttttatacttgtttctgcttttgctgctcttgatcccacctttgctcctgacaaccctcattcaataaagaccagtgaagaccaa

SEQ ID NO: 446082 - DNA, 3850 bp, Homo sapiens
ctcgacgagccggactttctgtgacaacgtgcgacacggacggctggctggcctgcgctcgcggcatccaggcgacagctcgatatcgcggacatgagaggcccgtggctgcgttgggctccgggaagccgttcgggctggggctgtcggccgcggggcggaggcactcgcgcggggggggtaattcggggtctgggttctggtgccgcgcagctttccccgtctaaaagttggttttaattggttgcccacaggattgacttggcctctacttcttgttaaggaaattcatctcttgttttatcaggtgtgtgtggtttcagcgcagcatggctgtggtcatccgtttgcaaggtctcccaattgtggcggggaccatggacattcgccacttcttctctggattgaccattcctgatgggggcgtgcatattgtagggggtgaactgggtgaggctttcatcgtttttgccactgatgaagatgcaaggcttggtatgatgcgcacaggtggtacaattaaagggtcaaaagtaacactattgttgagtagtaagacggaaatgcagaatatgattgaactgagtcgtaggcgttttgaaactgccaacttagatataccaccagcaaatgccagtagatcaggaccaccacctagctcaggaatgagtagcagggtaaacttgcccacaacagtatccaactttaataatccatcacccagtgtagttactgccaccacttctgttcatgaaagcaacaaaaacatacagacattttccacagccagcgtaggaacagctcctccaaatatgggggcttcctttgggagcccaacgtttagctcaactgttccaagcacagcctctccaatgaacacagtcccgccgccaccaattcctccaattccagcgatgccatctctgccaccaatgccatccattcccccaattccagttcctcctccagtacctacattgcctcctgtgcctcctgtgcccccgattcccccagttccttctgtgccacccatgaccccactgccacccatgtcgggcatgccgcccttgaatccgccacctgtggcacctctacctgctggaatgaatggctctggagcacctatgaatttgaacaataatctgaatcctatgtttcttggtccgttgaatcctgttaaccctatccagatgaactctcagagcagtgtgaagccactccccatcaaccctgatgatctgtatgtcagtgtgcatggaatgcccttttctgcaatggaaaatgatgtcagagatttttttcatgggctccgtgttgatgcagtgcatttgttgaaagatcatgtaggtcgaaataatgggaatggattggttaagtttctctcccctcaagatacatttgaagctttgaaacgaaacagaatgctgatgattcaacgctatgtggaagttagccctgccacagaaagacagtgggtagctgctggaggccatatcacttttaagcaaaatatgggaccttctggacaaactcatccccctcctcagacacttcccaggtcaaaatcgcccagtgggcagaaaagatcaaggtcaagatcaccacatgaggctggtttttgtgtttacttgaaagggctaccatttgaagcagaaaacaaacatgtcattgatttttttaaaaagctggatattgtggaagatagtatttatatagcttatggacccaatgggaaagcaactggcgaaggctttgtagagttcagaaatgaggctgactataaggctgctctgtgtcgtcataaacagtacatgggcaatcgctttattcaagttcatccaattactaagaaaggtatgctagaaaagatagatatgattcgaaaaagactgcagaacttcagctatgaccagagggaaatgatactaaatccagagggggatgtcaactctgccaaagtctgtgcccacataacaaatattccattcagcattacaaagatggatgttcttcagttcctagaaggaatcccagtggatgaaaatgctgtacatgttcttgttgataacaatgggcaaggtctaggacaggcattggttcagtttaaaaatgaagatgatgcacatggcccactgcgtgaccttggttcagctgtccatttcctgtgaccatctcattgacaaggacatcggctccaagtctgacccactctgcgtccttttacaggatgtgggagggggcagctgggctgagcttggccggactgaacgggtgcggaactgctcaagccctgagttctccaagactctacagcttgagtaccgctttgagacagtccagaagctacgctttggaatctatgacatagacaacaagacgccagagctgagggatgatgacttcctagggggtgctgagtgttccctaggacagattgtgtccagccaggtactgactctccccttgatgctgaagcctggaaaacctgctgggcgggggaccatcacggtctcagctcaggaattaaaggacaatcgtgtagtaaccatggaggtagaggccagaaacctagataagaaggacttcctgggaaaatcagatccatttctggagttcttccgccagggtgatgggaaatggcacctggtgtacagatctgaggtcatcaagaacaacctgaaccctacatggaagcgtttctcagtccccgttcagcatttctgtggtgggaaccccagcacacccatccaggtgcaatgctccgattatgacagtgacgggtcacatgatctcatcggtaccttccacaccagcttggcccagctgcaggcagtcccggctgagtttgaatgcatccaccctgagaagcagcagaaaaagaaaagctacaagaactctggaactatccgtgtcaagatttgtcgggtagaaacagagtactcctttctggactatgtgatgggaggctgtcagatcaacttcactgtgggcgtggacttcactggctccaatggagacccctcctcacctgactccctacactacctgagtccaacaggggtcaatgagtacctgatggcactgtggagtgtgggcagcgtggttcaggactatgactcagacaagctgttccctgcatttggatttggggcccaggttccccctgactggcaggtctcgcatgaatttgccttgaatttcaaccccagtaacccctactgtgcaggggtttaggaggaggatctgcttcaggacatgaatgggcttgtccccagcaatacttcatgctgttgctgctgactgatggtgctgtgacggatgtggaagccacacgtgaggctgtggtgcgtgcctcgaacctgcccatgtcagtgatcattgtgggtgtgggtggtgctgactttgaggccatggagcagctggacgctgatggtggacccctgcatacacgttctgggcaggctgctgcccgcgacattgtgcagtttgtaccctaccgccggttccagaatgcccctcgggaggcattggcacagaccgtgctcgcagaagtgcccacacaactggtctcatacttcagggcccagggttgggccccgctcaagccacttccaccctcagccaaggatcctgcacaggccccccaggcctaggttcccttggaggctgtggcaagtcctcaatcctgtgtcccagaggtccctctgggccacaacccaacccttctcactctcctcagtgctagcactttgtattttttgatacttttatacttgtttctgcttttgctgctcttgatcccacctttgctcctgacaaccctcattcaataaagaccagtgaagaccaa

SEQ ID NO: 446083 - DNA, 4888 bp, Homo sapiens
ctcgacgagccggactttctgtgacaacgtgcgacacggacggctggctggcctgcgctcgcggcatccaggcgacagctcgatatcgcggacatgagaggcccgtggctgcgttgggctccgggaagccgttcgggctggggctgtcggccgcggggcggaggcactcgcgcggggggggtaattcggggtctgggttctggtgccgcgcagctttccccgtctaaaagttggttttaattggttgcccacaggattgacttggcctctacttcttgttaaggaaattcatctcttgttttatcaggtgtgtgtggtttcagcgcagcatggctgtggtcatccgtttgcaaggtctcccaattgtggcggggaccatggacattcgccacttcttctctggattgaccattcctgatgggggcgtgcatattgtagggggtgaactgggtgaggctttcatcgtttttgccactgatgaagatgcaaggcttggtatgatgcgcacaggtggtacaattaaagggtcaaaagtaacactattgttgagtagtaagacggaaatgcagaatatgattgaactgagtcgtaggcgttttgaaactgccaacttagatataccaccagcaaatgccagtagatcaggaccaccacctagctcaggaatgagtagcagggtaaacttgcccacaacagtatccaactttaataatccatcacccagtgtagttactgccaccacttctgttcatgaaagcaacaaaaacatacagacattttccacagccagcgtaggaacagctcctccaaatatgggggcttcctttgggagcccaacgtttagctcaactgttccaagcacagcctctccaatgaacacagtcccgccgccaccaattcctccaattccagcgatgccatctctgccaccaatgccatccattcccccaattccagttcctcctccagtacctacattgcctcctgtgcctcctgtgcccccgattcccccagttccttctgtgccacccatgaccccactgccacccatgtcgggcatgccgcccttgaatccgccacctgtggcacctctacctgctggaatgaatggctctggagcacctatgaatttgaacaataatctgaatcctatgtttcttggtccgttgaatcctgttaaccctatccagatgaactctcagagcagtgtgaagccactccccatcaaccctgatgatctgtatgtcagtgtgcatggaatgcccttttctgcaatggaaaatgatgtcagagatttttttcatgggctccgtgttgatgcagtgcatttgttgaaagatcatgtaggtcgaaataatgggaatggattggttaagtttctctcccctcaagatacatttgaagctttgaaacgaaacagaatgctgatgattcaacgctatgtggaagttagccctgccacagaaagacagtgggtagctgctggaggccatatcacttttaagcaaaatatgggaccttctggacaaactcatccccctcctcagacacttcccaggtcaaaatcgcccagtgggcagaaaagatcaaggtcaagatcaccacatgaggctggtttttgtgtttacttgaaagggctaccatttgaagcagaaaacaaacatgtcattgatttttttaaaaagctggatattgtggaagatagtatttatatagcttatggacccaatgggaaagcaactggcgaaggctttgtagagttcagaaatgaggctgactataaggctgctctgtgtcgtcataaacagtacatgggcaatcgctttattcaagttcatccaattactaagaaaggtatgctagaaaagatagatatgattcgaaaaagactgcagaacttcagctatgaccagagggaaatgatactaaatccagagggggatgtcaactctgccaaagtctgtgcccacataacaaatattccattcagcattacaaagatggatgttcttcagttcctagaaggaatcccagtggatgaaaatgctgtacatgttcttgttgataacaatgggcaaggtctaggacaggcattggttcagtttaaaaatgaagatgatgcacatggcccactgcgtgaccttggttcagctgtccatttcctgtgaccatctcattgacaaggacatcggctccaagtctgacccactctgcgtccttttacaggatgtgggagggggcagctgggctgagcttggccggactgaacgggtgcggaactgctcaagccctgagttctccaagactctacagcttgagtaccgctttgagacagtccagaagctacgctttggaatctatgacatagacaacaagacgccagagctgagggatgatgacttcctagggggtgctgagtgttccctaggacagattgtgtccagccaggtactgactctccccttgatgctgaagcctggaaaacctgctgggcgggggaccatcacggtctcagctcaggaattaaaggacaatcgtgtagtaaccatggaggtagaggccagaaacctagataagaaggacttcctgggaaaatcagatccatttctggagttcttccgccagggtgatgggaaatggcacctggtgtacagatctgaggtcatcaagaacaacctgaaccctacatggaagcgtttctcagtccccgttcagcatttctgtggtgggaaccccagcacacccatccaggtgcaatgctccgattatgacagtgacgggtcacatgatctcatcggtaccttccacaccagcttggcccagctgcaggcagtcccggctgagtttgaatgcatccaccctgagaagcagcagaaaaagaaaagctacaagaactctggaactatccgtgtcaagatttgtcgggtagaaacagagtactcctttctggactatgtgatgggaggctgtcagatcaacttcactgtgggcgtggacttcactggctccaatggagacccctcctcacctgactccctacactacctgagtccaacaggggtcaatgagtacctgatggcactgtggagtgtgggcagcgtggttcaggactatgactcagacaagctgttccctgcatttggatttggggcccaggttccccctgactggcaggtctcgcatgaatttgccttgaatttcaaccccagtaacccctactgtgcaggcatccagggcattgtggatgcctaccgccaagccctgccccaagttcgcctctatggccctaccaactttgcacccatcatcaaccatgtggccaggtttgcagcccaggctgcacatcaggggactgcctcgcaatacttcatgctgttgctgctgactgatggtgctgtgacggatgtggaagccacacgtgaggctgtggtgcgtgcctcgaacctgcccatgtcagtgatcattgtgggtgtgggtggtgctgactttgaggccatggagcagctggacgctgatggtggacccctgcatacacgttctgggcaggctgctgcccgcgacattgtgcagtttgtaccctaccgccggttccagaatgcccctcgggaggcattggcacagaccgtgctcgcagaagtgcccacacaactggtctcatacttcagggcccagggttgggccccgctcaagccacttccaccctcagccaaggatcctgcacaggccccccaggcctaggttcccttggaggctgtggcaagtcctcaatcctgtgtcccagaggtccctctgggccacaacccaacccttctcactctcctcagtgctagcactttgtattttttgatacttttatacttgtttctgcttttgctgctcttgatcccacctttgctcctgacaaccctcattcaataaagaccagtgaagaccaaaaaaaaaaaaaaaaaaaaaaaaaaaaaaaaaaaaaaaaaaaaaaaaaaaaaaaaaaaaaaaaaagagagagagggggggcgcgcgcccaaaaatatatcccccgcggggggcgcgccccttgcgcgcgcgcgcccccccgacttttgtgctgcgaacaagaaggggcgccccacaagaagggaggcccgcttattatacccgaccgagcgagcgcggagcgggcgccgcgttaaaaacaagcgcgcgcacaggggaaaaacacgcgcccacagcgcggcagcaacctccgtgggagaagagaaccacccccacacgcggggggggaggcgcgaccaccaacctatgtgggggcgccccactcctcctcctcaccagacagagatttatttacaccccccactagggggagaacaatatctacaacactctcttctacacgggggtactacataaggggtggtgtacaacaccaaggcgcccgataatatccccctccttcgcgcctagcgaaaacatttttcgccccccaaccgacgagtcatctagatatcgcgaggaggacacaaatatttttttaacccacgggggggtcttgttttttatataataaaaatctcgcgcagtgacgacccagtcagaactacagagcaaccaggcccacagacacacgccagcgcgacgaggactgaccactcacaaacagaccgaaccaaccgagcacacaagagtgctacgacgccgattgacgtacctaggaccaagaagcaaagaccgctctacccacctcacagctcgctaagccaagggacacagagtcggagcactgagacgggatgacagcggagaacactacgcagcacgtcaggcacacgaaaacccacaaagccacacaaactacaacacacacgaggcacagaaaaagccaacagcaaaacaacacccacagaaccca

SEQ ID NO: 446084 - DNA, 2108 bp, Homo sapiens
ctcgacgagccggactttctgtgacaacgtgcgacacggacggctggctggcctgcgctcgcggcatccaggcgacagctcgatatcgcggacatgagaggcccgtggctgcgttgggctccgggaagccgttcgggctggggctgtcggccgcggggcggaggcactcgcgcggggggggtaattcggggtctgggttctggtgccgcgcagctttccccggattgacttggcctctacttcttgttaaggaaattcatctcttgttttatcagatggcccactgcgtgaccttggttcagctgtccatttcctgtgaccatctcattgacaaggacatcggctccaagtctgacccactctgcgtccttttacaggatgtgggagggggcagctgggctgagcttggccggactgaacgggtgcggaactgctcaagccctgagttctccaagactctacagcttgagtaccgctttgagacagtccagaagctacgctttggaatctatgacatagacaacaagacgccagagctgagggatgatgacttcctagggggtgctgagtgttccctaggacagattgtgtccagccaggtactgactctccccttgatgctgaagcctggaaaacctgctgggcgggggaccatcacggacttcctgggaaaatcagatccatttctggagttcttccgccagggtgatgggaaatggcacctggtgtacagatctgaggtcatcaagaacaacctgaaccctacatggaagcgtttctcagtccccgttcagcatttctgtggtgggaaccccagcacacccatccaggtgcaatgctccgattatgacagtgacgggtcacatgatctcatcggtaccttccacaccagcttggcccagctgcaggcagtcccggctgagtttgaatgcatccaccctgagaagcagcagaaaaagaaaagctacaagaactctggaactatccgtgtcaagatttgtcgggtgagacaaaagcccatgtaaccaaggctctgattcctgagctccatgacaccaactgctatcaccccaggcatgaccctggtttcatttgcaggtagaaacagagtactcctttctggactatgtgatgggaggctgtcagatcaacttcactgtgggcgtggacttcactggctccaatggagacccctcctcacctgactccctacactacctgagtccaacaggggtcaatgagtacctgatggcactgtggagtgtgggcagcgtggttcaggactatgactcagacaagctgttccctgcatttggatttggggcccaggttccccctgactggcaggtctcgcatgaatttgccttgaatttcaaccccagtaacccctactgtgcaggcatccagggcattgtggatgcctaccgccaagccctgccccaagttcgcctctatggccctaccaactttgcacccatcatcaaccatgtggccaggtttgcagcccaggctgcacatcaggggactgcctcgcaatacttcatgctgttgctgctgactgatggtgctgtgacggatgtggaagccacacgtgaggctgtggtgcgtgcctcgaacctgcccatgtcagtgatcattgtgggtgtgggtggtgctgactttgaggccatggagcagctggacgctgatggtggacccctgcatacacgttctgggcaggctgctgcccgcgacattgtgcagtttgtaccctaccgccggttccagaatgcccctcgggaggcattggcacagaccgtgctcgcagaagtgcccacacaactggtctcatacttcagggcccagggttgggccccgctcaagccacttccaccctcagccaaggatcctgcacaggccccccaggcctaggttcccttggaggctgtggcaagtcctcaatcctgtgtcccagaggtccctctgggccacaacccaacccttctcactctcctcagtgctagcactttgtattttttgatacttttatacttgtttctgcttttgctgctcttgatcccacctttgctcctgacaaccctcattcaataaagaccagtgaagaccaa

SEQ ID NO: 446085 - DNA, 7409 bp, Homo sapiens
ctcgacgagccggactttctgtgacaacgtgcgacacggacggctggctggcctgcgctcgcggcatccaggcgacagctcgatatcgcggacatgagaggcccgtggctgcgttgggctccgggaagccgttcgggctggggctgtcggccgcggggcggaggcactcgcgcggggggggtaattcggggtctgggttctggtgccgcgcagctttccccgtctaaaagttggttttaattggttgcccacaggattgacttggcctctacttcttgttaaggaaattcatctcttgttttatcaggtgtgtgtggtttcagcgcagcatggctgtggtcatccgtttgcaaggtctcccaattgtggcggggaccatggacattcgccacttcttctctggattgaccattcctgatgggggcgtgcatattgtagggggtgaactgggtgaggctttcatcgtttttgccactgatgaagatgcaaggcttggtatgatgcgcacaggtggtacaattaaagggtcaaaagtaacactattgttgagtagtaagacggaaatgcagaatatgattgaactgagtcgtaggcgttttgaaactgccaacttagatataccaccagcaaatgccagtagatcaggaccaccacctagctcaggaatgagtagcagggtaaacttgcccacaacagtatccaactttaataatccatcacccagtgtagttactgccaccacttctgttcatgaaagcaacaaaaacatacagacattttccacagccagcgtaggaacagctcctccaaatatgggggcttcctttgggagcccaacgtttagctcaactgttccaagcacagcctctccaatgaacacagtcccgccgccaccaattcctccaattccagcgatgccatctctgccaccaatgccatccattcccccaattccagttcctcctccagtacctacattgcctcctgtgcctcctgtgcccccgattcccccagttccttctgtgccacccatgaccccactgccacccatgtcgggcatgccgcccttgaatccgccacctgtggcacctctacctgctggaatgaatggctctggagcacctatgaatttgaacaataatctgaatcctatgtttcttggtccgttgaatcctgttaaccctatccagatgaactctcagagcagtgtgaagccactccccatcaaccctgatgatctgtatgtcagtgtgcatggaatgcccttttctgcaatggaaaatgatgtcagagatttttttcatgggctccgtgttgatgcagtgcatttgttgaaagatcatgtaggtcgaaataatgggaatggattggttaagtttctctcccctcaagatacatttgaagctttgaaacgaaacagaatgctgatgattcaacgctatgtggaagttagccctgccacagaaagacagtgggtagctgctggaggccatatcacttttaagcaaaatatgggaccttctggacaaactcatccccctcctcagacacttcccaggtcaaaatcgcccagtgggcagaaaagatcaaggtcaagatcaccacatgaggctggtttttgtgtttacttgaaagggctaccatttgaagcagaaaacaaacatgtcattgatttttttaaaaagctggatattgtggaagatagtatttatatagcttatggacccaatgggaaagcaactggcgaaggctttgtagagttcagaaatgaggctgactataaggctgctctgtgtcgtcataaacagtacatgggcaatcgctttattcaagttcatccaattactaagaaaggtatgctagaaaagatagatatgattcgaaaaagactgcagaacttcagctatgaccagagggaaatgatactaaatccagagggggatgtcaactctgccaaagtctgtgcccacataacaaatattccattcagcattacaaagatggatgttcttcagttcctagaaggaatcccagtggatgaaaatgctgtacatgttcttgttgataacaatgggcaaggtctaggacaggcattggttcagtttaaaaatgaagatgatgcacgtaagtctgaacgcttacaccgtaaaaaacttaatgggagagaagcttttgttcatgtagttaccctagaagatatgagagagattgagaaaaatccccctgcccaaggaaaaaagggattaaagatgcctgtgccaggtaatcctgcagttccaggaatgcccaatgcgggactgcccggtgtgggactgcccagtgcaggacttcccggtgcaggcctgcccagcacaggactgcctggttcagcaataaccagtgcaggactgcctggtgcgggaatgcccagtgcaggaatacctagtgcaggaggtgaagagcatgccttcctgactgtaggatcaaaggaagccaataatgggcctccatttaactttcctggtaattttggtggatcaaatgcctttgggccaccaatccctcctccaggattaggaggcggggcctttggtgatgctaggcctggtatgccttcagttggaaacagtggtttgcctggtctaggactggatgttccgggttttggaggtggaccaaacaatttaagtgggccatcgggatttggagggggccctcagaattttggaaatggccctggtagcttaggcggtcccccggggtttggaagtggccctcctggtcttggaagtgcccctgggcatttgggtgggccaccagcttttgggcctggccccggccccggccccggccctggcccaatccatattggtggtccccctggctttgcatctagttctggaaaaccaggaccgacagtaattaaagtgcaaaacatgccctttactgtgtctattgatgagattttagatttcttttatggctatcaagtaatcccaggctcagtgtgtttaaaatacaatgaaaaaggtatgcccacaggtgaagccatggtggcctttgagtctcgggatgaagccacagctgctgtcattgacttaaatgacaggcctataggttcaagaaaagtaaaacttgtattagggtagccattcacatcattttttatagggtagatcttcatattgctgtgattaatgcatccagattgttttcctagtatttccaggttagaacctgtggattgtttcaattgcatatagcttggtttccataacatagagcattggttgactgtttacagaagactcactcaccaggataaacattgctgtatgttacagtaaagctatctggagagaacacataaatgattttggcataccattagagaaaccatttgtaaaactcaaatgaccacataaagcttatcaaggagtctagattggttttgttttataccatatgggatgaagaaaatagaaatgtcagtagaactcattgagggtgctcttgccagctgctgaaaatagaagttggctactctcagaatttggtttaaagctggacagatttgctttgttatagggtaaagctttgtctaaagtcctcattttcttttaaaattgaataaaatttctgtatacagattcattgtatgtacctttattgcttcttaagggtccttgctgtatagacagtcctgcttcagaagttgctgctttgtttgtctaattgactcatttgtaaatgagcagaactgttttgttggtttttttccctaaatataaaagtccacacttcgtttgtgctataacctcaaactttgatttctaatgtcacacttaaaactgtgtggaataagacttttgccataaaaataaactatggagtcctttatctaccagagcctttttggtttgaccgccacgatttaggttagtcagtttaaaaattgttcatgttgtttggatggtatcgaaaaccagaaaccacttttaataatgtgtttaagatacttgatttgaagtccttttcatatggactaattgtagtatcaatttcctcctgtcccgattatgtgaaattttggcctttaaacaaagaggggcccattcataagaaagtgttatatctaggtttttaaaactgaagttgaaattatctttgttagcagtagtagtatagaataaaagatccgtatgctggttcgtagattgatacgtgttagtcctgttatttggaggctttttggcatagttgttcgatcaggagcctgtttactaaaagtcttcatacagagtacaagtgcagccgccagaggagaaaattgagattcttgaccctttcatactcttttctttggtattcaggacactaaggcaggaggaccacatgagttctggttggtaagtgtccttgtcatgaaaacacttgccttacaaggctctaattatgatttccctagtcagtgctctgaagatgtgtcacattatattataaacaatacggaaggggagataggtgagatgatatgaaaaacaaattttctcactgtcataaaaggctctaattatggttactttccttgtgatgaaaaacttggccttacagggctctagttatggttactttccctagtcaatgctctgaaaatgtgtcacattataaacaatacagaaggagagatagatgagagatcatgaaaaccaaattttatcttttacatggcccctttgtcttcgtttgaaacatccccaacatttcctacaaatcagcgtagttacaaaggggtcagtcttttaaaataagtatttcctattaaactatatatatatacagtgcctttttggtgttgtgagtcagtggaacactgaaatacagcggttgtgtaatttaagagtggcaacagtttcatttgataagatttgaaaaggctttttatcactacaatcttagaggattgacagtacaggatttttgtttaagagaaggattgtttagactcaagaggtgactatgttgtgggtcttttgataattcatgaatacagatttgctttgaccgatcactagatactgcctcctcaatttcaaaagcaatataacgtttgtatatgctgtttaatttaagttaatgttaagtaatcatttctcattccaaagacaatgcaaaaaacttcagcactgcttgagagttgtatttcagccacagatattttctccattggaaagctattttcattttagaaaaatgggttgtttgaagatgaaagtcttttatcttttttcacaatttattttggttatatgttcgtacattcttattaaatatttcatacactttattgcaactactttgttatttctacatcttagataaatgctgaaaaggaaaacgatttcattgttcatctaattaaataaattaaaagagcggtttgtgtagaaattggagagaactatgttttatatgaatcacaacagtgctcgttgtggactgtaattaaatgctttgccctctggaacttgatttttgtgtatctgagatttattaacagtgctaactgctaaggatactgtttatcttgttctgggcattggagtttcagtttttaaaaaattcttgaaaatgtattctgtgaaactactcatacctctcttcctgcgaattttctcctaagaactaggtttggggtagaaatgaattgacattattttctcatttgctttgtatggtatgaaggatttgtaaagctttgctcaaagttgtgtgcatttgtaaacactatcatgatattttcaattttatgtgtaaattttattgtctgtttttggtgactctgacattaatggaagagaatattttccattagatttaattttttttcctctcccttctgattttttttttattggtgttcatttttcttttgatttaaaggattagagaaatctacaaatgtatgtcataaataagcaaatttgtaaacttttctgaactttagtgaaacatttagttcacaagcataatttggaggtgtgttctgtgtttacacagtagtttggatgtacaattattattagtggctttttaaaaaatgaaacagtgttaagtgaaatgtagttcctagctttgtactccaagttgtcaaagcatcaacaatgaaaattcgattaggaaactttatttaaaatttcaggtagtaatattcagtgtagttaaggccagtcttaacccactggatgaaaatctaggactgtatggaagtaagcaaacattacatttttaggtggaaatagtcagccttgcataaaaacaaggatgcgtgaaagccttaaattccagctcccttttactggagtctgtggttgtgtacaggtatgggccaagtgtaaaatctcatcaattttaagaacactcgggaaatgagtaaagaaaatgtaaaattgctgctagtcaaatcttttggaaagaatttctggaagtggtcactttaaaaattattttccacccttgcaaaattgccacatttaaattgttttactggcagttctatagtagtccagactttagaaaccaaacacaacaaaatggcttgttgccaatatggccacaacattgccagcaaatactgccttggcatcactcagcagaggtttttgtttataaagatgaagtcttgaatactgttcaataaacttgtcaaaaaataaaacaggctgatgcttttaatgctttaactgcacaaaagtactttactgagctataatattatcttgtcagggtttttgttttgttttgtttttaaacctgaaaatattttgtgcctttggagaggtagatttggtaatcttggagaggtaaaaattgttgcttatccttgcctgctaatgctgaagtgtcaagagaagaggatacttggaacagcagggaggaaacttgattcaagtccatagtatccaccttttcagaattttatgtgtatgatgtgttggcaaacaaagcccttaaatgttgaaaactttttatcttgaaagagtttagcttgtattagaatttggatacccagtgtgttttagagggggctagacatataattccaggtagtagctgagccattattaaataatcgggatttgactaagcaatggacaaatcactgagtgaaatcagctgcctacagatatccaaaatggcttttaccatctgaaaggggtggactgtgtgataatatgtctccttttcttgttcaggagagatcagttatgtaattcattgttacctgctttccagtgttttacagcaagaaatagtttatcaactatgtgcatcatcactaatctcccaaaagtagagcttttacagggtatggtagaatcaaacttatggctttccttttttattaaaaatggctttatttcagtctt

SEQ ID NO: 446086 - DNA, 4120 bp, Homo sapiens
ctcgacgagccggactttctgtgacaacgtgcgacacggacggctggctggcctgcgctcgcggcatccaggcgacagctcgatatcgcggacatgagaggcccgtggctgcgttgggctccgggaagccgttcgggctggggctgtcggccgcggggcggaggcactcgcgcggggggggtaattcggggtctgggttctggtgccgcgcagctttccccgtctaaaagttggttttaattggttgcccacaggattgacttggcctctacttcttgttaaggaaattcatctcttgttttatcaggtgtgtgtggtttcagcgcagcatggctgtggtcatccgtttgcaaggtctcccaattgtggcggggaccatggacattcgccacttcttctctggattgaccattcctgatgggggcgtgcatattgtagggggtgaactgggtgaggctttcatcgtttttgccactgatgaagatgcaaggcttggtatgatgcgcacaggtggtacaattaaagggtcaaaagtaacactattgttgagtagtaagacggaaatgcagaatatgattgaactgagtcgtaggcgttttgaaactgccaacttagatataccaccagcaaatgccagtagatcaggaccaccacctagctcaggaatgagtagcagggtaaacttgcccacaacagtatccaactttaataatccatcacccagtgtagttactgccaccacttctgttcatgaaagcaacaaaaacatacagacattttccacagccagcgtaggaacagctcctccaaatatgggggcttcctttgggagcccaacgtttagctcaactgttccaagcacagcctctccaatgaacacagtcccgccgccaccaattcctccaattccagcgatgccatctctgccaccaatgccatccattcccccaattccagttcctcctccagtacctacattgcctcctgtgcctcctgtgcccccgattcccccagttccttctgtgccacccatgaccccactgccacccatgtcgggcatgccgcccttgaatccgccacctgtggcacctctacctgctggaatgaatggctctggagcacctatgaatttgaacaataatctgaatcctatgtttcttggtccgttgaatcctgttaaccctatccagatgaactctcagagcagtgtgaagccactccccatcaaccctgatgatctgtatgtcagtgtgcatggaatgcccttttctgcaatggaaaatgatgtcagagatttttttcatgggctccgtgttgatgcagtgcatttgttgaaagatcatgtaggtcgaaataatgggaatggattggttaagtttctctcccctcaagatacatttgaagctttgaaacgaaacagaatgctgatgattcaacgctatgtggaagttagccctgccacagaaagacagtgggtagctgctggaggccatatcacttttaagcaaaatatgggaccttctggacaaactcatccccctcctcagacacttcccaggtcaaaatcgcccagtgggcagaaaagatcaaggtcaagatcaccacatgaggctggtttttgtgtttacttgaaagggctaccatttgaagcagaaaacaaacatgtcattgatttttttaaaaagctggatattgtggaagatagtatttatatagcttatggacccaatgggaaagcaactggcgaaggctttgtagagttcagaaatgaggctgactataaggctgctctgtgtcgtcataaacagtacatgggcaatcgctttattcaagttcatccaattactaagaaaggtatgctagaaaagatagatatgattcgaaaaagactgcagaacttcagctatgaccagagggaaatgatactaaatccagagggggatgtcaactctgccaaagtctgtgcccacataacaaatattccattcagcattacaaagatggatgttcttcagttcctagaaggaatcccagtggatgaaaatgctgtacatgttcttgttgataacaatgggcaaggtctaggacaggcattggttcagtttaaaaatgaagatgatgcacatggcccactgcgtgaccttggttcagctgtccatttcctgtgaccatctcattgacaaggacatcggctccaagtctgacccactctgcgtccttttacaggatgtgggagggggcagctgggctgagcttggccggactgaacgggtgcggaactgctcaagccctgagttctccaagactctacagcttgagtaccgctttgagacagtccagaagctacgctttggaatctatgacatagacaacaagacgccagagctgagggatgatgacttcctagggggtgctgagtgttccctaggacagattgtgtccagccaggtactgactctccccttgatgctgaagcctggaaaacctgctgggcgggggaccatcacggtctcagctcaggaattaaaggacaatcgtgtagtaaccatggaggtagaggccagaaacctagataagaaggacttcctgggaaaatcagatccatttctggagttcttccgccagggtgatgggaaatggcacctggtgtacagatctgaggtcatcaagaacaacctgaaccctacatggaagcgtttctcagtccccgttcagcatttctgtggtgggaaccccagcacacccatccaggtgcaatgctccgattatgacagtgacgggtcacatgatctcatcggtaccttccacaccagcttggcccagctgcaggcagtcccggctgagtttgaatgcatccaccctgagaagcagcagaaaaagaaaagctacaagaactctggaactatccgtgtcaagatttgtcgggtagaaacagagtactcctttctggactatgtgatgggaggctgtcagatcaacttcactgtgggcgtggacttcactggctccaatggagacccctcctcacctgactccctacactacctgagtccaacaggggtcaatgagtacctgatggcactgtggagtgtgggcagcgtggttcaggactatgactcagacaagctgttccctgcatttggatttggggcccaggttccccctgactggcaggtctcgcatgaatttgccttgaatttcaaccccagtaacccctactgtgcaggcatccagggcattgtggatgcctaccgccaagccctgccccaagttcgcctctatggccctaccaactttgcacccatcatcaaccatgtggccaggtttgcagcccaggctgcacatcaggggactgcctcgcaatacttcatgctgttgctgctgactgatggtgctgtgacggatgtggaagccacacgtgaggctgtggtgcgtgcctcgaacctgcccatgtcagtgatcattgtgggtgtgggtggtgctgactttgaggccatggagcagctggacgctgatggtggacccctgcatacacgttctgggcaggctgctgcccgcgacattgtgcagtttgtaccctaccgccggttccagaatgtgagtaggtgcaaatttgatctgggagtttaccctttcacctttccctgatgtgagtagggttgaggcccaagggatgctcaccttttcctctaagcctgggatatggttgggttcttgggcatgaaatacagactttgggcagctgttctgggccaccactgacttttcccttttcttggcaggcccctcgggaggcattggcacagaccgtgctcgcagaagtgcccacacaactggtctcatacttcagggcccagggttgggccccgctcaagccacttccaccctcagccaaggatcctgcacaggccccccaggcctaggttcccttggaggctgtggcaagtcctcaatcctgtgtcccagaggtccctctgggccacaacccaacccttctcactctcctcagtgctagcactttgtattttttgatacttttatacttgtttctgcttttgctgctcttgatcccacctttgctcctgacaaccctcattcaataaagaccagtgaagaccaa

SEQ ID NO: 446087 - DNA, 5839 bp, Homo sapiens
ctcgacgagccggactttctgtgacaacgtgcgacacggacggctggctggcctgcgctcgcggcatccaggcgacagctcgatatcgcggacatgagaggcccgtggctgcgttgggctccgggaagccgttcgggctggggctgtcggccgcggggcggaggcactcgcgcggggggggtaattcggggtctgggttctggtgccgcgcagctttccccgtctaaaagttggttttaattggttgcccacaggattgacttggcctctacttcttgttaaggaaattcatctcttgttttatcaggtgtgtgtggtttcagcgcagcatggctgtggtcatccgtttgcaaggtctcccaattgtggcggggaccatggacattcgccacttcttctctggattgaccattcctgatgggggcgtgcatattgtagggggtgaactgggtgaggctttcatcgtttttgccactgatgaagatgcaaggcttggtatgatgcgcacaggtggtacaattaaagggtcaaaagtaacactattgttgagtagtaagacggaaatgcagaatatgattgaactgagtcgtaggcgttttgaaactgccaacttagatataccaccagcaaatgccagtagatcaggaccaccacctagctcaggaatgagtagcagggtaaacttgcccacaacagtatccaactttaataatccatcacccagtgtagttactgccaccacttctgttcatgaaagcaacaaaaacatacagacattttccacagccagcgtaggaacagctcctccaaatatgggggcttcctttgggagcccaacgtttagctcaactgttccaagcacagcctctccaatgaacacagtcccgccgccaccaattcctccaattccagcgatgccatctctgccaccaatgccatccattcccccaattccagttcctcctccagtacctacattgcctcctgtgcctcctgtgcccccgattcccccagttccttctgtgccacccatgaccccactgccacccatgtcgggcatgccgcccttgaatccgccacctgtggcacctctacctgctggaatgaatggctctggagcacctatgaatttgaacaataatctgaatcctatgtttcttggtccgttgaatcctgttaaccctatccagatgaactctcagagcagtgtgaagccactccccatcaaccctgatgatctgtatgtcagtgtgcatggaatgcccttttctgcaatggaaaatgatgtcagagatttttttcatgggctccgtgttgatgcagtgcatttgttgaaagatcatgtaggtcgaaataatgggaatggattggttaagtttctctcccctcaagatacatttgaagctttgaaacgaaacagaatgctgatgattcaacgctatgtggaagttagccctgccacagaaagacagtgggtagctgctggaggccatatcacttttaagcaaaatatgggaccttctggacaaactcatccccctcctcagacacttcccaggtcaaaatcgcccagtgggcagaaaagatcaaggtcaagatcaccacatgaggctggtttttgtgtttacttgaaagggctaccatttgaagcagaaaacaaacatgtcattgatttttttaaaaagctggatattgtggaagatagtatttatatagcttatggacccaatgggaaagcaactggcgaaggctttgtagagttcagaaatgaggctgactataaggctgctctgtgtcgtcataaacagtacatgggcaatcgctttattcaagttcatccaattactaagaaaggtatgctagaaaagatagatatgattcgaaaaagactgcagaacttcagctatgaccagagggaaatgatactaaatccagagggggatgtcaactctgccaaagtctgtgcccacataacaaatattccattcagcattacaaagatggatgttcttcagttcctagaaggaatcccagtggatgaaaatgctgtacatgttcttgttgataacaatgggcaaggtctaggacaggcattggttcagtttaaaaatgaagatgatgcacgtaagtctgaacgcttacaccgtaaaaaacttaatgggagagaagcttttgttcatgtagttaccctagaagatatgagagagattgagaaaaatccccctgcccaaggaaaaaagggattaaagatgcctgtgccaggtaatcctgcagttccaggaatgcccaatgcgggactgcccggtgtgggactgcccagtgcaggacttcccggtgcaggcctgcccagcacaggactgcctggttcagcaataaccagtgcaggactgcctggtgcgggaatgcccagtgcaggaatacctagtgcaggaggtgaagagcatgccttcctgactgtaggatcaaaggaagccaataatgggcctccatttaactttcctggtaattttggtggatcaaatgcctttgggccaccaatccctcctccaggattaggaggcggggcctttggtgatgctaggcctggtatgccttcagttggaaacagtggtttgcctggtctaggactggatgttccgggttttggaggtggaccaaacaatttaagtgggccatcgggatttggagggggccctcagaattttggaaatggccctggtagcttaggcggtcccccggggtttggaagtggccctcctggtcttggaagtgcccctgggcatttgggtgggccaccagcttttgggcctggccccggccccggccccggccctggcccaatccatattggtggtccccctggctttgcatctagttctggaaaaccaggaccgacagtaattaaagtgcaaaacatgccctttactgtgtctattgatgagattttagatttcttttatggctatcaagtaatcccaggctcagtgtgtttaaaatacaatgaaaaaggtatgcccacaggtgaagccatggtggcctttgagtctcgggatgaagccacagctgctgtcattgacttaaatgacaggcctataggttcaagaaaagtaaaacttgtattagggtagccattcacatcattttttatagggtagatcttcatattgctgtgattaatgcatccagattgttttcctagtatttccaggttagaacctgtggattgtttcaattgcatatagcttggtttccataacatagagcattggttgactgtttacagaagactcactcaccaggataaacattgctgtatgttacagtaaagctatctggagagaacacataaatgattttggcataccattagagaaaccatttgtaaaactcaaatgaccacataaagcttatcaaggagtctagattggttttgttttataccatatgggatgaagaaaatagaaatgtcagtagaactcattgagggtgctcttgccagctgctgaaaatagaagttggctactctcagaatttggtttaaagctggacagatttgctttgttatagggtaaagctttgtctaaagtcctcattttcttttaaaattgaataaaatttctgtatacagattcattgtatgtacctttattgcttcttaagggtccttgctgtatagacagtcctgcttcagaagttgctgctttgtttgtctaattgactcatttgtaaatgagcagaactgttttgttggtttttttccctaaatataaaagtccacacttcgtttgtgctataacctcaaactttgatttctaatgtcacacttaaaactgtgtggaataagacttttgccataaaaataaactatggagtcctttatctaccagagcctttttggtttgaccgccacgatttaggttagtcagtttaaaaattgttcatgttgtttggatggtatcgaaaaccagaaaccacttttaataatgtgtttaagatacttgatttgaagtccttttcatatggactaattgtagtatcaatttcctcctgtcccgattatgtgaaattttggcctttaaacaaagaggggcccattcataagaaagtgttatatctaggtttttaaaactgaagttgaaattatctttgttagcagtagtagtatagaataaaagatccgtatgctggttcgtagattgatacgtgttagtcctgttatttggaggctttttggcatagttgttcgatcaggagcctgtttactaaaagtcttcatacagagtacaagtgcagccgccagaggagaaaattgagattcttgaccctttcatactcttttctttggtattcaggacactaaggcaggaggaccacatgagttctggttggtaagtgtccttgtcatgaaaacacttgccttacaaggctctaattatgatttccctagtcagtgctctgaagatgtgtcacattatattataaacaatacggaaggggagataggtgagatgatatgaaaaacaaattttctcactgtcataaaaggctctaattatggttactttccttgtgatgaaaaacttggccttacagggctctagttatggttactttccctagtcaatgctctgaaaatgtgtcacattataaacaatacagaaggagagatagatgagagatcatgaaaaccaaattttatcttttacatggcccctttgtcttcgtttgaaacatccccaacatttcctacaaatcagcgtagttacaaaggggtcagtcttttaaaataagtatttcctattaaactatatatatatacagtgcctttttggtgttgtgagtcagtggaacactgaaatacagcggttgtgtaatttaagagtggcaacagtttcatttgataagatttgaaaaggctttttatcactacaatcttagaggattgacagtacaggatttttgtttaagagaaggattgtttagactcaagaggtgactatgttgtgggtcttttgataattcatgaatacagatttgctttgaccgatcactagatactgcctcctcaatttcaaaagcaatataacgtttgtatatgctgtttaatttaagttaatgttaagtaatcatttctcattccaaagacaatgcaaaaaacttcagcactgcttgagagttgtatttcagccacagatattttctccattggaaagctattttcattttagaaaaatgggttgtttgaagatgaaagtcttttatcttttttcacaatttattttggttatatgttcgtacattcttattaaatatttcatacactttattgcaactactttgttatttctacatcttagataaatgctgaaaaggaaaacgatttcattgttcatctaattaaataaattaaaagagcggtttgtgtagaaattggagagaactatgttttatatgaatcacaacagtgctcgttgtggactgtaattaaatgctttgccctctggaacttgaaaaaaaaaaacagacaacaaccaaacccaagcaaccacaatacacaccaagccactcccgaacgacagacccacgcaacgagaaccgacacccacgaacactccacccacacacgagacagcaggacaaaacaaaacaagttgtccgggcgccaccccgccacaactatataacacaacccggcgggccgcgccccacgatgaatatcgcagtgagacggtcgacagacaacggcgataaagcgcggttcccacaaaaaaacgcggcgggaacggggctaacaacaggtcggccgcggtgatcaaggagaagcagcaaaaccgcgcgt

SEQ ID NO: 446088 - DNA, 3770 bp, Homo sapiens
ctcgacgagccggactttctgtgacaacgtgcgacacggacggctggctggcctgcgctcgcggcatccaggcgacagctcgatatcgcggacatgagaggcccgtggctgcgttgggctccgggaagccgttcgggctggggctgtcggccgcggggcggaggcactcgcgcggggggggtaattcggggtctgggttctggtgccgcgcagctttccccgtctaaaagttggttttaattggttgcccacaggattgacttggcctctacttcttgttaaggaaattcatctcttgttttatcaggtgtgtgtggtttcagcgcagcatggctgtggtcatccgtttgcaaggtctcccaattgtggcggggaccatggacattcgccacttcttctctggattgaccattcctgatgggggcgtgcatattgtagggggtgaactgggtgaggctttcatcgtttttgccactgatgaagatgcaaggcttggtatgatgcgcacaggtggtacaattaaagggtcaaaagtaacactattgttgagtagtaagacggaaatgcagaatatgattgaactgagtcgtaggcgttttgaaactgccaacttagatataccaccagcaaatgccagtagatcaggaccaccacctagctcaggaatgagtagcagggtaaacttgcccacaacagtatccaactttaataatccatcacccagtgtagttactgccaccacttctgttcatgaaagcaacaaaaacatacagacattttccacagccagcgtaggaacagctcctccaaatatgggggcttcctttgggagcccaacgtttagctcaactgttccaagcacagcctctccaatgaacacagtcccgccgccaccaattcctccaattccagcgatgccatctctgccaccaatgccatccattcccccaattccagttcctcctccagtacctacattgcctcctgtgcctcctgtgcccccgattcccccagttccttctgtgccacccatgaccccactgccacccatgtcgggcatgccgcccttgaatccgccacctgtggcacctctacctgctggaatgaatggctctggagcacctatgaatttgaacaataatctgaatcctatgtttcttggtccgttgaatcctgttaaccctatccagatgaactctcagagcagtgtgaagccactccccatcaaccctgatgatctgtatgtcagtgtgcatggaatgcccttttctgcaatggaaaatgatgtcagagatttttttcatgggctccgtgttgatgcagtgcatttgttgaaagatcatgtaggtcgaaataatgggaatggattggttaagtttctctcccctcaagatacatttgaagctttgaaacgaaacagaatgctgatgattcaacgctatgtggaagttagccctgccacagaaagacagtgggtagctgctggaggccatatcacttttaagcaaaatatgggaccttctggacaaactcatccccctcctcagacacttcccaggtcaaaatcgcccagtgggcagaaaagatcaaggtcaagatcaccacatgaggctggtttttgtgtttacttgaaagggctaccatttgaagcagaaaacaaacatgtcattgatttttttaaaaagctggatattgtggaagatagtatttatatagcttatggacccaatgggaaagcaactggcgaaggctttgtagagttcagaaatgaggctgactataaggctgctctgtgtcgtcataaacagtacatgggcaatcgctttattcaagttcatccaattactaagaaaggtatgctagaaaagatagatatgattcgaaaaagactgcagaacttcagctatgaccagagggaaatgatactaaatccagagggggatgtcaactctgccaaagtctgtgcccacataacaaatattccattcagcattacaaagatggatgttcttcagttcctagaaggaatcccagtggatgaaaatgctgtacatgttcttgttgataacaatgggcaaggtctaggacaggcattggttcagtttaaaaatgaagatgatgcacatggcccactgcgtgaccttggttcagctgtccatttcctgtgaccatctcattgacaaggacatcggctccaagtctgacccactctgcgtccttttacaggatgtgggagggggcagctgggctgagcttggccggactgaacgggtgcggaactgctcaagccctgagttctccaagactctacagcttgagtaccgctttgagacagtccagaagctacgctttggaatctatgacatagacaacaagacgccagagctgagggatgatgacttcctagggggtgctgagtgttccctaggacagattgtgtccagccaggtactgactctccccttgatgctgaagcctggaaaacctgctgggcgggggaccatcacggtctcagctcaggaattaaaggacaatcgtgtagtaaccatggaggtagaggccagaaacctagataagaaggacttcctgggaaaatcagatccatttctggagttcttccgccagggtgatgggaaatggcacctggtgtacagatctgaggtcatcaagaacaacctgaaccctacatggaagcgtttctcagtccccgttcagcatttctgtggtgggaaccccagcacacccatccaggtgcaatgctccgattatgacagtgacgggtcacatgatctcatcggtaccttccacaccagcttggcccagctgcaggcagtcccggctgagtttgaatgcatccaccctgagaagcagcagaaaaagaaaagctacaagaactctggaactatccgtgtcaagatttgtcgggtagaaacagagtactcctttctggactatgtgatgggaggctgtcagatcaacttcactgtgggcgtggacttcactggctccaatggagacccctcctcacctgactccctacactacctgagtccaacaggggtcaatgagtacctgatggcactgtggagtgtgggcagcgtggttcaggactatgactcagacaagctgttccctgcatttggatttggggcccaggttccccctgactggcaggtctcgcatgaatttgccttgaatttcaaccccagtaacccctactgtgcaggcatccagggcattgtggatgcctaccgccaagccctgccccaagttcgcctctatggccctaccaactttgcacccatcatcaaccatgtggccaggtttgcagcccaggctgcacatcaggggactgcctcgcaatacttcatgctgttgctgctgactgatggtgctgtgacggatgtggaagccacacgtgaggctgtggtggcccctcgggaggcattggcacagaccgtgctcgcagaagtgcccacacaactggtctcatacttcagggcccagggttgggccccgctcaagccacttccaccctcagccaaggatcctgcacaggccccccaggcctaggttcccttggaggctgtggcaagtcctcaatcctgtgtcccagaggtccctctgggccacaacccaacccttctcactctcctcagtgctagcactttgtattttttgatacttttatacttgtttctgcttttgctgctcttgatcccacctttgctcctgacaaccctcattcaataaagaccagtgaagaccaa

SEQ ID NO: 446089 - DNA, 3879 bp, Homo sapiens
ctcgacgagccggactttctgtgacaacgtgcgacacggacggctggctggcctgcgctcgcggcatccaggcgacagctcgatatcgcggacatgagaggcccgtggctgcgttgggctccgggaagccgttcgggctggggctgtcggccgcggggcggaggcactcgcgcggggggggtaattcggggtctgggttctggtgccgcgcagctttccccgtctaaaagttggttttaattggttgcccacaggattgacttggcctctacttcttgttaaggaaattcatctcttgttttatcaggtgtgtgtggtttcagcgcagcatggctgtggtcatccgtttgcaaggtctcccaattgtggcggggaccatggacattcgccacttcttctctggattgaccattcctgatgggggcgtgcatattgtagggggtgaactgggtgaggctttcatcgtttttgccactgatgaagatgcaaggcttggtatgatgcgcacaggtggtacaattaaagggtcaaaagtaacactattgttgagtagtaagacggaaatgcagaatatgattgaactgagtcgtaggcgttttgaaactgccaacttagatataccaccagcaaatgccagtagatcaggaccaccacctagctcaggaatgagtagcagggtaaacttgcccacaacagtatccaactttaataatccatcacccagtgtagttactgccaccacttctgttcatgaaagcaacaaaaacatacagacattttccacagccagcgtaggaacagctcctccaaatatgggggcttcctttgggagcccaacgtttagctcaactgttccaagcacagcctctccaatgaacacagtcccgccgccaccaattcctccaattccagcgatgccatctctgccaccaatgccatccattcccccaattccagttcctcctccagtacctacattgcctcctgtgcctcctgtgcccccgattcccccagttccttctgtgccacccatgaccccactgccacccatgtcgggcatgccgcccttgaatccgccacctgtggcacctctacctgctggaatgaatggctctggagcacctatgaatttgaacaataatctgaatcctatgtttcttggtccgttgaatcctgttaaccctatccagatgaactctcagagcagtgtgaagccactccccatcaaccctgatgatctgtatgtcagtgtgcatggaatgcccttttctgcaatggaaaatgatgtcagagatttttttcatgggctccgtgttgatgcagtgcatttgttgaaagatcatgtaggtcgaaataatgggaatggattggttaagtttctctcccctcaagatacatttgaagctttgaaacgaaacagaatgctgatgattcaacgctatgtggaagttagccctgccacagaaagacagtgggtagctgctggaggccatatcacttttaagcaaaatatgggaccttctggacaaactcatccccctcctcagacacttcccaggtcaaaatcgcccagtgggcagaaaagatcaaggtcaagatcaccacatgaggctggtttttgtgtttacttgaaagggctaccatttgaagcagaaaacaaacatgtcattgatttttttaaaaagctggatattgtggaagatagtatttatatagcttatggacccaatgggaaagcaactggcgaaggctttgtagagttcagaaatgaggctgactataaggctgctctgtgtcgtcataaacagtacatgggcaatcgctttattcaagttcatccaattactaagaaaggtatgctagaaaagatagatatgattcgaaaaagactgcagaacttcagctatgaccagagggaaatgatactaaatccagagggggatgtcaactctgccaaagtctgtgcccacataacaaatattccattcagcattacaaagatggatgttcttcagttcctagaaggaatcccagtggatgaaaatgctgtacatgttcttgttgataacaatgggcaaggtctaggacaggcattggttcagtttaaaaatgaagatgatgcacgtaagtctgaacgcttacaccgtaaaaaacttaatgggagagaagcttttgttcatgtagttaccctagaagatatgagagagattgagaaaaatccccctgcccaaggaaaaaagggattaaagatgcctgtgccaggtaatcctgcagttccaggaatgcccaatgcgggactgcccggtgtgggactgcccagtgcaggacttcccggtgcaggcctgcccagcacaggactgcctggttcagcaataaccagtgcaggactgcctggtgcgggaatgcccagtgcaggaatacctagtgcaggaggtgaagagcatgccttcctgactgtaggatcaaaggaagccaataatgggcctccatttaactttcctggtaattttggtggatcaaatgcctttgggccaccaatccctcctccaggattaggaggcggggcctttggtgatgctaggcctggtatgccttcagttggaaacagtggtttgcctggtctaggactggatgttccgggttttggaggtggaccaaacaatttaagtgggccatcgggatttggagggggccctcagaattttggaaatggccctggtagcttaggcggtcccccggggtttggaagtggccctcctggtcttggaagtgcccctgggcatttgggtgggccaccagcttttgggcctggccccggccccggccccggccctggcccaatccatattggtggtccccctggctttgcatctagttctggaaaaccaggaccgacagtaattaaagtgcaaaacatgccctttactgtgtctattgatgagattttagatttcttttatggctatcaagtaatcccaggctcagtgtgtttaaaatacaatgaaaaaggtatgcccacaggtgaagccatggtggcctttgagtctcgggatgaagccacagctgctgtcattgacttaaatgacaggcctataggttcaagaaaagtaaaacttgtattagggtagccattcacatcattttttatagggtagatcttcatattgctgtgattaatgcatccagattgttttcctagtatttccaggttagaacctgtggattgtttcaattgcatatagcttggtttccataacatagagcattggttgactgtttacagaagactcactcaccaggataaacattgctgtatgttacagtaaagctatctggagagaacacataaatgattttggcataccattagagaaaccatttgtaaaactcaaatgaccacataaagcttatcaaggagtctagattggttttgttttataccatatgggatgaagaaaatagaaatgtcagtagaactcattgagggtgctcttgccagctgctgaaaatagaagttggctactctcagaatttggtttaaagctggacagatttgctttgttatagggtaaagctttgtctaaagtcctcattttcttttaaaattgaataaaatttctgtatacagattcattgtatgtacctttattgcttcttaagggtccttgctgtatagacagtcctgcttcagaagttgctgctttgtttgtctaattgactcatttgtaaatgagcagaactgttttgttggtttttttccctaaatataaaagtccacacttcgtttgtgctataacctcaaactttgatttctaatgtcacacttaaaactgtgtggaataagacttttgccataaaaataaactatggagtccttta

SEQ ID NO: 446090 - DNA, 3793 bp, Homo sapiens
ctcgacgagccggactttctgtgacaacgtgcgacacggacggctggctggcctgcgctcgcggcatccaggcgacagctcgatatcgcggacatgagaggcccgtggctgcgttgggctccgggaagccgttcgggctggggctgtcggccgcggggcggaggcactcgcgcggggggggtaattcggggtctgggttctggtgccgcgcagctttccccgtctaaaagttggttttaattggttgcccacaggattgacttggcctctacttcttgttaaggaaattcatctcttgttttatcaggtgtgtgtggtttcagcgcagcatggctgtggtcatccgtttgcaaggtctcccaattgtggcggggaccatggacattcgccacttcttctctggattgaccattcctgatgggggcgtgcatattgtagggggtgaactgggtgaggctttcatcgtttttgccactgatgaagatgcaaggcttggtatgatgcgcacaggtggtacaattaaagggtcaaaagtaacactattgttgagtagtaagacggaaatgcagaatatgattgaactgagtcgtaggcgttttgaaactgccaacttagatataccaccagcaaatgccagtagatcaggaccaccacctagctcaggaatgagtagcagggtaaacttgcccacaacagtatccaactttaataatccatcacccagtgtagttactgccaccacttctgttcatgaaagcaacaaaaacatacagacattttccacagccagcgtaggaacagctcctccaaatatgggggcttcctttgggagcccaacgtttagctcaactgttccaagcacagcctctccaatgaacacagtcccgccgccaccaattcctccaattccagcgatgccatctctgccaccaatgccatccattcccccaattccagttcctcctccagtacctacattgcctcctgtgcctcctgtgcccccgattcccccagttccttctgtgccacccatgaccccactgccacccatgtcgggcatgccgcccttgaatccgccacctgtggcacctctacctgctggaatgaatggctctggagcacctatgaatttgaacaataatctgaatcctatgtttcttggtccgttgaatcctgttaaccctatccagatgaactctcagagcagtgtgaagccactccccatcaaccctgatgatctgtatgtcagtgtgcatggaatgcccttttctgcaatggaaaatgatgtcagagatttttttcatgggctccgtgttgatgcagtgcatttgttgaaagatcatgtaggtcgaaataatgggaatggattggttaagtttctctcccctcaagatacatttgaagctttgaaacgaaacagaatgctgatgattcaacgctatgtggaagttagccctgccacagaaagacagtgggtagctgctggaggccatatcacttttaagcaaaatatgggaccttctggacaaactcatccccctcctcagacacttcccaggtcaaaatcgcccagtgggcagaaaagatcaaggtcaagatcaccacatgaggctggtttttgtgtttacttgaaagggctaccatttgaagcagaaaacaaacatgtcattgatttttttaaaaagctggatattgtggaagatagtatttatatagcttatggacccaatgggaaagcaactggcgaaggctttgtagagttcagaaatgaggctgactataaggctgctctgtgtcgtcataaacagtacatgggcaatcgctttattcaagttcatccaattactaagaaaggtatgctagaaaagatagatatgattcgaaaaagactgcagaacttcagctatgaccagagggaaatgatactaaatccagagggggatgtcaactctgccaaagtctgtgcccacataacaaatattccattcagcattacaaagatggatgttcttcagttcctagaaggaatcccagtggatgaaaatgctgtacatgttcttgttgataacaatgggcaaggtctaggacaggcattggttcagtttaaaaatgaagatgatgcacatggcccactgcgtgaccttggttcagctgtccatttcctgtgaccatctcattgacaaggacatcggctccaagtctgacccactctgcgtccttttacaggatgtgggagggggcagctgggctgagcttggccggactgaacgggtgcggaactgctcaagccctgagttctccaagactctacagcttgagtaccgctttgagacagtccagaagctacgctttggaatctatgacatagacaacaagacgccagagctgagggatgatgacttcctagggggtgctgagtgttccctaggacagattgtgtccagccaggtactgactctccccttgatgctgaagcctggaaaacctgctgggcgggggaccatcacggtctcagctcaggaattaaaggacaatcgtgtagtaaccatggaggtagaggccagaaacctagataagaaggacttcctgggaaaatcagatccatttctggagttcttccgccagggtgatgggaaatggcacctggtgtacagatctgaggtcatcaagaacaacctgaaccctacatggaagcgtttctcagtccccgttcagcatttctgtggtgggaaccccagcacacccatccaggtgcaatgctccgattatgacagtgacgggtcacatgatctcatcggtaccttccacaccagcttggcccagctgcaggcagtcccggctgagtttgaatgcatccaccctgagaagcagcagaaaaagaaaagctacaagaactctggaactatccgtgtcaagatttgtcgggtagaaacagagtactcctttctggactatgtgatgggaggctgtcagatcaacttcactgtgggcgtggacttcactggctccaatggagacccctcctcacctgactccctacactacctgagtccaacaggggtcaatgagtacctgatggcactgtggagtgtgggcagcgtggttcaggactatgactcagacaagctgttccctgcatttggatttggggcccaggttccccctgactggcaggtctcgcatgaatttgccttgaatttcaaccccagtaacccctactgtgcaggcatccagggcattgtggatgcctaccgccaagccctgccccaagttcgcctctatggccctaccaactttgcacccatcatcaaccatgtggccaggtttgcagcccaggctgcacatcaggggactgcctcggacatgaatgggcttgtccccagcaatacttcatgctgttgctgctgactgatggtgctgtgacggatgtggaagccacacgtgaggctgtggtggcccctcgggaggcattggcacagaccgtgctcgcagaagtgcccacacaactggtctcatacttcagggcccagggttgggccccgctcaagccacttccaccctcagccaaggatcctgcacaggccccccaggcctaggttcccttggaggctgtggcaagtcctcaatcctgtgtcccagaggtccctctgggccacaacccaacccttctcactctcctcagtgctagcactttgtattttttgatacttttatacttgtttctgcttttgctgctcttgatcccacctttgctcctgacaaccctcattcaataaagaccagtgaagaccaa

SEQ ID NO: 446091 - DNA, 3563 bp, Homo sapiens
ctcgacgagccggactttctgtgacaacgtgcgacacggacggctggctggcctgcgctcgcggcatccaggcgacagctcgatatcgcggacatgagaggcccgtggctgcgttgggctccgggaagccgttcgggctggggctgtcggccgcggggcggaggcactcgcgcggggggggtaattcggggtctgggttctggtgccgcgcagctttccccgtctaaaagttggttttaattggttgcccacaggattgacttggcctctacttcttgttaaggaaattcatctcttgttttatcaggtgtgtgtggtttcagcgcagcatggctgtggtcatccgtttgcaaggtctcccaattgtggcggggaccatggacattcgccacttcttctctggattgaccattcctgatgggggcgtgcatattgtagggggtgaactgggtgaggctttcatcgtttttgccactgatgaagatgcaaggcttggtatgatgcgcacaggtggtacaattaaagggtcaaaagtaacactattgttgagtagtaagacggaaatgcagaatatgattgaactgagtcgtaggcgttttgaaactgccaacttagatataccaccagcaaatgccagtagatcaggaccaccacctagctcaggaatgagtagcagggtaaacttgcccacaacagtatccaactttaataatccatcacccagtgtagttactgccaccacttctgttcatgaaagcaacaaaaacatacagacattttccacagccagcgtaggaacagctcctccaaatatgggggcttcctttgggagcccaacgtttagctcaactgttccaagcacagcctctccaatgaacacagtcccgccgccaccaattcctccaattccagcgatgccatctctgccaccaatgccatccattcccccaattccagttcctcctccagtacctacattgcctcctgtgcctcctgtgcccccgattcccccagttccttctgtgccacccatgaccccactgccacccatgtcgggcatgccgcccttgaatccgccacctgtggcacctctacctgctggaatgaatggctctggagcacctatgaatttgaacaataatctgaatcctatgtttcttggtccgttgaatcctgttaaccctatccagatgaactctcagagcagtgtgaagccactccccatcaaccctgatgatctgtatgtcagtgtgcatggaatgcccttttctgcaatggaaaatgatgtcagagatttttttcatgggctccgtgttgatgcagtgcatttgttgaaagatcatgtaggtcgaaataatgggaatggattggttaagtttctctcccctcaagatacatttgaagctttgaaacgaaacagaatgctgatgattcaacgctatgtggaagttagccctgccacagaaagacagtgggtagctgctggaggccatatcacttttaagcaaaatatgggaccttctggacaaactcatccccctcctcagacacttcccaggtcaaaatcgcccagtgggcagaaaagatcaaggtcaagatcaccacatgaggctggtttttgtgtttacttgaaagggctaccatttgaagcagaaaacaaacatgtcattgatttttttaaaaagctggatattgtggaagatagtatttatatagcttatggacccaatgggaaagcaactggcgaaggctttgtagagttcagaaatgaggctgactataaggctgctctgtgtcgtcataaacagtacatgggcaatcgctttattcaagttcatccaattactaagaaaggtatgctagaaaagatagatatgattcgaaaaagactgcagaacttcagctatgaccagagggaaatgatactaaatccagagggggatgtcaactctgccaaagtctgtgcccacataacaaatattccattcagcattacaaagatggatgttcttcagttcctagaaggaatcccagtggatgaaaatgctgtacatgttcttgttgataacaatgggcaaggtctaggacaggcattggttcagtttaaaaatgaagatgatgcacatggcccactgcgtgaccttggttcagctgtccatttcctgtgaccatctcattgacaaggacatcggctccaagtctgacccactctgcgtccttttacaggatgtgggagggggcagctgggctgagcttggccggactgaacgggtgcggaactgctcaagccctgagttctccaagactctacagcttgagtaccgctttgagacagtccagaagctacgctttggaatctatgacatagacaacaagacgccagagctgagggatgatgacttcctagggggtgctgagtgttccctaggacagattgtgtccagccaggtactgactctccccttgatgctgaagcctggaaaacctgctgggcgggggaccatcacggtctcagctcaggaattaaaggacaatcgtgtagtaaccatggaggtagaggccagaaacctagataagaaggacttcctgggaaaatcagatccatttctggagttcttccgccagggtgatgggaaatggcacctggtgtacagatctgaggtcatcaagaacaacctgaaccctacatggaagcgtttctcagtccccgttcagcatttctgtggtgggaaccccagcacacccatccaggtgcaatgctccgattatgacagtgacgggtcacatgatctcatcggtaccttccacaccagcttggcccagctgcaggcagtcccggctgagtttgaatgcatccaccctgagaagcagcagaaaaagaaaagctacaagaactctggaactatccgtgtcaagatttgtcgggtagaaacagagtactcctttctggactatgtgatgggaggctgtcagatcaacttcactgtgggcgtggacttcactggctccaatggagacccctcctcacctgactccctacactacctgagtccaacaggggtcaatgagtacctgatggcactgtggagtgtgggcagcgtggttcaggactatgactcagacaagctgttccctgcatttggatttggggcccaggttccccctgactggcaggtctcgcatgaatttgccttgaatttcaaccccagtaacccctactgtgcaggcatccagggcattgtggatgcctaccgccaagccctgccccaagttcgcctctatggccctaccaactttgcacccatcatcaaccatgtggccaggtttgcagcccaggctgcacatcaggggactgcctcgtcgcaatactccatggcggtgctgctgacctgatggggccgtgacggactgtggagaacccaccacgtgaagctgggagcgtggcccgaaactgccaagggccagaacccacaggggggggcgggcggggcacttggggcagggcaactgggcgcgaggggggcccggtacatctgggagggggccgacaaggagtgaccccc

SEQ ID NO: 446092 - DNA, 3339 bp, Homo sapiens
ctcgacgagccggactttctgtgacaacgtgcgacacggacggctggctggcctgcgctcgcggcatccaggcgacagctcgatatcgcggacatgagaggcccgtggctgcgttgggctccgggaagccgttcgggctggggctgtcggccgcggggcggaggcactcgcgcggggggggtaattcggggtctgggttctggtgccgcgcagctttccccgtctaaaagttggttttaattggttgcccacaggattgacttggcctctacttcttgttaaggaaattcatctcttgttttatcaggtgtgtgtggtttcagcgcagcatggctgtggtcatccgtttgcaaggtctcccaattgtggcggggaccatggacattcgccacttcttctctggattgaccattcctgatgggggcgtgcatattgtagggggtgaactgggtgaggctttcatcgtttttgccactgatgaagatgcaaggcttggtatgatgcgcacaggtggtacaattaaagggtcaaaagtaacactattgttgagtagtaagacggaaatgcagaatatgattgaactgagtcgtaggcgttttgaaactgccaacttagatataccaccagcaaatgccagtagatcaggaccaccacctagctcaggaatgagtagcagggtaaacttgcccacaacagtatccaactttaataatccatcacccagtgtagttactgccaccacttctgttcatgaaagcaacaaaaacatacagacattttccacagccagcgtaggaacagctcctccaaatatgggggcttcctttgggagcccaacgtttagctcaactgttccaagcacagcctctccaatgaacacagtcccgccgccaccaattcctccaattccagcgatgccatctctgccaccaatgccatccattcccccaattccagttcctcctccagtacctacattgcctcctgtgcctcctgtgcccccgattcccccagttccttctgtgccacccatgaccccactgccacccatgtcgggcatgccgcccttgaatccgccacctgtggcacctctacctgctggaatgaatggctctggagcacctatgaatttgaacaataatctgaatcctatgtttcttggtccgttgaatcctgttaaccctatccagatgaactctcagagcagtgtgaagccactccccatcaaccctgatgatctgtatgtcagtgtgcatggaatgcccttttctgcaatggaaaatgatgtcagagatttttttcatgggctccgtgttgatgcagtgcatttgttgaaagatcatgtaggtcgaaataatgggaatggattggttaagtttctctcccctcaagatacatttgaagctttgaaacgaaacagaatgctgatgattcaacgctatgtggaagttagccctgccacagaaagacagtgggtagctgctggaggccatatcacttttaagcaaaatatgggaccttctggacaaactcatccccctcctcagacacttcccaggtcaaaatcgcccagtgggcagaaaagatcaaggtcaagatcaccacatgaggctggtttttgtgtttacttgaaagggctaccatttgaagcagaaaacaaacatgtcattgatttttttaaaaagctggatattgtggaagatagtatttatatagcttatggacccaatgggaaagcaactggcgaaggctttgtagagttcagaaatgaggctgactataaggctgctctgtgtcgtcataaacagtacatgggcaatcgctttattcaagttcatccaattactaagaaaggtatgctagaaaagatagatatgattcgaaaaagactgcagaacttcagctatgaccagagggaaatgatactaaatccagagggggatgtcaactctgccaaagtctgtgcccacataacaaatattccattcagcattacaaagatggatgttcttcagttcctagaaggaatcccagtggatgaaaatgctgtacatgttcttgttgataacaatgggcaaggtctaggacaggcattggttcagtttaaaaatgaagatgatgcacatggcccactgcgtgaccttggttcagctgtccatttcctgtgaccatctcattgacaaggacatcggctccaagtctgacccactctgcgtccttttacaggatgtgggagggggcagctgggctgagcttggccggactgaacgggtgcggaactgctcaagccctgagttctccaagactctacagcttgagtaccgctttgagacagtccagaagctacgctttggaatctatgacatagacaacaagacgccagagctgagggatgatgacttcctagggggtgctgagtgttccctaggacagattgtgtccagccaggtactgactctccccttgatgctgaagcctggaaaacctgctgggcgggggaccatcacggtctcagctcaggaattaaaggacaatcgtgtagtaaccatggaggtagaggccagaaacctagataagaaggacttcctgggaaaatcagatccatttctggagttcttccgccagggtgatgggaaatggcacctggtgtacagatctgaggtcatcaagaacaacctgaaccctacatggaagcgtttctcagtccccgttcagcatttctgtggtgggaaccccagcacacccatccaggtgcaatgctccgattatgacagtgacgggtcacatgatctcatcggtaccttccacaccagcttggcccagctgcaggcagtcccggctgagtttgaatgcatccaccctgagaagcagcagaaaaagaaaagctacaagaactctggaactatccgtgtcaagatttgtcgggtagaaacagagtactcctttctggactatgtgatgggaggctgtcagatcaacttcactgtgggcgtggacttcactggctccaatggagacccctcctcacctgactccctacactaccacacaactggtctcatacttcagggcccagggttgggccccgctcaagccacttccaccctcagccaaggatcctgcacaggccccccaggcctaggttcccttggaggctgtggcaagtcctcaatcctgtgtcccagaggtccctctgggccacaacccaacccttctcactctcctcagtgctagcactttgtattttttgatacttttatacttgtttctgcttttgctgctcttgatcccacctttgctcctgacaaccctcattcaataaagaccagtgaagaccaa

SEQ ID NO: 446093 - DNA, 3555 bp, Homo sapiens
ctcgacgagccggactttctgtgacaacgtgcgacacggacggctggctggcctgcgctcgcggcatccaggcgacagctcgatatcgcggacatgagaggcccgtggctgcgttgggctccgggaagccgttcgggctggggctgtcggccgcggggcggaggcactcgcgcggggggggtaattcggggtctgggttctggtgccgcgcagctttccccgtctaaaagttggttttaattggttgcccacaggattgacttggcctctacttcttgttaaggaaattcatctcttgttttatcaggtgtgtgtggtttcagcgcagcatggctgtggtcatccgtttgcaaggtctcccaattgtggcggggaccatggacattcgccacttcttctctggattgaccattcctgatgggggcgtgcatattgtagggggtgaactgggtgaggctttcatcgtttttgccactgatgaagatgcaaggcttggtatgatgcgcacaggtggtacaattaaagggtcaaaagtaacactattgttgagtagtaagacggaaatgcagaatatgattgaactgagtcgtaggcgttttgaaactgccaacttagatataccaccagcaaatgccagtagatcaggaccaccacctagctcaggaatgagtagcagggtaaacttgcccacaacagtatccaactttaataatccatcacccagtgtagttactgccaccacttctgttcatgaaagcaacaaaaacatacagacattttccacagccagcgtaggaacagctcctccaaatatgggggcttcctttgggagcccaacgtttagctcaactgttccaagcacagcctctccaatgaacacagtcccgccgccaccaattcctccaattccagcgatgccatctctgccaccaatgccatccattcccccaattccagttcctcctccagtacctacattgcctcctgtgcctcctgtgcccccgattcccccagttccttctgtgccacccatgaccccactgccacccatgtcgggcatgccgcccttgaatccgccacctgtggcacctctacctgctggaatgaatggctctggagcacctatgaatttgaacaataatctgaatcctatgtttcttggtccgttgaatcctgttaaccctatccagatgaactctcagagcagtgtgaagccactccccatcaaccctgatgatctgtatgtcagtgtgcatggaatgcccttttctgcaatggaaaatgatgtcagagatttttttcatgggctccgtgttgatgcagtgcatttgttgaaagatcatgtaggtcgaaataatgggaatggattggttaagtttctctcccctcaagatacatttgaagctttgaaacgaaacagaatgctgatgattcaacgctatgtggaagttagccctgccacagaaagacagtgggtagctgctggaggccatatcacttttaagcaaaatatgggaccttctggacaaactcatccccctcctcagacacttcccaggtcaaaatcgcccagtgggcagaaaagatcaaggtcaagatcaccacatgaggctggtttttgtgtttacttgaaagggctaccatttgaagcagaaaacaaacatgtcattgatttttttaaaaagctggatattgtggaagatagtatttatatagcttatggacccaatgggaaagcaactggcgaaggctttgtagagttcagaaatgaggctgactataaggctgctctgtgtcgtcataaacagtacatgggcaatcgctttattcaagttcatccaattactaagaaaggtatgctagaaaagatagatatgattcgaaaaagactgcagaacttcagctatgaccagagggaaatgatactaaatccagagggggatgtcaactctgccaaagtctgtgcccacataacaaatattccattcagcattacaaagatggatgttcttcagttcctagaaggaatcccagtggatgaaaatgctgtacatgttcttgttgataacaatgggcaaggtctaggacaggcattggttcagtttaaaaatgaagatgatgcacatggcccactgcgtgaccttggttcagctgtccatttcctgtgaccatctcattgacaaggacatcggctccaagtctgacccactctgcgtccttttacaggatgtgggagggggcagctgggctgagcttggccggactgaacgggtgcggaactgctcaagccctgagttctccaagactctacagcttgagtaccgctttgagacagtccagaagctacgctttggaatctatgacatagacaacaagacgccagagctgagggatgatgacttcctagggggtgctgagtgttccctaggacagattgtgtccagccaggtactgactctccccttgatgctgaagcctggaaaacctgctgggcgggggaccatcacggtctcagctcaggaattaaaggacaatcgtgtagtaaccatggaggtagaggccagaaacctagataagaaggacttcctgggaaaatcagatccatttctggagttcttccgccagggtgatgggaaatggcacctggtgtacagatctgaggtcatcaagaacaacctgaaccctacatggaagcgtttctcagtccccgttcagcatttctgtggtgggaaccccagcacacccatccaggtgcaatgctccgattatgacagtgacgggtcacatgatctcatcggtaccttccacaccagcttggcccagctgcaggcagtcccgtccacctggccgcctccatggacccttggtggctttgtaaattaatttttgatgacattttgagttttaagatttctgaccagcagtctcttacctgtatatttgtaaatatatcatgtttctgtgaaaatgtatttactgaacattaaaacatggggaaggaaaacacccctttttctagcttaaccaaacaaaagcgacaaaccaagaaagacaacacaacacaccgcacacacgaagaaaaagaaaaagaaaacaaaacaacaacaacgcaaaaagacaaaacacacagccccaccccacagcagagggggggcaccagccccaacaccggcgagggcgccgcggccaaaccgacaccaaacgacagaacaaggagaacccacacaaacatcatcagatgacaagggcggcgcagcagatcagaacacgagggcgagagcagacaacagcgatggctgacaagcgggagacacaaccaaagggtgaagaacaaggacgaggacacaccaccaagcgaacagacgggagagacataaaccgaagagaaagcacgaaccgaagggatgagagagacagacaacgagccggacgaggaaaaactcgtgcaggcccgcacagaaggcccgggaaggagagcacagactaaacaagagcgagaagcacggcacagaccgcaggcaggacacaagactcgaagaacaagaagacgacgaa

SEQ ID NO: 446094 - DNA, 2892 bp, Homo sapiens
ctcgacgagccggactttctgtgacaacgtgcgacacggacggctggctggcctgcgctcgcggcatccaggcgacagctcgatatcgcggacatgagaggcccgtggctgcgttgggctccgggaagccgttcgggctggggctgtcggccgcggggcggaggcactcgcgcggggggggtaattcggggtctgggttctggtgccgcgcagctttccccgtctaaaagttggttttaattggttgcccacaggattgacttggcctctacttcttgttaaggaaattcatctcttgttttatcaggtgtgtgtggtttcagcgcagcatggctgtggtcatccgtttgcaaggtctcccaattgtggcggggaccatggacattcgccacttcttctctggattgaccattcctgatgggggcgtgcatattgtagggggtgaactgggtgaggctttcatcgtttttgccactgatgaagatgcaaggcttggtatgatgcgcacaggtggtacaattaaagggtcaaaagtaacactattgttgagtagtaagacggaaatgcagaatatgattgaactgagtcgtaggcgttttgaaactgccaacttagatataccaccagcaaatgccagtagatcaggaccaccacctagctcaggaatgagtagcagggtaaacttgcccacaacagtatccaactttaataatccatcacccagtgtagttactgccaccacttctgttcatgaaagcaacaaaaacatacagacattttccacagccagcgtaggaacagctcctccaaatatgggggcttcctttgggagcccaacgtttagctcaactgttccaagcacagcctctccaatgaacacagtcccgccgccaccaattcctccaattccagcgatgccatctctgccaccaatgccatccattcccccaattccagttcctcctccagtacctacattgcctcctgtgcctcctgtgcccccgattcccccagttccttctgtgccacccatgaccccactgccacccatgtcgggcatgccgcccttgaatccgccacctgtggcacctctacctgctggaatgaatggctctggagcacctatgaatttgaacaataatctgaatcctatgtttcttggtccgttgaatcctgttaaccctatccagatgaactctcagagcagtgtgaagccactccccatcaaccctgatgatctgtatgtcagtgtgcatggaatgcccttttctgcaatggaaaatgatgtcagagatttttttcatgggctccgtgttgatgcagtgcatttgttgaaagatcatgtaggtcgaaataatgggaatggattggttaagtttctctcccctcaagatacatttgaagctttgaaacgaaacagaatgctgatgattcaacgctatgtggaagttagccctgccacagaaagacagtgggtagctgctggaggccatatcacttttaagcaaaatatgggaccttctggacaaactcatccccctcctcagacacttcccaggtcaaaatcgcccagtgggcagaaaagatcaaggtcaagatcaccacatgaggctggtttttgtgtttacttgaaagggctaccatttgaagcagaaaacaaacatgtcattgatttttttaaaaagctggatattgtggaagatagtatttatatagcttatggacccaatgggaaagcaactggcgaaggctttgtagagttcagaaatgaggctgactataaggctgctctgtgtcgtcataaacagtacatgggcaatcgctttattcaagttcatccaattactaagaaaggtatgctagaaaagatagatatgattcgaaaaagactgcagaacttcagctatgaccagagggaaatgatactaaatccagagggggatgtcaactctgccaaagtctgtgcccacataacaaatattccattcagcattacaaagatggatgttcttcagttcctagaaggaatcccagtggatgaaaatgctgtacatgttcttgttgataacaatgggcaaggtctaggacaggcattggttcagtttaaaaatgaagatgatgcacatggcccactgcgtgaccttggttcagctgtccatttcctgtgaccatctcattgacaaggacatcggctccaagtctgacccactctgcgtccttttacaggatgtgggagggggcagctgggctgagcttggccggactgaacgggtgcggaactgctcaagccctgagttctccaagactctacagcttgagtaccgctttgagacagtccagaagctacgctttggaatctatgacatagacaacaagacgccagagctgagggatgatgacttcctagggggtgctgagtgttccctaggacagattgtgtccagccaggtactgactctccccttgatgctgaagcctggaaaacctgctgggcgggggaccatcacggtctcagctcaggaattaaaggacaatcgtgtagtaaccatggaggtagaggccagaaacctagataagaaggacttcctgggaaaatcagatccatttctggagttcttccgccagggtgatgggaaatggcacctggtgtacagatctgaggtcatcaagaacaacctgaaccctacatggaagcgtttctcagtccccgttcagcatttctgtggtgggaaccccagcacacccatccaggtgcaatgctccgattatgacagtgacgggtcacatgatctcatcggtaccttccacaccagcttggcccagctgcaggcagtcccgtgcaccttctcccacttggagttgatgatttgcggggcagctcgcccctgagtt

SEQ ID NO: 446095 - DNA, 872 bp, Homo sapiens
ctcgacgagccggactttctgtgacaacgtgcgacacggacggctggctggcctgcgctcgcggcatccaggcgacagctcgatatcgcggacatgagaggcccgtggctgcgttgggctccgggaagccgttcgggctggggctgtcggccgcggggcggaggcactcgcgcggggggggtaattcggggtctgggttctggtgccgcgcagctttccccggattgacttggcctctacttcttgttaaggaaattcatctcttgttttatcaggtgtgtgtggtttcagcgcagcatggctgtggtcatccgtttgcaaggtctcccaattgtggcggggaccatggacattcgccacttcttctctggattgaccattcctgatgggggcgtgcatattgtagggggtgaactggatggcccactgcgtgaccttggttcagctgtccatttcctgtgaccatctcattgacaaggacatcggctccaagtctgacccactctgcgtccttttacaggatgtgggagggggcagctgggctgagcttggccggactgaacgggtgcggaactgctcaagccctgagttctccaagactctacagcttgagtaccgctttgagacagtccagaagctacgctttggaatctatgacatagacaacaagacgccagagctgagggatgatgacttcctagggggtgctgagtgttccctaggacagattgttgtcccaagccaaggtaattggactcttccccctttgatgcttgaaaggcctggaaaaaactggctggggccggggggggaacaatcaaagggtctccagctccaggaaattaaagggacaaacccgtgtaataacccag

SEQ ID NO: 446096 - DNA, 291 bp, Homo sapiens
agcctgcgtaccgaagtggggacgaggccatagcgaggactcccccgtggtctgagagggggcaggccagagctggctggctcagcggcctgcgagctaacggggactgcagtaaaaacacgcctacatcccgagtacggaggatttcttgtctcccccagtgaagcagaggttataactacatctctgtgcctggaggtggggagataatcgtagtgaggacactccttcaacccgaaatggaaaggaggcctttgtggcctaccagcaaaaggggacccaggtcacacc

SEQ ID NO: 446097 - DNA, 1047 bp, Homo sapiens
ggaacgcggagccgctgagcgggccgagcggccattttgtgaagcggcgaaggaggtggtgggtggctgcgttgggctccgggaagccgttcgggctggggctgtcggccgcggggcggaggcactcgcgcgggggatggcccactgcgtgaccttggttcagctgtccatttcctgtgaccatctcattgacaaggacatcggctccaagtctgacccactctgcgtccttttacaggatgtgggagggggcagctgggctgagcttggccggactgaacgggtgcggaactgctcaagccctgagttctccaagactctacagcttgagtaccgctttgagacagtccagaagctacgctttggaatctatgacatagacaacaagacgccagagctgagggatgatgacttcctagggggtgctgagtgttccctaggacagattgtgtccagccaggtactgactctccccttgatgctgaagcctggaaaacctgctgggcgggggaccatcacggtctcagctcaggaattaaaggacaatcgtgtagtaaccatggaggtagaggccagaaacctagataagaaggacttcctgggaaaatcagatccatttctggagttcttccgccagggtgatgggaaatggcacctggtgtacagatctgaggtcatcaagaacaacctgaaccctacatggaagcgtttctcagtccccgttcagcatttctgtggtgggaaccccagcacacccatccaggtgcaatgctccgattatgacagtggacgcggtcacacatgcagttccaatcgggaacacttccaaaccacaggttgggccccgactggacagcgcaagccccggcacgagtatggcagtggctccacccctgttaaaagcacggcgacaacagacaagcctccaagacatctgggacatatccgaggtgaacgcatcgtggcggtaaaaccacagaacaccaactcgggacaacagccacggcacgtagagacgatcagcgtaacaggagacacgtcaccacg

SEQ ID NO: 446098 - DNA, 3838 bp, Homo sapiens
ctcgacgagccggactttctgtgacaacgtgcgacacggacggctggctggcctgcgctcgcggcatccaggcgacagctcgatatcgcggacatgagaggcccgtggctgcgttgggctccgggaagccgttcgggctggggctgtcggccgcggggcggaggcactcgcgcggggggggtaattcggggtctgggttctggtgccgcgcagctttccccgtctaaaagttggttttaattggttgcccacaggattgacttggcctctacttcttgttaaggaaattcatctcttgttttatcaggtgtgtgtggtttcagcgcagcatggctgtggtcatccgtttgcaaggtctcccaattgtggcggggaccatggacattcgccacttcttctctggattgaccattcctgatgggggcgtgcatattgtagggggtgaactgggtgaggctttcatcgtttttgccactgatgaagatgcaaggcttggtatgatgcgcacaggtggtacaattaaagggtcaaaagtaacactattgttgagtagtaagacggaaatgcagaatatgattgaactgagtcgtaggcgttttgaaactgccaacttagatataccaccagcaaatgccagtagatcaggaccaccacctagctcaggaatgagtagcagggtaaacttgcccacaacagtatccaactttaataatccatcacccagtgtagttactgccaccacttctgttcatgaaagcaacaaaaacatacagacattttccacagccagcgtaggaacagctcctccaaatatgggggcttcctttgggagcccaacgtttagctcaactgttccaagcacagcctctccaatgaacacagtcccgccgccaccaattcctccaattccagcgatgccatctctgtgccacccatgaccccactgccacccatgtcgggcatgccgcccttgaatccgccacctgtggcacctctacctgctggaatgaatggctctggagcacctatgaatttgaacaataatctgaatcctatgtttcttggtccgttgaatcctgttaaccctatccagatgaactctcagagcagtgtgaagccactccccatcaaccctgatgatctgtatgtcagtgtgcatggaatgcccttttctgcaatggaaaatgatgtcagagatttttttcatgggctccgtgttgatgcagtgcatttgttgaaagatcatgtaggtcgaaataatgggaatggattggttaagtttctctcccctcaagatacatttgaagctttgaaacgaaacagaatgctgatgattcaacgctatgtggaagttagccctgccacagaaagacagtgggtagctgctggaggccatatcacttttaagcaaaatatgggaccttctggacaaactcatccccctcctcagacacttcccaggtcaaaatcgcccagtgggcagaaaagatcaaggtcaagatcaccacatgaggctggtttttgtgtttacttgaaagggctaccatttgaagcagaaaacaaacatgtcattgatttttttaaaaagctggatattgtggaagatagtatttatatagcttatggacccaatgggaaagcaactggcgaaggctttgtagagttcagaaatgaggctgactataaggctgctctgtgtcgtcataaacagtacatgggcaatcgctttattcaagttcatccaattactaagaaaggtatgctagaaaagatagatatgattcgaaaaagactgcagaacttcagctatgaccagagggaaatgatactaaatccagagggggatgtcaactctgccaaagtctgtgcccacataacaaatattccattcagcattacaaagatggatgttcttcagttcctagaaggaatcccagtggatgaaaatgctgtacatgttcttgttgataacaatgggcaaggtctaggacaggcattggttcagtttaaaaatgaagatgatgcacatggcccactgcgtgaccttggttcagctgtccatttcctgtgaccatctcattgacaaggacatcggctccaagtctgacccactctgcgtccttttacaggatgtgggagggggcagctgggctgagcttggccggactgaacgggtgcggaactgctcaagccctgagttctccaagactctacagcttgagtaccgctttgagacagtccagaagctacgctttggaatctatgacatagacaacaagacgccagagctgagggatgatgacttcctagggggtgctgagtgttccctaggacagattgtgtccagccaggtactgactctccccttgatgctgaagcctggaaaacctgctgggcgggggaccatcacggtctcagctcaggaattaaaggacaatcgtgtagtaaccatggaggtagaggccagaaacctagataagaaggacttcctgggaaaatcagatccatttctggagttcttccgccagggtgatgggaaatggcacctggtgtacagatctgaggtcatcaagaacaacctgaaccctacatggaagcgtttctcagtccccgttcagcatttctgtggtgggaaccccagcacacccatccaggtgcaatgctccgattatgacagtgacgggtcacatgatctcatcggtaccttccacaccagcttggcccagctgcaggcagtcccggctgagtttgaatgcatccaccctgagaagcagcagaaaaagaaaagctacaagaactctggaactatccgtgtcaagatttgtcgggtagaaacagagtactcctttctggactatgtgatgggaggctgtcagatcaacttcactgtgggcgtggacttcactggctccaatggagacccctcctcacctgactccctacactacctgagtccaacaggggtcaatgagtacctgatggcactgtggagtgtgggcagcgtggttcaggactatgactcagacaagctgttccctgcatttggatttggggcccaggttccccctgactggcaggtctcgcatgaatttgccttgaatttcaaccccagtaacccctactgtgcaggcatccagggcattgtggatgcctaccgccaagccctgccccaagttcgcctctatggccctaccaactttgcacccatcatcaaccatgtggccaggtttgcagcccaggctgcacatcaggggactgcctcgcaatacttcatgctgttgctgctgactgatggtgctgtgacggatgtggaagccacacgtgaggctgtggtgcgtgcctcgaacctgcccatgtcagtgatcattgtgggtgtgggtggtgctgactttgaggccatggagcagctggacgctgatggtggacccctgcatacacgttctgggcaggctgctgcccgcgacattgtgcagtttgtaccctaccgccggttccagaatgcccctcgggaggcattggcacagaccgtgctcgcagaagtgcccacacaactggtctcatacttcagggcccagggttgggccccgctcaagccacttccaccctcagccaaggatcctgcacaggccccccaggcctaggttcccttggaggctgtggcaagtcctcaatcctgtgtcccagaggtccctctgggccacaacccaacccttctcactctcctcagtgctagcactttgtattttttgatacttttatacttgtttctgcttttgctgctcttgatcccacctttgctcctgacaaccctcattcaataaagaccagtgaagaccaa

SEQ ID NO: 446099 - DNA, 2229 bp, Homo sapiens
ctcgacgagccggactttctgtgacaacgtgcgacacggacggctggctggcctgcgctcgcggcatccaggcgacagctcgatatcgcggacatgagaggcccgtggctgcgttgggctccgggaagccgttcgggctggggctgtcggccgcggggcggaggcactcgcgcggggggggtaattcggggtctgggttctggtgccgcgcagctttccccggattgacttggcctctacttcttgttaaggaaattcatctcttgttttatcaggtgtgtgtggtttcagcgcagcatggctgtggtcatccgtttgcaaggtctcccaattgtggcggggaccatggacattcgccacttcttctctggattgaccattcctgatgggggcgtgcatattgtagggggtgaactggatggcccactgcgtgaccttggttcagctgtccatttcctgtgaccatctcattgacaaggacatcggctccaagtctgacccactctgcgtccttttacaggatgtgggagggggcagctgggctgagcttggccggactgaacgggtgcggaactgctcaagccctgagttctccaagactctacagcttgagtaccgctttgagacagtccagaagctacgctttggaatctatgacatagacaacaagacgccagagctgagggatgatgacttcctagggggtgctgagtgttccctaggacagattgtgtccagccaggtactgactctccccttgatgctgaagcctggaaaacctgctgggcgggggaccatcacggtctcagctcaggaattaaaggacaatcgtgtagtaaccatggaggtagaggccagaaacctagataagaaggacttcctgggaaaatcagatccatttctggagttcttccgccagggtgatgggaaatggcacctggtgtacagatctgaggtcatcaagaacaacctgaaccctacatggaagcgtttctcagtccccgttcagcatttctgtggtgggaaccccagcacacccatccaggtgcaatgctccgattatgacagtgacgggtcacatgatctcatcggtaccttccacaccagcttggcccagctgcaggcagtcccggctgagtttgaatgcatccaccctgagaagcagcagaaaaagaaaagctacaagaactctggaactatccgtgtcaagatttgtcgggtagaaacagagtactcctttctggactatgtgatgggaggctgtcagatcaacttcactgtgggcgtggacttcactggctccaatggagacccctcctcacctgactccctacactacctgagtccaacaggggtcaatgagtacctgatggcactgtggagtgtgggcagcgtggttcaggactatgactcagacaagctgttccctgcatttggatttggggcccaggttccccctgactggcaggtctcgcatgaatttgccttgaatttcaaccccagtaacccctactgtgcaggcatccagggcattgtggatgcctaccgccaagccctgccccaagttcgcctctatggccctaccaactttgcacccatcatcaaccatgtggccaggtttgcagcccaggctgcacatcaggggactgcctcgcaatacttcatgctgttgctgctgactgatggtgctgtgacggatgtggaagccacacgtgaggctgtggtgcgtgcctcgaacctgcccatgtcagtgatcattgtgggtgtgggtggtgctgactttgaggccatggagcagctggacgctgatggtggacccctgcatacacgttctgggcaggctgctgcccgcgacattgtgcagtttgtaccctaccgccggttccagaatgcccctcgggaggcattggcacagaccgtgctcgcagaagtgcccacacaactggtctcatacttcagggcccagggttgggccccgctcaagccacttccaccctcagccaaggatcctgcacaggccccccaggcctaggttcccttggaggctgtggcaagtcctcaatcctgtgtcccagaggtccctctgggccacaacccaacccttctcactctcctcagtgctagcactttgtattttttgatacttttatacttgtttctgcttttgctgctcttgatcccacctttgctcctgacaaccctcattcaataaagaccagtgaagaccaa

SEQ ID NO: 446100 - DNA, 2086 bp, Homo sapiens
ctcgacgagccggactttctgtgacaacgtgcgacacggacggctggctggcctgcgctcgcggcatccaggcgacagctcgatatcgcggacatgagaggcccgtggctgcgttgggctccgggaagccgttcgggctggggctgtcggccgcggggcggaggcactcgcgcggggggggtaattcggggtctgggttctggtgccgcgcagctttccccggattgacttggcctctacttcttgttaaggaaattcatctcttgttttatcagatggcccactgcgtgaccttggttcagctgtccatttcctgtgaccatctcattgacaaggacatcggctccaagtctgacccactctgcgtccttttacaggatgtgggagggggcagctgggctgagcttggccggactgaacgggtgcggaactgctcaagccctgagttctccaagactctacagcttgagtaccgctttgagacagtccagaagctacgctttggaatctatgacatagacaacaagacgccagagctgagggatgatgacttcctagggggtgctgagtgttccctaggacagattgtgtccagccaggtactgactctccccttgatgctgaagcctggaaaacctgctgggcgggggaccatcacggtctcagctcaggaattaaaggacaatcgtgtagtaaccatggaggtagaggccagaaacctagataagaaggacttcctgggaaaatcagatccatttctggagttcttccgccagggtgatgggaaatggcacctggtgtacagatctgaggtcatcaagaacaacctgaaccctacatggaagcgtttctcagtccccgttcagcatttctgtggtgggaaccccagcacacccatccaggtgcaatgctccgattatgacagtgacgggtcacatgatctcatcggtaccttccacaccagcttggcccagctgcaggcagtcccggctgagtttgaatgcatccaccctgagaagcagcagaaaaagaaaagctacaagaactctggaactatccgtgtcaagatttgtcgggtagaaacagagtactcctttctggactatgtgatgggaggctgtcagatcaacttcactgtgggcgtggacttcactggctccaatggagacccctcctcacctgactccctacactacctgagtccaacaggggtcaatgagtacctgatggcactgtggagtgtgggcagcgtggttcaggactatgactcagacaagctgttccctgcatttggatttggggcccaggttccccctgactggcaggtctcgcatgaatttgccttgaatttcaaccccagtaacccctactgtgcaggcatccagggcattgtggatgcctaccgccaagccctgccccaagttcgcctctatggccctaccaactttgcacccatcatcaaccatgtggccaggtttgcagcccaggctgcacatcaggggactgcctcgcaatacttcatgctgttgctgctgactgatggtgctgtgacggatgtggaagccacacgtgaggctgtggtgcgtgcctcgaacctgcccatgtcagtgatcattgtgggtgtgggtggtgctgactttgaggccatggagcagctggacgctgatggtggacccctgcatacacgttctgggcaggctgctgcccgcgacattgtgcagtttgtaccctaccgccggttccagaatgcccctcgggaggcattggcacagaccgtgctcgcagaagtgcccacacaactggtctcatacttcagggcccagggttgggccccgctcaagccacttccaccctcagccaaggatcctgcacaggccccccaggcctaggttcccttggaggctgtggcaagtcctcaatcctgtgtcccagaggtccctctgggccacaacccaacccttctcactctcctcagtgctagcactttgtattttttgatacttttatacttgtttctgcttttgctgctcttgatcccacctttgctcctgacaaccctcattcaataaagaccagtgaagaccaa

SEQ ID NO: 446101 - DNA, 1961 bp, Homo sapiens
ctcgacgagccggactttctgtgacaacgtgcgacacggacggctggctggcctgcgctcgcggcatccaggcgacagctcgatatcgcggacatgagaggcccgtggctgcgttgggctccgggaagccgttcgggctggggctgtcggccgcggggcggaggcactcgcgcggggggggtaattcggggtctgggttctggtgccgcgcagctttccccgatggcccactgcgtgaccttggttcagctgtccatttcctgtgaccatctcattgacaaggacatcggctccaagtctgacccactctgcgtccttttacaggatgtgggagggggcagctgggctgagcttggccggactgaacgggtgcggaactgctcaagccctgagttctccaagactctacagcttgagtaccgctttgagacagtccagaagctacgctttggaatctatgacatagacaacaagacgccagagctgagggatgatgacttcctagggggtgctgagtgttccctaggacagattgtgtccagccaggtactgactctccccttgatgctgaagcctggaaaacctgctgggcgggggaccatcacggacttcctgggaaaatcagatccatttctggagttcttccgccagggtgatgggaaatggcacctggtgtacagatctgaggtcatcaagaacaacctgaaccctacatggaagcgtttctcagtccccgttcagcatttctgtggtgggaaccccagcacacccatccaggtgcaatgctccgattatgacagtgacgggtcacatgatctcatcggtaccttccacaccagcttggcccagctgcaggcagtcccggctgagtttgaatgcatccaccctgagaagcagcagaaaaagaaaagctacaagaactctggaactatccgtgtcaagatttgtcgggtagaaacagagtactcctttctggactatgtgatgggaggctgtcagatcaacttcactgtgggcgtggacttcactggctccaatggagacccctcctcacctgactccctacactacctgagtccaacaggggtcaatgagtacctgatggcactgtggagtgtgggcagcgtggttcaggactatgactcagacaagctgttccctgcatttggatttggggcccaggttccccctgactggcaggtctcgcatgaatttgccttgaatttcaaccccagtaacccctactgtgcaggcatccagggcattgtggatgcctaccgccaagccctgccccaagttcgcctctatggccctaccaactttgcacccatcatcaaccatgtggccaggtttgcagcccaggctgcacatcaggggactgcctcgcaatacttcatgctgttgctgctgactgatggtgctgtgacggatgtggaagccacacgtgaggctgtggtgcgtgcctcgaacctgcccatgtcagtgatcattgtgggtgtgggtggtgctgactttgaggccatggagcagctggacgctgatggtggacccctgcatacacgttctgggcaggctgctgcccgcgacattgtgcagtttgtaccctaccgccggttccagaatgcccctcgggaggcattggcacagaccgtgctcgcagaagtgcccacacaactggtctcatacttcagggcccagggttgggccccgctcaagccacttccaccctcagccaaggatcctgcacaggccccccaggcctaggttcccttggaggctgtggcaagtcctcaatcctgtgtcccagaggtccctctgggccacaacccaacccttctcactctcctcagtgctagcactttgtattttttgatacttttatacttgtttctgcttttgctgctcttgatcccacctttgctcctgacaaccctcattcaataaagaccagtgaagaccaa

SEQ ID NO: 446102 - DNA, 4184 bp, Homo sapiens
ctcgacgagccggactttctgtgacaacgtgcgacacggacggctggctggcctgcgctcgcggcatccaggcgacagctcgatatcgcggacatgagaggcccgtggctgcgttgggctccgggaagccgttcgggctggggctgtcggccgcggggcggaggcactcgcgcggggggggtaattcggggtctgggttctggtgccgcgcagctttccccgtctaaaagttggttttaattggttgcccacaggattgacttggcctctacttcttgttaaggaaattcatctcttgttttatcaggtgtgtgtggtttcagcgcagcatggctgtggtcatccgtttgcaaggtctcccaattgtggcggggaccatggacattcgccacttcttctctggattgaccattcctgatgggggcgtgcatattgtagggggtgaactgggtgaggctttcatcgtttttgccactgatgaagatgcaaggcttggtatgatgcgcacaggtggtacaattaaagggtcaaaagtaacactattgttgagtagtaagacggaaatgcagaatatgattgaactgagtcgtaggcgttttgaaactgccaacttagatataccaccagcaaatgccagtagatcaggaccaccacctagctcaggaatgagtagcagggtaaacttgcccacaacagtatccaactttaataatccatcacccagtgtagttactgccaccacttctgttcatgaaagcaacaaaaacatacagacattttccacagccagcgtaggaacagctcctccaaatatgggggcttcctttgggagcccaacgtttagctcaactgttccaagcacagcctctccaatgaacacagtcccgccgccaccaattcctccaattccagcgatgccatctctgccaccaatgccatccattcccccaattccagttcctcctccagtacctacattgcctcctgtgcctcctgtgcccccgattcccccagttccttctgtgccacccatgaccccactgccacccatgtcgggcatgccgcccttgaatccgccacctgtggcacctctacctgctggaatgaatggctctggagcacctatgaatttgaacaataatctgaatcctatgtttcttggtccgttgaatcctgttaaccctatccagatgaactctcagagcagtgtgaagccactccccatcaaccctgatgatctgtatgtcagtgtgcatggaatgcccttttctgcaatggaaaatgatgtcagagatttttttcatgggctccgtgttgatgcagtgcatttgttgaaagatcatgtaggtcgaaataatgggaatggattggttaagtttctctcccctcaagatacatttgaagctttgaaacgaaacagaatgctgatgattcaacgctatgtggaagttagccctgccacagaaagacagtgggtagctgctggaggccatatcacttttaagcaaaatatgggaccttctggacaaactcatccccctcctcagacacttcccaggtcaaaatcgcccagtgggcagaaaagatcaaggtcaagatcaccacatgaggctggtttttgtgtttacttgaaagggctaccatttgaagcagaaaacaaacatgtcattgatttttttaaaaagctggatattgtggaagatagtatttatatagcttatggacccaatgggaaagcaactggcgaaggctttgtagagttcagaaatgaggctgactataaggctgctctgtgtcgtcataaacagtacatgggcaatcgctttattcaagttcatccaattactaagaaaggtatgctagaaaagatagatatgattcgaaaaagactgcagaacttcagctatgaccagagggaaatgatactaaatccagagggggatgtcaactctgccaaagtctgtgcccacataacaaatattccattcagcattacaaagatggatgttcttcagttcctagaaggaatcccagtggatgaaaatgctgtacatgttcttgttgataacaatgggcaaggtctaggacaggcattggttcagtttaaaaatgaagatgatgcacatggcccactgcgtgaccttggttcagctgtccatttcctgtgaccatctcattgacaaggacatcggctccaagtctgacccactctgcgtccttttacaggatgtgggagggggcagctgggctgagcttggccggactgaacgggtgcggaactgctcaagccctgagttctccaagactctacagcttgagtaccgctttgagacagtccagaagctacgctttggaatctatgacatagacaacaagacgccagagctgagggatgatgacttcctagggggtgctgagtgttccctaggacagattgtgtccagccaggtactgactctccccttgatgctgaagcctggaaaacctgctgggcgggggaccatcacggtctcagctcaggaattaaaggacaatcgtgtagtaaccatggaggtagaggccagaaacctagataagaaggacttcctgggaaaatcagatccatttctggagttcttccgccagggtgatgggaaatggcacctggtgtacagatctgaggtcatcaagaacaacctgaaccctacatggaagcgtttctcagtccccgttcagcatttctgtggtgggaaccccagcacacccatccaggtgcaatgctccgattatgacagtgacgggtcacatgatctcatcggtaccttccacaccagcttggcccagctgcaggcagtcccggctgagtttgaatgcatccaccctgagaagcagcagaaaaagaaaagctacaagaactctggaactatccgtgtcaagatttgtcgggtagaaacagagtactcctttctggactatgtgatgggaggctgtcagatcaacttcactgtgggcgtggacttcactggctccaatggagacccctcctcacctgactccctacactacctgagtccaacaggggtcaatgagtacctgatggcactgtggagtgtgggcagcgtggttcaggactatgactcagacaagctgttccctgcatttggatttggggcccaggttccccctgactggcagtgagctccctctctttctgccactcctgttttcagtttcagggtcctgattttgggggatgtggtaaatttacttgctacttggcactcagctttaagaggagatgcagggttggattcctgcaggcacgtagacagcaagtgctcaggactccatagctcctataggaatcttggcacacgccagtgtcctttttcattcttagcagaggtcatggggaaagaacctcattttcattcttgtctccaggtctcgcatgaatttgccttgaatttcaaccccagtaacccctactgtgcaggcatccagggcattgtggatgcctaccgccaagccctgccccaagttcgcctctatggccctaccaactttgcacccatcatcaaccatgtggccaggtttgcagcccaggctgcacatcaggggactgcctcgcaatacttcatgctgttgctgctgactgatggtgctgtgacggatgtggaagccacacgtgaggctgtggtgcgtgcctcgaacctgcccatgtcagtgatcattgtgggtgtgggtggtgctgactttgaggccatggagcagctggacgctgatggtggacccctgcatacacgttctgggcaggctgctgcccgcgacattgtgcagtttgtaccctaccgccggttccagaatgcccctcgggaggcattggcacagaccgtgctcgcagaagtgcccacacaactggtctcatacttcagggcccagggttgggccccgctcaagccacttccaccctcagccaaggatcctgcacaggccccccaggcctaggttcccttggaggctgtggcaagtcctcaatcctgtgtcccagaggtccctctgggccacaacccaacccttctcactctcctcagtgctagcactttgtattttttgatacttttatacttgtttctgcttttgctgctcttgatcccacctttgctcctgacaaccctcattcaataaagaccagtgaagaccaa

SEQ ID NO: 446103 - DNA, 3880 bp, Homo sapiens
ctcgacgagccggactttctgtgacaacgtgcgacacggacggctggctggcctgcgctcgcggcatccaggcgacagctcgatatcgcggacatgagaggcccgtggctgcgttgggctccgggaagccgttcgggctggggctgtcggccgcggggcggaggcactcgcgcggggggggtaattcggggtctgggttctggtgccgcgcagctttccccgtctaaaagttggttttaattggttgcccacaggattgacttggcctctacttcttgttaaggaaattcatctcttgttttatcaggtgtgtgtggtttcagcgcagcatggctgtggtcatccgtttgcaaggtctcccaattgtggcggggaccatggacattcgccacttcttctctggattgaccattcctgatgggggcgtgcatattgtagggggtgaactgggtgaggctttcatcgtttttgccactgatgaagatgcaaggcttggtatgatgcgcacaggtggtacaattaaagggtcaaaagtaacactattgttgagtagtaagacggaaatgcagaatatgattgaactgagtcgtaggcgttttgaaactgccaacttagatataccaccagcaaatgccagtagatcaggaccaccacctagctcaggaatgagtagcagggtaaacttgcccacaacagtatccaactttaataatccatcacccagtgtagttactgccaccacttctgttcatgaaagcaacaaaaacatacagacattttccacagccagcgtaggaacagctcctccaaatatgggggcttcctttgggagcccaacgtttagctcaactgttccaagcacagcctctccaatgaacacagtcccgccgccaccaattcctccaattccagcgatgccatctctgccaccaatgccatccattcccccaattccagttcctcctccagtacctacattgcctcctgtgcctcctgtgcccccgattcccccagttccttctgtgccacccatgaccccactgccacccatgtcgggcatgccgcccttgaatccgccacctgtggcacctctacctgctggaatgaatggctctggagcacctatgaatttgaacaataatctgaatcctatgtttcttggtccgttgaatcctgttaaccctatccagatgaactctcagagcagtgtgaagccactccccatcaaccctgatgatctgtatgtcagtgtgcatggaatgcccttttctgcaatggaaaatgatgtcagagatttttttcatgggctccgtgttgatgcagtgcatttgttgaaagatcatgtaggtcgaaataatgggaatggattggttaagtttctctcccctcaagatacatttgaagctttgaaacgaaacagaatgctgatgattcaacgctatgtggaagttagccctgccacagaaagacagtgggtagctgctggaggccatatcacttttaagcaaaatatgggaccttctggacaaactcatccccctcctcagacacttcccaggtcaaaatcgcccagtgggcagaaaagatcaaggtcaagatcaccacatgaggctggtttttgtgtttacttgaaagggctaccatttgaagcagaaaacaaacatgtcattgatttttttaaaaagctggatattgtggaagatagtatttatatagcttatggacccaatgggaaagcaactggcgaaggctttgtagagttcagaaatgaggctgactataaggctgctctgtgtcgtcataaacagtacatgggcaatcgctttattcaagttcatccaattactaagaaaggtatgctagaaaagatagatatgattcgaaaaagactgcagaacttcagctatgaccagagggaaatgatactaaatccagagggggatgtcaactctgccaaagtctgtgcccacataacaaatattccattcagcattacaaagatggatgttcttcagttcctagaaggaatcccagtggatgaaaatgctgtacatgttcttgttgataacaatgggcaaggtctaggacaggcattggttcagtttaaaaatgaagatgatgcacatggcccactgcgtgaccttggttcagctgtccatttcctgtgaccatctcattgacaaggacatcggctccaagtctgacccactctgcgtccttttacaggatgtgggagggggcagctgggctgagcttggccggactgaacgggtgcggaactgctcaagccctgagttctccaagactctacagcttgagtaccgctttgagacagtccagaagctacgctttggaatctatgacatagacaacaagacgccagagctgagggatgatgacttcctagggggtgctgagtgttccctaggacagattgtgtccagccaggtactgactctccccttgatgctgaagcctggaaaacctgctgggcgggggaccatcacggtctcagctcaggaattaaaggacaatcgtgtagtaaccatggaggtagaggccagaaacctagataagaaggacttcctgggaaaatcagatccatttctggagttcttccgccagggtgatgggaaatggcacctggtgtacagatctgaggtcatcaagaacaacctgaaccctacatggaagcgtttctcagtccccgttcagcatttctgtggtgggaaccccagcacacccatccaggtgcaatgctccgattatgacagtgacgggtcacatgatctcatcggtaccttccacaccagcttggcccagctgcaggcagtcccggctgagtttgaatgcatccaccctgagaagcagcagaaaaagaaaagctacaagaactctggaactatccgtgtcaagatttgtcgggtagaaacagagtactcctttctggactatgtgatgggaggctgtcagatcaacttcactgtgggcgtggacttcactggctccaatggagacccctcctcacctgactccctacactacctgagtccaacaggggtcaatgagtacctgatggcactgtggagtgtgggcagcgtggttcaggactatgactcgtctcgcatgaatttgccttgaatttcaaccccagtaacccctactgtgcaggcatccagggcattgtggatgcctaccgccaagccctgccccaagttcgcctctatggccctaccaactttgcacccatcatcaaccatgtggccaggtttgcagcccaggctgcacatcaggggactgcctcgcaatacttcatgctgttgctgctgactgatggtgctgtgacggatgtggaagccacacgtgaggctgtggtgcgtgcctcgaacctgcccatgtcagtgatcattgtgggtgtgggtggtgctgactttgaggccatggagcagctggacgctgatggtggacccctgcatacacgttctgggcaggctgctgcccgcgacattgtgcagtttgtaccctaccgccggttccagaatgcccctcgggaggcattggcacagaccgtgctcgcagaagtgcccacacaactggtctcatacttcagggcccagggttgggccccgctcaagccacttccaccctcagccaaggatcctgcacaggccccccaggcctaggttcccttggaggctgtggcaagtcctcaatcctgtgtcccagaggtccctctgggccacaacccaacccttctcactctcctcagtgctagcactttgtattttttgatacttttatacttgtttctgcttttgctgctcttgatcccacctttgctcctgacaaccctcattcaataaagaccagtgaagaccaa

SEQ ID NO: 446104 - DNA, 4058 bp, Homo sapiens
ctcgacgagccggactttctgtgacaacgtgcgacacggacggctggctggcctgcgctcgcggcatccaggcgacagctcgatatcgcggacatgagaggcccgtggctgcgttgggctccgggaagccgttcgggctggggctgtcggccgcggggcggaggcactcgcgcggggggggtaattcggggtctgggttctggtgccgcgcagctttccccgtctaaaagttggttttaattggttgcccacaggattgacttggcctctacttcttgttaaggaaattcatctcttgttttatcaggtgtgtgtggtttcagcgcagcatggctgtggtcatccgtttgcaaggtctcccaattgtggcggggaccatggacattcgccacttcttctctggattgaccattcctgatgggggcgtgcatattgtagggggtgaactgggtgaggctttcatcgtttttgccactgatgaagatgcaaggcttggtatgatgcgcacaggtggtacaattaaagggtcaaaagtaacactattgttgagtagtaagacggaaatgcagaatatgattgaactgagtcgtaggcgttttgaaactgccaacttagatataccaccagcaaatgccagtagatcaggaccaccacctagctcaggaatgagtagcagggtaaacttgcccacaacagtatccaactttaataatccatcacccagtgtagttactgccaccacttctgttcatgaaagcaacaaaaacatacagacattttccacagccagcgtaggaacagctcctccaaatatgggggcttcctttgggagcccaacgtttagctcaactgttccaagcacagcctctccaatgaacacagtcccgccgccaccaattcctccaattccagcgatgccatctctgccaccaatgccatccattcccccaattccagttcctcctccagtacctacattgcctcctgtgcctcctgtgcccccgattcccccagttccttctgtgccacccatgaccccactgccacccatgtcgggcatgccgcccttgaatccgccacctgtggcacctctacctgctggaatgaatggctctggagcacctatgaatttgaacaataatctgaatcctatgtttcttggtccgttgaatcctgttaaccctatccagatgaactctcagagcagtgtgaagccactccccatcaaccctgatgatctgtatgtcagtgtgcatggaatgcccttttctgcaatggaaaatgatgtcagagatttttttcatgggctccgtgttgatgcagtgcatttgttgaaagatcatgtaggtcgaaataatgggaatggattggttaagtttctctcccctcaagatacatttgaagctttgaaacgaaacagaatgctgatgattcaacgctatgtggaagttagccctgccacagaaagacagtgggtagctgctggaggccatatcacttttaagcaaaatatgggaccttctggacaaactcatccccctcctcagacacttcccaggtcaaaatcgcccagtgggcagaaaagatcaaggtcaagatcaccacatgaggctggtttttgtgtttacttgaaagggctaccatttgaagcagaaaacaaacatgtcattgatttttttaaaaagctggatattgtggaagatagtatttatatagcttatggacccaatgggaaagcaactggcgaaggctttgtagagttcagaaatgaggctgactataaggctgctctgtgtcgtcataaacagtacatgggcaatcgctttattcaagttcatccaattactaagaaaggtatgctagaaaagatagatatgattcgaaaaagactgcagaacttcagctatgaccagagggaaatgatactaaatccagagggggatgtcaactctgccaaagtctgtgcccacataacaaatattccattcagcattacaaagatggatgttcttcagttcctagaaggaatcccagtggatgaaaatgctgtacatgttcttgttgataacaatgggcaaggtctaggacaggcattggttcagtttaaaaatgaagatgatgcacatggcccactgcgtgaccttggttcagctgtccatttcctgtgaccatctcattgacaaggacatcggctccaagtctgacccactctgcgtccttttacaggatgtgggagggggcagctgggctgagcttggccggactgaacgggtgcggaactgctcaagccctgagttctccaagactctacagcttgagtaccgctttgagacagtccagaagctacgctttggaatctatgacatagacaacaagacgccagagctgagggatgatgacttcctagggggtgctgagtgttccctaggacagattgtgtccagccaggtactgactctccccttgatgctgaagcctggaaaacctgctgggcgggggaccatcacggtctcagctcaggaattaaaggacaatcgtgtagtaaccatggaggtagaggccagaaacctagataagaaggacttcctgggaaaatcagatccatttctggagttcttccgccagggtgatgggaaatggcacctggtgtacagatctgaggtcatcaagaacaacctgaaccctacatggaagcgtttctcagtccccgttcagcatttctgtggtgggaaccccagcacacccatccaggtgcaatgctccgattatgacagtgacgggtcacatgatctcatcggtaccttccacaccagcttggcccagctgcaggcagtcccggctgagtttgaatgcatccaccctgagaagcagcagaaaaagaaaagctacaagaactctggaactatccgtgtcaagatttgtcgggtagaaacagagtactcctttctggactatgtgatgggaggctgtcagatcaacttcactgtgggcgtggacttcactggctccaatggagacccctcctcacctgactccctacactacctgagtccaacaggggtcaatgagtacctgatggcactgtggagtgtgggcagcgtggttcaggactatgactcagacaagctgttccctgcatttggatttggggcccaggttccccctgactggcaggtctcgcatgaatttgccttgaatttcaaccccagtaacccctactgtgcaggcatccagggcattgtggatgcctaccgccaagccctgccccaagttcgcctctatggccctaccaactttgcacccatcatcaaccatgtggccaggtttgcagcccaggctgcacatcaggggactgcctcgcaatacttcatgctgttgctgctgactgatggtgctgtgacggatgtggaagccacacgtgaggctgtggtgcgtgcctcgaacctgcccatgtcagtgatcattgtgggtgtgggtggtgctgactttgaggccatggagcagctggacgctgatggtggacccctgcatacacgttctgggcaggctgctgcccgcgacattgtgcagtttgtaccctaccgccggttccagaatgcccctcgggaggcattggcacagaccgtgctcgcagaagtgcccacacaactggtctcatacttcagggcccagggttgggccccgctcaagccacttccaccctcagccaaggatcctgcacaggccccccaggcctaggttcccttggaggctgtggcaagtcctcaatcctgtgtcccagaggtccctctgggccacaacccaacccttctcactctcctcagtgctagcactttgtattttttgatacttttatacttgtttctgcttttgctgctcttgatcccacctttgctcctgacaaccctcattcaataaagaccagtgaagaccaaaaaaaaaaggggggcgcaaagattccccaagggcccagtacacgtcacccgttttgtaaaagggccccaagggcgaaaaaaagagcgcgggtaaacgcgggaaagatggtctgggccctgggg

SEQ ID NO: 446105 - DNA, 3629 bp, Homo sapiens
ctcgacgagccggactttctgtgacaacgtgcgacacggacggctggctggcctgcgctcgcggcatccaggcgacagctcgatatcgcggacatgagaggcccgtggctgcgttgggctccgggaagccgttcgggctggggctgtcggccgcggggcggaggcactcgcgcggggggggtaattcggggtctgggttctggtgccgcgcagctttccccgtctaaaagttggttttaattggttgcccacaggattgacttggcctctacttcttgttaaggaaattcatctcttgttttatcaggtgtgtgtggtttcagcgcagcatggctgtggtcatccgtttgcaaggtctcccaattgtggcggggaccatggacattcgccacttcttctctggattgaccattcctgatgggggcgtgcatattgtagggggtgaactgggtgaggctttcatcgtttttgccactgatgaagatgcaaggcttggtatgatgcgcacaggtggtacaattaaagggtcaaaagtaacactattgttgagtagtaagacggaaatgcagaatatgattgaactgagtcgtaggcgttttgaaactgccaacttagatataccaccagcaaatgccagtagatcaggaccaccacctagctcaggaatgagtagcagggtaaacttgcccacaacagtatccaactttaataatccatcacccagtgtagttactgccaccacttctgttcatgaaagcaacaaaaacatacagacattttccacagccagcgtaggaacagctcctccaaatatgggggcttcctttgggagcccaacgtttagctcaactgttccaagcacagcctctccaatgaacacagtcccgccgccaccaattcctccaattccagcgatgccatctctgccaccaatgccatccattcccccaattccagttcctcctccagtacctacattgcctcctgtgcctcctgtgcccccgattcccccagttccttctgtgccacccatgaccccactgccacccatgtcgggcatgccgcccttgaatccgccacctgtggcacctctacctgctggaatgaatggctctggagcacctatgaatttgaacaataatctgaatcctatgtttcttggtccgttgaatcctgttaaccctatccagatgaactctcagagcagtgtgaagccactccccatcaaccctgatgatctgtatgtcagtgtgcatggaatgcccttttctgcaatggaaaatgatgtcagagatttttttcatgggctccgtgttgatgcagtgcatttgttgaaagatcatgtaggtcgaaataatgggaatggattggttaagtttctctcccctcaagatacatttgaagctttgaaacgaaacagaatgctgatgattcaacgctatgtggaagttagccctgccacagaaagacagtgggtagctgctggaggccatatcacttttaagcaaaatatgggaccttctggacaaactcatccccctcctcagacacttcccaggtcaaaatcgcccagtgggcagaaaagatcaaggtcaagatcaccacatgaggctggtttttgtgtttacttgaaagggctaccatttgaagcagaaaacaaacatgtcattgatttttttaaaaagctggatattgtggaagatagtatttatatagcttatggacccaatgggaaagcaactggcgaaggctttgtagagttcagaaatgaggctgactataaggctgctctgtgtcgtcataaacagtacatgggcaatcgctttattcaagttcatccaattactaagaaaggtatgctagaaaagatagatatgattcgaaaaagactgcagaacttcagctatgaccagagggaaatgatactaaatccagagggggatgtcaactctgccaaagtctgtgcccacataacaaatattccattcagcattacaaagatggatgttcttcagttcctagaaggaatcccagtggatgaaaatgctgtacatgttcttgttgataacaatgggcaaggtctaggacaggcattggttcagtttaaaaatgaagatgatgcacgtaagtctgaacgcttacaccgtaaaaaacttaatgggagagaagcttttgttcatgtagttaccctagaagatatgagagagattgagaaaaatccccctgcccaaggaaaaaagggattaaagatgcctgtgccaggtaatcctgcagttccaggaatgcccaatgcgggactgcccggtgtgggactgcccagtgcaggacttcccggtgcaggcctgcccagcacaggactgcctggttcagcaataaccagtgcaggactgcctggtgcgggaatgcccagtgcaggaatacctagtgcaggaggtgaagagcatgccttcctgactgtaggatcaaaggaagccaataatgggcctccatttaactttcctggtaattttggtggatcaaatgcctttgggccaccaatccctcctccaggattaggaggcggggcctttggtgatgctaggcctggtatgccttcagttggaaacagtggtttgcctggtctaggactggatgttccgggttttggaggtggaccaaacaatttaagtgggccatcgggatttggagggggccctcagaattttggaaatggccctggtagcttaggcggtcccccggggtttggaagtggccctcctggtcttggaagtgcccctgggcatttgggtgggccaccagcttttgggcctggccccggccccggccccggccctggcccaatccatattggtggtccccctggctttgcatctagttctggaaaaccaggaccgacagtaattaaagtgcaaaacatgccctttactgtgtctattgatgagattttagatttcttttatggctatcaagtaatcccaggctcagtgtgtttaaaatacaatgaaaaaggtatgcccacaggtgaagccatggtggcctttgagtctcgggatgaagccacagctgctgtcattgacttaaatgacaggcctataggttcaagaaaagtaaaacttgtattagggtagccattcacatcattttttatagggtagatcttcatattgctgtgattaatgcatccagattgttttcctagtatttccaggttagaacctgtggattgtttcaattgcatatagcttggtttccataacatagagcattggttgactgtttacagaagactcactcaccaggataaacattgctgtatgttacagtaaagctatctggagagaacacataaatgattttggcataccattagagaaaccatttgtaaaactcaaatgaccacataaagcttatcaaggagtctagattggttttgttttataccatatgggatgaagaaaatagaaatgtcagtagaactcattgagggtgctcttgccagctgctgaaaatagaagttggctactctcagaatttggtttaaagctggacagatttgctttgttatagggtaaagctttgtctaaagtcctcattttcttttaaaattgaataaaatttctgtatacaga

SEQ ID NO: 446106 - DNA, 6727 bp, Homo sapiens
ctcgacgagccggactttctgtgacaacgtgcgacacggacggctggctggcctgcgctcgcggcatccaggcgacagctcgatatcgcggacatgagaggcccgtggctgcgttgggctccgggaagccgttcgggctggggctgtcggccgcggggcggaggcactcgcgcggggggggtaattcggggtctgggttctggtgccgcgcagctttccccgtctaaaagttggttttaattggttgcccacaggattgacttggcctctacttcttgttaaggaaattcatctcttgttttatcaggtgtgtgtggtttcagcgcagcatggctgtggtcatccgtttgcaaggtctcccaattgtggcggggaccatggacattcgccacttcttctctggattgaccattcctgatgggggcgtgcatattgtagggggtgaactgggtgaggctttcatcgtttttgccactgatgaagatgcaaggcttggtatgatgcgcacaggtggtacaattaaagggtcaaaagtaacactattgttgagtagtaagacggaaatgcagaatatgattgaactgagtcgtaggcgttttgaaactgccaacttagatataccaccagcaaatgccagtagatcaggaccaccacctagctcaggaatgagtagcagggtaaacttgcccacaacagtatccaactttaataatccatcacccagtgtagttactgccaccacttctgttcatgaaagcaacaaaaacatacagacattttccacagccagcgtaggaacagctcctccaaatatgggggcttcctttgggagcccaacgtttagctcaactgttccaagcacagcctctccaatgaacacagtcccgccgccaccaattcctccaattccagcgatgccatctctgccaccaatgccatccattcccccaattccagttcctcctccagtacctacattgcctcctgtgcctcctgtgcccccgattcccccagttccttctgtgccacccatgaccccactgccacccatgtcgggcatgccgcccttgaatccgccacctgtggcacctctacctgctggaatgaatggctctggagcacctatgaatttgaacaataatctgaatcctatgtttcttggtccgttgaatcctgttaaccctatccagatgaactctcagagcagtgtgaagccactccccatcaaccctgatgatctgtatgtcagtgtgcatggaatgcccttttctgcaatggaaaatgatgtcagagatttttttcatgggctccgtgttgatgcagtgcatttgttgaaagatcatgtaggtcgaaataatgggaatggattggttaagtttctctcccctcaagatacatttgaagctttgaaacgaaacagaatgctgatgattcaacgctatgtggaagttagccctgccacagaaagacagtgggtagctgctggaggccatatcacttttaagcaaaatatgggaccttctggacaaactcatccccctcctcagacacttcccaggtcaaaatcgcccagtgggcagaaaagatcaaggtcaagatcaccacatgaggctggtttttgtgtttacttgaaagggctaccatttgaagcagaaaacaaacatgtcattgatttttttaaaaagctggatattgtggaagatagtatttatatagcttatggacccaatgggaaagcaactggcgaaggctttgtagagttcagaaatgaggctgactataaggctgctctgtgtcgtcataaacagtacatgggcaatcgctttattcaagttcatccaattactaagaaaggtatgctagaaaagatagatatgattcgaaaaagactgcagaacttcagctatgaccagagggaaatgatactaaatccagagggggatgtcaactctgccaaagtctgtgcccacataacaaatattccattcagcattacaaagatggatgttcttcagttcctagaaggaatcccagtggatgaaaatgctgtacatgttcttgttgataacaatgggcaaggtctaggacaggcattggttcagtttaaaaatgaagatgatgcacgtaagtctgaacgcttacaccgtaaaaaacttaatgggagagaagcttttgttcatgtagttaccctagaagatatgagagagattgagaaaaatccccctgcccaaggaaaaaagggattaaagatgcctgtgccaggtaatcctgcagttccaggaatgcccaatgcgggactgcccggtgtgggactgcccagtgcaggacttcccggtgcaggcctgcccagcacaggactgcctggttcagcaataaccagtgcaggactgcctggtgcgggaatgcccagtgcaggaatacctagtgcaggaggtgaagagcatgccttcctgactgtaggatcaaaggaagccaataatgggcctccatttaactttcctggtaattttggtggatcaaatgcctttgggccaccaatccctcctccaggattaggaggcggggcctttggtgatgctaggcctggtatgccttcagttggaaacagtggtttgcctggtctaggactggatgttccgggttttggaggtggaccaaacaatttaagtgggccatcgggatttggagggggccctcagaattttggaaatggccctggtagcttaggcggtcccccggggtttggaagtggccctcctggtcttggaagtgcccctgggcatttgggtgggccaccagcttttgggcctggccccggccccggccccggccctggcccaatccatattggtggtccccctggctttgcatctagttctggaaaaccaggaccgacagtaattaaagtgcaaaacatgccctttactgtgtctattgatgagattttagatttcttttatggctatcaagtaatcccaggctcagtgtgtttaaaatacaatgaaaaaggtatgcccacaggtgaagccatggtggcctttgagtctcgggatgaagccacagctgctgtcattgacttaaatgacaggcctataggttcaagaaaagtaaaacttgtattagggtagccattcacatcattttttatagggtagatcttcatattgctgtgattaatgcatccagattgttttcctagtatttccaggttagaacctgtggattgtttcaattgcatatagcttggtttccataacatagagcattggttgactgtttacagaagactcactcaccaggataaacattgctgtatgttacagtaaagctatctggagagaacacataaatgattttggcataccattagagaaaccatttgtaaaactcaaatgaccacataaagcttatcaaggagtctagattggttttgttttataccatatgggatgaagaaaatagaaatgtcagtagaactcattgagggtgctcttgccagctgctgaaaatagaagttggctactctcagaatttggtttaaagctggacagatttgctttgttatagggtaaagctttgtctaaagtcctcattttcttttaaaattgaataaaatttctgtatacagattcattgtatgtacctttattgcttcttaagggtccttgctgtatagacagtcctgcttcagaagttgctgctttgtttgtctaattgactcatttgtaaatgagcagaactgttttgttggtttttttccctaaatataaaagtccacacttcgtttgtgctataacctcaaactttgatttctaatgtcacacttaaaactgtgtggaataagacttttgccataaaaataaactatggagtcctttatctaccagagcctttttggtttgaccgccacgatttaggttagtcagtttaaaaattgttcatgttgtttggatggtatcgaaaaccagaaaccacttttaataatgtgtttaagatacttgatttgaagtccttttcatatggactaattgtagtatcaatttcctcctgtcccgattatgtgaaattttggcctttaaacaaagaggggcccattcataagaaagtgttatatctaggtttttaaaactgaagttgaaattatctttgttagcagtagtagtatagaataaaagatccgtatgctggttcgtagattgatacgtgttagtcctgttatttggaggctttttggcatagttgttcgatcaggagcctgtttactaaaagtcttcatacagagtacaagtgcagccgccagaggagaaaattgagattcttgaccctttcatactcttttctttggtattcaggacactaaggcaggaggaccacatgagttctggttggtaagtgtccttgtcatgaaaacacttgccttacaaggctctaattatgatttccctagtcagtgctctgaagatgtgtcacattatattataaacaatacggaaggggagataggtgagatgatatgaaaaacaaattttctcactgtcataaaaggctctaattatggttactttccttgtgatgaaaaacttggccttacagggctctagttatggttactttccctagtcaatgctctgaaaatgtgtcacattataaacaatacagaaggagagatagatgagagatcatgaaaaccaaattttatcttttacatggcccctttgtcttcgtttgaaacatccccaacatttcctacaaatcagcgtagttacaaaggggtcagtcttttaaaataagtatttcctattaaactatatatatatacagtgcctttttggtgttgtgagtcagtggaacactgaaatacagcggttgtgtaatttaagagtggcaacagtttcatttgataagatttgaaaaggctttttatcactacaatcttagaggattgacagtacaggatttttgtttaagagaaggattgtttagactcaagaggtgactatgttgtgggtcttttgataattcatgaatacagatttgctttgaccgatcactagatactgcctcctcaatttcaaaagcaatataacgtttgtatatgctgtttaatttaagttaatgttaagtaatcatttctcattccaaagacaatgcaaaaaacttcagcactgcttgagagttgtatttcagccacagatattttctccattggaaagctattttcattttagaaaaatgggttgtttgaagatgaaagtcttttatcttttttcacaatttattttggttatatgttcgtacattcttattaaatatttcatacactttattgcaactactttgttatttctacatcttagataaatgctgaaaaggaaaacgatttcattgttcatctaattaaataaattaaaagagcggtttgtgtagaaattggagagaactatgttttatatgaatcacaacagtgctcgttgtggactgtaattaaatgctttgccctctggaacttgatttttgtgtatctgagatttattaacagtgctaactgctaaggatactgtttatcttgttctgggcattggagtttcagtttttaaaaaattcttgaaaatgtattctgtgaaactactcatacctctcttcctgcgaattttctcctaagaactaggtttggggtagaaatgaattgacattattttctcatttgctttgtatggtatgaaggatttgtaaagctttgctcaaagttgtgtgcatttgtaaacactatcatgatattttcaattttatgtgtaaattttattgtctgtttttggtgactctgacattaatggaagagaatattttccattagatttaattttttttcctctcccttctgattttttttttattggtgttcatttttcttttgatttaaaggattagagaaatctacaaatgtatgtcataaataagcaaatttgtaaacttttctgaactttagtgaaacatttagttcacaagcataatttggaggtgtgttctgtgtttacacagtagtttggatgtacaattattattagtggctttttaaaaaatgaaacagtgttaagtgaaatgtagttcctagctttgtactccaagttgtcaaagcatcaacaatgaaaattcgattaggaaactttatttaaaatttcaggtagtaatattcagtgtagttaaggccagtcttaacccactggatgaaaatctaggactgtatggaagtaagcaaacattacatttttaggtggaaatagtcagccttgcataaaaacaaggatgcgtgaaagccttaaattccagctcccttttactggagtctgtggttgtgtacaggtatgggccaagtgtaaaatctcatcaattttaagaacactcgggaaatgagtaaagaaaatgtaaaattgctgctagtcaaatcttttggaaagaatttctggaagtggtcactttaaaaattattttccacccttgcaaaattgccacatttaaattgttttactggcagttctatagtagtccagactttagaaaccaaacacaacaaaatggcttgttgccaatatggccacaacattgccagcaaatactgccttggcatcactcagcagaggtttttgtttataaagatgaagtcttgaatactgttcaataaacttgtcaaaaaataaaacaggctgatgcttttaatgctttaactgca

SEQ ID NO: 446107 - DNA, 6069 bp, Homo sapiens
ctcgacgagccggactttctgtgacaacgtgcgacacggacggctggctggcctgcgctcgcggcatccaggcgacagctcgatatcgcggacatgagaggcccgtggctgcgttgggctccgggaagccgttcgggctggggctgtcggccgcggggcggaggcactcgcgcggggggggtaattcggggtctgggttctggtgccgcgcagctttccccgtctaaaagttggttttaattggttgcccacaggattgacttggcctctacttcttgttaaggaaattcatctcttgttttatcaggtgtgtgtggtttcagcgcagcatggctgtggtcatccgtttgcaaggtctcccaattgtggcggggaccatggacattcgccacttcttctctggattgaccattcctgatgggggcgtgcatattgtagggggtgaactgggtgaggctttcatcgtttttgccactgatgaagatgcaaggcttggtatgatgcgcacaggtggtacaattaaagggtcaaaagtaacactattgttgagtagtaagacggaaatgcagaatatgattgaactgagtcgtaggcgttttgaaactgccaacttagatataccaccagcaaatgccagtagatcaggaccaccacctagctcaggaatgagtagcagggtaaacttgcccacaacagtatccaactttaataatccatcacccagtgtagttactgccaccacttctgttcatgaaagcaacaaaaacatacagacattttccacagccagcgtaggaacagctcctccaaatatgggggcttcctttgggagcccaacgtttagctcaactgttccaagcacagcctctccaatgaacacagtcccgccgccaccaattcctccaattccagcgatgccatctctgccaccaatgccatccattcccccaattccagttcctcctccagtacctacattgcctcctgtgcctcctgtgcccccgattcccccagttccttctgtgccacccatgaccccactgccacccatgtcgggcatgccgcccttgaatccgccacctgtggcacctctacctgctggaatgaatggctctggagcacctatgaatttgaacaataatctgaatcctatgtttcttggtccgttgaatcctgttaaccctatccagatgaactctcagagcagtgtgaagccactccccatcaaccctgatgatctgtatgtcagtgtgcatggaatgcccttttctgcaatggaaaatgatgtcagagatttttttcatgggctccgtgttgatgcagtgcatttgttgaaagatcatgtaggtcgaaataatgggaatggattggttaagtttctctcccctcaagatacatttgaagctttgaaacgaaacagaatgctgatgattcaacgctatgtggaagttagccctgccacagaaagacagtgggtagctgctggaggccatatcacttttaagcaaaatatgggaccttctggacaaactcatccccctcctcagacacttcccaggtcaaaatcgcccagtgggcagaaaagatcaaggtcaagatcaccacatgaggctggtttttgtgtttacttgaaagggctaccatttgaagcagaaaacaaacatgtcattgatttttttaaaaagctggatattgtggaagatagtatttatatagcttatggacccaatgggaaagcaactggcgaaggctttgtagagttcagaaatgaggctgactataaggctgctctgtgtcgtcataaacagtacatgggcaatcgctttattcaagttcatccaattactaagaaaggtatgctagaaaagatagatatgattcgaaaaagactgcagaacttcagctatgaccagagggaaatgatactaaatccagagggggatgtcaactctgccaaagtctgtgcccacataacaaatattccattcagcattacaaagatggatgttcttcagttcctagaaggaatcccagtggatgaaaatgctgtacatgttcttgttgataacaatgggcaaggtctaggacaggcattggttcagtttaaaaatgaagatgatgcacgtaagtctgaacgcttacaccgtaaaaaacttaatgggagagaagcttttgttcatgtagttaccctagaagatatgagagagattgagaaaaatccccctgcccaaggaaaaaagggattaaagatgcctgtgccaggtaatcctgcagttccaggaatgcccaatgcgggactgcccggtgtgggactgcccagtgcaggacttcccggtgcaggcctgcccagcacaggactgcctggttcagcaataaccagtgcaggactgcctggtgcgggaatgcccagtgcaggaatacctagtgcaggaggtgaagagcatgccttcctgactgtaggatcaaaggaagccaataatgggcctccatttaactttcctggtaattttggtggatcaaatgcctttgggccaccaatccctcctccaggattaggaggcggggcctttggtgatgctaggcctggtatgccttcagttggaaacagtggtttgcctggtctaggactggatgttccgggttttggaggtggaccaaacaatttaagtgggccatcgggatttggagggggccctcagaattttggaaatggccctggtagcttaggcggtcccccggggtttggaagtggccctcctggtcttggaagtgcccctgggcatttgggtgggccaccagcttttgggcctggccccggccccggccccggccctggcccaatccatattggtggtccccctggctttgcatctagttctggaaaaccaggaccgacagtaattaaagtgcaaaacatgccctttactgtgtctattgatgagattttagatttcttttatggctatcaagtaatcccaggctcagtgtgtttaaaatacaatgaaaaaggtatgcccacaggtgaagccatggtggcctttgagtctcgggatgaagccacagctgctgtcattgacttaaatgacaggcctataggttcaagaaaagtaaaacttgtattagggtagccattcacatcattttttatagggtagatcttcatattgctgtgattaatgcatccagattgttttcctagtatttccaggttagaacctgtggattgtttcaattgcatatagcttggtttccataacatagagcattggttgactgtttacagaagactcactcaccaggataaacattgctgtatgttacagtaaagctatctggagagaacacataaatgattttggcataccattagagaaaccatttgtaaaactcaaatgaccacataaagcttatcaaggagtctagattggttttgttttataccatatgggatgaagaaaatagaaatgtcagtagaactcattgagggtgctcttgccagctgctgaaaatagaagttggctactctcagaatttggtttaaagctggacagatttgctttgttatagggtaaagctttgtctaaagtcctcattttcttttaaaattgaataaaatttctgtatacagattcattgtatgtacctttattgcttcttaagggtccttgctgtatagacagtcctgcttcagaagttgctgctttgtttgtctaattgactcatttgtaaatgagcagaactgttttgttggtttttttccctaaatataaaagtccacacttcgtttgtgctataacctcaaactttgatttctaatgtcacacttaaaactgtgtggaataagacttttgccataaaaataaactatggagtcctttatctaccagagcctttttggtttgaccgccacgatttaggttagtcagtttaaaaattgttcatgttgtttggatggtatcgaaaaccagaaaccacttttaataatgtgtttaagatacttgatttgaagtccttttcatatggactaattgtagtatcaatttcctcctgtcccgattatgtgaaattttggcctttaaacaaagaggggcccattcataagaaagtgttatatctaggtttttaaaactgaagttgaaattatctttgttagcagtagtagtatagaataaaagatccgtatgctggttcgtagattgatacgtgttagtcctgttatttggaggctttttggcatagttgttcgatcaggagcctgtttactaaaagtcttcatacagagtacaagtgcagccgccagaggagaaaattgagattcttgaccctttcatactcttttctttggtattcaggacactaaggcaggaggaccacatgagttctggttggtaagtgtccttgtcatgaaaacacttgccttacaaggctctaattatgatttccctagtcagtgctctgaagatgtgtcacattatattataaacaatacggaaggggagataggtgagatgatatgaaaaacaaattttctcactgtcataaaaggctctaattatggttactttccttgtgatgaaaaacttggccttacagggctctagttatggttactttccctagtcaatgctctgaaaatgtgtcacattataaacaatacagaaggagagatagatgagagatcatgaaaaccaaattttatcttttacatggcccctttgtcttcgtttgaaacatccccaacatttcctacaaatcagcgtagttacaaaggggtcagtcttttaaaataagtatttcctattaaactatatatatatacagtgcctttttggtgttgtgagtcagtggaacactgaaatacagcggttgtgtaatttaagagtggcaacagtttcatttgataagatttgaaaaggctttttatcactacaatcttagaggattgacagtacaggatttttgtttaagagaaggattgtttagactcaagaggtgactatgttgtgggtcttttgataattcatgaatacagatttgctttgaccgatcactagatactgcctcctcaatttcaaaagcaatataacgtttgtatatgctgtttaatttaagttaatgttaagtaatcatttctcattccaaagacaatgcaaaaaacttcagcactgcttgagagttgtatttcagccacagatattttctccattggaaagctattttcattttagaaaaatgggttgtttgaagatgaaagtcttttatcttttttcacaatttattttggttatatgttcgtacattcttattaaatatttcatacactttattgcaactactttgttatttctacatcttagataaatgctgaaaaggaaaacgatttcattgttcatctaattaaataaattaaaagagcggtttgtgtagaaattggagagaactatgttttatatgaatcacaacagtgctcgttgtggactgtaattaaatgctttgccctctggaacttgatttttgtgtatctgagatttattaacagtgctaactgctaaggatactgtttatcttgttctgggcattggagtttcagtttttaaaaaattcttgaaaatgtattctgtgaaactactcatacctctcttcctgcgaattttctcctaagaactaggtttggggtagaaatgaattgacattattttctcatttgctttgtatggtatgaaggatttgtaaagctttgctcaaagttgtgtgcatttgtaaacactatcatgatattttcaattttatgtgtaaattttattgtctgtttttggtgactctgacattaatggaagagaatattttccattagatttaattttttttcctctcccttctgattttttttttattggtgttcatttttcttttgatttaaaggattagagaaatctacaaatgtatgtcataaataagcaaatttgtaaacttttctgaactttagtgaaacatttagttcacaagcactcctccccggcggcccgtgttcctgttgtttaccacagctacctttgccattctccacaa

SEQ ID NO: 446108 - DNA, 3635 bp, Homo sapiens
  misc_feature (3635)..(3635): n is a, c, g, or t
ctcgacgagccggactttctgtgacaacgtgcgacacggacggctggctggcctgcgctcgcggcatccaggcgacagctcgatatcgcggacatgagaggcccgtggctgcgttgggctccgggaagccgttcgggctggggctgtcggccgcggggcggaggcactcgcgcggggggggtaattcggggtctgggttctggtgccgcgcagctttccccgtctaaaagttggttttaattggttgcccacaggattgacttggcctctacttcttgttaaggaaattcatctcttgttttatcaggtgtgtgtggtttcagcgcagcatggctgtggtcatccgtttgcaaggtctcccaattgtggcggggaccatggacattcgccacttcttctctggattgaccattcctgatgggggcgtgcatattgtagggggtgaactgggtgaggctttcatcgtttttgccactgatgaagatgcaaggcttggtatgatgcgcacaggtggtacaattaaagggtcaaaagtaacactattgttgagtagtaagacggaaatgcagaatatgattgaactgagtcgtaggcgttttgaaactgccaacttagatataccaccagcaaatgccagtagatcaggaccaccacctagctcaggaatgagtagcagggtaaacttgcccacaacagtatccaactttaataatccatcacccagtgtagttactgccaccacttctgttcatgaaagcaacaaaaacatacagacattttccacagccagcgtaggaacagctcctccaaatatgggggcttcctttgggagcccaacgtttagctcaactgttccaagcacagcctctccaatgaacacagtcccgccgccaccaattcctccaattccagcgatgccatctctgccaccaatgccatccattcccccaattccagttcctcctccagtacctacattgcctcctgtgcctcctgtgcccccgattcccccagttccttctgtgccacccatgaccccactgccacccatgtcgggcatgccgcccttgaatccgccacctgtggcacctctacctgctggaatgaatggctctggagcacctatgaatttgaacaataatctgaatcctatgtttcttggtccgttgaatcctgttaaccctatccagatgaactctcagagcagtgtgaagccactccccatcaaccctgatgatctgtatgtcagtgtgcatggaatgcccttttctgcaatggaaaatgatgtcagagatttttttcatgggctccgtgttgatgcagtgcatttgttgaaagatcatgtaggtcgaaataatgggaatggattggttaagtttctctcccctcaagatacatttgaagctttgaaacgaaacagaatgctgatgattcaacgctatgtggaagttagccctgccacagaaagacagtgggtagctgctggaggccatatcacttttaagcaaaatatgggaccttctggacaaactcatccccctcctcagacacttcccaggtcaaaatcgcccagtgggcagaaaagatcaaggtcaagatcaccacatgaggctggtttttgtgtttacttgaaagggctaccatttgaagcagaaaacaaacatgtcattgatttttttaaaaagctggatattgtggaagatagtatttatatagcttatggacccaatgggaaagcaactggcgaaggctttgtagagttcagaaatgaggctgactataaggctgctctgtgtcgtcataaacagtacatgggcaatcgctttattcaagttcatccaattactaagaaaggtatgctagaaaagatagatatgattcgaaaaagactgcagaacttcagctatgaccagagggaaatgatactaaatccagagggggatgtcaactctgccaaagtctgtgcccacataacaaatattccattcagcattacaaagatggatgttcttcagttcctagaaggaatcccagtggatgaaaatgctgtacatgttcttgttgataacaatgggcaaggtctaggacaggcattggttcagtttaaaaatgaagatgatgcacatggcccactgcgtgaccttggttcagctgtccatttcctgtgaccatctcattgacaaggacatcggctccaagtctgacccactctgcgtccttttacaggatgtgggagggggcagctgggctgagcttggccggactgaacgggtgcggaactgctcaagccctgagttctccaagactctacagcttgagtaccgctttgagacagtccagaagctacgctttggaatctatgacatagacaacaagacgccagagctgagggatgatgacttcctagggggtgctgagtgttccctaggacagattgtgtccagccaggtactgactctccccttgatgctgaagcctggaaaacctgctgggcgggggaccatcacggtctcagctcaggaattaaaggacaatcgtgtagtaaccatggaggtagaggccagaaacctagataagaaggacttcctgggaaaatcagatccatttctggagttcttccgccagggtgatgggaaatggcacctggtgtacagatctgaggtcatcaagaacaacctgaaccctacatggaagcgtttctcagtccccgttcagcatttctgtggtgggaaccccagcacacccatccaggtgcaatgctccgattatgacagtgacgggtcacatgatctcatcggtaccttccacaccagcttggcccagctgcaggcagtcccggctgagtttgaatgcatccaccctgagaagcagcagaaaaagaaaagctacaagaactctggaactatccgtgtcaagatttgtcgggtagaaacagagtactcctttctggactatgtgatgggaggctgtcagatcaacttcactgtgggcgtggacttcactggctccaatggagacccctcctcacctgactccctacactacctgagtccaacaggggtcaatgagtacctgatggcactgtggagtgtgggcagcgtggttcaggactatgactcagacaagctgttccctgcatttggatttggggcccaggttccccctgactggcaggtctcgcatgaatttgccttgaatttcaaccccagtaacccctactgtgcaggcatccagggcattgtggatgcctaccgccaagccctgccccaagttcgcctctatggccctaccaactttgcacccatcatcaaccatgtggccaggtttgcagcccaggctgcacatcaggggactgcctcgcaatacttcatgctgttgctgctgactgatggtgctgtgacggatgtggaagccacacgtgaggctgtggtgcgtgcctcgaacctgcccatgtcagtgatcattgtgggtgtgggtggtgctgactttgaggccatggagcagctggacgctgatggtggacccctgcatacacgttctgggcaggctgctgcccgcgacattgtgcagtttgtacctacggcgggtcgaatgcccggggggctgggccccgggtcccaatgccaccgggtccn

SEQ ID NO: 446109 - DNA, 4143 bp, Homo sapiens
ctcgacgagccggactttctgtgacaacgtgcgacacggacggctggctggcctgcgctcgcggcatccaggcgacagctcgatatcgcggacatgagaggcccgtggctgcgttgggctccgggaagccgttcgggctggggctgtcggccgcggggcggaggcactcgcgcggggggggtaattcggggtctgggttctggtgccgcgcagctttccccgtctaaaagttggttttaattggttgcccacaggattgacttggcctctacttcttgttaaggaaattcatctcttgttttatcaggtgtgtgtggtttcagcgcagcatggctgtggtcatccgtttgcaaggtctcccaattgtggcggggaccatggacattcgccacttcttctctggattgaccattcctgatgggggcgtgcatattgtagggggtgaactgggtgaggctttcatcgtttttgccactgatgaagatgcaaggcttggtatgatgcgcacaggtggtacaattaaagggtcaaaagtaacactattgttgagtagtaagacggaaatgcagaatatgattgaactgagtcgtaggcgttttgaaactgccaacttagatataccaccagcaaatgccagtagatcaggaccaccacctagctcaggaatgagtagcagggtaaacttgcccacaacagtatccaactttaataatccatcacccagtgtagttactgccaccacttctgttcatgaaagcaacaaaaacatacagacattttccacagccagcgtaggaacagctcctccaaatatgggggcttcctttgggagcccaacgtttagctcaactgttccaagcacagcctctccaatgaacacagtcccgccgccaccaattcctccaattccagcgatgccatctctgccaccaatgccatccattcccccaattccagttcctcctccagtacctacattgcctcctgtgcctcctgtgcccccgattcccccagttccttctgtgccacccatgaccccactgccacccatgtcgggcatgccgcccttgaatccgccacctgtggcacctctacctgctggaatgaatggctctggagcacctatgaatttgaacaataatctgaatcctatgtttcttggtccgttgaatcctgttaaccctatccagatgaactctcagagcagtgtgaagccactccccatcaaccctgatgatctgtatgtcagtgtgcatggaatgcccttttctgcaatggaaaatgatgtcagagatttttttcatgggctccgtgttgatgcagtgcatttgttgaaagatcatgtaggtcgaaataatgggaatggattggttaagtttctctcccctcaagatacatttgaagctttgaaacgaaacagaatgctgatgattcaacgctatgtggaagttagccctgccacagaaagacagtgggtagctgctggaggccatatcacttttaagcaaaatatgggaccttctggacaaactcatccccctcctcagacacttcccaggtcaaaatcgcccagtgggcagaaaagatcaaggtcaagatcaccacatgaggctggtttttgtgtttacttgaaagggctaccatttgaagcagaaaacaaacatgtcattgatttttttaaaaagctggatattgtggaagatagtatttatatagcttatggacccaatgggaaagcaactggcgaaggctttgtagagttcagaaatgaggctgactataaggctgctctgtgtcgtcataaacagtacatgggcaatcgctttattcaagttcatccaattactaagaaaggtatgctagaaaagatagatatgattcgaaaaagactgcagaacttcagctatgaccagagggaaatgatactaaatccagagggggatgtcaactctgccaaagtctgtgcccacataacaaatattccattcagcattacaaagatggatgttcttcagttcctagaaggaatcccagtggatgaaaatgctgtacatgttcttgttgataacaatgggcaaggtctaggacaggcattggttcagtttaaaaatgaagatgatgcacatggcccactgcgtgaccttggttcagctgtccatttcctgtgaccatctcattgacaaggacatcggctccaagtctgacccactctgcgtccttttacaggatgtgggagggggcagctgggctgagcttggccggactgaacgggtgcggaactgctcaagccctgagttctccaagactctacagcttgagtaccgctttgagacagtccagaagctacgctttggaatctatgacatagacaacaagacgccagagctgagggatgatgacttcctagggggtgctgagtgttccctaggacagattgtgtccagccaggtactgactctccccttgatgctgaagcctggaaaacctgctgggcgggggaccatcacggtctcagctcaggaattaaaggacaatcgtgtagtaaccatggaggtagaggccagaaacctagataagaaggacttcctgggaaaatcagatccatttctggagttcttccgccagggtgatgggaaatggcacctggtgtacagatctgaggtcatcaagaacaacctgaaccctacatggaagcgtttctcagtccccgttcagcatttctgtggtgggaaccccagcacacccatccaggtgcaatgctccgattatgacagtgacgggtcacatgatctcatcggtaccttccacaccagcttggcccagctgcaggcagtcccggctgagtttgaatgcatccaccctgagaagcagcagaaaaagaaaagctacaagaactctggaactatccgtgtcaagatttgtcgggtagaaacagagtactcctttctggactatgtgatgggaggctgtcagatcaacttcactgtgggcgtggacttcactggctccaatggagacccctcctcacctgactccctacactacctgagtccaacaggggtcaatgagtacctgatggcactgtggagtgtgggcagcgtggttcaggactatgactcagacaagctgttccctgcatttggatttggggcccaggttccccctgactggcaggtctcgcatgaatttgccttgaatttcaaccccagtaacccctactgtgcaggcatccagggcattgtggatgcctaccgccaagccctgccccaagttcgcctctatggccctaccaactttgcacccatcatcaaccatgtggccaggtttgcagcccaggctgcacatcaggggactgcctcggacatgaatgggcttgtccccagcaatacttcatgctgttgctgctgactgatggtgctgtgacggatgtggaagccacacgtgaggctgtggtgcgtgcctcgaacctgcccatgtcagtgatcattgtgggtgtgggtggtgctgactttgaggccatggagcagctggacgctgatggtggacccctgcatacacgttctgggcaggctgctgcccgcgacattgtgcagtttgtaccctaccgccggttccagaatgtgagtaggtgcaaatttgatctgggagtttaccctttcacctttccctgatgtgagtagggttgaggcccaagggatgctcaccttttcctctaagcctgggatatggttgggttcttgggcatgaaatacagactttgggcagctgttctgggccaccactgacttttcccttttcttggcaggcccctcgggaggcattggcacagaccgtgctcgcagaagtgcccacacaactggtctcatacttcagggcccagggttgggccccgctcaagccacttccaccctcagccaaggatcctgcacaggccccccaggcctaggttcccttggaggctgtggcaagtcctcaatcctgtgtcccagaggtccctctgggccacaacccaacccttctcactctcctcagtgctagcactttgtattttttgatacttttatacttgtttctgcttttgctgctcttgatcccacctttgctcctgacaaccctcattcaataaagaccagtgaagaccaa

SEQ ID NO: 446110 - DNA, 6548 bp, Homo sapiens
ctcgacgagccggactttctgtgacaacgtgcgacacggacggctggctggcctgcgctcgcggcatccaggcgacagctcgatatcgcggacatgagaggcccgtggctgcgttgggctccgggaagccgttcgggctggggctgtcggccgcggggcggaggcactcgcgcggggggggtaattcggggtctgggttctggtgccgcgcagctttccccgtctaaaagttggttttaattggttgcccacaggattgacttggcctctacttcttgttaaggaaattcatctcttgttttatcaggtgtgtgtggtttcagcgcagcatggctgtggtcatccgtttgcaaggtctcccaattgtggcggggaccatggacattcgccacttcttctctggattgaccattcctgatgggggcgtgcatattgtagggggtgaactgggtgaggctttcatcgtttttgccactgatgaagatgcaaggcttggtatgatgcgcacaggtggtacaattaaagggtcaaaagtaacactattgttgagtagtaagacggaaatgcagaatatgattgaactgagtcgtaggcgttttgaaactgccaacttagatataccaccagcaaatgccagtagatcaggaccaccacctagctcaggaatgagtagcagggtaaacttgcccacaacagtatccaactttaataatccatcacccagtgtagttactgccaccacttctgttcatgaaagcaacaaaaacatacagacattttccacagccagcgtaggaacagctcctccaaatatgggggcttcctttgggagcccaacgtttagctcaactgttccaagcacagcctctccaatgaacacagtcccgccgccaccaattcctccaattccagcgatgccatctctgccaccaatgccatccattcccccaattccagttcctcctccagtacctacattgcctcctgtgcctcctgtgcccccgattcccccagttccttctgtgccacccatgaccccactgccacccatgtcgggcatgccgcccttgaatccgccacctgtggcacctctacctgctggaatgaatggctctggagcacctatgaatttgaacaataatctgaatcctatgtttcttggtccgttgaatcctgttaaccctatccagatgaactctcagagcagtgtgaagccactccccatcaaccctgatgatctgtatgtcagtgtgcatggaatgcccttttctgcaatggaaaatgatgtcagagatttttttcatgggctccgtgttgatgcagtgcatttgttgaaagatcatgtaggtcgaaataatgggaatggattggttaagtttctctcccctcaagatacatttgaagctttgaaacgaaacagaatgctgatgattcaacgctatgtggaagttagccctgccacagaaagacagtgggtagctgctggaggccatatcacttttaagcaaaatatgggaccttctggacaaactcatccccctcctcagacacttcccaggtcaaaatcgcccagtgggcagaaaagatcaaggtcaagatcaccacatgaggctggtttttgtgtttacttgaaagggctaccatttgaagcagaaaacaaacatgtcattgatttttttaaaaagctggatattgtggaagatagtatttatatagcttatggacccaatgggaaagcaactggcgaaggctttgtagagttcagaaatgaggctgactataaggctgctctgtgtcgtcataaacagtacatgggcaatcgctttattcaagttcatccaattactaagaaaggtatgctagaaaagatagatatgattcgaaaaagactgcagaacttcagctatgaccagagggaaatgatactaaatccagagggggatgtcaactctgccaaagtctgtgcccacataacaaatattccattcagcattacaaagatggatgttcttcagttcctagaaggaatcccagtggatgaaaatgctgtacatgttcttgttgataacaatgggcaaggtctaggacaggcattggttcagaatgcccaatgcgggactgcccggtgtgggactgcccagtgcaggacttcccggtgcaggcctgcccagcacaggactgcctggttcagcaataaccagtgcaggactgcctggtgcgggaatgcccagtgcaggaatacctagtgcaggaggtgaagagcatgccttcctgactgtaggatcaaaggaagccaataatgggcctccatttaactttcctggtaattttggtggatcaaatgcctttgggccaccaatccctcctccaggattaggaggcggggcctttggtgatgctaggcctggtatgccttcagttggaaacagtggtttgcctggtctaggactggatgttccgggttttggaggtggaccaaacaatttaagtgggccatcgggatttggagggggccctcagaattttggaaatggccctggtagcttaggcggtcccccggggtttggaagtggccctcctggtcttggaagtgcccctgggcatttgggtgggccaccagcttttgggcctggccccggccccggccccggccctggcccaatccatattggtggtccccctggctttgcatctagttctggaaaaccaggaccgacagtaattaaagtgcaaaacatgccctttactgtgtctattgatgagattttagatttcttttatggctatcaagtaatcccaggctcagtgtgtttaaaatacaatgaaaaaggtatgcccacaggtgaagccatggtggcctttgagtctcgggatgaagccacagctgctgtcattgacttaaatgacaggcctataggttcaagaaaagtaaaacttgtattagggtagccattcacatcattttttatagggtagatcttcatattgctgtgattaatgcatccagattgttttcctagtatttccaggttagaacctgtggattgtttcaattgcatatagcttggtttccataacatagagcattggttgactgtttacagaagactcactcaccaggataaacattgctgtatgttacagtaaagctatctggagagaacacataaatgattttggcataccattagagaaaccatttgtaaaactcaaatgaccacataaagcttatcaaggagtctagattggttttgttttataccatatgggatgaagaaaatagaaatgtcagtagaactcattgagggtgctcttgccagctgctgaaaatagaagttggctactctcagaatttggtttaaagctggacagatttgctttgttatagggtaaagctttgtctaaagtcctcattttcttttaaaattgaataaaatttctgtatacagattcattgtatgtacctttattgcttcttaagggtccttgctgtatagacagtcctgcttcagaagttgctgctttgtttgtctaattgactcatttgtaaatgagcagaactgttttgttggtttttttccctaaatataaaagtccacacttcgtttgtgctataacctcaaactttgatttctaatgtcacacttaaaactgtgtggaataagacttttgccataaaaataaactatggagtcctttatctaccagagcctttttggtttgaccgccacgatttaggttagtcagtttaaaaattgttcatgttgtttggatggtatcgaaaaccagaaaccacttttaataatgtgtttaagatacttgatttgaagtccttttcatatggactaattgtagtatcaatttcctcctgtcccgattatgtgaaattttggcctttaaacaaagaggggcccattcataagaaagtgttatatctaggtttttaaaactgaagttgaaattatctttgttagcagtagtagtatagaataaaagatccgtatgctggttcgtagattgatacgtgttagtcctgttatttggaggctttttggcatagttgttcgatcaggagcctgtttactaaaagtcttcatacagagtacaagtgcagccgccagaggagaaaattgagattcttgaccctttcatactcttttctttggtattcaggacactaaggcaggaggaccacatgagttctggttggtaagtgtccttgtcatgaaaacacttgccttacaaggctctaattatgatttccctagtcagtgctctgaagatgtgtcacattatattataaacaatacggaaggggagataggtgagatgatatgaaaaacaaattttctcactgtcataaaaggctctaattatggttactttccttgtgatgaaaaacttggccttacagggctctagttatggttactttccctagtcaatgctctgaaaatgtgtcacattataaacaatacagaaggagagatagatgagagatcatgaaaaccaaattttatcttttacatggcccctttgtcttcgtttgaaacatccccaacatttcctacaaatcagcgtagttacaaaggggtcagtcttttaaaataagtatttcctattaaactatatatatatacagtgcctttttggtgttgtgagtcagtggaacactgaaatacagcggttgtgtaatttaagagtggcaacagtttcatttgataagatttgaaaaggctttttatcactacaatcttagaggattgacagtacaggatttttgtttaagagaaggattgtttagactcaagaggtgactatgttgtgggtcttttgataattcatgaatacagatttgctttgaccgatcactagatactgcctcctcaatttcaaaagcaatataacgtttgtatatgctgtttaatttaagttaatgttaagtaatcatttctcattccaaagacaatgcaaaaaacttcagcactgcttgagagttgtatttcagccacagatattttctccattggaaagctattttcattttagaaaaatgggttgtttgaagatgaaagtcttttatcttttttcacaatttattttggttatatgttcgtacattcttattaaatatttcatacactttattgcaactactttgttatttctacatcttagataaatgctgaaaaggaaaacgatttcattgttcatctaattaaataaattaaaagagcggtttgtgtagaaattggagagaactatgttttatatgaatcacaacagtgctcgttgtggactgtaattaaatgctttgccctctggaacttgatttttgtgtatctgagatttattaacagtgctaactgctaaggatactgtttatcttgttctgggcattggagtttcagtttttaaaaaattcttgaaaatgtattctgtgaaactactcatacctctcttcctgcgaattttctcctaagaactaggtttggggtagaaatgaattgacattattttctcatttgctttgtatggtatgaaggatttgtaaagctttgctcaaagttgtgtgcatttgtaaacactatcatgatattttcaattttatgtgtaaattttattgtctgtttttggtgactctgacattaatggaagagaatattttccattagatttaattttttttcctctcccttctgattttttttttattggtgttcatttttcttttgatttaaaggattagagaaatctacaaatgtatgtcataaataagcaaatttgtaaacttttctgaactttagtgaaacatttagttcacaagcataatttggaggtgtgttctgtgtttacacagtagtttggatgtacaattattattagtggctttttaaaaaatgaaacagtgttaagtgaaatgtagttcctagctttgtactccaagttgtcaaagcatcaacaatgaaaattcgattaggaaactttatttaaaatttcaggtagtaatattcagtgtagttaaggccagtcttaacccactggatgaaaatctaggactgtatggaagtaagcaaacattacatttttaggtggaaatagtcagccttgcataaaaacaaggatgcgtgaaagccttaaattccagctcccttttactggagtctgtggttgtgtacaggtatgggccaagtgtaaaatctcatcaattttaagaacactcgggaaatgagtaaagaaaatgtaaaattgctgctagtcaaatcttttggaaagaatttctggaagtggtcactttaaaaattattttccacccttgcaaaattgccacatttaaattgttttactggcagttctatagtagtccagactttagaaaccaaacacaacaaaatggcttgttgccaatatggccacaacattgccagcaaatactgccttggcatcactcagcagaggtttttgtttataaagatgaagtcttgaatactgttcaataaacttgtcaaaaaataaaacaggctgatgcttttaatgctttaactgca

SEQ ID NO: 446111 - DNA, 3377 bp, Homo sapiens
ctcgacgagccggactttctgtgacaacgtgcgacacggacggctggctggcctgcgctcgcggcatccaggcgacagctcgatatcgcggacatgagaggcccgtggctgcgttgggctccgggaagccgttcgggctggggctgtcggccgcggggcggaggcactcgcgcggggggggtaattcggggtctgggttctggtgccgcgcagctttccccgtctaaaagttggttttaattggttgcccacaggattgacttggcctctacttcttgttaaggaaattcatctcttgttttatcaggtgtgtgtggtttcagcgcagcatggctgtggtcatccgtttgcaaggtctcccaattgtggcggggaccatggacattcgccacttcttctctggattgaccattcctgatgggggcgtgcatattgtagggggtgaactgggtgaggctttcatcgtttttgccactgatgaagatgcaaggcttggtatgatgcgcacaggtggtacaattaaagggtcaaaagtaacactattgttgagtagtaagacggaaatgcagaatatgattgaactgagtcgtaggcgttttgaaactgccaacttagatataccaccagcaaatgccagtagatcaggaccaccacctagctcaggaatgagtagcagggtaaacttgcccacaacagtatccaactttaataatccatcacccagtgtagttactgccaccacttctgttcatgaaagcaacaaaaacatacagacattttccacagccagcgtaggaacagctcctccaaatatgggggcttcctttgggagcccaacgtttagctcaactgttccaagcacagcctctccaatgaacacagtcccgccgccaccaattcctccaattccagcgatgccatctctgccaccaatgccatccattcccccaattccagttcctcctccagtacctacattgcctcctgtgcctcctgtgcccccgattcccccagttccttctgtgccacccatgaccccactgccacccatgtcgggcatgccgcccttgaatccgccacctgtggcacctctacctgctggaatgaatggctctggagcacctatgaatttgaacaataatctgaatcctatgtttcttggtccgttgaatcctgttaaccctatccagatgaactctcagagcagtgtgaagccactccccatcaaccctgatgatctgtatgtcagtgtgcatggaatgcccttttctgcaatggaaaatgatgtcagagatttttttcatgggctccgtgttgatgcagtgcatttgttgaaagatcatgtaggtcgaaataatgggaatggattggttaagtttctctcccctcaagatacatttgaagctttgaaacgaaacagaatgctgatgattcaacgctatgtggaagttagccctgccacagaaagacagtgggtagctgctggaggccatatcacttttaagcaaaatatgggaccttctggacaaactcatccccctcctcagacacttcccaggtcaaaatcgcccagtgggcagaaaagatcaaggtcaagatcaccacatgaggctggtttttgtgtttacttgaaagggctaccatttgaagcagaaaacaaacatgtcattgatttttttaaaaagctggatattgtggaagatagtatttatatagcttatggacccaatgggaaagcaactggcgaaggctttgtagagttcagaaatgaggctgactataaggctgctctgtgtcgtcataaacagtacatgggcaatcgctttattcaagttcatccaattactaagaaaggtatgctagaaaagatagatatgattcgaaaaagactgcagaacttcagctatgaccagagggaaatgatactaaatccagagggggatgtcaactctgccaaagtctgtgcccacataacaaatattccattcagcattacaaagatggatgttcttcagttcctagaaggaatcccagtggatgaaaatgctgtacatgttcttgttgataacaatgggcaaggtctaggacaggcattggttcagtttaaaaatgaagatgatgcacatggcccactgcgtgaccttggttcagctgtccatttcctgtgaccatctcattgacaaggacatcggctccaagtctgacccactctgcgtccttttacaggatgtgggagggggcagctgggctgagcttggccggactgaacgggtgcggaactgctcaagccctgagttctccaagactctacagcttgagtaccgctttgagacagtccagaagctacgctttggaatctatgacatagacaacaagacgccagagctgagggatgatgacttcctagggggtgctgagtgttccctaggacagattgtgtccagccaggtactgactctccccttgatgctgaagcctggaaaacctgctgggcgggggaccatcacggtctcagctcaggaattaaaggacaatcgtgtagtaaccatggaggtagaggccagaaacctagataagaaggacttcctgggaaaatcagatccatttctggagttcttccgccagggtgatgggaaatggcacctggtgtacagatctgaggtcatcaagaacaacctgaaccctacatggaagcgtttctcagtccccgttcagcatttctgtggtgggaaccccagcacacccatccaggtgcaatgctccgattatgacagtgacgggtcacatgatctcatcggtaccttccacaccagcttggcccagctgcaggcagtcccggctgagtttgaatgcatccaccctgagaagcagcagaaaaagaaaagctacaagaactctggaactatccgtgtcaagatttgtcgggtagaaacagagtactcctttctggactatgtgatgggaggctgtcagatcaacttcactgtgggcgtggacttcactggctccaatggagacccctcctcacctgactccctacactacctgagtccaacaggggtcaatgagtacctgatggcactgtggagtgtgggcagcgtggttcaggactatgactcagacaagctgttccctgcatttggatttggggcccaggttccccctgactggcaggcctaggttcccttggaggctgtggcaagtcctcaatcctgtgtcccagaggtccctctgggccacaacccaacccttctcactctcctcagtgctagcactttgtattttttgatacttttatacttgtttctgcttttgctgctcttgatcccacctttgctcctgacaaccctcattcaataaagaccagtgaagaccaa

SEQ ID NO: 446112 - DNA, 4292 bp, Homo sapiens
ctcgacgagccggactttctgtgacaacgtgcgacacggacggctggctggcctgcgctcgcggcatccaggcgacagctcgatatcgcggacatgagaggcccgtggctgcgttgggctccgggaagccgttcgggctggggctgtcggccgcggggcggaggcactcgcgcggggggggtaattcggggtctgggttctggtgccgcgcagctttccccgtctaaaagttggttttaattggttgcccacaggattgacttggcctctacttcttgttaaggaaattcatctcttgttttatcaggtgtgtgtggtttcagcgcagcatggctgtggtcatccgtttgcaaggtctcccaattgtggcggggaccatggacattcgccacttcttctctggattgaccattcctgatgggggcgtgcatattgtagggggtgaactgggtgaggctttcatcgtttttgccactgatgaagatgcaaggcttggtatgatgcgcacaggtggtacaattaaagggtcaaaagtaacactattgttgagtagtaagacggaaatgcagaatatgattgaactgagtcgtaggcgttttgaaactgccaacttagatataccaccagcaaatgccagtagatcaggaccaccacctagctcaggaatgagtagcagggtaaacttgcccacaacagtatccaactttaataatccatcacccagtgtagttactgccaccacttctgttcatgaaagcaacaaaaacatacagacattttccacagccagcgtaggaacagctcctccaaatatgggggcttcctttgggagcccaacgtttagctcaactgttccaagcacagcctctccaatgaacacagtcccgccgccaccaattcctccaattccagcgatgccatctctgccaccaatgccatccattcccccaattccagttcctcctccagtacctacattgcctcctgtgcctcctgtgcccccgattcccccagttccttctgtgccacccatgaccccactgccacccatgtcgggcatgccgcccttgaatccgccacctgtggcacctctacctgctggaatgaatggctctggagcacctatgaatttgaacaataatctgaatcctatgtttcttggtccgttgaatcctgttaaccctatccagatgaactctcagagcagtgtgaagccactccccatcaaccctgatgatctgtatgtcagtgtgcatggaatgcccttttctgcaatggaaaatgatgtcagagatttttttcatgggctccgtgttgatgcagtgcatttgttgaaagatcatgtaggtcgaaataatgggaatggattggttaagtttctctcccctcaagatacatttgaagctttgaaacgaaacagaatgctgatgattcaacgctatgtggaagttagccctgccacagaaagacagtgggtagctgctggaggccatatcacttttaagcaaaatatgggaccttctggacaaactcatccccctcctcagacacttcccaggtcaaaatcgcccagtgggcagaaaagatcaaggtcaagatcaccacatgaggctggtttttgtgtttacttgaaagggctaccatttgaagcagaaaacaaacatgtcattgatttttttaaaaagctggatattgtggaagatagtatttatatagcttatggacccaatgggaaagcaactggcgaaggctttgtagagttcagaaatgaggctgactataaggctgctctgtgtcgtcataaacagtacatgggcaatcgctttattcaagttcatccaattactaagaaaggtatgctagaaaagatagatatgattcgaaaaagactgcagaacttcagctatgaccagagggaaatgatactaaatccagagggggatgtcaactctgccaaagtctgtgcccacataacaaatattccattcagcattacaaagatggatgttcttcagttcctagaaggaatcccagtggatgaaaatgctgtacatgttcttgttgataacaatgggcaaggtctaggacaggcattggttcagtttaaaaatgaagatgatgcacatggcccactgcgtgaccttggttcagctgtccatttcctgtgaccatctcattgacaaggacatcggctccaagtctgacccactctgcgtccttttacaggatgtgggagggggcagctgggctgagcttggccggactgaacgggtgcggaactgctcaagccctgagttctccaagactctacagcttgagtaccgctttgagacagtccagaagctacgctttggaatctatgacatagacaacaagacgccagagctgagggatgatgacttcctagggggtgctgagtgttccctaggacagattgtgtccagccaggtactgactctccccttgatgctgaagcctggaaaacctgctgggcgggggaccatcacggtctcagctcaggaattaaaggacaatcgtgtagtaaccatggaggtagaggccagaaacctagataagaaggacttcctgggaaaatcagatccatttctggagttcttccgccagggtgatgggaaatggcacctggtgtacagatctgaggtcatcaagaacaacctgaaccctacatggaagcgtttctcagtccccgttcagcatttctgtggtgggaaccccagcacacccatccaggtgcaatgctccgattatgacagtgacgggtcacatgatctcatcggtaccttccacaccagcttggcccagctgcaggcagtcccggctgagtttgaatgcatccaccctgagaagcagcagaaaaagaaaagctacaagaactctggaactatccgtgtcaagatttgtcgggtagaaacagagtactcctttctggactatgtgatgggaggctgtcagatcaacttcactgtgggcgtggacttcactggctccaatggagacccctcctcacctgactccctacactaccacacaactggtctcatacttcagggcccagggttgggccccgctcaagccacttccaccctcagccaaggatcctgcacaggccccccaggcctaggttcccttggaggctgtggcaagtcctcaatcctgtgtcccagaggtccctctgggccacaacccaacccttctcactctcctcagtgctagcactttgtattttttgatacttttatacttgtttctgcttttgctgctcttgatcccacctttgctcctgacaaccctcattcaataaagaccagtgaagaccaaaaaaaaaaaaaaaaaaaaaaaaaaaaaaaaaaaaaaaaaaaaaaaaaaaaaaaaaaaaaaaaaagagagagagggggggcgcgcgcccaaaaatatatcccccgcggggggcgcgccccttgcgcgcgcgcgcccccccgacttttgtgctgcgaacaagaaggggcgccccacaagaagggaggcccgcttattatacccgaccgagcgagcgcggagcgggcgccgcgttaaaaacaagcgcgcgcacaggggaaaaacacgcgcccacagcgcggcagcaacctccgtgggagaagagaaccacccccacacgcggggggggaggcgcgaccaccaacctatgtgggggcgccccactcctcctcctcaccagacagagatttatttacaccccccactagggggagaacaatatctacaacactctcttctacacgggggtactacataaggggtggtgtacaacaccaaggcgcccgataatatccccctccttcgcgcctagcgaaaacatttttcgccccccaaccgacgagtcatctagatatcgcgaggaggacacaaatatttttttaacccacgggggggtcttgttttttatataataaaaatctcgcgcagtgacgacccagtcagaactacagagcaaccaggcccacagacacacgccagcgcgacgaggactgaccactcacaaacagaccgaaccaaccgagcacacaagagtgctacgacgccgattgacgtacctaggaccaagaagcaaagaccgctctacccacctcacagctcgctaagccaagggacacagagtcggagcactgagacgggatgacagcggagaacactacgcagcacgtcaggcacacgaaaacccacaaagccacacaaactacaacacacacgaggcacagaaaaagccaacagcaaaacaacacccacagaaccca

SEQ ID NO: 446113 - DNA, 2676 bp, Homo sapiens
  misc_feature (2621)..(2621): n is a, c, g, or t
  misc_feature (2653)..(2653): n is a, c, g, or t
ctcgacgagccggactttctgtgacaacgtgcgacacggacggctggctggcctgcgctcgcggcatccaggcgacagctcgatatcgcggacatgagaggcccgtggctgcgttgggctccgggaagccgttcgggctggggctgtcggccgcggggcggaggcactcgcgcggggggggtaattcggggtctgggttctggtgccgcgcagctttccccgtctaaaagttggttttaattggttgcccacaggattgacttggcctctacttcttgttaaggaaattcatctcttgttttatcaggtgtgtgtggtttcagcgcagcatggctgtggtcatccgtttgcaaggtctcccaattgtggcggggaccatggacattcgccacttcttctctggattgaccattcctgatgggggcgtgcatattgtagggggtgaactgggtgaggctttcatcgtttttgccactgatgaagatgcaaggcttggtatgatgcgcacaggtggtacaattaaagggtcaaaagtaacactattgttgagtagtaagacggaaatgcagaatatgattgaactgagtcgtaggcgttttgaaactgccaacttagatataccaccagcaaatgccagtagatcaggaccaccacctagctcaggaatgagtagcagggtaaacttgcccacaacagtatccaactttaataatccatcacccagtgtagttactgccaccacttctgttcatgaaagcaacaaaaacatacagacattttccacagccagcgtaggaacagctcctccaaatatgggggcttcctttgggagcccaacgtttagctcaactgttccaagcacagcctctccaatgaacacagtcccgccgccaccaattcctccaattccagcgatgccatctctgccaccaatgccatccattcccccaattccagttcctcctccagtacctacattgcctcctgtgcctcctgtgcccccgattcccccagttccttctgtgccacccatgaccccactgccacccatgtcgggcatgccgcccttgaatccgccacctgtggcacctctacctgctggaatgaatggctctggagcacctatgaatttgaacaataatctgaatcctatgtttcttggtccgttgaatcctgttaaccctatccagatgaactctcagagcagtgtgaagccactccccatcaaccctgatgatctgtatgtcagtgtgcatggaatgcccttttctgcaatggaaaatgatgtcagagatttttttcatgggctccgtgttgatgcagtgcatttgttgaaagatcatgtaggtcgaaataatgggaatggattggttaagtttctctcccctcaagatacatttgaagctttgaaacgaaacagaatgctgatgattcaacgctatgtggaagttagccctgccacagaaagacagtgggtagctgctggaggccatatcacttttaagcaaaatatgggaccttctggacaaactcatccccctcctcagacacttcccaggtcaaaatcgcccagtgggcagaaaagatcaaggtcaagatcaccacatgaggctggtttttgtgtttacttgaaagggctaccatttgaagcagaaaacaaacatgtcattgatttttttaaaaagctggatattgtggaagatagtatttatatagcttatggacccaatgggaaagcaactggcgaaggctttgtagagttcagaaatgaggctgactataaggctgctctgtgtcgtcataaacagtacatgggcaatcgctttattcaagttcatccaattactaagaaaggtatgctagaaaagatagatatgattcgaaaaagactgcagaacttcagctatgaccagagggaaatgatactaaatccagagggggatgtcaactctgccaaagtctgtgcccacataacaaatattccattcagcattacaaagatggatgttcttcagttcctagaaggaatcccagtggatgaaaatgctgtacatgttcttgttgataacaatgggcaaggtctaggacaggcattggttcagtttaaaaatgaagatgatgcacgtaagtctgaacgcttacaccgtaaaaaacttaatgggagagaagcttttgttcatgtagttaccctagaagatatgagagagattgagaaaaatccccctgcccaaggaaaaaagggattaaagatgcctgtgccaggtaatcctgcagttccaggaatgcccaatgcgggactgcccggtgtgggactgcccagtgcaggacttcccggtgcaggcctgcccagcacaggactgcctggttcagcaataaccagtgcaggactgcctggtgcgggaatgcccagtgcaggaatacctagtgcaggaggtgaagagcatgccttcctgactgtaggatcaaaggaagccaataatgggcctccatttaactttcctggtaattttggtggatcaaatgcctttgggccaccaatccctcctccaggattaggaggcggggcctttggtgatgctaggcctggtatgccttcagttggaaacagtggtttgcctgtntatgatgagtgacacataatggccatcgtaanactagcgtccccgggtcaggagg

SEQ ID NO: 446114 - DNA, 371 bp, Homo sapiens
agcggcgggaatcggtcacagaaatgagtcacaggtcatcagattttgccaagattattaacaatacagagaatcttgtgcgggaattgctgtaagttttaaaaagaccaaatcatgttacttttgttagatacttcctaaatctggatgtcttccagtattttctacactctattgtttgttcagaatatttcataatttaaaataatccttgtaagattctctccaattcactattagtacctaacgctttttatttgttccccatcccgtgtttatatgtttttgtttttattttatgtgatatttccaaagatttgaaatcattgtatctaggaatgatttttcagcactgtggcagttaaactggt

SEQ ID NO: 446115 - DNA, 3623 bp, Homo sapiens
gttcggggccggctgcagactctcaccgcagcggccaggaacgccagccgttcacgcgttcggtcctccttggctgactcaccgccctcgccgccgcaccatggacgcccccaggcaggtggtcaactttgggcctggtcccgccaagctgccgcactcagtgttgttagagatacaaaaggaattattagactacaaaggagttggcattagtgttcttgaaatgagtcacaggtcatcagattttgccaagattattaacaatacagagaatcttgtgcgggaattgctagctgttccagacaactataaggtgatttttctgcaaggaggtgggtgcggccagttcagtgctgtccccttaaacctcattggcttgaaagcaggaaggtgtgcggactatgtggtgacaggagcttggtcagctaaggccgcagaagaagccaagaagtttgggactataaatatcgttcaccctaaacttgggagttatacaaaaattccagatccaagcacctggaacctcaacccagatgcctcctacgtgtattattgcgcaaatgagacggtgcatggtgtggagtttgactttatacccgatgtcaagggagcagtactggtttgtgacatgtcctcaaacttcctgtccaagccagtggatgtttccaagtttggtgtgatttttgctggtgcccagaagaatgttggctctgctggggtcaccgtggtgattgtccgtgatgacctgctggggtttgccctccgagagtgcccctcggtcctggaatacaaggtgcaggctggaaacagctccttgtacaacacgcctccatgtttcagcatctacgtcatgggcttggttctggagtggattaaaaacaatggaggtgccgcggccatggagaagcttagctccatcaaatctcaaacaatttatgagattattgataattctcaaggattctacgtgtctgtgggaggcatccgggcctctctgtataatgctgtcacaattgaagacgttcagaagctggccgccttcatgaaaaaatttttggagatgcatcagctatgaacacatcctaaccaggatatactctgttcttgaacaacatacaaagtttaaagtaacttggggatggctacaaaaagttaacacagtatttttctcaaatgaacatgtttattgcagattcttcttttttgaaagaacaacagcaaaacatccacaactctgtaaagctggtgggacctaatgtcaccttaattctgacttgaactggaagcattttaagaaatcttgttgcttttctaacaaattcccgcgtattttgcctttgctgctactttttctagttagatttcaaacttgcctgtggacttaataatgcaagttgcgattaattatttctggagtcatgggaacacacagcacagagggtaggggggccctctaggtgctgaatctacacatctgtggggtctcctgggttcagcggctgttgattcaaggtcaacattgaccattggaggagtggtttaagagtgccaggcgaagggcaaactgtagatcgatctttatgctgttattacaggagaagtgacatactttatatatgtttatattagcaaggtctgtttttaataccatatactttatatttctatacatttatatttctaataatacagttatcactgatatatgtagacacttttagaatttattaaatccttgaccttgtgcattatagcattccattagcaagagttgtaccccctccccagtcttcgccttcctctttttaagctgttttatgaaaaagacctagaagttcttgattcatttttaccattctttccataggtagaagagaaagttgattggttggttgtttttcaattatgccattaaactaaacatttctgttaaattaccctatcctttgttctctactgttttctttgtaatgtatgactacgagagtgatactttgctgaaaagtctttcccctattgtttatctattgtcagtattttatgttgaatatgtaaagaacattaaagtcctaaacacggttctaagctaagtgaaggggaagatctgagagcgtgctgtttgtggctgttgatgcatattcgtgatgtaacaggtcctggggcctcactttaccccatttgtaaaatggggctaatgtcacctgcctcttacctacctcagagggatttggtgaagcaaactgttaatcttcgaaaacgaccatttcacttcttggatatcaagtgctaacccagtatgttcttcttttttatgtaagggacagctttctccacagagtcctttctgctggtgaggacagcatttctgagcagggctttgttctctatgtgcattaggacttttatcatgcccttgttctgtgtgtagttacttgacagcatcaaatgccgcctcttcctaatgtccttcaagttttcatgaactagcaaccccaccttccaccatggttctgggcgcctgattttgctgtgactcccagacccagccactgtttctgccaccctgtaacaggccattaaagctccccagtgttcagcctccttcactcccttgttttccctgttgctatgtgtcacctgggccctacagacaggggcacacgcttatggatgtgtgtaccattgagatgagaatgggtagatggaacggagaccatcaagccacacccccttcttaaaactggggacatgagcctgagcagaaagggtgaagaagagccatgggacacagagttgacccagccagggggaaagcccagctctctttaaaccagctaagccattccagtctcctgtgaagccaaaagggaccaggaaccgtgcaaaggaaactggaaacttttccccgctgggtagagcatgttgctgatactcttctgttttcaagggaaacaatcacattgtttgattccaaatggtaaatgaacactcactattcttcaggcttcagtaaatctttttttcttccttcatatatatatacacaacacacacacacatatgtatatctatacacacatgtgtgttgtgtatatgcatgtgtgtgtgtgcgtgtgtgtatagttttagctccaagccaagcaagtttgtgtttggatagaggggaacttaactattaactacaagttgtatgtctgtggtatcttgattttcccatttctaaagatgaatttcacaaagccataaagcgtgaaattagagctggacttaagactcattggccgaccatcctgtgtcctggcctggccctgcagtaagaagcgtgtctgggtctggagaagggtgcttccgagagtgtgcaggtggcccttccccttggaggcgagaagagagaatgtgctgtctatcttcctggttttcagtccacagagtcggtagaccaggggttacgtgactggggaaaatctcacatctccttgtctgaaaacatttcccctgctgttctctttctaacatgttgtggtaaatctgttcagatactgctcatctgactgttttgtacatgtgacaattgccttaaaacctagcacagtcctcagaaatgaataccgtgtttccactgg

SEQ ID NO: 446116 - DNA, 3754 bp, Homo sapiens
aacggcagtaactctcagcggttctaaggtagcgaggctgggtggcgcgcgttcggtcctccttggctgactcaccgccctcgccgccgcaccatggacgcccccaggcaggtggtcaactttgggcctggtcccgccaagctgccgcactcagtgttgttagagatacaaaaggaattattagactacaaaggagttggcattagtgttcttgaaatgagtcacaggtcatcagattttgccaagattattaacaatacagagaatcttgtgcgggaattgctagctgttccagacaactataaggtgatttttctgcaaggaggtgggtgcggccagttcagtgctgtccccttaaacctcattggcttgaaagcaggaaggtgtgcggactatgtggtgacaggagcttggtcagctaaggccgcagaagaagccaagaagtttgggactataaatatcgttcaccctaaacttgggagttatacaaaaattccagatccaagcacctggaacctcaacccagatgcctcctacgtgtattattgcgcaaatgagacggtgcatggtgtggagtttgactttatacccgatgtcaagggagcagtactggtttgtgacatgtcctcaaacttcctgtccaagccagtggatgtttccaagtttggtgtgatttttgctggtgcccagaagaatgttggctctgctggggtcaccgtggtgattgtccgtgatgacctgctggggtttgccctccgagagtgcccctcggtcctggaatacaaggtgcaggctggaaacagctccttgtacaacacgcctccatgtttcagcatctacgtcatgggcttggttctggagtggattaaaaacaatggaggtgccgcggccatggagaagcttagctccatcaaatctcaaacaatttatgagattattgataattctcaaggattctacgtttgtccagtggagccccaaaatagaagcaagatgaatattccattccgcattggcaatgccaaaggagatgatgctttagaaaaaagatttcttgataaagctcttgaactcaatatgttgtccttgaaagggcataggtctgtgggaggcatccgggcctctctgtataatgctgtcacaattgaagacgttcagaagctggccgccttcatgaaaaaatttttggagatgcatcagctatgaacacatcctaaccaggatatactctgttcttgaacaacatacaaagtttaaagtaacttggggatggctacaaaaagttaacacagtatttttctcaaatgaacatgtttattgcagattcttcttttttgaaagaacaacagcaaaacatccacaactctgtaaagctggtgggacctaatgtcaccttaattctgacttgaactggaagcattttaagaaatcttgttgcttttctaacaaattcccgcgtattttgcctttgctgctactttttctagttagatttcaaacttgcctgtggacttaataatgcaagttgcgattaattatttctggagtcatgggaacacacagcacagagggtaggggggccctctaggtgctgaatctacacatctgtggggtctcctgggttcagcggctgttgattcaaggtcaacattgaccattggaggagtggtttaagagtgccaggcgaagggcaaactgtagatcgatctttatgctgttattacaggagaagtgacatactttatatatgtttatattagcaaggtctgtttttaataccatatactttatatttctatacatttatatttctaataatacagttatcactgatatatgtagacacttttagaatttattaaatccttgaccttgtgcattatagcattccattagcaagagttgtaccccctccccagtcttcgccttcctctttttaagctgttttatgaaaaagacctagaagttcttgattcatttttaccattctttccataggtagaagagaaagttgattggttggttgtttttcaattatgccattaaactaaacatttctgttaaattaccctatcctttgttctctactgttttctttgtaatgtatgactacgagagtgatactttgctgaaaagtctttcccctattgtttatctattgtcagtattttatgttgaatatgtaaagaacattaaagtcctaaacacggttctaagctaagtgaaggggaagatctgagagcgtgctgtttgtggctgttgatgcatattcgtgatgtaacaggtcctggggcctcactttaccccatttgtaaaatggggctaatgtcacctgcctcttacctacctcagagggatttggtgaagcaaactgttaatcttcgaaaacgaccatttcacttcttggatatcaagtgctaacccagtatgttcttcttttttatgtaagggacagctttctccacagagtcctttctgctggtgaggacagcatttctgagcagggctttgttctctatgtgcattaggacttttatcatgcccttgttctgtgtgtagttacttgacagcatcaaatgccgcctcttcctaatgtccttcaagttttcatgaactagcaaccccaccttccaccatggttctgggcgcctgattttgctgtgactcccagacccagccactgtttctgccaccctgtaacaggccattaaagctccccagtgttcagcctccttcactcccttgttttccctgttgctatgtgtcacctgggccctacagacaggggcacacgcttatggatgtgtgtaccattgagatgagaatgggtagatggaacggagaccatcaagccacacccccttcttaaaactggggacatgagcctgagcagaaagggtgaagaagagccatgggacacagagttgacccagccagggggaaagcccagctctctttaaaccagctaagccattccagtctcctgtgaagccaaaagggaccaggaaccgtgcaaaggaaactggaaacttttccccgctgggtagagcatgttgctgatactcttctgttttcaagggaaacaatcacattgtttgattccaaatggtaaatgaacactcactattcttcaggcttcagtaaatctttttttcttccttcatatatatatacacaacacacacacacatatgtatatctatacacacatgtgtgttgtgtatatgcatgtgtgtgtgtgcgtgtgtgtatagttttagctccaagccaagcaagtttgtgtttggatagaggggaacttaactattaactacaagttgtatgtctgtggtatcttgattttcccatttctaaagatgaatttcacaaagccataaagcgtgaaattagagctggacttaagactcattggccgaccatcctgtgtcctggcctggccctgcagtaagaagcgtgtctgggtctggagaagggtgcttccgagagtgtgcaggtggcccttccccttggaggcgagaagagagaatgtgctgtctatcttcctggttttcagtccacagagtcggtagaccaggggttacgtgactggggaaaatctcacatctccttgtctgaaaacatttcccctgctgttctctttctaacatgttgtggtaaatctgttcagatactgctcatctgactgttttgtacatgtgacaattgccttaaaacctagcacagtcctcagaaatgaataccgtgtttccactgg

SEQ ID NO: 446117 - DNA, 1081 bp, Homo sapiens
gttcggggccggctgcagactctcaccgcagcggccaggaacgccagccgttcacgcgttcggtcctccttggctgactcaccgccctcgccgccgcaccatggacgcccccaggcaggtggtcaactttgggcctggtcccgccaagctgccgcactcagtgttgttagagatacaaaaggaattattagactacaaaggagttggcattagtgttcttgaaatgagtcacaggtcatcagattttgccaagattattaacaatacagagaatcttgtgcgggaattgctagctgttccagacaactataaggtgatttttctgcaaggaggtgggtgcggccagttcagtgctgtccccttaaacctcattggcttgaaagcaggaaggtgtgcggactatgtggtgacaggagcttggtcagctaaggccgcagaagaagccaagaagtttgggactataaatatcgttcaccctaaacttgggagttatacaaaaattccagatccaagcacctggaacctcaacccagatgcctcctacgtgtattattgcgcaaatgagacggtgcatggtgtggagtttgactttatacccgatgtcaagggagcagtactggtttgtgacatgtcctcaaacttcctgtccaagccagtggatgtttccaagtttggtgtgatttttgctggtgcccagaagaatgttggctctgctggggtcaccgtggtgattgtccgtgatgacctgctggggtttgccctccgagagtgcccctcggtcctggaatacaaggtgcaggctggaaacagctccttgtacaacacgcctccatgtttcagcatctacgtcatgggcttggttctggagtggattaaaaacaatggaggtgccgcggccatggagaagcttagctccatcaaatctcaaacaatttatgagattattgataattctcaaggattctacgtgtaagtcaatggattttatctcctattttgcctcttgtgaatttaaaactgtgtatatactgtgtacctttgaaaagtggacatattcacctttctctgagacattaaaata

SEQ ID NO: 446118 - DNA, 3828 bp, Homo sapiens
ggaacgagaacagataaactcactaaggcggttcctaacgcgtacagcgacggctctgtgcggctggtcgacactctcggtcaccgacggggccagtatcaccgacgatatctgcgtccattccctgtgcgacttgaaactactacccaggcaacctccgcgcgaccatggacgcccccaggcaggtggtcaactttgggcctggtcccgccaagctgccgcactcagtgttgttagagatacaaaaggaattattagactacaaaggagttggcattagtgttcttgaaatgagtcacaggtcatcagattttgccaagattattaacaatacagagaatcttgtgcgggaattgctagctgttccagacaactataaggtgatttttctgcaaggaggtgggtgcggccagttcagtgctgtccccttaaacctcattggcttgaaagcaggaaggtgtgcggactatgtggtgacaggagcttggtcagctaaggccgcagaagaagccaagaagtttgggactataaatatcgttcaccctaaacttgggagttatacaaaaattccagatccaagcacctggaacctcaacccagatgcctcctacgtgtattattgcgcaaatgagacggtgcatggtgtggagtttgactttatacccgatgtcaagggagcagtactggtttgtgacatgtcctcaaacttcctgtccaagccagtggatgtttccaagtttggtgtgatttttgctggtgcccagaagaatgttggctctgctggggtcaccgtggtgattgtccgtgatgacctgctggggtttgccctccgagagtgcccctcggtcctggaatacaaggtgcaggctggaaacagctccttgtacaacacgcctccatgtttcagcatctacgtcatgggcttggttctggagtggattaaaaacaatggaggtgccgcggccatggagaagcttagctccatcaaatctcaaacaatttatgagattattgataattctcaaggattctacgtttgtccagtggagccccaaaatagaagcaagatgaatattccattccgcattggcaatgccaaaggagatgatgctttagaaaaaagatttcttgataaagctcttgaactcaatatgttgtccttgaaagggcataggtctgtgggaggcatccgggcctctctgtataatgctgtcacaattgaagacgttcagaagctggccgccttcatgaaaaaatttttggagatgcatcagctatgaacacatcctaaccaggatatactctgttcttgaacaacatacaaagtttaaagtaacttggggatggctacaaaaagttaacacagtatttttctcaaatgaacatgtttattgcagattcttcttttttgaaagaacaacagcaaaacatccacaactctgtaaagctggtgggacctaatgtcaccttaattctgacttgaactggaagcattttaagaaatcttgttgcttttctaacaaattcccgcgtattttgcctttgctgctactttttctagttagatttcaaacttgcctgtggacttaataatgcaagttgcgattaattatttctggagtcatgggaacacacagcacagagggtaggggggccctctaggtgctgaatctacacatctgtggggtctcctgggttcagcggctgttgattcaaggtcaacattgaccattggaggagtggtttaagagtgccaggcgaagggcaaactgtagatcgatctttatgctgttattacaggagaagtgacatactttatatatgtttatattagcaaggtctgtttttaataccatatactttatatttctatacatttatatttctaataatacagttatcactgatatatgtagacacttttagaatttattaaatccttgaccttgtgcattatagcattccattagcaagagttgtaccccctccccagtcttcgccttcctctttttaagctgttttatgaaaaagacctagaagttcttgattcatttttaccattctttccataggtagaagagaaagttgattggttggttgtttttcaattatgccattaaactaaacatttctgttaaattaccctatcctttgttctctactgttttctttgtaatgtatgactacgagagtgatactttgctgaaaagtctttcccctattgtttatctattgtcagtattttatgttgaatatgtaaagaacattaaagtcctaaacacggttctaagctaagtgaaggggaagatctgagagcgtgctgtttgtggctgttgatgcatattcgtgatgtaacaggtcctggggcctcactttaccccatttgtaaaatggggctaatgtcacctgcctcttacctacctcagagggatttggtgaagcaaactgttaatcttcgaaaacgaccatttcacttcttggatatcaagtgctaacccagtatgttcttcttttttatgtaagggacagctttctccacagagtcctttctgctggtgaggacagcatttctgagcagggctttgttctctatgtgcattaggacttttatcatgcccttgttctgtgtgtagttacttgacagcatcaaatgccgcctcttcctaatgtccttcaagttttcatgaactagcaaccccaccttccaccatggttctgggcgcctgattttgctgtgactcccagacccagccactgtttctgccaccctgtaacaggccattaaagctccccagtgttcagcctccttcactcccttgttttccctgttgctatgtgtcacctgggccctacagacaggggcacacgcttatggatgtgtgtaccattgagatgagaatgggtagatggaacggagaccatcaagccacacccccttcttaaaactggggacatgagcctgagcagaaagggtgaagaagagccatgggacacagagttgacccagccagggggaaagcccagctctctttaaaccagctaagccattccagtctcctgtgaagccaaaagggaccaggaaccgtgcaaaggaaactggaaacttttccccgctgggtagagcatgttgctgatactcttctgttttcaagggaaacaatcacattgtttgattccaaatggtaaatgaacactcactattcttcaggcttcagtaaatctttttttcttccttcatatatatatacacaacacacacacacatatgtatatctatacacacatgtgtgttgtgtatatgcatgtgtgtgtgtgcgtgtgtgtatagttttagctccaagccaagcaagtttgtgtttggatagaggggaacttaactattaactacaagttgtatgtctgtggtatcttgattttcccatttctaaagatgaatttcacaaagccataaagcgtgaaattagagctggacttaagactcattggccgaccatcctgtgtcctggcctggccctgcagtaagaagcgtgtctgggtctggagaagggtgcttccgagagtgtgcaggtggcccttccccttggaggcgagaagagagaatgtgctgtctatcttcctggttttcagtccacagagtcggtagaccaggggttacgtgactggggaaaatctcacatctccttgtctgaaaacatttcccctgctgttctctttctaacatgttgtggtaaatctgttcagatactgctcatctgactgttttgtacatgtgacaattgccttaaaacctagcacagtcctcagaaatgaataccgtgtttccactgg

SEQ ID NO: 446119 - DNA, 3698 bp, Homo sapiens
  misc_feature (212)..(212): n is a, c, g, or t
gtaataattggatgaataaaagaactagaagcagcaaaatggatgcaccaggaaggtggtcaaatttgggaatggtcccgcaaagatgcagaactaagtgttgttagagataaaaaaggaattattagaataaaaaggagtaggaattagtgtttttgaaatgagtaaaaggtaataagattttgaaaagattattaaaaataaagagaatnttgtgggggaattggtagctgttccagacaactataaggtgatttttctgcaaggaggtgggtgcggccagttcagtgctgtccccttaaacctcattggcttgaaagcaggaaggtgtgcggactatgtggtgacaggagcttggtcagctaaggccgcagaagaagccaagaagtttgggactataaatatcgttcaccctaaacttgggagttatacaaaaattccagatccaagcacctggaacctcaacccagatgcctcctacgtgtattattgcgcaaatgagacggtgcatggtgtggagtttgactttatacccgatgtcaagggagcagtactggtttgtgacatgtcctcaaacttcctgtccaagccagtggatgtttccaagtttggtgtgatttttgctggtgcccagaagaatgttggctctgctggggtcaccgtggtgattgtccgtgatgacctgctggggtttgccctccgagagtgcccctcggtcctggaatacaaggtgcaggctggaaacagctccttgtacaacacgcctccatgtttcagcatctacgtcatgggcttggttctggagtggattaaaaacaatggaggtgccgcggccatggagaagcttagctccatcaaatctcaaacaatttatgagattattgataattctcaaggattctacgtttgtccagtggagccccaaaatagaagcaagatgaatattccattccgcattggcaatgccaaaggagatgatgctttagaaaaaagatttcttgataaagctcttgaactcaatatgttgtccttgaaagggcataggtctgtgggaggcatccgggcctctctgtataatgctgtcacaattgaagacgttcagaagctggccgccttcatgaaaaaatttttggagatgcatcagctatgaacacatcctaaccaggatatactctgttcttgaacaacatacaaagtttaaagtaacttggggatggctacaaaaagttaacacagtatttttctcaaatgaacatgtttattgcagattcttcttttttgaaagaacaacagcaaaacatccacaactctgtaaagctggtgggacctaatgtcaccttaattctgacttgaactggaagcattttaagaaatcttgttgcttttctaacaaattcccgcgtattttgcctttgctgctactttttctagttagatttcaaacttgcctgtggacttaataatgcaagttgcgattaattatttctggagtcatgggaacacacagcacagagggtaggggggccctctaggtgctgaatctacacatctgtggggtctcctgggttcagcggctgttgattcaaggtcaacattgaccattggaggagtggtttaagagtgccaggcgaagggcaaactgtagatcgatctttatgctgttattacaggagaagtgacatactttatatatgtttatattagcaaggtctgtttttaataccatatactttatatttctatacatttatatttctaataatacagttatcactgatatatgtagacacttttagaatttattaaatccttgaccttgtgcattatagcattccattagcaagagttgtaccccctccccagtcttcgccttcctctttttaagctgttttatgaaaaagacctagaagttcttgattcatttttaccattctttccataggtagaagagaaagttgattggttggttgtttttcaattatgccattaaactaaacatttctgttaaattaccctatcctttgttctctactgttttctttgtaatgtatgactacgagagtgatactttgctgaaaagtctttcccctattgtttatctattgtcagtattttatgttgaatatgtaaagaacattaaagtcctaaacacggttctaagctaagtgaaggggaagatctgagagcgtgctgtttgtggctgttgatgcatattcgtgatgtaacaggtcctggggcctcactttaccccatttgtaaaatggggctaatgtcacctgcctcttacctacctcagagggatttggtgaagcaaactgttaatcttcgaaaacgaccatttcacttcttggatatcaagtgctaacccagtatgttcttcttttttatgtaagggacagctttctccacagagtcctttctgctggtgaggacagcatttctgagcagggctttgttctctatgtgcattaggacttttatcatgcccttgttctgtgtgtagttacttgacagcatcaaatgccgcctcttcctaatgtccttcaagttttcatgaactagcaaccccaccttccaccatggttctgggcgcctgattttgctgtgactcccagacccagccactgtttctgccaccctgtaacaggccattaaagctccccagtgttcagcctccttcactcccttgttttccctgttgctatgtgtcacctgggccctacagacaggggcacacgcttatggatgtgtgtaccattgagatgagaatgggtagatggaacggagaccatcaagccacacccccttcttaaaactggggacatgagcctgagcagaaagggtgaagaagagccatgggacacagagttgacccagccagggggaaagcccagctctctttaaaccagctaagccattccagtctcctgtgaagccaaaagggaccaggaaccgtgcaaaggaaactggaaacttttccccgctgggtagagcatgttgctgatactcttctgttttcaagggaaacaatcacattgtttgattccaaatggtaaatgaacactcactattcttcaggcttcagtaaatctttttttcttccttcatatatatatacacaacacacacacacatatgtatatctatacacacatgtgtgttgtgtatatgcatgtgtgtgtgtgcgtgtgtgtatagttttagctccaagccaagcaagtttgtgtttggatagaggggaacttaactattaactacaagttgtatgtctgtggtatcttgattttcccatttctaaagatgaatttcacaaagccataaagcgtgaaattagagctggacttaagactcattggccgaccatcctgtgtcctggcctggccctgcagtaagaagcgtgtctgggtctggagaagggtgcttccgagagtgtgcaggtggcccttccccttggaggcgagaagagagaatgtgctgtctatcttcctggttttcagtccacagagtcggtagaccaggggttacgtgactggggaaaatctcacatctccttgtctgaaaacatttcccctgctgttctctttctaacatgttgtggtaaatctgttcagatactgctcatctgactgttttgtacatgtgacaattgccttaaaacctagcacagtcctcagaaatgaataccgtgtttccactgg

SEQ ID NO: 446120 - DNA, 3212 bp, Homo sapiens
gttcggggccggctgcagactctcaccgcagcggccaggaacgccagccgttcacgcgttcggtcctccttggctgactcaccgccctcgccgccgcaccatggacgcccccaggcaggtggtcaactttgggcctggtcccgccaagctgccgcactcagtgttgttagagatacaaaaggaattattagactacaaaggagttggcattagtgttcttgaaatgagtcacaggtcatcagattttgccaagattattaacaatacagagaatcttgtgcgggaattgctcatctacgtcatgggcttggttctggagtggattaaaaacaatggaggtgccgcggccatggagaagcttagctccatcaaatctcaaacaatttatgagattattgataattctcaaggattctacgtttgtccagtggagccccaaaatagaagcaagatgaatattccattccgcattggcaatgccaaaggagatgatgctttagaaaaaagatttcttgataaagctcttgaactcaatatgttgtccttgaaagggcataggtctgtgggaggcatccgggcctctctgtataatgctgtcacaattgaagacgttcagaagctggccgccttcatgaaaaaatttttggagatgcatcagctatgaacacatcctaaccaggatatactctgttcttgaacaacatacaaagtttaaagtaacttggggatggctacaaaaagttaacacagtatttttctcaaatgaacatgtttattgcagattcttcttttttgaaagaacaacagcaaaacatccacaactctgtaaagctggtgggacctaatgtcaccttaattctgacttgaactggaagcattttaagaaatcttgttgcttttctaacaaattcccgcgtattttgcctttgctgctactttttctagttagatttcaaacttgcctgtggacttaataatgcaagttgcgattaattatttctggagtcatgggaacacacagcacagagggtaggggggccctctaggtgctgaatctacacatctgtggggtctcctgggttcagcggctgttgattcaaggtcaacattgaccattggaggagtggtttaagagtgccaggcgaagggcaaactgtagatcgatctttatgctgttattacaggagaagtgacatactttatatatgtttatattagcaaggtctgtttttaataccatatactttatatttctatacatttatatttctaataatacagttatcactgatatatgtagacacttttagaatttattaaatccttgaccttgtgcattatagcattccattagcaagagttgtaccccctccccagtcttcgccttcctctttttaagctgttttatgaaaaagacctagaagttcttgattcatttttaccattctttccataggtagaagagaaagttgattggttggttgtttttcaattatgccattaaactaaacatttctgttaaattaccctatcctttgttctctactgttttctttgtaatgtatgactacgagagtgatactttgctgaaaagtctttcccctattgtttatctattgtcagtattttatgttgaatatgtaaagaacattaaagtcctaaacacggttctaagctaagtgaaggggaagatctgagagcgtgctgtttgtggctgttgatgcatattcgtgatgtaacaggtcctggggcctcactttaccccatttgtaaaatggggctaatgtcacctgcctcttacctacctcagagggatttggtgaagcaaactgttaatcttcgaaaacgaccatttcacttcttggatatcaagtgctaacccagtatgttcttcttttttatgtaagggacagctttctccacagagtcctttctgctggtgaggacagcatttctgagcagggctttgttctctatgtgcattaggacttttatcatgcccttgttctgtgtgtagttacttgacagcatcaaatgccgcctcttcctaatgtccttcaagttttcatgaactagcaaccccaccttccaccatggttctgggcgcctgattttgctgtgactcccagacccagccactgtttctgccaccctgtaacaggccattaaagctccccagtgttcagcctccttcactcccttgttttccctgttgctatgtgtcacctgggccctacagacaggggcacacgcttatggatgtgtgtaccattgagatgagaatgggtagatggaacggagaccatcaagccacacccccttcttaaaactggggacatgagcctgagcagaaagggtgaagaagagccatgggacacagagttgacccagccagggggaaagcccagctctctttaaaccagctaagccattccagtctcctgtgaagccaaaagggaccaggaaccgtgcaaaggaaactggaaacttttccccgctgggtagagcatgttgctgatactcttctgttttcaagggaaacaatcacattgtttgattccaaatggtaaatgaacactcactattcttcaggcttcagtaaatctttttttcttccttcatatatatatacacaacacacacacacatatgtatatctatacacacatgtgtgttgtgtatatgcatgtgtgtgtgtgcgtgtgtgtatagttttagctccaagccaagcaagtttgtgtttggatagaggggaacttaactattaactacaagttgtatgtctgtggtatcttgattttcccatttctaaagatgaatttcacaaagccataaagcgtgaaattagagctggacttaagactcattggccgaccatcctgtgtcctggcctggccctgcagtaagaagcgtgtctgggtctggagaagggtgcttccgagagtgtgcaggtggcccttccccttggaggcgagaagagagaatgtgctgtctatcttcctggttttcagtccacagagtcggtagaccaggggttacgtgactggggaaaatctcacatctccttgtctgaaaacatttcccctgctgttctctttctaacatgttgtggtaaatctgttcagatactgctcatctgactgttttgtacatgtgacaattgccttaaaacctagcacagtcctcagaaatgaataccgtgtttccactgg

SEQ ID NO: 446121 - DNA, 2705 bp, Homo sapiens
  misc_feature (327)..(327): n is a, c, g, or t
  misc_feature (331)..(331): n is a, c, g, or t
  misc_feature (355)..(355): n is a, c, g, or t
  misc_feature (402)..(403): n is a, c, g, or t
  misc_feature (405)..(405): n is a, c, g, or t
  misc_feature (470)..(470): n is a, c, g, or t
  misc_feature (479)..(479): n is a, c, g, or t
  misc_feature (486)..(486): n is a, c, g, or t
  misc_feature (530)..(530): n is a, c, g, or t
  misc_feature (542)..(542): n is a, c, g, or t
  misc_feature (554)..(554): n is a, c, g, or t
  misc_feature (577)..(577): n is a, c, g, or t
  misc_feature (597)..(597): n is a, c, g, or t
  misc_feature (642)..(642): n is a, c, g, or t
  misc_feature (645)..(645): n is a, c, g, or t
  misc_feature (660)..(660): n is a, c, g, or t
  misc_feature (662)..(662): n is a, c, g, or t
gtaattcatatcactctcactttacacgcatcgcttgtaatcttatcctaattatttgtactgtctaattttctcggtatcgttcattgtgttacctcttttagttagtccttacaaaattcccttcatgcaatttccagtcacactttttaactcgtcttgctagtgattttgcttttaatactgttctactatttggggtcctttgttatcataaaacttggtaactgtttatacgttggcctcttcgaagggattttttggcgcccccttgttttttttttttagatcttttaggactttaatgttctttacatattcacatanaatnctgacaatagattacaataggggnaagacttttcagcaaagtatcactctcgtagtcatacattacaaagnngnacagtagagaacaaaggatagggtaatttaacagaaatgtttagttataatggcatagattgaanacaatccanccaatcnactttctcttctacctactggaaagaatggtataaatgaatganagaacttctagntctttttcatantacagcttcaaaagaggaaggcnaagactggggagggggtacnactcttgctacatggaatgctataatgcacaagttcaaggatttnatncattctaaaagtgtntncatatatcagtgataactgtattattagaaatatatatgtttatattagcaaggtctgtttttaataccatatactttatatttctatacatttatatttctaataatacagttatcactgatatatgtagacacttttagaatttattaaatccttgaccttgtgcattatagcattccattagcaagagttgtaccccctccccagtcttcgccttcctctttttaagctgttttatgaaaaagacctagaagttcttgattcatttttaccattctttccataggtagaagagaaagttgattggttggttgtttttcaattatgccattaaactaaacatttctgttaaattaccctatcctttgttctctactgttttctttgtaatgtatgactacgagagtgatactttgctgaaaagtctttcccctattgtttatctattgtcagtattttatgttgaatatgtaaagaacattaaagtcctaaacacggttctaagctaagtgaaggggaagatctgagagcgtgctgtttgtggctgttgatgcatattcgtgatgtaacaggtcctggggcctcactttaccccatttgtaaaatggggctaatgtcacctgcctcttacctacctcagagggatttggtgaagcaaactgttaatcttcgaaaacgaccatttcacttcttggatatcaagtgctaacccagtatgttcttcttttttatgtaagggacagctttctccacagagtcctttctgctggtgaggacagcatttctgagcagggctttgttctctatgtgcattaggacttttatcatgcccttgttctgtgtgtagttacttgacagcatcaaatgccgcctcttcctaatgtccttcaagttttcatgaactagcaaccccaccttccaccatggttctgggcgcctgattttgctgtgactcccagacccagccactgtttctgccaccctgtaacaggccattaaagctccccagtgttcagcctccttcactcccttgttttccctgttgctatgtgtcacctgggccctacagacaggggcacacgcttatggatgtgtgtaccattgagatgagaatgggtagatggaacggagaccatcaagccacacccccttcttaaaactggggacatgagcctgagcagaaagggtgaagaagagccatgggacacagagttgacccagccagggggaaagcccagctctctttaaaccagctaagccattccagtctcctgtgaagccaaaagggaccaggaaccgtgcaaaggaaactggaaacttttccccgctgggtagagcatgttgctgatactcttctgttttcaagggaaacaatcacattgtttgattccaaatggtaaatgaacactcactattcttcaggcttcagtaaatctttttttcttccttcatatatatatacacaacacacacacacatatgtatatctatacacacatgtgtgttgtgtatatgcatgtgtgtgtgtgcgtgtgtgtatagttttagctccaagccaagcaagtttgtgtttggatagaggggaacttaactattaactacaagttgtatgtctgtggtatcttgattttcccatttctaaagatgaatttcacaaagccataaagcgtgaaattagagctggacttaagactcattggccgaccatcctgtgtcctggcctggccctgcagtaagaagcgtgtctgggtctggagaagggtgcttccgagagtgtgcaggtggcccttccccttggaggcgagaagagagaatgtgctgtctatcttcctggttttcagtccacagagtcggtagaccaggggttacgtgactggggaaaatctcacatctccttgtctgaaaacatttcccctgctgttctctttctaacatgttgtggtaaatctgttcagatactgctcatctgactgttttgtacatgtgacaattgccttaaaacctagcacagtcctcagaaatgaataccgtgtttccactgg

SEQ ID NO: 446122 - DNA, 3761 bp, Homo sapiens
gttcggggccggctgcagactctcaccgcagcggccaggaacgccagccgttcacgcgttcggtcctccttggctgactcaccgccctcgccgccgcaccatggacgcccccaggcaggtggtcaactttgggcctggtcccgccaagctgccgcactcagtgttgttagagatacaaaaggaattattagactacaaaggagttggcattagtgttcttgaaatgagtcacaggtcatcagattttgccaagattattaacaatacagagaatcttgtgcgggaattgctagctgttccagacaactataaggtgatttttctgcaaggaggtgggtgcggccagttcagtgctgtccccttaaacctcattggcttgaaagcaggaaggtgtgcggactatgtggtgacaggagcttggtcagctaaggccgcagaagaagccaagaagtttgggactataaatatcgttcaccctaaacttgggagttatacaaaaattccagatccaagcacctggaacctcaacccagatgcctcctacgtgtattattgcgcaaatgagacggtgcatggtgtggagtttgactttatacccgatgtcaagggagcagtactggtttgtgacatgtcctcaaacttcctgtccaagccagtggatgtttccaagtttggtgtgatttttgctggtgcccagaagaatgttggctctgctggggtcaccgtggtgattgtccgtgatgacctgctggggtttgccctccgagagtgcccctcggtcctggaatacaaggtgcaggctggaaacagctccttgtacaacacgcctccatgtttcagcatctacgtcatgggcttggttctggagtggattaaaaacaatggaggtgccgcggccatggagaagcttagctccatcaaatctcaaacaatttatgagattattgataattctcaaggattctacgtttgtccagtggagccccaaaatagaagcaagatgaatattccattccgcattggcaatgccaaaggagatgatgctttagaaaaaagatttcttgataaagctcttgaactcaatatgttgtccttgaaagggcataggtctgtgggaggcatccgggcctctctgtataatgctgtcacaattgaagacgttcagaagctggccgccttcatgaaaaaatttttggagatgcatcagctatgaacacatcctaaccaggatatactctgttcttgaacaacatacaaagtttaaagtaacttggggatggctacaaaaagttaacacagtatttttctcaaatgaacatgtttattgcagattcttcttttttgaaagaacaacagcaaaacatccacaactctgtaaagctggtgggacctaatgtcaccttaattctgacttgaactggaagcattttaagaaatcttgttgcttttctaacaaattcccgcgtattttgcctttgctgctactttttctagttagatttcaaacttgcctgtggacttaataatgcaagttgcgattaattatttctggagtcatgggaacacacagcacagagggtaggggggccctctaggtgctgaatctacacatctgtggggtctcctgggttcagcggctgttgattcaaggtcaacattgaccattggaggagtggtttaagagtgccaggcgaagggcaaactgtagatcgatctttatgctgttattacaggagaagtgacatactttatatatgtttatattagcaaggtctgtttttaataccatatactttatatttctatacatttatatttctaataatacagttatcactgatatatgtagacacttttagaatttattaaatccttgaccttgtgcattatagcattccattagcaagagttgtaccccctccccagtcttcgccttcctctttttaagctgttttatgaaaaagacctagaagttcttgattcatttttaccattctttccataggtagaagagaaagttgattggttggttgtttttcaattatgccattaaactaaacatttctgttaaattaccctatcctttgttctctactgttttctttgtaatgtatgactacgagagtgatactttgctgaaaagtctttcccctattgtttatctattgtcagtattttatgttgaatatgtaaagaacattaaagtcctaaacacggttctaagctaagtgaaggggaagatctgagagcgtgctgtttgtggctgttgatgcatattcgtgatgtaacaggtcctggggcctcactttaccccatttgtaaaatggggctaatgtcacctgcctcttacctacctcagagggatttggtgaagcaaactgttaatcttcgaaaacgaccatttcacttcttggatatcaagtgctaacccagtatgttcttcttttttatgtaagggacagctttctccacagagtcctttctgctggtgaggacagcatttctgagcagggctttgttctctatgtgcattaggacttttatcatgcccttgttctgtgtgtagttacttgacagcatcaaatgccgcctcttcctaatgtccttcaagttttcatgaactagcaaccccaccttccaccatggttctgggcgcctgattttgctgtgactcccagacccagccactgtttctgccaccctgtaacaggccattaaagctccccagtgttcagcctccttcactcccttgttttccctgttgctatgtgtcacctgggccctacagacaggggcacacgcttatggatgtgtgtaccattgagatgagaatgggtagatggaacggagaccatcaagccacacccccttcttaaaactggggacatgagcctgagcagaaagggtgaagaagagccatgggacacagagttgacccagccagggggaaagcccagctctctttaaaccagctaagccattccagtctcctgtgaagccaaaagggaccaggaaccgtgcaaaggaaactggaaacttttccccgctgggtagagcatgttgctgatactcttctgttttcaagggaaacaatcacattgtttgattccaaatggtaaatgaacactcactattcttcaggcttcagtaaatctttttttcttccttcatatatatatacacaacacacacacacatatgtatatctatacacacatgtgtgttgtgtatatgcatgtgtgtgtgtgcgtgtgtgtatagttttagctccaagccaagcaagtttgtgtttggatagaggggaacttaactattaactacaagttgtatgtctgtggtatcttgattttcccatttctaaagatgaatttcacaaagccataaagcgtgaaattagagctggacttaagactcattggccgaccatcctgtgtcctggcctggccctgcagtaagaagcgtgtctgggtctggagaagggtgcttccgagagtgtgcaggtggcccttccccttggaggcgagaagagagaatgtgctgtctatcttcctggttttcagtccacagagtcggtagaccaggggttacgtgactggggaaaatctcacatctccttgtctgaaaacatttcccctgctgttctctttctaacatgttgtggtaaatctgttcagatactgctcatctgactgttttgtacatgtgacaattgccttaaaacctagcacagtcctcagaaatgaataccgtgtttccactgg

SEQ ID NO: 446123 - DNA, 1689 bp, Homo sapiens
gttcggggccggctgcagactctcaccgcagcggccaggaacgccagccgttcacgcgttcggtcctccttggctgactcaccgccctcgccgccgcaccatggacgcccccaggcaggtggtcaactttgggcctggtcccgccaagctgccgcactcagtgttgttagagatacaaaaggaattattagactacaaaggagttggcattagtgttcttgaaatgagtcacaggtcatcagattttgccaagattattaacaatacagagaatcttgtgcgggaattgctagctgttccagacaactataaggtgatttttctgcaaggaggtgggtgcggccagttcagtgctgtccccttaaacctcattggcttgaaagcaggaaggtgtgcggactatgtggtgacaggagcttggtcagctaaggccgcagaagaagccaagaagtttgggactataaatatcgttcaccctaaacttgggagttatacaaaaattccagatccaagcacctggaacctcaacccagatgcctcctacgtgtattattgcgcaaatgagacggtgcatggtgtggagtttgactttatacccgatgtcaagggagcagtactggtttgtgacatgtcctcaaacttcctgtccaagccagtggatgtttccaagtttggtgtgatttttgctggtgcccagaagaatgttggctctgctggggtcaccgtggtgattgtccgtgatgacctgctggggtttgccctccgagagtgcccctcggtcctggaatacaaggtgcaggctggaaacagctccttgtacaacacgcctccatgtttcagcatctacgtcatgggcttggttctggagtggattaaaaacaatggaggtgccgcggccatggagaagcttagctccatcaaatctcaaacaatttatgagattattgataattctcaaggattctacgtttgtccagtggagccccaaaatagaagcaagatgaatattccattccgcattggcaatgccaaaggagatgatgctttagaaaaaagatttcttgataaagctcttgaactcaatatgttgtccttgaaagggcataggtctgtgggaggcatccgggcctctctgtataatgctgtcacaattgaagacgttcagaagctggccgccttcatgaaaaaatttttggagatgcatcagctatgaacacatcctaaccaggatatactctgttcttgaacaacatacaaagtttaaagtaacttggggatggctacaaaaagttaacacagtatttttctcaaatgaacatgtttattgcagattcttcttttttgaaagaacaacagcaaaacatccacaactctgtaaagctggtgggacctaatgtcaccttaattctgacttgaactggaagcattttaagaaatcttgttgcttttctaacaaattcccgcgtattttgcctttgctgctactttttctagttagatttcaaacttgcctgtggacttaataatgcaagttgcgattaattatttctggagtcatgggaacacacagcacagagggtaggggggccccatggtaactcacttgggggtccgggtccgggtgatcaggcactgcctgcgggtgtaagcgcagaggacgtaacttcgtaagagacactattcttacgg

SEQ ID NO: 446124 - DNA, 3745 bp, Homo sapiens
gtgacgcgtggtcgacccacgcgtcgcggacgcgtgggcgcgttcggtcctccttggctgactcaccgccctcgccgccgcaccatggacgcccccaggcaggtggtcaactttgggcctggtcccgccaagctgccgcactcagtgttgttagagatacaaaaggaattattagactacaaaggagttggcattagtgttcttgaaatgagtcacaggtcatcagattttgccaagattattaacaatacagagaatcttgtgcgggaattgctagctgttccagacaactataaggtgatttttctgcaaggaggtgggtgcggccagttcagtgctgtccccttaaacctcattggcttgaaagcaggaaggtgtgcggactatgtggtgacaggagcttggtcagctaaggccgcagaagaagccaagaagtttgggactataaatatcgttcaccctaaacttgggagttatacaaaaattccagatccaagcacctggaacctcaacccagatgcctcctacgtgtattattgcgcaaatgagacggtgcatggtgtggagtttgactttatacccgatgtcaagggagcagtactggtttgtgacatgtcctcaaacttcctgtccaagccagtggatgtttccaagtttggtgtgatttttgctggtgcccagaagaatgttggctctgctggggtcaccgtggtgattgtccgtgatgacctgctggggtttgccctccgagagtgcccctcggtcctggaatacaaggtgcaggctggaaacagctccttgtacaacacgcctccatgtttcagcatctacgtcatgggcttggttctggagtggattaaaaacaatggaggtgccgcggccatggagaagcttagctccatcaaatctcaaacaatttatgagattattgataattctcaaggattctacgtttgtccagtggagccccaaaatagaagcaagatgaatattccattccgcattggcaatgccaaaggagatgatgctttagaaaaaagatttcttgataaagctcttgaactcaatatgttgtccttgaaagggcataggtctgtgggaggcatccgggcctctctgtataatgctgtcacaattgaagacgttcagaagctggccgccttcatgaaaaaatttttggagatgcatcagctatgaacacatcctaaccaggatatactctgttcttgaacaacatacaaagtttaaagtaacttggggatggctacaaaaagttaacacagtatttttctcaaatgaacatgtttattgcagattcttcttttttgaaagaacaacagcaaaacatccacaactctgtaaagctggtgggacctaatgtcaccttaattctgacttgaactggaagcattttaagaaatcttgttgcttttctaacaaattcccgcgtattttgcctttgctgctactttttctagttagatttcaaacttgcctgtggacttaataatgcaagttgcgattaattatttctggagtcatgggaacacacagcacagagggtaggggggccctctaggtgctgaatctacacatctgtggggtctcctgggttcagcggctgttgattcaaggtcaacattgaccattggaggagtggtttaagagtgccaggcgaagggcaaactgtagatcgatctttatgctgttattacaggagaagtgacatactttatatatgtttatattagcaaggtctgtttttaataccatatactttatatttctatacatttatatttctaataatacagttatcactgatatatgtagacacttttagaatttattaaatccttgaccttgtgcattatagcattccattagcaagagttgtaccccctccccagtcttcgccttcctctttttaagctgttttatgaaaaagacctagaagttcttgattcatttttaccattctttccataggtagaagagaaagttgattggttggttgtttttcaattatgccattaaactaaacatttctgttaaattaccctatcctttgttctctactgttttctttgtaatgtatgactacgagagtgatactttgctgaaaagtctttcccctattgtttatctattgtcagtattttatgttgaatatgtaaagaacattaaagtcctaaacacggttctaagctaagtgaaggggaagatctgagagcgtgctgtttgtggctgttgatgcatattcgtgatgtaacaggtcctggggcctcactttaccccatttgtaaaatggggctaatgtcacctgcctcttacctacctcagagggatttggtgaagcaaactgttaatcttcgaaaacgaccatttcacttcttggatatcaagtgctaacccagtatgttcttcttttttatgtaagggacagctttctccacagagtcctttctgctggtgaggacagcatttctgagcagggctttgttctctatgtgcattaggacttttatcatgcccttgttctgtgtgtagttacttgacagcatcaaatgccgcctcttcctaatgtccttcaagttttcatgaactagcaaccccaccttccaccatggttctgggcgcctgattttgctgtgactcccagacccagccactgtttctgccaccctgtaacaggccattaaagctccccagtgttcagcctccttcactcccttgttttccctgttgctatgtgtcacctgggccctacagacaggggcacacgcttatggatgtgtgtaccattgagatgagaatgggtagatggaacggagaccatcaagccacacccccttcttaaaactggggacatgagcctgagcagaaagggtgaagaagagccatgggacacagagttgacccagccagggggaaagcccagctctctttaaaccagctaagccattccagtctcctgtgaagccaaaagggaccaggaaccgtgcaaaggaaactggaaacttttccccgctgggtagagcatgttgctgatactcttctgttttcaagggaaacaatcacattgtttgattccaaatggtaaatgaacactcactattcttcaggcttcagtaaatctttttttcttccttcatatatatatacacaacacacacacacatatgtatatctatacacacatgtgtgttgtgtatatgcatgtgtgtgtgtgcgtgtgtgtatagttttagctccaagccaagcaagtttgtgtttggatagaggggaacttaactattaactacaagttgtatgtctgtggtatcttgattttcccatttctaaagatgaatttcacaaagccataaagcgtgaaattagagctggacttaagactcattggccgaccatcctgtgtcctggcctggccctgcagtaagaagcgtgtctgggtctggagaagggtgcttccgagagtgtgcaggtggcccttccccttggaggcgagaagagagaatgtgctgtctatcttcctggttttcagtccacagagtcggtagaccaggggttacgtgactggggaaaatctcacatctccttgtctgaaaacatttcccctgctgttctctttctaacatgttgtggtaaatctgttcagatactgctcatctgactgttttgtacatgtgacaattgccttaaaacctagcacagtcctcagaaatgaataccgtgtttccactgg

SEQ ID NO: 446125 - DNA, 3719 bp, Homo sapiens
gtgacgcgtggtcgacccacgcgtcgcggacgcgtgggcgcgttcggtcctccttggctgactcaccgccctcgccgccgcaccatggacgcctggtcccgccaagctgccgcactcagtgttgttagagatacaaaaggaattattagactacaaaggagttggcattagtgttcttgaaatgagtcacaggtcatcagattttgccaagattattaacaatacagagaatcttgtgcgggaattgctagctgttccagacaactataaggtgatttttctgcaaggaggtgggtgcggccagttcagtgctgtccccttaaacctcattggcttgaaagcaggaaggtgtgcggactatgtggtgacaggagcttggtcagctaaggccgcagaagaagccaagaagtttgggactataaatatcgttcaccctaaacttgggagttatacaaaaattccagatccaagcacctggaacctcaacccagatgcctcctacgtgtattattgcgcaaatgagacggtgcatggtgtggagtttgactttatacccgatgtcaagggagcagtactggtttgtgacatgtcctcaaacttcctgtccaagccagtggatgtttccaagtttggtgtgatttttgctggtgcccagaagaatgttggctctgctggggtcaccgtggtgattgtccgtgatgacctgctggggtttgccctccgagagtgcccctcggtcctggaatacaaggtgcaggctggaaacagctccttgtacaacacgcctccatgtttcagcatctacgtcatgggcttggttctggagtggattaaaaacaatggaggtgccgcggccatggagaagcttagctccatcaaatctcaaacaatttatgagattattgataattctcaaggattctacgtttgtccagtggagccccaaaatagaagcaagatgaatattccattccgcattggcaatgccaaaggagatgatgctttagaaaaaagatttcttgataaagctcttgaactcaatatgttgtccttgaaagggcataggtctgtgggaggcatccgggcctctctgtataatgctgtcacaattgaagacgttcagaagctggccgccttcatgaaaaaatttttggagatgcatcagctatgaacacatcctaaccaggatatactctgttcttgaacaacatacaaagtttaaagtaacttggggatggctacaaaaagttaacacagtatttttctcaaatgaacatgtttattgcagattcttcttttttgaaagaacaacagcaaaacatccacaactctgtaaagctggtgggacctaatgtcaccttaattctgacttgaactggaagcattttaagaaatcttgttgcttttctaacaaattcccgcgtattttgcctttgctgctactttttctagttagatttcaaacttgcctgtggacttaataatgcaagttgcgattaattatttctggagtcatgggaacacacagcacagagggtaggggggccctctaggtgctgaatctacacatctgtggggtctcctgggttcagcggctgttgattcaaggtcaacattgaccattggaggagtggtttaagagtgccaggcgaagggcaaactgtagatcgatctttatgctgttattacaggagaagtgacatactttatatatgtttatattagcaaggtctgtttttaataccatatactttatatttctatacatttatatttctaataatacagttatcactgatatatgtagacacttttagaatttattaaatccttgaccttgtgcattatagcattccattagcaagagttgtaccccctccccagtcttcgccttcctctttttaagctgttttatgaaaaagacctagaagttcttgattcatttttaccattctttccataggtagaagagaaagttgattggttggttgtttttcaattatgccattaaactaaacatttctgttaaattaccctatcctttgttctctactgttttctttgtaatgtatgactacgagagtgatactttgctgaaaagtctttcccctattgtttatctattgtcagtattttatgttgaatatgtaaagaacattaaagtcctaaacacggttctaagctaagtgaaggggaagatctgagagcgtgctgtttgtggctgttgatgcatattcgtgatgtaacaggtcctggggcctcactttaccccatttgtaaaatggggctaatgtcacctgcctcttacctacctcagagggatttggtgaagcaaactgttaatcttcgaaaacgaccatttcacttcttggatatcaagtgctaacccagtatgttcttcttttttatgtaagggacagctttctccacagagtcctttctgctggtgaggacagcatttctgagcagggctttgttctctatgtgcattaggacttttatcatgcccttgttctgtgtgtagttacttgacagcatcaaatgccgcctcttcctaatgtccttcaagttttcatgaactagcaaccccaccttccaccatggttctgggcgcctgattttgctgtgactcccagacccagccactgtttctgccaccctgtaacaggccattaaagctccccagtgttcagcctccttcactcccttgttttccctgttgctatgtgtcacctgggccctacagacaggggcacacgcttatggatgtgtgtaccattgagatgagaatgggtagatggaacggagaccatcaagccacacccccttcttaaaactggggacatgagcctgagcagaaagggtgaagaagagccatgggacacagagttgacccagccagggggaaagcccagctctctttaaaccagctaagccattccagtctcctgtgaagccaaaagggaccaggaaccgtgcaaaggaaactggaaacttttccccgctgggtagagcatgttgctgatactcttctgttttcaagggaaacaatcacattgtttgattccaaatggtaaatgaacactcactattcttcaggcttcagtaaatctttttttcttccttcatatatatatacacaacacacacacacatatgtatatctatacacacatgtgtgttgtgtatatgcatgtgtgtgtgtgcgtgtgtgtatagttttagctccaagccaagcaagtttgtgtttggatagaggggaacttaactattaactacaagttgtatgtctgtggtatcttgattttcccatttctaaagatgaatttcacaaagccataaagcgtgaaattagagctggacttaagactcattggccgaccatcctgtgtcctggcctggccctgcagtaagaagcgtgtctgggtctggagaagggtgcttccgagagtgtgcaggtggcccttccccttggaggcgagaagagagaatgtgctgtctatcttcctggttttcagtccacagagtcggtagaccaggggttacgtgactggggaaaatctcacatctccttgtctgaaaacatttcccctgctgttctctttctaacatgttgtggtaaatctgttcagatactgctcatctgactgttttgtacatgtgacaattgccttaaaacctagcacagtcctcagaaatgaataccgtgtttccactgg

SEQ ID NO: 446126 - DNA, 3148 bp, Homo sapiens
agagagagagagagagagagaccaaacttcctgtccaagccagtggatgtttccaagtttggtgtgatttttgctggtgcccagaagaatgttggctctgctggggtcaccgtggtgattgtccgtgatgacctgctggggtttgccctccgagagtgcccctcggtcctggaatacaaggtgcaggctggaaacagctccttgtacaacacgcctccatgtttcagcatctacgtcatgggcttggttctggagtggattaaaaacaatggaggtgccgcggccatggagaagcttagctccatcaaatctcaaacaatttatgagattattgataattctcaaggattctacgtttgtccagtggagccccaaaatagaagcaagatgaatattccattccgcattggcaatgccaaaggagatgatgctttagaaaaaagatttcttgataaagctcttgaactcaatatgttgtccttgaaagggcataggtctgtgggaggcatccgggcctctctgtataatgctgtcacaattgaagacgttcagaagctggccgccttcatgaaaaaatttttggagatgcatcagctatgaacacatcctaaccaggatatactctgttcttgaacaacatacaaagtttaaagtaacttggggatggctacaaaaagttaacacagtatttttctcaaatgaacatgtttattgcagattcttcttttttgaaagaacaacagcaaaacatccacaactctgtaaagctggtgggacctaatgtcaccttaattctgacttgaactggaagcattttaagaaatcttgttgcttttctaacaaattcccgcgtattttgcctttgctgctactttttctagttagatttcaaacttgcctgtggacttaataatgcaagttgcgattaattatttctggagtcatgggaacacacagcacagagggtaggggggccctctaggtgctgaatctacacatctgtggggtctcctgggttcagcggctgttgattcaaggtcaacattgaccattggaggagtggtttaagagtgccaggcgaagggcaaactgtagatcgatctttatgctgttattacaggagaagtgacatactttatatatgtttatattagcaaggtctgtttttaataccatatactttatatttctatacatttatatttctaataatacagttatcactgatatatgtagacacttttagaatttattaaatccttgaccttgtgcattatagcattccattagcaagagttgtaccccctccccagtcttcgccttcctctttttaagctgttttatgaaaaagacctagaagttcttgattcatttttaccattctttccataggtagaagagaaagttgattggttggttgtttttcaattatgccattaaactaaacatttctgttaaattaccctatcctttgttctctactgttttctttgtaatgtatgactacgagagtgatactttgctgaaaagtctttcccctattgtttatctattgtcagtattttatgttgaatatgtaaagaacattaaagtcctaaacacggttctaagctaagtgaaggggaagatctgagagcgtgctgtttgtggctgttgatgcatattcgtgatgtaacaggtcctggggcctcactttaccccatttgtaaaatggggctaatgtcacctgcctcttacctacctcagagggatttggtgaagcaaactgttaatcttcgaaaacgaccatttcacttcttggatatcaagtgctaacccagtatgttcttcttttttatgtaagggacagctttctccacagagtcctttctgctggtgaggacagcatttctgagcagggctttgttctctatgtgcattaggacttttatcatgcccttgttctgtgtgtagttacttgacagcatcaaatgccgcctcttcctaatgtccttcaagttttcatgaactagcaaccccaccttccaccatggttctgggcgcctgattttgctgtgactcccagacccagccactgtttctgccaccctgtaacaggccattaaagctccccagtgttcagcctccttcactcccttgttttccctgttgctatgtgtcacctgggccctacagacaggggcacacgcttatggatgtgtgtaccattgagatgagaatgggtagatggaacggagaccatcaagccacacccccttcttaaaactggggacatgagcctgagcagaaagggtgaagaagagccatgggacacagagttgacccagccagggggaaagcccagctctctttaaaccagctaagccattccagtctcctgtgaagccaaaagggaccaggaaccgtgcaaaggaaactggaaacttttccccgctgggtagagcatgttgctgatactcttctgttttcaagggaaacaatcacattgtttgattccaaatggtaaatgaacactcactattcttcaggcttcagtaaatctttttttcttccttcatatatatatacacaacacacacacacatatgtatatctatacacacatgtgtgttgtgtatatgcatgtgtgtgtgtgcgtgtgtgtatagttttagctccaagccaagcaagtttgtgtttggatagaggggaacttaactattaactacaagttgtatgtctgtggtatcttgattttcccatttctaaagatgaatttcacaaagccataaagcgtgaaattagagctggacttaagactcattggccgaccatcctgtgtcctggcctggccctgcagtaagaagcgtgtctgggtctggagaagggtgcttccgagagtgtgcaggtggcccttccccttggaggcgagaagagagaatgtgctgtctatcttcctggttttcagtccacagagtcggtagaccaggggttacgtgactggggaaaatctcacatctccttgtctgaaaacatttcccctgctgttctctttctaacatgttgtggtaaatctgttcagatactgctcatctgactgttttgtacatgtgacaattgccttaaaacctagcacagtcctcagaaatgaataccgtgtttccactgg

SEQ ID NO: 446127 - DNA, 2097 bp, Homo sapiens
tcgtgcagaagatcaccttatcgtgcagaagaccaccttcgtgcagaagatcacctaccgtgcagaagatcacctctcgtgcagaagatcaccttatcgtgcagaagaccaccttcgtgcagaagatcacctatcgtgcagaagatcacctcatcgtgcagaagatcacctactgatatatgtagacacttttagaatttattaaatccttgaccttgtgcattatagcattccattagcaagagttgtaccccctccccagtcttcgccttcctctttttaagctgttttatgaaaaagacctagaagttcttgattcatttttaccattctttccataggtagaagagaaagttgattggttggttgtttttcaattatgccattaaactaaacatttctgttaaattaccctatcctttgttctctactgttttctttgtaatgtatgactacgagagtgatactttgctgaaaagtctttcccctattgtttatctattgtcagtattttatgttgaatatgtaaagaacattaaagtcctaaacacggttctaagctaagtgaaggggaagatctgagagcgtgctgtttgtggctgttgatgcatattcgtgatgtaacaggtcctggggcctcactttaccccatttgtaaaatggggctaatgtcacctgcctcttacctacctcagagggatttggtgaagcaaactgttaatcttcgaaaacgaccatttcacttcttggatatcaagtgctaacccagtatgttcttcttttttatgtaagggacagctttctccacagagtcctttctgctggtgaggacagcatttctgagcagggctttgttctctatgtgcattaggacttttatcatgcccttgttctgtgtgtagttacttgacagcatcaaatgccgcctcttcctaatgtccttcaagttttcatgaactagcaaccccaccttccaccatggttctgggcgcctgattttgctgtgactcccagacccagccactgtttctgccaccctgtaacaggccattaaagctccccagtgttcagcctccttcactcccttgttttccctgttgctatgtgtcacctgggccctacagacaggggcacacgcttatggatgtgtgtaccattgagatgagaatgggtagatggaacggagaccatcaagccacacccccttcttaaaactggggacatgagcctgagcagaaagggtgaagaagagccatgggacacagagttgacccagccagggggaaagcccagctctctttaaaccagctaagccattccagtctcctgtgaagccaaaagggaccaggaaccgtgcaaaggaaactggaaacttttccccgctgggtagagcatgttgctgatactcttctgttttcaagggaaacaatcacattgtttgattccaaatggtaaatgaacactcactattcttcaggcttcagtaaatctttttttcttccttcatatatatatacacaacacacacacacatatgtatatctatacacacatgtgtgttgtgtatatgcatgtgtgtgtgtgcgtgtgtgtatagttttagctccaagccaagcaagtttgtgtttggatagaggggaacttaactattaactacaagttgtatgtctgtggtatcttgattttcccatttctaaagatgaatttcacaaagccataaagcgtgaaattagagctggacttaagactcattggccgaccatcctgtgtcctggcctggccctgcagtaagaagcgtgtctgggtctggagaagggtgcttccgagagtgtgcaggtggcccttccccttggaggcgagaagagagaatgtgctgtctatcttcctggttttcagtccacagagtcggtagaccaggggttacgtgactggggaaaatctcacatctccttgtctgaaaacatttcccctgctgttctctttctaacatgttgtggtaaatctgttcagatactgctcatctgactgttttgtacatgtgacaattgccttaaaacctagcacagtcctcagaaatgaataccgtgtttccactgg

SEQ ID NO: 446128 - DNA, 1504 bp, Homo sapiens
  misc_feature (1498)..(1498): n is a, c, g, or t
  misc_feature (1502)..(1504): n is a, c, g, or t
ggctcggtacctacttttccacggtattaagagctattttagaaagctaaatgaatcgcaagttaacttggaaatcagtagaaagctaaagtgatcctaaatatgacagtgggcagcacctttctagcgtgagctgtagagtaacgagaagtgctttatactgaacgtggttgatgggaggagagacgaggcattcgggccggtggggcgtaagggttatcgttaagcacaagacacagaatagtttacacactgtgtgggggacggcttctcacgctttgtttactctcttcatccgttgtgactctaggcttcaggttgcattggggttcctctgtacagcaagatgtttcttgccttttgttaatgcattgttgtaaagtatttgatgtacattacagattaaagaagaaaagcgcgttgtgtatattacaccaatgccgccgtgtttcctcatctatggttctaaatattgcttcaatttcaaacttttgaaagatgtatggatttccagtttttctttactttctcccagtatgttttaacaaaaaaaaaaaaaagcaggaaaaaaggaatatttagcagtattgttcgttctgatatgtgaatttgtttgtgacaactaaacaaggcattcagcagtttctgacaattaacatacatcattccacactccttgtcaacaaagtgctttttcactgcctaaaattttagatgtagatatttgaaatagattttttcatttataccagttttctttatgatgatacagtgttaaaagaaaataaattacaattgatctgtcatccatatttgctaagaatgtctatttccaagaacctatatcttacaaaatacacattcttgcttgtgtgtctgtgtgtgtgggtgtatgtatgtccacgtactagaaaaattacctgtgtgagattttattttgacagaagctatttcatttgctgttcatcttgtacaaactttgtttttggttttttagtataaatgtacatcagtttgttccttttgtactgtatctattcttctgaccatctagtgactcaggatattaggccagttgaagtggagttataggattttcacacattcacgcatacttggatatcaaccctctctacaggtccgtttccttacacattttatcccctcagaacacgataaaccatggccaattcagtttcactttggggccaattacttgaagtatccacagaaaatgtaaactgctcgccttattcccccaaactttttgttcatgtggcagggagcagtacacaactatggaatagattattaaaactgaacttgaagctaacgttagaatagtggttaacagagctaagaaataaggctaaccatcgaaaagaacatgggccgcgggtaaactagctttgctctttagatgcaagtggctgaggccaataggtgcctagtaaatgttaactgttcttggaaaaaataaaaacatcagtaacaaaanaaannn

SEQ ID NO: 446129 - DNA, 407 bp, Homo sapiens
  misc_feature (3)..(3): n is a, c, g, or t
  misc_feature (8)..(8): n is a, c, g, or t
ctnccccnggtgatctagaggaccccgcctaagtggaagatgctccgaatagacaatgaccgtgtggtgtgcgcggtggccactgcgctgcggaacatggccttggacgtcagaaataaggagctcatcggcaaatacgccatgcgagacctagtccacaggcttccaggagggaacaacagcaacaacactgcaagcaaggccatgtcggatgacacagtgacagctgtctgctgcacactgcacgaagtgattaccaagaacatggagaacgccaaggcctggccgactcaggaggcatagagaagctggtgaacataaccaaaggcaggggcgacagatcatctctgaaagtggtgaaggcagcagcccaggtcttgaatacattatggcaatatcgggacctc

SEQ ID NO: 446130 - DNA, 5518 bp, Homo sapiens
  misc_feature (5512)..(5512): n is a, c, g, or t
  misc_feature (5516)..(5518): n is a, c, g, or t
gccagcatcccttgtcccgcggccgcgctcagacaacaaaagcggaagatgctgcagttgggcaaggtcaggaccttgccctgaagccgggcggcgccgcgcacgcctcttcccggactgaggagctgtcgccggcggagggtgcatgtttgcgaggaagccgccgggcgccgcgcctttgggagctatgcctgttccagaccagccttcatcagcctcagagaagacgagttccctgagccccggcttaaacacctccaacggggatggctctgaaacagaaaccacctctgccatcctcgcctcagtcaaagaacaggaattacagtttgaaaggctgacccgagagctggaggctgaacggcagatcgtagccagccagctggagcgatgcaagctcggatccgagactggcagcatgagcagcatgagttcagcagaagagcagtttcagtggcagtcacaagatggtcaaaaagatatcgaagatgagcttacaacaggtctcgagctggtggactcctgtattaggtcactacaggaatcaggaatacttgacccacaggattattctacaggtgaaaggcccagcctgctctcccagagtgcacttcagctcaattccaaacctgaagggtctttccagtatccggccagctaccatagcaaccagaccctggccctgggggaaaccaccccttcacagctcccggcccgaggcacacaagcccgagctacgggccagagcttcagccagggcacgaccagccgcgccggccacctggcggggcccgagcccgcgccgccgccgccgccgccgccgcgggagccgttcgcgcccagcctgggcagcgccttccacctgcccgacgcgccgcccgccgccgccgccgccgcgctctactactccagctccacgctgcccgcgccgccgcgcgggggctccccgctggccgcgccccagggcggttcgcccaccaagctgcagcgcggcggctcggcccccgagggcgccacctacgccgcgccgcgcggctcctcgcccaagcagtcgcccagccgcctggccaagtcctacagcaccagctcgcccatcaacatcgtcgtgtcctcggccggcctgtccccgatccgcgtgacctcgccccccaccgtgcagtccaccatctcctcctcgcccatccaccagctgagctccaccatcggcacgtacgccaccctgtcgcccaccaagcgcctggtccacgcgtccgagcagtacagcaagcactcgcaggagctgtatgccacggccaccctccagaggccgggcagcctggcagctggttcccgagcctcatacagcagccagcatgggcacctgggcccagagttgcgggccctgcagtccccagaacaccacatagatcccatctatgaagaccgcgtctatcagaagccccctatgaggagtctcagccagagccagggggaccctctgccgccagcacacaccggcacctaccgcacgagcacagccccatcttcccctggtgtcgactccgtccccttgcagcgcacaggcagccagcacggcccacagaatgccgccgcggccaccttccagagggccagctatgccgccggcccagcctccaattacgcggacccctaccgacagctgcagtattgtccctctgttgagtctccatacagcaaatccggccctgctctcccgcctgaaggcaccttggccaggtccccgtccattgatagcattcagaaagatcccagagaatttggatggagagacccggaactgccggaagtgattcagatgttgcagcaccagtttccctcggtccagtctaacgcggcagcctacttgcaacacctctgttttggagacaacaaaattaaagccgagataaggagacaaggaggcatccagctcctggtggacctgttggatcatcggatgaccgaagtccaccgtagtgcctgtggagctctgagaaacctggtgtatgggaaggccaacgatgataacaaaattgccctgaaaaactgtggtggcatcccagcactggtgaggttactccgcaagacgactgacctggagatccgggagctggtcacaggagtcctttggaacctctcctcatgcgatgcactcaaaatgccaatcatccaggatgccctagcagtactgaccaacgcggtgattatcccccactcaggctgggaaaattcgcctcttcaggatgatcggaaaatacagctgcattcatcacaggtgctgcgtaacgccaccgggtgcctaaggaatgttagttcggccggagaggaggcccgcagaaggatgagagagtgtgatgggcttacggatgccttgctgtacgtgatccagtctgcgctggggagcagtgagatcgatagcaagaccgttgaaaactgtgtgtgcattttaaggaacctctcgtaccggctggcggcagaaacgtctcagggacagcacatgggcacggacgagctggacgggctactctgtggcgaggccaatggcaaggatgctgagagctctgggtgctggggcaagaagaagaagaaaaagaaatcccaagatcagtgggatggagtaggacctcttccagactgtgctgaaccaccaaaagggatccagatgctgtggcacccatcaatagtcaaaccctacctcacactgctctctgagtgctcaaatccagacacgctggaaggggcggcaggcgccctgcagaacttggctgcagggagctggaagggctgggctgaggatgtggcaggcatggcatatgccctacgttcactgccagagggggctccctgcctgccacagtggtcagtatatatccgagccgctgtccgaaaagagaaaggcctgcccatcctcgtggagctgctccgaatagacaatgaccgtgtggtgtgcgcggtggccactgcgctgcggaacatggccttggacgtcagaaataaggagctcatcggcaaatacgccatgcgagacctagtccacaggcttccaggagggaacaacagcaacaacactgcaagcaaggccatgtcggatgacacagtgacagctgtctgctgcacactgcacgaagtgattaccaagaacatggagaacgccaaggccttacgggatgccggtggcatcgagaagttggtcggcatctccaaaagcaaaggagataaacactctccaaaagtggtcaaggctgcatctcaggtcctcaacagcatgtggcagtaccgagatctgaggagtctctacaaaaaggatggatggtcacaataccactttgtagcctcgtcttcaaccatcgagagggaccggcaaaggccctactcctcctcccgcacgccctccatctcccctgtgcgcgtgtctcccaacaaccgctcagcaagtgccccagcttcacctcgggaaatgatcagcctcaaagaaaggaaaacagactacgagtgcaccggcagcaacgccacctaccacggagctaaaggcgaacacacttccaggaaagatgccatgacagctcaaaacactggaatttcaactttgtataggaattcttatggtgcgcccgctgaagacatcaaacacaaccaggtttcagcacagccagtcccacaggagcccagcagaaaagattacgagacctaccagccatttcagaattccacaagaaattacgatgagtccttcttcgaggaccaggtccaccatcgccctcccgccagcgagtacaccatgcacctgggtctcaagtccaccggcaactacgttgacttctactcagctgcccgtccctacagtgaactgaactatgaaacgagccactacccggcctcccccgactcctgggtgtgaggagcagggcacaggcgctccgggaacagtgcatgtgcatgcataccacaagacatttctttctgttttgtttttttctcctgcaaatttagtttgttaaagcctgttccataggaaggctgtgataaccagtaaggaaatattaagagctattttagaaagctaaatgaatcgcaagttaacttggaaatcagtagaaagctaaagtgatcctaaatatgacagtgggcagcacctttctagcgtgagctgtagagtaacgagaagtgctttatactgaacgtggttgatgggaggagagacgaggcattcgggccggtggggcgtaagggttatcgttaagcacaagacacagaatagtttacacactgtgtgggggacggcttctcacgctttgtttactctcttcatccgttgtgactctaggcttcaggttgcattggggttcctctgtacagcaagatgtttcttgccttttgttaatgcattgttgtaaagtatttgatgtacattacagattaaagaagaaaagcgcgttgtgtatattacaccaatgccgccgtgtttcctcatctatggttctaaatattgcttcaatttcaaacttttgaaagatgtatggatttccagtttttctttactttctcccagtatgttttaacaaaaaaaaaaaaaagcaggaaaaaaggaatatttagcagtattgttcgttctgatatgtgaatttgtttgtgacaactaaacaaggcattcagcagtttctgacaattaacatacatcattccacactccttgtcaacaaagtgctttttcactgcctaaaattttagatgtagatatttgaaatagattttttcatttataccagttttctttatgatgatacagtgttaaaagaaaataaattacaattgatctgtcatccatatttgctaagaatgtctatttccaagaacctatatcttacaaaatacacattcttgcttgtgtgtctgtgtgtgtgggtgtatgtatgtccacgtactagaaaaattacctgtgtgagattttattttgacagaagctatttcatttgctgttcatcttgtacaaactttgtttttggttttttagtataaatgtacatcagtttgttccttttgtactgtatctattcttctgaccatctagtgactcaggatattaggccagttgaagtggagttataggattttcacacattcacgcatacttggatatcaaccctctctacaggtccgtttccttacacattttatcccctcagaacacgataaaccatggccaattcagtttcactttggggccaattacttgaagtatccacagaaaatgtaaactgctcgccttattcccccaaactttttgttcatgtggcagggagcagtacacaactatggaatagattattaaaactgaacttgaagctaacgttagaatagtggttaacagagctaagaaataaggctaaccatcgaaaagaacatgggccgcgggtaaactagctttgctctttagatgcaagtggctgaggccaataggtgcctagtaaatgttaactgttcttggaaaaaataaaaacatcagtaacaaaanaaannn

SEQ ID NO: 446131 - DNA, 4365 bp, Homo sapiens
gccagcatcccttgtcccgcggccgcgctcagacaacaaaagcggaagatgctgcagttgggcaaggtcaggaccttgccctgaagccgggcggcgccgcgcacgcctcttcccggactgaggagctgtcgccggcggagggtgcatgtttgcgaggaagccgccgggcgccgcgcctttgggagctatgcctgttccagaccagccttcatcagcctcagagaagacgagttccctgagccccggcttaaacacctccaacggggatggctctgaaacagaaaccacctctgccatcctcgcctcagtcaaagaacaggaattacagtttgaaaggctgacccgagagctggaggctgaacggcagatcgtagccagccagctggagcgatgcaagctcggatccgagactggcagcatgagcagcatgagttcagcagaagagcagtttcagtggcagtcacaagatggtcaaaaagatatcgaagatgagcttacaacaggtctcgagctggtggactcctgtattaggtcactacaggaatcaggaatacttgacccacaggattattctacaggtgaaaggcccagcctgctctcccagagtgcacttcagctcaattccaaacctgaagggtctttccagtatccggccagctaccatagcaaccagaccctggccctgggggaaaccaccccttcacagctcccggcccgaggcacacaagcccgagctacgggccagagcttcagccagggcacgaccagccgcgccggccacctggcggggcccgagcccgcgccgccgccgccgccgccgccgcgggagccgttcgcgcccagcctgggcagcgccttccacctgcccgacgcgccgcccgccgccgccgccgccgcgctctactactccagctccacgctgcccgcgccgccgcgcgggggctccccgctggccgcgccccagggcggttcgcccaccaagctgcagcgcggcggctcggcccccgagggcgccacctacgccgcgccgcgcggctcctcgcccaagcagtcgcccagccgcctggccaagtcctacagcaccagctcgcccatcaacatcgtcgtgtcctcggccggcctgtccccgatccgcgtgacctcgccccccaccgtgcagtccaccatctcctcctcgcccatccaccagctgagctccaccatcggcacgtacgccaccctgtcgcccaccaagcgcctggtccacgcgtccgagcagtacagcaagcactcgcaggagctgtatgccacggccaccctccagaggccgggcagcctggcagctggttcccgagcctcatacagcagccagcatgggcacctgggcccagagttgcgggccctgcagtccccagaacaccacatagatcccatctatgaagaccgcgtctatcagaagccccctatgaggagtctcagccagagccagggggaccctctgccgccagcacacaccggcacctaccgcacgagcacagccccatcttcccctggtgtcgactccgtccccttgcagcgcacaggcagccagcacggcccacagaatgccgccgcggccaccttccagagggccagctatgccgccggcccagcctccaattacgcggacccctaccgacagctgcagtattgtccctctgttgagtctccatacagcaaatccggccctgctctcccgcctgaaggcaccttggccaggtccccgtccattgatagcattcagaaagatcccagagaatttggatggagagacccggaactgccggaagtgattcagatgttgcagcaccagtttccctcggtccagtctaacgcggcagcctacttgcaacacctctgttttggagacaacaaaattaaagccgagataaggagacaaggaggcatccagctcctggtggacctgttggatcatcggatgaccgaagtccaccgtagtgcctgtggagctctgagaaacctggtgtatgggaaggccaacgatgataacaaaattgccctgaaaaactgtggtggcatcccagcactggtgaggttactccgcaagacgactgacctggagatccgggagctggtcacaggagtcctttggaacctctcctcatgcgatgcactcaaaatgccaatcatccaggatgccctagcagtactgaccaacgcggtgattatcccccactcaggctgggaaaattcgcctcttcaggatgatcggaaaatacagctgcattcatcacaggtgctgcgtaacgccaccgggtgcctaaggaatgttagttcggccggagaggaggcccgcagaaggatgagagagtgtgatgggcttacggatgccttgctgtacgtgatccagtctgcgctggggagcagtgagatcgatagcaagaccgttgaaaactgtgtgtgcattttaaggaacctctcgtaccggctggcggcagaaacgtctcagggacagcacatgggcacggacgagctggacgggctactctgtggcgaggccaatggcaaggatgctgagagctctgggtgctggggcaagaagaagaagaaaaagaaatcccaagatcagtgggatggagtaggacctcttccagactgtgctgaaccaccaaaagggatccagatgctgtggcacccatcaatagtcaaaccctacctcacactgctctctgagtgctcaaatccagacacgctggaaggggcggcaggcgccctgcagaacttggctgcagggagctggaagtggtcagtatatatccgagccgctgtccgaaaagagaaaggcctgcccatcctcgtggagctgctccgaatagacaatgaccgtgtggtgtgcgcggtggccactgcgctgcggaacatggccttggacgtcagaaataaggagctcatcggcaaatacgccatgcgagacctagtccacaggcttccaggagggaacaacagcaacaacactgcaagcaaggccatgtcggatgacacagtgacagctgtctgctgcacactgcacgaagtgattaccaagaacatggagaacgccaaggccttacgggatgccggtggcatcgagaagttggtcggcatctccaaaagcaaaggagataaacactctccaaaagtggtcaaggctgcatctcaggtcctcaacagcatgtggcagtaccgagatctgaggagtctctacaaaaaggatggatggtcacaataccactttgtagcctcgtcttcaaccatcgagagggaccggcaaaggccctactcctcctcccgcacgccctccatctcccctgtgcgcgtgtctcccaacaaccgctcagcaagtgccccagcttcacctcgggaaatgatcagcctcaaagaaaggaaaacagactacgagtgcaccggcagcaacgccacctaccacggagctaaaggcgaacacacttccaggaaagatgccatgacagctcaaaacactggaatttcaactttgtataggaattcttatggtgcgcccgctgaagacatcaaacacaaccaggtttcagcacagccagtcccacaggagcccagcagaaaagattacgagacctaccagccatttcagaattccacaagaaattacgatgagtccttcttcgaggaccaggtccaccatcgccctcccgccagcgagtacaccatgcacctgggtctcaagtccaccggcaactacgttgacttctactcagctgcccgtccctacagtgaactgaactatgaaacgagccactacccggcctcccccgactcctgggtgtgaggagcagggcacaggcgctccgggaacagtgcatgtgcatgcataccacaagacatttctttctgttttgtttttttctcctgcaaatttagtttgttaaagcctgttccataggaaggctgtgataaccagtaaggaaatattaagagctattttagaaagctaaatgaatcgcaagttaacttggaaatcagtagaaagctaaagtgatcctaaatatgacagtgggcagcacctttctagcgtgagctgtagagtaacgagaagtgctttatactgaacgtggttgatgggaggagagacgaggcattcgggccggtggggcgtaagggttatcgttaagcacaagacacagaatagtttacacactgtgtgggggacggcttctcacgctttgtttactctcttcatccgttgtgactctaggcttcaggttgcattggggttcctctgtacagcaagatgtttcttgccttttgttaatgcattgttgtaaagtatttgatgtacattacagattaaagaagaaaagcgcgttgtgt

SEQ ID NO: 446132 - DNA, 2643 bp, Homo sapiens
  misc_feature (25)..(25): n is a, c, g, or t
  misc_feature (2637)..(2637): n is a, c, g, or t
  misc_feature (2641)..(2643): n is a, c, g, or t
tacgacatagacagattcgaatcgnctcgtaccgcctaatggatgctccgaatagacaatgaccgtgtggtgtgcgcggtggccactgcgctgcggaacatggccttggacgtcagaaataaggagctcatcggcaaatacgccatgcgagacctagtccacaggcttccaggagggaacaacagcaacaacactgcaagcaaggccatgtcggatgacacagtgacagctgtctgctgcacactgcacgaagtgattaccaagaacatggagaacgccaaggccttacgggatgccggtggcatcgagaagttggtcggcatctccaaaagcaaaggagataaacactctccaaaagtggtcaaggctgcatctcaggtcctcaacagcatgtggcagtaccgagatctgaggagtctctacaaaaaggatggatggtcacaataccactttgtagcctcgtcttcaaccatcgagagggaccggcaaaggccctactcctcctcccgcacgccctccatctcccctgtgcgcgtgtctcccaacaaccgctcagcaagtgccccagcttcacctcgggaaatgatcagcctcaaagaaaggaaaacagactacgagtgcaccggcagcaacgccacctaccacggagctaaaggcgaacacacttccaggaaagatgccatgacagctcaaaacactggaatttcaactttgtataggaattcttatggtgcgcccgctgaagacatcaaacacaaccaggtttcagcacagccagtcccacaggagcccagcagaaaagattacgagacctaccagccatttcagaattccacaagaaattacgatgagtccttcttcgaggaccaggtccaccatcgccctcccgccagcgagtacaccatgcacctgggtctcaagtccaccggcaactacgttgacttctactcagctgcccgtccctacagtgaactgaactatgaaacgagccactacccggcctcccccgactcctgggtgtgaggagcagggcacaggcgctccgggaacagtgcatgtgcatgcataccacaagacatttctttctgttttgtttttttctcctgcaaatttagtttgttaaagcctgttccataggaaggctgtgataaccagtaaggaaatattaagagctattttagaaagctaaatgaatcgcaagttaacttggaaatcagtagaaagctaaagtgatcctaaatatgacagtgggcagcacctttctagcgtgagctgtagagtaacgagaagtgctttatactgaacgtggttgatgggaggagagacgaggcattcgggccggtggggcgtaagggttatcgttaagcacaagacacagaatagtttacacactgtgtgggggacggcttctcacgctttgtttactctcttcatccgttgtgactctaggcttcaggttgcattggggttcctctgtacagcaagatgtttcttgccttttgttaatgcattgttgtaaagtatttgatgtacattacagattaaagaagaaaagcgcgttgtgtatattacaccaatgccgccgtgtttcctcatctatggttctaaatattgcttcaatttcaaacttttgaaagatgtatggatttccagtttttctttactttctcccagtatgttttaacaaaaaaaaaaaaaagcaggaaaaaaggaatatttagcagtattgttcgttctgatatgtgaatttgtttgtgacaactaaacaaggcattcagcagtttctgacaattaacatacatcattccacactccttgtcaacaaagtgctttttcactgcctaaaattttagatgtagatatttgaaatagattttttcatttataccagttttctttatgatgatacagtgttaaaagaaaataaattacaattgatctgtcatccatatttgctaagaatgtctatttccaagaacctatatcttacaaaatacacattcttgcttgtgtgtctgtgtgtgtgggtgtatgtatgtccacgtactagaaaaattacctgtgtgagattttattttgacagaagctatttcatttgctgttcatcttgtacaaactttgtttttggttttttagtataaatgtacatcagtttgttccttttgtactgtatctattcttctgaccatctagtgactcaggatattaggccagttgaagtggagttataggattttcacacattcacgcatacttggatatcaaccctctctacaggtccgtttccttacacattttatcccctcagaacacgataaaccatggccaattcagtttcactttggggccaattacttgaagtatccacagaaaatgtaaactgctcgccttattcccccaaactttttgttcatgtggcagggagcagtacacaactatggaatagattattaaaactgaacttgaagctaacgttagaatagtggttaacagagctaagaaataaggctaaccatcgaaaagaacatgggccgcgggtaaactagctttgctctttagatgcaagtggctgaggccaataggtgcctagtaaatgttaactgttcttggaaaaaataaaaacatcagtaacaaaanaaannn

SEQ ID NO: 446133 - DNA, 2725 bp, Homo sapiens
  misc_feature (2719)..(2719): n is a, c, g, or t
  misc_feature (2723)..(2725): n is a, c, g, or t
gggtacactccatgaccctgttgctgggtatcagcagcagtggctgcagaacagcggatattggtgaaccgcagatgctgctgcctgatcgttcttctggaagttttgtctcagaggagtacctggccgtgtgaggtgtcagtccacccctactggggggtgcctcccagttaggctactcgggggtcagggacccacttgaggaggcagtctgcccgttctcagatctcaagctgcatgctgggagaacccaggagggaacaacagcaacaacactgcaagcaaggccatgtcggatgacacagtgacagctgtctgctgcacactgcacgaagtgattaccaagaacatggagaacgccaaggccttacgggatgccggtggcatcgagaagttggtcggcatctccaaaagcaaaggagataaacactctccaaaagtggtcaaggctgcatctcaggtcctcaacagcatgtggcagtaccgagatctgaggagtctctacaaaaaggatggatggtcacaataccactttgtagcctcgtcttcaaccatcgagagggaccggcaaaggccctactcctcctcccgcacgccctccatctcccctgtgcgcgtgtctcccaacaaccgctcagcaagtgccccagcttcacctcgggaaatgatcagcctcaaagaaaggaaaacagactacgagtgcaccggcagcaacgccacctaccacggagctaaaggcgaacacacttccaggaaagatgccatgacagctcaaaacactggaatttcaactttgtataggaattcttatggtgcgcccgctgaagacatcaaacacaaccaggtttcagcacagccagtcccacaggagcccagcagaaaagattacgagacctaccagccatttcagaattccacaagaaattacgatgagtccttcttcgaggaccaggtccaccatcgccctcccgccagcgagtacaccatgcacctgggtctcaagtccaccggcaactacgttgacttctactcagctgcccgtccctacagtgaactgaactatgaaacgagccactacccggcctcccccgactcctgggtgtgaggagcagggcacaggcgctccgggaacagtgcatgtgcatgcataccacaagacatttctttctgttttgtttttttctcctgcaaatttagtttgttaaagcctgttccataggaaggctgtgataaccagtaaggaaatattaagagctattttagaaagctaaatgaatcgcaagttaacttggaaatcagtagaaagctaaagtgatcctaaatatgacagtgggcagcacctttctagcgtgagctgtagagtaacgagaagtgctttatactgaacgtggttgatgggaggagagacgaggcattcgggccggtggggcgtaagggttatcgttaagcacaagacacagaatagtttacacactgtgtgggggacggcttctcacgctttgtttactctcttcatccgttgtgactctaggcttcaggttgcattggggttcctctgtacagcaagatgtttcttgccttttgttaatgcattgttgtaaagtatttgatgtacattacagattaaagaagaaaagcgcgttgtgtatattacaccaatgccgccgtgtttcctcatctatggttctaaatattgcttcaatttcaaacttttgaaagatgtatggatttccagtttttctttactttctcccagtatgttttaacaaaaaaaaaaaaaagcaggaaaaaaggaatatttagcagtattgttcgttctgatatgtgaatttgtttgtgacaactaaacaaggcattcagcagtttctgacaattaacatacatcattccacactccttgtcaacaaagtgctttttcactgcctaaaattttagatgtagatatttgaaatagattttttcatttataccagttttctttatgatgatacagtgttaaaagaaaataaattacaattgatctgtcatccatatttgctaagaatgtctatttccaagaacctatatcttacaaaatacacattcttgcttgtgtgtctgtgtgtgtgggtgtatgtatgtccacgtactagaaaaattacctgtgtgagattttattttgacagaagctatttcatttgctgttcatcttgtacaaactttgtttttggttttttagtataaatgtacatcagtttgttccttttgtactgtatctattcttctgaccatctagtgactcaggatattaggccagttgaagtggagttataggattttcacacattcacgcatacttggatatcaaccctctctacaggtccgtttccttacacattttatcccctcagaacacgataaaccatggccaattcagtttcactttggggccaattacttgaagtatccacagaaaatgtaaactgctcgccttattcccccaaactttttgttcatgtggcagggagcagtacacaactatggaatagattattaaaactgaacttgaagctaacgttagaatagtggttaacagagctaagaaataaggctaaccatcgaaaagaacatgggccgcgggtaaactagctttgctctttagatgcaagtggctgaggccaataggtgcctagtaaatgttaactgttcttggaaaaaataaaaacatcagtaacaaaanaaannn

SEQ ID NO: 446134 - DNA, 1939 bp, Homo sapiens
  misc_feature (29)..(32): n is a, c, g, or t
  misc_feature (1933)..(1933): n is a, c, g, or t
  misc_feature (1937)..(1939): n is a, c, g, or t
agcagtgaaagaaacgaacgaggaaagannnnttgaacgaacaagatgcgagttcagggtttcagcacagccagtcccacaggagcccagcagaaaagattacgagacctaccagccatttcagaattccacaagaaattacgatgagtccttcttcgaggaccaggtccaccatcgccctcccgccagcgagtacaccatgcacctgggtctcaagtccaccggcaactacgttgacttctactcagctgcccgtccctacagtgaactgaactatgaaacgagccactacccggcctcccccgactcctgggtgtgaggagcagggcacaggcgctccgggaacagtgcatgtgcatgcataccacaagacatttctttctgttttgtttttttctcctgcaaatttagtttgttaaagcctgttccataggaaggctgtgataaccagtaaggaaatattaagagctattttagaaagctaaatgaatcgcaagttaacttggaaatcagtagaaagctaaagtgatcctaaatatgacagtgggcagcacctttctagcgtgagctgtagagtaacgagaagtgctttatactgaacgtggttgatgggaggagagacgaggcattcgggccggtggggcgtaagggttatcgttaagcacaagacacagaatagtttacacactgtgtgggggacggcttctcacgctttgtttactctcttcatccgttgtgactctaggcttcaggttgcattggggttcctctgtacagcaagatgtttcttgccttttgttaatgcattgttgtaaagtatttgatgtacattacagattaaagaagaaaagcgcgttgtgtatattacaccaatgccgccgtgtttcctcatctatggttctaaatattgcttcaatttcaaacttttgaaagatgtatggatttccagtttttctttactttctcccagtatgttttaacaaaaaaaaaaaaaagcaggaaaaaaggaatatttagcagtattgttcgttctgatatgtgaatttgtttgtgacaactaaacaaggcattcagcagtttctgacaattaacatacatcattccacactccttgtcaacaaagtgctttttcactgcctaaaattttagatgtagatatttgaaatagattttttcatttataccagttttctttatgatgatacagtgttaaaagaaaataaattacaattgatctgtcatccatatttgctaagaatgtctatttccaagaacctatatcttacaaaatacacattcttgcttgtgtgtctgtgtgtgtgggtgtatgtatgtccacgtactagaaaaattacctgtgtgagattttattttgacagaagctatttcatttgctgttcatcttgtacaaactttgtttttggttttttagtataaatgtacatcagtttgttccttttgtactgtatctattcttctgaccatctagtgactcaggatattaggccagttgaagtggagttataggattttcacacattcacgcatacttggatatcaaccctctctacaggtccgtttccttacacattttatcccctcagaacacgataaaccatggccaattcagtttcactttggggccaattacttgaagtatccacagaaaatgtaaactgctcgccttattcccccaaactttttgttcatgtggcagggagcagtacacaactatggaatagattattaaaactgaacttgaagctaacgttagaatagtggttaacagagctaagaaataaggctaaccatcgaaaagaacatgggccgcgggtaaactagctttgctctttagatgcaagtggctgaggccaataggtgcctagtaaatgttaactgttcttggaaaaaataaaaacatcagtaacaaaanaaannn

SEQ ID NO: 446135 - DNA, 1932 bp, Homo sapiens
  misc_feature (40)..(40): n is a, c, g, or t
  misc_feature (1926)..(1926): n is a, c, g, or t
  misc_feature (1930)..(1932): n is a, c, g, or t
actacaacgcccaacgccccccattgtgacacactaaaanaaaagccttgtgtttcagcacagccagtcccacaggagcccagcagaaaagattacgagacctaccagccatttcagaattccacaagaaattacgatgagtccttcttcgaggaccaggtccaccatcgccctcccgccagcgagtacaccatgcacctgggtctcaagtccaccggcaactacgttgacttctactcagctgcccgtccctacagtgaactgaactatgaaacgagccactacccggcctcccccgactcctgggtgtgaggagcagggcacaggcgctccgggaacagtgcatgtgcatgcataccacaagacatttctttctgttttgtttttttctcctgcaaatttagtttgttaaagcctgttccataggaaggctgtgataaccagtaaggaaatattaagagctattttagaaagctaaatgaatcgcaagttaacttggaaatcagtagaaagctaaagtgatcctaaatatgacagtgggcagcacctttctagcgtgagctgtagagtaacgagaagtgctttatactgaacgtggttgatgggaggagagacgaggcattcgggccggtggggcgtaagggttatcgttaagcacaagacacagaatagtttacacactgtgtgggggacggcttctcacgctttgtttactctcttcatccgttgtgactctaggcttcaggttgcattggggttcctctgtacagcaagatgtttcttgccttttgttaatgcattgttgtaaagtatttgatgtacattacagattaaagaagaaaagcgcgttgtgtatattacaccaatgccgccgtgtttcctcatctatggttctaaatattgcttcaatttcaaacttttgaaagatgtatggatttccagtttttctttactttctcccagtatgttttaacaaaaaaaaaaaaaagcaggaaaaaaggaatatttagcagtattgttcgttctgatatgtgaatttgtttgtgacaactaaacaaggcattcagcagtttctgacaattaacatacatcattccacactccttgtcaacaaagtgctttttcactgcctaaaattttagatgtagatatttgaaatagattttttcatttataccagttttctttatgatgatacagtgttaaaagaaaataaattacaattgatctgtcatccatatttgctaagaatgtctatttccaagaacctatatcttacaaaatacacattcttgcttgtgtgtctgtgtgtgtgggtgtatgtatgtccacgtactagaaaaattacctgtgtgagattttattttgacagaagctatttcatttgctgttcatcttgtacaaactttgtttttggttttttagtataaatgtacatcagtttgttccttttgtactgtatctattcttctgaccatctagtgactcaggatattaggccagttgaagtggagttataggattttcacacattcacgcatacttggatatcaaccctctctacaggtccgtttccttacacattttatcccctcagaacacgataaaccatggccaattcagtttcactttggggccaattacttgaagtatccacagaaaatgtaaactgctcgccttattcccccaaactttttgttcatgtggcagggagcagtacacaactatggaatagattattaaaactgaacttgaagctaacgttagaatagtggttaacagagctaagaaataaggctaaccatcgaaaagaacatgggccgcgggtaaactagctttgctctttagatgcaagtggctgaggccaataggtgcctagtaaatgttaactgttcttggaaaaaataaaaacatcagtaacaaaanaaannn

SEQ ID NO: 446136 - DNA, 214 bp, Homo sapiens
agaaaaccagaacagtcatttatgaaatattttcttttagagtcaggtacatttcatacacgagctaaccatgtgttaacagtgtggtaggatttctctctcatattctccccgcttctttccttttgttcagagaatttggatggagagacccggaactgccggaagtgattcagatgttgcagcaccagtttccctcggtccagtctaacgc

SEQ ID NO: 446137 - DNA, 270 bp, Homo sapiens
caggctgggaaaattcgcctcttcaggatgatcggaaaatacagctgcattcatcacaggtgctgcgtaacgccaccgggtgcctaaggtcagtcctgtgtcacgagtgcctcctcccaccatcttcccctggccagacactgtctctttccataactttagtggctcttttactgaggatcagaccattctgaaaacatgaatgttgatgtggcaacggagtataagaagttaattttaaattttctaaccaggtaataaagacatata

SEQ ID NO: 446138 - DNA, 5443 bp, Homo sapiens
  misc_feature (5437)..(5437): n is a, c, g, or t
  misc_feature (5441)..(5443): n is a, c, g, or t
gccagcatcccttgtcccgcggccgcgctcagacaacaaaagcggaagatgctgcagttgggcaaggtcaggaccttgccctgaagccgggcggcgccgcgcacgcctcttcccggactgaggagctgtcgccggcggagggtgcatgtttgcgaggaagccgccgggcgccgcgcctttgggagctatgcctgttccagaccagccttcatcagcctcagagaagacgagttccctgagccccggcttaaacacctccaacggggatggctctgaaacagaaaccacctctgccatcctcgcctcagtcaaagaacaggaattacagtttgaaaggctgacccgagagctggaggctgaacggcagatcgtagccagccagctggagcgatgcaagctcggatccgagactggcagcatgagcagcatgagttcagcagaagagcagtttcagtggcagtcacaagatggtcaaaaagatatcgaagatgagcttacaacaggtctcgagctggtggactcctgtattaggtcactacaggaatcaggaatacttgacccacaggattattctacaggtgaaaggcccagcctgctctcccagagtgcacttcagctcaattccaaacctgaagggtctttccagtatccggccagctaccatagcaaccagaccctggccctgggggaaaccaccccttcacagctcccggcccgaggcacacaagcccgagctacgggccagagcttcagccagggcacgaccagccgcgccggccacctggcggggcccgagcccgcgccgccgccgccgccgccgccgcgggagccgttcgcgcccagcctgggcagcgccttccacctgcccgacgcgccgcccgccgccgccgccgccgcgctctactactccagctccacgctgcccgcgccgccgcgcgggggctccccgctggccgcgccccagggcggttcgcccaccaagctgcagcgcggcggctcggcccccgagggcgccacctacgccgcgccgcgcggctcctcgcccaagcagtcgcccagccgcctggccaagtcctacagcaccagctcgcccatcaacatcgtcgtgtcctcggccggcctgtccccgatccgcgtgacctcgccccccaccgtgcagtccaccatctcctcctcgcccatccaccagctgagctccaccatcggcacgtacgccaccctgtcgcccaccaagcgcctggtccacgcgtccgagcagtacagcaagcactcgcaggagctgtatgccacggccaccctccagaggccgggcagcctggcagctggttcccgagcctcatacagcagccagcatgggcacctgggcccagagttgcgggccctgcagtccccagaacaccacatagatcccatctatgaagaccgcgtctatcagaagccccctatgaggagtctcagccagagccagggggaccctctgccgccagcacacaccggcacctaccgcacgagcacagccccatcttcccctggtgtcgactccgtccccttgcagcgcacaggcagccagcacggcccacagaatgccgccgcggccaccttccagagggccagctatgccgccggcccagcctccaattacgcggacccctaccgacagctgcagtattgtccctctgttgagtctccatacagcaaatccggccctgctctcccgcctgaaggcaccttggccaggtccccgtccattgatagcattcagaaagatcccagagaatttggatggagagacccggaactgccggaagtgattcagatgttgcagcaccagtttccctcggtccagtctaacgcggcagcctacttgcaacacctctgttttggagacaacaaaattaaagccgagataaggagacaaggaggcatccagctcctggtggacctgttggatcatcggatgaccgaagtccaccgtagtgcctgtggagctctgagaaacctggtgtatgggaaggccaacgatgataacaaaattgccctgaaaaactgtggtggcatcccagcactggtgaggttactccgcaagacgactgacctggagatccgggagctggtcacaggagtcctttggaacctctcctcatgcgatgcactcaaaatgccaatcatccaggatgccctagcagtactgaccaacgcggtgattatcccccactcaggctgggaaaattcgcctcttcaggatgatcggaaaatacagctgcattcatcacaggtgctgcgtaacgccaccgggtgcctaaggaatgttagttcggccggagaggaggcccgcagaaggatgagagagtgtgatgggcttacggatgccttgctgtacgtgatccagtctgcgctggggagcagtgagatcgatagcaagaccgttgaaaactgtgtgtgcattttaaggaacctctcgtaccggctggcggcagaaacgtctcagggacagcacatgggcacggacgagctggacgggctactctgtggcgaggccaatggcaaggatgctgagagctctgggtgctggggcaagaagaagaagaaaaagaaatcccaagatcagtgggatggagtaggacctcttccagactgtgctgaaccaccaaaagggatccagatgctgtggcacccatcaatagtcaaaccctacctcacactgctctctgagtgctcaaatccagacacgctggaaggggcggcaggcgccctgcagaacttggctgcagggagctggaagtggtcagtatatatccgagccgctgtccgaaaagagaaaggcctgcccatcctcgtggagctgctccgaatagacaatgaccgtgtggtgtgcgcggtggccactgcgctgcggaacatggccttggacgtcagaaataaggagctcatcggcaaatacgccatgcgagacctagtccacaggcttccaggagggaacaacagcaacaacactgcaagcaaggccatgtcggatgacacagtgacagctgtctgctgcacactgcacgaagtgattaccaagaacatggagaacgccaaggccttacgggatgccggtggcatcgagaagttggtcggcatctccaaaagcaaaggagataaacactctccaaaagtggtcaaggctgcatctcaggtcctcaacagcatgtggcagtaccgagatctgaggagtctctacaaaaaggatggatggtcacaataccactttgtagcctcgtcttcaaccatcgagagggaccggcaaaggccctactcctcctcccgcacgccctccatctcccctgtgcgcgtgtctcccaacaaccgctcagcaagtgccccagcttcacctcgggaaatgatcagcctcaaagaaaggaaaacagactacgagtgcaccggcagcaacgccacctaccacggagctaaaggcgaacacacttccaggaaagatgccatgacagctcaaaacactggaatttcaactttgtataggaattcttatggtgcgcccgctgaagacatcaaacacaaccaggtttcagcacagccagtcccacaggagcccagcagaaaagattacgagacctaccagccatttcagaattccacaagaaattacgatgagtccttcttcgaggaccaggtccaccatcgccctcccgccagcgagtacaccatgcacctgggtctcaagtccaccggcaactacgttgacttctactcagctgcccgtccctacagtgaactgaactatgaaacgagccactacccggcctcccccgactcctgggtgtgaggagcagggcacaggcgctccgggaacagtgcatgtgcatgcataccacaagacatttctttctgttttgtttttttctcctgcaaatttagtttgttaaagcctgttccataggaaggctgtgataaccagtaaggaaatattaagagctattttagaaagctaaatgaatcgcaagttaacttggaaatcagtagaaagctaaagtgatcctaaatatgacagtgggcagcacctttctagcgtgagctgtagagtaacgagaagtgctttatactgaacgtggttgatgggaggagagacgaggcattcgggccggtggggcgtaagggttatcgttaagcacaagacacagaatagtttacacactgtgtgggggacggcttctcacgctttgtttactctcttcatccgttgtgactctaggcttcaggttgcattggggttcctctgtacagcaagatgtttcttgccttttgttaatgcattgttgtaaagtatttgatgtacattacagattaaagaagaaaagcgcgttgtgtatattacaccaatgccgccgtgtttcctcatctatggttctaaatattgcttcaatttcaaacttttgaaagatgtatggatttccagtttttctttactttctcccagtatgttttaacaaaaaaaaaaaaaagcaggaaaaaaggaatatttagcagtattgttcgttctgatatgtgaatttgtttgtgacaactaaacaaggcattcagcagtttctgacaattaacatacatcattccacactccttgtcaacaaagtgctttttcactgcctaaaattttagatgtagatatttgaaatagattttttcatttataccagttttctttatgatgatacagtgttaaaagaaaataaattacaattgatctgtcatccatatttgctaagaatgtctatttccaagaacctatatcttacaaaatacacattcttgcttgtgtgtctgtgtgtgtgggtgtatgtatgtccacgtactagaaaaattacctgtgtgagattttattttgacagaagctatttcatttgctgttcatcttgtacaaactttgtttttggttttttagtataaatgtacatcagtttgttccttttgtactgtatctattcttctgaccatctagtgactcaggatattaggccagttgaagtggagttataggattttcacacattcacgcatacttggatatcaaccctctctacaggtccgtttccttacacattttatcccctcagaacacgataaaccatggccaattcagtttcactttggggccaattacttgaagtatccacagaaaatgtaaactgctcgccttattcccccaaactttttgttcatgtggcagggagcagtacacaactatggaatagattattaaaactgaacttgaagctaacgttagaatagtggttaacagagctaagaaataaggctaaccatcgaaaagaacatgggccgcgggtaaactagctttgctctttagatgcaagtggctgaggccaataggtgcctagtaaatgttaactgttcttggaaaaaataaaaacatcagtaacaaaanaaannn

SEQ ID NO: 446139 - DNA, 502 bp, Homo sapiens
gccagcatcccttgtcccgcggccgcgctcagacaacaaaagcggaagatgctgcagttgggcaaggtcaggaccttgccctgaagccgggcggcgccgcgcacgcctcttcccggactgaggagctgtcgccggcggagggtgcatgtttgcgaggaagccgccgggcgccgcgcctttgggagctatgcctgttccagaccagccttcatcagcctcagagaagacgagttccctgagccccggcttaaacacctccaacggggatggctctgaaacagaaaccacctctgccatcctcgcctcagtcaaagaacaggaattacagtttgaaaggctgacccgagagctggaggctgaacggcagatcgtagccagccagctggagcgatgcaagctcggatccgagactggcagcatgagcagcatgagaagcagaaggaaaacacttcacctccctacctctacatctgttgtttcaacctgaagtctcgggaacatg

SEQ ID NO: 446140 - DNA, 2640 bp, Homo sapiens
  misc_feature (3)..(3): n is a, c, g, or t
  misc_feature (8)..(8): n is a, c, g, or t
  misc_feature (2634)..(2634): n is a, c, g, or t
  misc_feature (2638)..(2640): n is a, c, g, or t
ctnccccnggtgatctagaggaccccgcctaagtggaagatgctccgaatagacaatgaccgtgtggtgtgcgcggtggccactgcgctgcggaacatggccttggacgtcagaaataaggagctcatcggcaaatacgccatgcgagacctagtccacaggcttccaggagggaacaacagcaacaacactgcaagcaaggccatgtcggatgacacagtgacagctgtctgctgcacactgcacgaagtgattaccaagaacatggagaacgccaaggccttacgggatgccggtggcatcgagaagttggtcggcatctccaaaagcaaaggagataaacactctccaaaagtggtcaaggctgcatctcaggtcctcaacagcatgtggcagtaccgagatctgaggagtctctacaaaaaggatggatggtcacaataccactttgtagcctcgtcttcaaccatcgagagggaccggcaaaggccctactcctcctcccgcacgccctccatctcccctgtgcgcgtgtctcccaacaaccgctcagcaagtgccccagcttcacctcgggaaatgatcagcctcaaagaaaggaaaacagactacgagtgcaccggcagcaacgccacctaccacggagctaaaggcgaacacacttccaggaaagatgccatgacagctcaaaacactggaatttcaactttgtataggaattcttatggtgcgcccgctgaagacatcaaacacaaccaggtttcagcacagccagtcccacaggagcccagcagaaaagattacgagacctaccagccatttcagaattccacaagaaattacgatgagtccttcttcgaggaccaggtccaccatcgccctcccgccagcgagtacaccatgcacctgggtctcaagtccaccggcaactacgttgacttctactcagctgcccgtccctacagtgaactgaactatgaaacgagccactacccggcctcccccgactcctgggtgtgaggagcagggcacaggcgctccgggaacagtgcatgtgcatgcataccacaagacatttctttctgttttgtttttttctcctgcaaatttagtttgttaaagcctgttccataggaaggctgtgataaccagtaaggaaatattaagagctattttagaaagctaaatgaatcgcaagttaacttggaaatcagtagaaagctaaagtgatcctaaatatgacagtgggcagcacctttctagcgtgagctgtagagtaacgagaagtgctttatactgaacgtggttgatgggaggagagacgaggcattcgggccggtggggcgtaagggttatcgttaagcacaagacacagaatagtttacacactgtgtgggggacggcttctcacgctttgtttactctcttcatccgttgtgactctaggcttcaggttgcattggggttcctctgtacagcaagatgtttcttgccttttgttaatgcattgttgtaaagtatttgatgtacattacagattaaagaagaaaagcgcgttgtgtatattacaccaatgccgccgtgtttcctcatctatggttctaaatattgcttcaatttcaaacttttgaaagatgtatggatttccagtttttctttactttctcccagtatgttttaacaaaaaaaaaaaaaagcaggaaaaaaggaatatttagcagtattgttcgttctgatatgtgaatttgtttgtgacaactaaacaaggcattcagcagtttctgacaattaacatacatcattccacactccttgtcaacaaagtgctttttcactgcctaaaattttagatgtagatatttgaaatagattttttcatttataccagttttctttatgatgatacagtgttaaaagaaaataaattacaattgatctgtcatccatatttgctaagaatgtctatttccaagaacctatatcttacaaaatacacattcttgcttgtgtgtctgtgtgtgtgggtgtatgtatgtccacgtactagaaaaattacctgtgtgagattttattttgacagaagctatttcatttgctgttcatcttgtacaaactttgtttttggttttttagtataaatgtacatcagtttgttccttttgtactgtatctattcttctgaccatctagtgactcaggatattaggccagttgaagtggagttataggattttcacacattcacgcatacttggatatcaaccctctctacaggtccgtttccttacacattttatcccctcagaacacgataaaccatggccaattcagtttcactttggggccaattacttgaagtatccacagaaaatgtaaactgctcgccttattcccccaaactttttgttcatgtggcagggagcagtacacaactatggaatagattattaaaactgaacttgaagctaacgttagaatagtggttaacagagctaagaaataaggctaaccatcgaaaagaacatgggccgcgggtaaactagctttgctctttagatgcaagtggctgaggccaataggtgcctagtaaatgttaactgttcttggaaaaaataaaaacatcagtaacaaaanaaannn

SEQ ID NO: 446141 - DNA, 3583 bp, Homo sapiens
gccagcatcccttgtcccgcggccgcgctcagacaacaaaagcggaagatgctgcagttgggcaaggtcaggaccttgccctgaagccgggcggcgccgcgcacgcctcttcccggactgaggagctgtcgccggcggagggtgcatgtttgcgaggaagccgccgggcgccgcgcctttgggagctatgcctgttccagaccagccttcatcagcctcagagaagacgagttccctgagccccggcttaaacacctccaacggggatggctctgaaacagaaaccacctctgccatcctcgcctcagtcaaagaacaggaattacagtttgaaaggctgacccgagagctggaggctgaacggcagatcgtagccagccagctggagcgatgcaagctcggatccgagactggcagcatgagcagcatgagttcagcagaagagcagtttcagtggcagtcacaagatggtcaaaaagatatcgaagatgagcttacaacaggtctcgagctggtggactcctgtattaggtcactacaggaatcaggaatacttgacccacaggattattctacaggtgaaaggcccagcctgctctcccagagtgcacttcagctcaattccaaacctgaagggtctttccagtatccggccagctaccatagcaaccagaccctggccctgggggaaaccaccccttcacagctcccggcccgaggcacacaagcccgagctacgggccagagcttcagccagggcacgaccagccgcgccggccacctggcggggcccgagcccgcgccgccgccgccgccgccgccgcgggagccgttcgcgcccagcctgggcagcgccttccacctgcccgacgcgccgcccgccgccgccgccgccgcgctctactactccagctccacgctgcccgcgccgccgcgcgggggctccccgctggccgcgccccagggcggttcgcccaccaagctgcagcgcggcggctcggcccccgagggcgccacctacgccgcgccgcgcggctcctcgcccaagcagtcgcccagccgcctggccaagtcctacagcaccagctcgcccatcaacatcgtcgtgtcctcggccggcctgtccccgatccgcgtgacctcgccccccaccgtgcagtccaccatctcctcctcgcccatccaccagctgagctccaccatcggcacgtacgccaccctgtcgcccaccaagcgcctggtccacgcgtccgagcagtacagcaagcactcgcaggagctgtatgccacggccaccctccagaggccgggcagcctggcagctggttcccgagcctcatacagcagccagcatgggcacctgggcccagagttgcgggccctgcagtccccagaacaccacatagatcccatctatgaagaccgcgtctatcagaagccccctatgaggagtctcagccagagccagggggaccctctgccgccagcacacaccggcacctaccgcacgagcacagccccatcttcccctggtgtcgactccgtccccttgcagcgcacaggcagccagcacggcccacagaatgccgccgcggccaccttccagagggccagctatgccgccggcccagcctccaattacgcggacccctaccgacagctgcagtattgtccctctgttgagtctccatacagcaaatccggccctgctctcccgcctgaaggcaccttggccaggtccccgtccattgatagcattcagaaagatcccagagaatttggatggagagacccggaactgccggaagtgattcagatgttgcagcaccagtttccctcggtccagtctaacgcggcagcctacttgcaacacctctgttttggagacaacaaaattaaagccgagataaggagacaaggaggcatccagctcctggtggacctgttggatcatcggatgaccgaagtccaccgtagtgcctgtggagctctgagaaacctggtgtatgggaaggccaacgatgataacaaaattgccctgaaaaactgtggtggcatcccagcactggtgaggttactccgcaagacgactgacctggagatccgggagctggtcacaggagtcctttggaacctctcctcatgcgatgcactcaaaatgccaatcatccaggatgccctagcagtactgaccaacgcggtgattatcccccactcaggctgggaaaattcgcctcttcaggatgatcggaaaatacagctgcattcatcacaggtgctgcgtaacgccaccgggtgcctaaggaatgttagttcggccggagaggaggcccgcagaaggatgagagagtgtgatgggcttacggatgccttgctgtacgtgatccagtctgcgctggggagcagtgagatcgatagcaagaccgttgaaaactgtgtgtgcattttaaggaacctctcgtaccggctggcggcagaaacgtctcagggacagcacatgggcacggacgagctggacgggctactctgtggcgaggccaatggcaaggatgctgagagctctgggtgctggggcaagaagaagaagaaaaagaaatcccaagatcagtgggatggagtaggacctcttccagactgtgctgaaccaccaaaagggatccagatgctgtggcacccatcaatagtcaaaccctacctcacactgctctctgagtgctcaaatccagacacgctggaaggggcggcaggcgccctgcagaacttggctgcagggagctggaagggctgggctgaggatgtggcaggcatggcatatgccctacgttcactgccagagggggctccctgcctgccacagtggtcagtatatatccgagccgctgtccgaaaagagaaaggcctgcccatcctcgtggagctgctccgaatagacaatgaccgtgtggtgtgcgcggtggccactgcgctgcggaacatggccttggacgtcagaaataaggagctcatcggcaaatacgccatgcgagacctagtccacaggcttccaggagggaacaacagcaacaacactgcaagcaaggccatgtcggatgacacagtgacagctgtctgctgcacactgcacgaagtgattaccaagaacatggagaacgccaaggccttacgggatgccggtggcatcgagaagttggtcggcatctccaaaagcaaaggagataaacactctccaaaagtggtcaaggctgcatctcaggtcctcaacagcatgtggcagtaccgagatctgaggagtctctacaaaaaggatggatggtcacaataccactttgtagcctcgtcttcaaccatcgagagggaccggcaaaggccctactcctcctcccgcacgccctccatctcccctgtgcgcgtgtctcccaacaaccgctcagcaagtgccccagcttcacctcgggaaatgatcagcctcaaagaaaggaaaacagactacgagtgcaccggcagcaacgccacctaccacggaagtccacttaggcgggtacgagctcgattcgatcatggctagtgtctgtataaaagcaaa

SEQ ID NO: 446142 - DNA, 2358 bp, Homo sapiens
  misc_feature (2352)..(2352): n is a, c, g, or t
  misc_feature (2356)..(2358): n is a, c, g, or t
tgcctagaggatcccgctagtagctgggaatctagtaacggtatgaaccctctgtctccttattaaatgtggatccacgatacctcgtgaggatacagatgagttcatttacctaccggagcagttcggagtctctacaaaaaggatggatggtcacaataccactttgtagcctcgtcttcaaccatcgagagggaccggcaaaggccctactcctcctcccgcacgccctccatctcccctgtgcgcgtgtctcccaacaaccgctcagcaagtgccccagcttcacctcgggaaatgatcagcctcaaagaaaggaaaacagactacgagtgcaccggcagcaacgccacctaccacggagctaaaggcgaacacacttccaggaaagatgccatgacagctcaaaacactggaatttcaactttgtataggaattcttatggtgcgcccgctgaagacatcaaacacaaccaggtttcagcacagccagtcccacaggagcccagcagaaaagattacgagacctaccagccatttcagaattccacaagaaattacgatgagtccttcttcgaggaccaggtccaccatcgccctcccgccagcgagtacaccatgcacctgggtctcaagtccaccggcaactacgttgacttctactcagctgcccgtccctacagtgaactgaactatgaaacgagccactacccggcctcccccgactcctgggtgtgaggagcagggcacaggcgctccgggaacagtgcatgtgcatgcataccacaagacatttctttctgttttgtttttttctcctgcaaatttagtttgttaaagcctgttccataggaaggctgtgataaccagtaaggaaatattaagagctattttagaaagctaaatgaatcgcaagttaacttggaaatcagtagaaagctaaagtgatcctaaatatgacagtgggcagcacctttctagcgtgagctgtagagtaacgagaagtgctttatactgaacgtggttgatgggaggagagacgaggcattcgggccggtggggcgtaagggttatcgttaagcacaagacacagaatagtttacacactgtgtgggggacggcttctcacgctttgtttactctcttcatccgttgtgactctaggcttcaggttgcattggggttcctctgtacagcaagatgtttcttgccttttgttaatgcattgttgtaaagtatttgatgtacattacagattaaagaagaaaagcgcgttgtgtatattacaccaatgccgccgtgtttcctcatctatggttctaaatattgcttcaatttcaaacttttgaaagatgtatggatttccagtttttctttactttctcccagtatgttttaacaaaaaaaaaaaaaagcaggaaaaaaggaatatttagcagtattgttcgttctgatatgtgaatttgtttgtgacaactaaacaaggcattcagcagtttctgacaattaacatacatcattccacactccttgtcaacaaagtgctttttcactgcctaaaattttagatgtagatatttgaaatagattttttcatttataccagttttctttatgatgatacagtgttaaaagaaaataaattacaattgatctgtcatccatatttgctaagaatgtctatttccaagaacctatatcttacaaaatacacattcttgcttgtgtgtctgtgtgtgtgggtgtatgtatgtccacgtactagaaaaattacctgtgtgagattttattttgacagaagctatttcatttgctgttcatcttgtacaaactttgtttttggttttttagtataaatgtacatcagtttgttccttttgtactgtatctattcttctgaccatctagtgactcaggatattaggccagttgaagtggagttataggattttcacacattcacgcatacttggatatcaaccctctctacaggtccgtttccttacacattttatcccctcagaacacgataaaccatggccaattcagtttcactttggggccaattacttgaagtatccacagaaaatgtaaactgctcgccttattcccccaaactttttgttcatgtggcagggagcagtacacaactatggaatagattattaaaactgaacttgaagctaacgttagaatagtggttaacagagctaagaaataaggctaaccatcgaaaagaacatgggccgcgggtaaactagctttgctctttagatgcaagtggctgaggccaataggtgcctagtaaatgttaactgttcttggaaaaaataaaaacatcagtaacaaaanaaannn

SEQ ID NO: 446143 - DNA, 1932 bp, Homo sapiens
  misc_feature (27)..(30): n is a, c, g, or t
  misc_feature (1926)..(1926): n is a, c, g, or t
  misc_feature (1930)..(1932): n is a, c, g, or t
cgtaccagcgaaaatcttacaaggagnnnncccaaaacaaggcacacttgagtttcagcacagccagtcccacaggagcccagcagaaaagattacgagacctaccagccatttcagaattccacaagaaattacgatgagtccttcttcgaggaccaggtccaccatcgccctcccgccagcgagtacaccatgcacctgggtctcaagtccaccggcaactacgttgacttctactcagctgcccgtccctacagtgaactgaactatgaaacgagccactacccggcctcccccgactcctgggtgtgaggagcagggcacaggcgctccgggaacagtgcatgtgcatgcataccacaagacatttctttctgttttgtttttttctcctgcaaatttagtttgttaaagcctgttccataggaaggctgtgataaccagtaaggaaatattaagagctattttagaaagctaaatgaatcgcaagttaacttggaaatcagtagaaagctaaagtgatcctaaatatgacagtgggcagcacctttctagcgtgagctgtagagtaacgagaagtgctttatactgaacgtggttgatgggaggagagacgaggcattcgggccggtggggcgtaagggttatcgttaagcacaagacacagaatagtttacacactgtgtgggggacggcttctcacgctttgtttactctcttcatccgttgtgactctaggcttcaggttgcattggggttcctctgtacagcaagatgtttcttgccttttgttaatgcattgttgtaaagtatttgatgtacattacagattaaagaagaaaagcgcgttgtgtatattacaccaatgccgccgtgtttcctcatctatggttctaaatattgcttcaatttcaaacttttgaaagatgtatggatttccagtttttctttactttctcccagtatgttttaacaaaaaaaaaaaaaagcaggaaaaaaggaatatttagcagtattgttcgttctgatatgtgaatttgtttgtgacaactaaacaaggcattcagcagtttctgacaattaacatacatcattccacactccttgtcaacaaagtgctttttcactgcctaaaattttagatgtagatatttgaaatagattttttcatttataccagttttctttatgatgatacagtgttaaaagaaaataaattacaattgatctgtcatccatatttgctaagaatgtctatttccaagaacctatatcttacaaaatacacattcttgcttgtgtgtctgtgtgtgtgggtgtatgtatgtccacgtactagaaaaattacctgtgtgagattttattttgacagaagctatttcatttgctgttcatcttgtacaaactttgtttttggttttttagtataaatgtacatcagtttgttccttttgtactgtatctattcttctgaccatctagtgactcaggatattaggccagttgaagtggagttataggattttcacacattcacgcatacttggatatcaaccctctctacaggtccgtttccttacacattttatcccctcagaacacgataaaccatggccaattcagtttcactttggggccaattacttgaagtatccacagaaaatgtaaactgctcgccttattcccccaaactttttgttcatgtggcagggagcagtacacaactatggaatagattattaaaactgaacttgaagctaacgttagaatagtggttaacagagctaagaaataaggctaaccatcgaaaagaacatgggccgcgggtaaactagctttgctctttagatgcaagtggctgaggccaataggtgcctagtaaatgttaactgttcttggaaaaaataaaaacatcagtaacaaaanaaannn

SEQ ID NO: 446144 - DNA, 139 bp, Homo sapiens
gtcagttcagttgtgaacaaagccctttgtgtacgtttttaaattttagttcacacgataacaatgctttgcaagtaggtgtaattattttactcccattttatggatgagaaaacaacagagaggttgattggcccca

SEQ ID NO: 446145 - DNA, 4681 bp, Homo sapiens
ccgctccatgagcagctggagctgtaccacacggtgatgtatcgcaactaccaaagaaagaacgacatggatgagccgcccccctttgactacggctctggggatgaagacggcaagagcgagaagaggaagaacaaggaccccctctatgccaagatggaggagcgcttctaccgctatggcatcaagccagagtggatgatgattcaccgaatcctgaaccatagctttgacaagaagggggatgtgcactacctgatcaagtggaaagacctgccctacgaccagtgcacctgggagatcgatgacatcgacatcccctactacgacaacctcaagcaggcctactggggccacagggagctgatgctgggagaagacaccaggctgcccaagaggctgctcaagaagggcaagaagctgagggacgacaagcaggagaagccgccggacacgcccattgtggaccccacggtcaagttcgacaagcagccatggtacatcgactccacaggcggcacactgcacccgtaccagctggagggcctcaactggctgcgcttctcttgggcccagggcactgacaccatcctggccgatgagatgggtctgggcaagacggtgcagaccatcgtgttcctttactccctctacaaggagggccactccaaagggccctacctggttagcgcgcccctctccaccatcatcaactgggaacgcgagtttgagatgtgggcgcccgacttctacgtggtcacctacacgggggacaaggagagccgctcggtgattcgggagaacgagttttcctttgaggacaacgccattcggagtgggaagaaggtattccgtatgaagaaagaagtgcagatcaaattccacgtgctgctcacctcctatgagctcatcaccatcgaccaggccatcctgggctccatcgagtgggcctgcctggtggtagatgaggcccaccgcctcaagaacaaccagtccaagttttttagggtcttaaacagctacaagattgattacaagctgctgctgacagggaccccccttcagaacaacctggaggagctgttccatctcctcaacttcctgactccagagaggttcaacaacctggagggcttcctggaggagtttgctgacatctccaaggaagaccagatcaagaagctgcatgacctgctggggccgcacatgctcaggcggctcaaggctgacgtgttcaagaacatgccggccaagaccgagctcattgtccgggtggagctgagccagatgcagaagaagtactacaagttcatcctcacacggaactttgaggcactgaactccaaggggggcgggaaccaagtatcgctgctcaacatcatgatggacctgaaaaagtgctgcaaccacccctacctcttccctgtggctgccgtggaggcccctgtcttgcccaatggctcctacgatggaagctccctggtcaagtcttcagggaagctcatgctgctacagaagatgctgaagaaactgcgggatgaggggcaccgtgtgctcatcttctcccagatgaccaagatgctggacctcctggaggacttcctggagtacgaaggctacaagtatgagcggattgatggtggcatcaccgggggcctccggcaggaggcaatcgacagattcaatgcccccggggcccagcagttctgcttcctcctctcaacccgggcaggtggtctgggcatcaacctggccacggcggacactgtcatcatctacgactcggactggaacccgcacaatgacatccaggccttcagccgcgcccaccgcatcggccagaacaagaaggtgatgatctaccgcttcgtgactcgggcctcggtggaggagcgcatcacgcaggtggccaagcgcaagatgatgctcacccacctggtggtgcggcccggcctcggctccaagtcggggtccatgaccaagcaggagctggacgacatcctcaagttcggcacggaggaactcttcaaggacgacgtggagggcatgatgtctcagggccagaggccggtcacacccatccctgatgtccagtcctccaaaggggggaacttggccgccagtgcaaagaagaagcacggtagcaccccgccaggtgacaacaaggacgtggaggacagcagtgtgatccactatgacgatgcggccatctccaagctgctggaccggaaccaggacgctacagatgacacggagctacagaacatgaacgagtacctgagctccttcaaggtggcgcagtacgtggtgcgcgaggaggacggcgtggaggaggtggagcgggaaatcatcaagcaggaggagaacgtggaccccgactactgggagaagctgctgcggcaccactatgagcagcagcaggaggacctggcccgcaacctgggcaagggcaagcgcatccgcaagcaggtcaactacaacgatgcctcccaggaggaccaggagtggcaggatgagctctctgataaccagtcagaatattccattggctctgaggatgaggatgaggactttgaagagaggccggaagggcagagtggacgacgacaatcccggaggcagctgaagagtgacagggacaagcccctgcccccgcttctcgcccgagttggtggcaacatcgaggtgctgggcttcaatgcccgacagcggaaggcctttctgaacgccatcatgcgctggggcatgcccccgcaggacgccttcaactcccactggctggtgcgggaccttcgagggaagagcgagaaggagtttagagcctatgtgtccctcttcatgcggcacctgtgtgagccgggggcggatggtgcagagaccttcgcagacggcgtgccccgggagggcctctccaggcagcacgtgctgacccgcatcggggtcatgtcactagttaggaagaaggttcaggagtttgagcatgtcaacgggaagtacagcaccccagacttgatccctgaggggcccgaggggaagaagccgggcgaggtgatctcctcggaccccaacacaccagtgcccgccagccctgcccacctcctgccagccccgctgggcctgccagacaaaatggaagcccagctgggctacatggatgagaaagaccccggggcacagaagccaaggcagcccctggaagtccaggcccttccagccgccttggatagagtggagagtgaggacaagcacgagagcccagccagcaaggagagagcccgagaggagcggccagaggagacggagaaggccccgccctccccggagcagctgccgagagaggaggtgcttcctgagaaggagaagatcctggacaagctggagctgagcttgatccacagcagaggggacagttccgaactcaggccagatgacaccaaggctgaggagaaggagcccattgaaacacagcaaaatggtgacaaagaggaagatgacgaggggaagaaggaggacaagaaggggaaattcaagttcatgttcaacatcgcggacgggggcttcacggagttgcacacgctgtggcagaacgaggagcgggctgctgtatcctctgggaaaatctacgacatctggcaccggcgccatgactactggctgctggcgggcatcgtgacgcacggctacgcccgctggcaggacatccagaatgacccacggtacatgatcctcaacgagcccttcaagtctgaggtccacaagggcaactacctggagatgaagaacaagttcctggcccgcaggtttaagctgctggagcaggcgttggtcattgaggagcagctccggagggccgcgtacctgaacatgacgcaggaccccaaccaccccgccatggccctcaacgcccgcctggctgaagtggagtgcctcgccgagagccaccagcacctgtccaaggagtcccttgctgggaacaagcctgccaatgccgtcctgcacaaggtcctgaaccagctggaggagctgctgagcgacatgaaggccgacgtgacccggctgccatccatgctgtcccgcatccccccggtggccgcccggctgcagatgtcggagcgcagcatcctgagccgcctgaccaaccgcgccggggaccccaccatccagcagggcgctttcggctcctcccagatgtacagcaacaactttgggcccaacttccggggccctggaccgggagggattgtcaactacaaccagatgcccctggggccctatgtgaccgatatctagccgtcctcgagacttccctgtgttgcagcgctcatttccagctgagccacgcctgccgggccacctgcccgacccacatgggagagaaaagctgccacctttttaggagccagcgccaccttgggacaaaaagggaaacctagtaatgccatcacatggaggacgaggcccagctcagctgggccagagcccagaagtgccacctcatcataattcaagtgttcttccacacagcgttgcccccacaaccacgccggacgtgccccctcgccaccttttccagacgacttcttagaagagatttcatttatttgtacatcttttgcactttcctattgaagacttgaacacgtttgtcttgataaaagttggatgacgtatggaagattcg

SEQ ID NO: 446146 - DNA, 4672 bp, Homo sapiens
ccgctccatgagcagctggagctgtaccacacggtgatgtatcgcaactaccaaagaaagaacgacatggatgagccgcccccctttgactacggctctggggatgaagacggcaagagcgagaagaggaagaacaaggaccccctctatgccaagatggaggagcgcttctaccgctatggcatcaagccagagtggatgatgattcaccgaatcctgaaccatagctttgacaagaagggggatgtgcactacctgatcaagtggaaagacctgccctacgaccagtgcacctgggagatcgatgacatcgacatcccctactacgacaacctcaagcaggcctactggggccacagggagctgatgctgggagaagacaccaggctgcccaagaggctgctcaagaagggcaagaagctgagggacgacaagcaggagaagccgccggacacgcccattgtggaccccacggtcaagttcgacaagcagccatggtacatcgactccacaggcggcacactgcacccgtaccagctggagggcctcaactggctgcgcttctcttgggcccagggcactgacaccatcctggccgatgagatgggtctgggcaagacggtgcagaccatcgtgttcctttactccctctacaaggagggccactccaaagggccctacctggttagcgcgcccctctccaccatcatcaactgggaacgcgagtttgagatgtgggcgcccgacttctacgtggtcacctacacgggggacaaggagagccgctcggtgattcgggagaacgagttttcctttgaggacaacgccattcggagtgggaagaaggtattccgtatgaagaaagaagtgcagatcaaattccacgtgctgctcacctcctatgagctcatcaccatcgaccaggccatcctgggctccatcgagtgggcctgcctggtggtagatgaggcccaccgcctcaagaacaaccagtccaagttttttagggtcttaaacagctacaagattgattacaagctgctgctgacagggaccccccttcagaacaacctggaggagctgttccatctcctcaacttcctgactccagagaggttcaacaacctggagggcttcctggaggagtttgctgacatctccaaggaagaccagatcaagaagctgcatgacctgctggggccgcacatgctcaggcggctcaaggctgacgtgttcaagaacatgccggccaagaccgagctcattgtccgggtggagctgagccagatgcagaagaagtactacaagttcatcctcacacggaactttgaggcactgaactccaaggggggcgggaaccaagtatcgctgctcaacatcatgatggacctgaaaaagtgctgcaaccacccctacctcttccctgtggctgccgtggaggcccctgtcttgcccaatggctcctacgatggaagctccctggtcaagtcttcagggaagctcatgctgctacagaagatgctgaagaaactgcgggatgaggggcaccgtgtgctcatcttctcccagatgaccaagatgctggacctcctggaggacttcctggagtacgaaggctacaagtatgagcggattgatggtggcatcaccgggggcctccggcaggaggcaatcgacagattcaatgcccccggggcccagcagttctgcttcctcctctcaacccgggcaggtggtctgggcatcaacctggccacggcggacactgtcatcatctacgactcggactggaacccgcacaatgacatccaggccttcagccgcgcccaccgcatcggccagaacaagaaggtgatgatctaccgcttcgtgactcgggcctcggtggaggagcgcatcacgcaggtggccaagcgcaagatgatgctcacccacctggtggtgcggcccggcctcggctccaagtcggggtccatgaccaagcaggagctggacgacatcctcaagttcggcacggaggaactcttcaaggacgacgtggagggcatgatgtctcagggccagaggccggtcacacccatccctgatgtccagtcctccaaaggggggaacttggccgccagtgcaaagaagaagcacggtagcaccccgccaggtgacaacaaggacgtggaggacagcagtgtgatccactatgacgatgcggccatctccaagctgctggaccggaaccaggacgctacagatgacacggagctacagaacatgaacgagtacctgagctccttcaaggtggcgcagtacgtggtgcgcgaggaggacggcgtggaggaggtggagcgggaaatcatcaagcaggaggagaacgtggaccccgactactgggagaagctgctgcggcaccactatgagcagcagcaggaggacctggcccgcaacctgggcaagggcaagcgcatccgcaagcaggtcaactacaacgatgcctcccaggaggaccaggagtggcaggatgagctctctgataaccagtcagaatattccattggctctgaggatgaggatgaggactttgaagagaggccggaagggcagagtggacgacgacaatcccggaggcagctgaagagtgacagggacaagcccctgcccccgcttctcgcccgagttggtggcaacatcgaggtgctgggcttcaatgcccgacagcggaaggcctttctgaacgccatcatgcgctggggcatgcccccgcaggacgccttcaactcccactggctggtgcgggaccttcgagggaagagcgagaaggagtttagagcctatgtgtccctcttcatgcggcacctgtgtgagccgggggcggatggtgcagagaccttcgcagacggcgtgccccgggagggcctctccaggcagcacgtgctgacccgcatcggggtcatgtcactagttaggaagaaggttcaggagtttgagcatgtcaacgggaagtacagcaccccagacttgatccctgaggggcccgaggggaagaagccgggcgaggtgatctcctcggaccccaacacaccagtgcccgccagccctgcccacctcctgccagccccgctgggcctgccagacaaaatggaagcccagctgggctacatggatgagaaagaccccggggcacagaagccaaggcagcccctggaagtccaggcccttccagccgccttggatagagtggagagtgaggacaagcacgagagcccagccagcaaggagagagcccgagaggagcggccagaggagacggagaaggccccgccctccccggagcagctgccgagagcgtcttgctctgtcactcaggctggagtgcagtggcgccatctcggctcatgggagcctttatctcctcggctcaagcgaccctcccacctcagcttcctgaacagaggaggtgcttcctgagaaggagaagatcctggacaagctggagctgagcttgatccacagcagaggggacagttccgaactcaggccagatgacaccaaggctgaggagaaggagcccattgaaacacagcaaaatggtgacaaagaggaagatgacgaggggaagaaggaggacaagaaggggaaattcaagttcatgttcaacatcgcggacgggggcttcacggagttgcacacgctgtggcagaacgaggagcgggctgctgtatcctctgggaaaatctacgacatctggcaccggcgccatgactactggctgctggcgggcatcgtgacgcacggctacgcccgctggcaggacatccagaatgacccacggtacatgatcctcaacgagcccttcaagtctgaggtccacaagggcaactacctggagatgaagaacaagttcctggcccgcaggtttaagctgctggagcaggcgttggtcattgaggagcagctccggagggccgcgtacctgaacatgacgcaggaccccaaccaccccgccatggccctcaacgcccgcctggctgaagtggagtgcctcgccgagagccaccagcacctgtccaaggagtcccttgctgggaacaagcctgccaatgccgtcctgcacaaggtcctgaaccagctggaggagctgctgagcgacatgaaggccgacgtgacccggctgccatccatgctgtcccgcatccccccggtggccgcccggctgcagatgtcggagcgcagcatcctgagccgcctgaccaaccgcgccggggaccccaccatccagcagatatctagccgtcctcgagacttccctgtgttgcagcgctcatttccagctgagccacgcctgccgggccacctgcccgacccacatgggagagaaaagctgccacctttttaggagccagcgccaccttgggacaaaaagggaaacctagtaatgccatcacatggaggacgaggcccagctcagctgggccagagcccagaagtgccacctcatcataattcaagtgttcttccacacagcgttgcccccacaaccacgccggacgtgccccctcgccaccttttccagacgacttcttagaagagatttcatttatttgtacatcttttgcactttcctattgaagacttgaacacgtttgtcttgataaaagttggatgacgtatggaagattcg

SEQ ID NO: 446147 - DNA, 7938 bp, Homo sapiens
  misc_feature (4994)..(4994): n is a, c, g, or t
  misc_feature (5227)..(5227): n is a, c, g, or t
ccgctccatgagcagctggagctgtaccacacggtgatgtatcgcaactaccaaagaaagaacgacatggatgagccgcccccctttgactacggctctggggatgaagacggcaagagcgagaagaggaagaacaaggaccccctctatgccaagatggaggagcgcttctaccgctatggcatcaagccagagtggatgatgattcaccgaatcctgaaccatagctttgacaagaagggggatgtgcactacctgatcaagtggaaagacctgccctacgaccagtgcacctgggagatcgatgacatcgacatcccctactacgacaacctcaagcaggcctactggggccacagggagctgatgctgggagaagacaccaggctgcccaagaggctgctcaagaagggcaagaagctgagggacgacaagcaggagaagccgccggacacgcccattgtggaccccacggtcaagttcgacaagcagccatggtacatcgactccacaggcggcacactgcacccgtaccagctggagggcctcaactggctgcgcttctcttgggcccagggcactgacaccatcctggccgatgagatgggtctgggcaagacggtgcagaccatcgtgttcctttactccctctacaaggagggccactccaaagggccctacctggttagcgcgcccctctccaccatcatcaactgggaacgcgagtttgagatgtgggcgcccgacttctacgtggtcacctacacgggggacaaggagagccgctcggtgattcgggagaacgagttttcctttgaggacaacgccattcggagtgggaagaaggtattccgtatgaagaaagaagtgcagatcaaattccacgtgctgctcacctcctatgagctcatcaccatcgaccaggccatcctgggctccatcgagtgggcctgcctggtggtagatgaggcccaccgcctcaagaacaaccagtccaagttttttagggtcttaaacagctacaagattgattacaagctgctgctgacagggaccccccttcagaacaacctggaggagctgttccatctcctcaacttcctgactccagagaggttcaacaacctggagggcttcctggaggagtttgctgacatctccaaggaagaccagatcaagaagctgcatgacctgctggggccgcacatgctcaggcggctcaaggctgacgtgttcaagaacatgccggccaagaccgagctcattgtccgggtggagctgagccagatgcagaagaagtactacaagttcatcctcacacggaactttgaggcactgaactccaaggggggcgggaaccaagtatcgctgctcaacatcatgatggacctgaaaaagtgctgcaaccacccctacctcttccctgtggctgccgtggaggcccctgtcttgcccaatggctcctacgatggaagctccctggtcaagtcttcagggaagctcatgctgctacagaagatgctgaagaaactgcgggatgaggggcaccgtgtgctcatcttctcccagatgaccaagatgctggacctcctggaggacttcctggagtacgaaggctacaagtatgagcggattgatggtggcatcaccgggggcctccggcaggaggcaatcgacagattcaatgcccccggggcccagcagttctgcttcctcctctcaacccgggcaggtggtctgggcatcaacctggccacggcggacactgtcatcatctacgactcggactggaacccgcacaatgacatccaggccttcagccgcgcccaccgcatcggccagaacaagaaggtgatgatctaccgcttcgtgactcgggcctcggtggaggagcgcatcacgcaggtggccaagcgcaagatgatgctcacccacctggtggtgcggcccggcctcggctccaagtcggggtccatgaccaagcaggagctggacgacatcctcaagttcggcacggaggaactcttcaaggacgacgtggagggcatgatgtctcagggccagaggccggtcacacccatccctgatgtccagtcctccaaaggggggaacttggccgccagtgcaaagaagaagcacggtagcaccccgccaggtgacaacaaggacgtggaggacagcagtgtgatccactatgacgatgcggccatctccaagctgctggaccggaaccaggacgctacagatgacacggagctacagaacatgaacgagtacctgagctccttcaaggtggcgcagtacgtggtgcgcgaggaggacggcgtgctgtccccgaagagctccttgtgggtctctcctggaggcctttccgtttcctcctctgctccccaccctccgtgcagacctggaggaggtggagcgggaaatcatcaagcaggaggagaacgtggaccccgactactgggagaagctgctgcggcaccactatgagcagcagcaggaggacctggcccgcaacctgggcaagggcaagcgcatccgcaagcaggtcaactacaacgatgcctcccaggaggaccaggagtggcaggatgagctctctgataaccagtcagaatattccattggctctgaggatgaggatgaggactttgaagagaggccggaagggcagagtggacgacgacaatcccggaggcagctgaagagtgacagggacaagcccctgcccccgcttctcgcccgagttggtggcaacatcgaggtgctgggcttcaatgcccgacagcggaaggcctttctgaacgccatcatgcgctggggcatgcccccgcaggacgccttcaactcccactggctggtgcgggaccttcgagggaagagcgagaaggagtttagagcctatgtgtccctcttcatgcggcacctgtgtgagccgggggcggatggtgcagagaccttcgcagacggcgtgccccgggagggcctctccaggcagcacgtgctgacccgcatcggggtcatgtcactagttaggaagaaggttcaggagtttgagcatgtcaacgggaagtacagcaccccagacttgatccctgaggggcccgaggggaagaagccgggcgaggtgatctcctcggaccccaacacaccagtgcccgccagccctgcccacctcctgccagccccgctgggcctgccagacaaaatggaagcccagctgggctacatggatgagaaagaccccggggcacagaagccaaggcagcccctggaagtccaggcccttccagccgccttggatagagtggagagtgaggacaagcacgagagcccagccagcaaggagagagcccgagaggagcggccagaggagacggagaaggccccgccctccccggagcagctgccgagagaggaggtgcttcctgagaaggagaagatcctggacaagctggagctgagcttgatccacagcagaggggacagttccgaactcaggccagatgacaccaaggctgaggagaaggagcccattgaaacacagcaaaatggtgacaaagaggaagatgacgaggggaagaaggaggacaagaaggggaaattcaagttcatgttcaacatcgcggacgggggcttcacggagttgcacacgctgtggcagaacgaggagcgggctgctgtatcctctgggaaaatctacgacatctggcaccggcgccatgactactggctgctggcgggcatcgtgacgcacggctacgcccgctggcaggacatccagaatgacccacggtacatgatcctcaacgagcccttcaagtctgaggtccacaagggcaactacctggagatgaagaacaagttcctggcccgcaggtttaagctgctggagcaggcgttggtcattgaggagcagctccggagggccgcgtacctgaacatgacgcaggaccccaaccaccccgccatggccctcaacgcccgcctggctgaagtggagtgcctcgccgagagccaccagcacctgtccaaggagtcccttgctgggaacaagcctgccaatgccgtcctgcacaaggtcctgaaccagctggaggagctgctgagcgacatgaaggccgacgtgacccggctgccatccatgctgtcccgcatccccccggtggccgcccggctgcagatgtcggagcgcagcatcctgagccgcctgaccaaccgcgccggggaccccaccatccagcagggcgctttcggctcctcccagatgtacagcaacaactttgggcccaacttccggggccctggaccgggagggattgtcaactacaaccagatgcccctggggccctatgtgaccgatatctagccgtcctcgagacttccctgtgttgcagcgctcatttccagctgagccacgcctgccgggccacctgcccgacccacatgggagagaaaagctgccacctttttaggagccagcgccaccttgggacaaaaagggaaacctagtaatgccatcacatggaggacgaggcccagctcagctgggccagagcccagaagtgccacctcatcataattcaagtgttcttccacacagcgttgcccccacaaccacgccggacgtgccccctcgccaccttttccagacgacttcttagaagagatttcatttatttgtacatcttttgcactttcctattgaagacttgaacacgtttgtcttgataaaagttggatgacgtatggaagattcgaacctgcagcactgatgtctctttaccgatgggttccagacccaaggtagtcctggcactgccctgtggactcagcccagctggggaggacatggcgcccggtgccctaggagccctcagtgtcccctacctgacctgtctgcacctgtgtgacagccccttctgatttggccccctgcccgcttggagcctcccagcaccagacagggcaggtttggggagccgctgtcnagccctatggtgagaccctggctgacatttcccctccttcctgccaaggctggaggccgccaggtgtttgctctctccttgtggggaggtggatcctctgccagcaggtgtctgtccccggcccagcgcatcttgaaggccctggactctgttaccagtggggggcctgtggccccggctcttcacagcaggcagaagcgtatgatcccagggagggtgggctgggggggggncagcacttgcctcggagccactgctgcgttgggtttgccttctgccagaggtgtggttaagggcagtgatagctgcgccccagcaaggagggtcatgggccctgagctggcccaggagaccctggccctgccctgtgccctgggatgcctaccctgcccacctccggaggtggaaccgggctgcccctgggggcctggacttgtcccattcccctgtccctggaaaggccttcccgggggctttttgcctgaggctgcactcttggaaggcgtggggagagttctgcctggagggggactggacccagtgccctctgcagacccctcccagccgcagcaccaagggcttgctgccttgtttcctgccaggagcgccctgacatcccaaaaccatcttcccacatgtgggttgttggaatcccacccactcccccggaccctgcccctccaagttggggacggagatggggagcaggtcaggccctccctaggcctgtttgtgtgtgatccttctcctggccccaggtcgacctggaaggcgtttctgagtcttgtactgggaccttcccagggaaggtgccttggggtgcagaatcctgggaatgttaggaaagggctgcgtgaaaaacccagctgggcctggggtggaggtgcacacgggctggggctcagctccttggagagggcctgcctgggactgagggggccagggctgggtcaggattcaccagcttgtgttgcagacactggagcaattgcctggccctccctaagccctatatgcctcactcataatgaggctgtctctgaaccccggagggcgggacctacaagtccttcctcttggcgcattcccacactccagtctggatccaggtctgcaaggccagcccgaccctgacactgcacgtgggcgtagtggggagcaccctggagtggagatgattgtcagcgggctcacatgttatggttcatccacatgcgtgttgtgtgctctgcggtgcctcctggcaaagggtcctggctcgggtcagaagctcactcccgtgccctcgtccccaaacaagcagtggcaagcactggggttggccctcgttgggagcagtgcccaccttccttggcccacagcagataggtcccgagcagcaggactggaggcctgtggcggtcagggcaggggtctgtgtctccaccccaagggctgatggtccctcccctgtgcgccttcctctcaggcaggcttgctctgtcccttcctctctgcttccctcccaggcctcgccagggctcccttctcctctgcctggttagactcgggcacccaggaccatcaccacttttggcagagatgactgacaaaccaagaaggacattctcagatcttttcatctctgccaaaagtggtgatggtggtgtccgtatgtttggcgtctttgggctgggtttggtttttgctgctggtagaatcagggtcctcgggcatgaacgcgagcccaaagtgccagtctgcgattggaaatttccagccactttaagccagtgctgagtagggcttctgcagagccatgtttgagccaaggtcttggaaggcattgccccatgggctcaggtgactcggggtggagtgagcacgtctgcagggccctctcatacacgcctgaggcagaagcagcgtcccccgtgaaagccaccttccgaagctcctgcgttttttgcaaacttggcttcccccaggggcaggctggactttccctgccccctatgattgaagtcctcctgcttttgggggctgccttcccagagtcccccgggtgctcccctgccgaggtcaggagctgaccaagcctttggcccggtgacacctgcagccctcactcctgtcatcccaggacacttgaggcccaaggaggtggagtggagagtgggctcgggtacatgggagccagaagccagatggacttggtcaagtgtcggtcacttggagcctccagtgtgcgtcagggtctgtgggcaggggacagggcgtgggtgggggccgaggctggcacgcccctctgccctcaccgtcttggtgacctggcctcggcccctcccccaagtctcttctgtgcaaggcccgcctcggcctcggcagctggttcctgtcctgttttctgtgtctgaaagtttacaggttgtggtgcatcagcccaaactcactggcgttgtgttttttttttctttaattttcagattttttttttaaacaaagtatttttttaggtgcgataacccagaaagggcccgttgggtgtgtgtgtgtgtcctgaactcctcaagcagcgattggagcccaagcacccctggagaggaagggagggtccccactggcccgtggggtctgagttcaggggtgtggagggagcagactccaccggcccaggcccagctaagagggggccgacccctttccccaggcacagccccaggctggcaaagggagggccctgggctgggtgcagggcgcgccaggagtcccagccagggtggccccggcgggggcgggtccagctttggaagccaggctcccctgtgagccgtggcttgtctggtcttcgcccacgggaggctggacagaggctgtagccaacacaatcacctttactttgtactctgtgtgtatgttttggttttctgtgttttaataaatcctttgggaaaggaataaaaaa

SEQ ID NO: 446148 - DNA, 2811 bp, Homo sapiens
  misc_feature (2598)..(2598): n is a, c, g, or t
  misc_feature (2608)..(2608): n is a, c, g, or t
  misc_feature (2626)..(2626): n is a, c, g, or t
  misc_feature (2647)..(2647): n is a, c, g, or t
  misc_feature (2654)..(2654): n is a, c, g, or t
  misc_feature (2670)..(2670): n is a, c, g, or t
  misc_feature (2678)..(2678): n is a, c, g, or t
  misc_feature (2741)..(2741): n is a, c, g, or t
  misc_feature (2749)..(2749): n is a, c, g, or t
  misc_feature (2758)..(2758): n is a, c, g, or t
  misc_feature (2781)..(2781): n is a, c, g, or t
ccgctccatgagcagctggagctgtaccacacggtgatgtatcgcaactaccaaagaaagaacgacatggatgagccgcccccctttgactacggctctggggatgaagacggcaagagcgagaagaggaagaacaaggaccccctctatgccaagatggaggagcgcttctaccgctatggcatcaagccagagtggatgatgattcaccgaatcctgaaccatagctttgacaagaagggggatgtgcactacctgatcaagtggaaagacctgccctacgaccagtgcacctgggagatcgatgacatcgacatcccctactacgacaacctcaagcaggcctactggggccacagggagctgatgctgggagaagacaccaggctgcccaagaggctgctcaagaagggcaagaagctgagggacgacaagcaggagaagccgccggacacgcccattgtggaccccacggtcaagttcgacaagcagccatggtacatcgactccacaggcggcacactgcacccgtaccagctggagggcctcaactggctgcgcttctcttgggcccagggcactgacaccatcctggccgatgagatgggtctgggcaagacggtgcagaccatcgtgttcctttactccctctacaaggagggccactccaaagggccctacctggttagcgcgcccctctccaccatcatcaactgggaacgcgagtttgagatgtgggcgcccgacttctacgtggtcacctacacgggggacaaggagagccgctcggtgattcgggagaacgagttttcctttgaggacaacgccattcggagtgggaagaaggtattccgtatgaagaaagaagtgcagatcaaattccacgtgctgctcacctcctatgagctcatcaccatcgaccaggccatcctgggctccatcgagtgggcctgcctggtggtagatgaggcccaccgcctcaagaacaaccagtccaagttttttagggtcttaaacagctacaagattgattacaagctgctgctgacagggaccccccttcagaacaacctggaggagctgttccatctcctcaacttcctgactccagagaggttcaacaacctggagggcttcctggaggagtttgctgacatctccaaggaagaccagatcaagaagctgcatgacctgctggggccgcacatgctcaggcggctcaaggctgacgtgttcaagaacatgccggccaagaccgagctcattgtccgggtggagctgagccagatgcagaagaagtactacaagttcatcctcacacggaactttgaggcactgaactccaaggggggcgggaaccaagtatcgctgctcaacatcatgatggacctgaaaaagtgctgcaaccacccctacctcttccctgtggctgccgtggaggcccctgtcttgcccaatggctcctacgatggaagctccctggtcaagtcttcagggaagctcatgctgctacagaagatgctgaagaaactgcgggatgaggggcaccgtgtgctcatcttctcccagatgaccaagatgctggacctcctggaggacttcctggagtacgaaggctacaagtatgagcggattgatggtggcatcaccgggggcctccggcaggaggcaatcgacagattcaatgcccccggggcccagcagttctgcttcctcctctcaacccgggcaggtggtctgggcatcaacctggccacggcggacactgtcatcatctacgactcggactggaacccgcacaatgacatccaggccttcagccgcgcccaccgcatcggccagaacaagaaggtgatgatctaccgcttcgtgactcgggcctcggtggaggagcgcatcacgcaggtggccaagcgcaagatgatgctcacccacctggtggtgcggcccggcctcggctccaagtcggggtccatgaccaagcaggagctggacgacatcctcaagttcggcacggaggaactcttcaaggacgacgtggagggcatgatgtctcagggccagaggccggtcacacccatccctgatgtccagtcctccaaaggggggaacttggccgccagtgcaaagaagaagcacggtagcaccccgccaggtgacaacaaggacgtggaggacagcagtgtgatccactatgacgatgcggccatctccaagctgctggaccggaaccaggacgctacagatgacacggagctacagaacatgaacgagtacctgagctccttcaaggtggcgcagtacgtggtgcgcgaggaggacggcgtggaggaggtggagcgggaaatcatcaagcaggaggagaacgtggaccccgactactgggagaagctgctgcggcaccactatgagcagcagcaggaggacctggcccgcaacctgggcaagggcaagcgcatccgcaagcaggtcaactacaacgatgcctcccaggaggaccaggagtggcaggatgagctctctgataaccagtcagaatattccattggctctgaggatgaggatgaggactttgaagagaggccggaagggcagaantggaccaacnaacaattcccggaaggcntcttgaaaaattgacaggggnacaaagnccccttggccccccgntttttttngcccggagtttgggggggccaaacattcgaagggggggttgggggcttttaaaattggccccngaacaagngggggaaangggccctttttttttgaaaaccnccccttttatttgccccctttggggggcaa

SEQ ID NO: 446149 - DNA, 7981 bp, Homo sapiens
  misc_feature (4912)..(4912): n is a, c, g, or t
  misc_feature (5145)..(5145): n is a, c, g, or t
ccgctccatgagcagctggagctgtaccacacggtgatgtatcgcaactaccaaagaaagaacgacatggatgagccgcccccctttgactacggctctggggatgaagacggcaagagcgagaagaggaagaacaaggaccccctctatgccaagatggaggagcgcttctaccgctatggcatcaagccagagtggatgatgattcaccgaatcctgaaccatagctttgacaagaagggggatgtgcactacctgatcaagtggaaagacctgccctacgaccagtgcacctgggagatcgatgacatcgacatcccctactacgacaacctcaagcaggcctactggggccacagggagctgatgctgggagaagacaccaggctgcccaagaggctgctcaagaagggcaagaagctgagggacgacaagcaggagaagccgccggacacgcccattgtggaccccacggtcaagttcgacaagcagccatggtacatcgactccacaggcggcacactgcacccgtaccagctggagggcctcaactggctgcgcttctcttgggcccagggcactgacaccatcctggccgatgagatgggtctgggcaagacggtgcagaccatcgtgttcctttactccctctacaaggagggccactccaaagggccctacctggttagcgcgcccctctccaccatcatcaactgggaacgcgagtttgagatgtgggcgcccgacttctacgtggtcacctacacgggggacaaggagagccgctcggtgattcgggagaacgagttttcctttgaggacaacgccattcggagtgggaagaaggtattccgtatgaagaaagaagtgcagatcaaattccacgtgctgctcacctcctatgagctcatcaccatcgaccaggccatcctgggctccatcgagtgggcctgcctggtggtagatgaggcccaccgcctcaagaacaaccagtccaagttttttagggtcttaaacagctacaagattgattacaagctgctgctgacagggaccccccttcagaacaacctggaggagctgttccatctcctcaacttcctgactccagagaggttcaacaacctggagggcttcctggaggagtttgctgacatctccaaggaagaccagatcaagaagctgcatgacctgctggggccgcacatgctcaggcggctcaaggctgacgtgttcaagaacatgccggccaagaccgagctcattgtccgggtggagctgagccagatgcagaagaagtactacaagttcatcctcacacggaactttgaggcactgaactccaaggggggcgggaaccaagtatcgctgctcaacatcatgatggacctgaaaaagtgctgcaaccacccctacctcttccctgtggctgccgtggaggcccctgtcttgcccaatggctcctacgatggaagctccctggtcaagtcttcagggaagctcatgctgctacagaagatgctgaagaaactgcgggatgaggggcaccgtgtgctcatcttctcccagatgaccaagatgctggacctcctggaggacttcctggagtacgaaggctacaagtatgagcggattgatggtggcatcaccgggggcctccggcaggaggcaatcgacagattcaatgcccccggggcccagcagttctgcttcctcctctcaacccgggcaggtggtctgggcatcaacctggccacggcggacactgtcatcatctacgactcggactggaacccgcacaatgacatccaggccttcagccgcgcccaccgcatcggccagaacaagaaggtgatgatctaccgcttcgtgactcgggcctcggtggaggagcgcatcacgcaggtggccaagcgcaagatgatgctcacccacctggtggtgcggcccggcctcggctccaagtcggggtccatgaccaagcaggagctggacgacatcctcaagttcggcacggaggaactcttcaaggacgacgtggagggcatgatgtctcagggccagaggccggtcacacccatccctgatgtccagtcctccaaaggggggaacttggccgccagtgcaaagaagaagcacggtagcaccccgccaggtgacaacaaggacgtggaggacagcagtgtgatccactatgacgatgcggccatctccaagctgctggaccggaaccaggacgctacagatgacacggagctacagaacatgaacgagtacctgagctccttcaaggtggcgcagtacgtggtgcgcgaggaggacggcgtggaggaggtggagcgggaaatcatcaagcaggaggagaacgtggaccccgactactgggagaagctgctgcggcaccactatgagcagcagcaggaggacctggcccgcaacctgggcaagggcaagcgcatccgcaagcaggtcaactacaacgatgcctcccaggaggaccaggagtggcaggatgagctctctgataaccagtcagaatattccattggctctgaggatgaggatgaggactttgaagagaggccggaagggcagagtggacgacgacaatcccggaggcagctgaagagtgacagggacaagcccctgcccccgcttctcgcccgagttggtggcaacatcgaggtgctgggcttcaatgcccgacagcggaaggcctttctgaacgccatcatgcgctggggcatgcccccgcaggacgccttcaactcccactggctggtgcgggaccttcgagggaagagcgagaaggagtttagagcctatgtgtccctcttcatgcggcacctgtgtgagccgggggcggatggtgcagagaccttcgcagacggcgtgccccgggagggcctctccaggcagcacgtgctgacccgcatcggggtcatgtcactagttaggaagaaggttcaggagtttgagcatgtcaacgggaagtacagcaccccagacttgatccctgaggggcccgaggggaagaagccgggcgaggtgatctcctcggaccccaacacaccagtgcccgccagccctgcccacctcctgccagccccgctgggcctgccagacaaaatggaagcccagctgggctacatggatgagaaagaccccggggcacagaagccaaggcagcccctggaagtccaggcccttccagccgccttggatagagtggagagtgaggacaagcacgagagcccagccagcaaggagagagcccgagaggagcggccagaggagacggagaaggccccgccctccccggagcagctgccgagagaggaggtgcttcctgagaaggagaagatcctggacaagctggagctgagcttgatccacagcagaggggacagttccgaactcaggccagatgacaccaaggctgaggagaaggagcccattgaaacacagcaaaatggtgacaaagaggaagatgacgaggggaagaaggaggacaagaaggggaaattcaagttcatgttcaacatcgcggacgggggcttcacggagttgcacacgctgtggcagaacgaggagcgggctgctgtatcctctgggaaaatctacgacatctggcaccggcgccatgactactggctgctggcgggcatcgtgacgcacggctacgcccgctggcaggacatccagaatgacccacggtacatgatcctcaacgagcccttcaagtctgaggtccacaagggcaactacctggagatgaagaacaagttcctggcccgcaggtttaagctgctggagcaggcgttggtcattgaggagcagctccggagggccgcgtacctgaacatgacgcaggaccccaaccaccccgccatggccctcaacgcccgcctggctgaagtggagtgcctcgccgagagccaccagcacctgtccaaggagtcccttgctgggaacaagcctgccaatgccgtcctgcacaaggtcctgaaccagctggaggagctgctgagcgacatgaaggccgacgtgacccggctgccatccatgctgtcccgcatccccccggtggccgcccggctgcagatgtcggagcgcagcatcctgagccgcctgaccaaccgcgccggggaccccaccatccagcagggcgctttcggctcctcccagatgtacagcaacaactttgggcccaacttccggggccctggaccgggagggattgtcaactacaaccagatgcccctggggccctatgtgaccgatatctagccgtcctcgagacttccctgtgttgcagcgctcatttccagctgagccacgcctgccgggccacctgcccgacccacatgggagagaaaagctgccacctttttaggagccagcgccaccttgggacaaaaagggaaacctagtaatgccatcacatggaggacgaggcccagctcagctgggccagagcccagaagtgccacctcatcataattcaagtgttcttccacacagcgttgcccccacaaccacgccggacgtgccccctcgccaccttttccagacgacttcttagaagagatttcatttatttgtacatcttttgcactttcctattgaagacttgaacacgtttgtcttgataaaagttggatgacgtatggaagattcgaacctgcagcactgatgtctctttaccgatgggttccagacccaaggtagtcctggcactgccctgtggactcagcccagctggggaggacatggcgcccggtgccctaggagccctcagtgtcccctacctgacctgtctgcacctgtgtgacagccccttctgatttggccccctgcccgcttggagcctcccagcaccagacagggcaggtttggggagccgctgtcnagccctatggtgagaccctggctgacatttcccctccttcctgccaaggctggaggccgccaggtgtttgctctctccttgtggggaggtggatcctctgccagcaggtgtctgtccccggcccagcgcatcttgaaggccctggactctgttaccagtggggggcctgtggccccggctcttcacagcaggcagaagcgtatgatcccagggagggtgggctgggggggggncagcacttgcctcggagccactgctgcgttgggtttgccttctgccagaggtgtggttaagggcagtgatagctgcgccccagcaaggagggtcatgggccctgagctggcccaggagaccctggccctgccctgtgccctgggatgcctaccctgcccacctccggaggtggaaccgggctgcccctgggggcctggacttgtcccattcccctgtccctggaaaggccttcccgggggctttttgcctgaggctgcactcttggaaggcgtggggagagttctgcctggagggggactggacccagtgccctctgcagacccctcccagccgcagcaccaagggcttgctgccttgtttcctgccaggagcgccctgacatcccaaaaccatcttcccacatgtgggttgttggaatcccacccactcccccggaccctgcccctccaagttggggacggagatggggagcaggtcaggccctccctaggcctgtttgtgtgtgatccttctcctggccccaggtcgacctggaaggcgtttctgagtcttgtactgggaccttcccagggaaggtgccttggggtgcagaatcctgggaatgttaggaaagggctgcgtgaaaaacccagctgggcctggggtggaggtgcacacgggctggggctcagctccttggagagggcctgcctgggactgagggggccagggctgggtcaggattcaccagcttgtgttgcagacactggagcaattgcctggccctccctaagccctatatgcctcactcataatgaggctgtctctgaaccccggagggcgggacctacaagtccttcctcttggcgcattcccacactccagtctggatccaggtctgcaaggccagcccgaccctgacactgcacgtgggcgtagtggggagcaccctggagtggagatgattgtcagcgggctcacatgttatggttcatccacatgcgtgttgtgtgctctgcggtgcctcctggcaaagggtcctggctcgggtcagaagctcactcccgtgccctcgtccccaaacaagcagtggcaagcactggggttggccctcgttgggagcagtgcccaccttccttggcccacagcagataggtcccgagcagcaggactggaggcctgtggcggtcagggcaggggtctgtgtctccaccccaagggctgatggtccctcccctgtgcgccttcctctcaggcaggcttgctctgtcccttcctctctgcttccctcccaggcctcgccagggctcccttctcctctgcctggttagactcgggcacccaggaaagcctggccagggctcctttgggcctgggccccctgcactgcctggtccagaaggggtggtgctgtccgtggccagcaccccggggcccgggaggggtgggctactagagtcagagcgggtttggggctgaccagtttgggagaggagaaaagatctgagaatgtccttcttggtttgtcagtcatctctgccaaaagtggtgatggtggtgtccgtatgtttggcgtctttgggctgggtttggtttttgctgctggtagaatcagggtcctcgggcatgaacgcgagcccaaagtgccagtctgcgattggaaatttccagccactttaagccagtgctgagtagggcttctgcagagccatgtttgagccaaggtcttggaaggcattgccccatgggctcaggtgactcggggtggagtgagcacgtctgcagggccctctcatacacgcctgaggcagaagcagcgtcccccgtgaaagccaccttccgaagctcctgcgttttttgcaaacttggcttcccccaggggcaggctggactttccctgccccctatgattgaagtcctcctgcttttgggggctgccttcccagagtcccccgggtgctcccctgccgaggtcaggagctgaccaagcctttggcccggtgacacctgcagccctcactcctgtcatcccaggacacttgaggcccaaggaggtggagtggagagtgggctcgggtacatgggagccagaagccagatggacttggtcaagtgtcggtcacttggagcctccagtgtgcgtcagggtctgtgggcaggggacagggcgtgggtgggggccgaggctggcacgcccctctgccctcaccgtcttggtgacctggcctcggcccctcccccaagtctcttctgtgcaaggcccgcctcggcctcggcagctggttcctgtcctgttttctgtgtctgaaagtttacaggttgtggtgcatcagcccaaactcactggcgttgtgttttttttttctttaattttcagattttttttttaaacaaagtatttttttaggtgcgataacccagaaagggcccgttgggtgtgtgtgtgtgtcctgaactcctcaagcagcgattggagcccaagcacccctggagaggaagggagggtccccactggcccgtggggtctgagttcaggggtgtggagggagcagactccaccggcccaggcccagctaagagggggccgacccctttccccaggcacagccccaggctggcaaagggagggccctgggctgggtgcagggcgcgccaggagtcccagccagggtggccccggcgggggcgggtccagctttggaagccaggctcccctgtgagccgtggcttgtctggtcttcgcccacgggaggctggacagaggctgtagccaacacaatcacctttactttgtactctgtgtgtatgttttggttttctgtgttttaataaatcctttgggaaaggaataaaaaa

SEQ ID NO: 446150 - DNA, 8063 bp, Homo sapiens
  misc_feature (4994)..(4994): n is a, c, g, or t
  misc_feature (5227)..(5227): n is a, c, g, or t
ccgctccatgagcagctggagctgtaccacacggtgatgtatcgcaactaccaaagaaagaacgacatggatgagccgcccccctttgactacggctctggggatgaagacggcaagagcgagaagaggaagaacaaggaccccctctatgccaagatggaggagcgcttctaccgctatggcatcaagccagagtggatgatgattcaccgaatcctgaaccatagctttgacaagaagggggatgtgcactacctgatcaagtggaaagacctgccctacgaccagtgcacctgggagatcgatgacatcgacatcccctactacgacaacctcaagcaggcctactggggccacagggagctgatgctgggagaagacaccaggctgcccaagaggctgctcaagaagggcaagaagctgagggacgacaagcaggagaagccgccggacacgcccattgtggaccccacggtcaagttcgacaagcagccatggtacatcgactccacaggcggcacactgcacccgtaccagctggagggcctcaactggctgcgcttctcttgggcccagggcactgacaccatcctggccgatgagatgggtctgggcaagacggtgcagaccatcgtgttcctttactccctctacaaggagggccactccaaagggccctacctggttagcgcgcccctctccaccatcatcaactgggaacgcgagtttgagatgtgggcgcccgacttctacgtggtcacctacacgggggacaaggagagccgctcggtgattcgggagaacgagttttcctttgaggacaacgccattcggagtgggaagaaggtattccgtatgaagaaagaagtgcagatcaaattccacgtgctgctcacctcctatgagctcatcaccatcgaccaggccatcctgggctccatcgagtgggcctgcctggtggtagatgaggcccaccgcctcaagaacaaccagtccaagttttttagggtcttaaacagctacaagattgattacaagctgctgctgacagggaccccccttcagaacaacctggaggagctgttccatctcctcaacttcctgactccagagaggttcaacaacctggagggcttcctggaggagtttgctgacatctccaaggaagaccagatcaagaagctgcatgacctgctggggccgcacatgctcaggcggctcaaggctgacgtgttcaagaacatgccggccaagaccgagctcattgtccgggtggagctgagccagatgcagaagaagtactacaagttcatcctcacacggaactttgaggcactgaactccaaggggggcgggaaccaagtatcgctgctcaacatcatgatggacctgaaaaagtgctgcaaccacccctacctcttccctgtggctgccgtggaggcccctgtcttgcccaatggctcctacgatggaagctccctggtcaagtcttcagggaagctcatgctgctacagaagatgctgaagaaactgcgggatgaggggcaccgtgtgctcatcttctcccagatgaccaagatgctggacctcctggaggacttcctggagtacgaaggctacaagtatgagcggattgatggtggcatcaccgggggcctccggcaggaggcaatcgacagattcaatgcccccggggcccagcagttctgcttcctcctctcaacccgggcaggtggtctgggcatcaacctggccacggcggacactgtcatcatctacgactcggactggaacccgcacaatgacatccaggccttcagccgcgcccaccgcatcggccagaacaagaaggtgatgatctaccgcttcgtgactcgggcctcggtggaggagcgcatcacgcaggtggccaagcgcaagatgatgctcacccacctggtggtgcggcccggcctcggctccaagtcggggtccatgaccaagcaggagctggacgacatcctcaagttcggcacggaggaactcttcaaggacgacgtggagggcatgatgtctcagggccagaggccggtcacacccatccctgatgtccagtcctccaaaggggggaacttggccgccagtgcaaagaagaagcacggtagcaccccgccaggtgacaacaaggacgtggaggacagcagtgtgatccactatgacgatgcggccatctccaagctgctggaccggaaccaggacgctacagatgacacggagctacagaacatgaacgagtacctgagctccttcaaggtggcgcagtacgtggtgcgcgaggaggacggcgtgctgtccccgaagagctccttgtgggtctctcctggaggcctttccgtttcctcctctgctccccaccctccgtgcagacctggaggaggtggagcgggaaatcatcaagcaggaggagaacgtggaccccgactactgggagaagctgctgcggcaccactatgagcagcagcaggaggacctggcccgcaacctgggcaagggcaagcgcatccgcaagcaggtcaactacaacgatgcctcccaggaggaccaggagtggcaggatgagctctctgataaccagtcagaatattccattggctctgaggatgaggatgaggactttgaagagaggccggaagggcagagtggacgacgacaatcccggaggcagctgaagagtgacagggacaagcccctgcccccgcttctcgcccgagttggtggcaacatcgaggtgctgggcttcaatgcccgacagcggaaggcctttctgaacgccatcatgcgctggggcatgcccccgcaggacgccttcaactcccactggctggtgcgggaccttcgagggaagagcgagaaggagtttagagcctatgtgtccctcttcatgcggcacctgtgtgagccgggggcggatggtgcagagaccttcgcagacggcgtgccccgggagggcctctccaggcagcacgtgctgacccgcatcggggtcatgtcactagttaggaagaaggttcaggagtttgagcatgtcaacgggaagtacagcaccccagacttgatccctgaggggcccgaggggaagaagccgggcgaggtgatctcctcggaccccaacacaccagtgcccgccagccctgcccacctcctgccagccccgctgggcctgccagacaaaatggaagcccagctgggctacatggatgagaaagaccccggggcacagaagccaaggcagcccctggaagtccaggcccttccagccgccttggatagagtggagagtgaggacaagcacgagagcccagccagcaaggagagagcccgagaggagcggccagaggagacggagaaggccccgccctccccggagcagctgccgagagaggaggtgcttcctgagaaggagaagatcctggacaagctggagctgagcttgatccacagcagaggggacagttccgaactcaggccagatgacaccaaggctgaggagaaggagcccattgaaacacagcaaaatggtgacaaagaggaagatgacgaggggaagaaggaggacaagaaggggaaattcaagttcatgttcaacatcgcggacgggggcttcacggagttgcacacgctgtggcagaacgaggagcgggctgctgtatcctctgggaaaatctacgacatctggcaccggcgccatgactactggctgctggcgggcatcgtgacgcacggctacgcccgctggcaggacatccagaatgacccacggtacatgatcctcaacgagcccttcaagtctgaggtccacaagggcaactacctggagatgaagaacaagttcctggcccgcaggtttaagctgctggagcaggcgttggtcattgaggagcagctccggagggccgcgtacctgaacatgacgcaggaccccaaccaccccgccatggccctcaacgcccgcctggctgaagtggagtgcctcgccgagagccaccagcacctgtccaaggagtcccttgctgggaacaagcctgccaatgccgtcctgcacaaggtcctgaaccagctggaggagctgctgagcgacatgaaggccgacgtgacccggctgccatccatgctgtcccgcatccccccggtggccgcccggctgcagatgtcggagcgcagcatcctgagccgcctgaccaaccgcgccggggaccccaccatccagcagggcgctttcggctcctcccagatgtacagcaacaactttgggcccaacttccggggccctggaccgggagggattgtcaactacaaccagatgcccctggggccctatgtgaccgatatctagccgtcctcgagacttccctgtgttgcagcgctcatttccagctgagccacgcctgccgggccacctgcccgacccacatgggagagaaaagctgccacctttttaggagccagcgccaccttgggacaaaaagggaaacctagtaatgccatcacatggaggacgaggcccagctcagctgggccagagcccagaagtgccacctcatcataattcaagtgttcttccacacagcgttgcccccacaaccacgccggacgtgccccctcgccaccttttccagacgacttcttagaagagatttcatttatttgtacatcttttgcactttcctattgaagacttgaacacgtttgtcttgataaaagttggatgacgtatggaagattcgaacctgcagcactgatgtctctttaccgatgggttccagacccaaggtagtcctggcactgccctgtggactcagcccagctggggaggacatggcgcccggtgccctaggagccctcagtgtcccctacctgacctgtctgcacctgtgtgacagccccttctgatttggccccctgcccgcttggagcctcccagcaccagacagggcaggtttggggagccgctgtcnagccctatggtgagaccctggctgacatttcccctccttcctgccaaggctggaggccgccaggtgtttgctctctccttgtggggaggtggatcctctgccagcaggtgtctgtccccggcccagcgcatcttgaaggccctggactctgttaccagtggggggcctgtggccccggctcttcacagcaggcagaagcgtatgatcccagggagggtgggctgggggggggncagcacttgcctcggagccactgctgcgttgggtttgccttctgccagaggtgtggttaagggcagtgatagctgcgccccagcaaggagggtcatgggccctgagctggcccaggagaccctggccctgccctgtgccctgggatgcctaccctgcccacctccggaggtggaaccgggctgcccctgggggcctggacttgtcccattcccctgtccctggaaaggccttcccgggggctttttgcctgaggctgcactcttggaaggcgtggggagagttctgcctggagggggactggacccagtgccctctgcagacccctcccagccgcagcaccaagggcttgctgccttgtttcctgccaggagcgccctgacatcccaaaaccatcttcccacatgtgggttgttggaatcccacccactcccccggaccctgcccctccaagttggggacggagatggggagcaggtcaggccctccctaggcctgtttgtgtgtgatccttctcctggccccaggtcgacctggaaggcgtttctgagtcttgtactgggaccttcccagggaaggtgccttggggtgcagaatcctgggaatgttaggaaagggctgcgtgaaaaacccagctgggcctggggtggaggtgcacacgggctggggctcagctccttggagagggcctgcctgggactgagggggccagggctgggtcaggattcaccagcttgtgttgcagacactggagcaattgcctggccctccctaagccctatatgcctcactcataatgaggctgtctctgaaccccggagggcgggacctacaagtccttcctcttggcgcattcccacactccagtctggatccaggtctgcaaggccagcccgaccctgacactgcacgtgggcgtagtggggagcaccctggagtggagatgattgtcagcgggctcacatgttatggttcatccacatgcgtgttgtgtgctctgcggtgcctcctggcaaagggtcctggctcgggtcagaagctcactcccgtgccctcgtccccaaacaagcagtggcaagcactggggttggccctcgttgggagcagtgcccaccttccttggcccacagcagataggtcccgagcagcaggactggaggcctgtggcggtcagggcaggggtctgtgtctccaccccaagggctgatggtccctcccctgtgcgccttcctctcaggcaggcttgctctgtcccttcctctctgcttccctcccaggcctcgccagggctcccttctcctctgcctggttagactcgggcacccaggaaagcctggccagggctcctttgggcctgggccccctgcactgcctggtccagaaggggtggtgctgtccgtggccagcaccccggggcccgggaggggtgggctactagagtcagagcgggtttggggctgaccagtttgggagaggagaaaagatctgagaatgtccttcttggtttgtcagtcatctctgccaaaagtggtgatggtggtgtccgtatgtttggcgtctttgggctgggtttggtttttgctgctggtagaatcagggtcctcgggcatgaacgcgagcccaaagtgccagtctgcgattggaaatttccagccactttaagccagtgctgagtagggcttctgcagagccatgtttgagccaaggtcttggaaggcattgccccatgggctcaggtgactcggggtggagtgagcacgtctgcagggccctctcatacacgcctgaggcagaagcagcgtcccccgtgaaagccaccttccgaagctcctgcgttttttgcaaacttggcttcccccaggggcaggctggactttccctgccccctatgattgaagtcctcctgcttttgggggctgccttcccagagtcccccgggtgctcccctgccgaggtcaggagctgaccaagcctttggcccggtgacacctgcagccctcactcctgtcatcccaggacacttgaggcccaaggaggtggagtggagagtgggctcgggtacatgggagccagaagccagatggacttggtcaagtgtcggtcacttggagcctccagtgtgcgtcagggtctgtgggcaggggacagggcgtgggtgggggccgaggctggcacgcccctctgccctcaccgtcttggtgacctggcctcggcccctcccccaagtctcttctgtgcaaggcccgcctcggcctcggcagctggttcctgtcctgttttctgtgtctgaaagtttacaggttgtggtgcatcagcccaaactcactggcgttgtgttttttttttctttaattttcagattttttttttaaacaaagtatttttttaggtgcgataacccagaaagggcccgttgggtgtgtgtgtgtgtcctgaactcctcaagcagcgattggagcccaagcacccctggagaggaagggagggtccccactggcccgtggggtctgagttcaggggtgtggagggagcagactccaccggcccaggcccagctaagagggggccgacccctttccccaggcacagccccaggctggcaaagggagggccctgggctgggtgcagggcgcgccaggagtcccagccagggtggccccggcgggggcgggtccagctttggaagccaggctcccctgtgagccgtggcttgtctggtcttcgcccacgggaggctggacagaggctgtagccaacacaatcacctttactttgtactctgtgtgtatgttttggttttctgtgttttaataaatcctttgggaaaggaataaaaaa

SEQ ID NO: 446151 - DNA, 385 bp, Homo sapiens
  misc_feature (62)..(62): n is a, c, g, or t
tgcgagattatgaatgtaattttgtatgttacattttatagccaaacgcgacgaaaacttantattatgacctttcaaagatgagagacttcatcaataaacaagctgatgcttatgtggagaaaggcatccttgacaaggaagaagccgaggccatcaagcgcatttatagcagcctgtaaaaatggcaaaagatccaggagtctttcaactgtttcagaaaacataatatagcttaaaacacttctaattctgtgattaaaattttttgacccaagggttattagaaagtgctgaatttacagtagttaaccttttacaagtggttaaaacatagctttcttcccgtaaaaactatctgaaagtaaagttgtatgtaagctga

SEQ ID NO: 446152 - DNA, 270 bp, Homo sapiens
caggtgtagtagcgcgccacgagaggtatttgtattaaaattattttttctggtattatgacctttcaaagatgagagacttcatcaataaacaagctgatgcttatgtggagaaaggcatccttgacaaggaagaagccgaggccatcaagcgcatttatagcagcctgtaaaaatggcaaaagatccaggagtctttcaactgtttcagaaaacataatatagcttaaaacacttctaattctgtgattaaaattttttgacccaagg

SEQ ID NO: 446153 - DNA, 3325 bp, Homo sapiens
tcctttgttccattcccgggggattggagtagcgttggagtcaccgacgccatcccctcccgcctctggcgtgcatggagcatgcgcttccttcctcacttcctctccaggagggagcgagagtaaagctacgccctggcgcgcagtctccgcgtcacaggaacttcagcacccacagggcggacagcgctcccctctacctggagacttgactcccgcgcgccccaaccctgcttatcccttgaccgtcgagtgtcagagatcctgcagccgcccagtcccggcccctctcccgccccacacccaccctcctggctcttcctgtttttactcctccttttcattcataacaaaagctacagctccaggagcccagcgccgggctgtgacccaagccgagcgtggaagaatggggttcctcgggaccggcacttggattctggtgttagtgctcccgattcaagctttccccaaacctggaggaagccaagacaaatctctacataatagagaattaagtgcagaaagacctttgaatgaacagattgctgaagcagaagaagacaagattaaaaaaacatatcctccagaaaacaagccaggtcagagcaactattcttttgttgataacttgaacctgctaaaggcaataacagaaaaggaaaaaattgagaaagaaagacaatctataagaagctccccacttgataataagttgaatgtggaagatgttgattcaaccaagaatcgaaaactgatcgatgattatgactctactaagagtggattggatcataaatttcaagatgatccagatggtcttcatcaactagacgggactcctttaaccgctgaagacattgtccataaaatcgctgccaggatttatgaagaaaatgacagagccgtgtttgacaagattgtttctaaactacttaatctcggccttatcacagaaagccaagcacatacactggaagatgaagtagcagaggttttacaaaaattaatctcaaaggaagccaacaattatgaggaggatcccaataagcccacaagctggactgagaatcaggctggaaaaataccagagaaagtgactccaatggcagcaattcaagatggtcttgctaagggagaaaacgatgaaacagtatctaacacattaaccttgacaaatggcttggaaaggagaactaaaacctacagtgaagacaactttgaggaactccaatatttcccaaatttctatgcgctactgaaaagtattgattcagaaaaagaagcaaaagagaaagaaacactgattactatcatgaaaacactgattgactttgtgaagatgatggtgaaatatggaacaatatctccagaagaaggtgtttcctaccttgaaaacttggatgaaatgattgctcttcagaccaaaaacaagctagaaaaaaatgctactgacaatataagcaagcttttcccagcaccatcagagaagagtcatgaagaaacagacagtaccaaggaagaagcagctaagatggaaaaggaatatggaagcttgaaggattccacaaaagatgataactccaacccaggaggaaagacagatgaacccaaaggaaaaacagaagcctatttggaagccatcagaaaaaatattgaatggttgaagaaacatgacaaaaagggaaataaagaagattatgacctttcaaagatgagagacttcatcaataaacaagctgatgcttatgtggagaaaggcatccttgacaaggaagaagccgaggccatcaagcgcatttatagcagcctgtaaaaatggcaaaagatccaggagtctttcaactgtttcagaaaacataatatagcttaaaacacttctaattctgtgattaaaattttttgacccaagggttattagaaagtgctgaatttacagtagttaaccttttacaagtggttaaaacatagctttcttcccgtaaaaactatctgaaagtaaagttgtatgtaagctgagattttgtatacagaatccttatttcctcatagacttatattttataatcagaatatgttgctttgaaaaagcctctaatggactgaccttaaaactcatccttcttccactgtctcatccacataagcactccccgaagaattaagggggttctgttttcaaggcatgccaagtactaaagcaccttgcagagcgtgtctattacaagatgtcatttccaccagcagttcccttaggggagctgaaataaattcacattttctcaaagtctcatagctttggaggagccatctgcttttttggctgctctttttagctggctttttattaggctcagtgacataaaaaggatccaggtaaatgggtataggatttgctggatttactaacaatttccccctgttcttaacacttcctattagtgacttttcagacattgagtttacttataaagagagatatttatgtactctctaagaagacaaatgaggtcataaacactgcataaagcaaggcaaaaatgtatgccacatctcagttatctaaactagattagatccaagccaagttttctcaacagagagcaaagggccaggcagtaaggtagaaatagagataaaaatcattccttccttgtgatccaaagctggtcgagcagctttcctggaggaaaaggttaatgaacttcaggtccctgcaactcagcccccaccacaaacacagccctggaaacatacagtggcgcaaggtcctcttgaaatgttaatggttaatgttcccaaaccagagaatgctttgaaaatgtatcattcagtgtaaattaattacatacatatttttctatatatttgtttcaaactgtaaaaataacataatatgtaatttgtgtattagtgagaggtgaagccagctggacttcctgggtcgagtggggccttggagaacttttctgtcttacaagaggattgtaaaatgcacccatcagtgctctgtaaaacacaccaatcagcgctctgtagctagcaataggtttgtaaaatgcacccatcagcactctgtaaaacgcaccaatcagcactctgtaaaatgcaccaatcagcaggattctaaaagtagacaatcacagggaggattgaaaaaaagggcactctgatagggcaaaaacggaacatgggaggggacaaataagggaataaaatctggccaccccagccagcagcagcaacctgttcaggtcgcctgccgctgtggaagctttgtccttttgctcttcataataaaccttgctactgttcaaaaattggg

SEQ ID NO: 446154 - DNA, 2019 bp, Homo sapiens
tcctttgttccattcccgggggattggagtagcgttggagtcaccgacgccatcccctcccgcctctggcgtgcatggagcatgcgcttccttcctcacttcctctccaggagggagcgagagtaaagctacgccctggcgcgcagtctccgcgtcacaggaacttcagcacccacagggcggacagcgctcccctctacctggagacttgactcccgcgcgccccaaccctgcttatcccttgaccgtcgagtgtcagagatcctgcagccgcccagtcccggcccctctcccgccccacacccaccctcctggctcttcctgtttttactcctccttttcattcataacaaaagctacagctccaggagcccagcgccgggctgtgacccaagccgagcgtggaagaatggggttcctcgggaccggcacttggattctggtgttagtgctcccgattcaagctttccccaaacctggaggaagccaagacaaatctctacataatagagaattaagtgcagaaagacctttgaatgaacagattgctgaagcagaagaagacaagattaaaaaaacatatcctccagaaaacaagccaggtcagagcaactattcttttgttgataacttgaacctgctaaaggcaataacagaaaaggaaaaaattgagaaagaaagacaatctataagaagctccccacttgataataagttgaatgtggaagatgttgattcaaccaagaatcgaaaactgatcgatgattatgactctactaagagtggattggatcataaatttcaagatgatccagatggtcttcatcaactagacgggactcctttaaccgctgaagacattgtccataaaatcgctgccaggatttatgaagaaaatgacagagccgtgtttgacaagattgtttctaaactacttaatctcggccttatcacagaaagccaagcacatacactggaagatgaagtagcagaggttttacaaaaattaatctcaaaggaagccaacaattatgaggaggatcccaataagcccacaagctggactgagaatcaggctggaaaaataccagagaaagtgactccaatggcagcaattcaagatggtcttgctaagggagaaaacgatgaaacagtatctaacacattaaccttgacaaatggcttggaaaggagaactaaaacctacagtgaagacaactttgaggaactccaatatttcccaaatttctatgcgctactgaaaagtattgattcagaaaaagaagcaaaagagaaagaaacactgattactatcatgaaaacactgattgactttgtgaagatgatggtgaaatatggaacaatatctccagaagaaggtgtttcctaccttgaaaacttggatgaaatgattgctcttcagaccaaaaacaagctagaaaaaaatgctactgacaatataagcaagcttttcccagcaccatcagagaagagtcatgaagaaacagacagtaccaaggaagaagcagctaagatggaaaaggaatatggaagcttgaaggattccacaaaagatgataactccaacccaggaggaaagacagatgaacccaaaggaaaaacagaagcctatttggaagccatcagaaaaaatattgaatggttgaagaaacatgacaaaaagggaaataaagaagattatgacctttcaaagatgagagacttcatcaataaacaagctgatgcttatgtggagaaaggcatccttgacaaggaagaagccgaggccatcaagcgcatttatagcagcctgtaaaaatggcaaaagatccaggagtctttcaactgtttcagaaaacataatatagcttaaaacacttctaattctgtgattaaaattttttgacccaagggttattagaaagtgctgaatttacagtagttaaccttttacaagtggttaaaacatagctttcttcccgtaaaaactatctgaaagtaaagttgtatgtaagctga

SEQ ID NO: 446155 - DNA, 1780 bp, Homo sapiens
tgtcttcttctgtcttcttctgcttcagcaatctgttcattcaaaggtctttctgcacttaattctctattatgtagagatttgtcttggcttcctccttttcattcataacaaaagctacagctccaggagcccagcgccgggctgtgacccaagccgagcgtggaagaatggggttcctcgggaccggcacttggattctggtgttagtgctcccgattcaagctttccccaaacctggaggaagccaagacaaatctctacataatagagaattaagtgcagaaagacctttgaatgaacagattgctgaagcagaagaagacaagattaaaaaaacatatcctccagaaaacaagccaggtcagagcaactattcttttgttgataacttgaacctgctaaaggcaataacagaaaaggaaaaaattgagaaagaaagacaatctataagaagctccccacttgataataagttgaatgtggaagatgttgattcaaccaagaatcgaaaactgatcgatgattatgactctactaagagtggattggatcataaatttcaagatgatccagatggtcttcatcaactagacgggactcctttaaccgctgaagacattgtccataaaatcgctgccaggatttatgaagaaaatgacagagccgtgtttgacaagattgtttctaaactacttaatctcggccttatcacagaaagccaagcacatacactggaagatgaagtagcagaggttttacaaaaattaatctcaaaggaagccaacaattatgaggaggatcccaataagcccacaagctggactgagaatcaggctggaaaaataccagagaaagtgactccaatggcagcaattcaagatggtcttgctaagggagaaaacgatgaaacagtatctaacacattaaccttgacaaatggcttggaaaggagaactaaaacctacagtgaagacaactttgaggaactccaatatttcccaaatttctatgcgctactgaaaagtattgattcagaaaaagaagcaaaagagaaagaaacactgattactatcatgaaaacactgattgactttgtgaagatgatggtgaaatatggaacaatatctccagaagaaggtgtttcctaccttgaaaacttggatgaaatgattgctcttcagaccaaaaacaagctagaaaaaaatgctactgacaatataagcaagcttttcccagcaccatcagagaagagtcatgaagaaacagacagtaccaaggaagaagcagctaagatggaaaaggaatatggaagcttgaaggattccacaaaagatgataactccaacccaggaggaaagacagatgaacccaaaggaaaaacagaagcctatttggaagccatcagaaaaaatattgaatggttgaagaaacatgacaaaaagggaaataaagaagattatgacctttcaaagatgagagacttcatcaataaacaagctgatgcttatgtggagaaaggcatccttgacaaggaagaagccgaggccatcaagcgcatttatagcagcctgtaaaaatggcaaaagatccaggagtctttcaactgtttcagaaaacataatatagcttaaaacacttctaattctgtgattaaaattttttgacccaagggttattagaaagtgctgaatttacagtagttaaccttttacaagtggttaaaacatagctttcttcccgtaaaaactatctgaaagtaaagttgtatgtaagctga

SEQ ID NO: 446156 - DNA, 1683 bp, Homo sapiens
  misc_feature (78)..(78): n is a, c, g, or t
taaataaaattagaaataaatgacatattaaatgtaacaacacccccacccttgacggaaacacctgcaaggtgtagnatattcatcaataaacaagctgatgcttatgtggagaaaggcatccttgacaaggaagaagccgaggccatcaagcgcatttatagcagcctgtaaaaatggcaaaagatccaggagtctttcaactgtttcagaaaacataatatagcttaaaacacttctaattctgtgattaaaattttttgacccaagggttattagaaagtgctgaatttacagtagttaaccttttacaagtggttaaaacatagctttcttcccgtaaaaactatctgaaagtaaagttgtatgtaagctgagattttgtatacagaatccttatttcctcatagacttatattttataatcagaatatgttgctttgaaaaagcctctaatggactgaccttaaaactcatccttcttccactgtctcatccacataagcactccccgaagaattaagggggttctgttttcaaggcatgccaagtactaaagcaccttgcagagcgtgtctattacaagatgtcatttccaccagcagttcccttaggggagctgaaataaattcacattttctcaaagtctcatagctttggaggagccatctgcttttttggctgctctttttagctggctttttattaggctcagtgacataaaaaggatccaggtaaatgggtataggatttgctggatttactaacaatttccccctgttcttaacacttcctattagtgacttttcagacattgagtttacttataaagagagatatttatgtactctctaagaagacaaatgaggtcataaacactgcataaagcaaggcaaaaatgtatgccacatctcagttatctaaactagattagatccaagccaagttttctcaacagagagcaaagggccaggcagtaaggtagaaatagagataaaaatcattccttccttgtgatccaaagctggtcgagcagctttcctggaggaaaaggttaatgaacttcaggtccctgcaactcagcccccaccacaaacacagccctggaaacatacagtggcgcaaggtcctcttgaaatgttaatggttaatgttcccaaaccagagaatgctttgaaaatgtatcattcagtgtaaattaattacatacatatttttctatatatttgtttcaaactgtaaaaataacataatatgtaatttgtgtattagtgagaggtgaagccagctggacttcctgggtcgagtggggccttggagaacttttctgtcttacaagaggattgtaaaatgcacccatcagtgctctgtaaaacacaccaatcagcgctctgtagctagcaataggtttgtaaaatgcacccatcagcactctgtaaaacgcaccaatcagcactctgtaaaatgcaccaatcagcaggattctaaaagtagacaatcacagggaggattgaaaaaaagggcactctgatagggcaaaaacggaacatgggaggggacaaataagggaataaaatctggccaccccagccagcagcagcaacctgttcaggtcgcctgccgctgtggaagctttgtccttttgctcttcataataaaccttgctactgttcaaaaattggg

SEQ ID NO: 446157 - DNA, 2268 bp, Homo sapiens
  misc_feature (2243)..(2243): n is a, c, g, or t
  misc_feature (2262)..(2262): n is a, c, g, or t
tcctttgttccattcccgggggattggagtagcgttggagtcaccgacgccatcccctcccgcctctggcgtgcatggagcatgcgcttccttcctcacttcctctccaggagggagcgagagtaaagctacgccctggcgcgcagtctccgcgtcacaggaacttcagcacccacagggcggacagcgctcccctctacctggagacttgactcccgcgcgccccaaccctgcttatcccttgaccgtcgagtgtcagagatcctgcagccgcccagtcccggcccctctcccgccccacacccaccctcctggctcttcctgtttttactcctccttttcattcataacaaaagctacagctccaggagcccagcgccgggctgtgacccaagccgagcgtggaagaatggggttcctcgggaccggcacttggattctggtgttagtgctcccgattcaagctttccccaaacctggaggaagccaagacaaatctctacataatagagaattaagtgcagaaagacctttgaatgaacagattgctgaagcagaagaagacaagattaaaaaaacatatcctccagaaaacaagccaggtcagagcaactattcttttgttgataacttgaacctgctaaaggcaataacagaaaaggaaaaaattgagaaagaaagacaatctataagaagctccccacttgataataagttgaatgtggaagatgttgattcaaccaagaatcgaaaactgatcgatgattatgactctactaagagtggattggatcataaatttcaagatgatccagatggtcttcatcaactagacgggactcctttaaccgctgaagacattgtccataaaatcgctgccaggatttatgaagaaaatgacagagccgtgtttgacaagattgtttctaaactacttaatctcggccttatcacagaaagccaagcacatacactggaagatgaagtagcagaggttttacaaaaattaatctcaaaggaagccaacaattatgaggaggatcccaataagcccacaagctggactgagaatcaggctggaaaaataccagagaaagtgactccaatggcagcaattcaagatggtcttgctaagggagaaaacgatgaaacagtatctaacacattaaccttgacaaatggcttggaaaggagaactaaaacctacagtgaagacaactttgaggaactccaatatttcccaaatttctatgcgctactgaaaagtattgattcagaaaaagaagcaaaagagaaagaaacactgattactatcatgaaaacactgattgactttgtgaagatgatggtgaaatatggaacaatatctccagaagaaggtgtttcctaccttgaaaacttggatgaaatgattgctcttcagaccaaaaacaagctagaaaaaaatgctactgacaatataagcaagcttttcccagcaccatcagagaagagtcatgaagaaacagacagtaccaaggaagaagcagctaagatggaaaaggaatatggaagcttgaaggattccacaaaagatgataactccaacccaggaggaaagacagatgaacccaaaggaaaaacagaagcctatttggaagccatcagaaaaaatattgaatggttgaagaaacatgacaaaaagggaaataaagaagattatgacctttcaaagatgagagacttcatcaataaacaagctgatgcttatgtggagaaaggcatccttgacaaggaagaagccgaggccatcaagcgcatttatagcagcctgtaaaaatggcaaaagatccaggagtctttcaactgtttcagaaaacataatatagcttaaaacacttctaattctgtgattaaaattttttgacccaagggttattagaaagtgctgaatttacagtagttaaccttttacaagtggttaaaacatagctttcttcccgtaaaaactatctgaaagtaaagttgtatgtaagctgagattttgtatacagaatccttatttcctcatagacttatattttataatcagaatatgttgctttgaaaaagcctctaatggactgaccttaaaactcatccttcttccactgtctcatccacataagcactccccgaagaattaagggggttctgttttcaaggcatgccaagtactaaagcaccttgcagagcgtgtctattacaagatagaagattaatcnatgctgtaatagatgtctnataggg

SEQ ID NO: 446158 - DNA, 1913 bp, Homo sapiens
tcctttgttccattcccgggggattggagtagcgttggagtcaccgacgccatcccctcccgcctctggcgtgcatggagcatgcgcttccttcctcacttcctctccaggagggagcgagagtaaagctacgccctggcgcgcagtctccgcgtcacaggaacttcagcacccacagggcggacagcgctcccctctacctggagacttgactcccgcgcgccccaaccctgcttatcccttgaccgtcgagtgtcagagatcctgcagccgcccagtcccggcccctctcccgccccacacccaccctcctggctcttcctgtttttactcctccttttcattcataacaaaagctacagctccaggagcccagcgccgggctgtgacccaagccgagcgtggaagaatggggttcctcgggaccggcacttggattctggtgttagtgctcccgattcaagctttccccaaacctggaggaagccaagacaaatctctacataatagagaattaagtgcagaaagacctttgaatgaacagattgctgaagcagaagaagacaagattaaaaaaacatatcctccagaaaacaagccaggtcagagcaactattcttttgttgataacttgaacctgctaaaggcaataacagaaaaggaaaaaattgagaaagaaagacaatctataagaagctccccacttgataataagttgaatgtggaagatgttgattcaaccaagaatcgaaaactgatcgatgattatgactctactaagagtggattggatcataaatttcaagatgatccagatggtcttcatcaactagacgggactcctttaaccgctgaagacattgtccataaaatcgctgccaggatttatgaagaaaatgacagagccgtgtttgacaagattgtttctaaactacttaatctcggccttatcacagaaagccaagcacatacactggaagatgaagtagcagaggttttacaaaaattaatctcaaaggaagccaacaattatgaggaggatcccaataagcccacaagctggactgagaatcaggctggaaaaataccagagaaagtgactccaatggcagcaattcaagatggtcttgctaagggagaaaacgatgaaacagtatctaacacattaaccttgacaaatggcttggaaaggagaactaaaacctacagtgaagacaactttgaggaactccaatatttcccaaatttctatgcgctactgaaaagtattgattcagaaaaagaagcaaaagagaaagaaacactgattactatcatgaaaacactgattgactttgtgaagatgatggtgaaatatggaacaatatctccagaagaaggtgtttcctaccttgaaaacttggatgaaatgattgctcttcagaccaaaaacaagctagaaaaaaatgctactgacaatataagcaagcttttcccagcaccatcagagaagagtcatgaagaaacagacagtaccaaggaagaagcagctaagatggaaaaggaatatggaagcttgaaggattccacaaaagatgataactccaacccaggaggaaagacagatgaacccaaaggaaaaacagaagcctatttggaagccatcagaaaaaatattgaatggttgaagaaacatgacaaaaagggaaataaagaagattatgacctttcaaagatgagagacttcatcaataaacaagctgatgcttatgtggagaaaggcatccttgacaaggaagaagccgaggccatcaagcgcatttatagcagcctgtaaaaatggcaaaagatccaggagtctttcaactgtttcagaaaacataatatagcttaaaacacttctaattctgtgattaaaattttttgacccaagg

SEQ ID NO: 446159 - DNA, 507 bp, Homo sapiens
aaaaaaaaaaaaaaaaaaaaaaaaaaaaaaaaaaaaaaaaaaaacccacatttttttttattggcaagcatgtggtgtttggcaaagttctagagggcatggaggtggtgcggaaggtggagagcaccaagacagacagccgggataaacccctgaaggatgtgatcatcgcagactgcggcaagatcgaggtggagaagccctttgccatcgccaaggagtagggcacagggacatctttctttgagtgaccgtctgtgcaggccctgtagtccgccacagggctctgagctgcactggccccggtgctggcatctggtggagcggacccactcccctcacattccacaggcccatggactcacttttgtaacaaactcctaccaacactgaccaataaaaaaaaatgtgggtttttttttttttttttttttttttttttttttttttttttttttgggggggccccaaaaaaaaatttgttgttgggcgcaaccaacagggggg

SEQ ID NO: 446160 - DNA, 292 bp, Homo sapiens
  misc_feature (24)..(24): n is a, c, g, or t
  misc_feature (29)..(29): n is a, c, g, or t
atgatctagagtcatccccatcgnaggtngtcatcgcagactgcggcaagatcgaggtggagaagccctttgccatcgccaaggagtagggcacagggacatctttctttgagtgaccgtctgtgcaggccctgtagtccgccacagggctctgagctgcactggccccggtgctggcatctggtggagcggacccactcccctcacattccacaggcccatggactcacttttgtaacaaactcctaccaacactgaccaataaaaaaaaatgtgggtttttttttttttt

SEQ ID NO: 446161 - DNA, 279 bp, Homo sapiens
  misc_feature (205)..(205): n is a, c, g, or t
ggcacattgtgctggcaccatgtgctggcatctggtggagcggacccactcccctcacattccacaggcccatggactcacttttgtaacaaactcctaccaacactgaccaataaaaaaaaatgtgggttttttttttttttttttttttttttttttttttttttttttttttttttttttttttttttttttttttttgttntttttttttttttgtttttttttttttttttttttttttataagaaaacagagagagagactatagggggggga

SEQ ID NO: 446162 - DNA, 347 bp, Homo sapiens
ttgtgatggcaagggcttctccacctcgatcttgccgcagtctgcgatgatcacatccttcaggcgtttatcccggctgtctgtcttggtgctggcatctggtggagcggacccactcccctcacattccacaggcccatggactcacttttgtaacaaactcctaccaacactgaccaataaaaaaaaatgtgggttttttttttttttttttttttttttttttttttttttttttttttttttttttttttttttttttttttttttttttttttttttttttttttttttgtgtggggggggggggagcctcctcaccccccccacacaccccccccccctga

SEQ ID NO: 446163 - DNA, 369 bp, Homo sapiens
atccagtctacatcacaacagtcaagacagcctgactagaatgcaagcatgtggtgtttggcaaagttctagagggcatggagatggtgcggacggtggagagcaccaagacagacagccgggataattttggggtctttgctacaggagagaaaggatttggctacaaaaacagcaaattccatcgtgtaatcaaggacttcatgatccagggcggagacttcaccaggggagatggcacaggaggaaagagcatctacggtgagcgcttccccgatgagaacttcaaactgaagcactacgggcctggctgggtgagcatggccaacgcaggcaaagacacagcaaagaccccaaaaggggtaccga

SEQ ID NO: 446164 - DNA, 238 bp, Homo sapiens
gacggagtgatgctgcggtgttctagaggatcccggcaccattgtgctggcatctggtggagcggacccactcccctcacattccacaggcccatggactcacttttgtaacaaactcctaccaacactgaccaataaaaaaaaatgtgggtttttttttttttttttttttttttttttttttttttaaaaaccccccccaaaaattcccccgggacaagggtccaccggccacaaa

SEQ ID NO: 446165 - DNA, 1000 bp, Homo sapiens
  misc_feature (3)..(5): n is a, c, g, or t
  misc_feature (8)..(8): n is a, c, g, or t
ggnnnganacggcccgccgcccgcccggagcccgcgagcaaccccagtcccccccacccgcgcgtggcggcgccggctccctagccaccgcggccccaccctcttccggcctcagctgtccgggctgctttcgcctccgcctgtggatgctgcgcctctccgaacgcaacatgaaggtgctccttgccgccgccctcatcgcggggtccgtcttcttcctgctgctgccgggaccttctgcggccgatgagaagaagaaggggcccaaagtcaccgtcaaggtgtattttgacctacgaattggagatgaagatgtaggccgggtgatctttggtctcttcggaaagactgttccaaaaacagtggataattttgtggccttagctacaggagagaaaggatttggctacaaaaacagcaaattccatcgtgtaatcaaggacttcatgatccagggcggagacttcaccaggggagatggcacaggaggaaagagcatctacggtgagcgcttccccgatgagaacttcaaactgaagcactacgggcctggctgggtgagcatggccaacgcaggcaaagacaccaacggctcccagttcttcatcacgacagtcaagacagcctggctagatggcaagcatgtggtgtttggcaaagttctagagggcatggaggtggtgcggaaggtggagagcaccaagacagacagccgggataaacccctgaaggatgtgatcatcgcagactgcggcaagatcgaggtggagaagccctttgccatcgccaaggagtagggcacagggacatctttctttgagtgaccgtctgtgcaggccctgtagtccgccacagggctctgagctgcactggccccggtgctggcatctggtggagcggacccactcccctcacattccacaggcccatggactcacttttgtaacaaactcctaccaacactgaccaataaaaaaaaatgtgggtttttttttttttt

SEQ ID NO: 446166 - DNA, 414 bp, Homo sapiens
cgagaggatcccggcggttgtgctggagagggcatggaggtggtgcggaaggtggagagcaccaagacagacagccgggataaacccctgaaggatgtgatcatcgcagactgcggcaagatcgaggtggagaagccctttgccatcgccaaggagtagggcacagggacatctttctttgagtgaccgtctgtgcaggccctgtagtccgccacagggctctgagctgcactggccccggtgctggcatctggtggagcggacccactcccctcacattccacaggcccatggactcacttttgtaacaaactcctaccaacactgaccaataaaaaaaaatgtgggttttttttttttttttttttttttttttttttttttttttatgggaatttttccattttttttaaa

SEQ ID NO: 446167 - DNA, 491 bp, Homo sapiens
tcaggatgctgcggtgatctagaggatcccagtgtctgagaaggtggagagcaccaagacagacagccgggataaacccctgaaggatgtgatcatcgcagactgcggcaagatcgaggtggagaagccctttgccatcgccaaggagtagggcacagggacatctttctttgagtgaccgtctgtgcaggccctgtagtccgccacagggctctgagctgcactggccccggtgctggcatctggtggagcggacccactcccctcacattccacaggcccatggactcacttttgtaacaaactcctaccaacactgaccaataaaaaaaaatgtgggttttttttttttttttttttttttttttttttttttttttttttttttttttttttggggggggggaaaaaaaaacaaaggggggggcaaaaaaaagaacagggaaaagggcgggggggggcacggggggcccacgggggggggaaaaaaa

SEQ ID NO: 446168 - DNA, 205 bp, Homo sapiens
  misc_feature (17)..(17): n is a, c, g, or t
tagtgtctagaggatcngtgcgtgccggtgctggcatctggtggagcggacccactcccctcacattccacaggcccatggactcacttttgtaacaaactcctaccaacactgaccaataaaaaaaaatgtgggtttttttttttttttttttttttttttttttttttttttttttttttggggggcccgggggcccattcga

SEQ ID NO: 446169 - DNA, 164 bp, Homo sapiens
gatgtgctgctgcggtactctcgacgactcccggcaccacttgtgctggcatctggtggagcggacccactcccctcacattccacaggcccatggactcacttttgtaacaaactcctaccaacactgaccaataaaaaaaaatgtgggtttttttttttttt

SEQ ID NO: 446170 - DNA, 834 bp, Homo sapiens
gagggtgagaaagccccttggcattgccaagggtttgtggcacacgggacatctcttcttggaagtgacccttttggggcagggcccctggtatgcgcgccaacaaggggttctgagacttcactttggcccccggtttctgggactttttggttgtaaccggacgccaatggcccgtcagcagtggccacccagcccctggatgtcaactttttgtgaccaactcctgtccgcacccgtgtgcacattaaagaaaaattttggggttattttttatttctgttaagtaatatataatgtgtgggcctggttcttgagcctgcagcacctcccctaggcctacatcccaacatgcctgcaactctcctgtggcaatgggtgcctgccccttccctgggatcctgcctgaaattttgacccaggagctacccaggaaaagtcaggcaggagcttttgccccctgcttctaaactttgccagctactgggcctccacatttgctccccttgccaccaccctccagtctatgttaagggatgtatctgtactttttcatagcctacctctaaattgatttttttttttttttttggtagagacaggtctcactatgttgcgctggctggtctcaaacttccagacccaagcatcctcctgccttggcctcctaaagtattgggattacaggcatgagctctgcacccagctgacttcttcctttattatttatttattttgagacggagtttcactcttgttgcccaggctggagtgcagtggcgcgatctcggctcaccacaacttccgcctcctggcttcaagagattctcctgc

SEQ ID NO: 446171 - DNA, 768 bp, Homo sapiens
  misc_feature (1)..(1): n is a, c, g, or t
ntctttaactagtggatcccccttctgcaggaattcggcacgaggtttatattaactttccattgagccagcaggtgacctttcttctcagttttcttgtatctgttcttatgattggaagaaatgaggggaaaagcattatgtgatgtagaattgtataaagcttgggaattgtatggaggcagagggatttccacatctgtgtgtaccatgcctgtcctgtggcgcctgcccgctcacttagtagcacactgaacagtgaaagtggtcagcagtggtgtctcttctgcgagcaggagttgtggacttgttcctgtgaggcctatttaatgtaatgtcttcctgctgccccataccacctccttaccttctcttccctttttctagaaaggatttggctacaaaaggatttggctacaaaaacagcaaattccatcgtgtaatcaaggacttcatgatccagggcggagacttcaccaggggagatggcacaggaggtaaccacaggtcctctgggccaaggagtatgtcagtgtagcctccacagtgggagggccaggttctgctggggagaccaggcctctttcttccccagctctagaggcaggcctacttattacttacctactttgagaccagcggcacccttctttgaagagggaacccagtaccaggtgaccgtccttgctgatccaggcctatagcctggtgaccctttcctgataccttttaagaatggggattggggagagaggcctctggaagcaa

SEQ ID NO: 446172 - DNA, 912 bp, Homo sapiens
ccacgcgtcggagcatctacggtgaaggcgcttcccctgctttcgcctccgcctgtggatgctgcgcctctccgaacgcaacatgaaggtgctccttgccgccgccctcatcgcggggtccgtcttcttcctgctgctgccgggaccttctgcggccgatgagaagaagaaggggcccaaagtcaccgtcaaggtgtattttgacctacgaattggagatgaagatgtaggccgggtgatctttggtctcttcggaaagactgttccaaaaacagtggataattttgtggccttagctacaggagagaaaggatttggctacaaaaacagcaaattccatcgtgtaatcaaggacttcatgatccagggcggagacttcaccaggggagatggcacaggaggaaagagcatctacggtgagcgcttccccgatgagaacttcaaactgaagcactacgggcctggctgggtgagcatggccaacgcaggcaaagacaccaacggctcccagttcttcatcacgacagtcaagacagcctggctagatggcaagcatgtggtgtttggcaaagttctagagggcatggaggtggtgcggaaggtggagagcaccaagacagacagccgggataaacccctgaaggatgtgatcatcgcagactgcggcaagatcgaggtggagaagccctttgccatcgccaaggagtagggcacagggacatctttctttgagtgaccgtctgtgcaggccctgtagtccgccacagggctctgagctgcactggccccggtgctggcatctggtggagcggacccactcccctcacattccacaggcccatggactcacttttgtaacaaactcctaccaacactgaccaataaaaaaaaatgtgggtttttttttttttt

SEQ ID NO: 446173 - DNA, 1407 bp, Homo sapiens
cccacgcgtccggctgtccgggctgctttcgcctccgcctgtggatgctgcgcctctccgaacgcaacatgaaggtgctccttgccgccgccctcatcgcggggtccgtcttcttcctgctgctgccgggaccttctgcggccgatgagaagaagaaggggcccaaagtcaccgtcaaggtgtattttgacctacgaattggagatgaagatgtaggccgggtgatctttggtctcttcggaaagactgttccaaaaacagtggataattttgtggccttagctacaggagagaaaggatttggctacaaaaacagcaaattccatcgtgtaatcaaggacttcatgatccagggcggagacttcaccaggggagatggcacaggaggaaagagcatctacggtgagcgcttccccgatgagaacttcaaactgaagcactacgggcctggctgggtgagcatggccaacgcaggcaaagacaccaacggctcccagttcttcatcacgacagtcaagacagcctggctagatggcaagcatgtggtgtttggcaaagttctagagggcatggaggtggtgcggaaggtggagagcaccaagacagacagccgggataaacccctgaaggatgtgatcatcgcagactgcggcaagatcgaggtggagaagccctttgccatcgccaaggagtagggcacagggacatctttctttgagtgaccgtctgtgcaggccctgtagtccgccacagggctctgagctgcactggccccggtgctggcatctggtggagcggacccactcccctcacattccacaggcccatggactcacttttgtaacaaactcctaccaacactgaccaataaaaaaaaatgtgggttttttttttttttaaaaaaaaaaaaaaaaaaaaaaaaaaaaaaaagggggggggggacaaaaaaatatccacagagggggcacaagttaaaggataccaagttttttggaaaagggtgggcccctaatgagggacgacgaataataaagacagagacaagggggcgagggtttaaacaacggtcgagaacggtggcaaaactgggagcgggggacacctggggaagggaccttacaacggggggggaccatattggggagaaaaagtgcctaaagagagtttttaaggccacgagggaaagttaacatttaagaggagtaaagggggtcaaaaacgaggagaaaggtgtggggggagtgagaagtttgggatacgggaatgtttatgtgacatttaggggggtgtaagtaaagacagagagaggtataatgatagagacgagaggaagaagagagagagagtaaaacgaagatgaaggaagagagcgtaggagaggatagcagacgaaaacgtacagctaag

SEQ ID NO: 446174 - DNA, 1033 bp, Homo sapiens
cccacgcgtccggctgtccgggctgctttcgcctccgcctgtggatgctgcgcctctccgaacgcaacatgaaggtgctccttgccgccgccctcatcgcggggtccgtcttcttcctgctgctgccgggaccttctgcggccgatgagaagaagaaggggcccaaagtcaccgtcaaggtgtattttgacctacgaattggagatgaagatgtaggccgggtgatctttggtctcttcggaaagactgttccaaaaacagtggataattttgtggccttagctacaggagagaaaggatttggctacaaaaacagcaaattccatcgtgtaatcaaggacttcatgatccagggcggagacttcaccaggggagatggcacaggaggaaagagcatctacggtgagcgcttccccgatgagaacttcaaactgaagcactacgggcctggctgggtgagcatggccaacgcaggcaaagacaccaacggctcccagttcttcatcacgacagtcaagacagcctggctagatggcaagcatgtggtgtttggcaaagttctagagggcatggaggtggtgcggaaggtggagagcaccaagacagacagccgggataaacccctgaaggatgtgatcatcgcagactgcggcaagatcgaggtggagaagccctttgccatcgccaaggagtagggcacagggacatctttctttgagtgaccgtctgtgcaggccctgtagtccgccacagggctctgagctgcactggccccggtgctggcatctggtggagcggacccactcccctcacattccacaggcccatggactcacttttgtaacaaactcctaccaacactgaccaataaaaaaaaatgtgggttttttttttttttaaaaaaaaaaaaaaaaaaaaaaaaaaaaaaaggcccgaactacaacgacagaaagaactggaaagaaacacaggggggggggcccggaaaccagaacgggcccaaaggggcccacaacccgccgtgagcccgacg

SEQ ID NO: 446175 - DNA, 1066 bp, Homo sapiens
cccacgcgtccggctgtccgggctgctttcgcctccgcctgtggatgctgcgcctctccgaacgcaacatgaaggtgctccttgccgccgccctcatcgcggggtccgtcttcttcctgctgctgccgggaccttctgcggccgatgagaagaagaaggggcccaaagtcaccgtcaaggtgtattttgacctacgaattggagatgaagatgtaggccgggtgatctttggtctcttcggaaagactgttccaaaaacagtggataattttgtggccttagctacaggagagaaaggatttggctacaaaaacagcaaattccatcgtgtaatcaaggacttcatgatccagggcggagacttcaccaggggagatggcacaggaggaaagagcatctacggtgagcgcttccccgatgagaacttcaaactgaagcactacgggcctggctgggtgagcatggccaacgcaggcaaagacaccaacggctcccagttcttcatcacgacagtcaagacagcctggctagatggcaagcatgtggtgtttggcaaagttctagagggcatggaggtggtgcggaaggtggagagcaccaagacagacagccgggataaacccctgaaggatgtgatcatcgcagactgcggcaagatcgaggtggagaagccctttgccatcgccaaggagtagggcacagggacatctttctttgagtgaccgtctgtgcaggccctgtagtccgccacagggctctgagctgcactggccccggtgctggcatctggtggagcggacccactcccctcacattccacaggcccatggactcacttttgtaacaaactcctaccaacactgaccaataaaaaaaaatgtgggttttttttttttttttttttttttttttttttttttttttttttttttttttttttttttttttttttttttttttttttttttttttttttttttttttttttttttttttttttttttcggggggcaggccttttgttccatcttggggggggggcacacccgcccccacttttctctcc

SEQ ID NO: 446176 - DNA, 1438 bp, Homo sapiens
cccacgcgtccggctgtccgggctgctttcgcctccgcctgtggatgctgcgcctctccgaacgcaacatgaaggtgctccttgccgccgccctcatcgcggggtccgtcttcttcctgctgctgccgggaccttctgcggccgatgagaagaagaaggggcccaaagtcaccgtcaaggtgtattttgacctacgaattggagatgaagatgtaggccgggtgatctttggtctcttcggaaagactgttccaaaaacagtggataattttgtggccttagctacaggagagaaaggatttggctacaaaaacagcaaattccatcgtgtaatcaaggacttcatgatccagggcggagacttcaccaggggagatggcacaggaggaaagagcatctacggtgagcgcttccccgatgagaacttcaaactgaagcactacgggcctggctgggtgagcatggccaacgcaggcaaagacaccaacggctcccagttcttcatcacgacagtcaagacagcctggctagatggcaagcatgtggtgtttggcaaagttctagagggcatggaggtggtgcggaaggtggagagcaccaagacagacagccgggataaacccctgaaggatgtgatcatcgcagactgcggcaagatcgaggtggagaagccctttgccatcgccaaggagtagggcacagggacatctttctttgagtgaccgtctgtgcaggccctgtagtccgccacagggctctgagctgcactggccccggtgctggcatctggtggagcggacccactcccctcacattccacaggcccatggactcacttttgtaacaaactcctaccaacactgaccaataaaaaaaaatgtgggtttttttttttttttaatgtgtgggcctggttcttgagcctgcagcacctcccctaggcctacatcccaacatgcctgcaactctcctgtggcaatgggtgcctgccccttccctgggatcctgcctgaaattttgacccaggagctacccaggaaaagtcaggcaggagcttttgccccctgcttctaaactttgccagctactgggcctccacatttgctccccttgccaccaccctccagtctatgttaagggatgtatctgtactttttcatagcctacctctaaattgatttttttttttttttttggtagagacaggtctcactatgttgcgctggctggtctcaaacttccagacccaagcatcctcctgccttggcctcctaaagtattgggattacaggcatgagctctgcacccagctgacttcttcctttattatttatttattttgagacggagtttcactcttgttgcccaggctggagtgcagtggcgcgatctcggctcaccacaacttccgcctcctggcttcaagagattctcctgc

SEQ ID NO: 446177 - DNA, 1118 bp, Homo sapiens
cccacgcgtccggctgtccgggctgctttcgcctccgcctgtggatgctgcgcctctccgaacgcaacatgaaggtgctccttgccgccgccctcatcgcggggtccgtcttcttcctgctgctgccgggaccttctgcggccgatgagaagaagaaggggcccaaagtcaccgtcaaggtgtattttgacctacgaattggagatgaagatgtaggccgggtgatctttggtctcttcggaaagactgttccaaaaacagtggataattttgtggccttagctacaggagagaaaggatttggctacaaaaacagcaaattccatcgtgtaatcaaggacttcatgatccagggcggagacttcaccaggggagatggcacaggaggaaagagcatctacggtgagcgcttccccgatgagaacttcaaactgaagcactacgggcctggctgggtgagcatggccaacgcaggcaaagacaccaacggctcccagttcttcatcacgacagtcaagacagcctggctagatggcaagcatgtggtgtttggcaaagttctagagggcatggaggtggtgcggaaggtggagagcaccaagacagacagccgggataaacccctgaaggatgtgatcatcgcagactgcggcaagatcgaggtggagaagccctttgccatcgccaaggagtagggcacagggacatctttctttgagtgaccgtctgtgcaggccctgtagtccgccacagggctctgagctgcactggccccggtgctggcatctggtggagcggacccactcccctcacattccacaggcccatggactcacttttgtaacaaactcctaccaacactgaccaataaaaaaaaatgtgggttttttttttttttttttttttttttttttttttttttttttttttttttttttttttttttttttttattttttttttaaacgcgcacttattgtatcgggggggaggggcgccgcgtggtcgcccccacggggggggaaaggggggggctcaacacaccaccctgtgcccccccccccgcggggggcgagaaaatcccccccgcgccgtggccccacaaaggagggcggacc

SEQ ID NO: 446178 - DNA, 1000 bp, Homo sapiens
cccacgcgtccggctgtccgggctgctttcgcctccgcctgtggatgctgcgcctctccgaacgcaacatgaaggtgctccttgccgccgccctcatcgcggggtccgtcttcttcctgctgctgccgggaccttctgcggccgatgagaagaagaaggggcccaaagtcaccgtcaaggtgtattttgacctacgaattggagatgaagatgtaggccgggtgatctttggtctcttcggaaagactgttccaaaaacagtggataattttgtggccttagctacaggagagaaaggatttggctacaaaaacagcaaattccatcgtgtaatcaaggacttcatgatccagggcggagacttcaccaggggagatggcacaggaggaaagagcatctacggtgagcgcttccccgatgagaacttcaaactgaagcactacgggcctggctgggtgagcatggccaacgcaggcaaagacaccaacggctcccagttcttcatcacgacagtcaagacagcctggctagatggcaagcatgtggtgtttggcaaagttctagagggcatggaggtggtgcggaaggtggagagcaccaagacagacagccgggataaacccctgaaggatgtgatcatcgcagactgcggcaagatcgaggtggagaagccctttgccatcgccaaggagtagggcacagggacatctttctttgagtgaccgtctgtgcaggccctgtagtccgccacagggctctgagctgcactggccccggtgctggcatctggtggagcggacccactcccctcacattccacaggcccatggactcacttttgtaacaaactcctaccaacactgaccaataaaaaaaaatgtgggttttttttttttttttttttttttttttttttttttttttttttgttttagggggttcatctgggagggaagaggggcagggcacccacgatgctgcaggtgaaacccaaaagtgg

SEQ ID NO: 446179 - DNA, 957 bp, Homo sapiens
cccacgcgtccggctgtccgggctgctttcgcctccgcctgtggatgctgcgcctctccgaacgcaacatgaaggtgctccttgccgccgccctcatcgcggggtccgtcttcttcctgctgctgccgggaccttctgcggccgatgagaagaagaaggggcccaaagtcaccgtcaaggtgtattttgacctacgaattggagatgaagatgtaggccgggtgatctttggtctcttcggaaagactgttccaaaaacagtggataattttgtggccttagctacaggagagaaaggatttggctacaaaaacagcaaattccatcgtgtaatcaaggacttcatgatccagggcggagacttcaccaggggagatggcacaggaggaaagagcatctacggtgagcgcttccccgatgagaacttcaaactgaagcactacgggcctggctgggtgagcatggccaacgcaggcaaagacaccaacggctcccagttcttcatcacgacagtcaagacagcctggctagatggcaagcatgtggtgtttggcaaagttctagagggcatggaggtggtgcggaaggtggagagcaccaagacagacagccgggataaacccctgaaggatgtgatcatcgcagactgcggcaagatcgaggtggagaagccctttgccatcgccaaggagtagggcacagggacatctttctttgagtgaccgtctgtgcaggccctgtagtccgccacagggctctgagctgcactggccccggtgctggcatctggtggagcggacccactcccctcacattccacaggcccatggactcacttttgtaacaaactcctaccaacactgaccaataaaaaaaaatgtgggtttttttttttttttttttttttttttttttttttttttttttgggggggggggggggggggggggggggggg

SEQ ID NO: 446180 - DNA, 973 bp, Homo sapiens
cccacgcgtccggctgtccgggctgctttcgcctccgcctgtggatgctgcgcctctccgaacgcaacatgaaggtgctccttgccgccgccctcatcgcggggtccgtcttcttcctgctgctgccgggaccttctgcggccgatgagaagaagaaggggcccaaagtcaccgtcaaggtgtattttgacctacgaattggagatgaagatgtaggccgggtgatctttggtctcttcggaaagactgttccaaaaacagtggataattttgtggccttagctacaggagagaaaggatttggctacaaaaacagcaaattccatcgtgtaatcaaggacttcatgatccagggcggagacttcaccaggggagatggcacaggaggaaagagcatctacggtgagcgcttccccgatgagaacttcaaactgaagcactacgggcctggctgggtgagcatggccaacgcaggcaaagacaccaacggctcccagttcttcatcacgacagtcaagacagcctggctagatggcaagcatgtggtgtttggcaaagttctagagggcatggaggtggtgcggaaggtggagagcaccaagacagacagccgggataaacccctgaaggatgtgatcatcgcagactgcggcaagatcgaggtggagaagccctttgccatcgccaaggagtagggcacagggacatctttctttgagtgaccgtctgtgcaggccctgtagtccgccacagggctctgagctgcactggccccggtgctggcatctggtggagcggacccactcccctcacattccacaggcccatggactcacttttgtaacaaactcctaccaacactgaccaataaaaaaaaatgtgggtttttttttttttttttttttttttttttttttttttttttttccccccaaaacccttttttttccgcgggtaaaaaaaaaactttata

SEQ ID NO: 446181 - DNA, 1033 bp, Homo sapiens
  misc_feature (910)..(910): n is a, c, g, or t
cccacgcgtccggctgtccgggctgctttcgcctccgcctgtggatgctgcgcctctccgaacgcaacatgaaggtgctccttgccgccgccctcatcgcggggtccgtcttcttcctgctgctgccgggaccttctgcggccgatgagaagaagaaggggcccaaagtcaccgtcaaggtgtattttgacctacgaattggagatgaagatgtaggccgggtgatctttggtctcttcggaaagactgttccaaaaacagtggataattttgtggccttagctacaggagagaaaggatttggctacaaaaacagcaaattccatcgtgtaatcaaggacttcatgatccagggcggagacttcaccaggggagatggcacaggaggaaagagcatctacggtgagcgcttccccgatgagaacttcaaactgaagcactacgggcctggctgggtgagcatggccaacgcaggcaaagacaccaacggctcccagttcttcatcacgacagtcaagacagcctggctagatggcaagcatgtggtgtttggcaaagttctagagggcatggaggtggtgcggaaggtggagagcaccaagacagacagccgggataaacccctgaaggatgtgatcatcgcagactgcggcaagatcgaggtggagaagccctttgccatcgccaaggagtagggcacagggacatctttctttgagtgaccgtctgtgcaggccctgtagtccgccacagggctctgagctgcactggccccggtgctggcatctggtggagcggacccactcccctcacattccacaggcccatggactcacttttgtaacaaactcctaccaacactgaccaataaaaaaaaatgtgggtttttttttttttttttttttttttntttttttttttttttggtgggtgggttttgtttgtttttttgggggtagggaaggggcttgtcttaactcagggtttccacaccctcgggggcagaaatgatcctccacccacgggtgccgag

SEQ ID NO: 446182 - DNA, 978 bp, Homo sapiens
cccacgcgtccggctgtccgggctgctttcgcctccgcctgtggatgctgcgcctctccgaacgcaacatgaaggtgctccttgccgccgccctcatcgcggggtccgtcttcttcctgctgctgccgggaccttctgcggccgatgagaagaagaaggggcccaaagtcaccgtcaaggtgtattttgacctacgaattggagatgaagatgtaggccgggtgatctttggtctcttcggaaagactgttccaaaaacagtggataattttgtggccttagctacaggagagaaaggatttggctacaaaaacagcaaattccatcgtgtaatcaaggacttcatgatccagggcggagacttcaccaggggagatggcacaggaggaaagagcatctacggtgagcgcttccccgatgagaacttcaaactgaagcactacgggcctggctgggtgagcatggccaacgcaggcaaagacaccaacggctcccagttcttcatcacgacagtcaagacagcctggctagatggcaagcatgtggtgtttggcaaagttctagagggcatggaggtggtgcggaaggtggagagcaccaagacagacagccgggataaacccctgaaggatgtgatcatcgcagactgcggcaagatcgaggtggagaagccctttgccatcgccaaggagtagggcacagggacatctttctttgagtgaccgtctgtgcaggccctgtagtccgccacagggctctgagctgcactggccccggtgctggcatctggtggagcggacccactcccctcacattccacaggcccatggactcacttttgtaacaaactcctaccaacactgaccaataaaaaaaaatgtgggtttttttttttttttttttttttttttttttttttttttttttttgggggggccccaaaaaaaaatttgttgttgggcgcaaccaacagggggg

SEQ ID NO: 446183 - DNA, 950 bp, Homo sapiens
cccacgcgtccggctgtccgggctgctttcgcctccgcctgtggatgctgcgcctctccgaacgcaacatgaaggtgctccttgccgccgccctcatcgcggggtccgtcttcttcctgctgctgccgggaccttctgcggccgatgagaagaagaaggggcccaaagtcaccgtcaaggtgtattttgacctacgaattggagatgaagatgtaggccgggtgatctttggtctcttcggaaagactgttccaaaaacagtggataattttgtggccttagctacaggagagaaaggatttggctacaaaaacagcaaattccatcgtgtaatcaaggacttcatgatccagggcggagacttcaccaggggagatggcacaggaggaaagagcatctacggtgagcgcttccccgatgagaacttcaaactgaagcactacgggcctggctgggtgagcatggccaacgcaggcaaagacaccaacggctcccagttcttcatcacgacagtcaagacagcctggctagatggcaagcatgtggtgtttggcaaagttctagagggcatggaggtggtgcggaaggtggagagcaccaagacagacagccgggataaacccctgaaggatgtgatcatcgcagactgcggcaagatcgaggtggagaagccctttgccatcgccaaggagtagggcacagggacatctttctttgagtgaccgtctgtgcaggccctgtagtccgccacagggctctgagctgcactggccccggtgctggcatctggtggagcggacccactcccctcacattccacaggcccatggactcacttttgtaacaaactcctaccaacactgaccaataaaaaaaaatgtgggttttttttttttttttttttttttttttttttttttttttatgggaatttttccattttttttaaa

SEQ ID NO: 446184 - DNA, 971 bp, Homo sapiens
cccacgcgtccggctgtccgggctgctttcgcctccgcctgtggatgctgcgcctctccgaacgcaacatgaaggtgctccttgccgccgccctcatcgcggggtccgtcttcttcctgctgctgccgggaccttctgcggccgatgagaagaagaaggggcccaaagtcaccgtcaaggtgtattttgacctacgaattggagatgaagatgtaggccgggtgatctttggtctcttcggaaagactgttccaaaaacagtggataattttgtggccttagctacaggagagaaaggatttggctacaaaaacagcaaattccatcgtgtaatcaaggacttcatgatccagggcggagacttcaccaggggagatggcacaggaggaaagagcatctacggtgagcgcttccccgatgagaacttcaaactgaagcactacgggcctggctgggtgagcatggccaacgcaggcaaagacaccaacggctcccagttcttcatcacgacagtcaagacagcctggctagatggcaagcatgtggtgtttggcaaagttctagagggcatggaggtggtgcggaaggtggagagcaccaagacagacagccgggataaacccctgaaggatgtgatcatcgcagactgcggcaagatcgaggtggagaagccctttgccatcgccaaggagtagggcacagggacatctttctttgagtgaccgtctgtgcaggccctgtagtccgccacagggctctgagctgcactggccccggtgctggcatctggtggagcggacccactcccctcacattccacaggcccatggactcacttttgtaacaaactcctaccaacactgaccaataaaaaaaaatgtgggtttttttttttttttttttttttttttttttttttttaaaaaccccccccaaaaattcccccgggacaagggtccaccggccacaaa

SEQ ID NO: 446185 - DNA, 1311 bp, Homo sapiens
ccacgcgtcggagcatctacggtgaaggcgcttcccctgctttcgcctccgcctgtggatgctgcgcctctccgaacgcaacatgaaggtgctccttgccgccgccctcatcgcggggtccgtcttcttcctgctgctgccgggaccttctgcggccgatgagaagaagaaggggcccaaagtcaccgtcaaggtgtattttgacctacgaattggagatgaagatgtaggccgggtgatctttggtctcttcggaaagactgttccaaaaacagtggataattttgtggccttagctacaggagagaaaggatttggctacaaaaacagcaaattccatcgtgtaatcaaggacttcatgatccagggcggagacttcaccaggggagatggcacaggaggaaagagcatctacggtgagcgcttccccgatgagaacttcaaactgaagcactacgggcctggctgggtgagcatggccaacgcaggcaaagacaccaacggctcccagttcttcatcacgacagtcaagacagcctggctagatggcaagcatgtggtgtttggcaaagttctagagggcatggaggtggtgcggaaggtggagagcaccaagacagacagccgggataaacccctgaaggatgtgatcatcgcagactgcggcaagatcgaggtggagaagccctttgccatcgccaaggagtagggcacagggacatctttctttgagtgaccgtctgtgcaggccctgtagtccgccacagggctctgagctgcactggccccggtgctggcatctggtggagcggacccactcccctcacattccacaggcccatggactcacttttgtaacaaacttctacaaactgaccaaaaaaaaaaaaaaaaaaaaaaaaaaaaaaacttgggggcgcgcgcgccactgcggcccccgcgaaaaacgtttcagaaaacaccacgcgcggggggcgcgcgcgcgggcccaggtcgggaaagcacaacggggcccaaacggcggctccaaggaaaaccggggccaagaaaaaggcgggaggaagattatcccaccacccactataaaaaacgcgcccgccgggggggcggcccacacgcgcgagagggtctctgcaggagaacaacacaaacttccccagagagagtgggagagttccgcgggaggggggcccacaacaccagcggggggacactctcattaaccaagagaggggggacgcccacacaaagaggagaagccccgcacataccccaaacatttagaggccccgccgcgagggcggggggcaa

SEQ ID NO: 446186 - DNA, 824 bp, Homo sapiens
tcctcctcctgctgctgtcctcctcctgctgctgtcctcctcctgctgctgccgggaccttctgcggccgatgagaagaagaaggggcccaaagtcaccgtcaaggtgtattttgacctacgaattggagatgaagatgtaggccgggtgatctttggtctcttcggaaagactgttccaaaaacagtggataattttgtggccttagctacaggagagaaaggatttggctacaaaaacagcaaattccatcgtgtaatcaaggacttcatgatccagggcggagacttcaccaggggagatggcacaggaggaaagagcatctacggtgagcgcttccccgatgagaacttcaaactgaagcactacgggcctggctgggtgagcatggccaacgcaggcaaagacaccaacggctcccagttcttcatcacgacagtcaagacagcctggctagatggcaagcatgtggtgtttggcaaagttctagagggcatggaggtggtgcggaaggtggagagcaccaagacagacagccgggataaacccctgaaggatgtgatcatcgcagactgcggcaagatcgaggtggagaagccctttgccatcgccaaggagtagggcacagggacatctttctttgagtgaccgtctgtgcaggccctgtagtccgccacagggctctgagctgcactggccccggtgctggcatctggtggagcggacccactcccctcacattccacaggcccatggactcacttttgtaacaaactcctaccaacactgaccaataaaaaaaaatgtgggtttttttttttttt

SEQ ID NO: 446187 - DNA, 798 bp, Homo sapiens
ccacgcgtcggagcatctacggtgaaggcgcttcccctgctttcgcctccgcctgtggatgctgcgcctctccgaacgcaacatgaaggtgctccttgccgccgccctcatcgcggggtccgtcttcttcctgctgctgccgggaccttctgcggccgatgagaagaagaaggggcccaaagtcaccgtcaagaaaggatttggctacaaaaacagcaaattccatcgtgtaatcaaggacttcatgatccagggcggagacttcaccaggggagatggcacaggaggaaagagcatctacggtgagcgcttccccgatgagaacttcaaactgaagcactacgggcctggctgggtgagcatggccaacgcaggcaaagacaccaacggctcccagttcttcatcacgacagtcaagacagcctggctagatggcaagcatgtggtgtttggcaaagttctagagggcatggaggtggtgcggaaggtggagagcaccaagacagacagccgggataaacccctgaaggatgtgatcatcgcagactgcggcaagatcgaggtggagaagccctttgccatcgccaaggagtagggcacagggacatctttctttgagtgaccgtctgtgcaggccctgtagtccgccacagggctctgagctgcactggccccggtgctggcatctggtggagcggacccactcccctcacattccacaggcccatggactcacttttgtaacaaactcctaccaacactgaccaataaaaaaaaatgtgggtttttttttttttt

SEQ ID NO: 446188 - DNA, 842 bp, Homo sapiens
ccacgcgtcggagcatctacggtgaaggcgcttcccctgctttcgcctccgcctgtggatgctgcgcctctccgaacgcaacatgaaggtgctccttgccgccgccctcatcgcggggtccgtcttcttcctgctgctgccgggaccttctgcggccgatgagaagaagaaggggcccaaagtcaccgtcaaggtgtattttgacctacgaattggagatgaagatgtaggccgggtgatctttggtctcttcggaaagactgttccaaaaacagtggataattttgtggccttagctacaggagagtcaccaggggagatggcacaggaggaaagagcatctacggtgagcgcttccccgatgagaacttcaaactgaagcactacgggcctggctgggtgagcatggccaacgcaggcaaagacaccaacggctcccagttcttcatcacgacagtcaagacagcctggctagatggcaagcatgtggtgtttggcaaagttctagagggcatggaggtggtgcggaaggtggagagcaccaagacagacagccgggataaacccctgaaggatgtgatcatcgcagactgcggcaagatcgaggtggagaagccctttgccatcgccaaggagtagggcacagggacatctttctttgagtgaccgtctgtgcaggccctgtagtccgccacagggctctgagctgcactggccccggtgctggcatctggtggagcggacccactcccctcacattccacaggcccatggactcacttttgtaacaaactcctaccaacactgaccaataaaaaaaaatgtgggtttttttttttttt

SEQ ID NO: 446189 - DNA, 2080 bp, Homo sapiens
  misc_feature (982)..(982): n is a, c, g, or t
  misc_feature (986)..(986): n is a, c, g, or t
  misc_feature (988)..(988): n is a, c, g, or t
tccgctcgccttctcccgttgccctctgctttccttcctctccttcttgcctcctcttcctttgtcttcctctccctcgtggtcttctctcacttctcttctttcttctcctcttccttttctctctctcctcccctccctctccgtcttctctctctcctctctcctctctctttcctcccttctcttcttcctccctgtctcttctggtcgcttctgttctttcttctctctcgtttttcgctttggtttcttccgtgctgttgtcttgtctgtcgctcttcttctgtggtcggcttgttggtgctttgctgctcgctttcggcttcggttctgtgtctcccgtggtttttgttggctgcctcgcctcgccggtctcgctgtctatatctttttttttttttctttttgtttcttctcgttcttctccgtgtttatgtctccacacgtctcttttgtcttctggcggcgtgctgcggttctgctgattctcgcccctcgtttctgttttgttcaccccccgctgtttgtgtcgccccctctgcgccagtgttcttttgtctagttttcttccccctctcttctgaggccctcgttgtatgtttgtctcgttatctggggtatgctgtttgctgctgccctttcttgtgtgtcgctcctccctcgcccgcgtcgttttttgtgggtttccctccctgctcccgatgttgttgtccctcgtccgctgtggctcccactcggtttttcccccaccgtgcgtctgctacctctttgttgttgtactgcgcgcgccctcccgctccgcctctaccgtctttattattctctcgtgccctcccttatttggggcgctcccccgttgtgtcctacaaaatttcgctggtggctactccgcttatctcctttgggctcccccccttctctggggttggagatcctttttgtgcgcggcccccccccttttttgtttttttttttgttntttntntttttttttttcactcacagctgtcttttattcctgttcattccttgttaagaggctttgactctccagaatccaaggggcagcccctcttttctgcccctccccacacatctctggctgctttctcctctgcagctatgcctgtgtcttttgtgctcataggaaaacaggctggtcagccacagcagtcctccttttctggagagttccgaccctgttgactcccctgcatcctgcacggcacttccctccaccaaagtccctccgtggcaggcctgggccatagctaaggggagctgataacatgcgccttatttaaaagccacaaaactatcttctcaaagtaatccttctgtgagctgttcaccacatcagcctggcctgatgccccacttggcctcagtcagcatggcttggctctgaggccagaagataggaaggacgctgcttttatgtccttgtagtccactccagcctagcctggcacagaggacaggttaagccccctcagtcctggccccgaatgtctgcttggtttggcgcaatccagcgcccctgacctgctctgtcttttttcccaggaaagagcatctacggtgagcgcttccccgatgagaacttcaaactgaagcactacgggcctggctgggtgagcatggccaacgcaggcaaagacaccaacggctcccagttcttcatcacgacagtcaagacagcctggctagatggcaagcatgtggtgtttggcaaagttctagagggcatggaggtggtgcggaaggtggagagcaccaagacagacagccgggataaacccctgaaggatgtgatcatcgcagactgcggcaagatcgaggtggagaagccctttgccatcgccaaggagtagggcacagggacatctttctttgagtgaccgtctgtgcaggccctgtagtccgccacagggctctgagctgcactggccccggtgctggcatctggtggagcggacccactcccctcacattccacaggcccatggactcacttttgtaacaaactcctaccaacactgaccaataaaaaaaaatgtgggtttttttttttttt

SEQ ID NO: 446190 - DNA, 975 bp, Homo sapiens
  misc_feature (458)..(458): n is a, c, g, or t
  misc_feature (535)..(535): n is a, c, g, or t
ccacgcgtcggagcatctacggtgaaggcgcttcccctgctttcgcctccgcctgtggatgctgcgcctctccgaacgcaacatgaaggtgctccttgccgccgccctcatcgcggggtccgtcttcttcctgctgctgccgggaccttctgcggccgatgagaagaagaaggggcccaaagtcaccgtcaaggtgtattttgacctacgaattggagatgaagatgtaggccgggtgatctttggtctcttcggaaagactgttccaaaaacagtggataattttgtggccttagctacaggagagaaaggatttggctacaaaaacagcaaattccatcgtgtaatcaaggacttcatgatccagggcggagacttcaccaggggagatggcacaggaggaaagagcatctacggtgagcgcttccccgatgagaacttcaaactgaagcactacngggccccttggggcttggggggttggaaggccatttggggccccaaaacgggccaaggggccaaaaaaggaaacaanccaaaaacgggggcttcccccccaagcaacggctcccagttcttcatcacgacagtcaagacagcctggctagatggcaagcatgtggtgtttggcaaagttctagagggcatggaggtggtgcggaaggtggagagcaccaagacagacagccgggataaacccctgaaggatgtgatcatcgcagactgcggcaagatcgaggtggagaagccctttgccatcgccaaggagtagggcacagggacatctttctttgagtgaccgtctgtgcaggccctgtagtccgccacagggctctgagctgcactggccccggtgctggcatctggtggagcggacccactcccctcacattccacaggcccatggactcacttttgtaacaaactcctaccaacactgaccaataaaaaaaaatgtgggtttttttttttttt

SEQ ID NO: 446191 - DNA, 989 bp, Homo sapiens
  misc_feature (951)..(952): n is a, c, g, or t
  misc_feature (954)..(954): n is a, c, g, or t
  misc_feature (956)..(956): n is a, c, g, or t
ccacgcgtcggagcatctacggtgaaggcgcttcccctgctttcgcctccgcctgtggatgctgcgcctctccgaacgcaacatgaaggtgctccttgccgccgccctcatcgcggggtccgtcttcttcctgctgctgccgggaccttctgcggccgatgagaagaagaaggggcccaaagtcaccgtcaaggtgtattttgacctacgaattggagatgaagatgtaggccgggtgatctttggtctcttcggaaagactgttccaaaaacagtggataattttgtggccttagctacaggagagaaaggatttggctacaaaaacagcaaattccatcgtgtaatcaaggacttcatgatccagggcggagacttcaccaggggagatggcacaggaggaaagagcatctacggtgagcgcttccccgatgagaacttcaaactgaagcactacgggcctggctgggtgagcatggccaacgcaggcaaagacaccaacggctcccagttcttcatcacgacagtcaagacagcctggctagatggcaagcatgtggtgtttggcaaagttctagagggcatggaggtggtgcggaaggtggagagcaccaagacagacagccgggataaacccctgaaggatgtgatcatcgcagactgcggcaagatcgaggtggagaagccctttgccatcgccaaggagtagggcacagggacatctttctttgagtgaccgtctgtgcaggccctgtagtccgccacagggctctgagctgcactggccccggtgctggcatctggtggagcggacccactcccctcacattccacaggcccatggactcacttttgtaacaaactcctaccaacactgaccaataaaaaaaaatgtgggttttttttttttttttttttttttttttttttttttttttttttttttttgtnngngngggggggggggggggggagtgggaggggggggg

SEQ ID NO: 446192 - DNA, 912 bp, Homo sapiens; identical to SEQ ID NO: 446172

SEQ ID NO: 446193 - DNA, 2736 bp, Homo sapiens
  misc_feature (982)..(982): n is a, c, g, or t
  misc_feature (986)..(986): n is a, c, g, or t
  misc_feature (988)..(988): n is a, c, g, or t
  misc_feature (2698)..(2699): n is a, c, g, or t
  misc_feature (2701)..(2701): n is a, c, g, or t
  misc_feature (2703)..(2703): n is a, c, g, or t
tccgctcgccttctcccgttgccctctgctttccttcctctccttcttgcctcctcttcctttgtcttcctctccctcgtggtcttctctcacttctcttctttcttctcctcttccttttctctctctcctcccctccctctccgtcttctctctctcctctctcctctctctttcctcccttctcttcttcctccctgtctcttctggtcgcttctgttctttcttctctctcgtttttcgctttggtttcttccgtgctgttgtcttgtctgtcgctcttcttctgtggtcggcttgttggtgctttgctgctcgctttcggcttcggttctgtgtctcccgtggtttttgttggctgcctcgcctcgccggtctcgctgtctatatctttttttttttttctttttgtttcttctcgttcttctccgtgtttatgtctccacacgtctcttttgtcttctggcggcgtgctgcggttctgctgattctcgcccctcgtttctgttttgttcaccccccgctgtttgtgtcgccccctctgcgccagtgttcttttgtctagttttcttccccctctcttctgaggccctcgttgtatgtttgtctcgttatctggggtatgctgtttgctgctgccctttcttgtgtgtcgctcctccctcgcccgcgtcgttttttgtgggtttccctccctgctcccgatgttgttgtccctcgtccgctgtggctcccactcggtttttcccccaccgtgcgtctgctacctctttgttgttgtactgcgcgcgccctcccgctccgcctctaccgtctttattattctctcgtgccctcccttatttggggcgctcccccgttgtgtcctacaaaatttcgctggtggctactccgcttatctcctttgggctcccccccttctctggggttggagatcctttttgtgcgcggcccccccccttttttgtttttttttttgttntttntntttttttttttcactcacagctgtcttttattcctgttcattccttgttaagaggctttgactctccagaatccaaggggcagcccctcttttctgcccctccccacacatctctggctgctttctcctctgcagctatgcctgtgtcttttgtgctcataggaaaacaggctggtcagccacagcagtcctccttttctggagagttccgaccctgttgactcccctgcatcctgcacggcacttccctccaccaaagtccctccgtggcaggcctgggccatagctaaggggagctgataacatgcgccttatttaaaagccacaaaactatcttctcaaagtaatccttctgtgagctgttcaccacatcagcctggcctgatgccccacttggcctcagtcagcatggcttggctctgaggccagaagataggaaggacgctgcttttatgtccttgtagtccactccagcctagcctggcacagaggacaggttaagccccctcagtcctggccccgaatgtctgcttggtttggcgcaatccagcgcccctgacctgctctgtcttttttcccaggaaagagcatctacggtgagcgcttccccgatgagaacttcaaactgaagcactacgggcctggctgggtgagcatggccaacgcaggcaaagacaccaacggctcccagttcttcatcacgacagtcaagacagcctggctagatggcaagcatgtggtgtttggcaaagttctagagggcatggtgagttgtggaagcaagggctactactgggcaatcctcaccggggattcaacacagaccccagggcaggagctccatgtgtccatccctttcccaaaaggacccaacccacagatgcagcccagtgctcctgtccagaataaaccctgtacctccatgcctccaaggttctaaattcttccagccccctcagagcccagccaggaaggctgcacaactgccagagcctccctcccctccttcactcagtgacgtgctggtcccacccctgaggtatacagagtgcagctgaacgcaatgtccctgagaagccacatgccctggtcaccctcttcctcctcctcacccttggcccaacctgggtcttacttcaaaggaacaaaattcctgtaccccctcgtcaaatctgcattctccctgctctggccaggagtctgttagaattttggtgcctccagttttgagtgctgttgatcacttgtgggtcttagccctcctgagccatacgctggggcctttctcctgagcggtggacctcctgatccaccatgccctcctacttccacctttcttttccaggaggtggtgcggaaggtggagagcaccaagacagacagccgggataaacccctgaaggatgtgatcatcgcagactgcggcaagatcgaggtggagaagccctttgccatcgccaaggagtagggcacagggacatctttctttgagtgaccgtctgtgcaggccctgtagtccgccacagggctctgagctgcactggccccggtgctggcatctggtggagcggacccactcccctcacattccacaggcccatggactcacttttgtaacaaactcctaccaacactgaccaataaaaaaaaatgtgggttttttttttttttttttttttttttttttttttttttttttttttttttgtnngngngggggggggggggggggagtgggaggggggggg

SEQ ID NO: 446194 - DNA, 504 bp, Homo sapiens
  misc_feature (466)..(467): n is a, c, g, or t
  misc_feature (469)..(469): n is a, c, g, or t
  misc_feature (471)..(471): n is a, c, g, or t
aaaaaaaaaaaaaaaaaaaaaaaaaaaaaaaaaaaaaaaaaaaacccacatttttttttattggcaagcatgtggtgtttggcaaagttctagagggcatggaggtggtgcggaaggtggagagcaccaagacagacagccgggataaacccctgaaggatgtgatcatcgcagactgcggcaagatcgaggtggagaagccctttgccatcgccaaggagtagggcacagggacatctttctttgagtgaccgtctgtgcaggccctgtagtccgccacagggctctgagctgcactggccccggtgctggcatctggtggagcggacccactcccctcacattccacaggcccatggactcacttttgtaacaaactcctaccaacactgaccaataaaaaaaaatgtgggttttttttttttttttttttttttttttttttttttttttttttttttttgtnngngngggggggggggggggggagtgggaggggggggg

SEQ ID NO: 446195 - DNA, 1547 bp, Homo sapiens
ccacgcgtcggagcatctacggtgaaggcgcttcccctgctttcgcctccgcctgtggatgctgcgcctctccgaacgcaacatgaaggtgctccttgccgccgccctcatcgcggggtccgtcttcttcctgctgctgccgggaccttctgcggccgatgagaagaagaaggggcccaaagtcaccgtcaaggtgtattttgacctacgaattggagatgaagatgtaggccgggtgatctttggtctcttcggaaagactgttccaaaaacagtggataattttgtggccttagctacaggagagaaaggatttggctacaaaaacagcaaattccatcgtgtaatcaaggacttcatgatccagggcggagacttcaccaggggagatggcacaggaggaaagagcatctacggtgagcgcttccccgatgagaacttcaaactgaagcactacgggcctggctgggtgagcatggccaacgcaggcaaagacaccaacggctcccagttcttcatcacgacagtcaagacagcctggctagatggcaagcatgtggtgtttggcaaagttctagagggcatggtgagttgtggaagcaagggctactactgggcaatcctcaccggggattcaacacagaccccagggcaggagctccatgtgtccatccctttcccaaaaggacccaacccacagatgcagcccagtgctcctgtccagaataaaccctgtacctccatgcctccaaggttctaaattcttccagccccctcagagcccagccaggaaggctgcacaactgccagagcctccctcccctccttcactcagtgacgtgctggtcccacccctgaggtatacagagtgcagctgaacgcaatgtccctgagaagccacatgccctggtcaccctcttcctcctcctcacccttggcccaacctgggtcttacttcaaaggaacaaaattcctgtaccccctcgtcaaatctgcattctccctgctctggccaggagtctgttagaattttggtgcctccagttttgagtgctgttgatcacttgtgggtcttagccctcctgagccatacgctggggcctttctcctgagcggtggacctcctgatccaccatgccctcctacttccacctttcttttccaggaggtggtgcggaaggtggagagcaccaagacagacagccgggataaacccctgaaggatgtgatcatcgcagactgcggcaagatcgaggtggagaagccctttgccatcgccaaggagtagggcacagggacatctttctttgagtgaccgtctgtgcaggccctgtagtccgccacagggctctgagctgcactggccccggtgctggcatctggtggagcggacccactcccctcacattccacaggcccatggactcacttttgtaacaaactcctaccaacactgaccaataaaaaaaaatgtgggttttttttttttttttttttttttttttttggggtccggggccggatttgggtatcgggggcctaggggt

SEQ ID NO: 446196 - DNA, 369 bp, Homo sapiens
  misc_feature (24)..(24): n is a, c, g, or t
  misc_feature (29)..(29): n is a, c, g, or t
  misc_feature (331)..(332): n is a, c, g, or t
  misc_feature (334)..(334): n is a, c, g, or t
  misc_feature (336)..(336): n is a, c, g, or t
atgatctagagtcatccccatcgnaggtngtcatcgcagactgcggcaagatcgaggtggagaagccctttgccatcgccaaggagtagggcacagggacatctttctttgagtgaccgtctgtgcaggccctgtagtccgccacagggctctgagctgcactggccccggtgctggcatctggtggagcggacccactcccctcacattccacaggcccatggactcacttttgtaacaaactcctaccaacactgaccaataaaaaaaaatgtgggttttttttttttttttttttttttttttttttttttttttttttttttttgtnngngngggggggggggggggggagtgggaggggggggg

SEQ ID NO: 446197 - DNA, 888 bp, Homo sapiens
ccacgcgtcggagcatctacggtgaaggcgcttcccctgctttcgcctccgcctgtggatgctgcgcctctccgaacgcaacatgaaggtgctccttgccgccgccctcatcgcggggtccgtcttcttcctgctgctgccgggaccttctgcggccgatgagaagaagaaggggcccaaagtcaccgtcaaggtgtattttgacctacgaattggagatgaagatgtaggccgggtgatctttggtctcttcggaaagactgttccaaaaacagtggataattttgtggccttagctacaggagagaaaggatttggctacaaaaacagcaaattccatcgtgtaatcaaggacttcatgatccagggcggagacttcaccaggggagatggcacaggaggaaagagcatctacggtgagcgcttccccgatgagaacttcaaactgaagcactacgggcctggctgggtgagcatggccaacgcaggcaaagacaccaacggctcccagttcttcatcacgacagtcaagacagcctggctagatgaccattaacaacaactgtgggttcccttcttaccactactagaccaagcgcaccacacgatcacaaacaaccactttttcgcgggccgcgtggggctccggagaaaagtttcctttagaacactctcgttgggcggcggcggccccactgtggtatagcgacctggcgcacaaggtgtctccagaagcactcggggtcagaaacggggtgggcttccccccataaaaacggcgcgggacgccgggttggaaccaccgaggggctcgggcatggcttcacggggccgggtcaataccgcgcggcggttgaggatcaacaacacatataattcactcctacg

SEQ ID NO: 446198 - DNA, 302 bp, Homo sapiens
gacggagtgatgctgcggtgttctagaggatcccggcaccattgtgctggcatctggtggagcggacccactcccctcacattccacaggcccatggactcacttttgtaacaaactcctaccaacactgaccaataaaaaaaaatgtgggttttttttttttttttttttttttttttttttttttttttttttttttttttttttttttttttttttttttttttttttttttttttttttttttttgtgtggggggggggggagcctcctcaccccccccacacaccccccccccctga

SEQ ID NO: 446199 - DNA, 458 bp, Homo sapiens
ccacgcgtcggagcatctacggtgaaggcgcttcccctgctttcgcctccgcctgtggatgctgcgcctctccgaacgcaacatgaaggtgctccttgccgccgccctcatcgcggggtccgtcttcttcctgctgctgccgggaccttctgcggccgatgagaagaagaaggggcccaaagtcaccgtcaagcggggaaaacaacgggggggggcggggggggccccccccaaaaaacacgtcaccgtcaaggtgtattttgacctacgaattggagatgaagatgtaggccgggtgatctttggtctcttcggaaagactgttccaaaagttgttcctgtgaaagccaagaacgtggctgaggatggagatgaagatgaggaagctgagtcagctacggccaagcgggcagctgaagatgatgaggatgacgatgtcgataccaagaagcaggaag

SEQ ID NO: 446200 - DNA, 460 bp, Homo sapiens
ctcgggttgacaacggctctcgggttgacaacggctctcgggttgacaacggctcccagttcttcatcacgacagtcaagacagcctggctagatggcaagcatgtggtgtttggcaaagttctagagggcatggaggtggtgcggaaggtggagagcaccaagacagacagccgggataaacccctgaaggatgtgatcatcgcagactgcggcaagatcgaggtggagaagccctttgccatcgccaaggagtagggcacagggacatctttctttgagtgaccgtctgtgcaggccctgtagtccgccacagggctctgagctgcactggccccggtgctggcatctggtggagcggacccactcccctcacattccacaggcccatggactcacttttgtaacaaactcctaccaacactgaccaataaaaaaaaatgtgggtttttttttttttt

SEQ ID NO: 446201 - DNA, 467 bp, Homo sapiens
gcctactactactaaattcgcggccgcgtcgacgccaacgcaggcaaagacaccaacggctcccagttcttcatcacgacagtcaagacagcctggctagatggcaagcatgtggtgtttggcaaagttctagagggcatggaggtggtgcggaaggtggagagcaccaagacagacagccgggataaacccctgaaggatgtgatcatcgcagactgcggcaagatcgaggtggagaagccctttgccatcgccaaggagtagggcacagggacatctttctttgagtgaccgtctgtgcaggccctgtagtccgccacagggctctgagctgcactggccccggtgctggcatctggtggagcggacccactcccctcacattccacaggcccatggactcacttttgtaacaaactcctaccaacactgaccaataaaaaaaaatgtgggtttttttttttttt

SEQ ID NO: 446202 - DNA, 898 bp, Homo sapiens
cccacgcgtccggctgtccgggctgctttcgcctccgcctgtggatgctgcgcctctccgaacgcaacatgaaggtgctccttgccgccgccctcatcgcggggtccgtcttcttcctgctgctgccgggaccttctgcggccgatgagaagaagaaggggcccaaagtcaccgtcaaggtgtattttgacctacgaattggagatgaagatgtaggccgggtgatctttggtctcttcggaaagactgttccaaaaacagtggataattttgtggccttagctacaggagagaaaggatttggctacaaaaacagcaaattccatcgtgtaatcaaggacttcatgatccagggcggagacttcaccaggggagatggcacaggaggaaagagcatctacggtgagcgcttccccgatgagaacttcaaactgaagcactacgggcctggctgggtgagcatggccaacgcaggcaaagacaccaacggctcccagttcttcatcacgacagtcaagacagcctggctagatggcaagcatgtggtgtttggcaaagttctagagggcatggaggtggtgcggaaggtggagagcaccaagacagacagccgggataaacccctgaaggatgtgatcatcgcagactgcggcaagatcgaggtggagaagccctttgccatcgccaaggagtagggcacagggacatctttctttgagtgaccgtctgtgcaggccctgtagtccgccacagggctctgagctgcactggccccggtgctggcatctggtggagcggacccactcccctcacattccacaggcccatggactcacttttgtaacaaactcctaccaacactgaccaataaaaaaaaatgtgggtttttttttttttt

SEQ ID NO: 446203 - DNA, 1237 bp, Homo sapiens
cccacgcgtccggctgtccgggctgctttcgcctccgcctgtggatgctgcgcctctccgaacgcaacatgaaggtgctccttgccgccgccctcatcgcggggtccgtcttcttcctgctgctgccgggaccttctgcggccgatgagaagaagaaggggcccaaagtcaccgtcaaggtgtattttgacctacgaattggagatgaagatgtaggccgggtgatctttggtctcttcggaaagactgttccaaaaacagtggataattttgtggccttagctacaggagagaaaggatttggctacaaaaacagcaaattccatcgtgtaatcaaggacttcatgatccagggcggagacttcaccaggggagatggcacaggaggaaagagcatctacggtgagcgcttccccgatgagaacttcaaactgaagcactacgggcctggctgggtgagcatggccaacgcaggcaaagacaccaacggctcccagttcttcatcacgacagtcaagacagcctggctagatggcaagcatgtggtgtttggcaaagttctagagggcatggaggtggtgcggaaggtggagagcaccaagacagacagccgggataaacccctgaaggatgtgatcatcgcagactgcggcaagatcgaggtggagaagccctttgccatcgccaaggagtagggcacagggacatctttctttgagtgaccgtctgtgcaggccctgtagtccgccacagggctctgagctgcactggccccggtgctggcatctggtggagcggacccactcccctcacattccacaggcccatggactcacttttgtaacaaactcctaccaacactgaccaataaaaaaaaatgtgggttttttttttttttaaaaaaaaaaaaaaaaaaaaaaaaaaaaaaaaaaaaaaaaaaaaaaaaaaaaaaaaaaaaaaaaaaaaaaaaaaaaaaaaataactaacgcacacagcaaaggaaaagaaagaacaagcaactggccaaaaacacagaacacagagacaccaaaaaagagggggggggggcacaaaacacagcacacagagagcggggcaaggatacacccaccaagcaccataggagagagggacagacaacacgcagggggacaactaaaagcggcagcgcgggcgaacaacacgtaggggaggacaaaaggagaggagggagagggggaaacacacccggggcgaa

SEQ ID NO: 446204 - DNA, 975 bp, Homo sapiens
  misc_feature (937)..(938): n is a, c, g, or t
  misc_feature (940)..(940): n is a, c, g, or t
  misc_feature (942)..(942): n is a, c, g, or t
cccacgcgtccggctgtccgggctgctttcgcctccgcctgtggatgctgcgcctctccgaacgcaacatgaaggtgctccttgccgccgccctcatcgcggggtccgtcttcttcctgctgctgccgggaccttctgcggccgatgagaagaagaaggggcccaaagtcaccgtcaaggtgtattttgacctacgaattggagatgaagatgtaggccgggtgatctttggtctcttcggaaagactgttccaaaaacagtggataattttgtggccttagctacaggagagaaaggatttggctacaaaaacagcaaattccatcgtgtaatcaaggacttcatgatccagggcggagacttcaccaggggagatggcacaggaggaaagagcatctacggtgagcgcttccccgatgagaacttcaaactgaagcactacgggcctggctgggtgagcatggccaacgcaggcaaagacaccaacggctcccagttcttcatcacgacagtcaagacagcctggctagatggcaagcatgtggtgtttggcaaagttctagagggcatggaggtggtgcggaaggtggagagcaccaagacagacagccgggataaacccctgaaggatgtgatcatcgcagactgcggcaagatcgaggtggagaagccctttgccatcgccaaggagtagggcacagggacatctttctttgagtgaccgtctgtgcaggccctgtagtccgccacagggctctgagctgcactggccccggtgctggcatctggtggagcggacccactcccctcacattccacaggcccatggactcacttttgtaacaaactcctaccaacactgaccaataaaaaaaaatgtgggttttttttttttttttttttttttttttttttttttttttttttttttttgtnngngngggggggggggggggggagtgggaggggggggg

SEQ ID NO: 446205 - DNA, 1600 bp, Homo sapiens
  misc_feature (1272)..(1272): n is a, c, g, or t
  misc_feature (1310)..(1310): n is a, c, g, or t
  misc_feature (1313)..(1313): n is a, c, g, or t
  misc_feature (1320)..(1320): n is a, c, g, or t
  misc_feature (1339)..(1339): n is a, c, g, or t
  misc_feature (1350)..(1350): n is a, c, g, or t
  misc_feature (1362)..(1362): n is a, c, g, or t
  misc_feature (1365)..(1365): n is a, c, g, or t
  misc_feature (1369)..(1369): n is a, c, g, or t
  misc_feature (1374)..(1374): n is a, c, g, or t
  misc_feature (1377)..(1377): n is a, c, g, or t
  misc_feature (1379)..(1380): n is a, c, g, or t
  misc_feature (1383)..(1383): n is a, c, g, or t
  misc_feature (1387)..(1388): n is a, c, g, or t
  misc_feature (1401)..(1401): n is a, c, g, or t
  misc_feature (1404)..(1404): n is a, c, g, or t
  misc_feature (1414)..(1414): n is a, c, g, or t
  misc_feature (1423)..(1423): n is a, c, g, or t
  misc_feature (1425)..(1425): n is a, c, g, or t
  misc_feature (1428)..(1428): n is a, c, g, or t
  misc_feature (1431)..(1431): n is a, c, g, or t
  misc_feature (1440)..(1440): n is a, c, g, or t
  misc_feature (1448)..(1448): n is a, c, g, or t
  misc_feature (1454)..(1454): n is a, c, g, or t
cccacgcgtccggctgtccgggctgctttcgcctccgcctgtggatgctgcgcctctccgaacgcaacatgaaggtgctccttgccgccgccctcatcgcggggtccgtcttcttcctgctgctgccgggaccttctgcggccgatgagaagaagaaggggcccaaagtcaccgtcaaggtgtattttgacctacgaattggagatgaagatgtaggccgggtgatctttggtctcttcggaaagactgttccaaaaacagtggataattttgtggccttagctacaggagagaaaggatttggctacaaaaacagcaaattccatcgtgtaatcaaggacttcatgatccagggcggagacttcaccaggggagatggcacaggaggaaagagcatctacggtgagcgcttccccgatgagaacttcaaactgaagcactacgggcctggctgggtgagcatggccaacgcaggcaaagacaccaacggctcccagttcttcatcacgacagtcaagacagcctggctagatggcaagcatgtggtgtttggcaaagttctagagggcatggaggtggtgcggaaggtggagagcaccaagacagacagccgggataaacccctgaaggatgtgatcatcgcagactgcggcaagatcgaggtggagaagccctttgccatcgccaaggagtagggcacagggacatctttctttgagtgaccgtctgtgcaggccctgtagtccgccacagggctctgagctgcactggccccggtgctggcatctggtggagcggacccactcccctcacattccacaggcccatggactcacttttgtaacaaactcctaccaacactgaccaataaaaaaaaatgtgggtttttttttttttttaatgtgtgggcctggttcttgagcctgcagcacctcccctaggcctacatcccaacatgcctgcaactctcctgtggcaatgggtgcctgccccttccctgggatcctgcctgaaattttgacccaggagctacccaggaaaagtcaggcaggagcttttgccccctgcttctaaactttgccagctactgggcctccacatttgctccccttgccaccaccctccagtctatgttaagggatgtatctgtactttttcatagcctacctctaaattgatttttttttttttttttggtagagacaggtctcactatgttgcgctggctggtctcaaacttccagacccaagcatcctcctgctctggccagnagtctgttagaattttggtgcctccagttttgtgtgcngtngatcatngtgggtcttagccctctgnagcatacgctngggcctttctcngancggnggacntcngnntcnacanngcctcctacttcnacnttcttttcangaggtggtncngangtngagagcccnagacaacngcgggntaaacctgaggatgtgatcacgccgatgggcagatcgagtgagaagcatttgcatcgcaagagaaggccagggaatcttctttgatcacgctttcaggctgtaatcgcaatgccctactgaatggccgtttggactgggcacggac

SEQ ID NO: 446206 - DNA, 965 bp, Homo sapiens
cccacgcgtccggctgtccgggctgctttcgcctccgcctgtggatgctgcgcctctccgaacgcaacatgaaggtgctccttgccgccgccctcatcgcggggtccgtcttcttcctgctgctgccgggaccttctgcggccgatgagaagaagaaggggcccaaagtcaccgtcaaggtgtattttgacctacgaattggagatgaagatgtaggccgggtgatctttggtctcttcggaaagactgttccaaaaacagtggataattttgtggccttagctacaggagagaaaggatttggctacaaaaacagcaaattccatcgtgtaatcaaggacttcatgatccagggcggagacttcaccaggggagatggcacaggaggaaagagcatctacggtgagcgcttccccgatgagaacttcaaactgaagcactacgggcctggctgggtgagcatggccaacgcaggcaaagacaccaacggctcccagttcttcatcacgacagtcaagacagcctggctagatggcaagcatgtggtgtttggcaaagttctagagggcatggaggtggtgcggaaggtggagagcaccaagacagacagccgggataaacccctgaaggatgtgatcatcgcagactgcggcaagatcgaggtggagaagccctttgccatcgccaaggagtagggcacagggacatctttctttgagtgaccgtctgtgcaggccctgtagtccgccacagggctctgagctgcactggccccggtgctggcatctggtggagcggacccactcccctcacattccacaggcccatggactcacttttgtaacaaactcctaccaacactgaccaataaaaaaaaatgtgggttttttttttttttttttttttttttttttttttttttttttttttttttaggccggtttcacccccgggggggcccccac

SEQ ID NO: 446207 - DNA, 1034 bp, Homo sapiens
  misc_feature (960)..(960): n is a, c, g, or t
cccacgcgtccggctgtccgggctgctttcgcctccgcctgtggatgctgcgcctctccgaacgcaacatgaaggtgctccttgccgccgccctcatcgcggggtccgtcttcttcctgctgctgccgggaccttctgcggccgatgagaagaagaaggggcccaaagtcaccgtcaaggtgtattttgacctacgaattggagatgaagatgtaggccgggtgatctttggtctcttcggaaagactgttccaaaaacagtggataattttgtggccttagctacaggagagaaaggatttggctacaaaaacagcaaattccatcgtgtaatcaaggacttcatgatccagggcggagacttcaccaggggagatggcacaggaggaaagagcatctacggtgagcgcttccccgatgagaacttcaaactgaagcactacgggcctggctgggtgagcatggccaacgcaggcaaagacaccaacggctcccagttcttcatcacgacagtcaagacagcctggctagatggcaagcatgtggtgtttggcaaagttctagagggcatggaggtggtgcggaaggtggagagcaccaagacagacagccgggataaacccctgaaggatgtgatcatcgcagactgcggcaagatcgaggtggagaagccctttgccatcgccaaggagtagggcacagggacatctttctttgagtgaccgtctgtgcaggccctgtagtccgccacagggctctgagctgcactggccccggtgctggcatctggtggagcggacccactcccctcacattccacaggcccatggactcacttttgtaacaaactcctaccaacactgaccaataaaaaaaaatgtgggttttttttttttttttttttttttttttttttttttttttttttttttttttttttttttttttttttttttgttntttttttttttttgtttttttttttttttttttttttttataagaaaacagagagagagactatagggggggga

SEQ ID NO: 446208 - DNA, 1036 bp, Homo sapiens
cccacgcgtccggctgtccgggctgctttcgcctccgcctgtggatgctgcgcctctccgaacgcaacatgaaggtgctccttgccgccgccctcatcgcggggtccgtcttcttcctgctgctgccgggaccttctgcggccgatgagaagaagaaggggcccaaagtcaccgtcaaggtgtattttgacctacgaattggagatgaagatgtaggccgggtgatctttggtctcttcggaaagactgttccaaaaacagtggataattttgtggccttagctacaggagagaaaggatttggctacaaaaacagcaaattccatcgtgtaatcaaggacttcatgatccagggcggagacttcaccaggggagatggcacaggaggaaagagcatctacggtgagcgcttccccgatgagaacttcaaactgaagcactacgggcctggctgggtgagcatggccaacgcaggcaaagacaccaacggctcccagttcttcatcacgacagtcaagacagcctggctagatggcaagcatgtggtgtttggcaaagttctagagggcatggaggtggtgcggaaggtggagagcaccaagacagacagccgggataaacccctgaaggatgtgatcatcgcagactgcggcaagatcgaggtggagaagccctttgccatcgccaaggagtagggcacagggacatctttctttgagtgaccgtctgtgcaggccctgtagtccgccacagggctctgagctgcactggccccggtgctggcatctggtggagcggacccactcccctcacattccacaggcccatggactcacttttgtaacaaactcctaccaacactgaccaataaaaaaaaatgtgggttttttttttttttttttttttttttttttttttttttttttttttttttttttttttttttttttttttttttttttttttttttttttttatttttttttttccaccccgacgccggagagtgggcccacgggggggcgcgcgggggggg

SEQ ID NO: 446209 - DNA, 1035 bp, Homo sapiens
cccacgcgtccggctgtccgggctgctttcgcctccgcctgtggatgctgcgcctctccgaacgcaacatgaaggtgctccttgccgccgccctcatcgcggggtccgtcttcttcctgctgctgccgggaccttctgcggccgatgagaagaagaaggggcccaaagtcaccgtcaaggtgtattttgacctacgaattggagatgaagatgtaggccgggtgatctttggtctcttcggaaagactgttccaaaaacagtggataattttgtggccttagctacaggagagaaaggatttggctacaaaaacagcaaattccatcgtgtaatcaaggacttcatgatccagggcggagacttcaccaggggagatggcacaggaggaaagagcatctacggtgagcgcttccccgatgagaacttcaaactgaagcactacgggcctggctgggtgagcatggccaacgcaggcaaagacaccaacggctcccagttcttcatcacgacagtcaagacagcctggctagatggcaagcatgtggtgtttggcaaagttctagagggcatggaggtggtgcggaaggtggagagcaccaagacagacagccgggataaacccctgaaggatgtgatcatcgcagactgcggcaagatcgaggtggagaagccctttgccatcgccaaggagtagggcacagggacatctttctttgagtgaccgtctgtgcaggccctgtagtccgccacagggctctgagctgcactggccccggtgctggcatctggtggagcggacccactcccctcacattccacaggcccatggactcacttttgtaacaaactcctaccaacactgaccaataaaaaaaaatgtgggttttttttttttttttttttttttttttttttttttttttttttttttttttttttttttttttttttttttttttttttttttttttttttttttttgtgtggggggggggggagcctcctcaccccccccacacaccccccccccctga

SEQ ID NO: 446210 - DNA, 1004 bp, Homo sapiens
cccacgcgtccggctgtccgggctgctttcgcctccgcctgtggatgctgcgcctctccgaacgcaacatgaaggtgctccttgccgccgccctcatcgcggggtccgtcttcttcctgctgctgccgggaccttctgcggccgatgagaagaagaaggggcccaaagtcaccgtcaaggtgtattttgacctacgaattggagatgaagatgtaggccgggtgatctttggtctcttcggaaagactgttccaaaaacagtggataattttgtggccttagctacaggagagaaaggatttggctacaaaaacagcaaattccatcgtgtaatcaaggacttcatgatccagggcggagacttcaccaggggagatggcacaggaggaaagagcatctacggtgagcgcttccccgatgagaacttcaaactgaagcactacgggcctggctgggtgagcatggccaacgcaggcaaagacaccaacggctcccagttcttcatcacgacagtcaagacagcctggctagatggcaagcatgtggtgtttggcaaagttctagagggcatggaggtggtgcggaaggtggagagcaccaagacagacagccgggataaacccctgaaggatgtgatcatcgcagactgcggcaagatcgaggtggagaagccctttgccatcgccaaggagtagggcacagggacatctttctttgagtgaccgtctgtgcaggccctgtagtccgccacagggctctgagctgcactggccccggtgctggcatctggtggagcggacccactcccctcacattccacaggcccatggactcacttttgtaacaaactcctaccaacactgaccaataaaaaaaaatgtgggttttttttttttttttttttttttttttttttttttttttttttttttttaaacccgccccctttccctttttttttcccgggttaaaaaaaaatttttatagtacagagggggtaattt

SEQ ID NO: 446211 - DNA, 954 bp, Homo sapiens
cccacgcgtccggctgtccgggctgctttcgcctccgcctgtggatgctgcgcctctccgaacgcaacatgaaggtgctccttgccgccgccctcatcgcggggtccgtcttcttcctgctgctgccgggaccttctgcggccgatgagaagaagaaggggcccaaagtcaccgtcaaggtgtattttgacctacgaattggagatgaagatgtaggccgggtgatctttggtctcttcggaaagactgttccaaaaacagtggataattttgtggccttagctacaggagagaaaggatttggctacaaaaacagcaaattccatcgtgtaatcaaggacttcatgatccagggcggagacttcaccaggggagatggcacaggaggaaagagcatctacggtgagcgcttccccgatgagaacttcaaactgaagcactacgggcctggctgggtgagcatggccaacgcaggcaaagacaccaacggctcccagttcttcatcacgacagtcaagacagcctggctagatggcaagcatgtggtgtttggcaaagttctagagggcatggaggtggtgcggaaggtggagagcaccaagacagacagccgggataaacccctgaaggatgtgatcatcgcagactgcggcaagatcgaggtggagaagccctttgccatcgccaaggagtagggcacagggacatctttctttgagtgaccgtctgtgcaggccctgtagtccgccacagggctctgagctgcactggccccggtgctggcatctggtggagcggacccactcccctcacattccacaggcccatggactcacttttgtaacaaactcctaccaacactgaccaataaaaaaaaatgtgggttttttttttttttttttttttttttttttggggtccggggccggatttgggtatcgggggcctaggggt

SEQ ID NO: 446212 - DNA, 1203 bp, Homo sapiens
ccacgcgtcggagcatctacggtgaaggcgcttcccctgctttcgcctccgcctgtggatgctgcgcctctccgaacgcaacatgaaggtgctccttgccgccgccctcatcgcggggtccgtcttcttcctgctgctgccgggaccttctgcggccgatgagaagaagaaggggcccaaagtcaccgtcaaggtgtattttgacctacgaattggagatgaagatgtaggccgggtgatctttggtctcttcggaaagactgttccaaaaacagtggataattttgtggccttagctacaggagagaaaggatttggctacaaaaacagcaaattccatcgtgtaatcaaggacttcatgatccagggcggagacttcaccaggggagatggcacaggaggaaagagcatctacggtgagcgcttccccgatgagaacttcaaactgaagcactacgggcctggctgggtgagcatggccaacgcaggcaaagacaccaacggctcccagttcttcatcacgacagtcaagacagcctggctagatggcaagcatgtggtgtttggcaaagttctagagggcatggaggtggtgcggaaggtggagagcaccaagacagacagccgggataaacccctgaaggatgtgatcatcgcagactgcggcaagatcgaggtggagaagccctttgccatcgccaaggagtagggcacagggacatctttctttgagtgaccgtctgtgcaggccctgtagtccgccacagggctctgagctgcactggccccggtgctggcatctggtggagcggacccactcccctcacattccacaggcccatggactcacttttgtaacaaactaaaaaaaaaaaaaaaaaaaaaaaaaaaaaaaaaaaaaaaaaaaaaaaaaaaaaaaaaaaaaaaaaaaaaaaaaaaaaaaaataactaacgcacacagcaaaggaaaagaaagaacaagcaactggccaaaaacacagaacacagagacaccaaaaaagagggggggggggcacaaaacacagcacacagagagcggggcaaggatacacccaccaagcaccataggagagagggacagacaacacgcagggggacaactaaaagcggcagcgcgggcgaacaacacgtaggggaggacaaaaggagaggagggagagggggaaacacacccggggcgaa

SEQ ID NO: 446213 - DNA, 972 bp, Homo sapiens
ccacgcgtcggagcatctacggtgaaggcgcttcccctgctttcgcctccgcctgtggatgctgcgcctctccgaacgcaacatgaaggtgctccttgccgccgccctcatcgcggggtccgtcttcttcctgctgctgccgggaccttctgcggccgatgagaagaagaaggggcccaaagtcaccgtcaagcggggaaaacaacgggggggggcggggggggccccccccaaaaaacacgtcaccgtcaaggtgtattttgacctacgaattggagatgaagatgtaggccgggtgatctttggtctcttcggaaagactgttccaaaaacagtggataattttgtggccttagctacaggagagaaaggatttggctacaaaaacagcaaattccatcgtgtaatcaaggacttcatgatccagggcggagacttcaccaggggagatggcacaggaggaaagagcatctacggtgagcgcttccccgatgagaacttcaaactgaagcactacgggcctggctgggtgagcatggccaacgcaggcaaagacaccaacggctcccagttcttcatcacgacagtcaagacagcctggctagatggcaagcatgtggtgtttggcaaagttctagagggcatggaggtggtgcggaaggtggagagcaccaagacagacagccgggataaacccctgaaggatgtgatcatcgcagactgcggcaagatcgaggtggagaagccctttgccatcgccaaggagtagggcacagggacatctttctttgagtgaccgtctgtgcaggccctgtagtccgccacagggctctgagctgcactggccccggtgctggcatctggtggagcggacccactcccctcacattccacaggcccatggactcacttttgtaacaaactcctaccaacactgaccaataaaaaaaaatgtgggtttttttttttttt

SEQ ID NO: 446214 - DNA, 600 bp, Homo sapiens
gacttcaccaggtgagatggcacaggatcgtgtaatcaaggacttcatgatccagggcggagacttcaccaggggagatggcacaggaggaaagagcatctacggtgagcgcttccccgatgagaacttcaaactgaagcactacgggcctggctgggtgagcatggccaacgcaggcaaagacaccaacggctcccagttcttcatcacgacagtcaagacagcctggctagatggcaagcatgtggtgtttggcaaagttctagagggcatggaggtggtgcggaaggtggagagcaccaagacagacagccgggataaacccctgaaggatgtgatcatcgcagactgcggcaagatcgaggtggagaagccctttgccatcgccaaggagtagggcacagggacatctttctttgagtgaccgtctgtgcaggccctgtagtccgccacagggctctgagctgcactggccccggtgctggcatctggtggagcggacccactcccctcacattccacaggcccatggactcacttttgtaacaaactcctaccaacactgaccaataaaaaaaaatgtgggtttttttttttttt

SEQ ID NO: 446215 - DNA, 1437 bp, Homo sapiens
ccgggttaggataatataaatagttaaattaagaatggttatgttagggttgtacggtagaactgctattattcatcctatgtgggtaattgaggagtatgctaagattttgcgtacctgggtttggtttaatccacctcaactgcctgctatgatggataagattgagagagtgaggagaaggcttacgtttagtgagggagagatttggtatatgattgagatgggggctagtctttgtcatgtgagaagaagcaggccggatgtcagaggggtgccttgggtaacctctgggactcagaagtgaaagggggctattcctagttttattgctatagccattatgattattaatgatgagtattgattggtagtattggttatggttcattgtccggagagtatattgttgaagaggatagctattagaaggattatggatgcggttgcttgcgtgaggaaatacttgatggcagcttctgttggaacgaaggtttatttttttggttagaactggaataaaagctagcatgtttatttctaggcctactcaggtaaaaaatcatgcgagcttaccgctgtgtattttgacctacgaattggagatgaagatgtaggccgggtgatctttggtctcttcggaaagactgttccaaaaacagtggataattttgtggccttagctacaggagagaaaggatttggctacaaaaacagcaaattccatcgtgtaatcaaggacttcatgatccagggcggagacttcaccaggggagatggcacaggaggaaagagcatctacggtgagcgcttccccgatgagaacttcaaactgaagcactacgggcctggctgggtgagcatggccaacgcaggcaaagacaccaacggctcccagttcttcatcacgacagtcaagacagcctggctagatggcaagcatgtggtgtttggcaaagttctagagggcatggaggtggtgcggaaggtggagagcaccaagacagacagccgggataaacccctgaaggatgtgatcatcgcagactgcggcaagatcgaggtggagaagccctttgccatcgccaaggagtagggcacagggacatctttctttgagtgaccgtctgtgcaggccctgtagtccgccacagggctctgagctgcactggccccggtgctggcatctggtggagcggacccactcccctcacattccacaggcccatggactcacttttgtaacaaactcctaccaacactgaccaataaaaaaaaatgtgggttttttttttttttttttttttttttttttttttttttttttttttttttttttttttttttttttttttttttttttttttttttttttttatttttttttttccaccccgacgccggagagtgggcccacgggggggcgcgcgggggggg

SEQ ID NO: 446216 - DNA, 1568 bp, Homo sapiens
  misc_feature (1530)..(1531): n is a, c, g, or t
  misc_feature (1533)..(1533): n is a, c, g, or t
  misc_feature (1535)..(1535): n is a, c, g, or t
ccacgcgtcggagcatctacggtgaaggcgcttcccctgctttcgcctccgcctgtggatgctgcgcctctccgaacgcaacatgaaggtgctccttgccgccgccctcatcgcggggtccgtcttcttcctgctgctgccgggaccttctgcggccgatgagaagaagaaggggcccaaagtcaccgtcaaggtgtattttgacctacgaattggagatgaagatgtaggccgggtgatctttggtctcttcggaaagactgttccaaaaacagtggataattttgtggccttagctacaggagagaaaggatttggctacaaaaacagcaaattccatcgtgtaatcaaggacttcatgatccagggcggagacttcaccaggggagatggcacaggaggaaagagcatctacggtgagcgcttccccgatgagaacttcaaactgaagcactacgggcctggctgggtgagcatggccaacgcaggcaaagacaccaacggctcccagttcttcatcacgacagtcaagacagcctggctagatggcaagcatgtggtgtttggcaaagttctagagggcatggtgagttgtggaagcaagggctactactgggcaatcctcaccggggattcaacacagaccccagggcaggagctccatgtgtccatccctttcccaaaaggacccaacccacagatgcagcccagtgctcctgtccagaataaaccctgtacctccatgcctccaaggttctaaattcttccagccccctcagagcccagccaggaaggctgcacaactgccagagcctccctcccctccttcactcagtgacgtgctggtcccacccctgaggtatacagagtgcagctgaacgcaatgtccctgagaagccacatgccctggtcaccctcttcctcctcctcacccttggcccaacctgggtcttacttcaaaggaacaaaattcctgtaccccctcgtcaaatctgcattctccctgctctggccaggagtctgttagaattttggtgcctccagttttgagtgctgttgatcacttgtgggtcttagccctcctgagccatacgctggggcctttctcctgagcggtggacctcctgatccaccatgccctcctacttccacctttcttttccaggaggtggtgcggaaggtggagagcaccaagacagacagccgggataaacccctgaaggatgtgatcatcgcagactgcggcaagatcgaggtggagaagccctttgccatcgccaaggagtagggcacagggacatctttctttgagtgaccgtctgtgcaggccctgtagtccgccacagggctctgagctgcactggccccggtgctggcatctggtggagcggacccactcccctcacattccacaggcccatggactcacttttgtaacaaactcctaccaacactgaccaataaaaaaaaatgtgggttttttttttttttttttttttttttttttttttttttttttttttttttgtnngngngggggggggggggggggagtgggaggggggggg

SEQ ID NO: 446217 - DNA, 2193 bp, Homo sapiens
  misc_feature (1865)..(1865): n is a, c, g, or t
  misc_feature (1903)..(1903): n is a, c, g, or t
  misc_feature (1906)..(1906): n is a, c, g, or t
  misc_feature (1913)..(1913): n is a, c, g, or t
  misc_feature (1932)..(1932): n is a, c, g, or t
  misc_feature (1943)..(1943): n is a, c, g, or t
  misc_feature (1955)..(1955): n is a, c, g, or t
  misc_feature (1958)..(1958): n is a, c, g, or t
  misc_feature (1962)..(1962): n is a, c, g, or t
  misc_feature (1967)..(1967): n is a, c, g, or t
  misc_feature (1970)..(1970): n is a, c, g, or t
  misc_feature (1972)..(1973): n is a, c, g, or t
  misc_feature (1976)..(1976): n is a, c, g, or t
  misc_feature (1980)..(1981): n is a, c, g, or t
  misc_feature (1994)..(1994): n is a, c, g, or t
  misc_feature (1997)..(1997): n is a, c, g, or t
  misc_feature (2007)..(2007): n is a, c, g, or t
  misc_feature (2016)..(2016): n is a, c, g, or t
  misc_feature (2018)..(2018): n is a, c, g, or t
  misc_feature (2021)..(2021): n is a, c, g, or t
  misc_feature (2024)..(2024): n is a, c, g, or t
  misc_feature (2033)..(2033): n is a, c, g, or t
  misc_feature (2041)..(2041): n is a, c, g, or t
  misc_feature (2047)..(2047): n is a, c, g, or t
ccacgcgtcggagcatctacggtgaaggcgcttcccctgctttcgcctccgcctgtggatgctgcgcctctccgaacgcaacatgaaggtgctccttgccgccgccctcatcgcggggtccgtcttcttcctgctgctgccgggaccttctgcggccgatgagaagaagaaggggcccaaagtcaccgtcaaggtgtattttgacctacgaattggagatgaagatgtaggccgggtgatctttggtctcttcggaaagactgttccaaaaacagtggataattttgtggccttagctacaggagagaaaggatttggctacaaaaacagcaaattccatcgtgtaatcaaggacttcatgatccagggcggagacttcaccaggggagatggcacaggaggaaagagcatctacggtgagcgcttccccgatgagaacttcaaactgaagcactacgggcctggctgggtgagcatggccaacgcaggcaaagacaccaacggctcccagttcttcatcacgacagtcaagacagcctggctagatggcaagcatgtggtgtttggcaaagttctagagggcatggtgagttgtggaagcaagggctactactgggcaatcctcaccggggattcaacacagaccccagggcaggagctccatgtgtccatccctttcccaaaaggacccaacccacagatgcagcccagtgctcctgtccagaataaaccctgtacctccatgcctccaaggttctaaattcttccagccccctcagagcccagccaggaaggctgcacaactgccagagcctccctcccctccttcactcagtgacgtgctggtcccacccctgaggtatacagagtgcagctgaacgcaatgtccctgagaagccacatgccctggtcaccctcttcctcctcctcacccttggcccaacctgggtcttacttcaaaggaacaaaattcctgtaccccctcgtcaaatctgcattctccctgctctggccaggagtctgttagaattttggtgcctccagttttgagtgctgttgatcacttgtgggtcttagccctcctgagccatacgctggggcctttctcctgagcggtggacctcctgatccaccatgccctcctacttccacctttcttttccaggaggtggtgcggaaggtggagagcaccaagacagacagccgggataaacccctgaaggatgtgatcatcgcagactgcggcaagatcgaggtggagaagccctttgccatcgccaaggagtagggcacagggacatctttctttgagtgaccgtctgtgcaggccctgtagtccgccacagggctctgagctgcactggccccggtgctggcatctggtggagcggacccactcccctcacattccacaggcccatggactcacttttgtaacaaactcctaccaacactgaccaataaaaaaaaatgtgggtttttttttttttttaatgtgtgggcctggttcttgagcctgcagcacctcccctaggcctacatcccaacatgcctgcaactctcctgtggcaatgggtgcctgccccttccctgggatcctgcctgaaattttgacccaggagctacccaggaaaagtcaggcaggagcttttgccccctgcttctaaactttgccagctactgggcctccacatttgctccccttgccaccaccctccagtctatgttaagggatgtatctgtactttttcatagcctacctctaaattgatttttttttttttttttggtagagacaggtctcactatgttgcgctggctggtctcaaacttccagacccaagcatcctcctgctctggccagnagtctgttagaattttggtgcctccagttttgtgtgcngtngatcatngtgggtcttagccctctgnagcatacgctngggcctttctcngancggnggacntcngnntcnacanngcctcctacttcnacnttcttttcangaggtggtncngangtngagagcccnagacaacngcgggntaaacctgaggatgtgatcacgccgatgggcagatcgagtgagaagcatttgcatcgcaagagaaggccagggaatcttctttgatcacgctttcaggctgtaatcgcaatgccctactgaatggccgtttggactgggcacggac

SEQ ID NO: 446218 - DNA, 1052 bp, Homo sapiens
  misc_feature (458)..(458): n is a, c, g, or t
  misc_feature (535)..(535): n is a, c, g, or t
  misc_feature (1014)..(1015): n is a, c, g, or t
  misc_feature (1017)..(1017): n is a, c, g, or t
  misc_feature (1019)..(1019): n is a, c, g, or t
ccacgcgtcggagcatctacggtgaaggcgcttcccctgctttcgcctccgcctgtggatgctgcgcctctccgaacgcaacatgaaggtgctccttgccgccgccctcatcgcggggtccgtcttcttcctgctgctgccgggaccttctgcggccgatgagaagaagaaggggcccaaagtcaccgtcaaggtgtattttgacctacgaattggagatgaagatgtaggccgggtgatctttggtctcttcggaaagactgttccaaaaacagtggataattttgtggccttagctacaggagagaaaggatttggctacaaaaacagcaaattccatcgtgtaatcaaggacttcatgatccagggcggagacttcaccaggggagatggcacaggaggaaagagcatctacggtgagcgcttccccgatgagaacttcaaactgaagcactacngggccccttggggcttggggggttggaaggccatttggggccccaaaacgggccaaggggccaaaaaaggaaacaanccaaaaacgggggcttcccccccaagcaacggctcccagttcttcatcacgacagtcaagacagcctggctagatggcaagcatgtggtgtttggcaaagttctagagggcatggaggtggtgcggaaggtggagagcaccaagacagacagccgggataaacccctgaaggatgtgatcatcgcagactgcggcaagatcgaggtggagaagccctttgccatcgccaaggagtagggcacagggacatctttctttgagtgaccgtctgtgcaggccctgtagtccgccacagggctctgagctgcactggccccggtgctggcatctggtggagcggacccactcccctcacattccacaggcccatggactcacttttgtaacaaactcctaccaacactgaccaataaaaaaaaatgtgggttttttttttttttttttttttttttttttttttttttttttttttttttgtnngngngggggggggggggggggagtgggaggggggggg

SEQ ID NO: 446219 - DNA, 755 bp, Homo sapiens
  misc_feature (717)..(718): n is a, c, g, or t
  misc_feature (720)..(720): n is a, c, g, or t
  misc_feature (722)..(722): n is a, c, g, or t
ccacgcgtcggagcatctacggtgaaggcgcttcccctgctttcgcctccgcctgtggatgctgcgcctctccgaacgcaacatgaaggtgctccttgccgccgccctcatcgcggggtccgtcttcttcctgctgctgccgggaccttctgcggccgatgagaagaagaaggggcccaaagtcaccgtcaaggtgtattttgacctacgaattggagatgaagatgtaggccgggtgatctttggtctcttcggaaagactgttccaaaaacagtggataattttgtggccttagctacaggagagaaaggatttggctacaaaaacagcaaattccatcgtgtaatcaaggacttcatgatccagggcggagacttcaccaggggagatggcacaggaggaaagagcatctacggtgagcgcttccccgatgagaacttcaaactgaagccctttgccatcgccaaggagtagggcacagggacatctttctttgagtgaccgtctgtgcaggccctgtagtccgccacagggctctgagctgcactggccccggtgctggcatctggtggagcggacccactcccctcacattccacaggcccatggactcacttttgtaacaaactcctaccaacactgaccaataaaaaaaaatgtgggttttttttttttttttttttttttttttttttttttttttttttttttttgtnngngngggggggggggggggggagtgggaggggggggg

SEQ ID NO: 446220 - DNA, 691 bp, Homo sapiens
ccacgcgtcggagcatctacggtgaaggcgcttcccctgctttcgcctccgcctgtggatgctgcgcctctccgaacgcaacatgaaggtgctccttgccgccgccctcatcgcggggtccgtcttcttcctgctgctgccgggaccttctgcggccgatgagaagaagaaggggcccaaagtcaccgtcaaggtgtattttgacctacgaattggagagcaccaagacagacagccgggataaacccctgaaggatgtgatcatcgcagactgcggcaagatcgaggtggagaagccctttgccatcgccaaggagtagggcacagggacatctttctttgagtgaccgtctgtgcaggccctgtagtccgccacagggctctgagctgcactggccccggtgctggcatctggtggagcggacccactcccctcacattccacaggcccatggactcacttttgtaacaaactcctaccaacactgaccaataaaaaaaaatgtgggttttttttttttttttttttttttttttttttttttttttttttttttttttttttttttttttttttttttttttttttttttttttttttttttttttttttttttttttttttttttcggggggcaggccttttgttccatcttggggggggggcacacccgcccccacttttctctcc

SEQ ID NO: 446221 - DNA, 1374 bp, Homo sapiens
agaaacagaatcctaactatttctgaggaaactgcaggtccaaaatgtggctgcttttaacaatggcaagtttgatatctgtactggggactacacatggtttgtttggaaaattacatcctggaagccctgaagtgactatgaacattagtcagatgattacttattggggatacccaaatgaagaatatgaagttgtgactgaagatggttatattcttgaagtcaatagaattccttatgggaagaaaaattcagggaatacaggccagagacctgttgtgtttttgcagcatggtttgcttgcatcagccacaaactggatttccaacctgccgaacaacagccttgccttcattctggcagatgctggttatgatgtgtggctgggcaacagcagaggaaacacctgggccagaagaaacttgtactattcaccagattcagttgaattctgggctttcagctttgatgaaatggctaaatatgaccttccagccacaatcgacttcattgtaaagaaaactggacagaagcagctacactatgttggccattcccagggcaccaccattggttttattgccttttccaccaatcccagcctggctaaaagaatcaaaaccttctatgctctagctcctgttgccactgtgaagtatacaaaaagccttataaacaaacttagatttgttcctcaatccctcttcaagtttatatttggtgacaaaatattctacccacacaacttctttgatcaatttcttgctactgaagtgtgctcccgtgagatgctgaatctcctttgcagcaatgccttatttataatttgtggatttgacagtaagaactttaacacgagtcgcttggatgtgtatctatcacataatccagcaggaacttctgttcaaaacatgttccattggacccaggctgttaagtctgggaaattccaagcttatgactggggaagcccagttcagaataggatgcactatgatcagtcccaacctccctactacaatgtgacagccatgaatgtaccaattgcagtgtggaacggtggcaaggacctgttggctgacccccaagatgttggccttttgcttccaaaactccccaatcttatttaccacaaggagattcctttttacaatcacttggactttatctgggcaatggatgcccctcaagaagtttacaatgacattgtttctatgatatcagaagataaaaagtagttctggatttaaagaattatccgtttgtttttccaaaatactttattctctcatacatagtattttcataatgtttgacatgcagtgcttctttctgtaattttgactttagaaatatattggcatcaacaaa

SEQ ID NO: 446222 - DNA, 607 bp, Homo sapiens
gacctgaatcagaaaacataaatctttactgtttttaagaaactgagtatgtgtcttagtatgtatataatatgtgtgtctgttgatttctagagtcgcttggatgtgtatctatcacataatccagcaggaacttctgttcaaaacatgttccattggacccaggctgttaagtctgggaaattccaagcttatgactggggaagcccagttcagaataggatgcactatgatcagtcccaacctccctactacaatgtgacagccatgaatgtaccaattgcagtgtggaacggtggcaaggacctgttggctgacccccaagatgttggccttttgcttccaaaactccccaatcttatttaccacaaggagattcctttttacaatcacttggactttatctgggcaatggatgcccctcaagaagtttacaatgacattgtttctatgatatcagaagataaaaagtagttctggatttaaagaattatccgtttgtttttccaaaatactttattctctcatacatagtattttcataatgtttgacatgcagtgcttctttctgtaattttgactttagaaatatattggcatcaacaaa

SEQ ID NO: 446223 - DNA, 583 bp, Homo sapiens
cgcttcttcccaggtcctgcggtgtcctgtgtgctgtcaggctgtccgtgaactccggacgtggccctggcgggccgtgtggtggagtctcatttcgggttgtttgccgacggttcggattttcgccaccctgtttttagtgctgttaagtctgggaaattccaagcttatgactggggaagcccagttcagaataggatgcactatgatcagtcccaacctccctactacaatgtgacagccatgaatgtaccaattgcagtgtggaacggtggcaaggacctgttggctgacccccaagatgttggccttttgcttccaaaactccccaatcttatttaccacaaggagattcctttttacaatcacttggactttatctgggcaatggatgcccctcaagaagtttacaatgacattgtttctatgatatcagaagataaaaagtagttctggatttaaagaattatccgtttgtttttccaaaatactttattctctcatacatagtattttcataatgtttgacatgcagtgcttctttctgtaattttgactttagaaatatattggcatcaacaaa

SEQ ID NO: 446224 - DNA, 448 bp, Homo sapiens
tgttggaatcctcacatttatcctagaataaggatacatttataaagtttataaacattttcttccttaggccagagacctgttgtgtttttgcagcatggtttgcttgcatcagccacaaactggatttccaacctgccgaacaacagccttgccttcattctggcagatgctggttatgatgtgtggctgggcaacagcagaggaaacacctgggccagaagaaacttgtactattcaccagattcagttgaattctgggctttcaggtaaacaaaagggacaattaaaaataaacactgggctttaaaagcataggcatttgccccttctaatccagtcccattttaacaaattacactccaagtaggaggataaacaagtcattttcattctaatccattcttggattcttccatgtacctcattcctagggtagcttttcctt

SEQ ID NO: 446225 - DNA, 583 bp, Homo sapiens
tggaatcctcacatttatcctagaataaggatacatttataaagtttataaacattttcttccttaggccagagacctgttgtgtttttgcagcatggtttgcttgcatcagccacaaactggatttccaacctgccgaacaacagccttgccttcattctggcagatgctggttatgatgtgtggctgggcaacagcagaggaaacacctgggccagaagaaacttgtactattcaccagattcagttgaattctgggctttcaggtaaacaaaagggacaattaaaaataaacactgggctttaaaagcataggcatttgccccttctaatccagtcccattttaacaaattacactccaagtaggaggataaacaagtcattttcattctaatccattcttggattcttccatgtacctcattcctagggtagcttttccttcaaacttttgtgatctcaggagtctccattagggatttccagaaagtgattttccaaatggaatgaacaatatggctgaagcaaggaaactcacagcccctggaaaattccaaaggaatgtccatatggattcaagag

SEQ ID NO: 446226 - DNA, 1425 bp, Homo sapiens
  misc_feature (1425)..(1425): n is a, c, g, or t
agaaacagaatcctaactatttctgaggaaactgcaggtccaaaatgtggctgcttttaacaatggcaagtttgatatctgtactggggactacacatggtttgtttggaaaattacatcctggaagccctgaagtgactatgaacattagtcagatgattacttattggggatacccaaatgaagaatatgaagttgtgactgaagatggttatattcttgaagtcaatagaattccttatgggaagaaaaattcagggaatacaggccagagacctgttgtgtttttgcagcatggtttgcttgcatcagccacaaactggatttccaacctgccgaacaacagccttgccttcattctggcagatgctggttatgatgtgtggctgggcaacagcagaggaaacacctgggccagaagaaacttgtactattcaccagattcagttgaattctgggctttcagctttgatgaaatggctaaatatgaccttccagccacaatcgacttcattgtaaagaaaactggacagaagcagctacactatgttggccattcccagggcaccaccattggttttattgccttttccaccaatcccagcctggctaaaagaatcaaaaccttctatgctctagctcctgttgccactgtgaagtatacaaaaagccttataaacaaacttagatttgttcctcaatccctcttcaagtttatatttggtgacaaaatattctacccacacaacttctttgatcaatttcttgctactgaagtgtgctcccgtgagatgctgaatctcctttgcagcaatgccttatttataatttgtggatttgacagtaagaactttaacacgagtcgcttggatgtgtatctatcacataatccagcaggaacttctgttcaaaacatgttccattggacccaggctgttaagtctgggaaattccaagcttatgactggggaagcccagttcagaataggatgcactatgatcagtcccaacctccctactacaatgtgacagccatgaatgtaccaattgcagtgtggaacggtggcaaggacctgttggctgacccccaagatgttggccttttgcttccaaaactccccaatcttatttaccacaaggagattcctttttacaatcacttggactttatctgggcaatggatgcccctcaagaagtttacaatgacattgtttctatgatatcagaagataaaaagtagttctggatttaaagaattatccgtttgtttttccaaaatactttattctctcatacatagtattttcataatgtttgacatgcagtgcttctttctgtaattttgactttagaaatatattggcatcaacaaaaaataaaacactggcctcgttggcctcagcggtggagctctgcggccggan

SEQ ID NO: 446227 - DNA, 3017 bp, Homo sapiens
tgcgcggggcgtaaggcgctttggccagagtggtttgatggttttgtgttagtcttcctgcagctgagcttccacaagacactttttccctttcagccacccaatatctcgcgagacttgctattctgcgccccctcctaccttgcgcttgcgcagatcttcaaagcagaaggtcgcgcttggaggaagtggcggctttgagtccggtggcccaatcgctgttactacttctctgaagctcctctcggctgcttgccgagacaccctgccgccaagatgcctcgaattatgatcaaggggggcgtatggaggaataccgaggatgaaattctgaaagcagcggtaatgaaatatgggaaaaatcagtggtctaggattgcctcattgctgcatagaaaatcagcaaagcagtgcaaagccagatggtatgaatggctggatccaagcattaagaagacagaatggtccagagaagaagaggaaaaactcttgcacttggccaagttgatgccaactcagtggaggaccattgctccaatcattggaagaacagcggcccagtgcttagaacactatgaatttcttctggataaagctgcccaaagagacaatgaagaggaaacaacagatgatccacgaaaacttaaacctggagaaatagatccaaatccagaaacaaaaccagcgcggcctgatccaattgatatggatgaggatgaacttgagatgctttctgaagccagagcccgcttggctaatactcagggaaagaaggccaagaggaaagcaagagagaaacaattggaagaagcaagacgtcttgctgccctccaaaaaagaagagaacttcgagcagctggcatagaaattcagaagaaaagaaaaaggaagagaggagttgattataatgccgaaatcccatttgaaaaaaagcctgcccttggtttttatgatacttctgaggaaaactaccaagctcttgacgcagatttcaggaaattaagacaacaggatcttgatggggagctaagatctgaaaaagaaggaagagatagaaaaaaagacaaacagcatttgaaaaggaaaaaagaatctgatttaccatcagctattcttcaaactagtggtgtttctgaatttactaaaaagagaagcaaactagtacttcctgcccctcagatttcagatgcagaactccaggaagttgtaaaagtaggccaagcgagtgaaattgcacgtcaaactgccgaggaatctggcataacaaattctgcttccagtacacttttgtctgagtacaatgtcaccaacaacagcgttgctcttagaacaccacgaacaccagcttcccaggacagaattctgcaggaagcccagaacctcatggccctcaccaatgtggacaccccattgaaaggtggacttaataccccattgcatgagagtgacttctcaggtgtaactccacagcgacaagttgtacagactccaaacacagttctctctactccattcaggactccttctaatggagctgaagggctgactccccggagtggaacaactcccaaaccagttattaactctactccgggtagaactcctcttcgagacaagttaaacattaatcccgaggatggaatggcagactatagtgatccctcttacgtgaagcagatggaaagagaatcccgagaacatctccgtttagggttgttgggccttcctgcccctaagaatgattttgaaattgttctaccagaaaatgccgagaaggagctggaagaacgtgaaatagatgatacttacattgaagatgctgctgatgtggatgctcgaaagcaggccatacgagatgcagagcgtgtaaaggaaatgaaacgaatgcataaagctgtccagaaagatctgccaagaccatcagaagtaaatgaaactattctaagacccttaaatgtagaaccgcctttaacagatttacagaaaagtgaagaactaatcaaaaaagaaatgatcacaatgcttcattatgaccttctacatcacccttatgaaccatctggaaataaaaaaggcaaaactgtagggtttggtaccaataattcagagcacattacctatctggaacataatccttatgaaaagttctccaaagaagagctgaaaaaggcccaggatgttttggtgcaggagatggaagtggttaaacaaggaatgagccatggagagctctcaagtgaagcttataaccaggtgtgggaagaatgctacagtcaagttttatatcttcctgggcagagccgctacacacgggccaatctggctagtaaaaaggacagaattgaatcacttgaaaagaggctcgagataaacaggggtcacatgacgacagaagccaagagggctgcaaagatggaaaagaagatgaaaattttgcttgggggttaccagtctcgtgctatggggctcatgaaacagttgaatgacttatgggaccaaattgaacaggctcacttggagttacgcacttttgaagaactcaagaaacatgaagattctgctattccccggaggctagagtgtctaaaagaagacgttcagcgacaacaagaaagagaaaaggaacttcaacatagatatgctgatttgctgctggagaaagagactttaaagtcaaaattctgaagtacagtttatattctgtcacaggattaattaattgccggttttcatactctagaaggctgaaactgatgtttatcttcattgacaaatttacccaccatctgtggtttttcagttgtttattttaaatgatatcgatcttacacattctgtgtataaagaccttaactccacaggacggacattttagagtttaaattattaaggctatcattcttttagtaatgtcatatttgcaaacttttttagttttggcctttaatttaaaaagcctaattttaaagtgctgcctgtgagtaactcttgaataaaaacaaaatataaaaaattga

SEQ ID NO: 446228 - DNA, 6546 bp, Homo sapiens
tgcgcggggcgtaaggcgctttggccagagtggtttgatggttttgtgttagtcttcctgcagctgagcttccacaagacactttttccctttcagccacccaatatctcgcgagacttgctattctgcgccccctcctaccttgcgcttgcgcagatcttcaaagcagaaggtcgcgcttggaggaagtggcggctttgagtccggtggcccaatcgctgttactacttctctgaagctcctctcggctgcttgccgagacaccctgccgccaagatgcctcgaattatgatcaaggggggcgtatggaggaataccgaggatgaaattctgaaagcagcggtaatgaaatatgggaaaaatcagtggtctaggattgcctcattgctgcatagaaaatcagcaaagcagtgcaaagccagatggtatgaatggctggatccaagcattaagaagacagaatggtccagagaagaagaggaaaaactcttgcacttggccaagttgatgccaactcagtggaggaccattgctccaatcattggaagaacagcggcccagtgcttagaacactatgaatttcttctggataaagctgcccaaagagacaatgaagaggaaacaacagatgatccacgaaaacttaaacctggagaaatagatccaaatccagaaacaaaaccagcgcggcctgatccaattgatatggatgaggatgaacttgagatgctttctgaagccagagcccgcttggctaatactcagggaaagaaggccaagaggaaagcaagagagaaacaattggaagaagcaagacgtcttgctgccctccaaaaaagaagagaacttcgagcagctggcatagaaattcagaagaaaagaaaaaggaagagaggagttgattataatgccgaaatcccatttgaaaaaaagcctgcccttggtttttatgatacttctgaggaaaactaccaagctcttgacgcagatttcaggaaattaagacaacaggatcttgatggggagctaagatctgaaaaagaaggaagagatagaaaaaaagacaaacagcatttgaaaaggaaaaaagaatctgatttaccatcagctattcttcaaactagtggtgtttctgaatttactaaaaagagaagcaaactagtacttcctgcccctcagatttcagatgcagaactccaggaagttgtaaaagtaggccaagcgagtgaaattgcacgtcaaactgccgaggaatctggcataacaaattctgcttccagtacacttttgtctgagtacaatgtcaccaacaacagcgttgctcttagaacaccacgaacaccagcttcccaggacagaattctgcaggaagcccagaacctcatggccctcaccaatgtggacaccccattgaaaggtggacttaataccccattgcatgagagtgacttctcaggtgtaactccacagcgacaagttgtacagactccaaacacagttctctctactccattcaggactccttctaatggagctgaagggctgactccccggagtggaacaactcccaaaccagttattaactctactccgggtagaactcctcttcgagacaagttaaacattaatcccgaggatggaatggcagactatagtgatccctcttacgtgaagcagatggaaagagaatcccgagaacatctccgtttagggttgttgggccttcctgcccctaagaatgattttgaaattgttctaccagaaaatgccgagaaggagctggaagaacgtgaaatagatgatacttacattgaagatgctgctgatgtggatgctcgaaagcaggccatacgagatgcagagcgtgtaaaggaaatgaaacgaatgcataaagctgtccagaaagatctgccaagaccatcagaagtaaatgaaactattctaagacccttaaatgtagaaccgcctttaacagatttacagaaaagtgaagaactaatcaaaaaagaaatgatcacaatgcttcattatgaccttctacatcacccttatgaaccatctggaaataaaaaaggcaaaactgtagggtttggtaccaataattcagagcacattacctatctggaacataatccttatgaaaagttctccaaagaagagctgaaaaaggcccaggatgttttggtgcaggagatggaagtggttaaacaaggaatgagccatggagagctctcaagtgaagcttataaccaggtgtgggaagaatgctacagtcaagttttatatcttcctgggcagagccgctacacacgggccaatctggctagtaaaaaggacagaattgaatcacttgaaaagaggctcgagataaacaggggtcacatgacgacagaagccaagagggctgcaaagatggaaaagaagatgaaaattttgcttgggggttaccagtctcgtgctatggggctcatgaaacagttgaatgacttatgggaccaaattgaacaggctcacttggagttacgcacttttgaagaactcaagaaacatgaagattctgctattccccggaggctagagtgtctaaaagaagacgttcagcgacaacaagaaagagaaaaggaacttcaacatagatatgctgatttgctgctggagaaagagactttaaagtcaaaattctgaagtacagtttatattctgtcacaggattaattaattgccggttttcatactctagaaggctgaaactgatgtttatcttcattgacaaatttacccaccatctgtggtttttcagttgtttattttaaatgatatcgatcttacacattctgtgtataaagaccttaactccacaggacggacattttagagtttaaattattaaggctatcattcttttagtaatgtcatatttgcaaacttttttagttttggcctttaatttaaaaagcctaattttaaagtgctgcctgtgagtaactcttgaataaaaacaaaatataaaaaattgagaatgtagccttttgtttgaagtaattagatacttaagagtgcctgcaaaccagcagctatgtactctgtgtcatatttaatgagtaactcttgggtaatcaaaatggtgatgcagtatcttaaacacttaagaggcagttctttgtggctttgttagtttcagcaaagagtggtcatttctgtatacactgacaagttagattaactttttagtacctcaaattttttttttgttaatatcactttaaagaaggtctcttgtctgccagctacttaaataatttatgggtcagggcttaaaagatttaacttccttgccccattattttcttataagtattttttgacaaaggcattttaaaagttaatttcaagaaggccatcaaacttaaagctctatgtttagcctaagaagtcagttacatcagtgtagaatttggggaatggatagaggtggagatatttaattttatataattcatataaattgatttagttacagtatcagttggctacaagctcattatagactagcaatgttttgacatcaccaaaaacgtttgcccagtcttagaatactagggactataggaagggaagggattcattcattcattcgatattgaatgtataccctgtgccagagtcttagagagagaacaacaaacaaaataggcctagttcttgtttagtagagcttatagtcttttgagaatgacagacaattaaaatccaaatgtttatttggtgattcttatgtgtcagacacttaagtgttgggagataagcagttattaagacagagttcttgctctcatggaggtgacattagtggggaggagatactaagtatgtccagggaaagtatcagaccatgagttttagattctgtggaggaaattaaagtagggtgattatgagatagtgaatgagtggctattttagactggacgatcaaagagacctcttggaaggcagctatgctcaccactataccactgcactgtgccgcaccgtaccactataagctgcacggccaaagagacctcttaaagaagtaacatttaagataacatgtgattgacattttagaatgggctatccttgtgagattcaaggaaagaacatcctaggtggagtgaatagcaaacataaagcctcttttgtatgtttgaggaacaaaaaggacaatgcagctagagtgtcaagaatggcatttctgtatataagacctcgttgtatagagccacataaataaggctataataaggaatttggatcttactttaaatatgataagaatcgatgagaagatctaagcaaaggaatgacatgatcagatttggttttagaaacatcactatctccttagtgtgtaaaatctcaccaggctggagatagggaagccagtccaattaggagcctgatgcagtgatccagacaaaaaaataatagtgattctaactagagtccaggtaatagtagtggagatatgtggagagacatgataggtatatacttaatagtcttatcagacgataaattgatattttcctggtgtgtagtcacttaattcaaatacttttttcagtaagttctgggttttctaggaaaaacttcagtatcatcagtgaataatgatagtgtttcttctgatagttttatttcacttttattgcatgttttgttatctgaaatgtttaggacaatgttaacaataatgatgttagacatttttttttcttattttaatgggaatgtccatagttttaagtttgctgttgggagttagatagtctttatctgaaagacagtgtctctcttttagtttttaaagagtttgaattagaaatggctctggaactttaaacagtataccatttgggcatctattaaagcattcatataattgttctcatttgatgttttgatgaggtatattaatagattttcccacattaaatcatctttgcactcctggaatcaggtagattaatttttaaaagaaattttaaaggatttatagtttatttgcactttttgtagacttgaattatatggatttaaaagttgatctaatattaataaaggctcactttgttttcaaaatttgaagtaattcacatacttatagcctaaaatcggcaggaattacaaaatttcaaaactggcacattgtaaactgcatatgcatttgccaggtagtggtgccacttgaaatggtgaacagacacactgttatcctttgtcagtatcctgtaaagcccaggattctttaccagcaccatacagcgattttggtgactattttaacattcacactgaggccaggggtggtgagtcatgcctgtaatcctagcactttgggaggccaaggtgggaggatcatttgagctcaggagttcaagattagcctgggtaacatagtgagaccctgtctctattaaaaaataataataaaaataacattcacattggtattgttcactaaggtattggttgttaaggcattcattaaggtattgttaaaacttgtgttaagcatgttaaagtctcagtaactttgggatagaaataaaatgtgataaaaagctgaaagaaaccaccacaagggagagtcctttttgaaatattagagacataatgctgtctaataaaaaacgacatcaaagaaaaactacactacagtgactgcagacttaatgttggccaaccatgcatccaaagtgctagaattacaggtgtgagccaccatgcccagcctggttattgtattttgatattgggattttgctagctctctaaagtaaataggataactgtatatctttttctgtgcattaagcagttataacatgggaatgatttgttcatgaaaggttgaaagtctgtacttacagaacttttgagttcacagtgctttctggaaataatttctttataactgtcagtttcttttgtgactattatgttacctatttttaaatttaagcaactttaaattaaaaaaattgtttttaaaatatattcttccttttatgtttatttagtaaatttaggtaatgtatactttttaagaaatatttttattttgttcaaatttaaacatctgttgttagcagaaaattctaatagcaatttcttttctattaactttgccatttctaagttataggaaatttaccttctcttaattctaccactttttacttgactagacttgttaagggtatacattttctgttcagaaaactagtgtttttattggcttatctattgtgattttgttttaaaatatgttaatttctcaatttaggcttattattttgttttctgtagttttttgactttttgagactgatgcttattttttgcttgtatacaaatgaatgtgttgaagacttttgaactgtcctttgagttcaaatatgttcacatcccagccattttgatatgtagtagtcttgttttctaagtagtatatcattgtgttttaaatttctggttcaataattaagtttttcaaaa

SEQ ID NO: 446229 - DNA, 4784 bp, Homo sapiens
tgcgcggggcgtaaggcgctttggccagagtggtttgatggttttgtgttagtcttcctgcagctgagcttccacaagacactttttccctttcagccacccaatatctcgcgagacttgctattctgcgccccctcctaccttgcgcttgcgcagatcttcaaagcagaaggtcgcgcttggaggaagtggcggctttgagtccggtggcccaatcgctgttactacttctctgaagctcctctcggctgcttgccgagacaccctgccgccaagatgcctcgaattatgatcaaggggggcgtatggaggaataccgaggatgaaattctgaaagcagcggtaatgaaatatgggaaaaatcagtggtctaggattgcctcattgctgcatagaaaatcagcaaagcagtgcaaagccagatggtatgaatggctggatccaagcattaagaagacagaatggtccagagaagaagaggaaaaactcttgcacttggccaagttgatgccaactcagtggaggaccattgctccaatcattggaagaacagcggcccagtgcttagaacactatgaatttcttctggataaagctgcccaaagagacaatgaagaggaaacaacagatgatccacgaaaacttaaacctggagaaatagatccaaatccagaaacaaaaccagcgcggcctgatccaattgatatggatgaggatgaacttgagatgctttctgaagccagagcccgcttggctaatactcagggaaagaaggccaagaggaaagcaagagagaaacaattggaagaagcaagacgtcttgctgccctccaaaaaagaagagaacttcgagcagctggcatagaaattcagaagaaaagaaaaaggaagagaggagttgattataatgccgaaatcccatttgaaaaaaagcctgcccttggtttttatgatacttctgaggaaaactaccaagctcttgacgcagatttcaggaaattaagacaacaggatcttgatggggagctaagatctgaaaaagaaggaagagatagaaaaaaagacaaacagcatttgaaaaggaaaaaagaatctgatttaccatcagctattcttcaaactagtggtgtttctgaatttactaaaaagagaagcaaactagtacttcctgcccctcagatttcagatgcagaactccaggaagttgtaaaagtaggccaagcgagtgaaattgcacgtcaaactgccgaggaatctggcataacaaattctgcttccagtacacttttgtctgagtacaatgtcaccaacaacagcgttgctcttagaacaccacgaacaccagcttcccaggacagaattctgcaggaagcccagaacctcatggccctcaccaatgtggacaccccattgaaaggtggacttaataccccattgcatgagagtgacttctcaggtgtaactccacagcgacaagttgtacagactccaaacacagttctctctactccattcaggactccttctaatggagctgaagggctgactccccggagtggaacaactcccaaaccagttattaactctactccgggtagaactcctcttcgagacaagttaaacattaatcccgaggatggaatggcagactatagtgatccctcttacgtgaagcagatggaaagagaatcccgagaacatctccgtttagggttgttgggccttcctgcccctaagaatgattttgaaattgttctaccagaaaatgccgagaaggagctggaagaacgtgaaatagatgatacttacattgaagatgctgctgatgtggatgctcgaaagcaggccatacgagatgcagagcgtgtaaaggaaatgaaacgaatgcataaagctgtccagaaagatctgccaagaccatcagaagtaaatgaaactattctaagacccttaaatgtagaaccgcctttaacagatttacagaaaagtgaagaactaatcaaaaaagaaatgatcacaatgcttcattatgaccttctacatcacccttatgaaccatctggaaataaaaaaggcaaaactgtagggtttggtaccaataattcagagcacattacctatctggaacataatccttatgaaaagttctccaaagaagagctgaaaaaggcccaggatgttttggtgcaggagatggaagtggttaaacaaggaatgagccatggagagctctcaagtgaagcttataaccaggtgtgggaagaatgctacagtcaagttttatatcttcctgggcagagccgctacacacgggccaatctggctagtaaaaaggacagaattgaatcacttgaaaagaggctcgagataaacaggggtcacatgacgacagaagccaagagggctgcaaagatggaaaagaagatgaaaattttgcttgggggttaccagtctcgtgctatggggctcatgaaacagttgaatgacttatgggaccaaattgaacaggctcacttggagttacgcacttttgaagaactcaagaaacatgaagattctgctattccccggaggctagagtgtctaaaagaagacgttcagcgacaacaagaaagagaaaaggaacttcaacatagatatgctgatttgctgctggagaaagagactttaaagtcaaaattctgaagtacagtttatattctgtcacaggattaattaattgccggttttcatactctagaaggctgaaactgatgtttatcttcattgacaaatttacccaccatctgtggtttttcagttgtttattttaaatgatatcgatcttacacattctgtgtataaagaccttaactccacaggacggacattttagagtttaaattattaaggctatcattcttttagtaatgtcatatttgcaaacttttttagttttggcctttaatttaaaaagcctaattttaaagtgctgcctgtgagtaactcttgaataaaaacaaaatataaaaaattgagaatgtagccttttgtttgaagtaattagatacttaagagtgcctgcaaaccagcagctatgtactctgtgtcatatttaatgagtaactcttgggtaatcaaaatggtgatgcagtatcttaaacacttaagaggcagttctttgtggctttgttagtttcagcaaagagtggtcatttctgtatacactgacaagttagattaactttttagtacctcaaattttttttttgttaatatcactttaaagaaggtctcttgtctgccagctacttaaataatttatgggtcagggcttaaaagatttaacttccttgccccattattttcttataagtattttttgacaaaggcattttaaaagttaatttcaagaaggccatcaaacttaaagctctatgtttagcctaagaagtcagttacatcagtgtagaatttggggaatggatagaggtggagatatttaattttatataattcatataaattgatttagttacagtatcagttggctacaagctcattatagactagcaatgttttgacatcaccaaaaacgtttgcccagtcttagaatactagggactataggaagggaagggattcattcattcattcgatattgaatgtataccctgtgccagagtcttagagagagaacaacaaacaaaataggcctagttcttgtttagtagagcttatagtcttttgagaatgacagacaattaaaatccaaatgtttatttggtgattcttatgtgtcagacacttaagtgttgggagataagcagttattaagacagagttcttgctctcatggaggtgacattagtggggaggagatactaagtatgtccagggaaagtatcagaccatgagttttagattctgtggaggaaattaaagtagggtgattatgagatagtgaatgagtggctattttagactggacgatcaaagcaaagtgctagaattacaggtgtgagccaccatgcccagcctggttattgtattttgatattgggattttgctagctctctaaagtaaataggataactgtatatctttttctgtgcattaagcagttataacatgggaatgatttgttcatgaaaggttgaaagtctgtacttacagaacttttgagttcacagtgctttctggaaataatttctttataactgtcagtttcttttgtgactattatgttacctatttttaaatttaagcaactttaaattaaaaaaattgtttttaaaatatattcttccttttatgtttatttagtaaatttaggtaatgtatactttttaagaaatatttttattttgttcaaatttaaacatctgttgttagcagaaaattctaatagcaatttcttttctattaactttgccatttctaagttataggaaatttaccttctcttaattctaccactttttacttgactagacttgttaagggtatacattttctgttcagaaaactagtgtttttattggcttatctattgtgattttgttttaaaatatgttaatttctcaatttaggcttattattttgttttctgtagttttttgactttttgagactgatgcttattttttgcttgtatacaaatgaatgtgttgaagacttttgaactgtcctttgagttcaaatatgttcacatcccagccattttgatatgtagtagtcttgttttctaagtagtatatcattgtgttttaaatttctggttcaataattaagtttttcaaaa

SEQ ID NO: 446230 - DNA, 2963 bp, Homo sapiens
tgcgcggggcgtaaggcgctttggccagagtggtttgatggttttgtgttagtcttcctgcagctgagcttccacaagacactttttccctttcagccacccaatatctcgcgagacttgctattctgcgccccctcctaccttgcgcttgcgcagatcttcaaagcagaaggtcgcgcttggaggaagtggcggctttgagtccggtggcccaatcgctgttactacttctctgaagctcctctcggctgcttgccgagacaccctgccgccaagatgcctcgaattatgatcaaggggggcgtatggaggaataccgaggatgaaattctgaaagcagcggtaatgaaatatgggaaaaatcagtggtctaggattgcctcattgctgcatagaaaatcagcaaagcagtgcaaagccagatggtatgaatggctggatccaagcattaagaagacagaatggtccagagaagaagaggaaaaactcttgcacttggccaagttgatgccaactcagtggaggaccattgctccaatcattggaagaacagcggcccagtgcttagaacactatgaatttcttctggataaagctgcccaaagagacaatgaagaggaaacaacagatgatccacgaaaacttaaacctggagaaatagatccaaatccagaaacaaaaccagcgcggcctgatccaattgatatggatgaggatgaacttgagatgctttctgaagccagagcccgcttggctaatactcagggaaagaaggccaagaggaaagcaagagagaaacaattggaagaagcaagacgtcttgctgccctccaaaaaagaagagaacttcgagcagctggcatagaaattcagaagaaaagaaaaaggaagagaggagttgattataatgccgaaatcccatttgaaaaaaagcctgcccttggtttttatgatacttctgaggaaaactaccaagctcttgacgcagatttcaggaaattaagacaacaggatcttgatggggagctaagatctgaaaaagaaggaagagatagaaaaaaagacaaacagcatttgaaaaggaaaaaagaatctgatttaccatcagctattcttcaaactagtggtgtttctgaatttactaaaaagagaagcaaactagtacttcctgcccctcagatttcagatgcagaactccaggaagttataacaaattctgcttccagtacacttttgtctgagtacaatgtcaccaacaacagcgttgctcttagaacaccacgaacaccagcttcccaggacagaattctgcaggaagcccagaacctcatggccctcaccaatgtggacaccccattgaaaggtggacttaataccccattgcatgagagtgacttctcaggtgtaactccacagcgacaagttgtacagactccaaacacagttctctctactccattcaggactccttctaatggagctgaagggctgactccccggagtggaacaactcccaaaccagttattaactctactccgggtagaactcctcttcgagacaagttaaacattaatcccgaggatggaatggcagactatagtgatccctcttacgtgaagcagatggaaagagaatcccgagaacatctccgtttagggttgttgggccttcctgcccctaagaatgattttgaaattgttctaccagaaaatgccgagaaggagctggaagaacgtgaaatagatgatacttacattgaagatgctgctgatgtggatgctcgaaagcaggccatacgagatgcagagcgtgtaaaggaaatgaaacgaatgcataaagctgtccagaaagatctgccaagaccatcagaagtaaatgaaactattctaagacccttaaatgtagaaccgcctttaacagatttacagaaaagtgaagaactaatcaaaaaagaaatgatcacaatgcttcattatgaccttctacatcacccttatgaaccatctggaaataaaaaaggcaaaactgtagggtttggtaccaataattcagagcacattacctatctggaacataatccttatgaaaagttctccaaagaagagctgaaaaaggcccaggatgttttggtgcaggagatggaagtggttaaacaaggaatgagccatggagagctctcaagtgaagcttataaccaggtgtgggaagaatgctacagtcaagttttatatcttcctgggcagagccgctacacacgggccaatctggctagtaaaaaggacagaattgaatcacttgaaaagaggctcgagataaacaggggtcacatgacgacagaagccaagagggctgcaaagatggaaaagaagatgaaaattttgcttgggggttaccagtctcgtgctatggggctcatgaaacagttgaatgacttatgggaccaaattgaacaggctcacttggagttacgcacttttgaagaactcaagaaacatgaagattctgctattccccggaggctagagtgtctaaaagaagacgttcagcgacaacaagaaagagaaaaggaacttcaacatagatatgctgatttgctgctggagaaagagactttaaagtcaaaattctgaagtacagtttatattctgtcacaggattaattaattgccggttttcatactctagaaggctgaaactgatgtttatcttcattgacaaatttacccaccatctgtggtttttcagttgtttattttaaatgatatcgatcttacacattctgtgtataaagaccttaactccacaggacggacattttagagtttaaattattaaggctatcattcttttagtaatgtcatatttgcaaacttttttagttttggcctttaatttaaaaagcctaattttaaagtgctgcctgtgagtaactcttgaataaaaacaaaatataaaaaattga

SEQ ID NO: 446231 - DNA, 2819 bp, Homo sapiens
tgcgcggggcgtaaggcgctttggccagagtggtttgatggttttgtgttagtcttcctgcagctgagcttccacaagacactttttccctttcagccacccaatatctcgcgagacttgctattctgcgccccctcctaccttgcgcttgcgcagatcttcaaagcagaaggtcgcgcttggaggaagtggcggctttgagtccggtggcccaatcgctgttactacttctctgaagctcctctcggctgcttgccgagacaccctgccgccaagatgcctcgaattatgatcaaggggggcgtatggaggaataccgaggatgaaattctgaaagcagcggtaatgaaatatgggaaaaatcagtggtctaggattgcctcattgctgcatagaaaatcagcaaagcagtgcaaagccagatggtatgaatggctggatccaagcattaagaagacagaatggtccagagaagaagaggaaaaactcttgcacttggccaagttgatgccaactcagtggaggaccattgctccaatcattggaagaacagcggcccagtgcttagaacactatgaatttcttctggataaagctgcccaaagagacaatgaagaggaaacaacagatgatccacgaaaacttaaacctggagaaatagatccaaatccagaaacaaaaccagcgcggcctgatccaattgatatggatgaggatgaacttgagatgctttctgaagccagagcccgcttggctaatactcagggaaagaaggccaagaggaaagcaagagagaaacaattggaagaagcaagacgtcttgctgccctccaaaaaagaagagaacttcgagcagctggcatagaaattcagaagaaaagaaaaaggaagagaggagttgattataatgccgaaatcccatttgaaaaaaagcctgcccttggtttttatgatacttctgaggaaaactaccaagctcttgacgcagatttcaggaaattaagacaacaggatcttgatggggagctaagatctgaaaaagaaggaagagatagaaaaaaagacaaacagcatttgaaaaggaaaaaagaatctgatttaccatcagctattcttcaaactagtggtgtttctgaatttactaaaaagagaagcaaactagtacttcctgcccctcagatttcagatgcagaactccaggaagttgtaaaagtaggccaagcgagtgaaattgcacgtcaaactgccgaggaatctggcataacaaattctgcttccagtacacttttgtctgagtacaatgtcaccaacaacagcgttgctcttagaacaccacgaacaccagcttcccaggacagaattctgcaggaagcccagaacctcatggccctcaccaatgtggacaccccattgaaaggtggacttaataccccattgcatgagagtgacttctcaggtgtaactccacagcgacaagttgtacagactccaaacacagttctctctactccattcaggactccttctaatggagctgaagggctgactccccggagtggaacaactcccaaaccagttattaactctactccgggtagaactcctcttcgagacaagttaaacattaatcccgaggatggaatggcagactatagtgatccctcttacgtgaagcagatggaaagagaatcccgagaacatctccgtttagggttgttgggccttcctgcccctaagaatgattttgaaattgttctaccagaaaatgccgagaaggagctggaagaacgtgaaatagatgatacttacattgaagatgctgctgatgtggatgctcgaaagcaggccatacgagatgcagagcgtgtaaaggaaatgaaacgaatgcataaagctgtccagaaagatctgccaagaccatcagaagtaaatgaaactattctaagacccttaaatgtagaaccgcctttaacagatttacagaaaagtgaagaactaatcaaaaaagaaatgatcacaatgcttcattatgaccttctacatcacccttatgaaccatctggaaataaaaaaggcaaaactgtagggtttggtaccaataattcagagcacattacctatctggaacataatccttatgaaaagttctccaaagaagagctgaaaaagataaacaggggtcacatgacgacagaagccaagagggctgcaaagatggaaaagaagatgaaaattttgcttgggggttaccagtctcgtgctatggggctcatgaaacagttgaatgacttatgggaccaaattgaacaggctcacttggagttacgcacttttgaagaactcaagaaacatgaagattctgctattccccggaggctagagtgtctaaaagaagacgttcagcgacaacaagaaagagaaaaggaacttcaacatagatatgctgatttgctgctggagaaagagactttaaagtcaaaattctgaagtacagtttatattctgtcacaggattaattaattgccggttttcatactctagaaggctgaaactgatgtttatcttcattgacaaatttacccaccatctgtggtttttcagttgtttattttaaatgatatcgatcttacacattctgtgtataaagaccttaactccacaggacggacattttagagtttaaattattaaggctatcattcttttagtaatgtcatatttgcaaacttttttagttttggcctttaatttaaaaagcctaattttaaagtgctgcctgtgagtaactcttgaataaaaacaaaatataaaaaattga

SEQ ID NO: 446232 - DNA, 1025 bp, Homo sapiens
gacacagttctattggtttgaaatacataaatattttatttcaattgtggtaattctttcatttcagttgattgctaaattataaacattattcaaagtttgttgtggggaaggaactccagttatattgtataaactaaatgctatacttaaattatcctttccactcttaggttcaggagataagcccttctctgtaagcactgtatgccatggctgccagtgtgtttgatttttgctgccatgaactttggaaccgtgaatctaaattatggccctatcactgcctatcaagcaagatgaagtccagctttgtcgtggctggtgtctcctgaatggattaaaaaaaaaaatgccctgaggtttatattggagataaacaggggtcacatgacgacagaagccaagagggctgcaaagatggaaaagaagatgaaaattttgcttgggggttaccagtctcgtgctatggggctcatgaaacagttgaatgacttatgggaccaaattgaacaggctcacttggagttacgcacttttgaagaactcaagaaacatgaagattctgctattccccggaggctagagtgtctaaaagaagacgttcagcgacaacaagaaagagaaaaggaacttcaacatagatatgctgatttgctgctggagaaagagactttaaagtcaaaattctgaagtacagtttatattctgtcacaggattaattaattgccggttttcatactctagaaggctgaaactgatgtttatcttcattgacaaatttacccaccatctgtggtttttcagttgtttattttaaatgatatcgatcttacacattctgtgtataaagaccttaactccacaggacggacattttagagtttaaattattaaggctatcattcttttagtaatgtcatatttgcaaacttttttagttttggcctttaatttaaaaagcctaattttaaagtgctgcctgtgagtaactcttgaataaaaacaaaatataaaaaattga

SEQ ID NO: 446233 - DNA, 699 bp, Homo sapiens
  misc_feature (37)..(37): n is a, c, g, or t
  misc_feature (44)..(44): n is a, c, g, or t
  misc_feature (57)..(57): n is a, c, g, or t
  misc_feature (76)..(76): n is a, c, g, or t
ggagggcccgcctcggccggcgcggttccgtttttcnccccgangatactgtttaanccagcctctttggggacanaaccaaccggctgcaaagatggaaaagaagatgaaaattttgcttgggggttaccagtctcgtgctatggggctcatgaaacagttgaatgacttatgggaccaaattgaacaggctcacttggagttacgcacttttgaagaactcaagaaacatgaagattctgctattccccggaggctagagtgtctaaaagaagacgttcagcgacaacaagaaagagaaaaggaacttcaacatagatatgctgatttgctgctggagaaagagactttaaagtcaaaattctgaagtacagtttatattctgtcacaggattaattaattgccggttttcatactctagaaggctgaaactgatgtttatcttcattgacaaatttacccaccatctgtggtttttcagttgtttattttaaatgatatcgatcttacacattctgtgtataaagaccttaactccacaggacggacattttagagtttaaattattaaggctatcattcttttagtaatgtcatatttgcaaacttttttagttttggcctttaatttaaaaagcctaattttaaagtgctgcctgtgagtaactcttgaataaaaacaaaatataaaaaattga

SEQ ID NO: 446234 - DNA, 1218 bp, Homo sapiens
gtctcaaactcctgacctcaggcgatccacccacctcagcgtcccaaagtgctgggattataggcgtgagcaccgcacctggcctatgagtaatcttttatttaggaaatttacatttttacattagtgagattggtcttttgggctattgtacttttttttttttttttttgagatggagtcttgctctctcacccaggctggagtgcagtagtgcaatcttggcccactgcaacctctgcctcctgggctcgagtgattctctgcctcagccttccaagtagctgggactacaggcatgtgccaccgcacctggctaatttttgtgtttttagtagagatggggttttgctatgttggccaggctggtcttgaattcctgacctcaggtgatccacctacctcggcctcccaaagtgctagaattacaggtgtgagccaccatgcccagcctggttattgtattttgatattgggattttgctagctctctaaagtaaataggataactgtatatctttttctgtgcattaagcagttataacatgggaatgatttgttcatgaaaggttgaaagtctgtacttacagaacttttgagttcacagtgctttctggaaataatttctttataactgtcagtttcttttgtgactattatgttacctatttttaaatttaagcaactttaaattaaaaaaattgtttttaaaatatattcttccttttatgtttatttagtaaatttaggtaatgtatactttttaagaaatatttttattttgttcaaatttaaacatctgttgttagcagaaaattctaatagcaatttcttttctattaactttgccatttctaagttataggaaatttaccttctcttaattctaccactttttacttgactagacttgttaagggtatacattttctgttcagaaaactagtgtttttattggcttatctattgtgattttgttttaaaatatgttaatttctcaatttaggcttattattttgttttctgtagttttttgactttttgagactgatgcttattttttgcttgtatacaaatgaatgtgttgaagacttttgaactgtcctttgagttcaaatatgttcacatcccagccattttgatatgtagtagtcttgttttctaagtagtatatcattgtgttttaaatttctggttcaataattaagtttttcaaaa

SEQ ID NO: 446235 - DNA, 375 bp, Homo sapiens
tgatctttggatataatgtaggtaaaacttttaaacctagtttctcacacacacaataggtacctgagaaatgatagctgctgttatagtgagtgaaagcaaaggatgtttatacttttgaggaaacatggatgcttgatttttaaaaagcagtctgcattgactcaaaggcttcttaagctatttttcctaggtattgttatccacccttccaaaaaacaaccaaccacatcttggatttgactcaaggcatgagggaaaaaattagtcttctaaagctctctggatatggcaagtgtttgtagtacttaaacttattgaaattattattgtaaacaggcccaggatgttttggtgcaggagatggaagtggtt

SEQ ID NO: 446236 - DNA, 6899 bp, Homo sapiens
tgcgcggggcgtaaggcgctttggccagagtggtttgatggttttgtgttagtcttcctgcagctgagcttccacaagacactttttccctttcagccacccaatatctcgcgagacttgctattctgcgccccctcctaccttgcgcttgcgcagatcttcaaagcagaaggtcgcgcttggaggaagtggcggctttgagtccggtggcccaatcgctgttactacttctctgaagctcctctcggctgcttgccgagacaccctgccgccaagatgcctcgaattatgatcaaggggggcgtatggaggaataccgaggatgaaattctgaaagcagcggtaatgaaatatgggaaaaatcagtggtctaggattgcctcattgctgcatagaaaatcagcaaagcagtgcaaagccagatggtatgaatggctggatccaagcattaagaagacagaatggtccagagaagaagaggaaaaactcttgcacttggccaagttgatgccaactcagtggaggaccattgctccaatcattggaagaacagcggcccagtgcttagaacactatgaatttcttctggataaagctgcccaaagagacaatgaagaggaaacaacagatgatccacgaaaacttaaacctggagaaatagatccaaatccagaaacaaaaccagcgcggcctgatccaattgatatggatgaggatgaacttgagatgctttctgaagccagagcccgcttggctaatactcagggaaagaaggccaagaggaaagcaagagagaaacaattggaagaagcaagacgtcttgctgccctccaaaaaagaagagaacttcgagcagctggcatagaaattcagaagaaaagaaaaaggaagagaggagttgattataatgccgaaatcccatttgaaaaaaagcctgcccttggtttttatgatacttctgaggaaaactaccaagctcttgacgcagatttcaggaaattaagacaacaggatcttgatggggagctaagatctgaaaaagaaggaagagatagaaaaaaagacaaacagcatttgaaaaggaaaaaagaatctgatttaccatcagctattcttcaaactagtggtgtttctgaatttactaaaaagagaagcaaactagtacttcctgcccctcagatttcagatgcagaactccaggaagttgtaaaagtaggccaagcgagtgaaattgcacgtcaaactgccgaggaatctggcataacaaattctgcttccagtacacttttgtctgagtacaatgtcaccaacaacagcgttgctcttagaacaccacgaacaccagcttcccaggacagaattctgcaggaagcccagaacctcatggccctcaccaatgtggacaccccattgaaaggtggacttaataccccattgcatgagagtgacttctcaggtgtaactccacagcgacaagttgtacagactccaaacacagttctctctactccattcaggactccttctaatggagctgaagggctgactccccggagtggaacaactcccaaaccagttattaactctactccgggtagaactcctcttcgagacaagttaaacattaatcccgaggatggaatggcagactatagtgatccctcttacgtgaagcagatggaaagagaatcccgagaacatctccgtttagggttgttgggccttcctgcccctaagaatgattttgaaattgttctaccagaaaatgccgagaaggagctggaagaacgtgaaatagatgatacttacattgaagatgctgctgatgtggatgctcgaaagcaggccatacgagatgcagagcgtgtaaaggaaatgaaacgaatgcataaagctgtccagaaagatctgccaagaccatcagaagtaaatgaaactattctaagacccttaaatgtagaaccgcctttaacagatttacagaaaagtgaagaactaatcaaaaaagaaatgatcacaatgcttcattatgaccttctacatcacccttatgaaccatctggaaataaaaaaggcaaaactgtagggtttggtaccaataattcagagcacattacctatctggaacataatccttatgaaaagttctccaaagaagagctgaaaaaggcccaggatgttttggtgcaggagatggaagtggttaaacaaggaatgagccatggagagctctcaagtgaagcttataaccaggtgtgggaagaatgctacagtcaagttttatatcttcctgggcagagccgctacacacgggccaatctggctagtaaaaaggacagaattgaatcacttgaaaagaggctcgagataaacaggggtcacatgacgacagaagccaagagggctgcaaagatggaaaagaagatgaaaattttgcttgggggttaccagtctcgtgctatggggctcatgaaacagttgaatgacttatgggaccaaattgaacaggctcacttggagttacgcacttttgaagaactcaagaaacatgaagattctgctattccccggaggctagagtgtctaaaagaagacgttcagcgacaacaagaaagagaaaaggaacttcaacatagatatgctgatttgctgctggagaaagagactttaaagtcaaaattctgaagtacagtttatattctgtcacaggattaattaattgccggttttcatactctagaaggctgaaactgatgtttatcttcattgacaaatttacccaccatctgtggtttttcagttgtttattttaaatgatatcgatcttacacattctgtgtataaagaccttaactccacaggacggacattttagagtttaaattattaaggctatcattcttttagtaatgtcatatttgcaaacttttttagttttggcctttaatttaaaaagcctaattttaaagtgctgcctgtgagtaactcttgaataaaaacaaaatataaaaaattgagaatgtagccttttgtttgaagtaattagatacttaagagtgcctgcaaaccagcagctatgtactctgtgtcatatttaatgagtaactcttgggtaatcaaaatggtgatgcagtatcttaaacacttaagaggcagttctttgtggctttgttagtttcagcaaagagtggtcatttctgtatacactgacaagttagattaactttttagtacctcaaattttttttttgttaatatcactttaaagaaggtctcttgtctgccagctacttaaataatttatgggtcagggcttaaaagatttaacttccttgccccattattttcttataagtattttttgacaaaggcattttaaaagttaatttcaagaaggccatcaaacttaaagctctatgtttagcctaagaagtcagttacatcagtgtagaatttggggaatggatagaggtggagatatttaattttatataattcatataaattgatttagttacagtatcagttggctacaagctcattatagactagcaatgttttgacatcaccaaaaacgtttgcccagtcttagaatactagggactataggaagggaagggattcattcattcattcgatattgaatgtataccctgtgccagagtcttagagagagaacaacaaacaaaataggcctagttcttgtttagtagagcttatagtcttttgagaatgacagacaattaaaatccaaatgtttatttggtgattcttatgtgtcagacacttaagtgttgggagataagcagttattaagacagagttcttgctctcatggaggtgacattagtggggaggagatactaagtatgtccagggaaagtatcagaccatgagttttagattctgtggaggaaattaaagtagggtgattatgagatagtgaatgagtggctattttagactggacgatcaaagagacctcttggaaggcagctatgctcaccactataccactgcactgtgccgcaccgtaccactataagctgcacggccaaagagacctcttaaagaagtaacatttaagataacatgtgattgacattttagaatgggctatccttgtgagattcaaggaaagaacatcctaggtggagtgaatagcaaacataaagcctcttttgtatgtttgaggaacaaaaaggacaatgcagctagagtgtcaagaatggcatttctgtatataagacctcgttgtatagagccacataaataaggctataataaggaatttggatcttactttaaatatgataagaatcgatgagaagatctaagcaaaggaatgacatgatcagatttggttttagaaacatcactatctccttagtgtgtaaaatctcaccaggctggagatagggaagccagtccaattaggagcctgatgcagtgatccagacaaaaaaataatagtgattctaactagagtccaggtaatagtagtggagatatgtggagagacatgataggtatatacttaatagtcttatcagacgataaattgatattttcctggtgtgtagtcacttaattcaaatacttttttcagtaagttctgggttttctaggaaaaacttcagtatcatcagtgaataatgatagtgtttcttctgatagttttatttcacttttattgcatgttttgttatctgaaatgtttaggacaatgttaacaataatgatgttagacatttttttttcttattttaatgggaatgtccatagttttaagtttgctgttgggagttagatagtctttatctgaaagacagtgtctctcttttagtttttaaagagtttgaattagaaatggctctggaactttaaacagtataccatttgggcatctattaaagcattcatataattgttctcatttgatgttttgatgaggtatattaatagattttcccacattaaatcatctttgcactcctggaatcaggtagattaatttttaaaagaaattttaaaggatttatagtttatttgcactttttgtagacttgaattatatggatttaaaagttgatctaatattaataaaggctcactttgttttcaaaatttgaagtaattcacatacttatagcctaaaatcggcaggaattacaaaatttcaaaactggcacattgtaaactgcatatgcatttgccaggtagtggtgccacttgaaatggtgaacagacacactgttatcctttgtcagtatcctgtaaagcccaggattctttaccagcaccatacagcgattttggtgactattttaacattcacactgaggccaggggtggtgagtcatgcctgtaatcctagcactttgggaggccaaggtgggaggatcatttgagctcaggagttcaagattagcctgggtaacatagtgagaccctgtctctattaaaaaataataataaaaataacattcacattggtattgttcactaaggtattggttgttaaggcattcattaaggtattgttaaaacttgtgttaagcatgttaaagtctcagtaactttgggatagaaataaaatgtgataaaaagctgaaagaaaccaccacaagggagagtcctttttgaaatattagagacataatgctgtctaataaaaaacgacatcaaagaaaaactacactacagtgactgcagacttaatgttggccaaccatgcatcctccctagaaatgcatttgaatttgatttactaatcttttatttaggaaatttacatttttacattagtgagattggtcttttgggctattgtacttttttttttttttttttgagatggagtcttgctctctcacccaggctggagtgcagtagtgcaatcttggcccactgcaacctctgcctcctgggctcgagtgattctctgcctcagccttccaagtagctgggactacaggcatgtgccaccgcacctggctaatttttgtgtttttagtagagatggggttttgctatgttggccaggctggtcttgaattcctgacctcaggtgatccacctacctcggcctcccaaagtgctagaattacaggtgtgagccaccatgcccagcctggttattgtattttgatattgggattttgctagctctctaaagtaaataggataactgtatatctttttctgtgcattaagcagttataacatgggaatgatttgttcatgaaaggttgaaagtctgtacttacagaacttttgagttcacagtgctttctggaaataatttctttataactgtcagtttcttttgtgactattatgttacctatttttaaatttaagcaactttaaattaaaaaaattgtttttaaaatatattcttccttttatgtttatttagtaaatttaggtaatgtatactttttaagaaatatttttattttgttcaaatttaaacatctgttgttagcagaaaattctaatagcaatttcttttctattaactttgccatttctaagttataggaaatttaccttctcttaattctaccactttttacttgactagacttgttaagggtatacattttctgttcagaaaactagtgtttttattggcttatctattgtgattttgttttaaaatatgttaatttctcaatttaggcttattattttgttttctgtagttttttgactttttgagactgatgcttattttttgcttgtatacaaatgaatgtgttgaagacttttgaactgtcctttgagttcaaatatgttcacatcccagccattttgatatgtagtagtcttgttttctaagtagtatatcattgtgttttaaatttctggttcaataattaagtttttcaaaa

SEQ ID NO: 446237 - DNA, 6926 bp, Homo sapiens
tgcgcggggcgtaaggcgctttggccagagtggtttgatggttttgtgttagtcttcctgcagctgagcttccacaagacactttttccctttcagccacccaatatctcgcgagacttgctattctgcgccccctcctaccttgcgcttgcgcagatcttcaaagcagaaggtcgcgcttggaggaagtggcggctttgagtccggtggcccaatcgctgttactacttctctgaagctcctctcggctgcttgccgagacaccctgccgccaagatgcctcgaattatgatcaaggggggcgtatggaggaataccgaggatgaaattctgaaagcagcggtaatgaaatatgggaaaaatcagtggtctaggattgcctcattgctgcatagaaaatcagcaaagcagtgcaaagccagatggtatgaatggctggatccaagcattaagaagacagaatggtccagagaagaagaggaaaaactcttgcacttggccaagttgatgccaactcagtggaggaccattgctccaatcattggaagaacagcggcccagtgcttagaacactatgaatttcttctggataaagctgcccaaagagacaatgaagaggaaacaacagatgatccacgaaaacttaaacctggagaaatagatccaaatccagaaacaaaaccagcgcggcctgatccaattgatatggatgaggatgaacttgagatgctttctgaagccagagcccgcttggctaatactcagggaaagaaggccaagaggaaagcaagagagaaacaattggaagaagcaagacgtcttgctgccctccaaaaaagaagagaacttcgagcagctggcatagaaattcagaagaaaagaaaaaggaagagaggagttgattataatgccgaaatcccatttgaaaaaaagcctgcccttggtttttatgatacttctgaggaaaactaccaagctcttgacgcagatttcaggaaattaagacaacaggatcttgatggggagctaagatctgaaaaagaaggaagagatagaaaaaaagacaaacagcatttgaaaaggaaaaaagaatctgatttaccatcagctattcttcaaactagtggtgtttctgaatttactaaaaagagaagcaaactagtacttcctgcccctcagatttcagatgcagaactccaggaagttgtaaaagtaggccaagcgagtgaaattgcacgtcaaactgccgaggaatctggcataacaaattctgcttccagtacacttttgtctgagtacaatgtcaccaacaacagcgttgctcttagaacaccacgaacaccagcttcccaggacagaattctgcaggaagcccagaacctcatggccctcaccaatgtggacaccccattgaaaggtggacttaataccccattgcatgagagtgacttctcaggtgtaactccacagcgacaagttgtacagactccaaacacagttctctctactccattcaggactccttctaatggagctgaagggctgactccccggagtggaacaactcccaaaccagttattaactctactccgggtagaactcctcttcgagacaagttaaacattaatcccgaggatggaatggcagactatagtgatccctcttacgtgaagcagatggaaagagaatcccgagaacatctccgtttagggttgttgggccttcctgcccctaagaatgattttgaaattgttctaccagaaaatgccgagaaggagctggaagaacgtgaaatagatgatacttacattgaagatgctgctgatgtggatgctcgaaagcaggccatacgagatgcagagcgtgtaaaggaaatgaaacgaatgcataaagctgtccagaaagatctgccaagaccatcagaagtaaatgaaactattctaagacccttaaatgtagaaccgcctttaacagatttacagaaaagtgaagaactaatcaaaaaagaaatgatcacaatgcttcattatgaccttctacatcacccttatgaaccatctggaaataaaaaaggcaaaactgtagggtttggtaccaataattcagagcacattacctatctggaacataatccttatgaaaagttctccaaagaagagctgaaaaaggcccaggatgttttggtgcaggagatggaagtggttaaacaaggaatgagccatggagagctctcaagtgaagcttataaccaggtgtgggaagaatgctacagtcaagttttatatcttcctgggcagagccgctacacacgggccaatctggctagtaaaaaggacagaattgaatcacttgaaaagaggctcgagataaacaggggtcacatgacgacagaagccaagagggctgcaaagatggaaaagaagatgaaaattttgcttgggggttaccagtctcgtgctatggggctcatgaaacagttgaatgacttatgggaccaaattgaacaggctcacttggagttacgcacttttgaagaactcaagaaacatgaagattctgctattccccggaggctagagtgtctaaaagaagacgttcagcgacaacaagaaagagaaaaggaacttcaacatagatatgctgatttgctgctggagaaagagactttaaagtcaaaattctgaagtacagtttatattctgtcacaggattaattaattgccggttttcatactctagaaggctgaaactgatgtttatcttcattgacaaatttacccaccatctgtggtttttcagttgtttattttaaatgatatcgatcttacacattctgtgtataaagaccttaactccacaggacggacattttagagtttaaattattaaggctatcattcttttagtaatgtcatatttgcaaacttttttagttttggcctttaatttaaaaagcctaattttaaagtgctgcctgtgagtaactcttgaataaaaacaaaatataaaaaattgagaatgtagccttttgtttgaagtaattagatacttaagagtgcctgcaaaccagcagctatgtactctgtgtcatatttaatgagtaactcttgggtaatcaaaatggtgatgcagtatcttaaacacttaagaggcagttctttgtggctttgttagtttcagcaaagagtggtcatttctgtatacactgacaagttagattaactttttagtacctcaaattttttttttgttaatatcactttaaagaaggtctcttgtctgccagctacttaaataatttatgggtcagggcttaaaagatttaacttccttgccccattattttcttataagtattttttgacaaaggcattttaaaagttaatttcaagaaggccatcaaacttaaagctctatgtttagcctaagaagtcagttacatcagtgtagaatttggggaatggatagaggtggagatatttaattttatataattcatataaattgatttagttacagtatcagttggctacaagctcattatagactagcaatgttttgacatcaccaaaaacgtttgcccagtcttagaatactagggactataggaagggaagggattcattcattcattcgatattgaatgtataccctgtgccagagtcttagagagagaacaacaaacaaaataggcctagttcttgtttagtagagcttatagtcttttgagaatgacagacaattaaaatccaaatgtttatttggtgattcttatgtgtcagacacttaagtgttgggagataagcagttattaagacagagttcttgctctcatggaggtgacattagtggggaggagatactaagtatgtccagggaaagtatcagaccatgagttttagattctgtggaggaaattaaagtagggtgattatgagatagtgaatgagtggctattttagactggacgatcaaagagacctcttggaaggcagctatgctcaccactataccactgcactgtgccgcaccgtaccactataagctgcacggccaaagagacctcttaaagaagtaacatttaagataacatgtgattgacattttagaatgggctatccttgtgagattcaaggaaagaacatcctaggtggagtgaatagcaaacataaagcctcttttgtatgtttgaggaacaaaaaggacaatgcagctagagtgtcaagaatggcatttctgtatataagacctcgttgtatagagccacataaataaggctataataaggaatttggatcttactttaaatatgataagaatcgatgagaagatctaagcaaaggaatgacatgatcagatttggttttagaaacatcactatctccttagtgtgtaaaatctcaccaggctggagatagggaagccagtccaattaggagcctgatgcagtgatccagacaaaaaaataatagtgattctaactagagtccaggtaatagtagtggagatatgtggagagacatgataggtatatacttaatagtcttatcagacgataaattgatattttcctggtgtgtagtcacttaattcaaatacttttttcagtaagttctgggttttctaggaaaaacttcagtatcatcagtgaataatgatagtgtttcttctgatagttttatttcacttttattgcatgttttgttatctgaaatgtttaggacaatgttaacaataatgatgttagacatttttttttcttattttaatgggaatgtccatagttttaagtttgctgttgggagttagatagtctttatctgaaagacagtgtctctcttttagtttttaaagagtttgaattagaaatggctctggaactttaaacagtataccatttgggcatctattaaagcattcatataattgttctcatttgatgttttgatgaggtatattaatagattttcccacattaaatcatctttgcactcctggaatcaggtagattaatttttaaaagaaattttaaaggatttatagtttatttgcactttttgtagacttgaattatatggatttaaaagttgatctaatattaataaaggctcactttgttttcaaaatttgaagtaattcacatacttatagcctaaaatcggcaggaattacaaaatttcaaaactggcacattgtaaactgcatatgcatttgccaggtagtggtgccacttgaaatggtgaacagacacactgttatcctttgtcagtatcctgtaaagcccaggattctttaccagcaccatacagcgattttggtgactattttaacattcacactgaggccaggggtggtgagtcatgcctgtaatcctagcactttgggaggccaaggtgggaggatcatttgagctcaggagttcaagattagcctgggtaacatagtgagaccctgtctctattaaaaaataataataaaaataacattcacattggtattgttcactaaggtattggttgttaaggcattcattaaggtattgttaaaacttgtgttaagcatgttaaagtctcagtaactttgggatagaaataaaatgtgataaaaagctgaaagaaaccaccacaagggagagtcctttttgaaatattagagacataatgctgtctaataaaaaacgacatcaaagaaaaactacactacagtgactgcagacttaatgttggccaaccatgcatcctccctagaaatgcatttgaatttgatttactaatcttttatttaggaaatttacatttttacattagtgagattggtcttttgggctattgtacttttttttttttttttttgagatggagtcttgctctctcacccaggctggagtgcagtagtgcaatcttggcccactgcaacctctgcctcctgggctcgagtgattctctgccttacaggacttctcccaagatagcgggaggagcatacagggctgtgttcgccaccggaacccgtggcataaattctgggggttatcaagataagacgacatggggttttgctatgttggccaggctggtcttgaattcctgacctcaggtgatccacctacctcggcctcccaaagtgctagaattacaggtgtgagccaccatgcccagcctggttattgtattttgatattgggattttgctagctctctaaagtaaataggataactgtatatctttttctgtgcattaagcagttataacatgggaatgatttgttcatgaaaggttgaaagtctgtacttacagaacttttgagttcacagtgctttctggaaataatttctttataactgtcagtttcttttgtgactattatgttacctatttttaaatttaagcaactttaaattaaaaaaattgtttttaaaatatattcttccttttatgtttatttagtaaatttaggtaatgtatactttttaagaaatatttttattttgttcaaatttaaacatctgttgttagcagaaaattctaatagcaatttcttttctattaactttgccatttctaagttataggaaatttaccttctcttaattctaccactttttacttgactagacttgttaagggtatacattttctgttcagaaaactagtgtttttattggcttatctattgtgattttgttttaaaatatgttaatttctcaatttaggcttattattttgttttctgtagttttttgactttttgagactgatgcttattttttgcttgtatacaaatgaatgtgttgaagacttttgaactgtcctttgagttcaaatatgttcacatcccagccattttgatatgtagtagtcttgttttctaagtagtatatcattgtgttttaaatttctggttcaataattaagtttttcaaaa

SEQ ID NO: 446238 - DNA, 4416 bp, Homo sapiens
tgcgcggggcgtaaggcgctttggccagagtggtttgatggttttgtgttagtcttcctgcagctgagcttccacaagacactttttccctttcagccacccaatatctcgcgagacttgctattctgcgccccctcctaccttgcgcttgcgcagatcttcaaagcagaaggtcgcgcttggaggaagtggcggctttgagtccggtggcccaatcgctgttactacttctctgaagctcctctcggctgcttgccgagacaccctgccgccaagatgcctcgaattatgatcaaggggggcgtatggaggaataccgaggatgaaattctgaaagcagcggtaatgaaatatgggaaaaatcagtggtctaggattgcctcattgctgcatagaaaatcagcaaagcagtgcaaagccagatggtatgaatggctggatccaagcattaagaagacagaatggtccagagaagaagaggaaaaactcttgcacttggccaagttgatgccaactcagtggaggaccattgctccaatcattggaagaacagcggcccagtgcttagaacactatgaatttcttctggataaagctgcccaaagagacaatgaagaggaaacaacagatgatccacgaaaacttaaacctggagaaatagatccaaatccagaaacaaaaccagcgcggcctgatccaattgatatggatgaggatgaacttgagatgctttctgaagccagagcccgcttggctaatactcagggaaagaaggccaagaggaaagcaagagagaaacaattggaagaagcaagacgtcttgctgccctccaaaaaagaagagaacttcgagcagctggcatagaaattcagaagaaaagaaaaaggaagagaggagttgattataatgccgaaatcccatttgaaaaaaagcctgcccttggtttttatgatacttctgaggaaaactaccaagctcttgacgcagatttcaggaaattaagacaacaggatcttgatggggagctaagatctgaaaaagaaggaagagatagaaaaaaagacaaacagcatttgaaaaggaaaaaagaatctgatttaccatcagctattcttcaaactagtggtgtttctgaatttactaaaaagagaagcaaactagtacttcctgcccctcagatttcagatgcagaactccaggaagttgtaaaagtaggccaagcgagtgaaattgcacgtcaaactgccgaggaatctggcataacaaattctgcttccagtacacttttgtctgagtacaatgtcaccaacaacagcgttgctcttagaacaccacgaacaccagcttcccaggacagaattctgcaggaagcccagaacctcatggccctcaccaatgtggacaccccattgaaaggtggacttaataccccattgcatgagagtgacttctcaggtgtaactccacagcgacaagttgtacagactccaaacacagttctctctactccattcaggactccttctaatggagctgaagggctgactccccggagtggaacaactcccaaaccagttattaactctactccgggtagaactcctcttcgagacaagttaaacattaatcccgaggatggaatggcagactatagtgatccctcttacgtgaagcagatggaaagagaatcccgagaacatctccgtttagggttgttgggccttcctgcccctaagaatgattttgaaattgttctaccagaaaatgccgagaaggagctggaagaacgtgaaatagatgatacttacattgaagatgctgctgatgtggatgctcgaaagcaggccatacgagatgcagagcgtgtaaaggaaatgaaacgaatgcataaagctgtccagaaagatctgccaagaccatcagaagtaaatgaaactattctaagacccttaaatgtagaaccgcctttaacagatttacagaaaagtgaagaactaatcaaaaaagaaatgatcacaatgcttcattatgaccttctacatcacccttatgaaccatctggaaataaaaaaggcaaaactgtagggtttggtaccaataattcagagcacattacctatctggaacataatccttatgaaaagttctccaaagaagagctgaaaaaggcccaggatgttttggtgcaggagatggaagtggttaaacaaggaatgagccatggagagctctcaagtgaagcttataaccaggtgtgggaagaatgctacagtcaagttttatatcttcctgggcagagccgctacacacgggccaatctggctagtaaaaaggacagaattgaatcacttgaaaagaggctcgagataaacaggggtcacatgacgacagaagccaagagggctgcaaagatggaaaagaagatgaaaattttgcttgggggttaccagtctcgtgctatggggctcatgaaacagttgaatgacttatgggaccaaattgaacaggctcacttggagttacgcacttttgaagaactcaagaaacatgaagattctgctattccccggaggctagagtgtctaaaagaagacgttcagcgacaacaagaaagagaaaaggaacttcaacatagatatgctgatttgctgctggagaaagagactttaaagtcaaaattctgaagtacagtttatattctgtcacaggattaattaattgccggttttcatactctagaaggctgaaactgatgtttatcttcattgacaaatttacccaccatctgtggtttttcagttgtttattttaaatgatatcgatcttacacattctgtgtataaagaccttaactccacaggacggacattttagagtttaaattattaaggctatcattcttttagtaatgtcatatttgcaaacttttttagttttggcctttaatttaaaaagcctaattttaaagtgctgcctgtgagtaactcttgaataaaaacaaaatataaaaaattgagaatgtagccttttgtttgaagtaattagatacttaagagtgcctgcaaaccagcagctatgtactctgtgtcatatttaatgagtaactcttgggtaatcaaaatggtgatgcagtatcttaaacacttaagaggcagttctttgtggctttgttagtttcagcaaagagtggtcatttctgtatacactgacaagttagattaactttttagtacctcaaattttttttttgttaatatcactttaaagaaggtctcttgtctgccagctacttaaataatttatgggtcagggcttaaaagatttaacttccttgccccattattttcttataagtattttttgacaaaggcattttaaaagttaatttcaagaaggccatcaaacttaaagctctatgtttagcctaagaagtcagttacatcagtgtagaatttggggaatggatagaggtggagatatttaattttatataattcatataaattgatttagttacagtatcagttggctacaagctcattatagactagcaatgttttgacatcaccaaaaacgtttgcccagtcttagaatactagggactataggaagggaagggattcattcattcattcgatattgaatgtataccctgtgccagagtcttagagagagaacaacaaacaaaataggcctagttcttgtttagtagagcttatagtcttttgagaatgacagacaattaaaatccaaatgtttatttggtgattcttatgtgtcagacacttaagtgttgggagataagcagttattaagacagagttcttgctctcatggaggtgacattagtggggaggagatactaagtatgtccagggaaagtatcagaccatgagttttagattctgtggaggaaattaaagtagggtgattatgagatagtgaatgagtggctattttagactggacgatcaaagagacctcttggaaggcagctatgctcaccactataccactgcactgtgccgcaccgtaccactataagctgcacggccaaagagacctcttaaagaagtaacatttaagataacatgtgattgacattttagaatgggctatccttgtgagattcaaggaaagaacatcctaggtggagtgaatagcaaacataaagcctcttttgtatgtttgaggaacaaaaaggacaatgcagctagagtgtcaagaatggcatttctgtatataagacctcgttgtatagagccacataaataaggctataataaggaatttggatcttaaatgttacttctttaagaggtctctttggccgtgcagcttatagtggtacggtgcggcacagtgcagtggtatagtggtgagcatagctgccttccaagaggtctctttgatcg

SEQ ID NO: 446239 - DNA, 3219 bp, Homo sapiens
tgcgcggggcgtaaggcgctttggccagagtggtttgatggttttgtgttagtcttcctgcagctgagcttccacaagacactttttccctttcagccacccaatatctcgcgagacttgctattctgcgccccctcctaccttgcgcttgcgcagatcttcaaagcagaaggtcgcgcttggaggaagtggcggctttgagtccggtggcccaatcgctgttactacttctctgaagctcctctcggctgcttgccgagacaccctgccgccaagatgcctcgaattatgatcaaggggggcgtatggaggaataccgaggatgaaattctgaaagcagcggtaatgaaatatgggaaaaatcagtggtctaggattgcctcattgctgcatagaaaatcagcaaagcagtgcaaagccagatggtatgaatggctggatccaagcattaagaagacagaatggtccagagaagaagaggaaaaactcttgcacttggccaagttgatgccaactcagtggaggaccattgctccaatcattggaagaacagcggcccagtgcttagaacactatgaatttcttctggataaagctgcccaaagagacaatgaagaggaaacaacagatgatccacgaaaacttaaacctggagaaatagatccaaatccagaaacaaaaccagcgcggcctgatccaattgatatggatgaggatgaacttgagatgctttctgaagccagagcccgcttggctaatactcagggaaagaaggccaagaggaaagcaagagagaaacaattggaagaagcaagacgtcttgctgccctccaaaaaagaagagaacttcgagcagctggcatagaaattcagaagaaaagaaaaaggaagagaggagttgattataatgccgaaatcccatttgaaaaaaagcctgcccttggtttttatgatacttctgaggaaaactaccaagctcttgacgcagatttcaggaaattaagacaacaggatcttgatggggagctaagatctgaaaaagaaggaagagatagaaaaaaagacaaacagcatttgaaaaggaaaaaagaatctgatttaccatcagctattcttcaaactagtggtgtttctgaatttactaaaaagagaagcaaactagtacttcctgcccctcagatttcagatgcagaactccaggaagttgtaaaagtaggccaagcgagtgaaattgcacgtcaaactgccgaggaatctggcataacaaattctgcttccagtacacttttgtctgagtacaatgtcaccaacaacagcgttgctcttagaacaccacgaacaccagcttcccaggacagaattctgcaggaagcccagaacctcatggccctcaccaatgtggacaccccattgaaaggtggacttaataccccattgcatgagagtgacttctcaggtgtaactccacagcgacaagttgtacagactccaaacacagttctctctactccattcaggactccttctaatggagctgaagggctgactccccggagtggaacaactcccaaaccagttattaactctactccgggtagaactcctcttcgagacaagttaaacattaatcccgaggatggaatggcagactatagtgatccctcttacgtgaagcagatggaaagagaatcccgagaacatctccgtttagggttgttgggccttcctgcccctaagaatgattttgaaattgttctaccagaaaatgccgagaaggagctggaagaacgtgaaatagatgatacttacattgaagatgctgctgatgtggatgctcgaaagcaggccatacgagatgcagagcgtgtaaaggaaatgaaacgaatgcataaagctgtccagaaagatctgccaagaccatcagaagtaaatgaaactattctaagacccttaaatgtagaaccgcctttaacagatttacagaaaagtgaagaactaatcaaaaaagaaatgatcacaatgcttcattatgaccttctacatcacccttatgaaccatctggaaataaaaaaggcaaaactgtagggtttggtaccaataattcagagcacattacctatctggaacataatccttatgaaaagttctccaaagaagagctgaaaaaggcccaggatgttttggtgcaggagatggaagtggttaaacaaggaatgagccatggagagctctcaagtgaagcttataaccaggtgtgggaagaatgctacagtcaagttttatatcttcctgggcagagccgctacacacgggccaatctggctagtaaaaaggacagaattgaatcacttgaaaagaggctcgaggttcaggagataagcccttctctgtaagcactgtatgccatggctgccagtgtgtttgatttttgctgccatgaactttggaaccgtgaatctaaattatggccctatcactgcctatcaagcaagatgaagtccagctttgtcgtggctggtgtctcctgaatggattaaaaaaaaaaatgccctgaggtttatattggagataaacaggggtcacatgacgacagaagccaagagggctgcaaagatggaaaagaagatgaaaattttgcttgggggttaccagtctcgtgctatggggctcatgaaacagttgaatgacttatgggaccaaattgaacaggctcacttggagttacgcacttttgaagaactcaagaaacatgaagattctgctattccccggaggctagagtgtctaaaagaagacgttcagcgacaacaagaaagagaaaaggaacttcaacatagatatgctgatttgctgctggagaaagagactttaaagtcaaaattctgaagtacagtttatattctgtcacaggattaattaattgccggttttcatactctagaaggctgaaactgatgtttatcttcattgacaaatttacccaccatctgtggtttttcagttgtttattttaaatgatatcgatcttacacattctgtgtataaagaccttaactccacaggacggacattttagagtttaaattattaaggctatcattcttttagtaatgtcatatttgcaaacttttttagttttggcctttaatttaaaaagcctaattttaaagtgctgcctgtgagtaactcttgaataaaaacaaaatataaaaaattga

SEQ ID NO: 446240 - DNA, 2303 bp, Homo sapiens
tgcgcggggcgtaaggcgctttggccagagtggtttgatggttttgtgttagtcttcctgcagctgagcttccacaagacactttttccctttcagccacccaatatctcgcgagacttgctattctgcgccccctcctaccttgcgcttgcgcagatcttcaaagcagaaggtcgcgcttggaggaagtggcggctttgagtccggtggcccaatcgctgttactacttctctgaagctcctctcggctgcttgccgagacaccctgccgccaagatgcctcgaattatgatcaaggggggcgtatggaggaataccgaggatgaaattctgaaagcagcggtaatgaaatatgggaaaaatcagtggtctaggattgcctcattgctgcatagaaaatcagcaaagcagtgcaaagccagatggtatgaatggctggatccaagcattaagaagacagaatggtccagagaagaagaggaaaaactcttgcacttggccaagttgatgccaactcagtggaggaccattgctccaatcattggaagaacagcggcccagtgcttagaacactatgaatttcttctggataaagctgcccaaagagacaatgaagaggaaacaacagatgatccacgaaaacttaaacctggagaaatagatccaaatccagaaacaaaaccagcgcggcctgatccaattgatatggatgaggatgaacttgagatgctttctgaagccagagcccgcttggctaatactcagggaaagaaggccaagaggaaagcaagagagaaacaattggaagaagcaagacgtcttgctgccctccaaaaaagaagagaacttcgagcagctggcatagaaattcagaagaaaagaaaaaggaagagaggagttgattataatgccgaaatcccatttgaaaaaaagcctgcccttggtttttatgatacttctgaggaaaactaccaagctcttgacgcagatttcaggaaattaagacaacaggatcttgatggggagctaagatctgaaaaagaaggaagagatagaaaaaaagacaaacagcatttgaaaaggaaaaaagaatctgatttaccatcagctattcttcaaactagtggtgtttctgaatttactaaaaagagaagcaaactagtacttcctgcccctcagatttcagatgcagaactccaggaagttgtaaaagtaggccaagcgagtgaaattgcacgtcaaactgccgaggaatctggcataacaaattctgcttccagtacacttttgtctgagtacaatgtcaccaacaacagcgttgctcttagaacaccacgaacaccagcttcccaggacagaattctgcaggaagcccagaacctcatggccctcaccaatgtggacaccccattgaaaggtggacttaataccccattgcatgagagtgacttctcaggtgtaactccacagcgacaagttgtacagactccaaacacagttctctctactccattcaggactccttctaatggagctgaagggctgactccccggagtggaacaactcccaaaccagttattaactctactccgggtagaactcctcttcgagacaagttaaacattaatcccgaggatggaatggcagactatagtgatccctcttacgtgaagcagatggaaagagaatcccgagaacatctccgtttagggttgttgggccttcctgcccctaagaatgattttgaaattgttctaccagaaaatgccgagaaggagctggaagaacgtgaaatagatgatacttacattgaagatgctgctgatgtggatgctcgaaagcaggccatacgagatgcagagcgtgtaaaggaaatgaaacgaatgcataaagctgtccagaaagatctgccaagaccatcagaagtaaatgaaactattctaagacccttaaatgtagaaccgcctttaacagatttacagaaaagtgaagaactaatcaaaaaagaaatgatcacaatgcttcattatgaccttctacatcacccttatgaaccatctggaaataaaaaaggcaaaactgtagggtttggtaccaataattcagagcacattacctatctggaacataatccttatgtgcaactgcttacacacggattggccccttggatcagctcttaagggacacttatcaccatgcccgccaccaaatgttcacgtcacttctcaaacctccactggtcacacccgttcctcacgcgctctctctcctctgctcccgtgcccactcgactctccct

SEQ ID NO: 446241 - DNA, 712 bp, Homo sapiens
tttggtagagacagggttttaccatgctgcccaggctggtctcgaattcctgagcgcaggcgatccgcccaggagtcaagaccagccttggcaacatagcaagaccccatctcttggcatttaatatgtactagctcatttaactcattcagcaattaaactactgagtgcctactatgttaagcagtagggaacaatgaataaaaagagagaaagctagcatttattgtacccctacgtgccaggcattgggtactcagaagagaacacatatagaaagtcatgtccacatggagcttacattctagtggaaggaaacagactagcaacaaggacttaaataaataagcagataattccagaacctgataaatgcaataaagataataaaacagtgatatgagagtgattagggagaggcactaatttagacagagggacaggaaaagcatctttgggatggtgacatttcagctgaggtttgaagagagcattgtagacagatggaagagtaagtgcaaagttcctgttagaaacaagttttagggggcgggtgtggtggctcacacctgtaatcctagcactttaggaggccgaagtgggtggattgcttgagcccaggagttcaagaccagtctgggcaacatagtgagagtttgtttctacaaataaaaaaaaattagccagatatggtggctcatgcctgtggtcc

SEQ ID NO: 446242 - DNA, 712 bp, Homo sapiens
tttggtagagacagggttttaccatgctgcccaggctggtctcgaattcctgagcgcaggcgatccgcccaggagtcaagaccagccttggcaacatagcaagaccccatctcttggcatttaatatgtactagctcatttaactcattcagcaattaaactactgagtgcctactatgttaagcagtagggaacaatgaaaaaatattgtctttgccttcaaacagttcaaagaagcatcataacaggaatttttaaaaagagagaaagctagcatttattgtacccctacgtgccaggcattgggtactcagaagagaacacatatagaaagtcatgtccacatggagcttacattctagtggaaggaaacagactagcaacaaggacttaaataaataagcagataattccagaacctgataaatgcaataaagataataaaacagtgatatgagagtgattagggagaggcactaatttagacagagggacaggaaaagcatctttgggatggtgacatttcagctgaggtttgaagagaagggggcgggtgtggtggctcacacctgtaatcctagcactttaggaggccgaagtgggtggattgcttgagcccaggagttcaagaccagtctgggcaacatagtgagagtttgtttctacaaataaaaaaaaattagccagatatggtggctcatgcctgtggtcc

SEQ ID NO: 446243 - DNA, 1461 bp, Homo sapiens
tttggtagagacagggttttaccatgctgcccaggctggtctcgaattcctgagcgcaggcgatccgcccacctcagtctcccaaagtgctgggattataagtatgaatcaccgcgtctggcctccctgccatttttactatagcaggaaccagggctggaggcagtctcccagactcctgccctggtcacctcatcagcctccctgagactcagctccactcagggcagcgaggaagacaagcaaacccatggaaccagttagagagggccagaggaacagatcaccctagagatctaccagtcagattccagttactttcttgtcaaggttcccaggatcccagacttccaaccaaacctactgggaatccagccagtctaggagtttcccaggagccagagggacaggatgcacttcctttctaaagattccagcctccagagcagcctgtgccagtgtttattttgagcaccaccgagagtctggcttcaggaaggaaagtaaaagcagcttcaggagagaatgcagtaagccagggtcgggggtgccggccagtgttcttggtgcaggttacctgggcttcggctggggcttcctgaccttcccctttcttggcaccagccttgtcccaagttctgaaattgtcaccatttttcagggaagaacagctataggatggctgttttcctttctttttcctgagagggagcccagccctactctcctcttccctcccaataagaatgggagaagaaaggactagaaaagatcagaggataaatctaaaaacaatgaggtgagatgtgtgctgccacctgcctgtactcctggctactcagtaggccgaggtgggaggatctcttgaggcccaggagtcaagaccagccttggcaacatagcaagaccccatctcttggcatttaatatgtactagctcatttaactcattcagcaattaaactactgagtgcctactatgttaagcagtagggaacaatgaataaaaagagagaaagctagcatttattgtacccctacgtgccaggcattgggtactcagaagagaacacatatagaaagtcatgtccacatggagcttacattctagtggaaggaaacagactagcaacaaggacttaaataaataagcagataattccagaacctgataaatgcaataaagataataaaacagtgatatgagagtgattagggagaggcactaatttagacagagggacaggaaaagcatctttgggatggtgacatttcagctgaggtttgaagagaagggggcgggtgtggtggctcacacctgtaatcctagcactttaggaggccgaagtgggtggattgcttgagcccaggagttcaagaccagtctgggcaacatagtgagagtttgtttctacaaataaaaaaaaattagccagatatggtggctcatgcctgtggtcc

SEQ ID NO: 446244 - DNA, 766 bp, Homo sapiens
tttggtagagacagggttttaccatgctgcccaggctggtctcgaattcctgagcgcaggcgatccgcccaggagtcaagaccagccttggcaacatagcaagaccccatctcttggcatttaatatgtactagctcatttaactcattcagcaattaaactactgagtgcctactatgttaagcagtagggaacaatgaaaaaatattgtctttgccttcaaacagttcaaagaagcatcataacaggaatttttaaaaagagagaaagctagcatttattgtacccctacgtgccaggcattgggtactcagaagagaacacatatagaaagtcatgtccacatggagcttacattctagtggaaggaaacagactagcaacaaggacttaaataaataagcagataattccagaacctgataaatgcaataaagataataaaacagtgatatgagagtgattagggagaggcactaatttagacagagggacaggaaaagcatctttgggatggtgacatttcagctgaggtttgaagagagcattgtagacagatggaagagtaagtgcaaagttcctgttagaaacaagttttagggggcgggtgtggtggctcacacctgtaatcctagcactttaggaggccgaagtgggtggattgcttgagcccaggagttcaagaccagtctgggcaacatagtgagagtttgtttctacaaataaaaaaaaattagccagatatggtggctcatgcctgtggtcc

SEQ ID NO: 446245 - DNA, 1515 bp, Homo sapiens
tttggtagagacagggttttaccatgctgcccaggctggtctcgaattcctgagcgcaggcgatccgcccacctcagtctcccaaagtgctgggattataagtatgaatcaccgcgtctggcctccctgccatttttactatagcaggaaccagggctggaggcagtctcccagactcctgccctggtcacctcatcagcctccctgagactcagctccactcagggcagcgaggaagacaagcaaacccatggaaccagttagagagggccagaggaacagatcaccctagagatctaccagtcagattccagttactttcttgtcaaggttcccaggatcccagacttccaaccaaacctactgggaatccagccagtctaggagtttcccaggagccagagggacaggatgcacttcctttctaaagattccagcctccagagcagcctgtgccagtgtttattttgagcaccaccgagagtctggcttcaggaaggaaagtaaaagcagcttcaggagagaatgcagtaagccagggtcgggggtgccggccagtgttcttggtgcaggttacctgggcttcggctggggcttcctgaccttcccctttcttggcaccagccttgtcccaagttctgaaattgtcaccatttttcagggaagaacagctataggatggctgttttcctttctttttcctgagagggagcccagccctactctcctcttccctcccaataagaatgggagaagaaaggactagaaaagatcagaggataaatctaaaaacaatgaggtgagatgtgtgctgccacctgcctgtactcctggctactcagtaggccgaggtgggaggatctcttgaggcccaggagtcaagaccagccttggcaacatagcaagaccccatctcttggcatttaatatgtactagctcatttaactcattcagcaattaaactactgagtgcctactatgttaagcagtagggaacaatgaataaaaagagagaaagctagcatttattgtacccctacgtgccaggcattgggtactcagaagagaacacatatagaaagtcatgtccacatggagcttacattctagtggaaggaaacagactagcaacaaggacttaaataaataagcagataattccagaacctgataaatgcaataaagataataaaacagtgatatgagagtgattagggagaggcactaatttagacagagggacaggaaaagcatctttgggatggtgacatttcagctgaggtttgaagagagcattgtagacagatggaagagtaagtgcaaagttcctgttagaaacaagttttagggggcgggtgtggtggctcacacctgtaatcctagcactttaggaggccgaagtgggtggattgcttgagcccaggagttcaagaccagtctgggcaacatagtgagagtttgtttctacaaataaaaaaaaattagccagatatggtggctcatgcctgtggtcc

SEQ ID NO: 446246 - DNA, 798 bp, Homo sapiens
tgacacaagaccaaattaggaatggttgccatgatccagattcttttatggaactcctacagatgcgttttggaatcaggtttttaaagtcccttttatagcaaataaataggaggttttgagggctgtttatgagcgcattccattgcagtgtctttcagcggagccagagctcagccaatcctaattaagaagcaatttcagctgcagtcattgcttattataataattgtgacatttttatagccctacattgtctttctcaaagtaacggattcaggaggagtccttttctgagtagagtccacagaagaggtattctattggtaagcatttcaaatgacttccttcatacagtagtataaaaataatttgatagcagtccgtttgaaaaatgtttataaggaaccagcttaaactgatcagatggaatatattttcatcagtcgcttacctgaaataagtacaaaccttttttattttttaaaaggggggcctaaatttcgctcctaataatattgtaaggttacatattaagtttcaaatagataagtagtactgtgagggaaggaactgctaactgtaaatactacctaatttgaatcaagtaattttggctcctgatgtcacatggaggtactgaaatttattttcttttacttaattccatctccaggtggatttatataatggaatttaaaagtttatgtaaatcttttccaatttttattctgtgttctttaaggatgactgtggcataatataaacattgcgaaaattttctcccaagtatatttg

SEQ ID NO: 446247 - DNA, 2773 bp, Homo sapiens
ccggccccctttgttcccgggtccgggccgcaggcccgctgcggcggactgggcggcggaagttcgacggcgccgggcgagtggctgttgagcggcgccgcgggagttccgcaggtttcccgtgttcgcagcggagccggaggccagctgaacccggccgtgggatcccggataggaggaggaggggacccataggacgcgttaacatggacctggaaaacaaagtgaagaagatgggcttaggtcacgagcaaggatttggagccccttgtttaaaatgcaaagaaaaatgtgaaggattcgaactgcacttctggagaaaaatatgtcgtaactgcaagtgtggccaagaagagcatgatgtcctcttgagcaatgaagaggatcgaaaagtgggaaaactttttgaagacaccaagtataccactctgattgcaaaactaaagtcagatggaattcccatgtataaacgcaatgttatgatattgacgaatccagttgctgccaagaagaatgtctccatcaatacagttacctatgagtgggctcctcctgtccagaatcaagcattggccaggcagtacatgcagatgctacccaaggaaaagcagccagtagcaggctcagagggggcacagtaccggaagaagcagctggcaaagcagctccctgcacatgaccaggacccttcaaagtgccatgagttgtctcccagagaggtgaaggagatggagcagtttgtgaagaaatataagagcgaagctctgggagtaggagatgtcaaacttccctgtgagatggatgcccaaggccccaaacaaatgaacattcctggaggggatagaagcaccccagcagcagtgggggccatggaggacaaatctgctgagcacaaaagaactcaatattcctgctattgctgcaaactgagtatgaaagaaggtgacccagccatctatgccgaaagggctggctatgataaactgtggcacccagcttgttttgtctgcagcacctgccatgaactcctggttgacatgatttatttttggaagaatgagaagctatactgtggcagacattactgtgacagcgagaaaccccgatgtgctggctgtgacgagctgatattcagcaatgagtatacccaggcagaaaaccagaattggcacctgaaacacttctgctgctttgactgtgatagcattctagctggggagatatacgtgatggtcaatgacaagcccgtgtgcaagccctgctatgtgaagaatcacgctgtggtgtgtcaaggatgccacaatgccatcgacccagaagtgcagcgggtgacctataacaatttcagctggcatgcatccacagagtgctttctgtgctcttgctgcagcaaatgcctcattgggcagaagttcatgccagtagaagggatggttttctgttcagtggaatgtaagaagaggatgtcttaggaggagggcacccagaagtatcgagccatagctatccaaagtggtctgcatttctactgtaaaatgcaatttgaaaaaaataaaacgcaaaaaaagaaactgtaaaggaaaccaagagattttgtttaatttttttggccattttttcttcatcaattttttttcggtctcaacttttaaacttggtttaagcatttgatttgtaaaacagtaaataattgtatctttccatagcttttcaaatgtgaaatcatttgttggaagcttggatctcattaaacttcatgtctctattccatttgtgccacacacttaaaagttagtgtactgaatggaaagatgagcattcctagttctacacttcttttttccccctcatgtgtaaaatgaaaagaaaactaaatttgccctaataccaaggcgctacgtttattgcctcgtcttattcactgacctttgtaatgatacacagtgaattctttttgacaaagagaaatgcagtgtagtatgcagagctgctgttttaatgcctatgcatttactctttcctgatttaggcagaggtggcattttctttattgcatttctctatttttttaatgtaccctaccttcagtattctctttgtaagttggtgacttgcatctgtggccttgaatattttattatcacatgtggcataacagtatccacactttttagttctttattttttttttttattttgagcaattctcctgcctcagcctcccaaatagctgggattacaggtgcatgccaccacacccagctaatttttgtatttttagtagagacaggttttcaccatgttagccaggctggtctcaaactcctgacctcagatgatccgcctgccttggcctcccaaagtgctgggattacaggtgtgggagccaccatgcctgacccacacactttttacttgtatagatgatttttggcttggacataaaagccaagccacccatttgcttttaatccaaagaacatgtatagtttttgtacccagagactatgatttatattgattgcacttgcctgccatgatttagataagattttttttgcatggtttttattctttcctaatggatcctgttttataatacttccaagcctgtccatggatatatcaaatgtcttcacttgtatattttcatggctaggtatttctaatgtttattcttccctgtgtacttctacacatagctatgcactatgaaaattaaatggaatgaatgatatgtatattactcaaaataaagtttctttcactttaa

SEQ ID NO: 446248 - DNA, 2866 bp, Homo sapiens
tgacacaagaccaaattaggaatggttgccatgatccagattcttttatggaactcctacagatgcgttttggaatcaggtttttaaagtcccttttatagcaaataaataggaggttttgagggctgtttatgagcgcattccattgcagtgtctttcagcggagccagagctcagccaatcctaattaagaagcaatttcagctgcagtcattgcttattataataattgtgacatttttatagccctacattgtctttctcaaagtaacggattcaggaggagtccttttctgagtagagtccacagaagaggtattctattgatgggcttaggtcacgagcaaggatttggagccccttgtttaaaatgcaaagaaaaatgtgaaggattcgaactgcacttctggagaaaaatatgtcgtaactgcaagtgtggccaagaagagcatgatgtcctcttgagcaatgaagaggatcgaaaagtgggaaaactttttgaagacaccaagtataccactctgattgcaaaactaaagtcagatggaattcccatgtataaacgcaatgttatgatattgacgaatccagttgctgccaagaagaatgtctccatcaatacagttacctatgagtgggctcctcctgtccagaatcaagcattggccaggcagtacatgcagatgctacccaaggaaaagcagccagtagcaggctcagagggggcacagtaccggaagaagcagctggcaaagcagctccctgcacatgaccaggacccttcaaagtgccatgagttgtctcccagagaggtgaaggagatggagcagtttgtgaagaaatataagagcgaagctctgggagtaggagatgtcaaacttccctgtgagatggatgcccaaggccccaaacaaatgaacattcctggaggggatagaagcaccccagcagcagtgggggccatggaggacaaatctgctgagcacaaaagaactcaatattcctgctattgctgcaaactgagtatgaaagaaggtgacccagccatctatgccgaaagggctggctatgataaactgtggcacccagcttgttttgtctgcagcacctgccatgaactcctggttgacatgatttatttttggaagaatgagaagctatactgtggcagacattactgtgacagcgagaaaccccgatgtgctggctgtgacgagctgatattcagcaatgagtatacccaggcagaaaaccagaattggcacctgaaacacttctgctgctttgactgtgatagcattctagctggggagatatacgtgatggtcaatgacaagcccgtgtgcaagccctgctatgtgaagaatcacgctgtggtgtgtcaaggatgccacaatgccatcgacccagaagtgcagcgggtgacctataacaatttcagctggcatgcatccacagagtgctttctgtgctcttgctgcagcaaatgcctcattgggcagaagttcatgccagtagaagggatggttttctgttcagtggaatgtaagaagaggatgtcttaggaggagggcacccagaagtatcgagccatagctatccaaagtggtctgcatttctactgtaaaatgcaatttgaaaaaaataaaacgcaaaaaaagaaactgtaaaggaaaccaagagattttgtttaatttttttggccattttttcttcatcaattttttttcggtctcaacttttaaacttggtttaagcatttgatttgtaaaacagtaaataattgtatctttccatagcttttcaaatgtgaaatcatttgttggaagcttggatctcattaaacttcatgtctctattccatttgtgccacacacttaaaagttagtgtactgaatggaaagatgagcattcctagttctacacttcttttttccccctcatgtgtaaaatgaaaagaaaactaaatttgccctaataccaaggcgctacgtttattgcctcgtcttattcactgacctttgtaatgatacacagtgaattctttttgacaaagagaaatgcagtgtagtatgcagagctgctgttttaatgcctatgcatttactctttcctgatttaggcagaggtggcattttctttattgcatttctctatttttttaatgtaccctaccttcagtattctctttgtaagttggtgacttgcatctgtggccttgaatattttattatcacatgtggcataacagtatccacactttttagttctttattttttttttttattttgagcaattctcctgcctcagcctcccaaatagctgggattacaggtgcatgccaccacacccagctaatttttgtatttttagtagagacaggttttcaccatgttagccaggctggtctcaaactcctgacctcagatgatccgcctgccttggcctcccaaagtgctgggattacaggtgtgggagccaccatgcctgacccacacactttttacttgtatagatgatttttggcttggacataaaagccaagccacccatttgcttttaatccaaagaacatgtatagtttttgtacccagagactatgatttatattgattgcacttgcctgccatgatttagataagattttttttgcatggtttttattctttcctaatggatcctgttttataatacttccaagcctgtccatggatatatcaaatgtcttcacttgtatattttcatggctaggtatttctaatgtttattcttccctgtgtacttctacacatagctatgcactatgaaaattaaatggaatgaatgatatgtatattactcaaaataaagtttctttcactttaa

SEQ ID NO: 446249 - DNA, 2824 bp, Homo sapiens
ccggccccctttgttcccgggtccgggccgcaggcccgctgcggcggactgggcggcggaagttcgacggcgccgggcgagtggctgttgagcggcgccgcgggagttccgcaggtttcccgtgttcgcagcggagccggaggccagctgaacccggccgtgggatcccggataggaggaggaggggacccataggacgcgttaacatggacctggaaaacaaagtgaagaagatgggcttaggtcacgagcaaggatttggagccccttgtttaaaatgcaaagaaaaatgtgaaggattcgaactgcacttctggagaaaaatatgtcgtaactgcaagtgtggccaagaagagcatgatgtcctcttgagcaatgaagaggatcgaaaagtgggaaaactttttgaagacaccaagtataccactctgattgcaaaactaaagtcagatggaattcccatgtataaacgcaatgttatgatattgacgaatccagttgctgccaagaagaatgtctccatcaatacagttacctatgagtgggctcctcctgtccagaatcaagcattggccaggcagtacatgcagatgctacccaaggaaaagcagccagtagcaggctcagagggggcacagtaccggaagaagcagctggcaaagcagctccctgcacatgaccaggacccttcaaagtgccatgagttgtctcccagagaggtgaaggagatggagcagtttgtgaagaaatataagagcgaagctctgggagtaggagatgtcaaacttccctgtgagatggatgcccaaggccccaaacaaatgaacattcctggaggggatagaagcaccccagcagcagtgggggccatggaggacaaatctgctgagcacaaaagaactcaatattcctgctattgctgcaaactgagtatgaaagaaggtgacccagccatctatgccgaaagggctggctatgataaactgtggcacccagcttgttttgtctgcagcacctgccatgaactcctggttgacatgatttatttttggaagaatgagaagctatactgtggcagacattactgtgacagcgagaaaccccgatgtgctggctgtgacgagctgatattcagcaatgagtatacccaggcagaaaaccagaattggcacctgaaacacttctgctgctttgactgtgatagcattctagctggggagatatacgtgatggtcaatgacaagcccgtgtgcaagccctgctatgtgaagaatcacgctgtggtgtgtcaaggatgccacaatgccatcgacccagaagtgcagcgggtgacctataacaatttcagctggcatgcatccacagagtgctttctgtgctcttgctgcagcaaatgcctcattgggcagaagttcatgccagtagaagggatggttttctgttcagtggaatgtaagaagaggatgtcttaggaggagggcacccagaagtatcgagccatagctatccaaagtggtctgcatttctactgtaaaatgcaatttgaaaaaaataaaacgcaaaaaaagaaactgtaaaggaaaccaagagattttgtttaatttttttggccattttttcttcatcaattttttttcggtctcaacttttaaacttggtttaagcatttgatttgtaaaacagtaaataattgtatctttccatagcttttcaaatgtgaaatcatttgttggaagcttggatctcattaaacttcatgtctctattccatttgtgccacacacttaaaagttagtgtactgaatggaaagatgagcattcctagttctacacttcttttttccccctcatgtgtaaaatgaaaagaaaactaaatttgccctaataccaaggcgctacgtttattgcctcgtcttattcactgacctttgtaatgatacacagtgaattctttttgacaaagagaaatgcagtgtagtatgcagagctgctgttttaatgcctatgcatttactctttcctgatttaggcagaggtggcattttctttattgcatttctctatttttttaatgtaccctaccttcagtattctctttgtaagttggtgacttgcatctgtggccttgaatattttattatcacatgtggcataacagtatccacactttttagttctttattttttttttttattttgagcaattctcctgcctcagcctcccaaatagctgggattacaggtgcatgccaccacacccagctaatttttgtatttttagtagagacaggttttcaccatgttagccaggctggtctcaaactcctgacctcagatgatccgcctgccttggcctcccaaagtgctgggattacaggtgtgggagccaccatgcctgacccacacactttttacttgtatagatgatttttggcttggacataaaagccaagccacccatttgcttttaatccaaagaacatgtatagtttttgtacccagagactatgatttatattgattgcacttgcctgccatgatttagataagattttttttgcatggtttttattctttcctaatggatcctgttttataatacttccaagcctgtccatggatatatcaaatgtcttcacttgtatattttcatggctaggtatttctaatgtttattcttccctgtgtacttctacacatagctatgcactatgaaaattaaatggaatgaatgatatgtatattactcaaaataaagtttctttcactttaatttcatagtcatagctatgtgtagaaattgacgggatcctctagaccgcct

SEQ ID NO: 446250 - DNA, 2216 bp, Homo sapiens
ccggccccctttgttcccgggtccgggccgcaggcccgctgcggcggactgggcggcggaagttcgacggcgccgggcgagtggctgttgagcggcgccgcgggagttccgcaggtttcccgtgttcgcagcggagccggaggccagctgaacccggccgtgggatcccggataggaggaggaggggacccataggacgcgttaacatggacctggaaaacaaagtgaagaagatgggcttaggtcacgagcaaggatttggagccccttgtttaaaatgcaaagaaaaatgtgaaggattcgaactgcacttctggagaaaaatatgtcgtaactgcaagtgtggccaagaagagcatgatgtcctcttgagcaatgaagaggatcgaaaagtgggaaaactttttgaagacaccaagtataccactctgattgcaaaactaaagtcagatggaattcccatgtataaacgcaatgttatgatattgacgaatccagttgctgccaagaagaatgtctccatcaatacagttacctatgagtgggctcctcctgtccagaatcaagcattggccaggcagtacatgcagatgctacccaaggaaaagcagccagtagcaggctcagagggggcacagtaccggaagaagcagctggcaaagcagctccctgcacatgaccaggacccttcaaagtgccatgagttgtctcccagagaggtgaaggagatggagcagtttgtgaagaaatataagagcgaagctctgggagtaggagatgtcaaacttccctgtgagatggatgcccaaggccccaaacaaatgaacattcctggaggggatagaagcaccccagcagcagtgggggccatggaggacaaatctgctgagcacaaaagaactcaatattcctgctattgctgcaaactgagtatgaaagaaggtgacccagccatctatgccgaaagggctggctatgataaactgtggcacccagcttgttttgtctgcagcacctgccatgaactcctggttgacatgatttatttttggaagaatgagaagctatactgtggcagacattactgtgacagcgagaaaccccgatgtgctggctgtgacgagctgatattcagcaatgagtatacccaggcagaaaaccagaattggcacctgaaacacttctgctgctttgactgtgatagcattctagctggggagatatacgtgatggtcaatgacaagcccgtgtgcaagccctgctatgtgaagaatcacgctgtggtgtgtcaaggatgccacaatgccatcgacccagaagtgcagcgggtgacctataacaatttcagctggcatgcatccacagagtgctttctgtgctcttgctgcagcaaatgcctcattgggcagaagttcatgccagtagaagggatggttttctgttcagtggaatgtaagaagaggatgtcttaggaggagggcacccagaagtatcgagccatagctatccaaagtggtctgcatttctactgtaaaatgcaatttgaaaaaaataaaacgcaaaaaaagaaactgtaaaggaaaccaagagattttgtttaatttttttggccattttttcttcatcaattttttttcggtctcaacttttaaacttggtttaagcatttgatttgtaaaacagtaaataattgtatctttccatagcttttcaaatgtgaaatcatttgttggaagcttggatctcattaaacttcatgtctctattccatttgtgccacacacttaaaagttagtgtactgaatggaaagatgagcattcctagttctacacttcttttttccccctcatgtgtaaaatgaaaagaaaactaaatttgccctaataccaaggcgctacgtttattgcctcgtcttattcactgacctttgtaatgatacacagtgaattctttttgacaaagagaaatgcagtgtagtatgcagagctgctgttttaatgcctatgcatttactctttcctgatttaggcagaggtggcattttctttattgcatttctctatttttttaatgtaccctaccttcagtattctctttgtaagttggtgacttgcatctgtggccttgaatattttattatcacatgtggcataacagtatcccgcagatctccgctttggaaagggatcctctagatcacagcagcatcactgcc

SEQ ID NO: 446251 - DNA, 2534 bp, Homo sapiens
ccgggtgcctgactgcaccccgcgtgatttactatgcatcaaaatgatgtcaatgattccgatactgcacttctgtcagaaaaatatgtcgtgacttgggaaagaccctgcgaagagcatgatgtcctcttgagcaatgaagaggatcgaaaagtgggaaaactttttgaagacaccaagtataccactctgattgcaaaactaaagtcagatggaattcccatgtataaacgcaatgttatgatattgacgaatccagttgctgccaagaagaatgtctccatcaatacagttacctatgagtgggctcctcctgtccagaatcaagcattggccaggcagtacatgcagatgctacccaaggaaaagcagccagtagcaggctcagagggggcacagtaccggaagaagcagctggcaaagcagctccctgcacatgaccaggacccttcaaagtgccatgagttgtctcccagagaggtgaaggagatggagcagtttgtgaagaaatataagagcgaagctctgggagtaggagatgtcaaacttccctgtgagatggatgcccaaggccccaaacaaatgaacattcctggaggggatagaagcaccccagcagcagtgggggccatggaggacaaatctgctgagcacaaaagaactcaatattcctgctattgctgcaaactgagtatgaaagaaggtgacccagccatctatgccgaaagggctggctatgataaactgtggcacccagcttgttttgtctgcagcacctgccatgaactcctggttgacatgatttatttttggaagaatgagaagctatactgtggcagacattactgtgacagcgagaaaccccgatgtgctggctgtgacgagctgatattcagcaatgagtatacccaggcagaaaaccagaattggcacctgaaacacttctgctgctttgactgtgatagcattctagctggggagatatacgtgatggtcaatgacaagcccgtgtgcaagccctgctatgtgaagaatcacgctgtggtgtgtcaaggatgccacaatgccatcgacccagaagtgcagcgggtgacctataacaatttcagctggcatgcatccacagagtgctttctgtgctcttgctgcagcaaatgcctcattgggcagaagttcatgccagtagaagggatggttttctgttcagtggaatgtaagaagaggatgtcttaggaggagggcacccagaagtatcgagccatagctatccaaagtggtctgcatttctactgtaaaatgcaatttgaaaaaaataaaacgcaaaaaaagaaactgtaaaggaaaccaagagattttgtttaatttttttggccattttttcttcatcaattttttttcggtctcaacttttaaacttggtttaagcatttgatttgtaaaacagtaaataattgtatctttccatagcttttcaaatgtgaaatcatttgttggaagcttggatctcattaaacttcatgtctctattccatttgtgccacacacttaaaagttagtgtactgaatggaaagatgagcattcctagttctacacttcttttttccccctcatgtgtaaaatgaaaagaaaactaaatttgccctaataccaaggcgctacgtttattgcctcgtcttattcactgacctttgtaatgatacacagtgaattctttttgacaaagagaaatgcagtgtagtatgcagagctgctgttttaatgcctatgcatttactctttcctgatttaggcagaggtggcattttctttattgcatttctctatttttttaatgtaccctaccttcagtattctctttgtaagttggtgacttgcatctgtggccttgaatattttattatcacatgtggcataacagtatccacactttttagttctttattttttttttttattttgagcaattctcctgcctcagcctcccaaatagctgggattacaggtgcatgccaccacacccagctaatttttgtatttttagtagagacaggttttcaccatgttagccaggctggtctcaaactcctgacctcagatgatccgcctgccttggcctcccaaagtgctgggattacaggtgtgggagccaccatgcctgacccacacactttttacttgtatagatgatttttggcttggacataaaagccaagccacccatttgcttttaatccaaagaacatgtatagtttttgtacccagagactatgatttatattgattgcacttgcctgccatgatttagataagattttttttgcatggtttttattctttcctaatggatcctgttttataatacttccaagcctgtccatggatatatcaaatgtcttcacttgtatattttcatggctaggtatttctaatgtttattcttccctgtgtacttctacacatagctatgcactatgaaaattaaatggaatgaatgatatgtatattactcaaaataaagtttctttcactttaa

SEQ ID NO: 446252 - DNA, 1618 bp, Homo sapiens
  misc_feature (1561)..(1561): n is a, c, g, or t
  misc_feature (1580)..(1581): n is a, c, g, or t
  misc_feature (1588)..(1588): n is a, c, g, or t
ccggccccctttgttcccgggtccgggccgcaggcccgctgcggcggactgggcggcggaagttcgacggcgccgggcgagtggctgttgagcggcgccgcgggagttccgcaggtttcccgtgttcgcagcggagccggaggccagctgaacccggccgtgggatcccggataggaggaggaggggacccataggacgcgttaacatggacctggaaaacaaagtgaagaagatgggcttaggtcacgagcaaggatttggagccccttgtttaaaatgcaaagaaaaatgtgaaggattcgaactgcacttctggagaaaaatatgtcgtaactgcaagtgtggccaagaagagcatgatgtcctcttgagcaatgaagaggatcgaaaagtgggaaaactttttgaagacaccaagtataccactctgattgcaaaactaaagtcagatggaattcccatgtataaacgcaatgttatgatattgacgaatccagttgctgccaagaagaatgtctccatcaatacagttacctatgagtgggctcctcctgtccagaatcaagcattggccaggcagtacatgcagatgctacccaaggaaaagcagccagtagcaggctcagagggggcacagtaccggaagaagcagctggcaaagcagctccctgcacatgaccaggacccttcaaagtgccatgagttgtctcccagagaggtgaaggagatggagcagtttgtgaagaaatataagagcgaagctctgggagtaggagatgtcaaacttccctgtgagatggatgcccaaggccccaaacaaatgaacattcctggaggggatagaagcaccccagcagcagtgggggccatggaggacaaatctgctgagcacaaaagaactcaatattcctgctattgctgcaaactgagtatgaaagaaggtgacccagccatctatgccgaaagggctggctatgataaactgtggcacccagcttgttttgtctgcagcacctgccatgaactcctggttgacatgatttatttttggaagaatgagaagctatactgtggcagacattactgtgacagcgagaaaccccgatgtgctggctgtgacgagctgatattcagcaatgagtatacccaggcagaaaaccagaattggcacctgaaacacttctgctgctttgactgtgatagcattctagctggggagatatacgtgatggtcaatgacaagcccgtgtgcaagccctgctatgtgaagaatcacgctgtggtgtgtcaaggatgccacaatgccatcgacccagaagtgcagcgggtgacctataacaatttcagctggcatgcatccacagagtgctttctgtgctcttgctgcagcaaatgcctcattgggcagaagttcatgccagtagaagggatggttttctgttcagtggaatgtaagaagaggatgtcttaggaggagggcacccagaagtatcgagccatagctatccaaagtggtctgcatttctactgtaaaatgcaatttgaaaaaaataaaacgtncgttcccccccagggtcgnnttttttncttacctaacgagatcttcattcaccggca

SEQ ID NO: 446253 - DNA, 1544 bp, Homo sapiens
ccggccccctttgttcccgggtccgggccgcaggcccgctgcggcggactgggcggcggaagttcgacggcgccgggcgagtggctgttgagcggcgccgcgggagttccgcaggtttcccgtgttcgcagcggagccggaggccagctgaacccggccgtgggatcccggataggaggaggaggggacccataggacgcgttaacatggacctggaaaacaaagtgaagaagatgggcttaggtcacgagcaaggatttggagccccttgtttaaaatgcaaagaaaaatgtgaaggattcgaactgcacttctggagaaaaatatgtcgtaactgcaagtgtggccaagaagagcatgatgtcctcttgagcaatgaagaggatcgaaaagtgggaaaactttttgaagacaccaagtataccactctgattgcaaaactaaagtcagatggaattcccatgtataaacgcaatgttatgatattgacgaatccagttgctgccaagaagaatgtctccatcaatacagttacctatgagtgggctcctcctgtccagaatcaagcattggccaggcagtacatgcagatgctacccaaggaaaagcagccagtagcaggctcagagggggcacagtaccggaagaagcagctggcaaagcagctccctgcacatgaccaggacccttcaaagtgccatgagttgtctcccagagaggtgaaggagatggagcagtttgtgaagaaatataagagcgaagctctgggagtaggagatgtcaaacttccctgtgagatggatgcccaaggccccaaacaaatgaacattcctggaggggatagaagcaccccagcagcagtgggggccatggaggacaaatctgctgagcacaaaagaactcaatattcctgctattgctgcaaactgagtatgaaagaaggtgacccagccatctatgccgaaagggctggctatgataaactgtggcacccagcttgttttgtctgcagcacctgccatgaactcctggttgacatgatttatttttggaagaatgagaagctatactgtggcagacattactgtgacagcgagaaaccccgatgtgctggctgtgacgagctgatattcagcaatgagtatacccaggcagaaaaccagaattggcacctgaaacacttctgctgctttgactgtgatagcattctagctggggagatatacgtgatggtcaatgacaagcccgtgtgcaagccctgctatgtgaagaatcacgctgtggtgagaagtgttctaaggatatggttgcctcagcctgctttaggacttgagtttatgcttttcttaaagcctcttacaaatgggaaacagaaagcagtcctcctaagtagaaagcaaattattcctaccacagggtgttaaaatcaaggcaattcaaaaacaatacatgcattgactatgagccacctcaagatttctacttgtgaaatttacaatatcaattataggtactgcttaataataaaatcctcacttaaaaaa

SEQ ID NO: 446254 - DNA, 2268 bp, Homo sapiens
  misc_feature (2268)..(2268): n is a, c, g, or t
tagctgatcgattgagccgtcccgtcatttcacaccagggtccagatcagcgcatcagttcacctggaatttataagaaatgaaattctcaggtaccaccccagagttaatggaataagaaactttgaagtgggtctaataatctgtattttatcaagctctccatgttattttaatacatattacagtttgagaaccactaatttatacctttgctattcaaagtgtgctccatggaccggcagcattgacattatctgggagctcattagaaaatgcaggatctctgcagacaacaggaaaggaaacaaaaaaagaaactgtaaaggaaaccaagagattttgtttaatttttttggccattttttcttcatcaattttttttcggtctcaacttttaaacttggtttaagcatttgatttgtaaaacagtaaataattgtatctttccatagcttttcaaatgtgaaatcatttgttggaagcttggatctcattaaacttcatgtctctattccatttgtgccacacacttaaaagttagtgtactgaatggaaagatgagcattcctagttctacacttcttttttccccctcatgtgtaaaatgaaaagaaaactaaatttgccctaataccaaggcgctacgtttattgcctcgtcttattcactgacctttgtaatgatacacagtgaattctttttgacaaagagaaatgcagtgtagtatgcagagctgctgttttaatgcctatgcatttactctttcctgatttaggcagaggtggcattttctttattgcatttctctatttttttaatgtaccctaccttcagtattctctttgtaagttggtgacttgcatctgtggccttgaatattttattatcacatgtggcataacagtatccacactttttagttctttattttttttttttattttgagcaattctcctgcctcagcctcccaaatagctgggattacaggtgcatgccaccacacccagctaatttttgtatttttagtagagacaggttttcaccatgttagccaggctggtctcaaactcctgacctcagatgatccgcctgccttggcctcccaaagtgctgggattacaggtgtgggagccaccatgcctgacccacacactttttacttgtatagatgatttttggcttggacataaaagccaagccacccatttgcttttaatccaaagaacatgtatagtttttgtacccagagactatgatttatattgattgcacttgcctgccatgatttagataagattttttttgcatggtttttattctttcctaatggatcctgttttataatacttccaagcctgtccatggatatatcaaatgtcttcacttgtatattttcatggctaggtatttctaatgtttattcttccctgtgtacttctacacatagctatgcactatgaaaattaaatggaatgaatgatatgtatattactcaaaataaagtttctttcactttaaaaaaaaaaaaaaaagggcgccgttcgcgaggctatttacaattacgcaaaggccccaaggttgtaggcccctaagggctactacaacccttcggtgacgccataaaactcttcaccaaagagcccctaaaacccggcaaatctaccatgaccctttaatttaccggccggaacttagcttctcaccatacggtcttctactattgaaccccccttacctatattccgaaccctggtcaacctcaagctagaggcccctaatatattctcagcccacccttatacgtacgccgggataaatcagcgtctgataacgagagagaattaaaagtgacaataaagccatatatgcgcccatgagagatatcgcacaaaaccctcattaaggagacccccgagacattcttatatactcaaccataaataaagagagcgcctaaaatatctccgcccatttatataacagaaaaaccagtcttatatttacacaccaaagagaaaacgtgccagaatcataagtaattcacccacaagagaagaaaacagccgcgcctctctgatgggcgcgcgatataatcataacgattaatcaacgcagcggcggttatataaagaacgaaagatgaataataccacgccaaagatagagcacctaacgcatggaagagacacagatcaacatcggcagaataatatttataaaataatgtgtagattataacaatatgtatatgtattaaataagcn

SEQ ID NO: 446255 - DNA, 1014 bp, Homo sapiens
ccggccccctttgttcccgggtccgggccgcaggcccgctgcggcggactgggcggcggaagttcgacggcgccgggcgagtggctgttgagcggcgccgcgggagttccgcaggtttcccgtgttcgcagcggagccggaggccagctgaacccggccgtgggatcccggataggaggaggaggggacccataggacgcgttaacatggacctggaaaacaaagtgaagaaggtaggggggcgctcgtgtcgggcggcggctgcttcacctgcgcgggtcgcgcggcgcgcggcggccggaggtgccgagtgggtggggctcgcgggccccccggtgtgagcccggctctgggtctgcggtgccccgggcccagggacctggccccctgggtagaggaggtgctcggcggccccgccagctccccacactcgggagcgacagaattggaagcgcgagcgagggcgggcgcgggactcttctctccagtctcacggaatcccagtggttgtaggtgttggaaactttacttaagatgtttcagctctgcctgtgcctcctcaaaaggaaaggacgagcttagggcgagtgcgggcgagaccgtgacacttcctggctcaggaagttgaatttcattaagcctttgtggtttggggctctgctgtgctttgacagctctgatctcctcccttccggctgggctgtctggggcgctctaaaatgagtgttgatttaatgcactgccttcgcacccgtgctggtgataacttctaatgtgatttttttttcggtcattcattacttgtctaccgaccgaggcagtgcctccctcttagggaattatctgtcaaagagcgcattctccttgtttggcaggtagtcccaaagggcggttgtcaccagcgtctcagcgcagggagacattttcagcttggctgctgcctcgcaggcactggaaccgacggccctacctgagccactcccgggttatgcggagcctggtgtcgcctgggag

SEQ ID NO: 446256 - DNA, 412 bp, Homo sapiens
agagactatgatttatattgattgcacttgcctgccatgatttagataagattttttttgcatggtttttattctttcctaatggatcctgttttataatacttccaagcctgtccatggatatatcaaatgtcttcacttgtatattttcatggctaggtatttctaatgtttattcttccctgtgtacttctacacatagctatgcactatgaaaattaaatggaatgaatgatatgtatattactcaaaataaagtttctttcactttaataatcattgtatctttttattcatatccttttttgagtgaaaaatgcttctgcaactaagcatgtgttacagcagggggcgatgtctccaaggataaaaattacccaaacgaaaataaaagtctgcctctgacaggaca

SEQ ID NO: 446257 - DNA, 3519 bp, Homo sapiens
  misc_feature (3519)..(3519): n is a, c, g, or t
ccggccccctttgttcccgggtccgggccgcaggcccgctgcggcggactgggcggcggaagttcgacggcgccgggcgagtggctgttgagcggcgccgcgggagttccgcaggtttcccgtgttcgcagcggagccggaggccagctgaacccggccgtgggatcccggataggaggaggaggggacccataggacgcgttaacatggacctggaaaacaaagtgaagaagatgggcttaggtcacgagcaaggatttggagccccttgtttaaaatgcaaagaaaaatgtgaaggattcgaactgcacttctggagaaaaatatgtcgtaactgcaagtgtggccaagaagagcatgatgtcctcttgagcaatgaagaggatcgaaaagtgggaaaactttttgaagacaccaagtataccactctgattgcaaaactaaagtcagatggaattcccatgtataaacgcaatgttatgatattgacgaatccagttgctgccaagaagaatgtctccatcaatacagttacctatgagtgggctcctcctgtccagaatcaagcattggccaggcagtacatgcagatgctacccaaggaaaagcagccagtagcaggctcagagggggcacagtaccggaagaagcagctggcaaagcagctccctgcacatgaccaggacccttcaaagtgccatgagttgtctcccagagaggtgaaggagatggagcagtttgtgaagaaatataagagcgaagctctgggagtaggagatgtcaaacttccctgtgagatggatgcccaaggccccaaacaaatgaacattcctggaggggatagaagcaccccagcagcagtgggggccatggaggacaaatctgctgagcacaaaagaactcaatattcctgctattgctgcaaactgagtatgaaagaaggtgacccagccatctatgccgaaagggctggctatgataaactgtggcacccagcttgttttgtctgcagcacctgccatgaactcctggttgacatgatttatttttggaagaatgagaagctatactgtggcagacattactgtgacagcgagaaaccccgatgtgctggctgtgacgagctgatattcagcaatgagtatacccaggcagaaaaccagaattggcacctgaaacacttctgctgctttgactgtgatagcattctagctggggagatatacgtgatggtcaatgacaagcccgtgtgcaagccctgctatgtgaagaatcacgctgtggtgtgtcaaggatgccacaatgccatcgacccagaagtgcagcgggtgacctataacaatttcagctggcatgcatccacagagtgctttctgtgctcttgctgcagcaaatgcctcattgggcagaagttcatgccagtagaagggatggttttctgttcagtggaatgtaagaagaggatgtcttaggaggagggcacccagaagtatcgagccatagctatccaaagtggtctgcatttctactgtaaaatgcaatttgaaaaaaataaaacgcaaaaaaagaaactgtaaaggaaaccaagagattttgtttaatttttttggccattttttcttcatcaattttttttcggtctcaacttttaaacttggtttaagcatttgatttgtaaaacagtaaataattgtatctttccatagcttttcaaatgtgaaatcatttgttggaagcttggatctcattaaacttcatgtctctattccatttgtgccacacacttaaaagttagtgtactgaatggaaagatgagcattcctagttctacacttcttttttccccctcatgtgtaaaatgaaaagaaaactaaatttgccctaataccaaggcgctacgtttattgcctcgtcttattcactgacctttgtaatgatacacagtgaattctttttgacaaagagaaatgcagtgtagtatgcagagctgctgttttaatgcctatgcatttactctttcctgatttaggcagaggtggcattttctttattgcatttctctatttttttaatgtaccctaccttcagtattctctttgtaagttggtgacttgcatctgtggccttgaatattttattatcacatgtggcataacagtatccacactttttagttctttattttttttttttattttgagcaattctcctgcctcagcctcccaaatagctgggattacaggtgcatgccaccacacccagctaatttttgtatttttagtagagacaggttttcaccatgttagccaggctggtctcaaactcctgacctcagatgatccgcctgccttggcctcccaaagtgctgggattacaggtgtgggagccaccatgcctgacccacacactttttacttgtatagatgatttttggcttggacataaaagccaagccacccatttgcttttaatccaaagaacatgtatagtttttgtacccagagactatgatttatattgattgcacttgcctgccatgatttagataagattttttttgcatggtttttattctttcctaatggatcctgttttataatacttccaagcctgtccatggatatatcaaatgtcttcacttgtatattttcatggctaggtatttctaatgtttattcttccctgtgtacttctacacatagctatgcactatgaaaattaaatggaatgaatgatatgtatattactcaaaataaagtttctttcactttaaaaaaaaaaaaaaaagggcgccgttcgcgaggctatttacaattacgcaaaggccccaaggttgtaggcccctaagggctactacaacccttcggtgacgccataaaactcttcaccaaagagcccctaaaacccggcaaatctaccatgaccctttaatttaccggccggaacttagcttctcaccatacggtcttctactattgaaccccccttacctatattccgaaccctggtcaacctcaagctagaggcccctaatatattctcagcccacccttatacgtacgccgggataaatcagcgtctgataacgagagagaattaaaagtgacaataaagccatatatgcgcccatgagagatatcgcacaaaaccctcattaaggagacccccgagacattcttatatactcaaccataaataaagagagcgcctaaaatatctccgcccatttatataacagaaaaaccagtcttatatttacacaccaaagagaaaacgtgccagaatcataagtaattcacccacaagagaagaaaacagccgcgcctctctgatgggcgcgcgatataatcataacgattaatcaacgcagcggcggttatataaagaacgaaagatgaataataccacgccaaagatagagcacctaacgcatggaagagacacagatcaacatcggcagaataatatttataaaataatgtgtagattataacaatatgtatatgtattaaataagcn

SEQ ID NO: 446258 - DNA, 2840 bp, Homo sapiens
  misc_feature (2770)..(2770): n is a, c, g, or t
ccggccccctttgttcccgggtccgggccgcaggcccgctgcggcggactgggcggcggaagttcgacggcgccgggcgagtggctgttgagcggcgccgcgggagttccgcaggtttcccgtgttcgcagcggagccggaggccagctgaacccggccgtgggatcccggataggaggaggaggggacccataggacgcgttaacatggacctggaaaacaaagtgaagaagatgggcttaggtcacgagcaaggatttggagccccttgtttaaaatgcaaagaaaaatgtgaaggattcgaactgcacttctggagaaaaatatgtcgtaactgcaagtgtggccaagaagagcatgatgtcctcttgagcaatgaagaggatcgaaaagtgggaaaactttttgaagacaccaagtataccactctgattgcaaaactaaagtcagatggaattcccatgtataaacgcaatgttatgatattgacgaatccagttgctgccaagaagaatgtctccatcaatacagttacctatgagtgggctcctcctgtccagaatcaagcattggccaggcagtacatgcagatgctacccaaggaaaagcagccagtagcaggctcagagggggcacagtaccggaagaagcagctggcaaagcagctccctgcacatgaccaggacccttcaaagtgccatgagttgtctcccagagaggtgaaggagatggagcagtttgtgaagaaatataagagcgaagctctgggagtaggagatgtcaaacttccctgtgagatggatgcccaaggccccaaacaaatgaacattcctggaggggatagaagcaccccagcagcagtgggggccatggaggacaaatctgctgagcacaaaagaactcaatattcctgctattgctgcaaactgagtatgaaagaaggtgacccagccatctatgccgaaagggctggctatgataaactgtggcacccagcttgttttgtctgcagcacctgccatgaactcctggttgacatgatttatttttggaagaatgagaagctatactgtggcagacattactgtgacagcgagaaaccccgatgtgctggctgtgacgagctgatattcagcaatgagtatacccaggcagaaaaccagaattggcacctgaaacacttctgctgctttgactgtgatagcattctagctggggagatatacgtgatggtcaatgacaagcccgtgtgcaagccctgctatgtgaagaatcacgctgtggtgtgtcaaggatgccacaatgccatcgacccagaagtgcagcgggtgacctataacaatttcagctggcatgcatccacagagtgctttctgtgctcttgctgcagcaaatgcctcattgggcagaagttcatgccagtagaagggatggttttctgttcagtggaatgtaagaagaggatgtcttaggaggagggcacccagaagtatcgagccatagctatccaaagtggtctgcatttctactgtaaaatgcaatttgaaaaaaataaaacgcaaaaaaagaaactgtaaaggaaaccaagagattttgtttaatttttttggccattttttcttcatcaattttttttcggtctcaacttttaaacttggtttaagcatttgatttgtaaaacagtaaataattgtatctttccatagcttttcaaatgtgaaatcatttgttggaagcttggatctcattaaacttcatgtctctattccatttgtgccacacacttaaaagttagtgtactgaatggaaagatgagcattcctagttctacacttcttttttccccctcatgtgtaaaatgaaaagaaaactaaatttgccctaataccaaggcgctacgtttattgcctcgtcttattcactgacctttgtaatgatacacagtgaattctttttgacaaagagaaatgcagtgtagtatgcagagctgctgttttaatgcctatgcatttactctttcctgatttaggcagaggtggcattttctttattgcatttctctatttttttaatgtaccctaccttcagtattctctttgtaagttggtgacttgcatctgtggccttgaatattttattatcacatgtggcataacagtatccacactttttagttctttattttttttttttattttgagcaattctcctgcctcagcctcccaaatagctgggattacaggtgcatgccaccacacccagctaatttttgtatttttagtagagacaggttttcaccatgttagccaggctggtctcaaactcctgacctcagatgatccgcctgccttggcctcccaaagtgctgggattacaggtgtgggagccaccatgcctgacccacacactttttacttgtatagatgatttttggcttggacataaaagccaagccacccatttgcttttaatccaaagaacatgtatagtttttgtacccagagactatgatttatattgattgcacttgcctgccatgatttagataagattttttttgcatggtttttattctttcctaatggatcctgttttataatacttccaagcctgtccatggatatatcaaatgtcttcacttgtatattttcatggctaggtatttctaatgtttattcttccctgtgtacttctacacatagctatgcactatgaaaattaaatggaatgaatgatatgtatattactcattccatttaattttcatagngcatagctatgaaaattaaatggaatgaatgatatgtatattactcaaaataaagtttctttcactttaa

SEQ ID NO: 446259 - DNA, 2687 bp, Homo sapiens
ccggccccctttgttcccgggtccgggccgcaggcccgctgcggcggactgggcggcggaagttcgacggcgccgggcgagtggctgttgagcggcgccgcgggagttccgcaggtttcccgtgttcgcagcggagccggaggccagctgaacccggccgtgggatcccggataggaggaggaggggacccataggacgcgttaacatggacctggaaaacaaagtgaagaagaaaaatatgtcgtaactgcaagtgtggccaagaagagcatgatgtcctcttgagcaatgaagaggatcgaaaagtgggaaaactttttgaagacaccaagtataccactctgattgcaaaactaaagtcagatggaattcccatgtataaacgcaatgttatgatattgacgaatccagttgctgccaagaagaatgtctccatcaatacagttacctatgagtgggctcctcctgtccagaatcaagcattggccaggcagtacatgcagatgctacccaaggaaaagcagccagtagcaggctcagagggggcacagtaccggaagaagcagctggcaaagcagctccctgcacatgaccaggacccttcaaagtgccatgagttgtctcccagagaggtgaaggagatggagcagtttgtgaagaaatataagagcgaagctctgggagtaggagatgtcaaacttccctgtgagatggatgcccaaggccccaaacaaatgaacattcctggaggggatagaagcaccccagcagcagtgggggccatggaggacaaatctgctgagcacaaaagaactcaatattcctgctattgctgcaaactgagtatgaaagaaggtgacccagccatctatgccgaaagggctggctatgataaactgtggcacccagcttgttttgtctgcagcacctgccatgaactcctggttgacatgatttatttttggaagaatgagaagctatactgtggcagacattactgtgacagcgagaaaccccgatgtgctggctgtgacgagctgatattcagcaatgagtatacccaggcagaaaaccagaattggcacctgaaacacttctgctgctttgactgtgatagcattctagctggggagatatacgtgatggtcaatgacaagcccgtgtgcaagccctgctatgtgaagaatcacgctgtggtgtgtcaaggatgccacaatgccatcgacccagaagtgcagcgggtgacctataacaatttcagctggcatgcatccacagagtgctttctgtgctcttgctgcagcaaatgcctcattgggcagaagttcatgccagtagaagggatggttttctgttcagtggaatgtaagaagaggatgtcttaggaggagggcacccagaagtatcgagccatagctatccaaagtggtctgcatttctactgtaaaatgcaatttgaaaaaaataaaacgcaaaaaaagaaactgtaaaggaaaccaagagattttgtttaatttttttggccattttttcttcatcaattttttttcggtctcaacttttaaacttggtttaagcatttgatttgtaaaacagtaaataattgtatctttccatagcttttcaaatgtgaaatcatttgttggaagcttggatctcattaaacttcatgtctctattccatttgtgccacacacttaaaagttagtgtactgaatggaaagatgagcattcctagttctacacttcttttttccccctcatgtgtaaaatgaaaagaaaactaaatttgccctaataccaaggcgctacgtttattgcctcgtcttattcactgacctttgtaatgatacacagtgaattctttttgacaaagagaaatgcagtgtagtatgcagagctgctgttttaatgcctatgcatttactctttcctgatttaggcagaggtggcattttctttattgcatttctctatttttttaatgtaccctaccttcagtattctctttgtaagttggtgacttgcatctgtggccttgaatattttattatcacatgtggcataacagtatccacactttttagttctttattttttttttttattttgagcaattctcctgcctcagcctcccaaatagctgggattacaggtgcatgccaccacacccagctaatttttgtatttttagtagagacaggttttcaccatgttagccaggctggtctcaaactcctgacctcagatgatccgcctgccttggcctcccaaagtgctgggattacaggtgtgggagccaccatgcctgacccacacactttttacttgtatagatgatttttggcttggacataaaagccaagccacccatttgcttttaatccaaagaacatgtatagtttttgtacccagagactatgatttatattgattgcacttgcctgccatgatttagataagattttttttgcatggtttttattctttcctaatggatcctgttttataatacttccaagcctgtccatggatatatcaaatgtcttcacttgtatattttcatggctaggtatttctaatgtttattcttccctgtgtacttctacacatagctatgcactatgaaaattaaatggaatgaatgatatgtatattactcaaaataaagtttctttcactttaa

SEQ ID NO: 446260 - DNA, 1985 bp, Homo sapiens
gagatggagccttgctctgttgcccaggctggagtgcggtggctgtatctcaaaaagaaagaaagaaaagaaatggcagtcttctaatgactaggttgttctggatggcttccctttcagtcctgctattgctgcaaactgagtatgaaagaaggtgacccagccatctatgccgaaagggctggctatgataaactgtggcacccagcttgttttgtctgcagcacctgccatgaactcctggttgacatgatttatttttggaagaatgagaagctatactgtggcagacattactgtgacagcgagaaaccccgatgtgctggctgtgacgagctgatattcagcaatgagtatacccaggcagaaaaccagaattggcacctgaaacacttctgctgctttgactgtgatagcattctagctggggagatatacgtgatggtcaatgacaagcccgtgtgcaagccctgctatgtgaagaatcacgctgtggtgtgtcaaggatgccacaatgccatcgacccagaagtgcagcgggtgacctataacaatttcagctggcatgcatccacagagtgctttctgtgctcttgctgcagcaaatgcctcattgggcagaagttcatgccagtagaagggatggttttctgttcagtggaatgtaagaagaggatgtcttaggaggagggcacccagaagtatcgagccatagctatccaaagtggtctgcatttctactgtaaaatgcaatttgaaaaaaataaaacgcaaaaaaagaaactgtaaaggaaaccaagagattttgtttaatttttttggccattttttcttcatcaattttttttcggtctcaacttttaaacttggtttaagcatttgatttgtaaaacagtaaataattgtatctttccatagcttttcaaatgtgaaatcatttgttggaagcttggatctcattaaacttcatgtctctattccatttgtgccacacacttaaaagttagtgtactgaatggaaagatgagcattcctagttctacacttcttttttccccctcatgtgtaaaatgaaaagaaaactaaatttgccctaataccaaggcgctacgtttattgcctcgtcttattcactgacctttgtaatgatacacagtgaattctttttgacaaagagaaatgcagtgtagtatgcagagctgctgttttaatgcctatgcatttactctttcctgatttaggcagaggtggcattttctttattgcatttctctatttttttaatgtaccctaccttcagtattctctttgtaagttggtgacttgcatctgtggccttgaatattttattatcacatgtggcataacagtatccacactttttagttctttattttttttttttattttgagcaattctcctgcctcagcctcccaaatagctgggattacaggtgcatgccaccacacccagctaatttttgtatttttagtagagacaggttttcaccatgttagccaggctggtctcaaactcctgacctcagatgatccgcctgccttggcctcccaaagtgctgggattacaggtgtgggagccaccatgcctgacccacacactttttacttgtatagatgatttttggcttggacataaaagccaagccacccatttgcttttaatccaaagaacatgtatagtttttgtacccagagactatgatttatattgattgcacttgcctgccatgatttagataagattttttttgcatggtttttattctttcctaatggatcctgttttataatacttccaagcctgtccatggatatatcaaatgtcttcacttgtatattttcatggctaggtatttctaatgtttattcttccctgtgtacttctacacatagctatgcactatgaaaattaaatggaatgaatgatatgtatattactcaaaataaagtttctttcactttaa

SEQ ID NO: 446261 - DNA, 1187 bp, Homo sapiens
ccggccccctttgttcccgggtccgggccgcaggcccgctgcggcggactgggcggcggaagttcgacggcgccgggcgagtggctgttgagcggcgccgcgggagttccgcaggtttcccgtgttcgcagcggagccggaggccagctgaacccggccgtgggatcccggataggaggaggaggggacccataggacgcgttaacatggacctggaaaacaaagtgaagaagatgggcttaggtcacgagcaaggatttggagccccttgtttaaaatgcaaagaaaaatgtgaaggattcgaactgcacttctggagaaaaatatgtcgtaactgcaagtgtggccaagaagagcatgatgtcctcttgagcaatgaagaggatcgaaaagtgggaaaactttttgaagacaccaagtataccactctgattgcaaaactaaagtcagatggaattcccatgtataaacgcaatgttatgatattgacgaatccagttgctgccaagaagaatgtctccatcaatacagttacctatgagtgggctcctcctgtccagaatcaagcattggccaggcagtacatgcagatgctacccaaggaaaagcagccagtagcaggctcagagggggcacagtaccggaagaagcagctggcaaagcagctccctgcacatgaccaggacccttcaaagtgccatgagttgtctcccagagaggtgaaggagatggagcagtttgtgaagaaatataagagcgaagctctgggagtaggagatgtcaaacttccctgtgagatggatgcccaaggccccaaacaaatgaacattcctggaggggatagaagcaccccagcagcagtgggggccatggaggacaaatctgctgagcacaaaagaactcaatattcctgctattgctgcaaactgagtatgaaagaaggtgacccagccatctatgccgaaagggctggctatgataaactgtggcacccagcttgttttgtctgcagcacctgccatgaactcctggttgacatgatttatttttggaagaatgagaagctatactgtggcagacattactgtgacagcgagaaaccccgatgtgctggctgtgacgagctgatatcacaactgagtatacccagccctcttccccagcccgggatcctctagacgactcga

SEQ ID NO: 446262 - DNA, 348 bp, Homo sapiens
cctgttaactcaagaatatctctcctctaccctcaatccagtccctctttgtatgagccataaatgttcttcattttaacttatgagagtaaaactctacattggaggctatgaattacatatcacacaactacaaatcactaggcatgctaaggtagtttagctaaatcacacagtatatgctcaacaaatgcaactgaattaagcagggggcatcacatatttgaaagtaaaatttggcataattattagtgattgacaattccattcaagatctttggtgtgtctagcgtttcctgtcagaatctctaaaagagacacaatttatcttttcattgtcttctaact

SEQ ID NO: 446263 - DNA, 353 bp, Homo sapiens
ctccatgattagctggaatgatgcacagaactcaggaaagcactcagcttcctatcactggttattataagggacactactccagaacagcccagaggaagagatgcggcgggcaaggacggcgggcacagcgcagcactccccgctcgttggcctgcagcagcagtgtgacttgctcaaggtccagtgagtgacctcattccccagaaaaggctcctcccaccccagagtacagcctgggtagggggaaaatcagttctttcagctaccccccatccaacctttgggcctatgtgaaaagaaaggaactaagctgggtgtgttctgtctggaacccgggaagcgggtttcct

SEQ ID NO: 446264 - DNA, 2175 bp, Homo sapiens
ctccatgattagctggaatgatgcacagaactcaggaaagcactcagcttcctatcactggttattataagggacactactccagaacagcccagaggaagagatgcggcgggcaaggacggcgggcacagcgcagcactccccgctcgttggcccgggtatcccagcgcggacccacgcgatacgctgacgccccgacgccgatccggccgagccaagactcaacgatgactctgaataatgtcaccatgcgccagggcactgtgggcatgcagccacagcagcagcgctggagcatcccagctgatggcaggcatctgatggtccagaaagagccccaccagtacagccaccgcaaccgccattctgctacccctgaggaccactgccgccgaagctggtcctctgactccacagactcagtcatctcctctgagtcagggaacacctactaccgagtggtgctcataggggagcagggggtgggcaagtccactctggccaacatctttgcaggtgtgcatgacagcatggacagcgactgcgaggtgctgggagaagatacatatgaacgaaccctgatggttgatggggaaagtgcaacgattatactcctggatatgtgggaaaataagggggaaaatgaatggctccatgaccactgcatgcaggtcggggacgcatacctgattgtctactcaatcacagaccgagcgagcttcgagaaggcatctgagctgcgaatccagctccgcagggcccggcagacagaggacattcccataattttggttggcaacaaaagtgacttagtgcggtgccgagaagtgtctgtatcagaagggagagcctgtgcagtggtgtttgactgcaagttcatcgagacctctgcagctgtccagcacaacgtgaaggagctgtttgagggcattgtgcgacaggtgcgccttcggcgggacagcaaggagaagaatgaacggcggctggcctaccagaaaaggaaggagagcatgcccaggaaagccaggcgcttctggggcaagatcgtggccaaaaacaacaagaatatggccttcaagctcaagtccaaatcctgccatgacctctctgtactctaggaacccagggtcacccagatgtccctttgatggccgttgttgaaggccattgggaccaataatctatattagattgaatacttaagttagatgtggtttcccccattgtagcagggagctagcgtattagccttgtgggcaacatgatgcatgggaaatgaaagatttttgtaaaaagtcagtatttatttccaggaaaagcctgaccttgctatttgaacacccaagactctttagaggatgtgtttggtgttcacatgtgtttcttctattttggatagtagggaagtaaagcttacaaagaatgcctagaacaagaacttttcatcattaaaaatttttcccagtgttctgatatgtgactttgaggccaatgagtcataaacaaatataagaaagctgtcaatgagtttcttcaaaggagggaaaactttctacgaatctaagatccatggagctagaattgtagaactaggctcatcagaatcgtgactattattgctccatcaaactgtgaaaagaaatgatgtggaccttgctggaaacaaaggcttagcaaacaatttttgttcaatgcccaccgagacatatagaattgggaactgatacatgtgtcccttataggctcaaaaattatatcttacaatttcttatttagggggaaattatttgaatcagattctatttagtcaaaccaccttttatgttttattatttttgaattcatggagccatcataaaaatatttttaaaatcagaattattgataccctgtagtgcaaaatgtcaatttttaatgtataatcagaagtctgaattttcataaaacatatagcataaaaacttccagtactttggttgacccttgtatgtcacagctctgctctatttattattattttgcaaaataaccattttaacatttgataaagcatatttatgaacatatttcttaataagaaaaatatccattttattaccattttctatctttttcaaaatatgcaagtttttacctatatgtcttataataaaagaaataaaatatttgaaaaaa

SEQ ID NO: 446265 - DNA, 2567 bp, Homo sapiens
ctccatgattagctggaatgatgcacagaactcaggaaagcactcagcttcctatcactggttattataagggacactactccagaacagcccagaggaagagatgcggcgggcaaggacggcgggcacagcgcagcactccccgctcgttggcccgggtatcccagcgcggacccacgcgatacgctgacgccccgacgccgatccggccgagccaagtaagggggacggcccgagacggagaagggagagagtgggagtttcccagcccgcagaactttcgaagttgagaagagaacccctggaacgtgcgctcagcactgggattttctggactcaacgatgactctgaataatgtcaccatgcgccagggcactgtgggcatgcagccacagcagcagcgctggagcatcccagctgatggcaggcatctgatggtccagaaagagccccaccagtacagccaccgcaaccgccattctgctacccctgaggaccactgccgccgaagctggtcctctgactccacagactcagtcatctcctctgagtcagggaacacctactaccgagtggtgctcataggggagcagggggtgggcaagtccactctggccaacatctttgcaggtgtgcatgacagcatggacagcgactgcgaggtgctgggagaagatacatatgaacgaaccctgatggttgatggggaaagtgcaacgattatactcctggatatgtgggaaaataagggggaaaatgaatggctccatgaccactgcatgcaggtcggggacgcatacctgattgtctactcaatcacagaccgagcgagcttcgagaaggcatctgagctgcgaatccagctccgcagggcccggcagacagaggacattcccataattttggttggcaacaaaagtgacttagtgcggtgccgagaagtgtctgtatcagaagggagagcctgtgcagtggtgtttgactgcaagttcatcgagacctctgcagctgtccagcacaacgtgaaggagctgtttgagggcattgtgcgacaggtgcgccttcggcgggacagcaaggagaagaatgaacggcggctggcctaccagaaaaggaaggagagcatgcccaggaaagccaggcgcttctggggcaagatcgtggccaaaaacaacaagaatatggccttcaagctcaagtccaaatcctgccatgacctctctgtactctaggaacccagggtcacccagatgtccctttgatggccgttgttgaaggccattgggaccaataatctatattagattgaatacttaagttagatgtggtttcccccattgtagcagggagctagcgtattagccttgtgggcaacatgatgcatgggaaatgaaagatttttgtaaaaagtcagtatttatttccaggaaaagcctgaccttgctatttgaacacccaagactctttagaggatgtgtttggtgttcacatgtgtttcttctattttggatagtagggaagtaaagcttacaaagaatgcctagaacaagaacttttcatcattaaaaatttttcccagtgttctgatatgtgactttgaggccaatgagtcataaacaaatataagaaagctgtcaatgagtttcttcaaaggagggaaaactttctacgaatctaagatccatggagctagaattgtagaactaggctcatcagaatcgtgactattattgctccatcaaactgtgaaaagaaatgatgtggaccttgctggaaacaaaggcttagcaaacaatttttgttcaatgcccaccgagacatatagaattgggaactgatacatgtgtcccttataggctcaaaaattatatcttacaatttcttatttagggggaaattatttgaatcagattctatttagtcaaaccaccttttatgttttattatttttgaattcatggagccatcataaaaatatttttaaaatcagaattattgataccctgtagtgcaaaatgtcaatttttaatgtataatcagaagtctgaattttcataaaacatatagcataaaaacttccagtactttggttgacccttgtatgtcacagctctgctctatttattattattttgcaaaataaccattttaacatttgataaagcatatttatgaacatatttcttaataagaaaaatatccattttattaccattttctatctttttcaaaatatgcaagtttttacctatatgtcttataataaaagaaataaaatatttgaaaaaaaaaaaagagagaaaacaaaaactcttggcggcgtctcgacgtgaaaaaagtttaaacaactctgtgggggcccgcggcccgatgagtggacatgggccaacttgacaaagagaaccgcgcggatcatgtggttccccaaaaaaacccgggagagcgcgtcgaaacccagggtcgggcaccggtcaacacggcacggtcgtaccccccccggactgagcgaaggggcgacgcaaaagagaaagacgaagagagccaacggacgacatcgacagagacg

SEQ ID NO: 446266 - DNA, 1983 bp, Homo sapiens
ctccatgattagctggaatgatgcacagaactcaggaaagcactcagcttcctatcactggttattataagggacactactccagaacagcccagaggaagagatgcggcgggcaaggacggcgggcacagcgcagcactccccgctcgttggcccgggtatcccagcgcggacccacgcgatacgctgacgccccgacgccgatccggccgagccaagtaagggggacggcccgagacggagaagggagagagtgggagtttcccagcccgcagaactttcgaagttgagaagagaacccctggaacgtgcgctcagcactgggattttctggactcaacgatgactctgaataatgtcaccatgcgccagggcactgtgggcatgcagccacagcagcagcgctggagcatcccagctgatggcaggcatctgatggtccagaaagagccccaccagtacagccaccgcaaccgccattctgctacccctgaggaccactgccgccgaagctggtcctctgactccacagactcagtcatctcctctgagtcagggaacacctactaccgagtggtgctcataggggagcagggggtgggcaagtccactctggccaacatctttgcaggtgtgcatgacagcatggacagcgactgcgaggtgctgggagaagatacatatgaacgaaccctgatggttgatggggaaagtgcaacgattatactcctggatatgtgggaaaataagggggaaaatgaatggctccatgaccactgcatgcaggtcggggacgcatacctgattgtctactcaatcacagaccgagcgagcttcgagaaggcatctgagctgcgaatccagctccgcagggcccggcagacagaggacattcccataattttggttggcaacaaaagtgacttagtgcggtgccgagaagtgtctgtatcagaagggagagcctgtgcagtggtgtttgactgcaagttcatcgagacctctgcagctgtccagcacaacgtgaaggagctgtttgagggcattgtgcgacaggtgcgccttcggcgggacagcaaggagaagaatgaacggcggctggcctaccagaaaaggaaggagagcatgcccaggaaagccaggcgcttctggggcaagatcgtggccaaaaacaacaagaatatggccttcaagctcaagtccaaatcctgccatgacctctctgtactctaggaacccagggtcacccagatgtccctttgatggccgttgttgaaggccattgggaccaataatctatattagattgaatacttaagttagatgtggtttcccccattgtagcagggagctagcgtattagccttgtgggcaacatgatgcatgggaaatgaaagatttttgtaaaaagtcagtatttatttccaggaaaagcctgaccttgctatttgaacacccaagactctttagaggatgtgtttggtgttcacatgtgtttcttctattttggatagtagggaagtaaagcttacaaagaatgcctagaacaagaacttttcatcattaaaaatttttcccagtgttctgatatgtgactttgaggccaatgagtcataaacaaatataagaaagctgtcaatgagtttcttcaaaggagggaaaactttctacgaatctaagatccatggagctagaattgtagaactaggctcatcagaatcgtgactattattgctccatcataacaacgtaaaagacactgatttccttggaaaaacaaagtgcaccacgaggattttgcagtcaccacacccctcttccgaaaataatacataagagaactcgtacgcaacatgattagtatcaatcaaggttcaaacagggaagaaataggtgagtaaataatatataataaattctatagaagtcaacaaatgagaatcatgataccctttatagaactggtgagtgggagtagacacc

SEQ ID NO: 446267 - DNA, 1038 bp, Homo sapiens
ctccatgattagctggaatgatgcacagaactcaggaaagcactcagcttcctatcactggttattataagggacactactccagaacagcccagaggaagagatgcggcgggcaaggacggcgggcacagcgcagcactccccgctcgttggcccgggtatcccagcgcggacccacgcgatacgctgacgccccgacgccgatccggccgagccaagtaagggggacggcccgagacggagaagggagagagtgggagtttcccagcccgcagaactttcgaagttgagaagagaacccctggaacgtgcgctcagcactgggattttctggtaggggtcagagcttcaagtgcaaaggatgtcgcttctcatcagcaggttccttagttcaattcggtagaagggtcacctccctctacagatcgagtggtcagagagggcagcccttaatgatgctttatgtatttgttgtttgaatgtaagtctgccaactgaggtgctgcttttgagactaaaaaaccggctggtcgtcctggttagtggcgagatgttggggtacggagtgtgggggtgagggtgggagaggagtgtttgtgcatcttgctgattgcaacgtaagtacttatactttgtcaccagtagccggaaaaacagacctcccggctaggggaggcagtctgcaaagggaaagttgtagagaagttgttgaatatcatttaggggagtcttcagccttctgatttgcttcaagaaggggatctgagaatggtggctcaggcctgtgatctcagcactttcggaagccgaggccggaggatcacttgaccccaggagttcgagaccagcctgggcaacctagtgagaccactgtctctaccaaaaaataaaaataaaaataaaaaaactagtggacgtggtagtgcaggtctgtagtcccagctacttgggaggctgaagtggaggatctcttgagcctggcagttggaggctagctacagtgagctatgatcgtgccactgcactccagcctgggtg

SEQ ID NO: 446268 - DNA, 2290 bp, Homo sapiens
ctccatgattagctggaatgatgcacagaactcaggaaagcactcagcttcctatcactggttattataagggacactactccagaacagcccagaggaagagatgcggcgggcaaggacggcgggcacagcgcagcactccccgctcgttggcccgggtatcccagcgcggacccacgcgatacgctgacgccccgacgccgatccggccgagccaagtaagggggacggcccgagacggagaagggagagagtgggagtttcccagcccgcagaactttcgaagttgagaagagaacccctggaacgtgcgctcagcactgggattttctggactcaacgatgactctgaataatgtcaccatgcgccagggcactgtgggcatgcagccacagcagcagcgctggagcatcccagctgatggcaggcatctgatggtccagaaagagccccaccagtacagccaccgcaaccgccattctgctacccctgaggaccactgccgccgaagctggtcctctgactccacagactcagtcatctcctctgagtcagggaacacctactaccgagtggtgctcataggggagcagggggtgggcaagtccactctggccaacatctttgcaggtgtgcatgacagcatggacagcgactgcgaggtgctgggagaagatacatatgaacgaaccctgatggttgatggggaaagtgcaacgattatactcctggatatgtgggaaaataagggggaaaatgaatggctccatgaccactgcatgcaggtcggggacgcatacctgattgtctactcaatcacagaccgagcgagcttcgagaaggcatctgagctgcgaatccagctccgcagggcccggcagacagaggacattcccataattttggttggcaacaaaagtgacttagtgcggtgccgagaagtgtctgtatcagaagggagagcctgtgcagtggtgtttgactgcaagttcatcgagacctctgcagctgtccagcacaacgtgaaggagctgtttgagggcattgtgcgacaggtgcgccttcggcgggacagcaaggagaagaatgaacggcggctggcctaccagaaaaggaaggagagcatgcccaggaaagccaggcgcttctggggcaagatcgtggccaaaaacaacaagaatatggccttcaagctcaagtccaaatcctgccatgacctctctgtactctaggaacccagggtcacccagatgtccctttgatggccgttgttgaaggccattgggaccaataatctatattagattgaatacttaagttagatgtggtttcccccattgtagcagggagctagcgtattagccttgtgggcaacatgatgcatgggaaatgaaagatttttgtaaaaagtcagtatttatttccaggaaaagcctgaccttgctatttgaacacccaagactctttagaggatgtgtttggtgttcacatgtgtttcttctattttggatagtagggaagtaaagcttacaaagaatgcctagaacaagaacttttcatcattaaaaatttttcccagtgttctgatatgtgactttgaggccaatgagtcataaacaaatataagaaagctgtcaatgagtttcttcaaaggagggaaaactttctacgaatctaagatccatggagctagaattgtagaactaggctcatcagaatcgtgactattattgctccatcaaactgtgaaaagaaatgatgtggaccttgctggaaacaaaggcttagcaaacaatttttgttcaatgcccaccgagacatatagaattgggaactgatacatgtgtcccttataggctcaaaaattatatcttacaatttcttatttagggggaaattatttgaatcagattctatttagtcaaaccaccttttatgttttattatttttgaattcatggagccatcataaaaatatttttaaaatcagaattattgataccctgtagtgcaaaatgtcaatttttaatgtataatcagaagtctgaattttcataaaacatatagcataaaaacttccagtactttggttgacccttgtatgtcacagctctgctctatttattattattttgcaaaataaccattttaacatttgataaagcatatttatgaacatatttcttaataagaaaaatatccattttattaccattttctatctttttcaaaatatgcaagtttttacctatatgtcttataataaaagaaataaaatatttgaaaaaa

SEQ ID NO: 446269 - DNA, 2236 bp, Homo sapiens
ctccatgattagctggaatgatgcacagaactcaggaaagcactcagcttcctatcactggttattataagggacactactccagaacagcccagaggaagagatgcggcgggcaaggacggcgggcacagcgcagcactccccgctcgttggcccgggtatcccagcgcggacccacgcgatacgctgacgccccgacgccgatccggccgagccaagtaagggggacggcccgagacggagaagggagagagtgggagtttcccagcccgcagaactttcgaagttgagaagagaacccctggaacgtgcgctcagcactgggattttctggactcaacgatgactctgaataatgtcaccatgcgccagggcactgtgggcatgcagccacagcagcagcgctggagcatcccagctgatggcaggcatctgatggtccagaaagagccccaccagtacagccaccgcaaccgccattctgctacccctgaggaccactgccgccgaagctggtcctctgactccacagactcagtcatctcctctgagtcagggaacacctactaccgagtggtgctcataggggagcagggggtgggcaagtccactctggccaacatctttgcaggtgtgcatgacagcatggacagcgactgcgaggtgctgggagaagatacatatgaacgaaccctgatggttgatggggaaagtgcaacgattatactcctggatatgtgggaaaataagggggaaaatgaatggctccatgaccactgcatgcaggtcggggacgcatacctgattgtctactcaatcacagaccgagcgagcttcgagaaggcatctgagctgcgaatccagctccgcagggcccggcagacagaggacattcccataattttggttggcaacaaaatggtgtttgactgcaagttcatcgagacctctgcagctgtccagcacaacgtgaaggagctgtttgagggcattgtgcgacaggtgcgccttcggcgggacagcaaggagaagaatgaacggcggctggcctaccagaaaaggaaggagagcatgcccaggaaagccaggcgcttctggggcaagatcgtggccaaaaacaacaagaatatggccttcaagctcaagtccaaatcctgccatgacctctctgtactctaggaacccagggtcacccagatgtccctttgatggccgttgttgaaggccattgggaccaataatctatattagattgaatacttaagttagatgtggtttcccccattgtagcagggagctagcgtattagccttgtgggcaacatgatgcatgggaaatgaaagatttttgtaaaaagtcagtatttatttccaggaaaagcctgaccttgctatttgaacacccaagactctttagaggatgtgtttggtgttcacatgtgtttcttctattttggatagtagggaagtaaagcttacaaagaatgcctagaacaagaacttttcatcattaaaaatttttcccagtgttctgatatgtgactttgaggccaatgagtcataaacaaatataagaaagctgtcaatgagtttcttcaaaggagggaaaactttctacgaatctaagatccatggagctagaattgtagaactaggctcatcagaatcgtgactattattgctccatcaaactgtgaaaagaaatgatgtggaccttgctggaaacaaaggcttagcaaacaatttttgttcaatgcccaccgagacatatagaattgggaactgatacatgtgtcccttataggctcaaaaattatatcttacaatttcttatttagggggaaattatttgaatcagattctatttagtcaaaccaccttttatgttttattatttttgaattcatggagccatcataaaaatatttttaaaatcagaattattgataccctgtagtgcaaaatgtcaatttttaatgtataatcagaagtctgaattttcataaaacatatagcataaaaacttccagtactttggttgacccttgtatgtcacagctctgctctatttattattattttgcaaaataaccattttaacatttgataaagcatatttatgaacatatttcttaataagaaaaatatccattttattaccattttctatctttttcaaaatatgcaagtttttacctatatgtcttataataaaagaaataaaatatttgaaaaaa

SEQ ID NO: 446270 - DNA, 917 bp, Homo sapiens
ctccatgattagctggaatgatgcacagaactcaggaaagcactcagcttcctatcactggttattataagggacactactccagaacagcccagaggaagagatgcggcgggcaaggacggcgggcacagcgcagcactccccgctcgttggcccgggtatcccagcgcggacccacgcgatacgctgacgccccgacgccgatccggccgagccaagactcaacgatgactctgaataatgtcaccatgcgccagggcactgtgggcatgcagccacagcagcagcgctggagcatcccagctgatggcaggcatctgatggtccagaaagagccccaccagtacagccaccgcaaccgccattctgctacccctgaggaccactgccgccgaagctggtcctctgactccacagactcagtcatctcctctgagtcagggaacacctactaccgagtggtgctcataggggagcagggggtgggcaagtccactctggccaacatctttgcaggtgtgcatgacagcatggacagcgactgcgaggtgctgggaggtaggtgtcccagccccagtgggcttctttccaccaggggtggcccaggaagaaagagtgagggtgggtgacttatttacccacagagttgggagctgaagttaggcattttggacaattgatgggggagctgagtctctagaaaagcccaagcacaggctttcgggcaagaaaatgaaaatgcttgtagacaggaccaaaatctgttgatcctgggccagaaagggaattcttcagattccaattctaaatgggttggggaaggctgattagagagggcagagccagagggtcagcgccccacttgacttctgctgactctgacttgaacattcttcccggaactcagtatagacaca

SEQ ID NO: 446271 - DNA, 2332 bp, Homo sapiens
tactttttttacaattattgaggttttaataatacataatttgactacatttcttagatttcgcgtcgtgacgttttcagcctctcaaactgcatcgcctacgcacagaagcttcccgaatctcagacgagacacaacaaagctgcgcgctgccctcgccccgcccgcgggcgcggcggcgacaggccctcggccccgcccacaccgcggcgccacgcctccaacccgcctccagccgtgcctccccaggcccttggccccgcccacaccgcctcgccccgccccaagccgcgctgtgctccaggggcgggggcccacggcggccactcactgagccccacgggccgcagcggagtgacgtagggttggcgcacggatccgttgcggctgcagctctgcagtcgggccgttccttcgccgccgccaggggtagcggtgtagctgcgcagcgtcgcgcgcgctaccgcacccaggttcggcccgtaggcgtctggcagcccggcgccatcttcatcgagcgccatggccgcagcctgcgggccgggagcggccgggtactgcttgctcctcggcttgcatttgtttctgctgaccgcgggccctgccctgggctggaacgaccctgacagaatgttgctgcgggatgtaaaagctcttaccctccactatgaccgctataccacctcccgcaggctggatcccatcccacagttgaaatgtgttggaggcacagctggttgtgattcttataccccaaaagtcatacagtgtcagaacaaaggctgggatgggtatgatgtacagtgggaatgtaagacggacttagatattgcatacaaatttggaaaaactgtggtgagctgtgaaggctatgagtcctctgaagaccagtatgtactaagaggttcttgtggcttggagtataatttagattatacagaacttggcctgcagaaactgaaggagtctggaaagcagcacggctttgcctctttctctgattattattataagtggtcctcggcggattcctgtaacatgagtggattgattaccatcgtggtactccttgggatcgcctttgtagtctataagctgttcctgagtgacgggcagtattctcctccaccgtactctgagtatcctccattttcccaccgttaccagagattcaccaactcagcaggacctcctcccccaggctttaagtctgagttcacaggaccacagaatactggccatggtgcaacttctggttttggcagtgcttttacaggacaacaaggatatgaaaattcaggaccagggttctggacaggcttgggaactggtggaatactaggatatttgtttggcagcaatagagcggcaacacccttctcagactcgtggtactacccgtcctatcctccctcctaccctggcacgtggaatagggcttactcaccccttcatggaggctcgggcagctattcggtatgttcaaactcagacacgaaaaccagaactgcatcaggatatggtggtaccaggagacgataaagtagaaagttggagtcaaacactggatgcagaaattttggatttttcatcactttctctttagaaaaaaagtactacctgttaacaattgggaaaaggggatattcaaaagttctgtggtgttatgtccagtgtagctttttgtattctattatttgaggctaaaagttgatgtgtgacaaaatacttatgtgttgtatgtcagtgtaacatgcagatgtatattgcagtttttgaaagtgatcattactgtggaatgctaaaaatacattaatttctaaaacctgtgatgccctaagaagcattaagaatgaaggtgttgtactaatagaaactaagtacagaaaatttcagttttaggtggttgtagctgatgagttattacctcatagagactataatattctatttggtattatattatttgatgtttgctgttcttcaaacatttaaatcaagctttggactaattatgctaatttgtgagttctgatcacttttgagctctgaagctttgaatcattcagtggtggagatggccttctggtaactgaatattaccttctgtaggaaaaggtggaaaataagcatctagaaggttgttgtgaatgactctgtgctggcaaaaatgcttgaaacctctatatttctttcgttcataagaggtaaaggtcaaatttttcaacaaaagtcttttaataacaaaagcatgcagttctctgtgaaatctcaaatattgttgtaatagtctgtttcaatcttaaaaagaatcaataaaaacaaacaaggg

SEQ ID NO: 446272 - DNA, 2355 bp, Homo sapiens
tactttttttacaattattgaggttttaataatacataatttgactacatttcttagatttcgcgtcgtgacgttttcagcctctcaaactgcatcgcctacgcacagaagcttcccgaatctcagacgagacacaacaaagctgcgcgctgccctcgccccgcccgcgggcgcggcggcgacaggccctcggccccgcccacaccgcggcgccacgcctccaacccgcctccagccgtgcctccccaggcccttggccccgcccacaccgcctcgccccgccccaagccgcgctgtgctccaggggcgggggcccacggcggccactcactgagccccacgggccgcagcggagtgacgtagggttggcgcacggatccgttgcggctgcagctctgcagtcgggccgttccttcgccgccgccaggggtagcggtgtagctgcgcagcgtcgcgcgcgctaccgcacccaggttcggcccgtaggcgtctggcagcccggcgccatcttcatcgagcgccatggccgcagcctgcgggccgggagcggccgggtactgcttgctcctcggcttgcatttgtttctgctgaccgcgggccctgccctgggctggaacgaccctgacagaatgttgctgcgggatgtaaaagctcttaccctccactatgaccgctataccacctcccgcaggctggatcccatcccacagttgaaatgtgttggaggcacagctggttgtgattcttataccccaaaagtcatacagtgtcagaacaaaggctgggatgggtatgatgtacagtgggaatgtaagacggacttagatattgcatacaaatttggaaaaactgtggtgagctgtgaaggctatgagtcctctgaagaccagtatgtactaagaggttcttgtggcttggagtataatttagattatacagaacttggcctgcagaaactgaaggagtctggaaagcagcacggctttgcctctttctctgattattattataagtggtcctcggcggattcctgtaacatgagtggattgattaccatcgtggtactccttgggatcgcctttgtagtctataagctgttcctgagtgacgggcagtattctcctccaccgtactctgagtatcctccattttcccaccgttaccagagattcaccaactcagcaggacctcctcccccaggctttaagtctgagttcacaggaccacagaatactggccatggtgcaacttctggttttggcagtgcttttacaggacaacaaggatatgaaaattcaggaccagggttctggacaggcttgggaactggtggaatactaggatatttgtttggcagcaatagagcggcaacacccttctcagactcgtggtactacccgtcctatcctccctcctaccctggcacgtggaatagggcttactcaccccttcatggaggctcgggcagctattcggtatgttcaaactcagacacgaaaaccagaactgcatcaggatatggtggtaccaggagacgataaagtagaaagttggagtcaaacactggatgcagaaattttggatttttcatcactttctctttagaaaaaaagtactacctgttaacaattgggaaaaggggatattcaaaagttctgtggtgttatgtccagtgtagctttttgtattctattatttgaggctaaaagttgatgtgtgacaaaatacttatgtgttgtatgtcagtgtaacatgcagatgtatattgcagtttttgaaagtgatcattactgtggaatgctaaaaatacattaatttctaaaacctgtgatgccctaagaagcattaagaatgaaggtgttgtactaatagaaactaagtacagaaaatttcagttttaggtggttgtagctgatgagttattacctcatagagactataatattctatttggtattatattatttgatgtttgctgttcttcaaacatttaaatcaagctttggactaattatgctaatttgtgagttctgatcacttttgagctctgaagctttgaatcattcagtggtggagatggccttctggtaactgaatattaccttctgtaggaaaaggtggaaaataagcatctagaaggttgttgtgaatgactctgtgctggcaaaaatgcttgaaacctctatatttctttcgttcataagaggtaaaggtcaaatttttcaacaaaagtcttttaataacaaaagcatgcagttctctgtgaaatctcaaatattgttgtaatagtctgtttcaatcttaaaaagaatcaataaaaacaaacaaggggtttagtctcattctttctatta

SEQ ID NO: 446273 - DNA, 2249 bp, Homo sapiens
tactttttttacaattattgaggttttaataatacataatttgactacatttcttagatttcgcgtcgtgacgttttcagcctctcaaactgcatcgcctacgcacagaagcttcccgaatctcagacgagacacaacaaagctgcgcgctgccctcgccccgcccgcgggcgcggcggcgacaggccctcggccccgcccacaccgcggcgccacgcctccaacccgcctccagccgtgcctccccaggcccttggccccgcccacaccgcctcgccccgccccaagccgcgctgtgctccaggggcgggggcccacggcggccactcactgagccccacgggccgcagcggagtgacgtagggttggcgcacggatccgttgcggctgcagctctgcagtcgggccgttccttcgccgccgccaggggtagcggtgtagctgcgcagcgtcgcgcgcgctaccgcacccaggttcggcccgtaggcgtctggcagcccggcgccatcttcatcgagcgccatggccgcagcctgcgggccgggagcggccgggtactgcttgctcctcggcttgcatttgtttctgctgaccgcgggccctgccctgggctggaacgaccctgacagaatgttgctgcgggatgtaaaagctcttaccctccactatgaccgctataccacctcccgcaggctggatcccatcccacagttgaaatgtgttggaggcacagctggttgtgattcttataccccaaaagtcatacagtgtcagaacaaaggctgggatgggtatgatgtacagtgggaatgtaagacggacttagatattgcatacaaatttggaaaaactgtggtgagctgtgaaggctatgagtcctctgaagaccagtatgtactaagaggttcttgtggcttggagtataatttagattatacagaacttggcctgcagaaactgaaggagtctggaaagcagcacggctttgcctctttctctgattattattataagtggtcctcggcggattcctgtaacatgagtggattgattaccatcgtggtactccttgggatcgcctttgtagtctataagctgttcctgagtgacgggcagtattctcctccaccgtactctgagtatcctccattttcccaccgttaccagagattcaccaactcagcaggacctcctcccccaggctttaagtctgagttcacaggaccacagaatactggccatggtgcaacttctggttttggcagtgcttttacaggacaacaaggatatgaaaattcaggaccagggttctggacaggcttgggaactggtggaatactaggatatttgtttggcagcaatagagcggcaacacccttctcagactcgtggtactacccgtcctatcctccctcctaccctggcacgtggaatagggcttactcaccccttcatggaggctcgggcagctattcggtatgttcaaactcagacacgaaaaccagaactgcatcaggatatggtggtaccaggagacgataaagtagaaagttggagtcaaacactggatgcagaaattttggatttttcatcactttctctttagaaaaaaagtactacctgttaacaattgggaaaaggggatattcaaaagttctgtggtgttatgtccagtgtagctttttgtattctattatttgaggctaaaagttgatgtgtgacaaaatacttatgtgttgtatgtcagtgtaacatgcagatgtatattgcagtttttgaaagtgatcattactgtggaatgctaaaaatacattaatttctaaaacctgtgatgccctaagaagcattaagaatgaaggtgttgtactaatagaaactaagtacagaaaatttcagttttaggtggttgtagctgatgagttattacctcatagagactataatattctatttggtattatattatttgatgtttgctgttcttcaaacatttaaatcaagctttggactaattatgctaatttgtgagttctgatcacttttgagctctgaagctttgaatcattcagtggtggagatggccttctggtaactgaatattaccttctgtaggaaaaggtggaaaataagcatctagaaggttgttgtgaatgactctgtgctggcaaaaatgcttgaaacctctatatttctttcgttcataagaggtaaaggtcaaattgtcgacgcggccgaagtttagtagtagt

SEQ ID NO: 446274 - DNA, 2242 bp, Homo sapiens
tactttttttacaattattgaggttttaataatacataatttgactacatttcttagatttcgcgtcgtgacgttttcagcctctcaaactgcatcgcctacgcacagaagcttcccgaatctcagacgagacacaacaaagctgcgcgctgccctcgccccgcccgcgggcgcggcggcgacaggccctcggccccgcccacaccgcggcgccacgcctccaacccgcctccagccgtgcctccccaggcccttggccccgcccacaccgcctcgccccgccccaagccgcgctgtgctccaggggcgggggcccacggcggccactcactgagccccacgggccgcagcggagtgacgtagggttggcgcacggatccgttgcggctgcagctctgcagtcgggccgttccttcgccgccgccaggggtagcggtgtagctgcgcagcgtcgcgcgcgctaccgcacccaggttcggcccgtaggcgtctggcagcccggcgccatcttcatcgagcgccatggccgcagcctgcgggccgggagcggccgggtactgcttgctcctcggcttgcatttgtttctgctgaccgcgggccctgccctgggctggaacgaccctgacagaatgttgctgcgggatgtaaaagctcttaccctccactatgaccgctataccacctcccgcaggctggatcccatcccacagttgaaatgtgttggaggcacagctggttgtgattcttataccccaaaagtcatacagtgtcagaacaaaggctgggatgggtatgatgtacagtgggaatgtaagacggacttagatattgcatacaaatttggaaaaactgtggtgagctgtgaaggctatgagtcctctgaagaccagtatgtactaagaggttcttgtggcttggagtataatttagattatacagaacttggcctgcagaaactgaaggagtctggaaagcagcacggctttgcctctttctctgattattattataagtggtcctcggcggattcctgtaacatgagtggattgattaccatcgtggtactccttgggatcgcctttgtagtctataagctgttcctgagtgacgggcagtattctcctccaccgtactctgagtatcctccattttcccaccgttaccagagattcaccaactcagcaggacctcctcccccaggctttaagtctgagttcacaggaccacagaatactggccatggtgcaacttctggttttggcagtgcttttacaggacaacaaggatatgaaaattcaggaccagggttctggacaggcttgggaactggtggaatactaggatatttgtttggcagcaatagagcggcaacacccttctcagactcgtggtactacccgtcctatcctccctcctaccctggcacgtggaatagggcttactcaccccttcatggaggctcgggcagctattcggtatgttcaaactcagacacgaaaaccagaactgcatcaggatatggtggtaccaggagacgataaagtagaaagttggagtcaaacattctgtggtgttatgtccagtgtagctttttgtattctattatttgaggctaaaagttgatgtgtgacaaaatacttatgtgttgtatgtcagtgtaacatgcagatgtatattgcagtttttgaaagtgatcattactgtggaatgctaaaaatacattaatttctaaaacctgtgatgccctaagaagcattaagaatgaaggtgttgtactaatagaaactaagtacagaaaatttcagttttaggtggttgtagctgatgagttattacctcatagagactataatattctatttggtattatattatttgatgtttgctgttcttcaaacatttaaatcaagctttggactaattatgctaatttgtgagttctgatcacttttgagctctgaagctttgaatcattcagtggtggagatggccttctggtaactgaatattaccttctgtaggaaaaggtggaaaataagcatctagaaggttgttgtgaatgactctgtgctggcaaaaatgcttgaaacctctatatttctttcgttcataagaggtaaaggtcaaatttttcaacaaaagtcttttaataacaaaagcatgcagttctctgtgaaatctcaaatattgttgtaatagtctgtttcaatcttaaaaagaatcaataaaaacaaacaaggg

SEQ ID NO: 446275 - DNA, 2292 bp, Homo sapiens
tactttttttacaattattgaggttttaataatacataatttgactacatttcttagatttcgcgtcgtgacgttttcagcctctcaaactgcatcgcctacgcacagaagcttcccgaatctcagacgagacacaacaaagctgcgcgctgccctcgccccgcccgcgggcgcggcggcgacaggccctcggccccgcccacaccgcggcgccacgcctccaacccgcctccagccgtgcctccccaggcccttggccccgcccacaccgcctcgccccgccccaagccgcgctgtgctccaggggcgggggcccacggcggccactcactgagccccacgggccgcagcggagtgacgtagggttggcgcacggatccgttgcggctgcagctctgcagtcgggccgttccttcgccgccgccaggggtagcggtgtagctgcgcagcgtcgcgcgcgctaccgcacccaggttcggcccgtaggcgtctggcagcccggcgccatcttcatcgagcgccatggccgcagcctgcgggccgggagcggccgggtactgcttgctcctcggcttgcatttgtttctgctgaccgcgggccctgccctgggctggaacgaccctgacagaatgttgctgcgggatgtaaaagctcttaccctccactatgaccgctataccacctcccgcaggctggatcccatcccacagttgaaatgtgttggaggcacagctggttgtgattcttataccccaaaagtcatacagtgtcagaacaaaggctgggatgggtatgatgtacagtgggaatgtaagacggacttagatattgcatacaaatttggaaaaactgtggtgagctgtgaaggctatgagtcctctgaagaccagtatgtactaagaggttcttgtggcttggagtataatttagattatacagaacttggcctgcagaaactgaaggagtctggaaagcagcacggctttgcctctttctctgattattattataagtggtcctcggcggattcctgtaacatgagtggattgattaccatcgtggtactccttgggatcgcctttgtagtctataagctgttcctgagtgacgggcagtattctcctccaccgtactctgagtatcctccattttcccaccgttaccagagattcaccaactcagcaggacctcctcccccaggctttaagtctgagttcacaggaccacagaatactggccatggtgcaacttctggttttggcagtgcttttacaggacaacaaggatatgaaaattcaggaccagggttctggacaggcttgggaactggtggaatactaggatatttgtttggcagcaatagagcggcaacacccttctcagactcgtggtactacccgtcctatcctccctcctaccctggcacgtggaatagggcttactcaccccttcatggaggctcgggcagctattcggatatggtggtaccaggagacgataaagtagaaagttggagtcaaacactggatgcagaaattttggatttttcatcactttctctttagaaaaaaagtactacctgttaacaattgggaaaaggggatattcaaaagttctgtggtgttatgtccagtgtagctttttgtattctattatttgaggctaaaagttgatgtgtgacaaaatacttatgtgttgtatgtcagtgtaacatgcagatgtatattgcagtttttgaaagtgatcattactgtggaatgctaaaaatacattaatttctaaaacctgtgatgccctaagaagcattaagaatgaaggtgttgtactaatagaaactaagtacagaaaatttcagttttaggtggttgtagctgatgagttattacctcatagagactataatattctatttggtattatattatttgatgtttgctgttcttcaaacatttaaatcaagctttggactaattatgctaatttgtgagttctgatcacttttgagctctgaagctttgaatcattcagtggtggagatggccttctggtaactgaatattaccttctgtaggaaaaggtggaaaataagcatctagaaggttgttgtgaatgactctgtgctggcaaaaatgcttgaaacctctatatttctttcgttcataagaggtaaaggtcaaatttttcaacaaaagtcttttaataacaaaagcatgcagttctctgtgaaatctcaaatattgttgtaatagtctgtttcaatcttaaaaagaatcaataaaaacaaacaaggg

SEQ ID NO: 446276 - DNA, 2261 bp, Homo sapiens
tactttttttacaattattgaggttttaataatacataatttgactacatttcttagatttcgcgtcgtgacgttttcagcctctcaaactgcatcgcctacgcacagaagcttcccgaatctcagacgagacacaacaaagctgcgcgctgccctcgccccgcccgcgggcgcggcggcgacaggccctcggccccgcccacaccgcggcgccacgcctccaacccgcctccagccgtgcctccccaggcccttggccccgcccacaccgcctcgccccgccccaagccgcgctgtgctccaggggcgggggcccacggcggccactcactgagccccacgggccgcagcggagtgacgtagggttggcgcacggatccgttgcggctgcagctctgcagtcgggccgttccttcgccgccgccaggggtagcggtgtagctgcgcagcgtcgcgcgcgctaccgcacccgggagcggccgggtactgcttgctcctcggcttgcatttgtttctgctgaccgcgggccctgccctgggctggaacgaccctgacagaatgttgctgcgggatgtaaaagctcttaccctccactatgaccgctataccacctcccgcaggctggatcccatcccacagttgaaatgtgttggaggcacagctggttgtgattcttataccccaaaagtcatacagtgtcagaacaaaggctgggatgggtatgatgtacagtgggaatgtaagacggacttagatattgcatacaaatttggaaaaactgtggtgagctgtgaaggctatgagtcctctgaagaccagtatgtactaagaggttcttgtggcttggagtataatttagattatacagaacttggcctgcagaaactgaaggagtctggaaagcagcacggctttgcctctttctctgattattattataagtggtcctcggcggattcctgtaacatgagtggattgattaccatcgtggtactccttgggatcgcctttgtagtctataagctgttcctgagtgacgggcagtattctcctccaccgtactctgagtatcctccattttcccaccgttaccagagattcaccaactcagcaggacctcctcccccaggctttaagtctgagttcacaggaccacagaatactggccatggtgcaacttctggttttggcagtgcttttacaggacaacaaggatatgaaaattcaggaccagggttctggacaggcttgggaactggtggaatactaggatatttgtttggcagcaatagagcggcaacacccttctcagactcgtggtactacccgtcctatcctccctcctaccctggcacgtggaatagggcttactcaccccttcatggaggctcgggcagctattcggtatgttcaaactcagacacgaaaaccagaactgcatcaggatatggtggtaccaggagacgataaagtagaaagttggagtcaaacactggatgcagaaattttggatttttcatcactttctctttagaaaaaaagtactacctgttaacaattgggaaaaggggatattcaaaagttctgtggtgttatgtccagtgtagctttttgtattctattatttgaggctaaaagttgatgtgtgacaaaatacttatgtgttgtatgtcagtgtaacatgcagatgtatattgcagtttttgaaagtgatcattactgtggaatgctaaaaatacattaatttctaaaacctgtgatgccctaagaagcattaagaatgaaggtgttgtactaatagaaactaagtacagaaaatttcagttttaggtggttgtagctgatgagttattacctcatagagactataatattctatttggtattatattatttgatgtttgctgttcttcaaacatttaaatcaagctttggactaattatgctaatttgtgagttctgatcacttttgagctctgaagctttgaatcattcagtggtggagatggccttctggtaactgaatattaccttctgtaggaaaaggtggaaaataagcatctagaaggttgttgtgaatgactctgtgctggcaaaaatgcttgaaacctctatatttctttcgttcataagaggtaaaggtcaaatttttcaacaaaagtcttttaataacaaaagcatgcagttctctgtgaaatctcaaatattgttgtaatagtctgtttcaatcttaaaaagaatcaataaaaacaaacaaggg

SEQ ID NO: 446277 - DNA, 2377 bp, Homo sapiens
tactttttttacaattattgaggttttaataatacataatttgactacatttcttagatttcgcgtcgtgacgttttcagcctctcaaactgcatcgcctacgcacagaagcttcccgaatctcagacgagacacaacaaagctgcgcgctgccctcgccccgcccgcgggcgcggcggcgacaggccctcggccccgcccacaccgcggcgccacgcctccaacccgcctccagccgtgcctccccaggcccttggccccgcccacaccgcctcgccccgccccaagccgcgctgtgctccaggggcgggggcccacggcggccactcactgagccccacgggccgcagcggagtgacgtagggttggcgcacggatccgttgcggctgcagctctgcagtcgggccgttccttcgccgccgccaggggtagcggtgtagctgcgcagcgtcgcgcgcgctaccgcacccaggttcggcccgtaggcgtctggcagcccggcgccatcttcatcgagcgccatggccgcagcctgcgggccgggagcggccgggtactgcttgctcctcggcttgcatttgtttctgctgaccgcgggccctgccctgggctggaacgaccctgaagcccttgttggatttttggactttctgaactggtcctgaactgacagaatgttgctgcgggatgtaaaagctcttaccctccactatgaccgctataccacctcccgcaggctggatcccatcccacagttgaaatgtgttggaggcacagctggttgtgattcttataccccaaaagtcatacagtgtcagaacaaaggctgggatgggtatgatgtacagtgggaatgtaagacggacttagatattgcatacaaatttggaaaaactgtggtgagctgtgaaggctatgagtcctctgaagaccagtatgtactaagaggttcttgtggcttggagtataatttagattatacagaacttggcctgcagaaactgaaggagtctggaaagcagcacggctttgcctctttctctgattattattataagtggtcctcggcggattcctgtaacatgagtggattgattaccatcgtggtactccttgggatcgcctttgtagtctataagctgttcctgagtgacgggcagtattctcctccaccgtactctgagtatcctccattttcccaccgttaccagagattcaccaactcagcaggacctcctcccccaggctttaagtctgagttcacaggaccacagaatactggccatggtgcaacttctggttttggcagtgcttttacaggacaacaaggatatgaaaattcaggaccagggttctggacaggcttgggaactggtggaatactaggatatttgtttggcagcaatagagcggcaacacccttctcagactcgtggtactacccgtcctatcctccctcctaccctggcacgtggaatagggcttactcaccccttcatggaggctcgggcagctattcggtatgttcaaactcagacacgaaaaccagaactgcatcaggatatggtggtaccaggagacgataaagtagaaagttggagtcaaacactggatgcagaaattttggatttttcatcactttctctttagaaaaaaagtactacctgttaacaattgggaaaaggggatattcaaaagttctgtggtgttatgtccagtgtagctttttgtattctattatttgaggctaaaagttgatgtgtgacaaaatacttatgtgttgtatgtcagtgtaacatgcagatgtatattgcagtttttgaaagtgatcattactgtggaatgctaaaaatacattaatttctaaaacctgtgatgccctaagaagcattaagaatgaaggtgttgtactaatagaaactaagtacagaaaatttcagttttaggtggttgtagctgatgagttattacctcatagagactataatattctatttggtattatattatttgatgtttgctgttcttcaaacatttaaatcaagctttggactaattatgctaatttgtgagttctgatcacttttgagctctgaagctttgaatcattcagtggtggagatggccttctggtaactgaatattaccttctgtaggaaaaggtggaaaataagcatctagaaggttgttgtgaatgactctgtgctggcaaaaatgcttgaaacctctatatttctttcgttcataagaggtaaaggtcaaatttttcaacaaaagtcttttaataacaaaagcatgcagttctctgtgaaatctcaaatattgttgtaatagtctgtttcaatcttaaaaagaatcaataaaaacaaacaaggg

SEQ ID NO: 446278 - DNA, 1694 bp, Homo sapiens
tacaatcgagccggtaccaggaaacagctatgaccgctataccacctcccgcaggctggatcccatcccacagttgaaatgtgttggaggcacagctggttgtgattcttataccccaaaagtcatacagtgtcagaacaaaggctgggatgggtatgatgtacagtgggaatgtaagacggacttagatattgcatacaaatttggaaaaactgtggtgagctgtgaaggctatgagtcctctgaagaccagtatgtactaagaggttcttgtggcttggagtataatttagattatacagaacttggcctgcagaaactgaaggagtctggaaagcagcacggctttgcctctttctctgattattattataagtggtcctcggcggattcctgtaacatgagtggattgattaccatcgtggtactccttgggatcgcctttgtagtctataagctgttcctgagtgacgggcagtattctcctccaccgtactctgagtatcctccattttcccaccgttaccagagattcaccaactcagcaggacctcctcccccaggctttaagtctgagttcacaggaccacagaatactggccatggtgcaacttctggttttggcagtgcttttacaggacaacaaggatatgaaaattcaggaccagggttctggacaggcttgggaactggtggaatactaggatatttgtttggcagcaatagagcggcaacacccttctcagactcgtggtactacccgtcctatcctccctcctaccctggcacgtggaatagggcttactcaccccttcatggaggctcgggcagctattcggtatgttcaaactcagacacgaaaaccagaactgcatcaggatatggtggtaccaggagacgataaagtagaaagttggagtcaaacactggatgcagaaattttggatttttcatcactttctctttagaaaaaaagtactacctgttaacaattgggaaaaggggatattcaaaagttctgtggtgttatgtccagtgtagctttttgtattctattatttgaggctaaaagttgatgtgtgacaaaatacttatgtgttgtatgtcagtgtaacatgcagatgtatattgcagtttttgaaagtgatcattactgtggaatgctaaaaatacattaatttctaaaacctgtgatgccctaagaagcattaagaatgaaggtgttgtactaatagaaactaagtacagaaaatttcagttttaggtggttgtagctgatgagttattacctcatagagactataatattctatttggtattatattatttgatgtttgctgttcttcaaacatttaaatcaagctttggactaattatgctaatttgtgagttctgatcacttttgagctctgaagctttgaatcattcagtggtggagatggccttctggtaactgaatattaccttctgtaggaaaaggtggaaaataagcatctagaaggttgttgtgaatgactctgtgctggcaaaaatgcttgaaacctctatatttctttcgttcataagaggtaaaggtcaaatttttcaacaaaagtcttttaataacaaaagcatgcagttctctgtgaaatctcaaatattgttgtaatagtctgtttcaatcttaaaaagaatcaataaaaacaaacaaggg

SEQ ID NO: 446279 - DNA, 1821 bp, Homo sapiens
tactttttttacaattattgaggttttaataatacataatttgactacatttcttagatttcgcgtcgtgacgttttcagcctctcaaactgcatcgcctacgcacagaagcttcccgaatctcagacgagacacaacaaagctgcgcgctgccctcgccccgcccgcgggcgcggcggcgacaggccctcggccccgcccacaccgcggcgccacgcctccaacccgcctccagccgtgcctccccaggcccttggccccgcccacaccgcctcgccccgccccaagccgcgctgtgctccaggggcgggggcccacggcggccactcactgagccccacgggccgcagcggagtgacgtagggttggcgcacggatccgttgcggctgcagctctgcagtcgggccgttccttcgccgccgccaggggtagcggtgtagctgcgcagcgtcgcgcgcgctaccgcacccaggttcggcccgtaggcgtctggcagcccggcgccatcttcatcgagcgccatggccgcagcctgcgggccgggagcggccgggtactgcttgctcctcggcttgcatttgtttctgctgaccgcgggccctgccctgggctggaacgaccctgacagaatgttgctgcgggatgtaaaagctcttaccctccactatgaccgctataccacctcccgcaggctggatcccatcccacagttgaaatgtgttggaggcacagctggttgtgattcttataccccaaaagtcatacagtgtcagaacaaaggctgggatgggtatgatgtacagtgggaatgtaagacggacttagatattgcatacaaatttggaaaaactgtggtgagctgtgaaggctatgagtcctctgaagaccagtatgtactaagaggttcttgtggcttggagtataatttagattatacagaacttggcctgcagaaactgaaggagtctggaaagcagcacggctttgcctctttctctgattattattataagtggtcctcggcggattcctgtaacatgagtggattgattaccatcgtggtactccttgggatcgcctttgtagtctataagctgttcctgagtgacgggcagtattctcctccaccgtactctgagtatcctccattttcccaccgttaccagagattcaccaactcagcaggacctcctcccccaggctttaagtctgagttcacaggaccacagaatactggccatggtgcaacttctggttttggcagtgcttttacaggacaacaaggatatgaaaattcaggaccagggttctggacaggcttgggaactggtggaatactaggatatttgtttggcagcaatagagcggcaacacccttctcagactcgtggtactacccgtcctatcctccctcctaccctggcacgtggaatagggcttactcaccccttcatggaggctcgggcagctattcggtatgttcaaactcagacacgaaaaccagaactgcatcaggatatggtggtaccaggagacgataaagtagaaagttggagtcaaacactggatgcagaaattttggatttttcatcactttctctttagaaaaaaagtactacctgttaacaattgggaaaaggggatattcaaaagttctgtggtgttatgtccagtgtagctttttgtattctattatttgaggctaaaagttgatgtgtgacaaaatacttatgtgttgtatgtcagtgtaacatgcagatgtatattgcagtttttgaaggtactatactctgcggttatcgtatatactcttttatcct

SEQ ID NO: 446280 - DNA, 1583 bp, Homo sapiens
gttctgaggatccctttaacgtatcagaacaaaggctgggatgggtatgatgtactgggaatgtaagacggacttagatattgcatacaaatttggaaaaactgtggtgagctgtgaaggctatgagtcctctgaagaccagtatgtactaagaggttcttgtggcttggagtataatttagattatacagaacttggcctgcagaaactgaaggagtctggaaagcagcacggctttgcctctttctctgattattattataagtggtcctcggcggattcctgtaacatgagtggattgattaccatcgtggtactccttgggatcgcctttgtagtctataagctgttcctgagtgacgggcagtattctcctccaccgtactctgagtatcctccattttcccaccgttaccagagattcaccaactcagcaggacctcctcccccaggctttaagtctgagttcacaggaccacagaatactggccatggtgcaacttctggttttggcagtgcttttacaggacaacaaggatatgaaaattcaggaccagggttctggacaggcttgggaactggtggaatactaggatatttgtttggcagcaatagagcggcaacacccttctcagactcgtggtactacccgtcctatcctccctcctaccctggcacgtggaatagggcttactcaccccttcatggaggctcgggcagctattcggtatgttcaaactcagacacgaaaaccagaactgcatcaggatatggtggtaccaggagacgataaagtagaaagttggagtcaaacactggatgcagaaattttggatttttcatcactttctctttagaaaaaaagtactacctgttaacaattgggaaaaggggatattcaaaagttctgtggtgttatgtccagtgtagctttttgtattctattatttgaggctaaaagttgatgtgtgacaaaatacttatgtgttgtatgtcagtgtaacatgcagatgtatattgcagtttttgaaagtgatcattactgtggaatgctaaaaatacattaatttctaaaacctgtgatgccctaagaagcattaagaatgaaggtgttgtactaatagaaactaagtacagaaaatttcagttttaggtggttgtagctgatgagttattacctcatagagactataatattctatttggtattatattatttgatgtttgctgttcttcaaacatttaaatcaagctttggactaattatgctaatttgtgagttctgatcacttttgagctctgaagctttgaatcattcagtggtggagatggccttctggtaactgaatattaccttctgtaggaaaaggtggaaaataagcatctagaaggttgttgtgaatgactctgtgctggcaaaaatgcttgaaacctctatatttctttcgttcataagaggtaaaggtcaaatttttcaacaaaagtcttttaataacaaaagcatgcagttctctgtgaaatctcaaatattgttgtaatagtctgtttcaatcttaaaaagaatcaataaaaacaaacaaggg

SEQ ID NO: 446281 - DNA, 2282 bp, Homo sapiens
tactttttttacaattattgaggttttaataatacataatttgactacatttcttagatttcgcgtcgtgacgttttcagcctctcaaactgcatcgcctacgcacagaagcttcccgaatctcagacgagacacaacaaagctgcgcgctgccctcgccccgcccgcgggcgcggcggcgacaggccctcggccccgcccacaccgcggcgccacgcctccaacccgcctccagccgtgcctccccaggcccttggccccgcccacaccgcctcgccccgccccaagccgcgctgtgctccaggggcgggggcccacggcggccactcactgagccccacgggccgcagcggagtgacgtagggttggcgcacggatccgttgcggctgcagctctgcagtcgggccgttccttcgccgccgccaggggtagcggtgtagctgcgcagcgtcgcgcgcgctaccgcacccaggttcggcccgtaggcgtctggcagcccggcgccatcttcatcgagcgccatggccgcagcctgcgggccgggagcggccgggtactgcttgctcctcggcttgcatttgtttctgctgaccgcgggccctgccctgggctggaacgaccctgacagaatgttgctgcgggatgtaaaagctcttaccctccactatgaccgctataccacctcccgcaggctggatcccatcccacagttgaaatgtgttggaggcacagctggttgtgattcttataccccaaaagtcatacagtgtcagaacaaaggctgggatgggtatgatgtacagtgggaatgtaagacggacttagatattgcatacaaatttggaaaaaagaggttcttgtggcttggagtataatttagattatacagaacttggcctgcagaaactgaaggagtctggaaagcagcacggctttgcctctttctctgattattattataagtggtcctcggcggattcctgtaacatgagtggattgattaccatcgtggtactccttgggatcgcctttgtagtctataagctgttcctgagtgacgggcagtattctcctccaccgtactctgagtatcctccattttcccaccgttaccagagattcaccaactcagcaggacctcctcccccaggctttaagtctgagttcacaggaccacagaatactggccatggtgcaacttctggttttggcagtgcttttacaggacaacaaggatatgaaaattcaggaccagggttctggacaggcttgggaactggtggaatactaggatatttgtttggcagcaatagagcggcaacacccttctcagactcgtggtactacccgtcctatcctccctcctaccctggcacgtggaatagggcttactcaccccttcatggaggctcgggcagctattcggtatgttcaaactcagacacgaaaaccagaactgcatcaggatatggtggtaccaggagacgataaagtagaaagttggagtcaaacactggatgcagaaattttggatttttcatcactttctctttagaaaaaaagtactacctgttaacaattgggaaaaggggatattcaaaagttctgtggtgttatgtccagtgtagctttttgtattctattatttgaggctaaaagttgatgtgtgacaaaatacttatgtgttgtatgtcagtgtaacatgcagatgtatattgcagtttttgaaagtgatcattactgtggaatgctaaaaatacattaatttctaaaacctgtgatgccctaagaagcattaagaatgaaggtgttgtactaatagaaactaagtacagaaaatttcagttttaggtggttgtagctgatgagttattacctcatagagactataatattctatttggtattatattatttgatgtttgctgttcttcaaacatttaaatcaagctttggactaattatgctaatttgtgagttctgatcacttttgagctctgaagctttgaatcattcagtggtggagatggccttctggtaactgaatattaccttctgtaggaaaaggtggaaaataagcatctagaaggttgttgtgaatgactctgtgctggcaaaaatgcttgaaacctctatatttctttcgttcataagaggtaaaggtcaaatttttcaacaaaagtcttttaataacaaaagcatgcagttctctgtgaaatctcaaatattgttgtaatagtctgtttcaatcttaaaaagaatcaataaaaacaaacaaggg

SEQ ID NO: 446282 - DNA, 2249 bp, Homo sapiens
tactttttttacaattattgaggttttaataatacataatttgactacatttcttagatttcgcgtcgtgacgttttcagcctctcaaactgcatcgcctacgcacagaagcttcccgaatctcagacgagacacaacaaagctgcgcgctgccctcgccccgcccgcgggcgcggcggcgacaggccctcggccccgcccacaccgcggcgccacgcctccaacccgcctccagccgtgcctccccaggcccttggccccgcccacaccgcctcgccccgccccaagccgcgctgtgctccaggggcgggggcccacggcggccactcactgagccccacgggccgcagcggagtgacgtagggttggcgcacggatccgttgcggctgcagctctgcagtcgggccgttccttcgccgccgccaggggtagcggtgtagctgcgcagcgtcgcgcgcgctaccgcacccaggttcggcccgtaggcgtctggcagcccggcgccatcttcatcgagcgccatggccgcagcctgcgggccgggagcggccgggtactgcttgctcctcggcttgcatttgtttctgctgaccgcgggccctgccctgggctggaacgaccctgacagaatgttgctgcgggatgtaaaagctcttaccctccactatgaccgctataccacctcccgcaggctggatcccatcccacagttgaaatgtgttggaggcacagctggttgtgattcttataccccaaaagtcatacagtgtcagaacaaaggctgggatgggtatgatgtacagtgggaatgtaagacggacttagatattgcatacaaatttggaaaaactgtggtgagctgtgaaggctatgagtcctctgaagaccagtatgtactaagaggttcttgtggcttggagtataatttagattatacagaacttggcctgtaacatgagtggattgattaccatcgtggtactccttgggatcgcctttgtagtctataagctgttcctgagtgacgggcagtattctcctccaccgtactctgagtatcctccattttcccaccgttaccagagattcaccaactcagcaggacctcctcccccaggctttaagtctgagttcacaggaccacagaatactggccatggtgcaacttctggttttggcagtgcttttacaggacaacaaggatatgaaaattcaggaccagggttctggacaggcttgggaactggtggaatactaggatatttgtttggcagcaatagagcggcaacacccttctcagactcgtggtactacccgtcctatcctccctcctaccctggcacgtggaatagggcttactcaccccttcatggaggctcgggcagctattcggtatgttcaaactcagacacgaaaaccagaactgcatcaggatatggtggtaccaggagacgataaagtagaaagttggagtcaaacactggatgcagaaattttggatttttcatcactttctctttagaaaaaaagtactacctgttaacaattgggaaaaggggatattcaaaagttctgtggtgttatgtccagtgtagctttttgtattctattatttgaggctaaaagttgatgtgtgacaaaatacttatgtgttgtatgtcagtgtaacatgcagatgtatattgcagtttttgaaagtgatcattactgtggaatgctaaaaatacattaatttctaaaacctgtgatgccctaagaagcattaagaatgaaggtgttgtactaatagaaactaagtacagaaaatttcagttttaggtggttgtagctgatgagttattacctcatagagactataatattctatttggtattatattatttgatgtttgctgttcttcaaacatttaaatcaagctttggactaattatgctaatttgtgagttctgatcacttttgagctctgaagctttgaatcattcagtggtggagatggccttctggtaactgaatattaccttctgtaggaaaaggtggaaaataagcatctagaaggttgttgtgaatgactctgtgctggcaaaaatgcttgaaacctctatatttctttcgttcataagaggtaaaggtcaaatttttcaacaaaagtcttttaataacaaaagcatgcagttctctgtgaaatctcaaatattgttgtaatagtctgtttcaatcttaaaaagaatcaataaaaacaaacaaggg

SEQ ID NO: 446283 - DNA, 1971 bp, Homo sapiens
tactttttttacaattattgaggttttaataatacataatttgactacatttcttagatttcgcgtcgtgacgttttcagcctctcaaactgcatcgcctacgcacagaagcttcccgaatctcagacgagacacaacaaagctgcgcgctgccctcgccccgcccgcgggcgcggcggcgacaggccctcggccccgcccacaccgcggcgccacgcctccaacccgcctccagccgtgcctccccaggcccttggccccgcccacaccgcctcgccccgccccaagccgcgctgtgctccaggggcgggggcccacggcggccactcactgagccccacgggccgcagcggagtgacgtagggttggcgcacggatccgttgcggctgcagctctgcagtcgggccgttccttcgccgccgccaggggtagcggtgtagctgcgcagcgtcgcgcgcgctaccgcacccaggttcggcccgtaggcgtctggcagcccggcgccatcttcatcgagcgccatggccgcagcctgcgggccgggagcggccgggtactgcttgctcctcggcttgcatttgtttctgctgaccgcgggccctgccctgggctggaacgaccctgacagaatgttgctgcgggatgtaaaagctcttaccctccactatgaccgctataccacctcccgcaggctggatcccatcccacagttgaaatgtgttggaggcacagctggttgtgattcttataccccaaaagtcatacagtgtcagaacaaaggctgggatgggtatgatgtacagtgggaatgtaagacggacttagatattgcatacaaatttggaaaaactgtggtgagctgtgaaggctatgagtcctctgaagaccagtatgtactaagaggttcttgtggcttggagtataatttagattatacagaacttggcctgcagaaactgaaggagtctggaaagcagcacggctttgcctctttctctgattattattataagtggtcctcggcggattcctgtaacatgagtggattgattaccatcgtggtactccttgggatcgcctttgtagtctataagctgttcctgagtgacgggcagtattctcctccaccgtactctgagtatcctccattttcccaccgttaccagagattcaccaactcagcaggacctcctcccccaggctttaagtctgagttcacaggaccacagaatactggccatggtgcaacttctggttttggcagtgcttttacaggacaacaaggatatgaaaattcaggaccagggttctggacaggcttgggaactggtggaatactaggatatttgtttggcagcaatagagcggcaacacccttctcagactcgtggtactacccgtcctatcctccctcctaccctggcacgtggaatagggcttactcaccccttcatggaggctcgggcagctattcggtatgttcaaactcagacacgaaaaccagaactgcatcaggtaagagcaaaaaatacaagttccttttacctaggagtaaagtacagaaatagtttgggaactttagaagatgattatctgtttagcaaccatggttttatttggtgtacctaccaaaaatattaatagcacagttaactgagatcccacttttaaacattctttaaaaatcaaacagggatttgatttaggcttagctctaccatagaccaaggttttaacttgaaccttactgggtgctagcttccccatatatttaattctgtgatctctagagatcctttaagttctaaactagacttttctaagtagaagcttaaacttaaaattcaataacattcaaaaaagatattgaggtatactttaattttcaaaaatatgattgtaatgtttattggaatgctcagaggatattttgtaaaaagcaaagatacaaaaaaaacaaaggaataact

SEQ ID NO: 446284 - DNA, 1471 bp, Homo sapiens
  misc_feature (95)..(95): n is a, c, g, or t
acagcgaaatctaaagcaggtcatgtcagtccctggcagggaaccctccaccagcttcccgtgttccccaggacaaaagccccactcctcactgnggctccacagccctgtgtccagggcccctgccagtgtccagcttcctcctgggaacttgccctcatctcatgactacctctgccccagtcacagttgcttttctcttttccccatccccttcctgtctcaggttattgtccctgcctcgtgccgaattcggcacgagctccaccgtactctgagtatcctccattttcccaccgttaccagagattcaccaactcagcaggacctcctcccccaggctttaagtctgagttcacaggaccacagaatactggccatggtgcaacttctggttttggcagtgcttttacaggacaacaaggatatgaaaattcaggaccagggttctggacaggcttgggaactggtggaatactaggatatttgtttggcagcaatagagcggcaacacccttctcagactcgtggtactacccgtcctatcctccctcctaccctggcacgtggaatagggcttactcaccccttcatggaggctcgggcagctattcggtatgttcaaactcagacacgaaaaccagaactgcatcaggatatggtggtaccaggagacgataaagtagaaagttggagtcaaacactggatgcagaaattttggatttttcatcactttctctttagaaaaaaagtactacctgttaacaattgggaaaaggggatattcaaaagttctgtggtgttatgtccagtgtagctttttgtattctattatttgaggctaaaagttgatgtgtgacaaaatacttatgtgttgtatgtcagtgtaacatgcagatgtatattgcagtttttgaaagtgatcattactgtggaatgctaaaaatacattaatttctaaaacctgtgatgccctaagaagcattaagaatgaaggtgttgtactaatagaaactaagtacagaaaatttcagttttaggtggttgtagctgatgagttattacctcatagagactataatattctatttggtattatattatttgatgtttgctgttcttcaaacatttaaatcaagctttggactaattatgctaatttgtgagttctgatcacttttgagctctgaagctttgaatcattcagtggtggagatggccttctggtaactgaatattaccttctgtaggaaaaggtggaaaataagcatctagaaggttgttgtgaatgactctgtgctggcaaaaatgcttgaaacctctatatttctttcgttcataagaggtaaaggtcaaatttttcaacaaaagtcttttaataacaaaagcatgcagttctctgtgaaatctcaaatattgttgtaatagtctgtttcaatcttaaaaagaatcaataaaaacaaacaaggg

SEQ ID NO: 446285 - DNA, 1553 bp, Homo sapiens
tactttttttacaattattgaggttttaataatacataatttgactacatttcttagatttcgcgtcgtgacgttttcagcctctcaaactgcatcgcctacgcacagaagcttcccgaatctcagacgagacacaacaaagctgcgcgctgccctcgccccgcccgcgggcgcggcggcgacaggccctcggccccgcccacaccgcggcgccacgcctccaacccgcctccagccgtgcctccccaggcccttggccccgcccacaccgcctcgccccgccccaagccgcgctgtgctccaggggcgggggcccacggcggccactcactgagccccacgggccgcagcggagtgacgtagggttggcgcacggatccgttgcggctgcagctctgcagtcgggccgttccttcgccgccgccaggggtagcggtgtagctgcgcagcgtcgcgcgcgctaccgcacccaggttcggcccgtaggcgtctggcagcccggcgccatcttcatcgagcgccatggccgcagcctgcgggccgggagcggccgggtactgcttgctcctcggcttgcatttgtttctgctgaccgcgggccctgccctgggctggaacgaccctgacagaatgttgctgcgggatgtaaaagctcttaccctccactatgaccgctataccacctcccgcaggctggatcccatcccacagttgaaatgtgttggaggcacagctggttgtgattcttataccccaaaagtcatacagtgtcagaacaaaggctgggatgggtatgatgtacagtgggaatgtaagacggacttagatattgcatacaaatttggaaaaactgtggtgagctgtgaaggctatgagtcctctgaagaccagtatgtactaagaggttcttgtggcttggagtataatttagattatacagaacttggcctgcagaaactgaaggagtctggaaagcagcacggctttgcctctttctctgattattattataagtggtcctcggcggattcctgtaacatgagtggattgattaccatcgtggtactccttgggatcgcctttgtagtctataagctgttcctgagtgacgggcagtattctcctccaccgtactctgagtatcctccattttcccaccgttaccagagattcaccaactcagcaggacctcctcccccaggctttaagtctgagttcacaggaccacagaatactggccatggtgcaacttctggttttggcagtgcttttacaggacaacaaggatatgaaaattcaggaccagggttctggacaggcttgggaactggtggaatactaggatatttgtttggcagcaataggttgtgaatgactctgtgctggcaaaaatgcttgaaacctctatatttctttcgttcataagaggtaaaggtcaaatttttcaacaaaagtcttttaataacaaaagcatgcagttctctgtgaaatctcaaatattgttgtaatagtctgtttcaatcttaaaaagaatcaataaaaacaaacaaggg

SEQ ID NO: 446286 - DNA, 1417 bp, Homo sapiens
tactttttttacaattattgaggttttaataatacataatttgactacatttcttagatttcgcgtcgtgacgttttcagcctctcaaactgcatcgcctacgcacagaagcttcccgaatctcagacgagacacaacaaagctgcgcgctgccctcgccccgcccgcgggcgcggcggcgacaggccctcggccccgcccacaccgcggcgccacgcctccaacccgcctccagccgtgcctccccaggcccttggccccgcccacaccgcctcgccccgccccaagccgcgctgtgctccaggggcgggggcccacggcggccactcactgagccccacgggccgcagcggagtgacgtagggttggcgcacggatccgttgcggctgcagctctgcagtcgggccgttccttcgccgccgccaggggtagcggtgtagctgcgcagcgtcgcgcgcgctaccgcacccaggttcggcccgtaggcgtctggcagcccggcgccatcttcatcgagcgccatggccgcagcctgcgggccgggagcggccgggtactgcttgctcctcggcttgcatttgtttctgctgaccgcgggccctgccctgggctggaacgaccctgacagaatgttgctgcgggatgtaaaagctcttaccctccactatgaccgctataccacctcccgcaggctggatcccatcccacagttgaaatgtgttggaggcacagctggttgtgattcttataccccaaaagtcatacagtgtcagaacaaaggctgggatgggtatgatgtacagtgggaatgtaagacggacttagatattgcatacaaatttggaaaaactgtggtgagctgtgaaggctatgagtcctctgaagaccagtatgtactaagaggttcttgtggcttggagtataatttagattatacagaacttggcctgcagaaactgaaggagtctggaaagcagcacggctttgcctctttctctgattattattataagtggtcctcggcggattcctgtaacatgagtggattgattaccatcgtggtactccttgggatcgcctttgtagtctataagctgttcctgagtgacgggcagtattctcctccaccgtactctgagtatcctccattttcccaccgttaccagagattcaccaactcagcaggacctcctcccccaggctttaagtctgagttcacaggaccacagaatactggccatggtgcaacttctggttttggcagtgcttttacaggacaacaaggatatgaaaattcaggaccagggttctggacaggcttgggaactggtggaatactaggatatttgtttggcagcaatagtagtaccacgagtctgagaagggtgttgccgctctattgctgccgtcgacgcg

SEQ ID NO: 446287 - DNA, 959 bp, Homo sapiens
tagaggatccactctctccacactggctctctctcctccctcctaccctggcacgtggaatagggcttactcaccccttcatggaggctcgggcagctattcggtatgttcaaactcagacacgaaaaccagaactgcatcaggatatggtggtaccaggagacgataaagtagaaagttggagtcaaacactggatgcagaaattttggatttttcatcactttctctttagaaaaaaagtactacctgttaacaattgggaaaaggggatattcaaaagttctgtggtgttatgtccagtgtagctttttgtattctattatttgaggctaaaagttgatgtgtgacaaaatacttatgtgttgtatgtcagtgtaacatgcagatgtatattgcagtttttgaaagtgatcattactgtggaatgctaaaaatacattaatttctaaaacctgtgatgccctaagaagcattaagaatgaaggtgttgtactaatagaaactaagtacagaaaatttcagttttaggtggttgtagctgatgagttattacctcatagagactataatattctatttggtattatattatttgatgtttgctgttcttcaaacatttaaatcaagctttggactaattatgctaatttgtgagttctgatcacttttgagctctgaagctttgaatcattcagtggtggagatggccttctggtaactgaatattaccttctgtaggaaaaggtggaaaataagcatctagaaggttgttgtgaatgactctgtgctggcaaaaatgcttgaaacctctatatttctttcgttcataagaggtaaaggtcaaatttttcaacaaaagtcttttaataacaaaagcatgcagttctctgtgaaatctcaaatattgttgtaatagtctgtttcaatcttaaaaagaatcaataaaaacaaacaaggg

SEQ ID NO: 446288 - DNA, 2242 bp, Homo sapiens
tactttttttacaattattgaggttttaataatacataatttgactacatttcttagatttcgcgtcgtgacgttttcagcctctcaaactgcatcgcctacgcacagaagcttcccgaatctcagacgagacacaacaaagctgcgcgctgccctcgccccgcccgcgggcgcggcggcgacaggccctcggccccgcccacaccgcggcgccacgcctccaacccgcctccagccgtgcctccccaggcccttggccccgcccacaccgcctcgccccgccccaagccgcgctgtgctccaggggcgggggcccacggcggccactcactgagccccacgggccgcagcggagtgacgtagggttggcgcacggatccgttgcggctgcagctctgcagtcgggccgttccttcgccgccgccaggggtagcggtgtagctgcgcagcgtcgcgcgcgctaccgcacccaggttcggcccgtaggcgtctggcagcccggcgccatcttcatcgagcgccatggccgcagcctgcgggccgggagcggccgggtactgcttgctcctcggcttgcatttgtttctgctgaccgcgggccctgccctgggctggaacgaccctgacagaatgttgctgcgggatgtaaaagctcttaccctccactatgaccgctataccacctcccgcaggctggatcccatcccacagttgaaatgtgttggaggcacagctggttgtgattcttataccccaaaagtcatacagtgtcagaacaaaggctgggatgggtatgatgtacagtgggaatgtaagacggacttagatattgcatacaaatttggaaaaaagaggttcttgtggcttggagtataatttagattatacagaacttggcctgcagaaactgaaggagtctggaaagcagcacggctttgcctctttctctgattattattataagtggtcctcggcggattcctgtaacatgagtggattgattaccatcgtggtactccttgggatcgcctttgtagtctataagctgttcctgagtgacgggcagtattctcctccaccgtactctgagtatcctccattttcccaccgttaccagagattcaccaactcagcaggacctcctcccccaggctttaagtctgagttcacaggaccacagaatactggccatggtgcaacttctggttttggcagtgcttttacaggacaacaaggatatgaaaattcaggaccagggttctggacaggcttgggaactggtggaatactaggatatttgtttggcagcaatagagcggcaacacccttctcagactcgtggtactacccgtcctatcctccctcctaccctggcacgtggaatagggcttactcaccccttcatggaggctcgggcagctattcggatatggtggtaccaggagacgataaagtagaaagttggagtcaaacactggatgcagaaattttggatttttcatcactttctctttagaaaaaaagtactacctgttaacaattgggaaaaggggatattcaaaagttctgtggtgttatgtccagtgtagctttttgtattctattatttgaggctaaaagttgatgtgtgacaaaatacttatgtgttgtatgtcagtgtaacatgcagatgtatattgcagtttttgaaagtgatcattactgtggaatgctaaaaatacattaatttctaaaacctgtgatgccctaagaagcattaagaatgaaggtgttgtactaatagaaactaagtacagaaaatttcagttttaggtggttgtagctgatgagttattacctcatagagactataatattctatttggtattatattatttgatgtttgctgttcttcaaacatttaaatcaagctttggactaattatgctaatttgtgagttctgatcacttttgagctctgaagctttgaatcattcagtggtggagatggccttctggtaactgaatattaccttctgtaggaaaaggtggaaaataagcatctagaaggttgttgtgaatgactctgtgctggcaaaaatgcttgaaacctctatatttctttcgttcataagaggtaaaggtcaaatttttcaacaaaagtcttttaataacaaaagcatgcagttctctgtgaaatctcaaatattgttgtaatagtctgtttcaatcttaaaaagaatcaataaaaacaaacaaggg

SEQ ID NO: 446289 - DNA, 887 bp, Homo sapiens
acccactactggctacccactactggcccactactggccaaactcagacacgaaaaccagaactgcatcaggatatggtggtaccaggagacgataaagtagaaagttggagtcaaacactggatgcagaaattttggatttttcatcactttctctttagaaaaaaagtactacctgttaacaattgggaaaaggggatattcaaaagttctgtggtgttatgtccagtgtagctttttgtattctattatttgaggctaaaagttgatgtgtgacaaaatacttatgtgttgtatgtcagtgtaacatgcagatgtatattgcagtttttgaaagtgatcattactgtggaatgctaaaaatacattaatttctaaaacctgtgatgccctaagaagcattaagaatgaaggtgttgtactaatagaaactaagtacagaaaatttcagttttaggtggttgtagctgatgagttattacctcatagagactataatattctatttggtattatattatttgatgtttgctgttcttcaaacatttaaatcaagctttggactaattatgctaatttgtgagttctgatcacttttgagctctgaagctttgaatcattcagtggtggagatggccttctggtaactgaatattaccttctgtaggaaaaggtggaaaataagcatctagaaggttgttgtgaatgactctgtgctggcaaaaatgcttgaaacctctatatttctttcgttcataagaggtaaaggtcaaatttttcaacaaaagtcttttaataacaaaagcatgcagttctctgtgaaatctcaaatattgttgtaatagtctgtttcaatcttaaaaagaatcaataaaaacaaacaaggg

SEQ ID NO: 446290 - DNA, 856 bp, Homo sapiens
ccggtgtttatcgatgccaccatatccagaactgcatcaggatatggtggtaccaggagacgataaagtagaaagttggagtcaaacactggatgcagaaattttggatttttcatcactttctctttagaaaaaaagtactacctgttaacaattgggaaaaggggatattcaaaagttctgtggtgttatgtccagtgtagctttttgtattctattatttgaggctaaaagttgatgtgtgacaaaatacttatgtgttgtatgtcagtgtaacatgcagatgtatattgcagtttttgaaagtgatcattactgtggaatgctaaaaatacattaatttctaaaacctgtgatgccctaagaagcattaagaatgaaggtgttgtactaatagaaactaagtacagaaaatttcagttttaggtggttgtagctgatgagttattacctcatagagactataatattctatttggtattatattatttgatgtttgctgttcttcaaacatttaaatcaagctttggactaattatgctaatttgtgagttctgatcacttttgagctctgaagctttgaatcattcagtggtggagatggccttctggtaactgaatattaccttctgtaggaaaaggtggaaaataagcatctagaaggttgttgtgaatgactctgtgctggcaaaaatgcttgaaacctctatatttctttcgttcataagaggtaaaggtcaaatttttcaacaaaagtcttttaataacaaaagcatgcagttctctgtgaaatctcaaatattgttgtaatagtctgtttcaatcttaaaaagaatcaataaaaacaaacaaggg

SEQ ID NO: 446291 - DNA, 1307 bp, Homo sapiens
tactttttttacaattattgaggttttaataatacataatttgactacatttcttagatttcgcgtcgtgacgttttcagcctctcaaactgcatcgcctacgcacagaagcttcccgaatctcagacgagacacaacaaagctgcgcgctgccctcgccccgcccgcgggcgcggcggcgacaggccctcggccccgcccacaccgcggcgccacgcctccaacccgcctccagccgtgcctccccaggcccttggccccgcccacaccgcctcgccccgccccaagccgcgctgtgctccaggggcgggggcccacggcggccactcactgagccccacgggccgcagcggagtgacgtagggttggcgcacggatccgttgcggctgcagctctgcagtcgggccgttccttcgccgccgccaggggtagcggtgtagctgcgcagcgtcgcgcgcgctaccgcacccaggttcggcccgtaggcgtctggcagcccggcgccatcttcatcgagcgccatggccgcagcctgcgggccgggagcggccgggtactgcttgctcctcggcttgcatttgtttctgctgaccgcgggccctgccctgggctggaacgaccctgacagaatgttgctgcgggatgtaaaagctcttaccctccactatgaccgctataccacctcccgcaggctggatcccatcccacagttgaaatgtgttggaggcacagctggttgtgattcttataccccaaaagtcatacagtgtcagaacaaaggctgggatgggtatgatgtacagtgggaatgtaagacggacttagatattgcatacaaatttggaaaaactgtggtgagctgtgaaggctatgagtcctctgaagaccagtatgtactaagaggttcttgtggcttggagtataatttagattatacagaacttggcctgcagaaactgaaggagtctggaaagcagcacggctttgcctctttctctgattattattataagtggtcctcggcggattcctgtaacatgagtggattgattaccatcgtggtactccttgggatcgcctttgtagtctataagctgttcctgagtgacgggcagtattctcctccaccgtactctgagtatcctccattttcctgtacatcatacccatcccagcctttgttctgacactgtatgacttttggggtataagaatcacaaccagctgtgcctccacacatttcaactgtgggatggatccgcctgcgggatggtggtatacggtcatagtggaagtaagagctttg

SEQ ID NO: 446292 - DNA, 1016 bp, Homo sapiens
tactttttttacaattattgaggttttaataatacataatttgactacatttcttagatttcgcgtcgtgacgttttcagcctctcaaactgcatcgcctacgcacagaagcttcccgaatctcagacgagacacaacaaagctgcgcgctgccctcgccccgcccgcgggcgcggcggcgacaggccctcggccccgcccacaccgcggcgccacgcctccaacccgcctccagccgtgcctccccaggcccttggccccgcccacaccgcctcgccccgccccaagccgcgctgtgctccaggggcgggggcccacggcggccactcactgagccccacgggccgcagcggagtgacgtagggttggcgcacggatccgttgcggctgcagctctgcagtcgggccgttccttcgccgccgccaggggtagcggtgtagctgcgcagcgtcgcgcgcgctaccgcacccaggttcggcccgtaggcgtctggcagcccggcgccatcttcatcgagcgccatggccgcagcctgcgggccgggagcggccgggtactgcttgctcctcggcttgcatttgtttctgctgaccgcgggccctgccctgggctggaacgaccctgacagaatgttgctgcgggatgtaaaagctcttaccctccactatgaccgctataccacctcccgcaggctggatcccatcccacagttgaaatgtgttggaggcacagctggttgtgattcttataccccaaaagtcatacagtgtcagaacaaaggctgggatgggtatgatgtacagtgggaatgtaagacggacttagatattgcatacaaatttggaaaaactgtggtgagctgtgaaggctatgagtcctctgaagaccagtatgtactaagaggttcttgtggcttggagtataatttagattatacagaacttggcctgcagaaactgaaggagtctgttttttcccaaggcaacggacggaaacagctaagagcgacagattg

SEQ ID NO: 446293 - DNA, 745 bp, Homo sapiens
tactttttttacaattattgaggttttaataatacataatttgactacatttcttagatttcgcgtcgtgacgttttcagcctctcaaactgcatcgcctacgcacagaagcttcccgaatctcagacgagacacaacaaagctgcgcgctgccctcgccccgcccgcgggcgcggcggcgacaggccctcggccccgcccacaccgcggcgccacgcctccaacccgcctccagccgtgcctccccaggcccttggccccgcccacaccgcctcgccccgccccaagccgcgctgtgctccaggggcgggggcccacggcggccactcactgagccccacgggccgcagcggagtgacgtagggttggcgcacggatccgttgcggctgcagctctgcagtcgggccgttccttcgccgccgccaggggtagcggtgtagctgcgcagcgtcgcgcgcgctaccgcacccaggttcggcccgtaggcgtctggcagcccggcgccatcttcatcgagcgccatggccgcagcctgcgggccgggagcggccgggtactgcttgctcctcggcttgcatttgtttctgctgaccgcgggccctgccctgggctggaacgaccctggtgagtgctgccagggccctcaggcgcttcgttcgcccttttccgccgccgtcagccggtgcaggctcccctgcgtttccgtgcgccgtctccccggagcctgggtgcccggatacccca

SEQ ID NO: 446294 - DNA, 330 bp, Homo sapiens
acagaatactggccatggtgcaacttctggttttggcagtgcttttacaggacaacaaggatatgaaaattcaggaccagggttctggacaggcttgggaactggtggaatactaggatatttgtttggcagcaatagaggtaagctttttgcattgatctcacttgctctttaattcaagaggcttgttttgcttacaatttaactgcatttagttttgctaaggaaaataaattgtggtgacgttagcctattaaataagattctctgggaagggggaaggtacactatatttgttttgatcagtattgtgtatgttattttctttca

SEQ ID NO: 446295 - DNA, 2368 bp, Homo sapiens
  misc_feature (2346)..(2346): n is a, c, g, or t
tactttttttacaattattgaggttttaataatacataatttgactacatttcttagatttcgcgtcgtgacgttttcagcctctcaaactgcatcgcctacgcacagaagcttcccgaatctcagacgagacacaacaaagctgcgcgctgccctcgccccgcccgcgggcgcggcggcgacaggccctcggccccgcccacaccgcggcgccacgcctccaacccgcctccagccgtgcctccccaggcccttggccccgcccacaccgcctcgccccgccccaagccgcgctgtgctccaggggcgggggcccacggcggccactcactgagccccacgggccgcagcggagtgacgtagggttggcgcacggatccgttgcggctgcagctctgcagtcgggccgttccttcgccgccgccaggggtagcggtgtagctgcgcagcgtcgcgcgcgctaccgcacccaggttcggcccgtaggcgtctggcagcccggcgccatcttcatcgagcgccatggccgcagcctgcgggccgggagcggccgggtactgcttgctcctcggcttgcatttgtttctgctgaccgcgggccctgccctgggctggaacgaccctgacagaatgttgctgcgggatgtaaaagctcttaccctccactatgaccgctataccacctcccgcaggctggatcccatcccacagttgaaatgtgttggaggcacagctggttgtgattcttataccccaaaagtcatacagtgtcagaacaaaggctgggatgggtatgatgtacagtgggaatgtaagacggacttagatattgcatacaaatttggaaaaactgtggtgagctgtgaaggctatgagtcctctgaagaccagtatgtactaagaggttcttgtggcttggagtataatttagattatacagaacttggcctgcagaaactgaaggagtctggaaagcagcacggctttgcctctttctctgattattattataagtggtcctcggcggattcctgtaacatgagtggattgattaccatcgtggtactccttgggatcgcctttgtagtctataagctgttcctgagtgacgggcagtattctcctccaccgtactctgagtatcctccattttcccaccgttaccagagattcaccaactcagcaggacctcctcccccaggctttaagtctgagttcacaggaccacagaatactggccatggtgcaacttctggttttggcagtgcttttacaggacaacaaggatatgaaaattcaggaccagggttctggacaggcttgggaactggtggaatactaggatatttgtttggcagcaatagagcggcaacacccttctcagactcgtggtactacccgtcctatcctccctcctaccctggcacgtggaatagggcttactcaccccttcatggaggctcgggcagctattcggtatgttcaaactcagacacgaaaaccagaactgcatcaggatatggtggtaccaggagacgataaagtagaaagttggagtcaaacactggatgcagaaattttggatttttcatcactttctctttagaaaaaaagtactacctgttaacaattgggaaaaggggatattcaaaagttctgtggtgttatgtccagtgtagctttttgtattctattatttgaggctaaaagttgatgtgtgacaaaatacttatgtgttgtatgtcagtgtaacatgcagatgtatattgcagtttttgaaagtgatcattactgtggaatgctaaaaatacattaatttctaaaacctgtgatgccctaagaagcattaagaatgaaggtgttgtactaatagaaactaagtacagaaaatttcagttttaggtggttgtagctgatgagttattacctcatagagactataatattctatttggtattatattatttgatgtttgctgttcttcaaacatttaaatcaagctttggactaattatgctaatttgtgagttctgatcacttttgagctctgaagctttgaatcattcagtggtggagatggccttctggtaactgaatattaccttctgtaggaaaaggtggaaaataagcatctagaaggttgttgtgaatgactctgtgctggcaaaaatgcttgaaacctctatatttctttcgttcataagaggtaaaggtcaaatttttcaacaaaagtcttttaataacaaaagcatgcagttctctgtgaaatctcaaatattgttgtaatagtctgtttcaatcttaaaaagaatcaataaaaacaaacaagggaaaaaaataatatncttaacaaacaaaaaaataaaa

SEQ ID NO: 446296 - DNA, 2315 bp, Homo sapiens
tactttttttacaattattgaggttttaataatacataatttgactacatttcttagatttcgcgtcgtgacgttttcagcctctcaaactgcatcgcctacgcacagaagcttcccgaatctcagacgagacacaacaaagctgcgcgctgccctcgccccgcccgcgggcgcggcggcgacaggccctcggccccgcccacaccgcggcgccacgcctccaacccgcctccagccgtgcctccccaggcccttggccccgcccacaccgcctcgccccgccccaagccgcgctgtgctccaggggcgggggcccacggcggccactcactgagccccacgggccgcagcggagtgacgtagggttggcgcacggatccgttgcggctgcagctctgcagtcgggccgttccttcgccgccgccaggggtagcggtgtagctgcgcagcgtcgcgcgcgctaccgcacccaggttcggcccgtaggcgtctggcagcccggcgccatcttcatcgagcgccatggccgcagcctgcgggccgggagcggccgggtactgcttgctcctcggcttgcatttgtttctgctgaccgcgggccctgccctgggctggaacgaccctgacagaatgttgctgcgggatgtaaaagctcttaccctccactatgaccgctataccacctcccgcaggctggatcccatcccacagttgaaatgtgttggaggcacagctggttgtgattcttataccccaaaagtcatacagtgtcagaacaaaggctgggatgggtatgatgtacagtgggaatgtaagacggacttagatattgcatacaaatttggaaaaactgtggtgagctgtgaaggctatgagtcctctgaagaccagtatgtactaagaggttcttgtggcttggagtataatttagattatacagaacttggcctgcagaaactgaaggagtctggaaagcagcacggctttgcctctttctctgattattattataagtggtcctcggcggattcctgtaacatgagtggattgattaccatcgtggtactccttgggatcgcctttgtagtctataagctgttcctgagtgacgggcagtattctcctccaccgtactctgagtatcctccattttcccaccgttaccagagattcaccaactcagcaggacctcctcccccaggctttaagtctgagttcacaggaccacagaatactggccatggtgcaacttctggttttggcagtgcttttacaggacaacaaggatatgaaaattcaggaccagggttctggacaggcttgggaactggtggaatactaggatatttgtttggcagcaatagagcggcaacacccttctcagactcgtggtactacccgtcctatcctccctcctaccctggcacgtggaatagggcttactcaccccttcatggaggctcgggcagctattcggtatgttcaaactcagacacgaaaaccagaactgcatcaggatatggtggtaccaggagacgataaagtagaaagttggagtcaaacactggatgcagaaattttggatttttcatcactttctctttagaaaaaaagtactacctgttaacaattgggaaaaggggatattcaaaagttctgtggtgttatgtccagtgtagctttttgtattctattatttgaggctaaaagttgatgtgtgacaaaatacttatgtgttgtatgtcagtgtaacatgcagatgtatattgcagtttttgaaagtgatcattactgtggaatgctaaaaatacattaatttctaaaacctgtgatgccctaagaagcattaagaatgaaggtgttgtactaatagaaactaagtacagaaaatttcagttttaggtggttgtagctgatgagttattacctcatagagactataatattctatttggtattatattatttgatgtttgctgttcttcaaacatttaaatcaagctttggactaattatgctaatttgtgagttctgatcacttttgagctctgaagctttgaatcattcagtggtggagatggccttctggtaactgaatattaccttctataagcatctagaaggttgttgtgaatgactctgtgctggcaaaaatgcttgaaacctctatatttctttcgttcataagaggtaaaggtcaaatttttcaacaaaagtcttttaataacaaaagcatgcagttctctgtgaaatctcaaatattgttgtaatagtctgtttcaatcttaaaaagaatcaataaaaacaaacaaggg

SEQ ID NO: 446297 - DNA, 2278 bp, Homo sapiens
tactttttttacaattattgaggttttaataatacataatttgactacatttcttagatttcgcgtcgtgacgttttcagcctctcaaactgcatcgcctacgcacagaagcttcccgaatctcagacgagacacaacaaagctgcgcgctgccctcgccccgcccgcgggcgcggcggcgacaggccctcggccccgcccacaccgcggcgccacgcctccaacccgcctccagccgtgcctccccaggcccttggccccgcccacaccgcctcgccccgccccaagccgcgctgtgctccaggggcgggggcccacggcggccactcactgagccccacgggccgcagcggagtgacgtagggttggcgcacggatccgttgcggctgcagctctgcagtcgggccgttccttcgccgccgccaggggtagcggtgtagctgcgcagcgtcgcgcgcgctaccgcacccaggttcggcccgtaggcgtctggcagcccggcgccatcttcatcgagcgccatggccgcagcctgcgggccgggagcggccgggtactgcttgctcctcggcttgcatttgtttctgctgaccgcgggccctgccctgggctggaacgaccctgacagaatgttgctgcgggatgtaaaagctcttaccctccactatgaccgctataccacctcccgcaggctggatcccatcccacagttgaaatgtgttggaggcacagctggttgtgattcttataccccaaaagtcatacagtgtcagaacaaaggctgggatgggtatgatgtacagtgggaatgtaagacggacttagatattgcatacaaatttggaaaaactgtggtgagctgtgaaggctatgagtcctctgaagaccagtatgtactaagaggttcttgtggcttggagtataatttagattatacagaacttggcctgcagaaactgaaggagtctggaaagcagcacggctttgcctctttctctgattattattataagtggtcctcggcggattcctgtaacatgagtggattgattaccatcgtggtactccttgggatcgcctttgtagtctataagctgttcctgagtgacgggcagtattctcctccaccgtactctgagtatcctccattttcccaccgttaccagagattcaccaactcagcaggacctcctcccccaggctttaagtctgagttcacaggaccacagaatactggccatggtgcaacttctggttttggcagtgcttttacaggacaacaaggatatgaaaattcaggaccagggttctggacaggcttgggaactggtggaatactaggatatttgtttggcagcaatagagcggcaacacccttctcagactcgtggtactacccgtcctatcctccctcctaccctggcacgtggaatagggcttactcaccccttcatggaggctcgggcagctattcggtatgttcaaactcagacacgaaaaccagaactgcatcaggatatggtggtaccaggagacgataaagtagaaagttggagtcaaacactggatgcagaaattttggatttttcatcactttctctttagaaaaaaagtactacctgttaacaattgggaaaaggggatattcaaaagttctgtggtgttatgtccagtgtagctttttgtattctattatttgaggctaaaagttgatgtgtgacaaaatacttatgtgttgtatgtcagtgtaacatgcagatgtatattgcagtttttgaaagtgatcattactgtggaatgctaaaaatacattaatttctaaaacctgtgatgccctaagaagcattaagaatgaaggtgttgtactaatagaaactaagtacagtaatattctatttggtattatattatttgatgtttgctgttcttcaaacatttaaatcaagctttggactaattatgctaatttgtgagttctgatcacttttgagctctgaagctttgaatcattcagtggtggagatggccttctggtaactgaatattaccttctgtaggaaaaggtggaaaataagcatctagaaggttgttgtgaatgactctgtgctggcaaaaatgcttgaaacctctatatttctttcgttcataagaggtaaaggtcaaatttttcaacaaaagtcttttaataacaaaagcatgcagttctctgtgaaatctcaaatattgttgtaatagtctgtttcaatcttaaaaagaatcaataaaaacaaacaaggg

SEQ ID NO: 446298 - DNA, 2256 bp, Homo sapiens
tactttttttacaattattgaggttttaataatacataatttgactacatttcttagatttcgcgtcgtgacgttttcagcctctcaaactgcatcgcctacgcacagaagcttcccgaatctcagacgagacacaacaaagctgcgcgctgccctcgccccgcccgcgggcgcggcggcgacaggccctcggccccgcccacaccgcggcgccacgcctccaacccgcctccagccgtgcctccccaggcccttggccccgcccacaccgcctcgccccgccccaagccgcgctgtgctccaggggcgggggcccacggcggccactcactgagccccacgggccgcagcggagtgacgtagggttggcgcacggatccgttgcggctgcagctctgcagtcgggccgttccttcgccgccgccaggggtagcggtgtagctgcgcagcgtcgcgcgcgctaccgcacccaggttcggcccgtaggcgtctggcagcccggcgccatcttcatcgagcgccatggccgcagcctgcgggccgggagcggccgggtactgcttgctcctcggcttgcatttgtttctgctgaccgcgggccctgccctgggctggaacgaccctgacagaatgttgctgcgggatgtaaaagctcttaccctccactatgaccgctataccacctcccgcaggctggatcccatcccacagttgaaatgtgttggaggcacagctggttgtgattcttataccccaaaagtcatacagtgtcagaacaaaggctgggatgggtatgatgtacagtgggaatgtaagacggacttagatattgcatacaaatttggaaaaactgtggtgagctgtgaaggctatgagtcctctgaagaccagtatgtactaagaggttcttgtggcttggagtataatttagattatacagaacttggcctgcagaaactgaaggagtctggaaagcagcacggctttgcctctttctctgattattattataagtggtcctcggcggattcctgtaacatgagtggattgattaccatcgtggtactccttgggatcgcctttgtagtctataagctgttcctgagtgacgggcagtattctcctccaccgtactctgagtatcctccattttcccaccgttaccagagattcaccaactcagcaggacctcctcccccaggctttaagtctgagttcacaggaccacagaatactggccatggtgcaacttctggttttggcagtgcttttacaggacaacaaggatagcggcaacacccttctcagactcgtggtactacccgtcctatcctccctcctaccctggcacgtggaatagggcttactcaccccttcatggaggctcgggcagctattcggtatgttcaaactcagacacgaaaaccagaactgcatcaggatatggtggtaccaggagacgataaagtagaaagttggagtcaaacactggatgcagaaattttggatttttcatcactttctctttagaaaaaaagtactacctgttaacaattgggaaaaggggatattcaaaagttctgtggtgttatgtccagtgtagctttttgtattctattatttgaggctaaaagttgatgtgtgacaaaatacttatgtgttgtatgtcagtgtaacatgcagatgtatattgcagtttttgaaagtgatcattactgtggaatgctaaaaatacattaatttctaaaacctgtgatgccctaagaagcattaagaatgaaggtgttgtactaatagaaactaagtacagaaaatttcagttttaggtggttgtagctgatgagttattacctcatagagactataatattctatttggtattatattatttgatgtttgctgttcttcaaacatttaaatcaagctttggactaattatgctaatttgtgagttctgatcacttttgagctctgaagctttgaatcattcagtggtggagatggccttctggtaactgaatattaccttctgtaggaaaaggtggaaaataagcatctagaaggttgttgtgaatgactctgtgctggcaaaaatgcttgaaacctctatatttctttcgttcataagaggtaaaggtcaaatttttcaacaaaagtcttttaataacaaaagcatgcagttctctgtgaaatctcaaatattgttgtaatagtctgtttcaatcttaaaaagaatcaataaaaacaaacaaggg

SEQ ID NO: 446299 - DNA, 2361 bp, Homo sapiens
tactttttttacaattattgaggttttaataatacataatttgactacatttcttagatttcgcgtcgtgacgttttcagcctctcaaactgcatcgcctacgcacagaagcttcccgaatctcagacgagacacaacaaagctgcgcgctgccctcgccccgcccgcgggcgcggcggcgacaggccctcggccccgcccacaccgcggcgccacgcctccaacccgcctccagccgtgcctccccaggcccttggctggagatccttaaggtcccctttctccctgccccggactcccggaatttgcccattgtcgtctttctcatctctgagtataactggagagctggacactcacctgcgcatctgctttgttgttatggctgtgtgatgtcatcgtggcctgctgttgtcatggctgcctgttgctatcgccggccgttgcctgccactggcagtctctgagtcacccttagcggacagggctgcagacctcgcaggtctgttagcagaatcgcagattgcactcttttttttttttggagtcggagtctcacattgtcgccccggccgcactgcaatgacgtgatctcggctcactgcaacctccgcctccgtgggttcaagagattctcctgcctcggcctcaccgacagaatgttgctgcgggatgtaaaagctcttaccctccactatgaccgctataccacctcccgcaggctggatcccatcccacagttgaaatgtgttggaggcacagctggttgtgattcttataccccaaaagtcatacagtgtcagaacaaaggctgggatgggtatgatgtacagtgggaatgtaagacggacttagatattgcatacaaatttggaaaaactgtggtgagctgtgaaggctatgagtcctctgaagaccagtatgtactaagaggttcttgtggcttggagtataatttagattatacagaacttggcctgcagaaactgaaggagtctggaaagcagcacggctttgcctctttctctgattattattataagtggtcctcggcggattcctgtaacatgagtggattgattaccatcgtggtactccttgggatcgcctttgtagtctataagctgttcctgagtgacgggcagtattctcctccaccgtactctgagtatcctccattttcccaccgttaccagagattcaccaactcagcaggacctcctcccccaggctttaagtctgagttcacaggaccacagaatactggccatggtgcaacttctggttttggcagtgcttttacaggacaacaaggatatgaaaattcaggaccagggttctggacaggcttgggaactggtggaatactaggatatttgtttggcagcaatagagcggcaacacccttctcagactcgtggtactacccgtcctatcctccctcctaccctggcacgtggaatagggcttactcaccccttcatggaggctcgggcagctattcggtatgttcaaactcagacacgaaaaccagaactgcatcaggatatggtggtaccaggagacgataaagtagaaagttggagtcaaacactggatgcagaaattttggatttttcatcactttctctttagaaaaaaagtactacctgttaacaattgggaaaaggggatattcaaaagttctgtggtgttatgtccagtgtagctttttgtattctattatttgaggctaaaagttgatgtgtgacaaaatacttatgtgttgtatgtcagtgtaacatgcagatgtatattgcagtttttgaaagtgatcattactgtggaatgctaaaaatacattaatttctaaaacctgtgatgccctaagaagcattaagaatgaaggtgttgtactaatagaaactaagtacagaaaatttcagttttaggtggttgtagctgatgagttattacctcatagagactataatattctatttggtattatattatttgatgtttgctgttcttcaaacatttaaatcaagctttggactaattatgctaatttgtgagttctgatcacttttgagctctgaagctttgaatcattcagtggtggagatggccttctggtaactgaatattaccttctgtaggaaaaggtggaaaataagcatctagaaggttgttgtgaatgactctgtgctggcaaaaatgcttgaaacctctatatttctttcgttcataagaggtaaaggtcaaatttttcaacaaaagtcttttaataacaaaagcatgcagttctctgtgaaatctcaaatattgttgtaatagtctgtttcaatcttaaaaagaatcaataaaaacaaacaaggg

SEQ ID NO: 446300 - DNA, 2153 bp, Homo sapiens
tactttttttacaattattgaggttttaataatacataatttgactacatttcttagatttcgcgtcgtgacgttttcagcctctcaaactgcatcgcctacgcacagaagcttcccgaatctcagacgagacacaacaaagctgcgcgctgccctcgccccgcccgcgggcgcggcggcgacaggccctcggccccgcccacaccgcggcgccacgcctccaacccgcctccagccgtgcctccccaggcccttggccccgcccacaccgcctcgccccgccccaagccgcgctgtgctccaggggcgggggcccacggcggccactcactgagccccacgggccgcagcggagtgacgtagggttggcgcacggatccgttgcggctgcagctctgcagtcgggccgttccttcgccgccgccaggggtagcggtgtagctgcgcagcgtcgcgcgcgctaccgcacccaggttcggcccgtaggcgtctggcagcccggcgccatcttcatcgagcgccatggccgcagcctgcgggccgggagcggccgggtactgcttgctcctcggcttgcatttgtttctgctgaccgcgggccctgccctgggctggaacgaccctgtgggaatgtaagacggacttagatattgcatacaaatttggaaaaactgtggtgagctgtgaaggctatgagtcctctgaagaccagtatgtactaagaggttcttgtggcttggagtataatttagattatacagaacttggcctgcagaaactgaaggagtctggaaagcagcacggctttgcctctttctctgattattattataagtggtcctcggcggattcctgtaacatgagtggattgattaccatcgtggtactccttgggatcgcctttgtagtctataagctgttcctgagtgacgggcagtattctcctccaccgtactctgagtatcctccattttcccaccgttaccagagattcaccaactcagcaggacctcctcccccaggctttaagtctgagttcacaggaccacagaatactggccatggtgcaacttctggttttggcagtgcttttacaggacaacaaggatatgaaaattcaggaccagggttctggacaggcttgggaactggtggaatactaggatatttgtttggcagcaatagagcggcaacacccttctcagactcgtggtactacccgtcctatcctccctcctaccctggcacgtggaatagggcttactcaccccttcatggaggctcgggcagctattcggtatgttcaaactcagacacgaaaaccagaactgcatcaggatatggtggtaccaggagacgataaagtagaaagttggagtcaaacactggatgcagaaattttggatttttcatcactttctctttagaaaaaaagtactacctgttaacaattgggaaaaggggatattcaaaagttctgtggtgttatgtccagtgtagctttttgtattctattatttgaggctaaaagttgatgtgtgacaaaatacttatgtgttgtatgtcagtgtaacatgcagatgtatattgcagtttttgaaagtgatcattactgtggaatgctaaaaatacattaatttctaaaacctgtgatgccctaagaagcattaagaatgaaggtgttgtactaatagaaactaagtacagaaaatttcagttttaggtggttgtagctgatgagttattacctcatagagactataatattctatttggtattatattatttgatgtttgctgttcttcaaacatttaaatcaagctttggactaattatgctaatttgtgagttctgatcacttttgagctctgaagctttgaatcattcagtggtggagatggccttctggtaactgaatattaccttctgtaggaaaaggtggaaaataagcatctagaaggttgttgtgaatgactctgtgctggcaaaaatgcttgaaacctctatatttctttcgttcataagaggtaaaggtcaaatttttcaacaaaagtcttttaataacaaaagcatgcagttctctgtgaaatctcaaatattgttgtaatagtctgtttcaatcttaaaaagaatcaataaaaacaaacaaggg

SEQ ID NO: 446301 - DNA, 1764 bp, Homo sapiens
agcggaccgattctacgacgatgtcaaggataaccgggtgtagctcgtgcacccgaccgtacgctcaaccgtcagcccaccgttccgggcacgtactgccagtctgcgacacgctgcggactcatcgagcgccatggccgcagcctgcgggccgggagcggccgggtactgcttgctcctcggcttgcatttgtttctgctgaccgcgggccctgccctgggctggaacgaccctgtgggaatgtaagacggacttagatattgcatacaaatttggaaaaactgtggtgagctgtgaaggctatgagtcctctgaagaccagtatgtactaagaggttcttgtggcttggagtataatttagattatacagaacttggcctgcagaaactgaaggagtctggaaagcagcacggctttgcctctttctctgattattattataagtggtcctcggcggattcctgtaacatgagtggattgattaccatcgtggtactccttgggatcgcctttgtagtctataagctgttcctgagtgacgggcagtattctcctccaccgtactctgagtatcctccattttcccaccgttaccagagattcaccaactcagcaggacctcctcccccaggctttaagtctgagttcacaggaccacagaatactggccatggtgcaacttctggttttggcagtgcttttacaggacaacaaggatatgaaaattcaggaccagggttctggacaggcttgggaactggtggaatactaggatatttgtttggcagcaatagagcggcaacacccttctcagactcgtggtactacccgtcctatcctccctcctaccctggcacgtggaatagggcttactcaccccttcatggaggctcgggcagctattcggtatgttcaaactcagacacgaaaaccagaactgcatcaggatatggtggtaccaggagacgataaagtagaaagttggagtcaaacactggatgcagaaattttggatttttcatcactttctctttagaaaaaaagtactacctgttaacaattgggaaaaggggatattcaaaagttctgtggtgttatgtccagtgtagctttttgtattctattatttgaggctaaaagttgatgtgtgacaaaatacttatgtgttgtatgtcagtgtaacatgcagatgtatattgcagtttttgaaagtgatcattactgtggaatgctaaaaatacattaatttctaaaacctgtgatgccctaagaagcattaagaatgaaggtgttgtactaatagaaactaagtacagaaaatttcagttttaggtggttgtagctgatgagttattacctcatagagactataatattctatttggtattatattatttgatgtttgctgttcttcaaacatttaaatcaagctttggactaattatgctaatttgtgagttctgatcacttttgagctctgaagctttgaatcattcagtggtggagatggccttctggtaactgaatattaccttctgtaggaaaaggtggaaaataagcatctagaaggttgttgtgaatgactctgtgctggcaaaaatgcttgaaacctctatatttctttcgttcataagaggtaaaggtcaaatttttcaacaaaagtcttttaataacaaaagcatgcagttctctgtgaaatctcaaatattgttgtaatagtctgtttcaatcttaaaaagaatcaataaaaacaaacaaggg

SEQ ID NO: 446302 - DNA, 1795 bp, Homo sapiens
cgagagagagagagagagtcaaatcatcgagcgccatggccgcagcctgcgggccgggagcggccgggtactgcttgctcctcggcttgcatttgtttctgctgaccgcgggccctgccctgggctggaacgaccctgacagaatgttgctgcgggatgtaaaagctcttaccctccactatgaccgctataccacctcccgcaggctggatcccatcccacagttgaaatgtgttggaggcacagctggttgtgattcttataccccaaaagtcatacagtgtcagaacaaaggctgggatgggtatgatgtacagtgggaatgtaagacggacttagatattgcatacaaatttggaaaaaagaggttcttgtggcttggagtataatttagattatacagaacttggcctgcagaaactgaaggagtctggaaagcagcacggctttgcctctttctctgattattattataagtggtcctcggcggattcctgtaacatgagtggattgattaccatcgtggtactccttgggatcgcctttgtagtctataagctgttcctgagtgacgggcagtattctcctccaccgtactctgagtatcctccattttcccaccgttaccagagattcaccaactcagcaggacctcctcccccaggctttaagtctgagttcacaggaccacagaatactggccatggtgcaacttctggttttggcagtgcttttacaggacaacaaggatatgaaaattcaggaccagggttctggacaggcttgggaactggtggaatactaggatatttgtttggcagcaatagagcggcaacacccttctcagactcgtggtactacccgtcctatcctccctcctaccctggcacgtggaatagggcttactcaccccttcatggaggctcgggcagctattcggtatgttcaaactcagacacgaaaaccagaactgcatcaggatatggtggtaccaggagacgataaagtagaaagttggagtcaaacactggatgcagaaattttggatttttcatcactttctctttagaaaaaaagtactacctgttaacaattgggaaaaggggatattcaaaagttctgtggtgttatgtccagtgtagctttttgtattctattatttgaggctaaaagttgatgtgtgacaaaatacttatgtgttgtatgtcagtgtaacatgcagatgtatattgcagtttttgaaagtgatcattactgtggaatgctaaaaatacattaatttctaaaacctgtgatgccctaagaagcattaagaatgaaggtgttgtactaatagaaactaagtacagaaaatttcagttttaggtggttgtagctgatgagttattacctcatagagactataatattctatttggtattatattatttgatgtttgctgttcttcaaacatttaaatcaagctttggactaattatgctaatttgtgagttctgatcacttttgagctctgaagctttgaatcattcagtggtggagatggccttctggtaactgaatattaccttctgtaggaaaaggtggaaaataagcatctagaaggttgttgtgaatgactctgtgctggcaaaaatgcttgaaacctctatatttctttcgttcataagaggtaaaggtcaaatttttcaacaaaagtcttttaataacaaaagcatgcagttctctgtgaaatctcaaatattgttgtaatagtctgtttcaatcttaaaaagaatcaataaaaacaaacaaggg

SEQ ID NO: 446303 - DNA, 2103 bp, Homo sapiens
tactttttttacaattattgaggttttaataatacataatttgactacatttcttagatttcgcgtcgtgacgttttcagcctctcaaactgcatcgcctacgcacagaagcttcccgaatctcagacgagacacaacaaagctgcgcgctgccctcgccccgcccgcgggcgcggcggcgacaggccctcggccccgcccacaccgcggcgccacgcctccaacccgcctccagccgtgcctccccaggcccttggccccgcccacaccgcctcgccccgccccaagccgcgctgtgctccaggggcgggggcccacggcggccactcactgagccccacgggccgcagcggagtgacgtagggttggcgcacggatccgttgcggctgcagctctgcagtcgggccgttccttcgccgccgccaggggtagcggtgtagctgcgcagcgtcgcgcgcgctaccgcacccaggttcggcccgtaggcgtctggcagcccggcgccatcttcatcgagcgccatggccgcagcctgcgggccgggagcggccgggtactgcttgctcctcggcttgcatttgtttctgctgaccgcgggccctgccctgggctggaacgaccctgtgggaatgtaagacggacttagatattgcatacaaatttggaaaaaagaggttcttgtggcttggagtataatttagattatacagaacttggcctgcagaaactgaaggagtctggaaagcagcacggctttgcctctttctctgattattattataagtggtcctcggcggattcctgtaacatgagtggattgattaccatcgtggtactccttgggatcgcctttgtagtctataagctgttcctgagtgacgggcagtattctcctccaccgtactctgagtatcctccattttcccaccgttaccagagattcaccaactcagcaggacctcctcccccaggctttaagtctgagttcacaggaccacagaatactggccatggtgcaacttctggttttggcagtgcttttacaggacaacaaggatatgaaaattcaggaccagggttctggacaggcttgggaactggtggaatactaggatatttgtttggcagcaatagagcggcaacacccttctcagactcgtggtactacccgtcctatcctccctcctaccctggcacgtggaatagggcttactcaccccttcatggaggctcgggcagctattcggtatgttcaaactcagacacgaaaaccagaactgcatcaggatatggtggtaccaggagacgataaagtagaaagttggagtcaaacactggatgcagaaattttggatttttcatcactttctctttagaaaaaaagtactacctgttaacaattgggaaaaggggatattcaaaagttctgtggtgttatgtccagtgtagctttttgtattctattatttgaggctaaaagttgatgtgtgacaaaatacttatgtgttgtatgtcagtgtaacatgcagatgtatattgcagtttttgaaagtgatcattactgtggaatgctaaaaatacattaatttctaaaacctgtgatgccctaagaagcattaagaatgaaggtgttgtactaatagaaactaagtacagaaaatttcagttttaggtggttgtagctgatgagttattacctcatagagactataatattctatttggtattatattatttgatgtttgctgttcttcaaacatttaaatcaagctttggactaattatgctaatttgtgagttctgatcacttttgagctctgaagctttgaatcattcagtggtggagatggccttctggtaactgaatattaccttctgtaggaaaaggtggaaaataagcatctagaaggttgttgtgaatgactctgtgctggcaaaaatgcttgaaacctctatatttctttcgttcataagaggtaaaggtcaaatttttcaacaaaagtcttttaataacaaaagcatgcagttctctgtgaaatctcaaatattgttgtaatagtctgtttcaatcttaaaaagaatcaataaaaacaaacaaggg

SEQ ID NO: 446304 - DNA, 1566 bp, Homo sapiens
tactttttttacaattattgaggttttaataatacataatttgactacatttcttagatttcgcgtcgtgacgttttcagcctctcaaactgcatcgcctacgcacagaagcttcccgaatctcagacgagacacaacaaagctgcgcgctgccctcgccccgcccgcgggcgcggcggcgacaggccctcggccccgcccacaccgcggcgccacgcctccaacccgcctccagccgtgcctccccaggcccttggccccgcccacaccgcctcgccccgccccaagccgcgctgtgctccaggggcgggggcccacggcggccactcactgagccccacgggccgcagcggagtgacgtagggttggcgcacggatccgttgcggctgcagctctgcagtcgggccgttccttcgccgccgccaggggtagcggtgtagctgcgcagcgtcgcgcgcgctaccgcacccaggttcggcccgtaggcgtctggcagcccggcgccatcttcatcgagcgccatggccgcagcctgcgggccgggagcggccgggtactgcttgctcctcggcttgcatttgtttctgctgaccgcgggccctgccctgggctggaacgaccctgacagaatgttgctgcgggatgtaaaagctcttaccctccactatgaccgctataccacctcccgcaggctggatcccatcccacagttgaaatgtgttggaggcacagctggttgtgattcttataccccaaaagtcatacagtgtcagaacaaaggctgggatgggtatgatgtacagtgggaatgtaagacggacttagatattgcatacaaatttggaaaaactgtggtgagctgtgaaggctatgagtcctctgaagaccagtatgtactaagaggttcttgtggcttggagtataatttagattatacagaacttggcctgcagaaactgaaggagtctggaaagcagcacggctttgcctctttctctgattattattataagtggtcctcggcggattcctgtaacatgagtggattgattaccatcgtggtactccttgggatcgcctttgtagtctataagctgttcctgagtgacgggcagtattctcctccaccgtactctgagtatcctccattttcccaccgttaccagagattcaccaactcagcaggacctcctcccccaggctttaagtctgagttcacaggaccacagaatactggccatggtgcaacttctggttttggcagtgcttttacaggacaacaaggatatgaaaattcaggaccagggttctggacaggcttgggaactggtggaatactaggatatttgtttggcagcaatagagcggcaacacccttctcagactcgtggtactacccgtcctatcctccctcctaccctggcacgtggaatagggcttactcaccccttcatggaggctcgggcagctattcggtatgttcaaactcagacacgaaaaccagaactgcatcagatatggtgcatccagtgtttgactccaactttctactttatcggtcgagc

SEQ ID NO: 446305 - DNA, 1397 bp, Homo sapiens
tactttttttacaattattgaggttttaataatacataatttgactacatttcttagatttcgcgtcgtgacgttttcagcctctcaaactgcatcgcctacgcacagaagcttcccgaatctcagacgagacacaacaaagctgcgcgctgccctcgccccgcccgcgggcgcggcggcgacaggccctcggccccgcccacaccgcggcgccacgcctccaacccgcctccagccgtgcctccccaggcccttggccccgcccacaccgcctcgccccgccccaagccgcgctgtgctccaggggcgggggcccacggcggccactcactgagccccacgggccgcagcggagtgacgtagggttggcgcacggatccgttgcggctgcagctctgcagtcgggccgttccttcgccgccgccaggggtagcggtgtagctgcgcagcgtcgcgcgcgctaccgcacccaggttcggcccgtaggcgtctggcagcccggcgccatcttcatcgagcgccatggccgcagcctgcgggccgggagcggccgggtactgcttgctcctcggcttgcatttgtttctgctgaccgcgggccctgccctgggctggaacgaccctgacagaatgttgctgcgggatgtaaaagctcttaccctccactatgaccgctataccacctcccgcaggctggatcccatcccacagttgaaatgtgttggaggcacagctggttgtgattcttataccccaaaagtcatacagtgtcagaacaaaggctgggatgggtatgatgtacagtgggaatgtaagacggacttagatattgcatacaaatttggaaaaactgtggtgagctgtgaaggctatgagtcctctgaagaccagtatgtactaagaggttcttgtggcttggagtataatttagattatacagaacttggcctgcagaaactgaaggagtctggaaagcagcacggctttgcctctttctctgattattattataagtggtcctcggcggattcctgtaacatgagtggattgattaccatcgtggtactccttgggatcgcctttgtagtctataagctgttcctgagtgacgggcagtattctcctccaccgtactctgagtatcctccattttcccaccgttaccagagattcaccaactcagcaggacctcctcccccaggctttaagtctgagttcacaggaccacagaatactggccatggtgcaacttctggttttggcagtgcttttacaggacaacaaggatatgaaaattcaggaccagggttctggacaggcttgggaactggtggaatactaggatatttgtttggcagcaatagtagagcgatcagagaaacggatcctcagatcac

SEQ ID NO: 446306 - DNA, 1944 bp, Homo sapiens
tactttttttacaattattgaggttttaataatacataatttgactacatttcttagatttcgcgtcgtgacgttttcagcctctcaaactgcatcgcctacgcacagaagcttcccgaatctcagacgagacacaacaaagctgcgcgctgccctcgccccgcccgcgggcgcggcggcgacaggccctcggccccgcccacaccgcggcgccacgcctccaacccgcctccagccgtgcctccccaggcccttggccccgcccacaccgcctcgccccgccccaagccgcgctgtgctccaggggcgggggcccacggcggccactcactgagccccacgggccgcagcggagtgacgtagggttggcgcacggatccgttgcggctgcagctctgcagtcgggccgttccttcgccgccgccaggggtagcggtgtagctgcgcagcgtcgcgcgcgctaccgcacccaggttcggcccgtaggcgtctggcagcccggcgccatcttcatcgagcgccatggccgcagcctgcgggccgggagcggccgggtactgcttgctcctcggcttgcatttgtttctgctgaccgcgggccctgccctgggctggaacgaccctgacagaatgttgctgcgggatgtaaaagctcttaccctccactatgaccgctataccacctcccgcaggctggatcccatcccacagttgaaatgtgttggaggcacagctggttgtgattcttataccccaaaagtcatacagtgtcagaacaaaggctgggatgggtatgatgtacagtgggaatgtaagacggacttagatattgcatacaaatttggaaaaactgtggtgagctgtgaaggctatgagtcctctgaagaccagtatgtactaatgaaaattcaggaccagggttctggacaggcttgggaactggtggaatactaggatatttgtttggcagcaatagagcggcaacacccttctcagactcgtggtactacccgtcctatcctccctcctaccctggcacgtggaatagggcttactcaccccttcatggaggctcgggcagctattcggtatgttcaaactcagacacgaaaaccagaactgcatcaggatatggtggtaccaggagacgataaagtagaaagttggagtcaaacactggatgcagaaattttggatttttcatcactttctctttagaaaaaaagtactacctgttaacaattgggaaaaggggatattcaaaagttctgtggtgttatgtccagtgtagctttttgtattctattatttgaggctaaaagttgatgtgtgacaaaatacttatgtgttgtatgtcagtgtaacatgcagatgtatattgcagtttttgaaagtgatcattactgtggaatgctaaaaatacattaatttctaaaacctgtgatgccctaagaagcattaagaatgaaggtgttgtactaatagaaactaagtacagaaaatttcagttttaggtggttgtagctgatgagttattacctcatagagactataatattctatttggtattatattatttgatgtttgctgttcttcaaacatttaaatcaagctttggactaattatgctaatttgtgagttctgatcacttttgagctctgaagctttgaatcattcagtggtggagatggccttctggtaactgaatattaccttctgtaggaaaaggtggaaaataagcatctagaaggttgttgtgaatgactctgtgctggcaaaaatgcttgaaacctctatatttctttcgttcataagaggtaaaggtcaaatttttcaacaaaagtcttttaataacaaaagcatgcagttctctgtgaaatctcaaatattgttgtaatagtctgtttcaatcttaaaaagaatcaataaaaacaaacaaggg

SEQ ID NO: 446307 - DNA, 1300 bp, Homo sapiens
  misc_feature (1182)..(1182): n is a, c, g, or t
  misc_feature (1196)..(1196): n is a, c, g, or t
  misc_feature (1207)..(1207): n is a, c, g, or t
  misc_feature (1216)..(1216): n is a, c, g, or t
  misc_feature (1232)..(1232): n is a, c, g, or t
  misc_feature (1250)..(1250): n is a, c, g, or t
  misc_feature (1265)..(1265): n is a, c, g, or t
  misc_feature (1284)..(1284): n is a, c, g, or t
  misc_feature (1293)..(1293): n is a, c, g, or t
tactttttttacaattattgaggttttaataatacataatttgactacatttcttagatttcgcgtcgtgacgttttcagcctctcaaactgcatcgcctacgcacagaagcttcccgaatctcagacgagacacaacaaagctgcgcgctgccctcgccccgcccgcgggcgcggcggcgacaggccctcggccccgcccacaccgcggcgccacgcctccaacccgcctccagccgtgcctccccaggcccttggccccgcccacaccgcctcgccccgccccaagccgcgctgtgctccaggggcgggggcccacggcggccactcactgagccccacgggccgcagcggagtgacgtagggttggcgcacggatccgttgcggctgcagctctgcagtcgggccgttccttcgccgccgccaggggtagcggtgtagctgcgcagcgtcgcgcgcgctaccgcacccaggttcggcccgtaggcgtctggcagcccggcgccatcttcatcgagcgccatggccgcagcctgcgggccgggagcggccgggtactgcttgctcctcggcttgcatttgtttctgctgaccgcgggccctgccctgggctggaacgaccctgacagaatgttgctgcgggatgtaaaagctcttaccctccactatgaccgctataccacctcccgcaggctggatcccatcccacagttgaaatgtgttggaggcacagctggttgtgattcttataccccaaaagtcatacagtgtcagaacaaaggctgggatgggtatgatgtacagtgggaatgtaagacggacttagatattgcatacaaatttggaaaaactgtggtgagctgtgaaggctatgagtcctctgaagaccagtatgtactaagaggttcttgtggcttggagtataatttagattatacagaacttggcctgcagaaactgaaggagtctggaaagcagcacggctttgcctctttctctgattattattataagtggtcctcggcggattcctgtaacatgagtggattgattaccatcgtggtactccttgggatcgcctttgtagtctataagctgttcctgagtgacgggcagtattctcctccaccgtactctgagtatcctccattttcctccccaaccggtaacccagggggtctnccaaaccccaggangggcctccctnccccaaggnttaaagccctggggtncaaagggccacaagaaanactggccaatggggnaattccggggtttggaagncgttaaaanggaaaaa

SEQ ID NO: 446308 - DNA, 829 bp, Homo sapiens
tactttttttacaattattgaggttttaataatacataatttgactacatttcttagatttcgcgtcgtgacgttttcagcctctcaaactgcatcgcctacgcacagaagcttcccgaatctcagacgagacacaacaaagctgcgcgctgccctcgccccgcccgcgggcgcggcggcgacaggccctcggccccgcccacaccgcggcgccacgcctccaacccgcctccagccgtgcctccccaggcccttggccccgcccacaccgcctcgccccgccccaagccgcgctgtgctccaggggcgggggcccacggcggccactcactgagccccacgggccgcagcggagtgacgtagggttggcgcacggatccgttgcggctgcagctctgcagtcgggccgttccttcgccgccgccaggggtagcggtgtagctgcgcagcgtcgcgcgcgctaccgcacccaggttcggcccgtaggcgtctggcagcccggcgccatcttcatcgagcgccatggccgcagcctgcgggccgggagcggccgggtactgcttgctcctcggcttgcatttgtttctgctgaccgcgggccctgccctgggctggaacgaccctgacagaatgttgctgcgggatgtaaaagctcttaccctccactatgaccgctataccacctcccgcaggctggatcccatcccacagttgaaatgtgttggaggcacagctggttgtgattcttataccccaaaagtcatacagtgtcagaacaaaggctgggatgggtatgatgtacaggtaatatccactacagtaatggcag

SEQ ID NO: 446309 - DNA, 471 bp, Homo sapiens
tgtaatcccagctacttgggaggctgaggcgggagaatcgccagaacctgggaggcagaggttgcggtgagttgagatcaccccattccaccccagcctgggcgacaagagcgaaactccatctccgaaaaaagaaaccccagagttcatgtgagcgcagcatgcgatgactggtctgggaagaactggccattccttgggcctcctggccccttggtgctgtctggcccagtgtccacagttccagggctgtagtgacagctttttatcattacaggtgtaggtggagcttttgctggaatcccaggtgaggcaaggctggtgggagaagcagggtggccagccaggcagaggctctggcgttgggaggggttgggcacccaagatcccatccaagcctgcccaatttctcccacgcctgcagagccaggtcttgcagtggctgtagcacaaagtggcacccatcccagg

SEQ ID NO: 446310 - DNA, 436 bp, Homo sapiens
ctgcagggcaggctggatggaaggacagatgggtagtggggacacaggagttccccgatgcaggtgaaggggaggggactgagtcaagagatatctgcaaggaagcagaagagagacctcactggcctggggtgaggtctcgctcacggactctgctctgtcccagcccttgctgaaagccctgctgaatcttgttagccagcagggcttctaggagaagcacaggcctggcccaggcttgttagggatcggtgcaatgacacctgcactgcacatagtagtcgctcactaaactactggtggatgctattttatcaggatcgaccctgagcatcacaggcttagggaccagcctagggacctgagtggctgatcacagcactgccctaactccaggagacatttcccactctgggcctaggaacactgcctacac

SEQ ID NO: 446311 - DNA, 3242 bp, Homo sapiens
cgacgaggcaacaattaggctttggggataaaacgaggtgcggagagcgggctggggcatttctccccgagatggcgggtctgacggcggcggccccgcggcccggagtcctcctgctcctgctgtccatcctccacccctctcggcctggaggggtccctggggccattcctggtggagttcctggaggagtcttttatccaggggctggtctcggagcccttggaggaggagcgctggggcctggaggcaaacctcttaagccagttcccggagggcttgcgggtgctggccttggggcagggctcggcgccttccccgcagttacctttccgggggctctggtgcctggtggagtggctgacgctgctgcagcctataaagctgctaaggctggcgctgggcttggtggtgtcccaggagttggtggcttaggagtgtctgcaggtgcggtggttcctcagcctggagccggagtgaagcctgggaaagtgccgggtgtggggctgccaggtgtatacccaggtggcgtgctcccaggagctcggttccccggtgtgggggtgctccctggagttcccactggagcaggagttaagcccaaggctccaggtgtaggtggagcttttgctggaatcccaggagttggaccctttgggggaccgcaacctggagtcccactggggtatcccatcaaggcccccaagctgcctggtggctatggactgccctacaccacagggaaactgccctatggctatgggcccggaggagtggctggtgcagcgggcaaggctggttacccaacagggacaggggttggcccccaggcagcagcagcagcggcagctaaagcagcagcaaagttcggtgctggagcagccggagtcctccctggtgttggaggggctggtgttcctggcgtgcctggggcaattcctggaattggaggcatcgcaggcgttgggactccagctgcagctgcagctgcagcagcagccgctaaggcagccaagtatggagctgctgcaggcttagtgcctggtgggccaggctttggcccgggagtagttggtgtcccaggagctggcgttccaggtgttggtgtcccaggagctgggattccagttgtcccaggtgctgggatcccaggtgctgcggttccaggggttgtgtcaccagaagcagctgctaaggcagctgcaaaggcagccaaatacggggccaggcccggagtcggagttggaggcattcctacttacggggttggagctgggggctttcccggctttggtgtcggagtcggaggtatccctggagtcgcaggtgtccctggtgtcggaggtgttcccggagtcggaggtgtcccgggagttggcatttcccccgaagctcaggcagcagctgccgccaaggctgccaagtacggagtggggaccccagcagctgcagctgctaaagcagccgccaaagccgcccagtttgctcttctcaatcttgcagggttagttcctggtgtcggcgtggctcctggagttggcgtggctcctggtgtcggtgtggctcctggagttggcttggctcctggagttggcgtggctcctggagttggtgtggctcctggcgttggcgtggctcccggcattggccctggtggagttgcagctgcagcaaaatccgctgccaaggtggctgccaaagcccagctccgagctgcagctgggcttggtgctggcatccctggacttggagttggtgtcggcgtccctggacttggagttggtgctggtgttcctggacttggagttggtgctggtgttcctggcttcggggcagtacctggagccctggctgccgctaaagcagccaaatatggagcagcagtgcctggggtccttggagggctcggggctctcggtggagtaggcatcccaggcggtgtggtgggagccggacccgccgccgccgctgccgcagccaaagctgctgccaaagccgcccagtttggcctagtgggagccgctgggctcggaggactcggagtcggagggcttggagttccaggtgttgggggccttggaggtatacctccagctgcagccgctaaagcagctaaatacggtgctgctggccttggaggtgtcctagggggtgccgggcagttcccacttggaggagtggcagcaagacctggcttcggattgtctcccattttcccaggtggggcctgcctggggaaagcttgtggccggaagagaaaatgagcttcctaggacccctgactcacgacctcatcaacgttggtgctactgcttggtggagaatgtaaaccctttgtaaccccatcccatgcccctccgactccccaccccaggagggaacgggcaggccgggcggccttgcagatccacagggcaaggaaacaagaggggagcggccaagtgccccgaccaggaggccccctacttcagaggcaagggccatgtggtcctggccccccaccccatcccttcccacctaggagctccccctccacacagcctccatctccaggggaacttggtgctacacgctggtgctcttatcttcctggggggagggaggagggaagggtggcccctcggggaaccccctacctggggctcctctaaagatggtgcagacacttcctgggcagtcccagctccccctgcccaccaggacccaccgttggctgccatccagttggtacccaagcacctgaagcctcaaagctggattcgctctagcatccctcctctcctgggtccacttggccgtctcctccccaccgatcgctgttccccacatctggggcgcttttgggttggaaaaccaccccacactgggaatagccaccttgcccttgtagaatccatccgcccatccgtccattcatccatcggtccgtccatccatgtccccagttgaccgcccggcaccactagctggctgggtgcacccaccatcaacctggttgacctgtcatggccgcctgtgccctgcctccacccccatcctacactcccccagggcgtgcggggctgtgcagactggggtgccaggcatctcctccccacccggggtgtccccacatgcagtactgtataccccccatccctccctcggtccactgaacttcagagcagttcccattcctgccccgcccatctttttgtgtctcgctgtgatagatcaataaatattttattttttgtcctgga

SEQ ID NO: 446312 - DNA, 3560 bp, Homo sapiens
cgacgaggcaacaattaggctttggggataaaacgaggtgcggagagcgggctggggcatttctccccgagatggcgggtctgacggcggcggccccgcggcccggagtcctcctgctcctgctgtccatcctccacccctctcggcctggaggggtccctggggccattcctggtggagttcctggaggagtcttttatccaggggctggtctcggagcccttggaggaggagcgctggggcctggaggcaaacctcttaagccagttcccggagggcttgcgggtgctggccttggggcagggctcggcgccttccccgcagttacctttccgggggctctggtgcctggtggagtggctgacgctgctgcagcctataaagctgctaaggctggcgctgggcttggtggtgtcccaggagttggtggcttaggagtgtctgcaggtgcggtggttcctcagcctggagccggagtgaagcctgggaaagtgccgggtgtggggctgccaggtgtatacccaggtggcgtgctcccaggagctcggttccccggtgtgggggtgctccctggagttcccactggagcaggagttaagcccaaggctccaggtgtaggtggagcttttgctggaatcccaggagttggaccctttgggggaccgcaacctggagtcccactggggtatcccatcaaggcccccaagctgcctggtggctatggactgccctacaccacagggaaactgccctatggctatgggcccggaggagtggctggtgcagcgggcaaggctggttacccaacagggacaggggttggcccccaggcagcagcagcagcggcagctaaagcagcagcaaagttcggtgctggagcagccggagtcctccctggtgttggaggggctggtgttcctggcgtgcctggggcaattcctggaattggaggcatcgcaggcgttgggactccagctgcagctgcagctgcagcagcagccgctaaggcagccaagtatggagctgctgcaggcttagtgcctggtgggccaggctttggcccgggagtagttggtgtcccaggagctggcgttccaggtgttggtgtcccaggagctgggattccagttgtcccaggtgctgggatcccaggtgctgcggttccaggggttgtgtcaccagaagcagctgctaaggcagctgcaaaggcagccaaatacggggccaggcccggagtcggagttggaggcattcctacttacggggttggagctgggggctttcccggctttggtgtcggagtcggaggtatccctggagtcgcaggtgtccctggtgtcggaggtgttcccggagtcggaggtgtcccgggagttggcatttcccccgaagctcaggcagcagctgccgccaaggctgccaagtacggagtggggaccccagcagctgcagctgctaaagcagccgccaaagccgcccagtttgggttagttcctggtgtcggcgtggctcctggagttggcgtggctcctggtgtcggtgtggctcctggagttggcttggctcctggagttggcgtggctcctggagttggtgtggctcctggcgttggcgtggctcccggcattggccctggtggagttgcagctgcagcaaaatccgctgccaaggtggctgccaaagcccagctccgagctgcagctgggcttggtgctggcatccctggacttggagttggtgtcggcgtccctggacttggagttggtgctggtgttcctggacttggagttggtgctggtgttcctggcttcggggcaggtgcagatgagggagttaggcggagcctgtcccctgagctcagggaaggagatccctcctcctctcagcacctccccagcaccccctcatcacccagggtacctggagccctggctgccgctaaagcagccaaatatggagcagcagtgcctggggtccttggagggctcggggctctcggtggagtaggcatcccaggcggtgtggtgggagccggacccgccgccgccgctgccgcagccaaagctgctgccaaagccgcccagtttggcctagtgggagccgctgggctcggaggactcggagtcggagggcttggagttccaggtgttgggggccttggaggtatacctccagctgcagccgctaaagcagctaaatacggtgctgctggccttggaggtgtcctagggggtgccgggcagttcccacttggaggagtggcagcaagacctggcttcggattgtctcccattttcccaggtggggcctgcctggggaaagcttgtggccggaagagaaaatgagcttcctaggacccctgactcacgacctcatcaacgttggtgctactgcttggtggagaatgtaaaccctttgtaaccccatcccatgcccctccgactccccaccccaggagggaacgggcaggccgggcggccttgcagatccacagggcaaggaaacaagaggggagcggccaagtgccccgaccaggaggccccctacttcagaggcaagggccatgtggtcctggccccccaccccatcccttcccacctaggagctccccctccacacagcctccatctccaggggaacttggtgctacacgctggtgctcttatcttcctggggggagggaggagggaagggtggcccctcggggaaccccctacctggggctcctctaaagatggtgcagacacttcctgggcagtcccagctccccctgcccaccaggacccaccgttggctgccatccagttggtacccaagcacctgaagcctcaaagctggattcgctctagcatccctcctctcctgggtccacttggccgtctcctccccaccgatcgctgttccccacatctggggcgcttttgggttggaaaaccaccccacactgggaatagccaccttgcccttgtagaatccatccgcccatccgtccattcatccatcggtccgtccatccatgtccccagttgaccgcccggcaccactagctggctgggtgcacccaccatcaacctggttgacctgtcatggccgcctgtgccctgcctccacccccatcctacactcccccagggcgtgcggggctgtgcagactggggtgccaggcatctcctccccacccggggtgtccccacatgcagtactgtataccccccatccctccctcggtccactgaacttcagagcagttcccattcctgccccgcccatctttttgtgtctcgctgtgatagatcaataaatattttattttttgtcctggatatttggggattatttttgattgttgatattctcttttggttttattgttgtggttcattgaaaaaaaaagataatttttttttctgatccggggagctgtatccccagtagaaaaaacattttaatcactctaatataactctggatgaaacacacctttttttttaataagaaaagagaattaactgcttcagaaatgactaataaatgaaaaacctttaaaggaaaaaaaaaaa

SEQ ID NO: 446313 - DNA, 3461 bp, Homo sapiens
cgacgaggcaacaattaggctttggggataaaacgaggtgcggagagcgggctggggcatttctccccgagatggcgggtctgacggcggcggccccgcggcccggagtcctcctgctcctgctgtccatcctccacccctctcggcctggaggggtccctggggccattcctggtggagttcctggaggagtcttttatccaggggctggtctcggagcccttggaggaggagcgctggggcctggaggcaaacctcttaagccagttcccggagggcttgcgggtgctggccttggggcagggctcggcgccttccccgcagttacctttccgggggctctggtgcctggtggagtggctgacgctgctgcagcctataaagctgctaaggctggcgctgggcttggtggtgtcccaggagttggtggcttaggagtgtctgcaggtgcggtggttcctcagcctggagccggagtgaagcctgggaaagtgccgggtgtggggctgccaggtgtatacccaggtggcgtgctcccaggagctcggttccccggtgtgggggtgctccctggagttcccactggagcaggagttaagcccaaggctccaggtgtaggtggagcttttgctggaatcccaggagttggaccctttgggggaccgcaacctggagtcccactggggtatcccatcaaggcccccaagctgcctggtggctatggactgccctacaccacagggaaactgccctatggctatgggcccggaggagtggctggtgcagcgggcaaggctggttacccaacagggacaggggttggcccccaggcagcagcagcagcggcagctaaagcagcagcaaagttcggtgctggagcagccggagtcctccctggtgttggaggggctggtgttcctggcgtgcctggggcaattcctggaattggaggcatcgcaggcgttgggactccagctgcagctgcagctgcagcagcagccgctaaggcagccaagtatggagctgctgcaggcttagtgcctggtgggccaggctttggcccgggagtagttggtgtcccaggagctggcgttccaggtgttggtgtcccaggagctgggattccagttgtcccaggtgctgggatcccaggtgctgcggttccaggggttgtgtcaccagaagcagctgctaaggcagctgcaaaggcagccaaatacggggccaggcccggagtcggagttggaggcattcctacttacggggttggagctgggggctttcccggctttggtgtcggagtcggaggtatccctggagtcgcaggtgtccctggtgtcggaggtgttcccggagtcggaggtgtcccgggagttggcatttcccccgaagctcaggcagcagctgccgccaaggctgccaagtacggagtggggaccccagcagctgcagctgctaaagcagccgccaaagccgcccagtttgggttagttcctggtgtcggcgtggctcctggagttggcgtggctcctggtgtcggtgtggctcctggagttggcttggctcctggagttggcgtggctcctggagttggtgtggctcctggcgttggcgtggctcccggcattggccctggtggagttgcagctgcagcaaaatccgctgccaaggtggctgccaaagcccagctccgagctgcagctgggcttggtgctggcatccctggacttggagttggtgtcggcgtccctggacttggagttggtgctggtgttcctggacttggagttggtgctggtgttcctggcttcggggcagtacctggagccctggctgccgctaaagcagccaaatatggagcagcagtgcctggggtccttggagggctcggggctctcggtggagtaggcatcccaggcggtgtggtgggagccggacccgccgccgccgctgccgcagccaaagctgctgccaaagccgcccagtttggcctagtgggagccgctgggctcggaggactcggagtcggagggcttggagttccaggtgttgggggccttggaggtatacctccagctgcagccgctaaagcagctaaatacggtgctgctggccttggaggtgtcctagggggtgccgggcagttcccacttggaggagtggcagcaagacctggcttcggattgtctcccattttcccaggtggggcctgcctggggaaagcttgtggccggaagagaaaatgagcttcctaggacccctgactcacgacctcatcaacgttggtgctactgcttggtggagaatgtaaaccctttgtaaccccatcccatgcccctccgactccccaccccaggagggaacgggcaggccgggcggccttgcagatccacagggcaaggaaacaagaggggagcggccaagtgccccgaccaggaggccccctacttcagaggcaagggccatgtggtcctggccccccaccccatcccttcccacctaggagctccccctccacacagcctccatctccaggggaacttggtgctacacgctggtgctcttatcttcctggggggagggaggagggaagggtggcccctcggggaaccccctacctggggctcctctaaagatggtgcagacacttcctgggcagtcccagctccccctgcccaccaggacccaccgttggctgccatccagttggtacccaagcacctgaagcctcaaagctggattcgctctagcatccctcctctcctgggtccacttggccgtctcctccccaccgatcgctgttccccacatctggggcgcttttgggttggaaaaccaccccacactgggaatagccaccttgcccttgtagaatccatccgcccatccgtccattcatccatcggtccgtccatccatgtccccagttgaccgcccggcaccactagctggctgggtgcacccaccatcaacctggttgacctgtcatggccgcctgtgccctgcctccacccccatcctacactcccccagggcgtgcggggctgtgcagactggggtgccaggcatctcctccccacccggggtgtccccacatgcagtactgtataccccccatccctccctcggtccactgaacttcagagcagttcccattcctgccccgcccatctttttgtgtctcgctgtgatagatcaataaatattttattttttgtcctggatatttggggattatttttgattgttgatattctcttttggttttattgttgtggttcattgaaaaaaaaagataatttttttttctgatccggggagctgtatccccagtagaaaaaacattttaatcactctaatataactctggatgaaacacacctttttttttaataagaaaagagaattaactgcttcagaaatgactaataaatgaaaaacctttaaaggaaaaaaaaaaa

SEQ ID NO: 446314 - DNA, 3490 bp, Homo sapiens
cgacgaggcaacaattaggctttggggataaaacgaggtgcggagagcgggctggggcatttctccccgagatggcgggtctgacggcggcggccccgcggcccggagtcctcctgctcctgctgtccatcctccacccctctcggcctggaggggtccctggggccattcctggtggagttcctggaggagtcttttatccaggggctggtctcggagcccttggaggaggagcgctggggcctggaggcaaacctcttaagccagttcccggagggcttgcgggtgctggccttggggcagggctcggcgccttccccgcagttacctttccgggggctctggtgcctggtggagtggctgacgctgctgcagcctataaagctgctaaggctggcgctgggcttggtggtgtcccaggagttggtggcttaggagtgtctgcaggtgcggtggttcctcagcctggagccggagtgaagcctgggaaagtgccgggtgtggggctgccaggtgtatacccaggtggcgtgctcccaggagctcggttccccggtgtgggggtgctccctggagttcccactggagcaggagttaagcccaaggctccaggtgtaggtggagcttttgctggaatcccaggagttggaccctttgggggaccgcaacctggagtcccactggggtatcccatcaaggcccccaagctgcctggtggctatggactgccctacaccacagggaaactgccctatggctatgggcccggaggagtggctggtgcagcgggcaaggctggttacccaacagggacaggggttggcccccaggcagcagcagcagcggcagctaaagcagcagcaaagttcggtgctggagcagccggagtcctccctggtgttggaggggctggtgttcctggcgtgcctggggcaattcctggaattggaggcatcgcaggcgttgggactccagctgcagctgcagctgcagcagcagccgctaaggcagccaagtatggagctgctgcaggcttagtgcctggtgggccaggctttggcccgggagtagttggtgtcccaggagctggcgttccaggtgttggtgtcccaggagctgggattccagttgtcccaggtgctgggatcccaggtgctgcggttccaggggttgtgtcaccagaagcagctgctaaggcagctgcaaaggcagccaaatacggggccaggcccggagtcggagttggaggcattcctacttacggggttggagctgggggctttcccggctttggtgtcggagtcggaggtatccctggagtcgcaggtgtccctggtgtcggaggtgttcccggagtcggaggtgtcccgggagttggcatttcccccgaagctcaggcagcagctgccgccaaggctgccaagtacggagtggggaccccagcagctgcagctgctaaagcagccgccaaagccgcccagtttgctcttctcaatcttgcagggttagttcctggtgtcggcgtggctcctggagttggcgtggctcctggtgtcggtgtggctcctggagttggcttggctcctggagttggcgtggctcctggagttggtgtggctcctggcgttggcgtggctcccggcattggccctggtggagttgcagctgcagcaaaatccgctgccaaggtggctgccaaagcccagctccgagctgcagctgggcttggtgctggcatccctggacttggagttggtgtcggcgtccctggacttggagttggtgctggtgttcctggacttggagttggtgctggtgttcctggcttcggggcagtacctggagccctggctgccgctaaagcagccaaatatggagcagcagtgcctggggtccttggagggctcggggctctcggtggagtaggcatcccaggcggtgtggtgggagccggacccgccgccgccgctgccgcagccaaagctgctgccaaagccgcccagtttggcctagtgggagccgctgggctcggaggactcggagtcggagggcttggagttccaggtgttgggggccttggaggtatacctccagctgcagccgctaaagcagctaaatacggtgctgctggccttggaggtgtcctagggggtgccgggcagttcccacttggaggagtggcagcaagacctggcttcggattgtctcccattttcccaggtggggcctgcctggggaaagcttgtggccggaagagaaaatgagcttcctaggacccctgactcacgacctcatcaacgttggtgctactgcttggtggagaatgtaaaccctttgtaaccccatcccatgcccctccgactccccaccccaggagggaacgggcaggccgggcggccttgcagatccacagggcaaggaaacaagaggggagcggccaagtgccccgaccaggaggccccctacttcagaggcaagggccatgtggtcctggccccccaccccatcccttcccacctaggagctccccctccacacagcctccatctccaggggaacttggtgctacacgctggtgctcttatcttcctggggggagggaggagggaagggtggcccctcggggaaccccctacctggggctcctctaaagatggtgcagacacttcctgggcagtcccagctccccctgcccaccaggacccaccgttggctgccatccagttggtacccaagcacctgaagcctcaaagctggattcgctctagcatccctcctctcctgggtccacttggccgtctcctccccaccgatcgctgttccccacatctggggcgcttttgggttggaaaaccaccccacactgggaatagccaccttgcccttgtagaatccatccgcccatccgtccattcatccatcggtccgtccatccatgtccccagttgaccgcccggcaccactagctggctgggtgcacccaccatcaacctggttgacctgtcatggccgcctgtgccctgcctccacccccatcctacactcccccagggcgtgcggggctgtgcagactggggtgccaggcatctcctccccacccggggtgtccccacatgcagtactgtataccccccatccctccctcggtccactgaacttcagagcagttcccattcctgccccgcccatctttttgtgtctcgctgtgatagatcaataaatattttattttttgtcctggaaaaaaaaaaaaaaaaaaaaaaaaaaaaacaaaaaagaaaaaacaaaaaaaaaaaaaacgagaaaaacagagaaacaaaaacacacgacaacgaaaaaaaaaaaaacagagaacacacaagaagaggaacaaaacagcacaaaaccaccaacaaagcaagaccacagcgccgccaacactgcacagaaaacagcgaggagaggaaacacacacacgcacgccccaaggagaaaacgaagagccaaaaaa

SEQ ID NO: 446315 - DNA, 3404 bp, Homo sapiens
cgacgaggcaacaattaggctttggggataaaacgaggtgcggagagcgggctggggcatttctccccgagatggcgggtctgacggcggcggccccgcggcccggagtcctcctgctcctgctgtccatcctccacccctctcggcctggaggggtccctggggccattcctggtggagttcctggaggagtcttttatccaggggctggtctcggagcccttggaggaggagcgctggggcctggaggcaaacctcttaagccagttcccggagggcttgcgggtgctggccttggggcagggctcggcgccttccccgcagttacctttccgggggctctggtgcctggtggagtggctgacgctgctgcagcctataaagctgctaaggctggcgctgggcttggtggtgtcccaggagttggtggcttaggagtgtctgcaggtgcggtggttcctcagcctggagccggagtgaagcctgggaaagtgccgggtgtggggctgccaggtgtatacccaggtggcgtgctcccaggagctcggttccccggtgtgggggtgctccctggagttcccactggagcaggagttaagcccaaggctccaggtgtaggtggagcttttgctggaatcccaggagttggaccctttgggggaccgcaacctggagtcccactggggtatcccatcaaggcccccaagctgcctggtggctatggactgccctacaccacagggaaactgccctatggctatgggcccggaggagtggctggtgcagcgggcaaggctggttacccaacagggacaggggttggcccccaggcagcagcagcagcggcagctaaagcagcagcaaagttcggtgctggagcagccggagtcctccctggtgttggaggggctggtgttcctggcgtgcctggggcaattcctggaattggaggcatcgcaggcgttgggactccagctgcagctgcagctgcagcagcagccgctaaggcagccaagtatggagctgctgcaggcttagtgcctggtgggccaggctttggcccgggagtagttggtgtcccaggagctggcgttccaggtgttggtgtcccaggagctgggattccagttgtcccaggtgctgggatcccaggtgctgcggttccaggggttgtgtcaccagaagcagctgctaaggcagctgcaaaggcagccaaatacggggccaggcccggagtcggagttggaggcattcctacttacggggttggagctgggggctttcccggctttggtgtcggagtcggaggtatccctggagtcgcaggtgtccctggtgtcggaggtgttcccggagtcggaggtgtcccgggagttggcatttcccccgaagctcaggcagcagctgccgccaaggctgccaagtacgggttagttcctggtgtcggcgtggctcctggagttggcgtggctcctggtgtcggtgtggctcctggagttggcttggctcctggagttggcgtggctcctggagttggtgtggctcctggcgttggcgtggctcccggcattggccctggtggagttgcagctgcagcaaaatccgctgccaaggtggctgccaaagcccagctccgagctgcagctgggcttggtgctggcatccctggacttggagttggtgtcggcgtccctggacttggagttggtgctggtgttcctggacttggagttggtgctggtgttcctggcttcggggcagtacctggagccctggctgccgctaaagcagccaaatatggagcagcagtgcctggggtccttggagggctcggggctctcggtggagtaggcatcccaggcggtgtggtgggagccggacccgccgccgccgctgccgcagccaaagctgctgccaaagccgcccagtttggcctagtgggagccgctgggctcggaggactcggagtcggagggcttggagttccaggtgttgggggccttggaggtatacctccagctgcagccgctaaagcagctaaatacggtgctgctggccttggaggtgtcctagggggtgccgggcagttcccacttggaggagtggcagcaagacctggcttcggattgtctcccattttcccaggtggggcctgcctggggaaagcttgtggccggaagagaaaatgagcttcctaggacccctgactcacgacctcatcaacgttggtgctactgcttggtggagaatgtaaaccctttgtaaccccatcccatgcccctccgactccccaccccaggagggaacgggcaggccgggcggccttgcagatccacagggcaaggaaacaagaggggagcggccaagtgccccgaccaggaggccccctacttcagaggcaagggccatgtggtcctggccccccaccccatcccttcccacctaggagctccccctccacacagcctccatctccaggggaacttggtgctacacgctggtgctcttatcttcctggggggagggaggagggaagggtggcccctcggggaaccccctacctggggctcctctaaagatggtgcagacacttcctgggcagtcccagctccccctgcccaccaggacccaccgttggctgccatccagttggtacccaagcacctgaagcctcaaagctggattcgctctagcatccctcctctcctgggtccacttggccgtctcctccccaccgatcgctgttccccacatctggggcgcttttgggttggaaaaccaccccacactgggaatagccaccttgcccttgtagaatccatccgcccatccgtccattcatccatcggtccgtccatccatgtccccagttgaccgcccggcaccactagctggctgggtgcacccaccatcaacctggttgacctgtcatggccgcctgtgccctgcctccacccccatcctacactcccccagggcgtgcggggctgtgcagactggggtgccaggcatctcctccccacccggggtgtccccacatgcagtactgtataccccccatccctccctcggtccactgaacttcagagcagttcccattcctgccccgcccatctttttgtgtctcgctgtgatagatcaataaatattttattttttgtcctggatatttggggattatttttgattgttgatattctcttttggttttattgttgtggttcattgaaaaaaaaagataatttttttttctgatccggggagctgtatccccagtagaaaaaacattttaatcactctaatataactctggatgaaacacacctttttttttaataagaaaagagaattaactgcttcagaaatgactaataaatgaaaaacctttaaaggaaaaaaaaaaa

SEQ ID NO: 446316 - DNA, 3489 bp, Homo sapiens
cgacgaggcaacaattaggctttggggataaaacgaggtgcggagagcgggctggggcatttctccccgagatggcgggtctgacggcggcggccccgcggcccggagtcctcctgctcctgctgtccatcctccacccctctcggcctggaggggtccctggggccattcctggtggagttcctggaggagtcttttatccaggggctggtctcggagcccttggaggaggagcgctggggcctggaggcaaacctcttaagccagttcccggagggcttgcgggtgctggccttggggcagggctcggcgccttccccgcagttacctttccgggggctctggtgcctggtggagtggctgacgctgctgcagcctataaagctgctaaggctggcgctgggcttggtggtgtcccaggagttggtggcttaggagtgtctgcaggtgcggtggttcctcagcctggagccggagtgaagcctgggaaagtgccgggtgtggggctgccaggtgtatacccaggtggcgtgctcccaggagctcggttccccggtgtgggggtgctccctggagttcccactggagcaggagttaagcccaaggctccaggtgtaggtggagcttttgctggaatcccaggagttggaccctttgggggaccgcaacctggagtcccactggggtatcccatcaaggcccccaagctgcctggtggctatggactgccctacaccacagggaaactgccctatggctatgggcccggaggagtggctggtgcagcgggcaaggctggttacccaacagggacaggggttggcccccaggcagcagcagcagcggcagctaaagcagcagcaaagttcggtgctggagcagccggagtcctccctggtgttggaggggctggtgttcctggcgtgcctggggcaattcctggaattggaggcatcgcaggcgttgggactccagctgcagctgcagctgcagcagcagccgctaaggcagccaagtatggagctgctgcaggcttagtgcctggtgggccaggctttggcccgggagtagttggtgtcccaggagctggcgttccaggtgttggtgtcccaggagctgggattccagttgtcccaggtgctgggatcccaggtgctgcggttccaggggttgtgtcaccagaagcagctgctaaggcagctgcaaaggcagccaaatacggggccaggcccggagtcggagttggaggcattcctacttacggggttggagctgggggctttcccggctttggtgtcggagtcggaggtatccctggagtcgcaggtgtccctggtgtcggaggtgttcccggagtcggaggtgtcccgggagttggcatttcccccgaagctcaggcagcagctgccgccaaggctgccaagtacgggttagttcctggtgtcggcgtggctcctggagttggcgtggctcctggtgtcggtgtggctcctggagttggcttggctcctggagttggcgtggctcctggagttggtgtggctcctggcgttggcgtggctcccggcattggccctggtggagttgcagctgcagcaaaatccgctgccaaggtggctgccaaagcccagctccgagctgcagctgggcttggtgctggcatccctggacttggagttggtgtcggcgtccctggacttggagttggtgctggtgttcctggacttggagttggtgctggtgttcctggcttcggggcagtacctggagccctggctgccgctaaagcagccaaatatggagcagcagtgcctggggtccttggagggctcggggctctcggtggagtaggcatcccaggcggtgtggtgggtgagttgaaaccccaggaggggcagggtggggagggaatctaaccagtacagagtgcctccctgaactcggtctgtgttcccaggagccggacccgccgccgccgctgccgcagccaaagctgctgccaaagccgcccagtttggcctagtgggagccgctgggctcggaggactcggagtcggagggcttggagttccaggtgttgggggccttggaggtatacctccagctgcagccgctaaagcagctaaatacggtgctgctggccttggaggtgtcctagggggtgccgggcagttcccacttggaggagtggcagcaagacctggcttcggattgtctcccattttcccaggtggggcctgcctggggaaagcttgtggccggaagagaaaatgagcttcctaggacccctgactcacgacctcatcaacgttggtgctactgcttggtggagaatgtaaaccctttgtaaccccatcccatgcccctccgactccccaccccaggagggaacgggcaggccgggcggccttgcagatccacagggcaaggaaacaagaggggagcggccaagtgccccgaccaggaggccccctacttcagaggcaagggccatgtggtcctggccccccaccccatcccttcccacctaggagctccccctccacacagcctccatctccaggggaacttggtgctacacgctggtgctcttatcttcctggggggagggaggagggaagggtggcccctcggggaaccccctacctggggctcctctaaagatggtgcagacacttcctgggcagtcccagctccccctgcccaccaggacccaccgttggctgccatccagttggtacccaagcacctgaagcctcaaagctggattcgctctagcatccctcctctcctgggtccacttggccgtctcctccccaccgatcgctgttccccacatctggggcgcttttgggttggaaaaccaccccacactgggaatagccaccttgcccttgtagaatccatccgcccatccgtccattcatccatcggtccgtccatccatgtccccagttgaccgcccggcaccactagctggctgggtgcacccaccatcaacctggttgacctgtcatggccgcctgtgccctgcctccacccccatcctacactcccccagggcgtgcggggctgtgcagactggggtgccaggcatctcctccccacccggggtgtccccacatgcagtactgtataccccccatccctccctcggtccactgaacttcagagcagttcccattcctgccccgcccatctttttgtgtctcgctgtgatagatcaataaatattttattttttgtcctggatatttggggattatttttgattgttgatattctcttttggttttattgttgtggttcattgaaaaaaaaagataatttttttttctgatccggggagctgtatccccagtagaaaaaacattttaatcactctaatataactctggatgaaacacacctttttttttaataagaaaagagaattaactgcttcagaaatgactaataaatgaaaaacctttaaaggaaaaaaaaaaa

SEQ ID NO: 446317 - DNA, 2816 bp, Homo sapiens
cgacgaggcaacaattaggctttggggataaaacgaggtgcggagagcgggctggggcatttctccccgagatggcgggtctgacggcggcggccccgcggcccggagtcctcctgctcctgctgtccatcctccacccctctcggcctggaggggtccctggggccattcctggtggagttcctggaggagtcttttatccaggggctggtctcggagcccttggaggaggagcgctggggcctggaggcaaacctcttaagccagttcccggagggcttgcgggtgctggccttggggcagggctcggcgccttccccgcagttacctttccgggggctctggtgcctggtggagtggctgacgctgctgcagcctataaagctgctaaggctggcgctgggcttggtggtgtcccaggagttggtggcttaggagtgtctgcaggtgcggtggttcctcagcctggagccggagtgaagcctgggaaagtgccgggtgtggggctgccaggtgtatacccaggtggcgtgctcccaggagctcggttccccggtgtgggggtgctccctggagttcccactggagcaggagttaagcccaaggctccaggtgtaggtggagcttttgctggaatcccaggagttggaccctttgggggaccgcaacctggagtcccactggggtatcccatcaaggcccccaagctgcctggtggctatggactgccctacaccacagggaaactgccctatggctatgggcccggaggagtggctggtgcagcgggcaaggctggttacccaacagggacaggggttggcccccaggcagcagcagcagcggcagctaaagcagcagcaaagttcggtgctggagcagccggagtcctccctggtgttggaggggctggtgttcctggcgtgcctggggcaattcctggaattggaggcatcgcaggcgttgggactccagctgcagctgcagctgcagcagcagccgctaaggcagccaagtatggagctgctgcaggcttagtgcctggtgggccaggctttggcccgggagtagttggtgtcccaggagctggcgttccaggtgttggtgtcccaggagctgggattccagttgtcccaggtgctgggatcccaggtgctgcggttccaggggttgtgtcaccagaagcagctgctaaggcagctgcaaaggcagccaaatacggggccaggcccggagtcggagttggaggcattcctacttacggggttggagctgggggctttcccggctttggtgtcggagtcggaggtatccctggagtcgcaggtgtccctggtgtcggaggtgttcccggagtcggaggtgtcccgggagttggcatttcccccgaagctcaggcagcagctgccgccaaggctgccaagtacggagtggggaccccagcagctgcagctgctaaagcagccgccaaagccgcccagtttgctcttctcaatcttgcagggttagttcctggtgtcggcgtggctcctggagttggcgtggctcctggtgtcggtgtggctcctggagttggcttggctcctggagttggcgtggctcctggagttggtgtggctcctggcgttggcgtggctcccggcattggccctggtggagttgcagctgcagcaaaatccgctgccaaggtggctgccaaagcccagctccgagctgcagctgggcttggtgctggcatccctggacttggagttggtgtcggcgtccctggacttggagttggtgctggtgttcctggacttggagttggtgctggtgttcctggcttcggggcagtacctggagccctggctgccgctaaagcagccaaatatggagcagcagtgcctggggtccttggagggctcggggctctcggtggagtaggcatcccaggcggtgtggtgggagccggacccgccgccgccgctgccgcagccaaagctgctgccaaagccgcccagtttggcctagtgggagccgctgggctcggaggactcggagtcggagggcttggagttccaggtgttgggggccttggaggtatacctccagctgcagccgctaaagcagctaaatacggtgctgctggccttggaggtgtcctagggggtgccgggcagttcccacttggaggagtggcagcaagacctggcttcggattgtctcccattttcccaggtggggcctgcctggggaaagcttgtggccggaagagaaaatgagcttcctaggacccctgactcacgacctcatcaacgttggtgctactgcttggtggagaatgtaaaccctttgtaaccccatcccatgcccctccgactccccaccccaggagggaacgggcaggccgggcggccttgcagatccacagggcaaggaaacaagaggggagcggctgggaatagccaccttgcccttgtagaatccatccgcccatccgtccattcatccatcggtccgtccatccatgtccccagttgaccgcccggcaccactagctggctgggtgcacccaccatcaacctggttgacctgtcatggccgcctgtgccctgcctccacccccatcctacactcccccagggcgtgcggggctgtgcagactggggtgccaggcatctcctccccacccggggtgtccccacatgcagtactgtataccccccatccctccctcggtccactgaacttcagagcagttcccattcctgccccgcccatctttttgtgtctcgctgtgatagatcaataaatattttattttttgtcctgga

SEQ ID NO: 446318 - DNA, 2696 bp, Homo sapiens
gagggagagagaaagaaagaaagagagagagagagagagaaagaaagaaagaaagagaaaggaagaaaagaaaagaaaagaaaaagaaagagatcacattcctccagctcactgattcaaatcctagagctctttagggaccctcttagtctctccacatctctctgatgagtaggatccatgcagaggaaatgtcaacccacctgcaatcctgcattcaggaccaactgtcacttccatactctactaaccacccttctagcccctctgaggttcccataggttaggggaacaatgctttttcttccacaggagctgctgcaggcttagtgcctggtgggccaggctttggcccgggagtagttggtgtcccaggagctggcgttccaggtgttggtgtcccaggagctgggattccagttgtcccaggtgctgggatcccaggtgctgcggttccaggggttgtgtcaccagaagcagctgctaaggcagctgcaaaggcagccaaatacggggccaggcccggagtcggagttggaggcattcctacttacggggttggagctgggggctttcccggctttggtgtcggagtcggaggtatccctggagtcgcaggtgtccctggtgtcggaggtgttcccggagtcggaggtgtcccgggagttggcatttcccccgaagctcaggcagcagctgccgccaaggctgccaagtacgggttagttcctggtgtcggcgtggctcctggagttggcgtggctcctggtgtcggtgtggctcctggagttggcttggctcctggagttggcgtggctcctggagttggtgtggctcctggcgttggcgtggctcccggcattggccctggtggagttgcagctgcagcaaaatccgctgccaaggtggctgccaaagcccagctccgagctgcagctgggcttggtgctggcatccctggacttggagttggtgtcggcgtccctggacttggagttggtgctggtgttcctggacttggagttggtgctggtgttcctggcttcggggcagtacctggagccctggctgccgctaaagcagccaaatatggagcagcagtgcctggggtccttggagggctcggggctctcggtggagtaggcatcccaggcggtgtggtgggagccggacccgccgccgccgctgccgcagccaaagctgctgccaaagccgcccagtttggcctagtgggagccgctgggctcggaggactcggagtcggagggcttggagttccaggtgttgggggccttggaggtatacctccagctgcagccgctaaagcagctaaatacggtgctgctggccttggaggtgtcctagggggtgccgggcagttcccacttggaggagtggcagcaagacctggcttcggattgtctcccattttcccaggtggggcctgcctggggaaagcttgtggccggaagagaaaatgagcttcctaggacccctgactcacgacctcatcaacgttggtgctactgcttggtggagaatgtaaaccctttgtaaccccatcccatgcccctccgactccccaccccaggagggaacgggcaggccgggcggccttgcagatccacagggcaaggaaacaagaggggagcggccaagtgccccgaccaggaggccccctacttcagaggcaagggccatgtggtcctggccccccaccccatcccttcccacctaggagctccccctccacacagcctccatctccaggggaacttggtgctacacgctggtgctcttatcttcctggggggagggaggagggaagggtggcccctcggggaaccccctacctggggctcctctaaagatggtgcagacacttcctgggcagtcccagctccccctgcccaccaggacccaccgttggctgccatccagttggtacccaagcacctgaagcctcaaagctggattcgctctagcatccctcctctcctgggtccacttggccgtctcctccccaccgatcgctgttccccacatctggggcgcttttgggttggaaaaccaccccacactgggaatagccaccttgcccttgtagaatccatccgcccatccgtccattcatccatcggtccgtccatccatgtccccagttgaccgcccggcaccactagctggctgggtgcacccaccatcaacctggttgacctgtcatggccgcctgtgccctgcctccacccccatcctacactcccccagggcgtgcggggctgtgcagactggggtgccaggcatctcctccccacccggggtgtccccacatgcagtactgtataccccccatccctccctcggtccactgaacttcagagcagttcccattcctgccccgcccatctttttgtgtctcgctgtgatagatcaataaatattttattttttgtcctggatatttggggattatttttgattgttgatattctcttttggttttattgttgtggttcattgaaaaaaaaagataatttttttttctgatccggggagctgtatccccagtagaaaaaacattttaatcactctaatataactctggatgaaacacacctttttttttaataagaaaagagaattaactgcttcagaaatgactaataaatgaaaaacctttaaaggaaaaaaaaaaa

SEQ ID NO: 446319 - DNA, 2404 bp, Homo sapiens
tgctaggattacaggcatgagccactgcacccggccccacattttttttaaatggcttcatggtggaggtgctggggacccaggcatcccagttttctgtcttttatggacaaggcctgggggaaatttacatcctctttcccaatccatcagcatccctcagagcccgcccagcctctctcactgagcttcttttctacttggctcccttccctctgcaggggccaggcccggagtcggagttggaggcattcctacttacggggttggagctgggggctttcccggctttggtgtcggagtcggaggtatccctggagtcgcaggtgtccctggtgtcggaggtgttcccggagtcggaggtgtcccgggagttggcatttcccccgaagctcaggcagcagctgccgccaaggctgccaagtacgggttagttcctggtgtcggcgtggctcctggagttggcgtggctcctggtgtcggtgtggctcctggagttggcttggctcctggagttggcgtggctcctggagttggtgtggctcctggcgttggcgtggctcccggcattggccctggtggagttgcagctgcagcaaaatccgctgccaaggtggctgccaaagcccagctccgagctgcagctgggcttggtgctggcatccctggacttggagttggtgtcggcgtccctggacttggagttggtgctggtgttcctggacttggagttggtgctggtgttcctggcttcggggcagtacctggagccctggctgccgctaaagcagccaaatatggagcagcagtgcctggggtccttggagggctcggggctctcggtggagtaggcatcccaggcggtgtggtgggagccggacccgccgccgccgctgccgcagccaaagctgctgccaaagccgcccagtttggcctagtgggagccgctgggctcggaggactcggagtcggagggcttggagttccaggtgttgggggccttggaggtatacctccagctgcagccgctaaagcagctaaatacggtgctgctggccttggaggtgtcctagggggtgccgggcagttcccacttggaggagtggcagcaagacctggcttcggattgtctcccattttcccaggtggggcctgcctggggaaagcttgtggccggaagagaaaatgagcttcctaggacccctgactcacgacctcatcaacgttggtgctactgcttggtggagaatgtaaaccctttgtaaccccatcccatgcccctccgactccccaccccaggagggaacgggcaggccgggcggccttgcagatccacagggcaaggaaacaagaggggagcggccaagtgccccgaccaggaggccccctacttcagaggcaagggccatgtggtcctggccccccaccccatcccttcccacctaggagctccccctccacacagcctccatctccaggggaacttggtgctacacgctggtgctcttatcttcctggggggagggaggagggaagggtggcccctcggggaaccccctacctggggctcctctaaagatggtgcagacacttcctgggcagtcccagctccccctgcccaccaggacccaccgttggctgccatccagttggtacccaagcacctgaagcctcaaagctggattcgctctagcatccctcctctcctgggtccacttggccgtctcctccccaccgatcgctgttccccacatctggggcgcttttgggttggaaaaccaccccacactgggaatagccaccttgcccttgtagaatccatccgcccatccgtccattcatccatcggtccgtccatccatgtccccagttgaccgcccggcaccactagctggctgggtgcacccaccatcaacctggttgacctgtcatggccgcctgtgccctgcctccacccccatcctacactcccccagggcgtgcggggctgtgcagactggggtgccaggcatctcctccccacccggggtgtccccacatgcagtactgtataccccccatccctccctcggtccactgaacttcagagcagttcccattcctgccccgcccatctttttgtgtctcgctgtgatagatcaataaatattttattttttgtcctggatatttggggattatttttgattgttgatattctcttttggttttattgttgtggttcattgaaaaaaaaagataatttttttttctgatccggggagctgtatccccagtagaaaaaacattttaatcactctaatataactctggatgaaacacacctttttttttaataagaaaagagaattaactgcttcagaaatgactaataaatgaaaaacctttaaaggaaaaaaaaaaa

SEQ ID NO: 446320 - DNA, 2751 bp, Homo sapiens
cgacgaggcaacaattaggctttggggataaaacgaggtgcggagagcgggctggggcatttctccccgagatggcgggtctgacggcggcggccccgcggcccggagtcctcctgctcctgctgtccatcctccacccctctcggcctggaggggtccctggggccattcctggtggagttcctggaggagtcttttatccaggggctggtctcggagcccttggaggaggagcgctggggcctggaggcaaacctcttaagccagttcccggagggcttgcgggtgctggccttggggcagggctcggcgccttccccgcagttacctttccgggggctctggtgcctggtggagtggctgacgctgctgcagcctataaagctgctaaggctggcgctgggcttggtggtgtcccaggagttggtggcttaggagtgtctgcaggtgcggtggttcctcagcctggagccggagtgaagcctgggaaagtgccgggtgtggggctgccaggtgtatacccaggtggcgtgctcccaggagctcggttccccggtgtgggggtgctccctggagttcccactggagcaggagttaagcccaaggctccaggtgtaggtggagcttttgctggaatcccaggagttggaccctttgggggaccgcaacctggagtcccactggggtatcccatcaaggcccccaagctgcctggtggctatggactgccctacaccacagggaaactgccctatggctatgggcccggaggagtggctggtgcagcgggcaaggctggttacccaacagggacaggggttggcccccaggcagcagcagcagcggcagctaaagcagcagcaaagttcggtgctggagcagccggagtcctccctggtgttggaggggctggtgttcctggcgtgcctggggcaattcctggaattggaggcatcgcaggcgttgggactccagctgcagctgcagctgcagcagcagccgctaaggcagccaagtatggagctgctgcaggcttagtgcctggtgggccaggctttggcccgggagtagttggtgtcccaggagctggcgttccaggtgttggtgtcccaggagctgggattccagttgtcccaggtgctgggatcccaggtgctgcggttccaggggttgtgtcaccagaagcagctgctaaggcagctgcaaaggcagccaaatacggggccaggcccggagtcggagttggaggcattcctacttacggggttggagctgggggctttcccggctttggtgtcggagtcggaggtatccctggagtcgcaggtgtccctggtgtcggaggtgttcccggagtcggaggtgtcccgggagttggcatttcccccgaagctcaggcagcagctgccgccaaggctgccaagtacggagtggggaccccagcagctgcagctgctaaagcagccgccaaagccgcccagtttgctcttctcaatcttgcagggttagttcctggtgtcggcgtggctcctggagttggcgtggctcctggtgtcggtgtggctcctggagttggcttggctcctggagttggcgtggctcctggagttggtgtggctcctggcgttggcgtggctcccggcattggccctggtggagttgcagctgcagcaaaatccgctgccaaggtggctgccaaagcccagctccgagctgcagctgggcttggtgctggcatccctggacttggagttggtgtcggcgtccctggacttggagttggtgctggtgttcctggacttggagttggtgctggtgttcctggcttcggggcagtacctggagccctggctgccgctaaagcagccaaatatggagcagcagtgcctggggtccttggagggctcggggctctcggtggagtaggcatcccaggcggtgtggtgggagccggacccgccgccgccgctgccgcagccaaagctgctgccaaagccgcccagtttggcctagtgggagccgctgggctcggaggactcggagtcggagggcttggagttccaggtgttgggggccttggaggtatacctccagctgcagccgctaaagcagctaaatacggtgctgctggccttggaggtgtcctagggggtgccgggcagttcccacttggaggagtggcagcaagacctggcttcggattgtctcccattttcccaggtggggcctgcctggggaaagcttgtggccggaagagaaaatgagcttcctaggacccctgactcacgacctcatcaacgttggtgctactgcttggtggagaatgtaaaccctttgtaaccccatcccatgcccctccgactccccaccccaggagggaacgggcaggccgggcggccttgcagatccacagggcaaggaaacaagaggggagcggccaagtgccccgaccaggaggccccctacttcagaggcaagggccatgtggtcctggccccccaccccatcccttcccacctaggagctccccctccacacagcctccatctccaggggaacttggtgctacacgctggtgctcttatcttcctggggggagaataggtctttttttcacttatgattaatggagaactgggagcgtattttcctgactaatgcgtggatgtttattctaatcattgtcatactcacttgtgtaggaacttgtatcaccttgggaattcattgatatatttcctattataaagg

SEQ ID NO: 446321 - DNA, 2346 bp, Homo sapiens
gttcctttataacatagtagtgaaggctgcatggaggaagccccatggaccaaggaagcccaagggagtcgcttaactcagcaggggttcaggaaggcattctagaggaggtgggtggggaaatttgaccccaaaagatccatgcagttttcaggaaggctggagtgcagtggctcagtctcagctccccgcacctggtgcagttgatctcagctcaccacaacctccacctccccggttcaagtgattcttgtgtctcagcctcccaaatactgggattacaggcgcccgccaccacgcctggctaatttttgtatttttcgtagaaacagggtttcaccgtgttggccaggctggtctcaaactcctgacctcaggtgatctgccacctcagcctcccaaagtgctgggattacaggtgtgagccaccgcacccggcttacaaaagaacttttaaggccaggcacagtggttcacaccttcgggaggctaaggcaggaggatcgcatgagcccaggagttggaggctgcagtgaactatgattgtaccactgcactccagccggggtgacagagcaaaaccccatctcaaaatgaaacaaaatatggactggacttcctgtccactgctcctccacagtgtcacatggcccctgccacctgtctgcttgccttgtgtccctggggcagggagacccatcgttcagaaatggaacactcattttccctcctctccccgcaggagcagcagtgcctggggtccttggagggctcggggctctcggtggagtaggcatcccaggcggtgtggtgggagccggacccgccgccgccgctgccgcagccaaagctgctgccaaagccgcccagtttggcctagtgggagccgctgggctcggaggactcggagtcggagggcttggagttccaggtgttgggggccttggaggtatacctccagctgcagccgctaaagcagctaaatacggtgctgctggccttggaggtgtcctagggggtgccgggcagttcccacttggaggagtggcagcaagacctggcttcggattgtctcccattttcccaggtggggcctgcctggggaaagcttgtggccggaagagaaaatgagcttcctaggacccctgactcacgacctcatcaacgttggtgctactgcttggtggagaatgtaaaccctttgtaaccccatcccatgcccctccgactccccaccccaggagggaacgggcaggccgggcggccttgcagatccacagggcaaggaaacaagaggggagcggccaagtgccccgaccaggaggccccctacttcagaggcaagggccatgtggtcctggccccccaccccatcccttcccacctaggagctccccctccacacagcctccatctccaggggaacttggtgctacacgctggtgctcttatcttcctggggggagggaggagggaagggtggcccctcggggaaccccctacctggggctcctctaaagatggtgcagacacttcctgggcagtcccagctccccctgcccaccaggacccaccgttggctgccatccagttggtacccaagcacctgaagcctcaaagctggattcgctctagcatccctcctctcctgggtccacttggccgtctcctccccaccgatcgctgttccccacatctggggcgcttttgggttggaaaaccaccccacactgggaatagccaccttgcccttgtagaatccatccgcccatccgtccattcatccatcggtccgtccatccatgtccccagttgaccgcccggcaccactagctggctgggtgcacccaccatcaacctggttgacctgtcatggccgcctgtgccctgcctccacccccatcctacactcccccagggcgtgcggggctgtgcagactggggtgccaggcatctcctccccacccggggtgtccccacatgcagtactgtataccccccatccctccctcggtccactgaacttcagagcagttcccattcctgccccgcccatctttttgtgtctcgctgtgatagatcaataaatattttattttttgtcctggatatttggggattatttttgattgttgatattctcttttggttttattgttgtggttcattgaaaaaaaaagataatttttttttctgatccggggagctgtatccccagtagaaaaaacattttaatcactctaatataactctggatgaaacacacctttttttttaataagaaaagagaattaactgcttcagaaatgactaataaatgaaaaacctttaaaggaaaaaaaaaaa

SEQ ID NO: 446322 - DNA, 1624 bp, Homo sapiens
ccagacacctcctggctccactgtgccatcgaaggccaggggagacctcaggctccacctgtgtccccagaggacacctccgccctccacaggccgaggcttcagtcccacctttctgaccagcggagtctaatgctcagctgtctccacaggcctagtgggagccgctgggctcggaggactcggagtcggagggcttggagttccaggtgttgggggccttggaggtatacctccagctgcagccgctaaagcagctaaatacggtgctgctggccttggaggtgtcctagggggtgccgggcagttcccacttggaggagtggcagcaagacctggcttcggattgtctcccattttcccaggtggggcctgcctggggaaagcttgtggccggaagagaaaatgagcttcctaggacccctgactcacgacctcatcaacgttggtgctactgcttggtggagaatgtaaaccctttgtaaccccatcccatgcccctccgactccccaccccaggagggaacgggcaggccgggcggccttgcagatccacagggcaaggaaacaagaggggagcggccaagtgccccgaccaggaggccccctacttcagaggcaagggccatgtggtcctggccccccaccccatcccttcccacctaggagctccccctccacacagcctccatctccaggggaacttggtgctacacgctggtgctcttatcttcctggggggagggaggagggaagggtggcccctcggggaaccccctacctggggctcctctaaagatggtgcagacacttcctgggcagtcccagctccccctgcccaccaggacccaccgttggctgccatccagttggtacccaagcacctgaagcctcaaagctggattcgctctagcatccctcctctcctgggtccacttggccgtctcctccccaccgatcgctgttccccacatctggggcgcttttgggttggaaaaccaccccacactgggaatagccaccttgcccttgtagaatccatccgcccatccgtccattcatccatcggtccgtccatccatgtccccagttgaccgcccggcaccactagctggctgggtgcacccaccatcaacctggttgacctgtcatggccgcctgtgccctgcctccacccccatcctacactcccccagggcgtgcggggctgtgcagactggggtgccaggcatctcctccccacccggggtgtccccacatgcagtactgtataccccccatccctccctcggtccactgaacttcagagcagttcccattcctgccccgcccatctttttgtgtctcgctgtgatagatcaataaatattttattttttgtcctggatatttggggattatttttgattgttgatattctcttttggttttattgttgtggttcattgaaaaaaaaagataatttttttttctgatccggggagctgtatccccagtagaaaaaacattttaatcactctaatataactctggatgaaacacacctttttttttaataagaaaagagaattaactgcttcagaaatgactaataaatgaaaaacctttaaaggaaaaaaaaaaa

SEQ ID NO: 446323 - DNA, 2687 bp, Homo sapiens
cgacgaggcaacaattaggctttggggataaaacgaggtgcggagagcgggctggggcatttctccccgagatggcgggtctgacggcggcggccccgcggcccggagtcctcctgctcctgctgtccatcctccacccctctcggcctggaggggtccctggggccattcctggtggagttcctggaggagtcttttatccaggggctggtctcggagcccttggaggaggagcgctggggcctggaggcaaacctcttaagccagttcccggagggcttgcgggtgctggccttggggcagggctcggcgccttccccgcagttacctttccgggggctctggtgcctggtggagtggctgacgctgctgcagcctataaagctgctaaggctggcgctgggcttggtggtgtcccaggagttggtggcttaggagtgtctgcaggtgcggtggttcctcagcctggagccggagtgaagcctgggaaagtgccgggtgtggggctgccaggtgtatacccaggtggcgtgctcccaggagctcggttccccggtgtgggggtgctccctggagttcccactggagcaggagttaagcccaaggctccaggtgtaggtggagcttttgctggaatcccaggagttggaccctttgggggaccgcaacctggagtcccactggggtatcccatcaaggcccccaagctgcctggtggctatggactgccctacaccacagggaaactgccctatggctatgggcccggaggagtggctggtgcagcgggcaaggctggttacccaacagggacaggggttggcccccaggcagcagcagcagcggcagctaaagcagcagcaaagttcggtgctggagcagccggagtcctccctggtgttggaggggctggtgttcctggcgtgcctggggcaattcctggaattggaggcatcgcaggcgttgggactccagctgcagctgcagctgcagcagcagccgctaaggcagccaagtatggagctgctgcaggcttagtgcctggtgggccaggctttggcccgggagtagttggtgtcccaggagctggcgttccaggtgttggtgtcccaggagctgggattccagttgtcccaggtgctgggatcccaggtgctgcggttccaggggttgtgtcaccagaagcagctgctaaggcagctgcaaaggcagccaaatacggggccaggcccggagtcggagttggaggcattcctacttacggggttggagctgggggctttcccggctttggtgtcggagtcggaggtatccctggagtcgcaggtgtccctggtgtcggaggtgttcccggagtcggaggtgtcccgggagttggcatttcccccgaagctcaggcagcagctgccgccaaggctgccaagtacgggttagttcctggtgtcggcgtggctcctggagttggcgtggctcctggtgtcggtgtggctcctggagttggcttggctcctggagttggcgtggctcctggagttggtgtggctcctggcgttggcgtggctcccggcattggccctggtggagttgcagctgcagcaaaatccgctgccaaggtggctgccaaagcccagctccgagctgcagctgggcttggtgctggcatccctggacttggagttggtgtcggcgtccctggacttggagttggtgctggtgttcctggacttggagttggtgctggtgttcctggcttcggggcagtacctggagccctggctgccgctaaagcagccaaatatggagcagcagtgcctggggtccttggagggctcggggctctcggtggagtaggcatcccaggcggtgtggtgggagccggacccgccgccgccgctgccgcagccaaagctgctgccaaagccgcccagtttggcctagtgggagccgctgggctcggaggactcggagtcggagggcttggagttccaggtgttgggggccttggaggtatacctccagctgcagccgctaaagcagctaaatacggagtggcagcaagacctggcttcggattgtctcccattttcccaggtggggcctgcctggggaaagcttgtggccggaagagaaaatgagcttcctaggacccctgactcacgacctcatcaacgttggtgctactgcttggtggagaatgtaaaccctttgtaaccccatcccatgcccctccgactccccaccccaggagggaacgggcaggccgggcggccttgcagatccacagggcaaggaaacaagaggggagcggctgggaatagccaccttgcccttgtagaatccatccgcccatccgtccattcatccatcggtccgtccatccatgtccccagttgaccgcccggcaccactagctggctgggtgcacccaccatcaacctggttgacctgtcatggccgcctgtgccctgcctccacccccatcctacactcccccagggcgtgcggggctgtgcagactggggtgccaggcatctcctccccacccggggtgtccccacatgcagtactgtataccccccatccctccctcggtccactgaacttcagagcagttcccattcctgccccgcccatctttttgtgtctcgctgtgatagatcaataaatattttattttttgtcctgga

SEQ ID NO: 446324 - DNA, 1166 bp, Homo sapiens
cgacgaggcaacaattaggctttggggataaaacgaggtgcggagagcgggctggggcatttctccccgagatggcgggtctgacggcggcggccccgcggcccggagtcctcctgctcctgctgtccatcctccacccctctcggcctggaggggtccctggggccattcctggtggagttcctggaggagtcttttatccaggggctggtctcggagcccttggaggaggagcgctggggcctggaggcaaacctcttaagccagttcccggagggcttgcgggtgctggccttggggcagggctcggcgccttccccgcagttacctttccgggggctctggtgcctggtggagtggctgacgctgctgcagcctataaagctgctaaggctggcgctgggcttggtggtgtcccaggagttggtggcttaggagtgtctgcaggtgcggtggttcctcagcctggagccggagtgaagcctgggaaagtgccgggtgtggggctgccaggtgtatacccaggtggcgtgctcccaggagctcggttccccggtgtgggggtgctccctggagttcccactggagcaggagttaagcccaaggctccaggtgtaggtggagcttttgctggaatcccaggagttggaccctttgggggaccgcaacctggagtcccactggggtatcccatcaaggcccccaagctgcctggtggctatggactgccctacaccacagggaaactgccctatggctatgggcccggaggagtggctggtgcagcgggcaaggctggttacccaacagggacaggggttggcccccaggcagcagcagcagcggcagctaaagcagcagcaaagttcggtgctggagcagccggagtcctccctggtgttggaggggctggtgttcctggcgtgcctggggcaattcctggaattggaggcatcgcaggcgttgggactccagctgcagctgcagctgcagcagcagccgctaaggcagccaagtatggtgagtgcctcccggggtggcaagtccacggctcgggcccctgcatagacctcggagaccctagccgcaaagccagatggacttggcctttgttccttcccaaatatgcattgttcatgcctccttacctttgccccttctgatca

SEQ ID NO: 446325 - DNA, 735 bp, Homo sapiens
cacggactctgctctgtcccagcccttgctgaaagccctgctgaatcttgttagccagcagggcttctaggagaagcacaggcctggcccaggcttgttagggatcggtgcaatgacacctgcactgcacatagtagtcgctcactaaactactggtggatgctattttatcaggatcgaccctgagcatcacaggcttagggaccagcctagggacctgagtggctgatcacagcactgccctaactccaggagacatttcccactctgggcctaggaacactgcctacactcctgtctctgtttcttatccacagttcccggagggcttgcgggtgctggccttggggcaggtgagtgctgacacccaagaaagatatcccctgtggggaccagcccctgagctcaacccagggctggtatgcagcacggtcatggaacaagggtgcaggccaggttccgtcctgggcactgacggggactgatgctgataccaactgccccaagcagctgcccaggacatgaggaaatcacagctgagtacctgggttcctttataacatagtagtgaaggctgcatggaggaagccccatggaccaaggaagcccaagggagtcgcttaactcagcaggggttcaggaaggcattctagaggaggtgggtggggaaatttgaccccaaaagatccatgcagttttcaggaaggctgaagtgagaggatcccttgagcccag

SEQ ID NO: 446326 - DNA, 617 bp, Homo sapiens
aggattacaggcgtgagccaccacccccagcccatcatccccttttgaggctgagactctgggactcagagagtataaaccacgagttagaagtagagctaggttcccaggggctccaagtctgagcgggaggacctggggtgtgtgattccacactgcccacactttgcccgggttgggggttggataagtagtagatggataagctgggccaccccattcactatcttctcttccctctgcagcgctggggcctggaggcaaacctcttaagccaggtaagacccaaggcctcggagcattgagagacagcgagggagctggggagggaggagcctacccagctgggaatgggacaaggaaactaggaacaggacaaggaagccaacgggcaggaggaaggagggaggtgtggacaccgattagcctcccaaggatgagtaggccggggccaggtcccagggcttccaggaacaagaggctggaagcagctccatgtcctccctgtgtgagggcgtctagcatctaccctacatgtgcatgtgtgttcacccagctgtccagagactcctctctgcaaaggagaggctgttagaggcaacatcagggattgctcc

SEQ ID NO: 446327 - DNA, 3479 bp, Homo sapiens
cgacgaggcaacaattaggctttggggataaaacgaggtgcggagagcgggctggggcatttctccccgagatggcgggtctgacggcggcggccccgcggcccggagtcctcctgctcctgctgtccatcctccacccctctcggcctggaggggtccctggggccattcctggtggagttcctggaggagtcttttatccaggggctggtctcggagcccttggaggaggagcgctggggcctggaggcaaacctcttaagccagttcccggagggcttgcgggtgctggccttggggcagggctcggcgccttccccgcagttacctttccgggggctctggtgcctggtggagtggctgacgctgctgcagcctataaagctgctaaggctggcgctgggcttggtggtgtcccaggagttggtggcttaggagtgtctgcaggtgcggtggttcctcagcctggagccggagtgaagcctgggaaagtgccgggtgtggggctgccaggtgtatacccaggtggcgtgctcccaggagctcggttccccggtgtgggggtgctccctggagttcccactggagcaggagttaagcccaaggctccaggtgtaggtggagcttttgctggaatcccaggagttggaccctttgggggaccgcaacctggagtcccactggggtatcccatcaaggcccccaagctgcctggtggctatggactgccctacaccacagggaaactgccctatggctatgggcccggaggagtggctggtgcagcgggcaaggctggttacccaacagggacaggggttggcccccaggcagcagcagcagcggcagctaaagcagcagcaaagttcggtgctggagcagccggagtcctccctggtgttggaggggctggtgttcctggcgtgcctggggcaattcctggaattggaggcatcgcaggcgttgggactccagctgcagctgcagctgcagcagcagccgctaaggcagccaagtatggagctgctgcaggcttagtgcctggtgggccaggctttggcccgggagtagttggtgtcccaggagctggcgttccaggtgttggtgtcccaggagctgggattccagttgtcccaggtgctgggatcccaggtgctgcggttccaggggttgtgtcaccagaagcagctgctaaggcagctgcaaaggcagccaaatacggggccaggcccggagtcggagttggaggcattcctacttacggggttggagctgggggctttcccggctttggtgtcggagtcggaggtatccctggagtcgcaggtgtccctggtgtcggaggtgttcccggagtcggaggtgtcccgggagttggcatttcccccgaagctcaggcagcagctgccgccaaggctgccaagtacggagtggggaccccagcagctgcagctgctaaagcagccgccaaagccgcccagtttgctcttctcaatcttgcagggttagttcctggtgtcggcgtggctcctggagttggcgtggctcctggtgtcggtgtggctcctggagttggcttggctcctggagttggcgtggctcctggagttggtgtggctcctggcgttggcgtggctcccggcattggccctggtggagttgcagctgcagcaaaatccgctgccaaggtggctgccaaagcccagctccgagctgcagctgggcttggtgctggcatccctggacttggagttggtgtcggcgtccctggacttggagttggtgctggtgttcctggacttggagttggtgctggtgttcctggcttcggggcagtacctggagccctggctgccgctaaagcagccaaatatggagcagcagtgcctggggtccttggagggctcggggctctcggtggagtaggcatcccaggcggtgtggtgggagccggacccgccgccgccgctgccgcagccaaagctgctgccaaagccgcccagtttggcctagtgggagccgctgggctcggaggactcggagtcggagggcttggagttccaggtgttgggggccttggaggtatacctccagctgcagccgctaaagcagctaaatacggtgctgctggccttggaggtgtcctagggggtgccgggcagttcccacttggaggagtggcagcaagacctggcttcggattgtctcccattttcccaggtggggcctgcctggggaaagcttgtggccggaagagaaaatgagcttcctaggacccctgactcacgacctcatcaacgttggtgctactgcttggtggagaatgtaaaccctttgtaaccccatcccatgcccctccgactccccaccccaggagggaacgggcaggccgggcggccttgcagatccacagggcaaggaaacaagaggggagcggccaagtgccccgaccaggaggccccctacttcagaggcaagggccatgtggtcctggccccccaccccatcccttcccacctaggagctccccctccacacagcctccatctccaggggaacttggtgctacacgctggtgctcttatcttcctggggggagggaggagggaagggtggcccctcggggaaccccctacctggggctcctctaaagatggtgcagacacttcctgggcagtcccagctccccctgcccaccaggacccaccgttggctgccatccagttggtacccaagcacctgaagcctcaaagctggattcgctctagcatccctcctctcctgggtccacttggccgtctcctccccaccgatcgctgttccccacatctggggcgcttttgggttggaaaaccaccccacactgggaatagccaccttgcccttgtagaatccatccgcccatccgtccattcatccatcggtccgtccatccatgtccccagttgaccgcccggcaccactagctggctgggtgcacccaccatcaacctggttgacctgtcatggccgcctgtgccctgcctccacccccatcctacactcccccagggcgtgcggggctgtgcagactggggtgccaggcatctcctccccacccggggtgtccccacatgcagtactgtataccccccatccctccctcggtccactgaacttcagagcagttcccattcctgccccgcccatctttttgtgtctcgctgtgatagatcaataaatattttattttttgtcctggatatttggggattatttttgattgttgatattctcttttggttttattgttgtggttcattgaaaaaaaaagataatttttttttctgatccggggagctgtatccccagtagaaaaaacattttaatcactctaatataactctggatgaaacacacctttttttttaataagaaaagagaattaactgcttcagaaatgactaataaatgaaaaacctttaaaggaaaaaaaaaaa

SEQ ID NO: 446328 - DNA, 3451 bp, Homo sapiens
cgacgaggcaacaattaggctttggggataaaacgaggtgcggagagcgggctggggcatttctccccgagatggcgggtctgacggcggcggccccgcggcccggagtcctcctgctcctgctgtccatcctccacccctctcggcctggaggggtccctggggccattcctggtggagttcctggaggagtcttttatccaggggctggtctcggagcccttggaggaggagcgctggggcctggaggcaaacctcttaagccagttcccggagggcttgcgggtgctggccttggggcagggctcggcgccttccccgcagttacctttccgggggctctggtgcctggtggagtggctgacgctgctgcagcctataaagctgctaaggctggcgctgggcttggtggtgtcccaggagttggtggcttaggagtgtctgcaggtgcggtggttcctcagcctggagccggagtgaagcctgggaaagtgccgggtgtggggctgccaggtgtatacccaggtggcgtgctcccaggagctcggttccccggtgtgggggtgctccctggagttcccactggagcaggagttaagcccaaggctccaggtgtaggtggagcttttgctggaatcccaggagttggaccctttgggggaccgcaacctggagtcccactggggtatcccatcaaggcccccaagctgcctggtggctatggactgccctacaccacagggaaactgccctatggctatgggcccggaggagtggctggtgcagcgggcaaggctggttacccaacagggacaggggttggcccccaggcagcagcagcagcggcagctaaagcagcagcaaagttcggtgctggagcagccggagtcctccctggtgttggaggggctggtgttcctggcgtgcctggggcaattcctggaattggaggcatcgcaggcgttgggactccagctgcagctgcagctgcagcagcagccgctaaggcagccaagtatggagctgctgcaggcttagtgcctggtgggccaggctttggcccgggagtagttggtgtcccaggagctggcgttccaggtgttggtgtcccaggagctgggattccagttgtcccaggtgctgggatcccaggtgctgcggttccaggggttgtgtcaccagaagcagctgctaaggcagctgcaaaggcagccaaatacggggccaggcccggagtcggagttggaggcattcctacttacggggttggagctgggggctttcccggctttggtgtcggagtcggaggtatccctggagtcgcaggtgtccctggtgtcggaggtgttcccggagtcggaggtgtcccgggagttggcatttcccccgaagctcaggcagcagctgccgccaaggctgccaagtacggagtggggaccccagcagctgcagctgctaaagcagccgccaaagccgcccagtttgctcttctcaatcttgcagggttagttcctggtgtcggcgtggctcctggagttggcgtggctcctggtgtcggtgtggctcctggagttggcttggctcctggagttggcgtggctcctggagttggtgtggctcctggcgttggcgtggctcccggcattggccctggtggagttgcagctgcagcaaaatccgctgccaaggtggctgccaaagcccagctccgagctgcagctgggcttggtgctggcatccctggacttggagttggtgtcggcgtccctggacttggagttggtgctggtgttcctggacttggagttggtgctggtgttcctggcttcggggcagtacctggagccctggctgccgctaaagcagccaaatatggagcagcagtgcctggggtccttggagggctcggggctctcggtggagtaggcatcccaggcggtgtggtgggagccggacccgccgccgccgctgccgcagccaaagctgctgccaaagccgcccagtttggcctagtgggagccgctgggctcggaggactcggagtcggagggcttggagttccaggtgttgggggccttggaggtatacctccagctgcagccgctaaagcagctaaatacggtgctgctggccttggaggtgtcctagggggtgccgggcagttcccacttggaggagtggcagcaagacctggcttcggattgtctcccattttcccaggtggggcctgcctggggaaagcttgtggccggaagagaaaatgagcttcctaggacccctgactcacgacctcatcaacgttggtgctactgcttggtggagaatgtaaaccctttgtaaccccatcccatgcccctccgactccccaccccaggagggaacgggcaggccgggcggccttgcagatccacagggcaaggaaacaagaggggagcggccaagtgccccgaccaggaggccccctacttcagaggcaagggccatgtggtcctggccccccaccccatcccttcccacctaggagctccccctccacacagcctccatctccaggggaacttggtgctacacgctggtgctcttatcttcctggggggagggaggagggaagggtggcccctcggggaaccccctacctggggctcctctaaagatggtgcagacacttcctgggcagtcccagctctgccatccagttggtacccaagcacctgaagcctcaaagctggattcgctctagcatccctcctctcctgggtccacttggccgtctcctccccaccgatcgctgttccccacatctggggcgcttttgggttggaaaaccaccccacactgggaatagccaccttgcccttgtagaatccatccgcccatccgtccattcatccatcggtccgtccatccatgtccccagttgaccgcccggcaccactagctggctgggtgcacccaccatcaacctggttgacctgtcatggccgcctgtgccctgcctccacccccatcctacactcccccagggcgtgcggggctgtgcagactggggtgccaggcatctcctccccacccggggtgtccccacatgcagtactgtataccccccatccctccctcggtccactgaacttcagagcagttcccattcctgccccgcccatctttttgtgtctcgctgtgatagatcaataaatattttattttttgtcctggatatttggggattatttttgattgttgatattctcttttggttttattgttgtggttcattgaaaaaaaaagataatttttttttctgatccggggagctgtatccccagtagaaaaaacattttaatcactctaatataactctggatgaaacacacctttttttttaataagaaaagagaattaactgcttcagaaatgactaataaatgaaaaacctttaaaggaaaaaaaaaaa

SEQ ID NO: 446329 - DNA, 3445 bp, Homo sapiens
cgacgaggcaacaattaggctttggggataaaacgaggtgcggagagcgggctggggcatttctccccgagatggcgggtctgacggcggcggccccgcggcccggagtcctcctgctcctgctgtccatcctccacccctctcggcctggaggggtccctggggccattcctggtggagttcctggaggagtcttttatccaggggctggtctcggagcccttggaggaggagcgctggggcctggaggcaaacctcttaagccagttcccggagggcttgcgggtgctggccttggggcagggctcggcgccttccccgcagttacctttccgggggctctggtgcctggtggagtggctgacgctgctgcagcctataaagctgctaaggctggcgctgggcttggtggtgtcccaggagttggtggcttaggagtgtctgcaggtgcggtggttcctcagcctggagccggagtgaagcctgggaaagtgccgggtgtggggctgccaggtgtatacccaggtggcgtgctcccaggagctcggttccccggtgtgggggtgctccctggagttcccactggagcaggagttaagcccaaggctccaggtgtaggtggagcttttgctggaatcccaggagttggaccctttgggggaccgcaacctggagtcccactggggtatcccatcaaggcccccaagctgcctggtggctatggactgccctacaccacagggaaactgccctatggctatgggcccggaggagtggctggtgcagcgggcaaggctggttacccaacagggacaggggttggcccccaggcagcagcagcagcggcagctaaagcagcagcaaagttcggtgctggagcagccggagtcctccctggtgttggaggggctggtgttcctggcgtgcctggggcaattcctggaattggaggcatcgcaggcgttgggactccagctgcagctgcagctgcagcagcagccgctaaggcagccaagtatggagctgctgcaggcttagtgcctggtgggccaggctttggcccgggagtagttggtgtcccaggagctggcgttccaggtgttggtgtcccaggagctgggattccagttgtcccaggtgctgggatcccaggtgctgcggttccaggggttgtgtcaccagaagcagctgctaaggcagctgcaaaggcagccaaatacggggccaggcccggagtcggagttggaggcattcctacttacggggttggagctgggggctttcccggctttggtgtcggagtcggaggtatccctggagtcgcaggtgtccctggtgtcggaggtgttcccggagtcggaggtgtcccgggagttggcatttcccccgaagctcaggcagcagctgccgccaaggctgccaagtacggagtggggaccccagcagctgcagctgctaaagcagccgccaaagccgcccagtttgctcttctcaatcttgcagggttagttcctggtgtcggcgtggctcctggagttggcgtggctcctggtgtcggtgtggctcctggagttggcttggctcctggagttggcgtggctcctggagttggtgtggctcctggcgttggcgtggctcccggcattggccctggtggagttgcagctgcagcaaaatccgctgccaaggtggctgccaaagcccagctccgagctgcagctgggcttggtgctggcatccctggacttggagttggtgtcggcgtccctggacttggagttggtgctggtgttcctggacttggagttggtgctggtgttcctggcttcggggcagtacctggagccctggctgccgctaaagcagccaaatatggagcagcagtgcctggggtccttggagggctcggggctctcggtggagtaggcatcccaggcggtgtggtgggagccggacccgccgccgccgctgccgcagccaaagctgctgccaaagccgcccagtttggcctagtgggagccgctgggctcggaggactcggagtcggagggcttggagttccaggtgttgggggccttggaggtatacctccagctgcagccgctaaagcagctaaatacggtgctgctggccttggaggtgtcctagggggtgccgggcagttcccacttggaggagtggcagcaagacctggcttcggattgtctcccattttcccaggtggggcctgcctggggaaagcttgtggccggaagagaaaatgagcttcctaggacccctgactcacgacctcatcaacgttggtgctactgcttggtggagaatgtaaaccctttgtaaccccatcccatgcccctccgactccccaccccaggagggaacgggcaggccgggcggccttgcagatccacagggcaaggaaacaagaggggagcggccaagtgccccgaccaggaggccccctacttcagaggcaagggccatgtggtcctggccccccaccccatcccttcccacctaggagctccccctccacacagcctccatctccaggggaacttggtgctacacgctggtgctcttatcttcctggggggagggaggagggaagggtggcccctcggggaaccccctacctggggctcctctaaagatggtgcagacacttcctgggcagtcccagctccccctgcccaccaggacccaccgttggctgccatccagttggtacccaagcacctgaagcctcaaagctggattcgctctagcatccctcctctcctgggtccacttggccgtctcctccccaccgatcgctgttccccacatctggggcgcttttgggttggaaaaccaccccacactgggaatagccaccttgcccttgtagaatccatccgcccatccgtccattcatccatcggtccgtccatccatgtccccagttgaccgcccggcaccactagctggctgggtgcacccaccatcaacctggttgacctgtcatggccgcctgtgccctgcctccacccccatcctacactcccccagggcgtgcggggctgtgcagactggggtgccaggcatctcctccccacccggggtgtccccacatgcagtactgtataccccccatccctccctcggtccactgaacttcagagcagttcccattcctgccccgcccatctttttgtgtctcgctgtgatagatcaataaatattttattttttgtcctggaaagaacacaaacacacacccccccaggggccacctatgccggggggccggagacaggagggcccaccgcacggggcacatggcaagagacggaacccgcgaaccacacaacctggtaccaaaggggaacaaacgacggatacccaagagagacgccgaatcaacaccgagtcagccgggaaaacgtgcccacgacccggcaaa

SEQ ID NO: 446330 - DNA, 3159 bp, Homo sapiens
cgacgaggcaacaattaggctttggggataaaacgaggtgcggagagcgggctggggcatttctccccgagatggcgggtctgacggcggcggccccgcggcccggagtcctcctgctcctgctgtccatcctccacccctctcggcctggaggggtccctggggccattcctggtggagttcctggaggagtcttttatccaggggctggtctcggagcccttggaggaggagcgctggggcctggaggcaaacctcttaagccagttcccggagggcttgcgggtgctggccttggggcagggctcggcgccttccccgcagttacctttccgggggctctggtgcctggtggagtggctgacgctgctgcagcctataaagctgctaaggctggcgctgggcttggtggtgtcccaggagttggtggcttaggagtgtctgcaggtgcggtggttcctcagcctggagccggagtgaagcctgggaaagtgccgggtgtggggctgccaggtgtatacccaggtggcgtgctcccaggagctcggttccccggtgtgggggtgctccctggagttcccactggagcaggagttaagcccaaggctccaggtgtaggtggagcttttgctggaatcccaggagttggaccctttgggggaccgcaacctggagtcccactggggtatcccatcaaggcccccaagctgcctggtggctatggactgccctacaccacagggaaactgccctatggctatgggcccggaggagtggctggtgcagcgggcaaggctggttacccaacagggacaggggttggcccccaggcagcagcagcagcggcagctaaagcagcagcaaagttcggtgctggagcagccggagtcctccctggtgttggaggggctggtgttcctggcgtgcctggggcaattcctggaattggaggcatcgcaggcgttgggactccagctgcagctgcagctgcagcagcagccgctaaggcagccaagtatggagctgctgcaggcttagtgcctggtgggccaggctttggcccgggagtagttggtgtcccaggagctggcgttccaggtgttggtgtcccaggagctgggattccagttgtcccaggtgctgggatcccaggtgctgcggttccaggggttgtgtcaccagaagcagctgctaaggcagctgcaaaggcagccaaatacggggccaggcccggagtcggagttggaggcattcctacttacggggttggagctgggggctttcccggctttggtgtcggagtcggaggtatccctggagtcgcaggtgtccctggtgtcggaggtgttcccggagtcggaggtgtcccgggagttggcatttcccccgaagctcaggcagcagctgccgccaaggctgccaagtacggagtggggaccccagcagctgcagctgctaaagcagccgccaaagccgcccagtttgctcttctcaatcttgcagggttagttcctggtgtcggcgtggctcctggagttggcgtggctcctggtgtcggtgtggctcctggagttggcttggctcctggagttggcgtggctcctggagttggtgtggctcctggcgttggcgtggctcccggcattggccctggtggagttgcagctgcagcaaaatccgctgccaaggtggctgccaaagcccagctccgagctgcagctgggcttggtgctggcatccctggacttggagttggtgtcggcgtccctggacttggagttggtgctggtgttcctggacttggagttggtgctggtgttcctggcttcggggcagtacctggagccctggctgccgctaaagcagccaaatatggagcagcagtgcctggggtccttggagggctcggggctctcggtggagtaggcatcccaggcggtgtggtgggagccggacccgccgccgccgctgccgcagccaaagctgctgccaaagccgcccagtttggcctagtgggagccgctgggctcggaggactcggagtcggagggcttggagttccaggtgttgggggccttggaggtatacctccagctgcagccgctaaagcagctaaatacggtgctgctggccttggaggtgtcctagggggtgccgggcagttcccacttggaggagtggcagcaagacctggcttcggattgtctcccattttcccaggtggggcctgcctggggaaagcttgtggccggaagagaaaatgagcttcctaggacccctgactcacgacctcatcaacgttggtgctactgcttggtggagaatgtaaaccctttgtaaccccatcccatgcccctccgactccccaccccaggagggaacgggcaggccgggcggccttgcagatccacagggcaaggaaacaagaggggagcggccaagtgccccgaccaggaggccccctacttcagaggcaagggccatgtggtcctggccccccaccccatcccttcccacctaggagctccccctccacacagcctccatctccaggggaacttggtgctacacgctggtgctcttatcttcctggggggagggaggagggaagggtggcccctcggggaaccccctacctggggctcctctaaagatggtgcagacacttcctgggcagtcccagctccccctgcccaccaggacccaccgttggctgccatccagttggtacccaagcacctgaagcctcaaagctggattcgctctagcatccctcctctcctgggtccacttggccgtctcctccccaccgatcgctgttccccacatctggggcgcttttgggttggaaaaccaccccacactgggaatagccaccttgcccttgtagaatccatccaccatcaacctggttgacctgtcatggccgcctgtgccctgcctccacccccatcctacactcccccagggcgtgcggggctgtgcagactggggtgccaggcatctcctccccacccggggtgtccccacatgcagtactgtataccccccatccctccctcggtccactgaacttcagagcagttcccattcctgccccgcccatctttttgtgtctcgctgtgatagatcaataaatattttattttttgtcctgga

SEQ ID NO: 446331 - DNA, 3350 bp, Homo sapiens
cgacgaggcaacaattaggctttggggataaaacgaggtgcggagagcgggctggggcatttctccccgagatggcgggtctgacggcggcggccccgcggcccggagtcctcctgctcctgctgtccatcctccacccctctcggcctggaggggtccctggggccattcctggtggagttcctggaggagtcttttatccaggggctggtctcggagcccttggaggaggagcgctggggcctggaggcaaacctcttaagccagttcccggagggcttgcgggtgctggccttggggcagggctcggcgccttccccgcagttacctttccgggggctctggtgcctggtggagtggctgacgctgctgcagcctataaagctgctaaggctggcgctgggcttggtggtgtcccaggagttggtggcttaggagtgtctgcaggtgcggtggttcctcagcctggagccggagtgaagcctgggaaagtgccgggtgtggggctgccaggtgtatacccaggtggcgtgctcccaggagctcggttccccggtgtgggggtgctccctggagttcccactggagcaggagttaagcccaaggctccaggtgtaggtggagcttttgctggaatcccaggagttggaccctttgggggaccgcaacctggagtcccactggggtatcccatcaaggcccccaagctgcctggtggctatggactgccctacaccacagggaaactgccctatggctatgggcccggaggagtggctggtgcagcgggcaaggctggttacccaacagggacaggggttggcccccaggcagcagcagcagcggcagctaaagcagcagcaaagttcggtgctggagcagccggagtcctccctggtgttggaggggctggtgttcctggcgtgcctggggcaattcctggaattggaggcatcgcaggcgttgggactccagctgcagctgcagctgcagcagcagccgctaaggcagccaagtatggagctgctgcaggcttagtgcctggtgggccaggctttggcccgggagtagttggtgtcccaggagctggcgttccaggtgttggtgtcccaggagctgggattccagttgtcccaggtgctgggatcccaggtgctgcggttccaggggttgtgtcaccagaagcagctgctaaggcagctgcaaaggcagccaaatacggggccaggcccggagtcggagttggaggcattcctacttacggggttggagctgggggctttcccggctttggtgtcggagtcggaggtatccctggagtcgcaggtgtccctggtgtcggaggtgttcccggagtcggaggtgtcccgggagttggcatttcccccgaagctcaggcagcagctgccgccaaggctgccaagtacgggttagttcctggtgtcggcgtggctcctggagttggcgtggctcctggtgtcggtgtggctcctggagttggcttggctcctggagttggcgtggctcctggagttggtgtggctcctggcgttggcgtggctcccggcattggccctggtggagttgcagctgcagcaaaatccgctgccaaggtggctgccaaagcccagctccgagctgcagctgggcttggtgctggcatccctggacttggagttggtgtcggcgtccctggacttggagttggtgctggtgttcctggacttggagttggtgctggtgttcctggcttcggggcagtacctggagccctggctgccgctaaagcagccaaatatggagcagcagtgcctggggtccttggagggctcggggctctcggtggagtaggcatcccaggcggtgtggtgggagccggacccgccgccgccgctgccgcagccaaagctgctgccaaagccgcccagtttggcctagtgggagccgctgggctcggaggactcggagtcggagggcttggagttccaggtgttgggggccttggaggtatacctccagctgcagccgctaaagcagctaaatacggagtggcagcaagacctggcttcggattgtctcccattttcccaggtggggcctgcctggggaaagcttgtggccggaagagaaaatgagcttcctaggacccctgactcacgacctcatcaacgttggtgctactgcttggtggagaatgtaaaccctttgtaaccccatcccatgcccctccgactccccaccccaggagggaacgggcaggccgggcggccttgcagatccacagggcaaggaaacaagaggggagcggccaagtgccccgaccaggaggccccctacttcagaggcaagggccatgtggtcctggccccccaccccatcccttcccacctaggagctccccctccacacagcctccatctccaggggaacttggtgctacacgctggtgctcttatcttcctggggggagggaggagggaagggtggcccctcggggaaccccctacctggggctcctctaaagatggtgcagacacttcctgggcagtcccagctccccctgcccaccaggacccaccgttggctgccatccagttggtacccaagcacctgaagcctcaaagctggattcgctctagcatccctcctctcctgggtccacttggccgtctcctccccaccgatcgctgttccccacatctggggcgcttttgggttggaaaaccaccccacactgggaatagccaccttgcccttgtagaatccatccgcccatccgtccattcatccatcggtccgtccatccatgtccccagttgaccgcccggcaccactagctggctgggtgcacccaccatcaacctggttgacctgtcatggccgcctgtgccctgcctccacccccatcctacactcccccagggcgtgcggggctgtgcagactggggtgccaggcatctcctccccacccggggtgtccccacatgcagtactgtataccccccatccctccctcggtccactgaacttcagagcagttcccattcctgccccgcccatctttttgtgtctcgctgtgatagatcaataaatattttattttttgtcctggatatttggggattatttttgattgttgatattctcttttggttttattgttgtggttcattgaaaaaaaaagataatttttttttctgatccggggagctgtatccccagtagaaaaaacattttaatcactctaatataactctggatgaaacacacctttttttttaataagaaaagagaattaactgcttcagaaatgactaataaatgaaaaacctttaaaggaaaaaaaaaaa

SEQ ID NO: 446332 - DNA, 3302 bp, Homo sapiens
cgacgaggcaacaattaggctttggggataaaacgaggtgcggagagcgggctggggcatttctccccgagatggcgggtctgacggcggcggccccgcggcccggagtcctcctgctcctgctgtccatcctccacccctctcggcctggaggggtccctggggccattcctggtggagttcctggaggagtcttttatccaggggctggtctcggagcccttggaggaggagcgctggggcctggaggcaaacctcttaagccagttcccggagggcttgcgggtgctggccttggggcagggctcggcgccttccccgcagttacctttccgggggctctggtgcctggtggagtggctgacgctgctgcagcctataaagctgctaaggctggcgctgggcttggtggtgtcccaggagttggtggcttaggagtgtctgcaggtgcggtggttcctcagcctggagccggagtgaagcctgggaaagtgccgggtgtggggctgccaggtgtatacccaggtggcgtgctcccaggagttggaccctttgggggaccgcaacctggagtcccactggggtatcccatcaaggcccccaagctgcctggtggctatggactgccctacaccacagggaaactgccctatggctatgggcccggaggagtggctggtgcagcgggcaaggctggttacccaacagggacaggggttggcccccaggcagcagcagcagcggcagctaaagcagcagcaaagttcggtgctggagcagccggagtcctccctggtgttggaggggctggtgttcctggcgtgcctggggcaattcctggaattggaggcatcgcaggcgttgggactccagctgcagctgcagctgcagcagcagccgctaaggcagccaagtatggagctgctgcaggcttagtgcctggtgggccaggctttggcccgggagtagttggtgtcccaggagctggcgttccaggtgttggtgtcccaggagctgggattccagttgtcccaggtgctgggatcccaggtgctgcggttccaggggttgtgtcaccagaagcagctgctaaggcagctgcaaaggcagccaaatacggggccaggcccggagtcggagttggaggcattcctacttacggggttggagctgggggctttcccggctttggtgtcggagtcggaggtatccctggagtcgcaggtgtccctggtgtcggaggtgttcccggagtcggaggtgtcccgggagttggcatttcccccgaagctcaggcagcagctgccgccaaggctgccaagtacgggttagttcctggtgtcggcgtggctcctggagttggcgtggctcctggtgtcggtgtggctcctggagttggcttggctcctggagttggcgtggctcctggagttggtgtggctcctggcgttggcgtggctcccggcattggccctggtggagttgcagctgcagcaaaatccgctgccaaggtggctgccaaagcccagctccgagctgcagctgggcttggtgctggcatccctggacttggagttggtgtcggcgtccctggacttggagttggtgctggtgttcctggacttggagttggtgctggtgttcctggcttcggggcagtacctggagccctggctgccgctaaagcagccaaatatggagcagcagtgcctggggtccttggagggctcggggctctcggtggagtaggcatcccaggcggtgtggtgggagccggacccgccgccgccgctgccgcagccaaagctgctgccaaagccgcccagtttggcctagtgggagccgctgggctcggaggactcggagtcggagggcttggagttccaggtgttgggggccttggaggtatacctccagctgcagccgctaaagcagctaaatacggtgctgctggccttggaggtgtcctagggggtgccgggcagttcccacttggaggagtggcagcaagacctggcttcggattgtctcccattttcccaggtggggcctgcctggggaaagcttgtggccggaagagaaaatgagcttcctaggacccctgactcacgacctcatcaacgttggtgctactgcttggtggagaatgtaaaccctttgtaaccccatcccatgcccctccgactccccaccccaggagggaacgggcaggccgggcggccttgcagatccacagggcaaggaaacaagaggggagcggccaagtgccccgaccaggaggccccctacttcagaggcaagggccatgtggtcctggccccccaccccatcccttcccacctaggagctccccctccacacagcctccatctccaggggaacttggtgctacacgctggtgctcttatcttcctggggggagggaggagggaagggtggcccctcggggaaccccctacctggggctcctctaaagatggtgcagacacttcctgggcagtcccagctccccctgcccaccaggacccaccgttggctgccatccagttggtacccaagcacctgaagcctcaaagctggattcgctctagcatccctcctctcctgggtccacttggccgtctcctccccaccgatcgctgttccccacatctggggcgcttttgggttggaaaaccaccccacactgggaatagccaccttgcccttgtagaatccatccgcccatccgtccattcatccatcggtccgtccatccatgtccccagttgaccgcccggcaccactagctggctgggtgcacccaccatcaacctggttgacctgtcatggccgcctgtgccctgcctccacccccatcctacactcccccagggcgtgcggggctgtgcagactggggtgccaggcatctcctccccacccggggtgtccccacatgcagtactgtataccccccatccctccctcggtccactgaacttcagagcagttcccattcctgccccgcccatctttttgtgtctcgctgtgatagatcaataaatattttattttttgtcctggatatttggggattatttttgattgttgatattctcttttggttttattgttgtggttcattgaaaaaaaaagataatttttttttctgatccggggagctgtatccccagtagaaaaaacattttaatcactctaatataactctggatgaaacacacctttttttttaataagaaaagagaattaactgcttcagaaatgactaataaatgaaaaacctttaaaggaaaaaaaaaaa

SEQ ID NO: 446333 - DNA, 3338 bp, Homo sapiens
cgacgaggcaacaattaggctttggggataaaacgaggtgcggagagcgggctggggcatttctccccgagatggcgggtctgacggcggcggccccgcggcccggagtcctcctgctcctgctgtccatcctccacccctctcggcctggaggggtccctggggccattcctggtggagttcctggaggagtcttttatccaggggctggtctcggagcccttggaggaggagcgctggggcctggaggcaaacctcttaagccagggctcggcgccttccccgcagttacctttccgggggctctggtgcctggtggagtggctgacgctgctgcagcctataaagctgctaaggctggcgctgggcttggtggtgtcccaggagttggtggcttaggagtgtctgcaggtgcggtggttcctcagcctggagccggagtgaagcctgggaaagtgccgggtgtggggctgccaggtgtatacccaggtggcgtgctcccaggagctcggttccccggtgtgggggtgctccctggagttcccactggagcaggagttaagcccaaggctccaggagttggaccctttgggggaccgcaacctggagtcccactggggtatcccatcaaggcccccaagctgcctggtggctatggactgccctacaccacagggaaactgccctatggctatgggcccggaggagtggctggtgcagcgggcaaggctggttacccaacagggacaggggttggcccccaggcagcagcagcagcggcagctaaagcagcagcaaagttcggtgctggagcagccggagtcctccctggtgttggaggggctggtgttcctggcgtgcctggggcaattcctggaattggaggcatcgcaggcgttgggactccagctgcagctgcagctgcagcagcagccgctaaggcagccaagtatggagctgctgcaggcttagtgcctggtgggccaggctttggcccgggagtagttggtgtcccaggagctggcgttccaggtgttggtgtcccaggagctgggattccagttgtcccaggtgctgggatcccaggtgctgcggttccaggggttgtgtcaccagaagcagctgctaaggcagctgcaaaggcagccaaatacggggccaggcccggagtcggagttggaggcattcctacttacggggttggagctgggggctttcccggctttggtgtcggagtcggaggtatccctggagtcgcaggtgtccctggtgtcggaggtgttcccggagtcggaggtgtcccgggagttggcatttcccccgaagctcaggcagcagctgccgccaaggctgccaagtacgggttagttcctggtgtcggcgtggctcctggagttggcgtggctcctggtgtcggtgtggctcctggagttggcttggctcctggagttggcgtggctcctggagttggtgtggctcctggcgttggcgtggctcccggcattggccctggtggagttgcagctgcagcaaaatccgctgccaaggtggctgccaaagcccagctccgagctgcagctgggcttggtgctggcatccctggacttggagttggtgtcggcgtccctggacttggagttggtgctggtgttcctggacttggagttggtgctggtgttcctggcttcggggcagtacctggagccctggctgccgctaaagcagccaaatatggagcagcagtgcctggggtccttggagggctcggggctctcggtggagtaggcatcccaggcggtgtggtgggagccggacccgccgccgccgctgccgcagccaaagctgctgccaaagccgcccagtttggcctagtgggagccgctgggctcggaggactcggagtcggagggcttggagttccaggtgttgggggccttggaggtatacctccagctgcagccgctaaagcagctaaatacggtgctgctggccttggaggtgtcctagggggtgccgggcagttcccacttggaggagtggcagcaagacctggcttcggattgtctcccattttcccaggtggggcctgcctggggaaagcttgtggccggaagagaaaatgagcttcctaggacccctgactcacgacctcatcaacgttggtgctactgcttggtggagaatgtaaaccctttgtaaccccatcccatgcccctccgactccccaccccaggagggaacgggcaggccgggcggccttgcagatccacagggcaaggaaacaagaggggagcggccaagtgccccgaccaggaggccccctacttcagaggcaagggccatgtggtcctggccccccaccccatcccttcccacctaggagctccccctccacacagcctccatctccaggggaacttggtgctacacgctggtgctcttatcttcctggggggagggaggagggaagggtggcccctcggggaaccccctacctggggctcctctaaagatggtgcagacacttcctgggcagtcccagctccccctgcccaccaggacccaccgttggctgccatccagttggtacccaagcacctgaagcctcaaagctggattcgctctagcatccctcctctcctgggtccacttggccgtctcctccccaccgatcgctgttccccacatctggggcgcttttgggttggaaaaccaccccacactgggaatagccaccttgcccttgtagaatccatccgcccatccgtccattcatccatcggtccgtccatccatgtccccagttgaccgcccggcaccactagctggctgggtgcacccaccatcaacctggttgacctgtcatggccgcctgtgccctgcctccacccccatcctacactcccccagggcgtgcggggctgtgcagactggggtgccaggcatctcctccccacccggggtgtccccacatgcagtactgtataccccccatccctccctcggtccactgaacttcagagcagttcccattcctgccccgcccatctttttgtgtctcgctgtgatagatcaataaatattttattttttgtcctggatatttggggattatttttgattgttgatattctcttttggttttattgttgtggttcattgaaaaaaaaagataatttttttttctgatccggggagctgtatccccagtagaaaaaacattttaatcactctaatataactctggatgaaacacacctttttttttaataagaaaagagaattaactgcttcagaaatgactaataaatgaaaaacctttaaaggaaaaaaaaaaa

SEQ ID NO: 446334 - DNA, 2800 bp, Homo sapiens
ggtgctgggacctgaacttgctctctttattcccacaggagttggaccctttgggggaccgcaacctggagtcccactggggtatcccatcaaggcccccaagctgcctggtggctatggactgccctacaccacagggaaactgccctatggctatgggcccggaggagtggctggtgcagcgggcaaggctggttacccaacagggacaggggttggcccccaggcagcagcagcagcggcagctaaagcagcagcaaagttcggtgctggagcagccggagtcctccctggtgttggaggggctggtgttcctggcgtgcctggggcaattcctggaattggaggcatcgcaggcgttgggactccagctgcagctgcagctgcagcagcagccgctaaggcagccaagtatggagctgctgcaggcttagtgcctggtgggccaggctttggcccgggagtagttggtgtcccaggagctggcgttccaggtgttggtgtcccaggagctgggattccagttgtcccaggtgctgggatcccaggtgctgcggttccaggggttgtgtcaccagaagcagctgctaaggcagctgcaaaggcagccaaatacggggccaggcccggagtcggagttggaggcattcctacttacggggttggagctgggggctttcccggctttggtgtcggagtcggaggtatccctggagtcgcaggtgtccctggtgtcggaggtgttcccggagtcggaggtgtcccgggagttggcatttcccccgaagctcaggcagcagctgccgccaaggctgccaagtacgggttagttcctggtgtcggcgtggctcctggagttggcgtggctcctggtgtcggtgtggctcctggagttggcttggctcctggagttggcgtggctcctggagttggtgtggctcctggcgttggcgtggctcccggcattggccctggtggagttgcagctgcagcaaaatccgctgccaaggtggctgccaaagcccagctccgagctgcagctgggcttggtgctggcatccctggacttggagttggtgtcggcgtccctggacttggagttggtgctggtgttcctggacttggagttggtgctggtgttcctggcttcggggcagtacctggagccctggctgccgctaaagcagccaaatatggagcagcagtgcctggggtccttggagggctcggggctctcggtggagtaggcatcccaggcggtgtggtgggagccggacccgccgccgccgctgccgcagccaaagctgctgccaaagccgcccagtttggcctagtgggagccgctgggctcggaggactcggagtcggagggcttggagttccaggtgttgggggccttggaggtatacctccagctgcagccgctaaagcagctaaatacggtgctgctggccttggaggtgtcctagggggtgccgggcagttcccacttggaggagtggcagcaagacctggcttcggattgtctcccattttcccaggtggggcctgcctggggaaagcttgtggccggaagagaaaatgagcttcctaggacccctgactcacgacctcatcaacgttggtgctactgcttggtggagaatgtaaaccctttgtaaccccatcccatgcccctccgactccccaccccaggagggaacgggcaggccgggcggccttgcagatccacagggcaaggaaacaagaggggagcggccaagtgccccgaccaggaggccccctacttcagaggcaagggccatgtggtcctggccccccaccccatcccttcccacctaggagctccccctccacacagcctccatctccaggggaacttggtgctacacgctggtgctcttatcttcctggggggagggaggagggaagggtggcccctcggggaaccccctacctggggctcctctaaagatggtgcagacacttcctgggcagtcccagctccccctgcccaccaggacccaccgttggctgccatccagttggtacccaagcacctgaagcctcaaagctggattcgctctagcatccctcctctcctgggtccacttggccgtctcctccccaccgatcgctgttccccacatctggggcgcttttgggttggaaaaccaccccacactgggaatagccaccttgcccttgtagaatccatccgcccatccgtccattcatccatcggtccgtccatccatgtccccagttgaccgcccggcaccactagctggctgggtgcacccaccatcaacctggttgacctgtcatggccgcctgtgccctgcctccacccccatcctacactcccccagggcgtgcggggctgtgcagactggggtgccaggcatctcctccccacccggggtgtccccacatgcagtactgtataccccccatccctccctcggtccactgaacttcagagcagttcccattcctgccccgcccatctttttgtgtctcgctgtgatagatcaataaatattttattttttgtcctggatatttggggattatttttgattgttgatattctcttttggttttattgttgtggttcattgaaaaaaaaagataatttttttttctgatccggggagctgtatccccagtagaaaaaacattttaatcactctaatataactctggatgaaacacacctttttttttaataagaaaagagaattaactgcttcagaaatgactaataaatgaaaaacctttaaaggaaaaaaaaaaa

SEQ ID NO: 446335 - DNA, 2431 bp, Homo sapiens
gttcctttataacatagtagtgaaggctgcatggaggaagccccatggaccaaggaagcccaagggagtcgcttaactcagcaggggttcaggaaggcattctagaggaggtgggtggggaaatttgaccccaaaagatccatgcagttttcaggaaggctggagtgcagtggctcagtctcagctccccgcacctggtgcagttgatctcagctcaccacaacctccacctccccggttcaagtgattcttgtgtctcagcctcccaaatactgggattacaggcgcccgccaccacgcctggctaatttttgtatttttcgtagaaacagggtttcaccgtgttggccaggctggtctcaaactcctgacctcaggtgatctgccacctcagcctcccaaagtgctgggattacaggtgtgagccaccgcacccggcttacaaaagaacttttaaggccaggcacagtggttcacaccttcgggaggctaaggcaggaggatcgcatgagcccaggagttggaggctgcagtgaactatgattgtaccactgcactccagccggggtgacagagcaaaaccccatctcaaaatgaaacaaaatatggactggacttcctgtccactgctcctccacagtgtcacatggcccctgccacctgtctgcttgccttgtgtccctggggcagggagacccatcgttcagaaatggaacactcattttccctcctctccccgcaggagcagcagtgcctggggtccttggagggctcggggctctcggtggagtaggcatcccaggcggtgtggtgggtgagttgaaaccccaggaggggcagggtggggagggaatctaaccagtacagagtgcctccctgaactcggtctgtgttcccaggagccggacccgccgccgccgctgccgcagccaaagctgctgccaaagccgcccagtttggcctagtgggagccgctgggctcggaggactcggagtcggagggcttggagttccaggtgttgggggccttggaggtatacctccagctgcagccgctaaagcagctaaatacggtgctgctggccttggaggtgtcctagggggtgccgggcagttcccacttggaggagtggcagcaagacctggcttcggattgtctcccattttcccaggtggggcctgcctggggaaagcttgtggccggaagagaaaatgagcttcctaggacccctgactcacgacctcatcaacgttggtgctactgcttggtggagaatgtaaaccctttgtaaccccatcccatgcccctccgactccccaccccaggagggaacgggcaggccgggcggccttgcagatccacagggcaaggaaacaagaggggagcggccaagtgccccgaccaggaggccccctacttcagaggcaagggccatgtggtcctggccccccaccccatcccttcccacctaggagctccccctccacacagcctccatctccaggggaacttggtgctacacgctggtgctcttatcttcctggggggagggaggagggaagggtggcccctcggggaaccccctacctggggctcctctaaagatggtgcagacacttcctgggcagtcccagctccccctgcccaccaggacccaccgttggctgccatccagttggtacccaagcacctgaagcctcaaagctggattcgctctagcatccctcctctcctgggtccacttggccgtctcctccccaccgatcgctgttccccacatctggggcgcttttgggttggaaaaccaccccacactgggaatagccaccttgcccttgtagaatccatccgcccatccgtccattcatccatcggtccgtccatccatgtccccagttgaccgcccggcaccactagctggctgggtgcacccaccatcaacctggttgacctgtcatggccgcctgtgccctgcctccacccccatcctacactcccccagggcgtgcggggctgtgcagactggggtgccaggcatctcctccccacccggggtgtccccacatgcagtactgtataccccccatccctccctcggtccactgaacttcagagcagttcccattcctgccccgcccatctttttgtgtctcgctgtgatagatcaataaatattttattttttgtcctggatatttggggattatttttgattgttgatattctcttttggttttattgttgtggttcattgaaaaaaaaagataatttttttttctgatccggggagctgtatccccagtagaaaaaacattttaatcactctaatataactctggatgaaacacacctttttttttaataagaaaagagaattaactgcttcagaaatgactaataaatgaaaaacctttaaaggaaaaaaaaaaa

SEQ ID NO: 446336 - DNA, 2938 bp, Homo sapiens
cgacgaggcaacaattaggctttggggataaaacgaggtgcggagagcgggctggggcatttctccccgagatggcgggtctgacggcggcggccccgcggcccggagtcctcctgctcctgctgtccatcctccacccctctcggcctggaggggtccctggggccattcctggtggagttcctggaggagtcttttatccaggggctggtctcggagcccttggaggaggagcgctggggcctggaggcaaacctcttaagccagttcccggagggcttgcgggtgctggccttggggcagggctcggcgccttccccgcagttacctttccgggggctctggtgcctggtggagtggctgacgctgctgcagcctataaagctgctaaggctggcgctgggcttggtggtgtcccaggagttggtggcttaggagtgtctgcaggtgcggtggttcctcagcctggagccggagtgaagcctgggaaagtgccgggtgtggggctgccaggtgtatacccaggtggcgtgctcccaggagctcggttccccggtgtgggggtgctccctggagttcccactggagcaggagttaagcccaaggctccaggtgtaggtggagcttttgctggaatcccaggagttggaccctttgggggaccgcaacctggagtcccactggggtatcccatcaaggcccccaagctgcctggtggctatggactgccctacaccacagggaaactgccctatggctatgggcccggaggagtggctggtgcagcgggcaaggctggttacccaacagggacaggggttggcccccaggcagcagcagcagcggcagctaaagcagcagcaaagttcggtgctggagcagccggagtcctccctggtgttggaggggctggtgttcctggcgtgcctggggcaattcctggaattggaggcatcgcaggcgttgggactccagctgcagctgcagctgcagcagcagccgctaaggcagccaagtatggagctgctgcaggcttagtgcctggtgggccaggctttggcccgggagtagttggtgtcccaggagctggcgttccaggtgttggtgtcccaggagctgggattccagttgtcccaggtgctgggatcccaggtgctgcggttccaggggttgtgtcaccagaagcagctgctaaggcagctgcaaaggcagccaaatacggggccaggcccggagtcggagttggaggcattcctacttacggggttggagctgggggctttcccggctttggtgtcggagtcggaggtatccctggagtcgcaggtgtccctggtgtcggaggtgttcccggagtcggaggtgtcccgggagttggcatttcccccgaagctcaggcagcagctgccgccaaggctgccaagtacgggttagttcctggtgtcggcgtggctcctggagttggcgtggctcctggtgtcggtgtggctcctggagttggcttggctcctggagttggcgtggctcctggagttggtgtggctcctggcgttggcgtggctcccggcattggccctggtggagttgcagctgcagcaaaatccgctgccaaggtggctgccaaagcccagctccgagctgcagctgggcttggtgctggcatccctggacttggagttggtgtcggcgtccctggacttggagttggtgctggtgttcctggacttggagttggtgctggtgttcctggcttcggggcagtacctggagccctggctgccgctaaagcagccaaatatggagcagcagtgcctggggtccttggagggctcggggctctcggtggagtaggcatcccaggcggtgtggtgggagccggacccgccgccgccgctgccgcagccaaagctgctgccaaagccgcccagtttggcctagtgggagccgctgggctcggaggactcggagtcggagggcttggagttccaggtgttgggggccttggaggtatacctccagctgcagccgctaaagcagctaaatacggtgctgctggccttggaggtgtcctagggggtgccgggcagttcccacttggaggagtggcagcaagacctggcttcggattgtctcccattttcccagcccctgcccaccaggacccaccgttggctgccatccagttggtacccaagcacctgaagcctcaaagctggattcgctctagcatccctcctctcctgggtccacttggccgtctcctccccaccgatcgctgttccccacatctggggcgcttttgggttggaaaaccaccccacactgggaatagccaccttgcccttgtagaatccatccgcccatccgtccattcatccatcggtccgtccatccatgtccccagttgaccgcccggcaccactagctggctgggtgcacccaccatcaacctggttgacctgtcatggccgcctgtgccctgcctccacccccatcctacactcccccagggcgtgcggggctgtgcagactggggtgccaggcatctcctccccacccggggtgtccccacatgcagtactgtataccccccatccctccctcggtccactgaacttcagagcagttcccattcctgccccgcccatctttttgtgtctcgctgtgatagatcaataaatattttattttttgtcctggatatttggggattatttttgattgttgatattctcttttggttttattgttgtggttcattgaaaaaaaaagataatttttttttctgatccggggagctgtatccccagtagaaaaaacattttaatcactctaatataactctggatgaaacacacctttttttttaataagaaaagagaattaactgcttcagaaatgactaataaatgaaaaacctttaaaggaaaaaaaaaaa

SEQ ID NO: 446337 - DNA, 2016 bp, Homo sapiens
cgacgaggcaacaattaggctttggggataaaacgaggtgcggagagcgggctggggcatttctccccgagatggcgggtctgacggcggcggccccgcggcccggagtcctcctgctcctgctgtccatcctccacccctctcggcctggaggggtccctggggccattcctggtggagttcctggaggagtcttttatccaggggctggtctcggagcccttggaggaggagcgctggggcctggaggcaaacctcttaagccagttcccggagggcttgcgggtgctggccttggggcagggctcggcgccttccccgcagttacctttccgggggctctggtgcctggtggagtggctgacgctgctgcagcctataaagctgctaaggctggcgctgggcttggtggtgtcccaggagttggtggcttaggagtgtctgcaggtgcggtggttcctcagcctggagccggagtgaagcctgggaaagtgccgggtgtggggctgccaggtgtatacccaggtggcgtgctcccaggagctcggttccccggtgtgggggtgctccctggagttcccactggagcaggagttaagcccaaggctccaggtgtaggtggagcttttgctggaatcccaggagttggaccctttgggggaccgcaacctggagtcccactggggtatcccatcaaggcccccaagctgcctggtggctatggactgccctacaccacagggaaactgccctatggctatgggcccggaggagtggctggtgcagcgggcaaggctggttacccaacagggacaggggttggcccccaggcagcagcagcagcggcagctaaagcagcagcaaagttcggtgctggagcagccggagtcctccctggtgttggaggggctggtgttcctggcgtgcctggggcaattcctggaattggaggcatcgcaggcgttgggactccagctgcagctgcagctgcagcagcagccgctaaggcagccaagtatggagctgctgcaggcttagtgcctggtgggccaggctttggcccgggagtagttggtgtcccaggagctggcgttccaggtgttggtgtcccaggagctgggattccagttgtcccaggtgctgggatcccaggtgctgcggttccaggggttgtgtcaccagaagcagctgctaaggcagctgcaaaggcagccaaatacggggccaggcccggagtcggagttggaggcattcctacttacggggttggagctgggggctttcccggctttggtgtcggagtcggaggtatccctggagtcgcaggtgtccctggtgtcggaggtgttcccggagtcggaggtgtcccgggagttggcatttcccccgaagctcaggcagcagctgccgccaaggctgccaagtacgggttagttcctggtgtcggcgtggctcctggagttggcgtggctcctggtgtcggtgtggctcctggagttggcttggctcctggagttggcgtggctcctggagttggtgtggctcctggcgttggcgtggctcccggcattggccctggtggagttgcagctgcagcaaaatccgctgccaaggtggctgccaaagcccagctccgagctgcagctgggcttggtgctggcatccctggacttggagttggtgtcggcgtccctggacttggagttggtgctggtgttcctggacttggagttggtgctggtgttcctggcttcggggcagtacctggagccctggctgccgctaaagcagccaaatatggagcagcagtgcctggggtccttggagggctcggggctctcggtggagtaggcatcccaggcggtgtggtgggagccggacccgccgccgccgctgccgcagccaaagctgctgccaaagccgcccagtttggtgagcactgggtggaggtgggagctgccgccaggcccccaggcccccagggtgtgggaggagcttctgaccaggcactgtaga

SEQ ID NO: 446338 - DNA, 864 bp, Homo sapiens
gatcccagaggaggaagtccagagacagagcaccatgacttctgagaaaggagaagaatcgaaccctgggagtttgacgtcttctatgaccccagagaacttcgtaaagaggcctgtctgctctacgaaatcaagtggggcatgagccggaagatctggcgaagctcaggcaaaaacaccaccaatcacgtggaagttaattttataaaaaaatttacgtcagaaagagattttcacccatccatcagctgctccatcacctggttcttgtcctggagtccctgctgggaatgctcccaggctattagagagtttctgagtcggcaccctggtgtgactctagtgatctacgtagctcggcttttttggcacatggatcaacaaaatcggcaaggtctcagggaccttgttaacagtggagtaactattcagattatgagagcatcagagtattatcactgctggaggaattttgtcaactacccacctggggatgaagctcactggccacaatacccacctctgtggatgatgttgtacgcactggagctgcactgcataattctaagtcttccaccctgtttaaagatttcaagaagatggcaaaatcatcttacatttttcagacttcatcttcaaaactgccattaccaaacgattccgccacacatccttttagctacagggctgatacatccttctgtggcttggagatgaataggatgattccgtgtgtgtactgattcaagaacaagcaatgatgacccactaaagagtgaatgccatttagaatctagaaatgttcacaaggtaccccaaaactctgtagcttaaaccaacaataaatatgtattacctctggca

SEQ ID NO: 446339 - DNA, 892 bp, Homo sapiens
gatcccagaggaggaagtccagagacagagcaccatgacttctgagaaaggtccttcaaccggtgaccccactctgaggagaagaatcgaaccctgggagtttgacgtcttctatgaccccagagaacttcgtaaagaggcctgtctgctctacgaaatcaagtggggcatgagccggaagatctggcgaagctcaggcaaaaacaccaccaatcacgtggaagttaattttataaaaaaatttacgtcagaaagagattttcacccatccatcagctgctccatcacctggttcttgtcctggagtccctgctgggaatgctcccaggctattagagagtttctgagtcggcaccctggtgtgactctagtgatctacgtagctcggcttttttggcacatggatcaacaaaatcggcaaggtctcagggaccttgttaacagtggagtaactattcagattatgagagcatcagagtattatcactgctggaggaattttgtcaactacccacctggggatgaagctcactggccacaatacccacctctgtggatgatgttgtacgcactggagctgcactgcataattctaagtcttccaccctgtttaaagatttcaagaagatggcaaaatcatcttacatttttcagacttcatcttcaaaactgccattaccaaacgattccgccacacatccttttagctacagggctgatacatccttctgtggcttggagatgaataggatgattccgtgtgtgtactgattcaagaacaagcaatgatgacccactaaagagtgaatgccatttagaatctagaaatgttcacaaggtaccccaaaactctgtagcttaaaccaacaataaatatgtattacctctggca

SEQ ID NO: 446340 - DNA, 1084 bp, Homo sapiens
ctgggggacctcggagagcccgggacccaccaccaagaagggcagtgtactagttctttgtgactgcagtaaaaattttattttttaattttttttatttttggtagagatgcggtttcaccatgttagccaggatggtctcgatctcctgacctcgtgatcttcccgcctcggcctcccaaagtgctgggattacaggcgtgagccaccgcgcccggcctgaccgcagtagcaaatttatacacactgcatggcttcaaacaacagaaatgtattcgttacaattctggaggccaaaagtcaaaaataaaggtgtgggcaggaccctgttcccttcacaggtgctaggggaggatccctcctgcctcttccagctcctggtggctccaggccctctgtggcttgtggccgcatcacaggagttcctgcctccgtcttcacatggccttctccccatgtctgtctccaatctccctgtttttatgttgtaagaggttggattgtcgttgaaggtaggacccgcctgaaacctaggataatctcattttgatatccttagtttaattacatgtgcaaaggcccttttatcaagtgaggtcacattcacagattccagggcttagagggtggaggtatcattttgcgtgcccccatctggacatgcagtgtcctctcccctgtggggctgacctaccttcctagccgtcttcccagaacgtaatgtgtcttaaatccgtcatgctgacctggggccctgggtgcccttgggcaggagctgatggcactagtaccttgataaagttcttactggcaccagaagagaataaagtaactctccttccccttctctgacttatggccaggtgcccattcccactggcttgccgctccccagctccctgcgctttatattgttgaggcctcctctctcagctaagaaacaggaagtacacagatgtgtattcttaaagacagcattagccacggggcccccaccctcaaagggtgggagcgataactgctgctggttgaaactgacagttactactgataataaagttaattgttacccagtcagtggagt

SEQ ID NO: 446341 - DNA, 5495 bp, Homo sapiens
cgagaatggctcaactctccaaatagagagaatttctatcagttgcaagtacgaaaatttcctgccgattatataaaatactgggagtttgcagtttatctggaagaatgtgaactggctaaacagctttatccaaaggaaaacgatttggtgtttttagctcctgagagaataaatgaagagaagaaagatacagagagaaatgacatacaagatctccacgaatatcattctggttatgttcataaatttcgccgcacgtcagtcatgcgtaatgggaaaactgagtgttacctttccatccagactcaagagaactttccggccaatttaaacgaacttgtgaattgtattgtaatcagttctctggtaactacacaaaggaagttgaaagccatgtctctgttgggtagtcggaaccaactggctagagctgttctgaatccaaaccctatggacttctgtacaaaagatttactgactacaacatctgagagaattattgcgtacttaagagatttcaatgaagatcaaaagaaagcaatagaaactgcatatgctatggtgaaacactcaccatcagttgccaaaatctgcttgattcatggaccacctggaacaggaaaatcaaaaactattgttggcctcctctatcgtctactgacagagaaccagaggaaggggcattcagacgaaaactccaatgccaaaatcaaacaaaaccgtgtcctcgtgtgtgcaccttccaatgcagctgttgatgaactcatgaaaaaaattatccttgaattcaaagaaaaatgtaaagacaagaagaatcctttaggaaactgtggagatataaatttagtacgactgggtccagaaaagtctattaatagtgaggttctaaagttcagtttggacagccaagtaaaccacagaatgaaaaaagagttaccttctcatgttcaggcgatgcataaaagaaaggaatttctagattatcagctggatgagctttcccggcagcgagctctatgccgaggtggacgggaaatacagaggcaagaattagatgaaaacatttccaaagtttctaaggaaaggcaggaacttgcttctaaaattaaagaggttcaaggacgcccacagaaaacacagagtatcatcatcttagagtcccatatcatctgctgcacgttgagcacaagtggtggtttactacttgagtctgctttccgtgggcaagggggtgtccccttcagctgtgtcattgttgatgaggctggacagtcttgtgaaattgagactcttactccactcatccatcgctgcaataagctcatcctagtaggagatcctaagcagctccctccgacagtcatctctatgaaagcacaggagtatggctacgaccagtcaatgatggctcgcttctgcagactgctggaagagaatgtagaacacaacatgatcagcaggctgcccattctacagctcactgttcagtacaggatgcatccagacatatgcctcttcccttctaattatgtttataacagaaacttaaaaacaaatagacagacagaagccattcgatgttcatcagattggccatttcagccataccttgtgtttgatgttggagatggttcagaaagacgggataatgactcatatataaatgttcaagaaataaaactggtgatggaaataattaagcttattaaagacaaaagaaaggatgttagttttcgaaacattggcataataactcattacaaggcccagaagacgatgattcagaaggatttggacaaagagttcgatagaaaaggaccagcagaagtagacactgtggatgcattccagggtcggcagaaggattgtgttattgttacgtgtgtcagagcaaatagcatccaaggttcaattggattcctggcaagtttgcagagattgaatgtcaccatcacacgagccaagtacagcctcttcatcctcggacatttgaggaccctgatggaaaaccagcattggaatcagctgattcaggatgctcagaagcgtggtgccattattaagacctgtgacaaaaactatagacatgatgcagtgaagattctgaaactcaagcctgtgctgcagagaagtctcactcaccctcctaccatagccccagaggggtccagaccccagggtggtttgcccagcagcaagctagacagtggatttgccaagacatctgttgctgcttctctataccacacaccctctgactccaaggaaattactcttactgttacttcaaaggaccctgaaagacctcctgttcatgaccaacttcaggacccacgactgctgaagaggatgggcattgaggtcaaaggaggaatattcctttgggatccacaaccctcgagcccccagcatcctggagcaacacctcctacgggcgagccgggcttccctgtcgttcaccaggacctgagccatatacagcagcccgctgctgtagtggctgctctgagcagccacaaacctcccgtgcggggcgaacctccagctgccagtcccgaggcttccacgtgtcagagcaaatgtgatgacccggaagaggagctctgtcacaggagagaggccagggctttcagtgaaggggagcaggagaagtgtggttccgagacccatcacaccaggaggaactctaggtgggacaagaggacactggagcaggaggacagcagttccaagaaaagaaagcttttataggaaagcccagtgacatgggccagcagccacagcatattgtaaactgaagatgaccagctcgtgggaccatctagataagcttgttttttgtaaggagtttgtgtgctgttggaaaacatggaaaatgcatccttaacacctgagcctctggtcatcttcagtattttctgtcatttgcaaaagctttcagagggcattgtgtatccgtaataatgtccttgaagtcagagactggaaatgttgatctcttagtcttctatagacaaggaggtcagactggagtgaatgttgtaaaagttgaaatgtatatttgtatagcaaataacaaaatccttttaaaatttaatctagtagaccgcttttctttccccctgtttaaaatgttaatcagttttcaacagaacaaactttatattaccaaaaaaaaaaagatgggaggagggcgggtcctttcaaccattgttagagcaagacagataattatttaacagcctagcttggaataagctgagttagtgctggtgggtcaggtgtctctggctctattaaaaaaagcaaaaacccccccaaaaacctggagtctcctaggggacactttgggcagcacggttatgttaggtaaagtcttgctgacatggtgcatttttagatagagtgcattggcccagggtattatatttctgtgatgagttcatttacctgtttcagtatgcacatagttccctagctaaaattcctaatcttcttgagagagaagaatatggagtgaaagaataattcttgagctatcattcaaatgctcccagcatattgtgagccttgtgtgactggtgaggtacagacatttggttgccaaatgctagattagcgctgggtcagctgtggaagaatcgcctcagcttacagattgtcagacagatctaactagttttccagaaagcctgggaagctgtgtgttcaacatttcccaagggattctgatcaccaggcagcttgggaaccactggggcaggccaaatagaatattttgggcgggaaagaagcacccgatttaaaatgaagcgtaaccagaggagttcagaactgggaagagagtggtagacttcctgtgatcttcagaaatcatctacctggtaaaaatacatgctgtttagaatatctgataggtgtttccagctactattagaggtgatagtgcttttgtgggggaaaaaattggtcatggtgaatggagatcgaggaagctcgggacaagggaggggtgggctgcctgattttgtccagttttccaaatatccacgcagtgaactggagtatcctaaacatgagaatgtacagttgacagttgtaaaaactagggatctgtagtgaatgctgtgcagccccatatctcatttgggggtaggaaaatagctgaagattcatgtgcattatttgacatttcctttgtcatctgctttttaagcaaaaaagggttttgtgttagaaattctacttgagcagattataaagagctttaaaaaacaactttcggttgccaaaagtttgagcatttgatttcattacctgtgtctccctcactggtgtccagacggtcaactgaatactcctgaaacccagggagcaggtgacttcctggagtgctttgtccccagagtcagccactgcttcctctgtgggggtggagagtttgtctttggccatgcagtgtgcgacagttcaggacgggtagggatgggtcccattctgtctgggtcaagggctctatcagcttcttccatgtgcctttgggaagaaatctcgttactttaagtttgctttcctgttatcttgatgaagtgcccattttagcagacacttgtagtgctgaccacttagggaatgtacaaactcctaagcttctaaagggaggcatggcaaaaacgttggggtcaggatgtctctcacgctgctcatgttaatactattaacacatgatttgagaaataagttttctctaaaatgcatattttgccgccacacactgaacaatattatttccagtgaagtttgatgcctgttcttacgttgtgttcacctgttggttcaccactcagcagatctgattctgcaagaattaatggtagaactagatcatcctttctaacagacgagcctgtgtcctgtgacggcctttcacagcggaatgcagttgtacctcacattacttttgaaacttcactcgttccagttggtacaagtatttgccaaagccatttcctatgttcaccgtggcccctcctgatgtggctgtcagcgcagcgttgttgaacagggctattctttttacaaggtgtgaagtgtggctcttcgcttcgtctttgccatggcattaaaagaaagttccctgtcttctttcaatattagttatttcaaatgaatatgtgctacttaaaagcttgttttgtttctttgtatataatttgccttggatttattgtgcacagtttgttgagttgtatgtttttgtgaattatcaggagtaaatttgacaagtacatgtgaataacctcctgtaaatgaattttataacaaaaatgtactgaactattttttaaagttgtgcagattagcaattttttgctatagctttgacttttctatgctgtgaattaatagctgcgatttggcaaacagccctgttgtctttgttaaaccctaaattttaagaggaaatggcagaattaaaagcagaaacaaga

SEQ ID NO: 446342 - DNA, 5499 bp, Homo sapiens
cgagaatggctcaactctccaaatagagagaatttctatcagttgcaagtacgaaaatttcctgccgattatataaaatactgggagtttgcagtttatctggaagaatgtgaactggctaaacagctttatccaaaggaaaacgatttggtgtttttagctcctgagagaataaatgaagagaagaaagatacagagagaaatgacatacaagatctccacgaatatcattctggttatgttcataaatttcgccgcacgtcagtcatgcgtaatgggaaaactgagtgttacctttccatccagactcaagagaactttccggccaatttaaacgaacttgtgaattgtattgtaatcagttctctggtaactacacaaaggaagttgaaagccatgtctctgttgggtagtcggaaccaactggctagagctgttctgaatccaaaccctatggacttctgtacaaaagatttactgactacaacatctgagagaattattgcgtacttaagagatttcaatgaagatcaaaagaaagcaatagaaactgcatatgctatggtgaaacactcaccatcagttgccaaaatctgcttgattcatggaccacctggaacaggaaaatcaaaaactattgttggcctcctctatcgtctactgacagagaaccagaggaaggggcattcagacgaaaactccaatgccaaaatcaaacaaaaccgtgtcctcgtgtgtgcaccttccaatgcagctgttgatgaactcatgaaaaaaattatccttgaattcaaagaaaaatgtaaagacaagaagaatcctttaggaaactgtggagatataaatttagtacgactgggtccagaaaagtctattaatagtgaggttctaaagttcagtttggacagccaagtaaaccacagaatgaaaaaagagttaccttctcatgttcaggcgatgcataaaagaaaggaatttctagattatcagctggatgagctttcccggcagcgagctctatgccgaggtggacgggaaatacagaggcaagaattagatgaaaacatttccaaagtttctaaggaaaggcaggaacttgcttctaaaattaaagaggttcaaggacgcccacagaaaacacagagtatcatcatcttagagtcccatatcatctgctgcacgttgagcacaagtggtggtttactacttgagtctgctttccgtgggcaagggggtgtccccttcagctgtgtcattgttgatgaggctggacagtcttgtgaaattgagactcttactccactcatccatcgctgcaataagctcatcctagtaggagatcctaagcagctccctccgacagtcatctctatgaaagcacaggagtatggctacgaccagtcaatgatggctcgcttctgcagactgctggaagagaatgtagaacacaacatgatcagcaggctgcccattctacagctcactgttcagtacaggatgcatccagacatatgcctcttcccttctaattatgtttataacagaaacttaaaaacaaatagacagacagaagccattcgatgttcatcagattggccatttcagccataccttgtgtttgatgttggagatggttcagaaagacgggataatgactcatatataaatgttcaagaaataaaactggtgatggaaataattaagcttattaaagacaaaagaaaggatgttagttttcgaaacattggcataataactcattacaaggcccagaagacgatgattcagaaggatttggacaaagagttcgatagaaaaggaccagcagaagtagacactgtggatgcattccagggtcggcagaaggattgtgttattgttacgtgtgtcagagcaaatagcatccaaggttcaattggattcctggcaagtttgcagagattgaatgtcaccatcacacgagccaagtacagcctcttcatcctcggacatttgaggaccctgatggaaaaccagcattggaatcagctgattcaggatgctcagaagcgtggtgccattattaagacctgtgacaaaaactatagacatgatgcagtgaagattctgaaactcaagcctgtgctgcagagaagtctcactcaccctcctaccatagccccagaggggtccagaccccagggtggtttgcccagcagcaagctagacagtggatttgccaagacatctgttgctgcttctctataccacacaccctctgactccaaggaaattactcttactgttacttcaaaggaccctgaaagacctcctgttcatgaccaacttcaggacccacgactgctgaagaggatgggcattgaggtcaaaggaggaatattcctttgggatccacaaccctcgagcccccagcatcctggagcaacacctcctacgggcgagccgggcttccctgtcgttcaccaggacctgagccatatacagcagcccgctgctgtagtggctgctctgagcagccacaaacctcccgtgcggggcgaacctccagctgccagtcccgaggcttccacgtgtcagagcaaatgtgatgacccggaagaggagctctgtcacaggagagaggccagggctttcagtgaaggggagcaggagaagtgtggttccgagacccatcacaccaggaggaactctaggtgggacaagaggacactggagcaggaggacagcagttccaagaaaagaaagcttttataggaaagcccagtgacatgggccagcagccacagcatattgtaaactgaagatgaccagctcgtgggaccatctagataagcttgttttttgtaaggagtttgtgtgctgttggaaaacatggaaaatgcatccttaacacctgagcctctggtcatcttcagtattttctgtcatttgcaaaagctttcagagggcattgtgtatccgtaataatgtccttgaagtcagagactggaaatgttgatctcttagtcttctatagacaaggaggtcagactggagtgaatgttgtaaaagttgaaatgtatatttgtatagcaaataacaaaatccttttaaaatttaatctagtagaccgcttttctttccccctgtttaaaatgttaatcagttttcaacagaacaaactttatattaccaaaaaaaaaaagatgggaggagggcgggtcctttcaaccattgttagagcaagacagataattatttaacagcctagcttggaataagctgagttagtgctggtgggtcaggtgtctctggctctattaaaaaaagcaaaaacccccccaaaaacctggagtctcctaggggacactttgggcagcacggttatgttaggtaaagtcttgctgacatggtgcatttttagatagagtgcattggcccagggtattatatttctgtgatgagttcatttacctgtttcagtatgcacatagttccctagctaaaattcctaatcttcttgagagagaagaatatggagtgaaagaataattcttgagctatcattcaaatgctcccagcatattgtgagccttgtgtgactggtgaggtacagacatttggttgccaaatgctagattagcgctgggtcagctgtggaagaatcgcctcagcttacagattgtcagacagatctaactagttttccagaaagcctgggaagctgtgtgttcaacatttcccaagggattctgatcaccaggcagcttgggaaccactggggcaggccaaatagaatattttgggcgggaaagaagcacccgatttaaaatgaagcgtaaccagaggagttcagaactgggaagagagtggtagacttcctgtgatcttcagaaatcatctacctggtaaaaatacatgctgtttagaatatctgataggtgtttccagctactattagaggtgatagtgcttttgtgggggaaaaaattggtcatggtgaatggagatcgaggaagctcgggacaagggaggggtgggctgcctgattttgtccagttttccaaatatccacgcagtgaactggagtatcctaaacatgagaatgtacagttgacagttgtaaaaactagggatctgtagtgaatgctgtgcagccccatatctcatttgggggtaggaaaatagctgaagattcatgtgcattatttgacatttcctttgtcatctgctttttaagcaaaaaagggttttgtgttagaaattctacttgagcagattataaagagctttaaaaaacaactttcggttgccggtcaactgaatactcctgaaacccagggagcaggtgacttcctggagtgctttgtccccagagtcagccactgcttcctctgtgggggtggagagtttgtctttggccatgcagtgtgcgacagttcaggacgggtagggatgggtcccattctgtctgggtcaagggctctatcagcttcttccatgtgcctttgggaagaaatctcgttactttaagtttgctttcctgttatcttgatgaagtgcccattttagcagacacttgtagtgctgaccacttagggaatgtacaaactcctaagcttctaaagggaggcatggcaaaaacgttggggtcaggatgtctctcacgctgctcatgttaatactattaacacatgatttgagaaataagttttctctaaaatgcatattttgccgccacacactgaacaatattatttccagtgaagtttgatgcctgttcttacgttgtgttcacctgttggttcaccactcagcagatctgattctgcaagaattaatggtagaactagatcatcctttctaacagacgagcctgtgtcctgtgacggcctttcacagcggaatgcagttgtacctcacattacttttgaaacttcactcgttccagttggtacaagtatttgccaaagccatttcctatgttcaccgtggcccctcctgatgtggctgtcagcgcagcgttgttgaacagggctattctttttacaaggtgtgaagtgtggctcttcgcttcgtctttgccatggcattaaaagaaagttccctgtcttctttcaatattagttatttcaaatgaatatgtgctacttaaaagcttgttttgtttctttgtatataatttgccttggatttattgtgcacagtttgttgagttgtatgtttttgtgaattatcaggagtaaatttgacaagtacatgtgaataacctcctgtaaatgaattttataacaaaaatgtactgaactattttttaaagttgtgcagattagcaattttttgctatagctttgacttttctatgctgtgaattaatagctgcgatttggcaaacagccctgttgtctttgttaaaccctaaattttaagaggaaatggcagaattaaaagcagaaacaagaagatggacatggattagaggttatgtattatgaagtaaactacaaggtactaacatca

SEQ ID NO: 446343 - DNA, 5641 bp, Homo sapiens
cgagaatggctcaactctccaaatagagagaatttctatcagttgcaagtacgaaaatttcctgccgattatataaaatactgggagtttgcagtttatctggaagaatgtgaactggctaaacagctttatccaaaggaaaacgatttggtgtttttagctcctgagagaataaatgaagagaagaaagatacagagagaaatgacatacaagatctccacgaatatcattctggttatgttcataaatttcgccgcacgtcagtcatgcgtaatgggaaaactgagtgttacctttccatccagactcaagagaactttccggccaatttaaacgaacttgtgaattgtattgtaatcagttctctggtaactacacaaaggaagttgaaagccatgtctctgttgggtagtcggaaccaactggctagagctgttctgaatccaaaccctatggacttctgtacaaaagatttactgactacaacatctgagagaattattgcgtacttaagagatttcaatgaagatcaaaagaaagcaatagaaactgcatatgctatggtgaaacactcaccatcagttgccaaaatctgcttgattcatggaccacctggaacaggaaaatcaaaaactattgttggcctcctctatcgtctactgacagagaaccagaggaaggggcattcagacgaaaactccaatgccaaaatcaaacaaaaccgtgtcctcgtgtgtgcaccttccaatgcagctgttgatgaactcatgaaaaaaattatccttgaattcaaagaaaaatgtaaagacaagaagaatcctttaggaaactgtggagatataaatttagtacgactgggtccagaaaagtctattaatagtgaggttctaaagttcagtttggacagccaagtaaaccacagaatgaaaaaagagttaccttctcatgttcaggcgatgcataaaagaaaggaatttctagattatcagctggatgagctttcccggcagcgagctctatgccgaggtggacgggaaatacagaggcaagaattagatgaaaacatttccaaagtttctaaggaaaggcaggaacttgcttctaaaattaaagaggttcaaggacgcccacagaaaacacagagtatcatcatcttagagtcccatatcatctgctgcacgttgagcacaagtggtggtttactacttgagtctgctttccgtgggcaagggggtgtccccttcagctgtgtcattgttgatgaggctggacagtcttgtgaaattgagactcttactccactcatccatcgctgcaataagctcatcctagtaggagatcctaagcagctccctccgacagtcatctctatgaaagcacaggagtatggctacgaccagtcaatgatggctcgcttctgcagactgctggaagagaatgtagaacacaacatgatcagcaggctgcccattctacagctcactgttcagtacaggatgcatccagacatatgcctcttcccttctaattatgtttataacagaaacttaaaaacaaatagacagacagaagccattcgatgttcatcagattggccatttcagccataccttgtgtttgatgttggagatggttcagaaagacgggataatgactcatatataaatgttcaagaaataaaactggtgatggaaataattaagcttattaaagacaaaagaaaggatgttagttttcgaaacattggcataataactcattacaaggcccagaagacgatgattcagaaggatttggacaaagagttcgatagaaaaggaccagcagaagtagacactgtggatgcattccagggtcggcagaaggattgtgttattgttacgtgtgtcagagcaaatagcatccaaggttcaattggattcctggcaagtttgcagagattgaatgtcaccatcacacgagccaagtacagcctcttcatcctcggacatttgaggaccctgatggaaaaccagcattggaatcagctgattcaggatgctcagaagcgtggtgccattattaagacctgtgacaaaaactatagacatgatgcagtgaagattctgaaactcaagcctgtgctgcagagaagtctcactcaccctcctaccatagccccagaggggtccagaccccagggtggtttgcccagcagcaagctagacagtggatttgccaagacatctgttgctgcttctctataccacacaccctctgactccaaggaaattactcttactgttacttcaaaggaccctgaaagacctcctgttcatgaccaacttcaggacccacgactgctgaagaggatgggcattgaggtcaaaggaggaatattcctttgggatccacaaccctcgagcccccagcatcctggagcaacacctcctacgggcgagccgggcttccctgtcgttcaccaggacctgagccatatacagcagcccgctgctgtagtggctgctctgagcagccacaaacctcccgtgcggggcgaacctccagctgccagtcccgaggcttccacgtgtcagagcaaatgtgatgacccggaagaggagctctgtcacaggagagaggccagggctttcagtgaaggggagcaggagaagtgtggttccgagacccatcacaccaggaggaactctaggtgggacaagaggacactggagcaggaggacagcagttccaagaaaagaaagcttttataggaaagcccagtgacatgggccagcagccacagcatattgtaaactgaagatgaccagctcgtgggaccatctagataagcttgttttttgtaaggagtttgtgtgctgttggaaaacatggaaaatgcatccttaacacctgagcctctggtcatcttcagtattttctgtcatttgcaaaagctttcagagggcattgtgtatccgtaataatgtccttgaagtcagagactggaaatgttgatctcttagtcttctatagacaaggaggtcagactggagtgaatgttgtaaaagttgaaatgtatatttgtatagcaaataacaaaatccttttaaaatttaatctagtagaccgcttttctttccccctgtttaaaatgttaatcagttttcaacagaacaaactttatattaccaaaaaaaaaaagatgggaggagggcgggtcctttcaaccattgttagagcaagacagataattatttaacagcctagcttggaataagctgagttagtgctggtgggtcaggtgtctctggctctattaaaaaaagcaaaaacccccccaaaaacctggagtctcctaggggacactttgggcagcacggttatgttaggtaaagtcttgctgacatggtgcatttttagatagagtgcattggcccagggtattatatttctgtgatgagttcatttacctgtttcagtatgcacatagttccctagctaaaattcctaatcttcttgagagagaagaatatggagtgaaagaataattcttgagctatcattcaaatgctcccagcatattgtgagccttgtgtgactggtgaggtacagacatttggttgccaaatgctagattagcgctgggtcagctgtggaagaatcgcctcagcttacagattgtcagacagatctaactagttttccagaaagcctgggaagctgtgtgttcaacatttcccaagggattctgatcaccaggcagcttgggaaccactggggcaggccaaatagaatattttgggcgggaaagaagcacccgatttaaaatgaagcgtaaccagaggagttcagaactgggaagagagtggtagacttcctgtgatcttcagaaatcatctacctggtaaaaatacatgctgtttagaatatctgataggtgtttccagctactattagaggtgatagtgcttttgtgggggaaaaaattggtcatggtgaatggagatcgaggaagctcgggacaagggaggggtgggctgcctgattttgtccagttttccaaatatccacgcagtgaactggagtatcctaaacatgagaatgtacagttgacagttgtaaaaactagggatctgtagtgaatgctgtgcagccccatatctcatttgggggtaggaaaatagctgaagattcatgtgcattatttgacatttcctttgtcatctgctttttaagcaaaaaagggttttgtgttagaaattctacttgagcagattataaagagctttaaaaaacaactttcggttgccaaaagtttgagcatttgatttcattacctgtgtctccctcactggtgtccagacggtcaactgaatactcctgaaacccagggagcaggtgacttcctggagtgctttgtccccagagtcagccactgcttcctctgtgggggtggagagtttgtctttggccatgcagtgtgcgacagttcaggacgggtagggatgggtcccattctgtctgggtcaagggctctatcagcttcttccatgtgcctttgggaagaaatctcgttactttaagtttgctttcctgttatcttgatgaagtgcccattttagcagacacttgtagtgctgaccacttagggaatgtacaaactcctaagcttctaaagggaggcatggcaaaaacgttggggtcaggatgtctctcacgctgctcatgttaatactattaacacatgatttgagaaataagttttctctaaaatgcatattttgccgccacacactgaacaatattatttccagtgaagtttgatgcctgttcttacgttgtgttcacctgttggttcaccactcagcagatctgattctgcaagaattaatggtagaactagatcatcctttctaacagacgagcctgtgtcctgtgacggcctttcacagcggaatgcagttgtacctcacattacttttgaaacttcactcgttccagttggtacaagtatttgccaaagccatttcctatgttcaccgtggcccctcctgatgtggctgtcagcgcagcgttgttgaacagggctattctttttacaaggtgtgaagtgtggctcttcgcttcgtctttgccatggcattaaaagaaagttccctgtcttctttcaatattagttatttcaaatgaatatgtgctacttaaaagcttgttttgtttctttgtatataatttgccttggatttattgtgcacagtttgttgagttgtatgtttttgtgaattatcaggagtaaatttgacaagtacatgtgaataacctcctgtaaatgaattttataacaaaaatgtactgaactattttttaaagttgtgcagattagcaattttttgctatagctttgacttttctatgctgtgaattaatagctgcgatttggcaaacagccctgttgtctttgttaaaccctaaattttaagaggaaatggcagaattaaaagcagaaacaagaagatggacatggattagaggttatgtattatgaagtaaactacaaggtactaacatcatttcgtctgccatttggtttgctttatgctgaaattacttggtggggatttgtgcaattcagatataaaaagtttcattatccaaacc

SEQ ID NO: 446344 - DNA, 5377 bp, Homo sapiens
cgagaatggctcaactctccaaatagagagaatttctatcagttgcaagtacgaaaatttcctgccgattatataaaatactgggagtttgcagtttatctggaagaatgtgaactggctaaacagctttatccaaaggaaaacgatttggtgtttttagctcctgagagaataaatgaagagaagaaagatacagagagaaatgacatacaagatctccacgaatatcattctggttatgttcataaatttcgccgcacgtcagtcatgcgtaatgggaaaactgagtgttacctttccatccagactcaagagaactttccggccaatttaaacgaacttgtgaattgtattgtaatcagttctctggtaactacacaaaggaagttgaaagccatgtctctgttgggtagtcggaaccaactggctagagctgttctgaatccaaaccctatggacttctgtacaaaagatttactgactacaacatctgagagaattattgcgtacttaagagatttcaatgaagaccaaaatcaaacaaaaccgtgtcctcgtgtgtgcaccttccaatgcagctgttgatgaactcatgaaaaaaattatccttgaattcaaagaaaaatgtaaagacaagaagaatcctttaggaaactgtggagatataaatttagtacgactgggtccagaaaagtctattaatagtgaggttctaaagttcagtttggacagccaagtaaaccacagaatgaaaaaagagttaccttctcatgttcaggcgatgcataaaagaaaggaatttctagattatcagctggatgagctttcccggcagcgagctctatgccgaggtggacgggaaatacagaggcaagaattagatgaaaacatttccaaagtttctaaggaaaggcaggaacttgcttctaaaattaaagaggttcaaggacgcccacagaaaacacagagtatcatcatcttagagtcccatatcatctgctgcacgttgagcacaagtggtggtttactacttgagtctgctttccgtgggcaagggggtgtccccttcagctgtgtcattgttgatgaggctggacagtcttgtgaaattgagactcttactccactcatccatcgctgcaataagctcatcctagtaggagatcctaagcagctccctccgacagtcatctctatgaaagcacaggagtatggctacgaccagtcaatgatggctcgcttctgcagactgctggaagagaatgtagaacacaacatgatcagcaggctgcccattctacagctcactgttcagtacaggatgcatccagacatatgcctcttcccttctaattatgtttataacagaaacttaaaaacaaatagacagacagaagccattcgatgttcatcagattggccatttcagccataccttgtgtttgatgttggagatggttcagaaagacgggataatgactcatatataaatgttcaagaaataaaactggtgatggaaataattaagcttattaaagacaaaagaaaggatgttagttttcgaaacattggcataataactcattacaaggcccagaagacgatgattcagaaggatttggacaaagagttcgatagaaaaggaccagcagaagtagacactgtggatgcattccagggtcggcagaaggattgtgttattgttacgtgtgtcagagcaaatagcatccaaggttcaattggattcctggcaagtttgcagagattgaatgtcaccatcacacgagccaagtacagcctcttcatcctcggacatttgaggaccctgatggaaaaccagcattggaatcagctgattcaggatgctcagaagcgtggtgccattattaagacctgtgacaaaaactatagacatgatgcagtgaagattctgaaactcaagcctgtgctgcagagaagtctcactcaccctcctaccatagccccagaggggtccagaccccagggtggtttgcccagcagcaagctagacagtggatttgccaagacatctgttgctgcttctctataccacacaccctctgactccaaggaaattactcttactgttacttcaaaggaccctgaaagacctcctgttcatgaccaacttcaggacccacgactgctgaagaggatgggcattgaggtcaaaggaggaatattcctttgggatccacaaccctcgagcccccagcatcctggagcaacacctcctacgggcgagccgggcttccctgtcgttcaccaggacctgagccatatacagcagcccgctgctgtagtggctgctctgagcagccacaaacctcccgtgcggggcgaacctccagctgccagtcccgaggcttccacgtgtcagagcaaatgtgatgacccggaagaggagctctgtcacaggagagaggccagggctttcagtgaaggggagcaggagaagtgtggttccgagacccatcacaccaggaggaactctaggtgggacaagaggacactggagcaggaggacagcagttccaagaaaagaaagcttttataggaaagcccagtgacatgggccagcagccacagcatattgtaaactgaagatgaccagctcgtgggaccatctagataagcttgttttttgtaaggagtttgtgtgctgttggaaaacatggaaaatgcatccttaacacctgagcctctggtcatcttcagtattttctgtcatttgcaaaagctttcagagggcattgtgtatccgtaataatgtccttgaagtcagagactggaaatgttgatctcttagtcttctatagacaaggaggtcagactggagtgaatgttgtaaaagttgaaatgtatatttgtatagcaaataacaaaatccttttaaaatttaatctagtagaccgcttttctttccccctgtttaaaatgttaatcagttttcaacagaacaaactttatattaccaaaaaaaaaaagatgggaggagggcgggtcctttcaaccattgttagagcaagacagataattatttaacagcctagcttggaataagctgagttagtgctggtgggtcaggtgtctctggctctattaaaaaaagcaaaaacccccccaaaaacctggagtctcctaggggacactttgggcagcacggttatgttaggtaaagtcttgctgacatggtgcatttttagatagagtgcattggcccagggtattatatttctgtgatgagttcatttacctgtttcagtatgcacatagttccctagctaaaattcctaatcttcttgagagagaagaatatggagtgaaagaataattcttgagctatcattcaaatgctcccagcatattgtgagccttgtgtgactggtgaggtacagacatttggttgccaaatgctagattagcgctgggtcagctgtggaagaatcgcctcagcttacagattgtcagacagatctaactagttttccagaaagcctgggaagctgtgtgttcaacatttcccaagggattctgatcaccaggcagcttgggaaccactggggcaggccaaatagaatattttgggcgggaaagaagcacccgatttaaaatgaagcgtaaccagaggagttcagaactgggaagagagtggtagacttcctgtgatcttcagaaatcatctacctggtaaaaatacatgctgtttagaatatctgataggtgtttccagctactattagaggtgatagtgcttttgtgggggaaaaaattggtcatggtgaatggagatcgaggaagctcgggacaagggaggggtgggctgcctgattttgtccagttttccaaatatccacgcagtgaactggagtatcctaaacatgagaatgtacagttgacagttgtaaaaactagggatctgtagtgaatgctgtgcagccccatatctcatttgggggtaggaaaatagctgaagattcatgtgcattatttgacatttcctttgtcatctgctttttaagcaaaaaagggttttgtgttagaaattctacttgagcagattataaagagctttaaaaaacaactttcggttgccaaaagtttgagcatttgatttcattacctgtgtctccctcactggtgtccagacggtcaactgaatactcctgaaacccagggagcaggtgacttcctggagtgctttgtccccagagtcagccactgcttcctctgtgggggtggagagtttgtctttggccatgcagtgtgcgacagttcaggacgggtagggatgggtcccattctgtctgggtcaagggctctatcagcttcttccatgtgcctttgggaagaaatctcgttactttaagtttgctttcctgttatcttgatgaagtgcccattttagcagacacttgtagtgctgaccacttagggaatgtacaaactcctaagcttctaaagggaggcatggcaaaaacgttggggtcaggatgtctctcacgctgctcatgttaatactattaacacatgatttgagaaataagttttctctaaaatgcatattttgccgccacacactgaacaatattatttccagtgaagtttgatgcctgttcttacgttgtgttcacctgttggttcaccactcagcagatctgattctgcaagaattaatggtagaactagatcatcctttctaacagacgagcctgtgtcctgtgacggcctttcacagcggaatgcagttgtacctcacattacttttgaaacttcactcgttccagttggtacaagtatttgccaaagccatttcctatgttcaccgtggcccctcctgatgtggctgtcagcgcagcgttgttgaacagggctattctttttacaaggtgtgaagtgtggctcttcgcttcgtctttgccatggcattaaaagaaagttccctgtcttctttcaatattagttatttcaaatgaatatgtgctacttaaaagcttgttttgtttctttgtatataatttgccttggatttattgtgcacagtttgttgagttgtatgtttttgtgaattatcaggagtaaatttgacaagtacatgtgaataacctcctgtaaatgaattttataacaaaaatgtactgaactattttttaaagttgtgcagattagcaattttttgctatagctttgacttttctatgctgtgaattaatagctgcgatttggcaaacagccctgttgtctttgttaaaccctaaattttaagaggaaatggcagaattaaaagcagaaacaagaagatggacatggattagaggttatgtattatgaagtaaactacaaggtactaacatca

SEQ ID NO: 446345 - DNA, 3759 bp, Homo sapiens
taaatatgtttctcttttgtaaatagaccagcagaagtagacactgtggatgcattccagggtcggcagaaggattgtgttattgttacgtgtgtcagagcaaatagcatccaaggttcaattggattcctggcaagtttgcagagattgaatgtcaccatcacacgagccaagtacagcctcttcatcctcggacatttgaggaccctgatggaaaaccagcattggaatcagctgattcaggatgctcagaagcgtggtgccattattaagacctgtgacaaaaactatagacatgatgcagtgaagattctgaaactcaagcctgtgctgcagagaagtctcactcaccctcctaccatagccccagaggggtccagaccccagggtggtttgcccagcagcaagctagacagtggatttgccaagacatctgttgctgcttctctataccacacaccctctgactccaaggaaattactcttactgttacttcaaaggaccctgaaagacctcctgttcatgaccaacttcaggacccacgactgctgaagaggatgggcattgaggtcaaaggaggaatattcctttgggatccacaaccctcgagcccccagcatcctggagcaacacctcctacgggcgagccgggcttccctgtcgttcaccaggacctgagccatatacagcagcccgctgctgtagtggctgctctgagcagccacaaacctcccgtgcggggcgaacctccagctgccagtcccgaggcttccacgtgtcagagcaaatgtgatgacccggaagaggagctctgtcacaggagagaggccagggctttcagtgaaggggagcaggagaagtgtggttccgagacccatcacaccaggaggaactctaggtgggacaagaggacactggagcaggaggacagcagttccaagaaaagaaagcttttataggaaagcccagtgacatgggccagcagccacagcatattgtaaactgaagatgaccagctcgtgggaccatctagataagcttgttttttgtaaggagtttgtgtgctgttggaaaacatggaaaatgcatccttaacacctgagcctctggtcatcttcagtattttctgtcatttgcaaaagctttcagagggcattgtgtatccgtaataatgtccttgaagtcagagactggaaatgttgatctcttagtcttctatagacaaggaggtcagactggagtgaatgttgtaaaagttgaaatgtatatttgtatagcaaataacaaaatccttttaaaatttaatctagtagaccgcttttctttccccctgtttaaaatgttaatcagttttcaacagaacaaactttatattaccaaaaaaaaaaagatgggaggagggcgggtcctttcaaccattgttagagcaagacagataattatttaacagcctagcttggaataagctgagttagtgctggtgggtcaggtgtctctggctctattaaaaaaagcaaaaacccccccaaaaacctggagtctcctaggggacactttgggcagcacggttatgttaggtaaagtcttgctgacatggtgcatttttagatagagtgcattggcccagggtattatatttctgtgatgagttcatttacctgtttcagtatgcacatagttccctagctaaaattcctaatcttcttgagagagaagaatatggagtgaaagaataattcttgagctatcattcaaatgctcccagcatattgtgagccttgtgtgactggtgaggtacagacatttggttgccaaatgctagattagcgctgggtcagctgtggaagaatcgcctcagcttacagattgtcagacagatctaactagttttccagaaagcctgggaagctgtgtgttcaacatttcccaagggattctgatcaccaggcagcttgggaaccactggggcaggccaaatagaatattttgggcgggaaagaagcacccgatttaaaatgaagcgtaaccagaggagttcagaactgggaagagagtggtagacttcctgtgatcttcagaaatcatctacctggtaaaaatacatgctgtttagaatatctgataggtgtttccagctactattagaggtgatagtgcttttgtgggggaaaaaattggtcatggtgaatggagatcgaggaagctcgggacaagggaggggtgggctgcctgattttgtccagttttccaaatatccacgcagtgaactggagtatcctaaacatgagaatgtacagttgacagttgtaaaaactagggatctgtagtgaatgctgtgcagccccatatctcatttgggggtaggaaaatagctgaagattcatgtgcattatttgacatttcctttgtcatctgctttttaagcaaaaaagggttttgtgttagaaattctacttgagcagattataaagagctttaaaaaacaactttcggttgccaaaagtttgagcatttgatttcattacctgtgtctccctcactggtgtccagacggtcaactgaatactcctgaaacccagggagcaggtgacttcctggagtgctttgtccccagagtcagccactgcttcctctgtgggggtggagagtttgtctttggccatgcagtgtgcgacagttcaggacgggtagggatgggtcccattctgtctgggtcaagggctctatcagcttcttccatgtgcctttgggaagaaatctcgttactttaagtttgctttcctgttatcttgatgaagtgcccattttagcagacacttgtagtgctgaccacttagggaatgtacaaactcctaagcttctaaagggaggcatggcaaaaacgttggggtcaggatgtctctcacgctgctcatgttaatactattaacacatgatttgagaaataagttttctctaaaatgcatattttgccgccacacactgaacaatattatttccagtgaagtttgatgcctgttcttacgttgtgttcacctgttggttcaccactcagcagatctgattctgcaagaattaatggtagaactagatcatcctttctaacagacgagcctgtgtcctgtgacggcctttcacagcggaatgcagttgtacctcacattacttttgaaacttcactcgttccagttggtacaagtatttgccaaagccatttcctatgttcaccgtggcccctcctgatgtggctgtcagcgcagcgttgttgaacagggctattctttttacaaggtgtgaagtgtggctcttcgcttcgtctttgccatggcattaaaagaaagttccctgtcttctttcaatattagttatttcaaatgaatatgtgctacttaaaagcttgttttgtttctttgtatataatttgccttggatttattgtgcacagtttgttgagttgtatgtttttgtgaattatcaggagtaaatttgacaagtacatgtgaataacctcctgtaaatgaattttataacaaaaatgtactgaactattttttaaagttgtgcagattagcaattttttgctatagctttgacttttctatgctgtgaattaatagctgcgatttggcaaacagccctgttgtctttgttaaaccctaaattttaagaggaaatggcagaattaaaagcagaaacaagaagatggacatggattagaggttatgtattatgaagtaaactacaaggtactaacatca

SEQ ID NO: 446346 - DNA, 3956 bp, Homo sapiens
catgttgcccaggctcgtcttgaacctctgacctcaggtgatccgcccgcctcagcctcccaaagtgttaggattacaggcatgagccactgcacctggcccagtgcataagttttaatgctggtgttatcttgtcttatcagaaaatgtctgtagaaggttttcaggcattatttttaaatggtttattgactaaaagtctaagggttataattgcctcatcatgtaatttccaaggataggtacatggccaagaggctccccaaggtcagaaatgctaaaatgtgaaagcaacgtgcactttagaatccattaaatattgaccaaggtcacacagcaagtaaatactgtgcagcctcactgcttccctaacatacctttatgaacagtacaggagcccccatgagagggaaaaccagcattggaatcagctgattcaggatgctcagaagcgtggtgccattattaagacctgtgacaaaaactatagacatgatgcagtgaagattctgaaactcaagcctgtgctgcagagaagtctcactcaccctcctaccatagccccagaggggtccagaccccagggtggtttgcccagcagcaagctagacagtggatttgccaagacatctgttgctgcttctctataccacacaccctctgactccaaggaaattactcttactgttacttcaaaggaccctgaaagacctcctgttcatgaccaacttcaggacccacgactgctgaagaggatgggcattgaggtcaaaggaggaatattcctttgggatccacaaccctcgagcccccagcatcctggagcaacacctcctacgggcgagccgggcttccctgtcgttcaccaggacctgagccatatacagcagcccgctgctgtagtggctgctctgagcagccacaaacctcccgtgcggggcgaacctccagctgccagtcccgaggcttccacgtgtcagagcaaatgtgatgacccggaagaggagctctgtcacaggagagaggccagggctttcagtgaaggggagcaggagaagtgtggttccgagacccatcacaccaggaggaactctaggtgggacaagaggacactggagcaggaggacagcagttccaagaaaagaaagcttttataggaaagcccagtgacatgggccagcagccacagcatattgtaaactgaagatgaccagctcgtgggaccatctagataagcttgttttttgtaaggagtttgtgtgctgttggaaaacatggaaaatgcatccttaacacctgagcctctggtcatcttcagtattttctgtcatttgcaaaagctttcagagggcattgtgtatccgtaataatgtccttgaagtcagagactggaaatgttgatctcttagtcttctatagacaaggaggtcagactggagtgaatgttgtaaaagttgaaatgtatatttgtatagcaaataacaaaatccttttaaaatttaatctagtagaccgcttttctttccccctgtttaaaatgttaatcagttttcaacagaacaaactttatattaccaaaaaaaaaaagatgggaggagggcgggtcctttcaaccattgttagagcaagacagataattatttaacagcctagcttggaataagctgagttagtgctggtgggtcaggtgtctctggctctattaaaaaaagcaaaaacccccccaaaaacctggagtctcctaggggacactttgggcagcacggttatgttaggtaaagtcttgctgacatggtgcatttttagatagagtgcattggcccagggtattatatttctgtgatgagttcatttacctgtttcagtatgcacatagttccctagctaaaattcctaatcttcttgagagagaagaatatggagtgaaagaataattcttgagctatcattcaaatgctcccagcatattgtgagccttgtgtgactggtgaggtacagacatttggttgccaaatgctagattagcgctgggtcagctgtggaagaatcgcctcagcttacagattgtcagacagatctaactagttttccagaaagcctgggaagctgtgtgttcaacatttcccaagggattctgatcaccaggcagcttgggaaccactggggcaggccaaatagaatattttgggcgggaaagaagcacccgatttaaaatgaagcgtaaccagaggagttcagaactgggaagagagtggtagacttcctgtgatcttcagaaatcatctacctggtaaaaatacatgctgtttagaatatctgataggtgtttccagctactattagaggtgatagtgcttttgtgggggaaaaaattggtcatggtgaatggagatcgaggaagctcgggacaagggaggggtgggctgcctgattttgtccagttttccaaatatccacgcagtgaactggagtatcctaaacatgagaatgtacagttgacagttgtaaaaactagggatctgtagtgaatgctgtgcagccccatatctcatttgggggtaggaaaatagctgaagattcatgtgcattatttgacatttcctttgtcatctgctttttaagcaaaaaagggttttgtgttagaaattctacttgagcagattataaagagctttaaaaaacaactttcggttgccaaaagtttgagcatttgatttcattacctgtgtctccctcactggtgtccagacggtcaactgaatactcctgaaacccagggagcaggtgacttcctggagtgctttgtccccagagtcagccactgcttcctctgtgggggtggagagtttgtctttggccatgcagtgtgcgacagttcaggacgggtagggatgggtcccattctgtctgggtcaagggctctatcagcttcttccatgtgcctttgggaagaaatctcgttactttaagtttgctttcctgttatcttgatgaagtgcccattttagcagacacttgtagtgctgaccacttagggaatgtacaaactcctaagcttctaaagggaggcatggcaaaaacgttggggtcaggatgtctctcacgctgctcatgttaatactattaacacatgatttgagaaataagttttctctaaaatgcatattttgccgccacacactgaacaatattatttccagtgaagtttgatgcctgttcttacgttgtgttcacctgttggttcaccactcagcagatctgattctgcaagaattaatggtagaactagatcatcctttctaacagacgagcctgtgtcctgtgacggcctttcacagcggaatgcagttgtacctcacattacttttgaaacttcactcgttccagttggtacaagtatttgccaaagccatttcctatgttcaccgtggcccctcctgatgtggctgtcagcgcagcgttgttgaacagggctattctttttacaaggtgtgaagtgtggctcttcgcttcgtctttgccatggcattaaaagaaagttccctgtcttctttcaatattagttatttcaaatgaatatgtgctacttaaaagcttgttttgtttctttgtatataatttgccttggatttattgtgcacagtttgttgagttgtatgtttttgtgaattatcaggagtaaatttgacaagtacatgtgaataacctcctgtaaatgaattttataacaaaaatgtactgaactattttttaaagttgtgcagattagcaattttttgctatagctttgacttttctatgctgtgaattaatagctgcgatttggcaaacagccctgttgtctttgttaaaccctaaattttaagaggaaatggcagaattaaaagcagaaacaagaagatggacatggattagaggttatgtattatgaagtaaactacaaggtactaacatca

SEQ ID NO: 446347 - DNA, 3112 bp, Homo sapiens
acccgagattcctgctgctcgtgacaacagctgcagggaaaggagggaggactcaatgagaccatctgacaggctgatcctgcatgacccaattatttgatcttctagcactggagcactctactggaccacctttacagagtagctaacaacggcccggaagctctgtcacaggagagaggccagggctttcagtgaaggggagcaggagaagtgtggttccgagacccatcacaccaggaggaactctaggtgggacaagaggacactggagcaggaggacagcagttccaagaaaagaaagcttttataggaaagcccagtgacatgggccagcagccacagcatattgtaaactgaagatgaccagctcgtgggaccatctagataagcttgttttttgtaaggagtttgtgtgctgttggaaaacatggaaaatgcatccttaacacctgagcctctggtcatcttcagtattttctgtcatttgcaaaagctttcagagggcattgtgtatccgtaataatgtccttgaagtcagagactggaaatgttgatctcttagtcttctatagacaaggaggtcagactggagtgaatgttgtaaaagttgaaatgtatatttgtatagcaaataacaaaatccttttaaaatttaatctagtagaccgcttttctttccccctgtttaaaatgttaatcagttttcaacagaacaaactttatattaccaaaaaaaaaaagatgggaggagggcgggtcctttcaaccattgttagagcaagacagataattatttaacagcctagcttggaataagctgagttagtgctggtgggtcaggtgtctctggctctattaaaaaaagcaaaaacccccccaaaaacctggagtctcctaggggacactttgggcagcacggttatgttaggtaaagtcttgctgacatggtgcatttttagatagagtgcattggcccagggtattatatttctgtgatgagttcatttacctgtttcagtatgcacatagttccctagctaaaattcctaatcttcttgagagagaagaatatggagtgaaagaataattcttgagctatcattcaaatgctcccagcatattgtgagccttgtgtgactggtgaggtacagacatttggttgccaaatgctagattagcgctgggtcagctgtggaagaatcgcctcagcttacagattgtcagacagatctaactagttttccagaaagcctgggaagctgtgtgttcaacatttcccaagggattctgatcaccaggcagcttgggaaccactggggcaggccaaatagaatattttgggcgggaaagaagcacccgatttaaaatgaagcgtaaccagaggagttcagaactgggaagagagtggtagacttcctgtgatcttcagaaatcatctacctggtaaaaatacatgctgtttagaatatctgataggtgtttccagctactattagaggtgatagtgcttttgtgggggaaaaaattggtcatggtgaatggagatcgaggaagctcgggacaagggaggggtgggctgcctgattttgtccagttttccaaatatccacgcagtgaactggagtatcctaaacatgagaatgtacagttgacagttgtaaaaactagggatctgtagtgaatgctgtgcagccccatatctcatttgggggtaggaaaatagctgaagattcatgtgcattatttgacatttcctttgtcatctgctttttaagcaaaaaagggttttgtgttagaaattctacttgagcagattataaagagctttaaaaaacaactttcggttgccaaaagtttgagcatttgatttcattacctgtgtctccctcactggtgtccagacggtcaactgaatactcctgaaacccagggagcaggtgacttcctggagtgctttgtccccagagtcagccactgcttcctctgtgggggtggagagtttgtctttggccatgcagtgtgcgacagttcaggacgggtagggatgggtcccattctgtctgggtcaagggctctatcagcttcttccatgtgcctttgggaagaaatctcgttactttaagtttgctttcctgttatcttgatgaagtgcccattttagcagacacttgtagtgctgaccacttagggaatgtacaaactcctaagcttctaaagggaggcatggcaaaaacgttggggtcaggatgtctctcacgctgctcatgttaatactattaacacatgatttgagaaataagttttctctaaaatgcatattttgccgccacacactgaacaatattatttccagtgaagtttgatgcctgttcttacgttgtgttcacctgttggttcaccactcagcagatctgattctgcaagaattaatggtagaactagatcatcctttctaacagacgagcctgtgtcctgtgacggcctttcacagcggaatgcagttgtacctcacattacttttgaaacttcactcgttccagttggtacaagtatttgccaaagccatttcctatgttcaccgtggcccctcctgatgtggctgtcagcgcagcgttgttgaacagggctattctttttacaaggtgtgaagtgtggctcttcgcttcgtctttgccatggcattaaaagaaagttccctgtcttctttcaatattagttatttcaaatgaatatgtgctacttaaaagcttgttttgtttctttgtatataatttgccttggatttattgtgcacagtttgttgagttgtatgtttttgtgaattatcaggagtaaatttgacaagtacatgtgaataacctcctgtaaatgaattttataacaaaaatgtactgaactattttttaaagttgtgcagattagcaattttttgctatagctttgacttttctatgctgtgaattaatagctgcgatttggcaaacagccctgttgtctttgttaaaccctaaattttaagaggaaatggcagaattaaaagcagaaacaagaagatggacatggattagaggttatgtattatgaagtaaactacaaggtactaacatca

SEQ ID NO: 446348 - DNA, 2048 bp, Homo sapiens
  misc_feature (22)..(22): n is a, c, g, or t
aacgtcgtagaggatccggatncgtagatctgagctatcattcaaatgctcccagcatattgtgagccttgtgtgactggtgaggtacagacatttggttgccaaatgctagattagcgctgggtcagctgtggaagaatcgcctcagcttacagattgtcagacagatctaactagttttccagaaagcctgggaagctgtgtgttcaacatttcccaagggattctgatcaccaggcagcttgggaaccactggggcaggccaaatagaatattttgggcgggaaagaagcacccgatttaaaatgaagcgtaaccagaggagttcagaactgggaagagagtggtagacttcctgtgatcttcagaaatcatctacctggtaaaaatacatgctgtttagaatatctgataggtgtttccagctactattagaggtgatagtgcttttgtgggggaaaaaattggtcatggtgaatggagatcgaggaagctcgggacaagggaggggtgggctgcctgattttgtccagttttccaaatatccacgcagtgaactggagtatcctaaacatgagaatgtacagttgacagttgtaaaaactagggatctgtagtgaatgctgtgcagccccatatctcatttgggggtaggaaaatagctgaagattcatgtgcattatttgacatttcctttgtcatctgctttttaagcaaaaaagggttttgtgttagaaattctacttgagcagattataaagagctttaaaaaacaactttcggttgccaaaagtttgagcatttgatttcattacctgtgtctccctcactggtgtccagacggtcaactgaatactcctgaaacccagggagcaggtgacttcctggagtgctttgtccccagagtcagccactgcttcctctgtgggggtggagagtttgtctttggccatgcagtgtgcgacagttcaggacgggtagggatgggtcccattctgtctgggtcaagggctctatcagcttcttccatgtgcctttgggaagaaatctcgttactttaagtttgctttcctgttatcttgatgaagtgcccattttagcagacacttgtagtgctgaccacttagggaatgtacaaactcctaagcttctaaagggaggcatggcaaaaacgttggggtcaggatgtctctcacgctgctcatgttaatactattaacacatgatttgagaaataagttttctctaaaatgcatattttgccgccacacactgaacaatattatttccagtgaagtttgatgcctgttcttacgttgtgttcacctgttggttcaccactcagcagatctgattctgcaagaattaatggtagaactagatcatcctttctaacagacgagcctgtgtcctgtgacggcctttcacagcggaatgcagttgtacctcacattacttttgaaacttcactcgttccagttggtacaagtatttgccaaagccatttcctatgttcaccgtggcccctcctgatgtggctgtcagcgcagcgttgttgaacagggctattctttttacaaggtgtgaagtgtggctcttcgcttcgtctttgccatggcattaaaagaaagttccctgtcttctttcaatattagttatttcaaatgaatatgtgctacttaaaagcttgttttgtttctttgtatataatttgccttggatttattgtgcacagtttgttgagttgtatgtttttgtgaattatcaggagtaaatttgacaagtacatgtgaataacctcctgtaaatgaattttataacaaaaatgtactgaactattttttaaagttgtgcagattagcaattttttgctatagctttgacttttctatgctgtgaattaatagctgcgatttggcaaacagccctgttgtctttgttaaaccctaaattttaagaggaaatggcagaattaaaagcagaaacaagaagatggacatggattagaggttatgtattatgaagtaaactacaaggtactaacatca

SEQ ID NO: 446349 - DNA, 1352 bp, Homo sapiens
  misc_feature (15)..(15): n is a, c, g, or t
atgtcgggacagccntgctcccaagtacaaatagagtgacccgtaaaatccaggattttttgttttttgcagcttggggctttcgagttgccaaaagtttgagcatttgatttcattacctgtgtctccctcactggtgtccagacggtcaactgaatactcctgaaacccagggagcaggtgacttcctggagtgctttgtccccagagtcagccactgcttcctctgtgggggtggagagtttgtctttggccatgcagtgtgcgacagttcaggacgggtagggatgggtcccattctgtctgggtcaagggctctatcagcttcttccatgtgcctttgggaagaaatctcgttactttaagtttgctttcctgttatcttgatgaagtgcccattttagcagacacttgtagtgctgaccacttagggaatgtacaaactcctaagcttctaaagggaggcatggcaaaaacgttggggtcaggatgtctctcacgctgctcatgttaatactattaacacatgatttgagaaataagttttctctaaaatgcatattttgccgccacacactgaacaatattatttccagtgaagtttgatgcctgttcttacgttgtgttcacctgttggttcaccactcagcagatctgattctgcaagaattaatggtagaactagatcatcctttctaacagacgagcctgtgtcctgtgacggcctttcacagcggaatgcagttgtacctcacattacttttgaaacttcactcgttccagttggtacaagtatttgccaaagccatttcctatgttcaccgtggcccctcctgatgtggctgtcagcgcagcgttgttgaacagggctattctttttacaaggtgtgaagtgtggctcttcgcttcgtctttgccatggcattaaaagaaagttccctgtcttctttcaatattagttatttcaaatgaatatgtgctacttaaaagcttgttttgtttctttgtatataatttgccttggatttattgtgcacagtttgttgagttgtatgtttttgtgaattatcaggagtaaatttgacaagtacatgtgaataacctcctgtaaatgaattttataacaaaaatgtactgaactattttttaaagttgtgcagattagcaattttttgctatagctttgacttttctatgctgtgaattaatagctgcgatttggcaaacagccctgttgtctttgttaaaccctaaattttaagaggaaatggcagaattaaaagcagaaacaagaagatggacatggattagaggttatgtattatgaagtaaactacaaggtactaacatca

SEQ ID NO: 446350 - DNA, 2471 bp, Homo sapiens
cgagaatggctcaactctccaaatagagagaatttctatcagttgcaagtacgaaaatttcctgccgattatataaaatactgggagtttgcagtttatctggaagaatgtgaactggctaaacagctttatccaaaggaaaacgatttggtgtttttagctcctgagagaataaatgaagagaagaaagatacagagagaaatgacatacaagatctccacgaatatcattctggttatgttcataaatttcgccgcacgtcagtcatgcgtaatgggaaaactgagtgttacctttccatccagactcaagagaactttccggccaatttaaacgaacttgtgaattgtattgtaatcagttctctggtaactacacaaaggaagttgaaagccatgtctctgttgggtagtcggaaccaactggctagagctgttctgaatccaaaccctatggacttctgtacaaaagatttactgactacaacatctgagagaattattgcgtacttaagagatttcaatgaagatcaaaagaaagcaatagaaactgcatatgctatggtgaaacactcaccatcagttgccaaaatctgcttgattcatggaccacctggaacaggaaaatcaaaaactattgttggcctcctctatcgtctactgacagagaaccagaggaaggggcattcagacgaaaactccaatgccaaaatcaaacaaaaccgtgtcctcgtgtgtgcaccttccaatgcagctgttgatgaactcatgaaaaaaattatccttgaattcaaagaaaaatgtaaagacaagaagaatcctttaggaaactgtggagatataaatttagtacgactgggtccagaaaagtctattaatagtgaggttctaaagttcagtttggacagccaagtaaaccacagaatgaaaaaagagttaccttctcatgttcaggcgatgcataaaagaaaggaatttctagattatcagctggatgagctttcccggcagcgagctctatgccgaggtggacgggaaatacagaggcaagaattagatgaaaacatttccaaagtttctaaggaaaggcaggaacttgcttctaaaattaaagaggttcaaggacgcccacagaaaacacagagtatcatcatcttagagtcccatatcatctgctgcacgttgagcacaagtggtggtttactacttgagtctgctttccgtgggcaagggggtgtccccttcagctgtgtcattgttgatgaggctggacagtcttgtgaaattgagactcttactccactcatccatcgctgcaataagctcatcctagtaggagatcctaagcagctccctccgacagtcatctctatgaaagcacaggagtatggctacgaccagtcaatgatggctcgcttctgcagactgctggaagagaatgtagaacacaacatgatcagcaggctgcccattctacagctcactgttcagtacaggatgcatccagacatatgcctcttcccttctaattatgtttataacagaaacttaaaaacaaatagacagacagaagccattcgatgttcatcagattggccatttcagccataccttgtgtttgatgttggagatggttcagaaagacgggataatgactcatatataaatgttcaagaaataaaactggtgatggaaataattaagcttattaaagacaaaagaaaggatgttagttttcgaaacattggcataataactcattacaaggcccagaagacgatgattcagaaggatttggacaaagagttcgatagaaaaggaccagcagaagtagacactgtggatgcattccagggtcggcagaaggattgtgttattgttacgtgtgtcagagcaaatagcatccaaggttcaattggattcctggcaagtttgcagagattgaatgtcaccatcacacgagccaagtacagcctcttcatcctcggacatttgaggaccctgatgatgaggaaacaggctcagagaggtcaagtgacttgaccaaggtcacacagcaagtaaatactgtgcagcctcactgcttccctaacatacctttatgaacagtacaggagcccccatgagagggaaaaccagcattggaatcagctgattcaggatgctcagaagcgtggtgccattattaagacctgtgacaaaaactatagacatgatgcagtgaagattctgaaactcaagcctgtgctgcagagaagtctcactcaccctcctaccatagccccagaggggtccagaccccagggtggtttgcccagcagcaagctagacagtggatttgccaagacatctgttgtctttgttaaaccctaaattttaagaggaaatggcagaattaaaagcagaaacaagaagatggacatggattagaggttatgtattatgaagtaaactacaaggtactaacatca

SEQ ID NO: 446351 - DNA, 1992 bp, Homo sapiens
cgagaatggctcaactctccaaatagagagaatttctatcagttgcaagtacgaaaatttcctgccgattatataaaatactgggagtttgcagtttatctggaagaatgtgaactggctaaacagctttatccaaaggaaaacgatttggtgtttttagctcctgagagaataaatgaagagaagaaagatacagagagaaatgacatacaagatctccacgaatatcattctggttatgttcataaatttcgccgcacgtcagtcatgcgtaatgggaaaactgagtgttacctttccatccagactcaagagaactttccggccaatttaaacgaacttgtgaattgtattgtaatcagttctctggtaactacacaaaggaagttgaaagccatgtctctgttgggtagtcggaaccaactggctagagctgttctgaatccaaaccctatggacttctgtacaaaagatttactgactacaacatctgagagaattattgcgtacttaagagatttcaatgaagatcaaaagaaagcaatagaaactgcatatgctatggtgaaacactcaccatcagttgccaaaatctgcttgattcatggaccacctggaacaggaaaatcaaaaactattgttggcctcctctatcgtctactgacagagaaccagaggaaggggcattcagacgaaaactccaatgccaaaatcaaacaaaaccgtgtcctcgtgtgtgcaccttccaatgcagctgttgatgaactcatgaaaaaaattatccttgaattcaaagaaaaatgtaaagacaagaagaatcctttaggaaactgtggagatataaatttagtacgactgggtccagaaaagtctattaatagtgaggttctaaagttcagtttggacagccaagtaaaccacagaatgaaaaaagagttaccttctcatgttcaggcgatgcataaaagaaaggaatttctagattatcagctggatgagctttcccggcagcgagctctatgccgaggtggacgggaaatacagaggcaagaattagatgaaaacatttccaaagtttctaaggaaaggcaggaacttgcttctaaaattaaagaggttcaaggacgcccacagaaaacacagagtatcatcatcttagagtcccatatcatctgctgcacgttgagcacaagtggtggtttactacttgagtctgctttccgtgggcaagggggtgtccccttcagctgtgtcattgttgatgaggctggacagtcttgtgaaattgagactcttactccactcatccatcgctgcaataagctcatcctagtaggagatcctaagcagctccctccgacagtcatctctatgaaagcacaggagtatggctacgaccagtcaatgatggctcgcttctgcagactgctggaagagaatgtagaacacaacatgatcagcaggctgcccattctacagctcactgttcagtacaggatgcatccagacatatgcctcttcccttctaattatgtttataacagaaacttaaaaacaaatagacagacagaagccattcgatgttcatcagattggccatttcagccataccttgtgtttgatgttggagatggttcagaaagacgggataatgactccatcatcataacatgttcaacgcaacatcaacacactggtgcatggcaacatcacacttccacagctctcattcacacgcaccaacacagcaaaggactgcttagatctgtatcgacaccaattggcaataactaacgtcacttacaaggacccagaaagcacgaatgcattcagacaggcatttggaacaaaacgcagttcgactagaacaccaggacccagacagaacgatacgacaactgatggcatgcacatatccatgggatcgagacacgacaggacttgtcgtttactatgtataacgtgtgatcaagagcaaactacgcagtccag

SEQ ID NO: 446352 - DNA, 442 bp, Homo sapiens
ttggtgcaggagaagtgtgatacttttctgaatggttagaactttaatcagataaactatatggataaatagcaaagattgttaagactgcctctctcttctgtatcttaccaaggctggacagtcttgtgaaattgagactcttactccactcatccatcgctgcaataagctcatcctagtaggagatcctaagcagctccctccgacagtcatctctatggtaagttttttatgttcagattgctttaaaatggaaggggctttttaaaatttttgttttcaggagggagagacatctttcttggattggcctcttaatttggagggaaaagtaagcagtaactaagaaaagagaagcacttaataaattttaaaaaatgcctaaaaatgtccatttggtcatagttgttcttctgtgtatgtgtggcagaagcagtgt

SEQ ID NO: 446353 - DNA, 5553 bp, Homo sapiens
cgagaatggctcaactctccaaatagagagaatttctatcagttgcaagtacgaaaatttcctgccgattatataaaatactgggagtttgcagtttatctggaagaatgtgaactggctaaacagctttatccaaaggaaaacgatttggtgtttttagctcctgagagaataaatgaagagaagaaagatacagagagaaatgacatacaagatctccacgaatatcattctggttatgttcataaatttcgccgcacgtcagtcatgcgtaatgggaaaactgagtgttacctttccatccagactcaagagaactttccggccaatttaaacgaacttgtgaattgtattgtaatcagttctctggtaactacacaaaggaagttgaaagccatgtctctgttgggtagtcggaaccaactggctagagctgttctgaatccaaaccctatggacttctgtacaaaagatttactgactacaacatctgagagaattattgcgtacttaagagatttcaatgaagatcaaaagaaagcaatagaaactgcatatgctatggtgaaacactcaccatcagttgccaaaatctgcttgattcatggaccacctggaacaggaaaatcaaaaactattgttggcctcctctatcgtctactgacagagaaccagaggaaggggcattcagacgaaaactccaatgccaaaatcaaacaaaaccgtgtcctcgtgtgtgcaccttccaatgcagctgttgatgaactcatgaaaaaaattatccttgaattcaaagaaaaatgtaaagacaagaagaatcctttaggaaactgtggagatataaatttagtacgactgggtccagaaaagtctattaatagtgaggttctaaagttcagtttggacagccaagtaaaccacagaatgaaaaaagagttaccttctcatgttcaggcgatgcataaaagaaaggaatttctagattatcagctggatgagctttcccggcagcgagctctatgccgaggtggacgggaaatacagaggcaagaattagatgaaaacatttccaaagtttctaaggaaaggcaggaacttgcttctaaaattaaagaggttcaaggacgcccacagaaaacacagagtatcatcatcttagagtcccatatcatctgctgcacgttgagcacaagtggtggtttactacttgagtctgctttccgtgggcaagggggtgtccccttcagctgtgtcattgttgatgaggctggacagtcttgtgaaattgagactcttactccactcatccatcgctgcaataagctcatcctagtaggagatcctaagcagctccctccgacagtcatctctatgaaagcacaggagtatggctacgaccagtcaatgatggctcgcttctgcagactgctggaagagaatgtagaacacaacatgatcagcaggctgcccattctacagctcactgttcagtacaggatgcatccagacatatgcctcttcccttctaattatgtttataacagaaacttaaaaacaaatagacagacagaagccattcgatgttcatcagattggccatttcagccataccttgtgtttgatgttggagatggttcagaaagacgggataatgactcatatataaatgttcaagaaataaaactggtgatggaaataattaagcttattaaagacaaaagaaaggatgttagttttcgaaacattggcataataactcattacaaggcccagaagacgatgattcagaaggatttggacaaagagttcgatagaaaaggaccagcagaagtagacactgtggatgcattccagggtcggcagaaggattgtgttattgttacgtgtgtcagagcaaatagcatccaaggttcaattggattcctggcaagtttgcagagattgaatgtcaccatcacacgagccaagtacagcctcttcatcctcggacatttgaggaccctgatggaaaaccagcattggaatcagctgattcaggatgctcagaagcgtggtgccattattaagacctgtgacaaaaactatagacatgatgcagtgaagattctgaaactcaagcctgtgctgcagagaagtctcactcaccctcctaccatagccccagaggggtccagaccccagggtggtttgcccagcagcaagctagacagtggatttgccaagacatctgttgctgcttctctataccacacaccctctgactccaaggaaattactcttactgttacttcaaaggaccctgaaagacctcctgttcatgaccaacttcaggacccacgactgctgaagaggatgggcattgaggtcaaaggaggaatattcctttgggatccacaaccctcgagcccccagcatcctggagcaacacctcctacgggcgagccgggcttccctgtcgttcaccaggacctgagccatatacagcagcccgctgctgtagtggctgctctgagcagccacaaacctcccgtgcggggcgaacctccagctgccagtcccgaggcttccacgtgtcagagcaaatgtgatgacccggaagaggagctctgtcacaggagagaggccagggctttcagtgaaggggagcaggagaagtgtggttccgagacccatcacaccaggaggaactctaggtgggacaagaggacactggagcaggaggacagcagttccaagaaaagaaagcttttataggaaagcccagtgacatgggccagcagccacagcatattgtaaactgaagatgaccagctcgtgggaccatctagataagcttgttttttgtaaggagtttgtgtgctgttggaaaacatggaaaatgcatccttaacacctgagcctctggtcatcttcagtattttctgtcatttgcaaaagctttcagagggcattgtgtatccgtaataatgtccttgaagtcagagactggaaatgttgatctcttagtcttctatagacaaggaggtcagactggagtgaatgttgtaaaagttgaaatgtatatttgtatagcaaataacaaaatccttttaaaatttaatctagtagaccgcttttctttccccctgtttaaaatgttaatcagttttcaacagaacaaactttatattaccaaaaaaaaaaagatgggaggagggcgggtcctttcaaccattgttagagcaagacagataattatttaacagcctagcttggaataagctgagttagtgctggtgggtcaggtgtctctggctctattaaaaaaagcaaaaacccccccaaaaacctggagtctcctaggggacactttgggcagcacggttatgttaggtaaagtcttgctgacatggtgcatttttagatagagtgcattggcccagggtattatatttctgtgatgagttcatttacctgtttcagtatgcacatagttccctagctaaaattcctaatcttcttgagagagaagaatatggagtgaaagaataattcttgagctatcattcaaatgctcccagcatattgtgagccttgtgtgactggtgaggtacagacatttggttgccaaatgctagattagcgctgggtcagctgtggaagaatcgcctcagcttacagattgtcagacagatctaactagttttccagaaagcctgggaagctgtgtgttcaacatttcccaagggattctgatcaccaggcagcttgggaaccactggggcaggccaaatagaatattttgggcgggaaagaagcacccgatttaaaatgaagcgtaaccagaggagttcagaactgggaagagagtggtagacttcctgtgatcttcagaaatcatctacctggtaaaaatacatgctgtttagaatatctgataggtgtttccagctactattagaggtgatagtgcttttgtgggggaaaaaattggtcatggtgaatggagatcgaggaagctcgggacaagggaggggtgggctgcctgattttgtccagttttccaaatatccacgcagtgaactggagtatcctaaacatgagaatgtacagttgacagttgtaaaaactagggatctgtagtgaatgctgtgcagccccatatctcatttgggggtaggaaaatagctgaagattcatgtgcattatttgacatttcctttgtcatctgctttttaagcaaaaaagggttttgtgttagaaattctacttgagcagattataaagagctttaaaaaacaactttcggttgccaaaagtttgagcatttgatttcattacctgtgtctccctcactggtgtccagacggtcaactgaatactcctgaaacccagggagcaggtgacttcctggagtgctttgtccccagagtcagccactgcttcctctgtgggggtggagagtttgtctttggccatgcagtgtgcgacagttcaggacgggtagggatgggtcccattctgtctgggtcaagggctctatcagcttcttccatgtgcctttgggaagaaatctcgttactttaagtttgctttcctgttatcttgatgaagtgcccattttagcagacacttgtagtgctgaccacttagggaatgtacaaactcctaagcttctaaagggaggcatggcaaaaacgttggggtcaggatgtctctcacgctgctcatgttaatactattaacacatgatttgagaaataagttttctctaaaatgcatattttgccgccacacactgaacaatattatttccagtgaagtttgatgcctgttcttacgttgtgttcacctgttggttcaccactcagcagatctgattctgcaagaattaatggtagaactagatcatcctttctaacagacgagcctgtgtcctgtgacggcctttcacagcggaatgcagttgtacctcacattacttttgaaacttcactcgttccagttggtacaagtatttgccaaagccatttcctatgttcaccgtggcccctcctgatgtggctgtcagcgcagcgttgttgaacagggctattctttttacaaggtgtgaagtgtggctcttcgcttcgtctttgccatggcattaaaagaaagttccctgtcttctttcaatattagttatttcaaatgaatatgtgctacttaaaagcttgttttgtttctttgtatataatttgccttggatttattgtgcacagtttgttgagttgtatgtttttgtgaattatcaggagtaaatttgacaagtacatgtgaataacctcctgtaaatgaattttataacaaaaatgtactgaactattttttaaagttgtgcagattagcaattttttgctatagctttgacttttctatgctgtgaattaatagctgcgatttggcaaacagccctgttgtctttgttaaaccctaaattttaagaggaaatggcagaattaaaagcagaaacaagaagatggacatggattagaggttatgtattatgaagtaaactacaaggtactaacatca

SEQ ID NO: 446354 - DNA, 5196 bp, Homo sapiens
cgagaatggctcaactctccaaatagagagaatttctatcagttgcaagtacgaaaatttcctgccgattatataaaatactgggagtttgcagtttatctggaagaatgtgaactggctaaacagctttatccaaaggaaaacgatttggtgtttttagctcctgagagaataaatgaagagaagaaagatacagagagaaatgacatacaagatctccacgaatatcattctggttatgttcataaatttcgccgcacgtcagtcatgcgtaatgggaaaactgagtgttacctttccatccagactcaagagaactttccggccaatttaaacgaacttgtgaattgtattgtaatcagttctctggtaactacacaaaggaagttgaaagccatgtctctgttgggtagtcggaaccaactggctagagctgttctgaatccaaaccctatggacttctgtacaaaagatttactgactacaacatctgagagaattattgcgtacttaagagatttcaatgaagatcaaaagaaagcaatagaaactgcatatgctatggtgaaacactcaccatcagttgccaaaatctgcttgattcatggaccacctggaacaggaaaatcaaaaactattgttggcctcctctatcgtctactgacagagaaccagaggaaggggcattcagacgaaaactccaatgccaaaatcaaacaaaaccgtgtcctcgtgtgtgcaccttccaatgcagctgttgatgaactcatgaaaaaaattatccttgaattcaaagaaaaatgtaaagacaagaagaatcctttaggaaactgtggagatataaatttagtacgactgggtccagaaaagtctattaatagtgaggttctaaagttcagtttggacagccaagtaaaccacagaatgaaaaaagagttaccttctcatgttcaggcgatgcataaaagaaaggaatttctagattatcagctggatgagctttcccggcagcgagctctatgccgaggtggacgggaaatacagaggcaagaattagatgaaaacatttccaaagtttctaaggaaaggcaggaacttgcttctaaaattaaagaggttcaaggacgcccacagaaaacacagagtatcatcatcttagagtcccatatcatctgctgcacgttgagcacaagtggtggtttactacttgagtctgctttccgtgggcaagggggtgtccccttcagctgtgtcattgttgatgaggctggacagtcttgtgaaattgagactcttactccactcatccatcgctgcaataagctcatcctagtaggagatcctaagcagctccctccgacagtcatctctatgaaagcacaggagtatggctacgaccagtcaatgatggctcgcttctgcagactgctggaagagaatgtagaacacaacatgatcagcaggctgcccattctacagctcactgttcagtacaggatgcatccagacatatgcctcttcccttctaattatgtttataacagaaacttaaaaacaaatagacagacagaagccattcgatgttcatcagattggccatttcagccataccttgtgtttgatgttggagatggttcagaaagacgggataatgactcatatataaatgttcaagaaataaaactggtgatggaaataattaagcttattaaagacaaaagaaaggatgttagttttcgaaacattggcataataactcattacaaggcccagaagacgatgattcagaaggatttggacaaagagttcgatagaaaaggaccagcagaagtagacactgtggatgcattccagggtcggcagaaggattgtgttattgttacgtgtgtcagagcaaatagcatccaaggttcaattggattcctggcaagtttgcagagattgaatgtcaccatcacacgagccaagtacagcctcttcatcctcggacatttgaggaccctgatggaaaaccagcattggaatcagctgattcaggatgctcagaagcgtggtgccattattaagacctgtgacaaaaactatagacatgatgcagtgaagattctgaaactcaagcctgtgctgcagagaagtctcactcaccctcctaccatagccccagaggggtccagaccccagggtggtttgcccagcagcaagctagacagtggatttgccaagacatctgttgctgcttctctataccacacaccctctgactccaaggaaattactcttactgttacttcaaaggaccctgaaagacctcctgttcatgaccaacttcaggacccacgactgctgaagaggatgggcattgaggtcaaaggaggaatattcctttgggatccacaaccctcgagcccccagcatcctggagcaacacctcctacgggcgagccgggcttccctgtcgttcaccaggacctgagccatatacagcagcccgctgctgtagtggctgctctgagcagccacaaacctcccgtgcggggcgaacctccagctgccagtcccgaggcttccacgtgtcagagcaaatgtgatgacccggaagaggagctctgtcacaggagagaggccagggctttcagtgaaggggagcaggagaagtgtggttccgagacccatcacaccaggaggaactctaggtgggacaagaggacactggagcaggaggacagcagttccaagaaaagaaagcttttataggaaagcccagtgacatgggccagcagccacagcatattgtaaactgaagatgaccagctcgtgggaccatctagataagcttgttttttgtaaggagtttgtgtgctgttggaaaacatggaaaatgcatccttaacacctgagcctctggtcatcttcagtattttctgtcatttgcaaaagctttcagagggcattgtgtatccgtaataatgtccttgaagtcagagactggaaatgttgatctcttagtcttctatagacaaggaggtcagactggagtgaatgttgtaaaagttgaaatgtatatttgtatagcaaataacaaaatccttttaaaatttaatctagtagaccgcttttctttccccctgtttaaaatgttaatcagttttcaacagaacaaactttatattaccaaaaaaaaaaagatgggaggagggcgggtcctttcaaccattgttagagcaagacagataattatttaacagcctagcttggaataagctgagttagtgctggtgggtcaggtgtctctggctctattaaaaaaagcaaaaacccccccaaaaacctggagtctcctaggggacactttgggcagcacggttatgttaggtaaagtcttgctgacatggtgcatttttagatagagtgcattggcccagggtattatatttctgtgatgagttcatttacctgtttcagtatgcacatagttccctagctaaaattcctaatcttcttgagagagaagaatatggagtgaaagaataattcttgagctatcattcaaatgctcccagcatattgtgagccttgtgtgactggtgaggtacagacatttggttgccaaatgctagattagcgctgggtcagctgtggaagaatcgcctcagcttacagattgtcagacagatctaactattttccaaatatccacgcagtgaactggagtatcctaaacatgagaatgtacagttgacagttgtaaaaactagggatctgtagtgaatgctgtgcagccccatatctcatttgggggtaggaaaatagctgaagattcatgtgcattatttgacatttcctttgtcatctgctttttaagcaaaaaagggttttgtgttagaaattctacttgagcagattataaagagctttaaaaaacaactttcggttgccaaaagtttgagcatttgatttcattacctgtgtctccctcactggtgtccagacggtcaactgaatactcctgaaacccagggagcaggtgacttcctggagtgctttgtccccagagtcagccactgcttcctctgtgggggtggagagtttgtctttggccatgcagtgtgcgacagttcaggacgggtagggatgggtcccattctgtctgggtcaagggctctatcagcttcttccatgtgcctttgggaagaaatctcgttactttaagtttgctttcctgttatcttgatgaagtgcccattttagcagacacttgtagtgctgaccacttagggaatgtacaaactcctaagcttctaaagggaggcatggcaaaaacgttggggtcaggatgtctctcacgctgctcatgttaatactattaacacatgatttgagaaataagttttctctaaaatgcatattttgccgccacacactgaacaatattatttccagtgaagtttgatgcctgttcttacgttgtgttcacctgttggttcaccactcagcagatctgattctgcaagaattaatggtagaactagatcatcctttctaacagacgagcctgtgtcctgtgacggcctttcacagcggaatgcagttgtacctcacattacttttgaaacttcactcgttccagttggtacaagtatttgccaaagccatttcctatgttcaccgtggcccctcctgatgtggctgtcagcgcagcgttgttgaacagggctattctttttacaaggtgtgaagtgtggctcttcgcttcgtctttgccatggcattaaaagaaagttccctgtcttctttcaatattagttatttcaaatgaatatgtgctacttaaaagcttgttttgtttctttgtatataatttgccttggatttattgtgcacagtttgttgagttgtatgtttttgtgaattatcaggagtaaatttgacaagtacatgtgaataacctcctgtaaatgaattttataacaaaaatgtactgaactattttttaaagttgtgcagattagcaattttttgctatagctttgacttttctatgctgtgaattaatagctgcgatttggcaaacagccctgttgtctttgttaaaccctaaattttaagaggaaatggcagaattaaaagcagaaacaagaagatggacatggattagaggttatgtattatgaagtaaactacaaggtactaacatca

SEQ ID NO: 446355 - DNA, 5640 bp, Homo sapiens
cgagaatggctcaactctccaaatagagagaatttctatcagttgcaagtacgaaaatttcctgccgattatataaaatactgggagtttgcagtttatctggaagaatgtgaactggctaaacagctttatccaaaggaaaacgatttggtgtttttagctcctgagagaataaatgaagagaagaaagatacagagagaaatgacatacaagatctccacgaatatcattctggttatgttcataaatttcgccgcacgtcagtcatgcgtaatgggaaaactgagtgttacctttccatccagactcaagagaactttccggccaatttaaacgaacttgtgaattgtattgtaatcagttctctggtaactacacaaaggaagttgaaagccatgtctctgttgggtagtcggaaccaactggctagagctgttctgaatccaaaccctatggacttctgtacaaaagatttactgactacaacatctgagagaattattgcgtacttaagagatttcaatgaagatcaaaagaaagcaatagaaactgcatatgctatggtgaaacactcaccatcagttgccaaaatctgcttgattcatggaccacctggaacaggaaaatcaaaaactattgttggcctcctctatcgtctactgacagagaaccagaggaaggggcattcagacgaaaactccaatgccaaaatcaaacaaaaccgtgtcctcgtgtgtgcaccttccaatgcagctgttgatgaactcatgaaaaaaattatccttgaattcaaagaaaaatgtaaagacaagaagaatcctttaggaaactgtggagatataaatttagtacgactgggtccagaaaagtctattaatagtgaggttctaaagttcagtttggacagccaagtaaaccacagaatgaaaaaagagttaccttctcatgttcaggcgatgcataaaagaaaggaatttctagattatcagctggatgagctttcccggcagcgagctctatgccgaggtggacgggaaatacagaggcaagaattagatgaaaacatttccaaagtttctaaggaaaggcaggaacttgcttctaaaattaaagaggttcaaggacgcccacagaaaacacagagtatcatcatcttagagtcccatatcatctgctgcacgttgagcacaagtggtggtttactacttgagtctgctttccgtgggcaagggggtgtccccttcagctgtgtcattgttgatgaggctggacagtcttgtgaaattgagactcttactccactcatccatcgctgcaataagctcatcctagtaggagatcctaagcagctccctccgacagtcatctctatgaaagcacaggagtatggctacgaccagtcaatgatggctcgcttctgcagactgctggaagagaatgtagaacacaacatgatcagcaggctgcccattctacagctcactgttcagtacaggatgcatccagacatatgcctcttcccttctaattatgtttataacagaaacttaaaaacaaatagacagacagaagccattcgatgttcatcagattggccatttcagccataccttgtgtttgatgttggagatggttcagaaagacgggataatgactcatatataaatgttcaagaaataaaactggtgatggaaataattaagcttattaaagacaaaagaaaggatgttagttttcgaaacattggcataataactcattacaaggcccagaagacgatgattcagaaggatttggacaaagagttcgatagaaaaggaccagcagaagtagacactgtggatgcattccagggtcggcagaaggattgtgttattgttacgtgtgtcagagcaaatagcatccaaggttcaattggattcctggcaagtttgcagagattgaatgtcaccatcacacgagccaagtacagcctcttcatcctcggacatttgaggaccctgatgcaacttcttcctaggagcttttgtgtacacgtgaaccattcgccttttttcagcccagaacccaagtatctacactgggctctcaaggaaaaccagcattggaatcagctgattcaggatgctcagaagcgtggtgccattattaagacctgtgacaaaaactatagacatgatgcagtgaagattctgaaactcaagcctgtgctgcagagaagtctcactcaccctcctaccatagccccagaggggtccagaccccagggtggtttgcccagcagcaagctagacagtggatttgccaagacatctgttgctgcttctctataccacacaccctctgactccaaggaaattactcttactgttacttcaaaggaccctgaaagacctcctgttcatgaccaacttcaggacccacgactgctgaagaggatgggcattgaggtcaaaggaggaatattcctttgggatccacaaccctcgagcccccagcatcctggagcaacacctcctacgggcgagccgggcttccctgtcgttcaccaggacctgagccatatacagcagcccgctgctgtagtggctgctctgagcagccacaaacctcccgtgcggggcgaacctccagctgccagtcccgaggcttccacgtgtcagagcaaatgtgatgacccggaagaggagctctgtcacaggagagaggccagggctttcagtgaaggggagcaggagaagtgtggttccgagacccatcacaccaggaggaactctaggtgggacaagaggacactggagcaggaggacagcagttccaagaaaagaaagcttttataggaaagcccagtgacatgggccagcagccacagcatattgtaaactgaagatgaccagctcgtgggaccatctagataagcttgttttttgtaaggagtttgtgtgctgttggaaaacatggaaaatgcatccttaacacctgagcctctggtcatcttcagtattttctgtcatttgcaaaagctttcagagggcattgtgtatccgtaataatgtccttgaagtcagagactggaaatgttgatctcttagtcttctatagacaaggaggtcagactggagtgaatgttgtaaaagttgaaatgtatatttgtatagcaaataacaaaatccttttaaaatttaatctagtagaccgcttttctttccccctgtttaaaatgttaatcagttttcaacagaacaaactttatattaccaaaaaaaaaaagatgggaggagggcgggtcctttcaaccattgttagagcaagacagataattatttaacagcctagcttggaataagctgagttagtgctggtgggtcaggtgtctctggctctattaaaaaaagcaaaaacccccccaaaaacctggagtctcctaggggacactttgggcagcacggttatgttaggtaaagtcttgctgacatggtgcatttttagatagagtgcattggcccagggtattatatttctgtgatgagttcatttacctgtttcagtatgcacatagttccctagctaaaattcctaatcttcttgagagagaagaatatggagtgaaagaataattcttgagctatcattcaaatgctcccagcatattgtgagccttgtgtgactggtgaggtacagacatttggttgccaaatgctagattagcgctgggtcagctgtggaagaatcgcctcagcttacagattgtcagacagatctaactagttttccagaaagcctgggaagctgtgtgttcaacatttcccaagggattctgatcaccaggcagcttgggaaccactggggcaggccaaatagaatattttgggcgggaaagaagcacccgatttaaaatgaagcgtaaccagaggagttcagaactgggaagagagtggtagacttcctgtgatcttcagaaatcatctacctggtaaaaatacatgctgtttagaatatctgataggtgtttccagctactattagaggtgatagtgcttttgtgggggaaaaaattggtcatggtgaatggagatcgaggaagctcgggacaagggaggggtgggctgcctgattttgtccagttttccaaatatccacgcagtgaactggagtatcctaaacatgagaatgtacagttgacagttgtaaaaactagggatctgtagtgaatgctgtgcagccccatatctcatttgggggtaggaaaatagctgaagattcatgtgcattatttgacatttcctttgtcatctgctttttaagcaaaaaagggttttgtgttagaaattctacttgagcagattataaagagctttaaaaaacaactttcggttgccaaaagtttgagcatttgatttcattacctgtgtctccctcactggtgtccagacggtcaactgaatactcctgaaacccagggagcaggtgacttcctggagtgctttgtccccagagtcagccactgcttcctctgtgggggtggagagtttgtctttggccatgcagtgtgcgacagttcaggacgggtagggatgggtcccattctgtctgggtcaagggctctatcagcttcttccatgtgcctttgggaagaaatctcgttactttaagtttgctttcctgttatcttgatgaagtgcccattttagcagacacttgtagtgctgaccacttagggaatgtacaaactcctaagcttctaaagggaggcatggcaaaaacgttggggtcaggatgtctctcacgctgctcatgttaatactattaacacatgatttgagaaataagttttctctaaaatgcatattttgccgccacacactgaacaatattatttccagtgaagtttgatgcctgttcttacgttgtgttcacctgttggttcaccactcagcagatctgattctgcaagaattaatggtagaactagatcatcctttctaacagacgagcctgtgtcctgtgacggcctttcacagcggaatgcagttgtacctcacattacttttgaaacttcactcgttccagttggtacaagtatttgccaaagccatttcctatgttcaccgtggcccctcctgatgtggctgtcagcgcagcgttgttgaacagggctattctttttacaaggtgtgaagtgtggctcttcgcttcgtctttgccatggcattaaaagaaagttccctgtcttctttcaatattagttatttcaaatgaatatgtgctacttaaaagcttgttttgtttctttgtatataatttgccttggatttattgtgcacagtttgttgagttgtatgtttttgtgaattatcaggagtaaatttgacaagtacatgtgaataacctcctgtaaatgaattttataacaaaaatgtactgaactattttttaaagttgtgcagattagcaattttttgctatagctttgacttttctatgctgtgaattaatagctgcgatttggcaaacagccctgttgtctttgttaaaccctaaattttaagaggaaatggcagaattaaaagcagaaacaagaagatggacatggattagaggttatgtattatgaagtaaactacaaggtactaacatca

SEQ ID NO: 446356 - DNA, 5682 bp, Homo sapiens
cgagaatggctcaactctccaaatagagagaatttctatcagttgcaagtacgaaaatttcctgccgattatataaaatactgggagtttgcagtttatctggaagaatgtgaactggctaaacagctttatccaaaggaaaacgatttggtgtttttagctcctgagagaataaatgaagagaagaaagatacagagagaaatgacatacaagatctccacgaatatcattctggttatgttcataaatttcgccgcacgtcagtcatgcgtaatgggaaaactgagtgttacctttccatccagactcaagagaactttccggccaatttaaacgaacttgtgaattgtattgtaatcagttctctggtaactacacaaaggaagttgaaagccatgtctctgttgggtagtcggaaccaactggctagagctgttctgaatccaaaccctatggacttctgtacaaaagatttactgactacaacatctgagagaattattgcgtacttaagagatttcaatgaagatcaaaagaaagcaatagaaactgcatatgctatggtgaaacactcaccatcagttgccaaaatctgcttgattcatggaccacctggaacaggaaaatcaaaaactattgttggcctcctctatcgtctactgacagagaaccagaggaaggggcattcagacgaaaactccaatgccaaaatcaaacaaaaccgtgtcctcgtgtgtgcaccttccaatgcagctgttgatgaactcatgaaaaaaattatccttgaattcaaagaaaaatgtaaagacaagaagaatcctttaggaaactgtggagatataaatttagtacgactgggtccagaaaagtctattaatagtgaggttctaaagttcagtttggacagccaagtaaaccacagaatgaaaaaagagttaccttctcatgttcaggcgatgcataaaagaaaggaatttctagattatcagctggatgagctttcccggcagcgagctctatgccgaggtggacgggaaatacagaggcaagaattagatgaaaacatttccaaagtttctaaggaaaggcaggaacttgcttctaaaattaaagaggttcaaggacgcccacagaaaacacagagtatcatcatcttagagtcccatatcatctgctgcacgttgagcacaagtggtggtttactacttgagtctgctttccgtgggcaagggggtgtccccttcagctgtgtcattgttgatgaggctggacagtcttgtgaaattgagactcttactccactcatccatcgctgcaataagctcatcctagtaggagatcctaagcagctccctccgacagtcatctctatgaaagcacaggagtatggctacgaccagtcaatgatggctcgcttctgcagactgctggaagagaatgtagaacacaacatgatcagcaggctgcccattctacagctcactgttcagtacaggatgcatccagacatatgcctcttcccttctaattatgtttataacagaaacttaaaaacaaatagacagacagaagccattcgatgttcatcagattggccatttcagccataccttgtgtttgatgttggagatggttcagaaagacgggataatgactcatatataaatgttcaagaaataaaactggtgatggaaataattaagcttattaaagacaaaagaaaggatgttagttttcgaaacattggcataataactcattacaaggcccagaagacgatgattcagaaggattcgaactctttgtccaaatccttctgaatcatcgtcttctgggcttgtaatgagttcgatagaaaaggaccagcagaagtagacactgtggatgcattccagggtcggcagaaggattgtgttattgttacgtgtgtcagagcaaatagcatccaaggttcaattggattcctggcaagtttgcagagattgaatgtcaccatcacacgagccaagtacagcctcttcatcctcggacatttgaggaccctgatgcaacttcttcctaggagcttttgtgtacacgtgaaccattcgccttttttcagcccagaacccaagtatctacactgggctctcaaggaaaaccagcattggaatcagctgattcaggatgctcagaagcgtggtgccattattaagacctgtgacaaaaactatagacatgatgcagtgaagattctgaaactcaagcctgtgctgcagagaagtctcactcaccctcctaccatagccccagaggggtccagaccccagggtggtttgcccagcagcaagctagacagtggatttgccaagacatctgttgctgcttctctataccacacaccctctgactccaaggaaattactcttactgttacttcaaaggaccctgaaagacctcctgttcatgaccaacttcaggacccacgactgctgaagaggatgggcattgaggtcaaaggaggaatattcctttgggatccacaaccctcgagcccccagcatcctggagcaacacctcctacgggcgagccgggcttccctgtcgttcaccaggacctgagccatatacagcagcccgctgctgtagtggctgctctgagcagccacaaacctcccgtgcggggcgaacctccagctgccagtcccgaggcttccacgtgtcagagcaaatgtgatgacccggaagaggagctctgtcacaggagagaggccagggctttcagtgaaggggagcaggagaagtgtggttccgagacccatcacaccaggaggaactctaggtgggacaagaggacactggagcaggaggacagcagttccaagaaaagaaagcttttataggaaagcccagtgacatgggccagcagccacagcatattgtaaactgaagatgaccagctcgtgggaccatctagataagcttgttttttgtaaggagtttgtgtgctgttggaaaacatggaaaatgcatccttaacacctgagcctctggtcatcttcagtattttctgtcatttgcaaaagctttcagagggcattgtgtatccgtaataatgtccttgaagtcagagactggaaatgttgatctcttagtcttctatagacaaggaggtcagactggagtgaatgttgtaaaagttgaaatgtatatttgtatagcaaataacaaaatccttttaaaatttaatctagtagaccgcttttctttccccctgtttaaaatgttaatcagttttcaacagaacaaactttatattaccaaaaaaaaaaagatgggaggagggcgggtcctttcaaccattgttagagcaagacagataattatttaacagcctagcttggaataagctgagttagtgctggtgggtcaggtgtctctggctctattaaaaaaagcaaaaacccccccaaaaacctggagtctcctaggggacactttgggcagcacggttatgttaggtaaagtcttgctgacatggtgcatttttagatagagtgcattggcccagggtattatatttctgtgatgagttcatttacctgtttcagtatgcacatagttccctagctaaaattcctaatcttcttgagagagaagaatatggagtgaaagaataattcttgagctatcattcaaatgctcccagcatattgtgagccttgtgtgactggtgaggtacagacatttggttgccaaatgctagattagcgctgggtcagctgtggaagaatcgcctcagcttacagattgtcagacagatctaactagttttccagaaagcctgggaagctgtgtgttcaacatttcccaagggattctgatcaccaggcagcttgggaaccactggggcaggccaaatagaatattttgggcgggaaagaagcacccgatttaaaatgaagcgtaaccagaggagttcagaactgggaagagagtggtagacttcctgtgatcttcagaaatcatctacctggtaaaaatacatgctgtttagaatatctgataggtgtttccagctactattagaggtgatagtgcttttgtgggggaaaaaattggtcatggtgaatggagatcgaggaagctcgggacaagggaggggtgggctgcctgattttgtccagttttccaaatatccacgcagtgaactggagtatcctaaacatgagaatgtacagttgacagttgtaaaaactagggatctgtagtgaatgctgtgcagccccatatctcatttgggggtaggaaaatagctgaagattcatgtgcattatttgacatttcctttgtcatctgctttttaagcaaaaaagggttttgtgttagaaattctacttgagcagattataaagagctttaaaaaacaactttcggttgccaaaagtttgagcatttgatttcattacctgtgtctccctcactggtgtccagacggtcaactgaatactcctgaaacccagggagcaggtgacttcctggagtgctttgtccccagagtcagccactgcttcctctgtgggggtggagagtttgtctttggccatgcagtgtgcgacagttcaggacgggtagggatgggtcccattctgtctgggtcaagggctctatcagcttcttccatgtgcctttgggaagaaatctcgttactttaagtttgctttcctgttatcttgatgaagtgcccattttagcagacacttgtagtgctgaccacttagggaatgtacaaactcctaagcttctaaagggaggcatggcaaaaacgttggggtcaggatgtctctcacgctgctcatgttaatactattaacacatgatttgagaaataagttttctctaaaatgcatattttgccgccacacactgaacaatattatttccagtgaagtttgatgcctgttcttacgttgtgttcacctgttggttcaccactcagcagatctgattctgcaagaattaatggtagaactagatcatcctttctaacagacgagcctgtgtcctgtgacggcctttcacagcggaatgcagttgtacctcacattacttttgaaacttcactcgttccagttggtacaagtatttgccaaagccatttcctatgttcaccgtggcccctcctgatgtggctgtcagcgcagcgttgttgaacagggctattctttttacaaggtgtgaagtgtggctcttcgcttcgtctttgccatggcattaaaagaaagttccctgtcttctttcaatattagttatttcaaatgaatatgtgctacttaaaagcttgttttgtttctttgtatataatttgccttggatttattgtgcacagtttgttgagttgtatgtttttgtgaattatcaggagtaaatttgacaagtacatgtgaataacctcctgtaaatgaattttataacaaaaatgtactgaactattttttaaagttgtgcagattagcaattttttgctatagctttgacttttctatgctgtgaattaatagctgcgatttggcaaacagccctgttgtctttgttaaaccctaaattttaagaggaaatggcagaattaaaagcagaaacaagaagatggacatggattagaggttatgtattatgaagtaaactacaaggtactaacatca

SEQ ID NO: 446357 - DNA, 3574 bp, Homo sapiens
attatttctcccttctcattgtttcaaggaaaaccagcattggaatcagctgattcaggatgctcagaagcgtggtgccattattaagacctgtgacaaaaactatagacatgatgcagtgaagattctgaaactcaagcctgtgctgcagagaagtctcactcaccctcctaccatagccccagaggggtccagaccccagggtggtttgcccagcagcaagctagacagtggatttgccaagacatctgttgctgcttctctataccacacaccctctgactccaaggaaattactcttactgttacttcaaaggaccctgaaagacctcctgttcatgaccaacttcaggacccacgactgctgaagaggatgggcattgaggtcaaaggaggaatattcctttgggatccacaaccctcgagcccccagcatcctggagcaacacctcctacgggcgagccgggcttccctgtcgttcaccaggacctgagccatatacagcagcccgctgctgtagtggctgctctgagcagccacaaacctcccgtgcggggcgaacctccagctgccagtcccgaggcttccacgtgtcagagcaaatgtgatgacccggaagaggagctctgtcacaggagagaggccagggctttcagtgaaggggagcaggagaagtgtggttccgagacccatcacaccaggaggaactctaggtgggacaagaggacactggagcaggaggacagcagttccaagaaaagaaagcttttataggaaagcccagtgacatgggccagcagccacagcatattgtaaactgaagatgaccagctcgtgggaccatctagataagcttgttttttgtaaggagtttgtgtgctgttggaaaacatggaaaatgcatccttaacacctgagcctctggtcatcttcagtattttctgtcatttgcaaaagctttcagagggcattgtgtatccgtaataatgtccttgaagtcagagactggaaatgttgatctcttagtcttctatagacaaggaggtcagactggagtgaatgttgtaaaagttgaaatgtatatttgtatagcaaataacaaaatccttttaaaatttaatctagtagaccgcttttctttccccctgtttaaaatgttaatcagttttcaacagaacaaactttatattaccaaaaaaaaaaagatgggaggagggcgggtcctttcaaccattgttagagcaagacagataattatttaacagcctagcttggaataagctgagttagtgctggtgggtcaggtgtctctggctctattaaaaaaagcaaaaacccccccaaaaacctggagtctcctaggggacactttgggcagcacggttatgttaggtaaagtcttgctgacatggtgcatttttagatagagtgcattggcccagggtattatatttctgtgatgagttcatttacctgtttcagtatgcacatagttccctagctaaaattcctaatcttcttgagagagaagaatatggagtgaaagaataattcttgagctatcattcaaatgctcccagcatattgtgagccttgtgtgactggtgaggtacagacatttggttgccaaatgctagattagcgctgggtcagctgtggaagaatcgcctcagcttacagattgtcagacagatctaactagttttccagaaagcctgggaagctgtgtgttcaacatttcccaagggattctgatcaccaggcagcttgggaaccactggggcaggccaaatagaatattttgggcgggaaagaagcacccgatttaaaatgaagcgtaaccagaggagttcagaactgggaagagagtggtagacttcctgtgatcttcagaaatcatctacctggtaaaaatacatgctgtttagaatatctgataggtgtttccagctactattagaggtgatagtgcttttgtgggggaaaaaattggtcatggtgaatggagatcgaggaagctcgggacaagggaggggtgggctgcctgattttgtccagttttccaaatatccacgcagtgaactggagtatcctaaacatgagaatgtacagttgacagttgtaaaaactagggatctgtagtgaatgctgtgcagccccatatctcatttgggggtaggaaaatagctgaagattcatgtgcattatttgacatttcctttgtcatctgctttttaagcaaaaaagggttttgtgttagaaattctacttgagcagattataaagagctttaaaaaacaactttcggttgccaaaagtttgagcatttgatttcattacctgtgtctccctcactggtgtccagacggtcaactgaatactcctgaaacccagggagcaggtgacttcctggagtgctttgtccccagagtcagccactgcttcctctgtgggggtggagagtttgtctttggccatgcagtgtgcgacagttcaggacgggtagggatgggtcccattctgtctgggtcaagggctctatcagcttcttccatgtgcctttgggaagaaatctcgttactttaagtttgctttcctgttatcttgatgaagtgcccattttagcagacacttgtagtgctgaccacttagggaatgtacaaactcctaagcttctaaagggaggcatggcaaaaacgttggggtcaggatgtctctcacgctgctcatgttaatactattaacacatgatttgagaaataagttttctctaaaatgcatattttgccgccacacactgaacaatattatttccagtgaagtttgatgcctgttcttacgttgtgttcacctgttggttcaccactcagcagatctgattctgcaagaattaatggtagaactagatcatcctttctaacagacgagcctgtgtcctgtgacggcctttcacagcggaatgcagttgtacctcacattacttttgaaacttcactcgttccagttggtacaagtatttgccaaagccatttcctatgttcaccgtggcccctcctgatgtggctgtcagcgcagcgttgttgaacagggctattctttttacaaggtgtgaagtgtggctcttcgcttcgtctttgccatggcattaaaagaaagttccctgtcttctttcaatattagttatttcaaatgaatatgtgctacttaaaagcttgttttgtttctttgtatataatttgccttggatttattgtgcacagtttgttgagttgtatgtttttgtgaattatcaggagtaaatttgacaagtacatgtgaataacctcctgtaaatgaattttataacaaaaatgtactgaactattttttaaagttgtgcagattagcaattttttgctatagctttgacttttctatgctgtgaattaatagctgcgatttggcaaacagccctgttgtctttgttaaaccctaaattttaagaggaaatggcagaattaaaagcagaaacaagaagatggacatggattagaggttatgtattatgaagtaaactacaaggtactaacatca

SEQ ID NO: 446358 - DNA, 2445 bp, Homo sapiens
cgagaatggctcaactctccaaatagagagaatttctatcagttgcaagtacgaaaatttcctgccgattatataaaatactgggagtttgcagtttatctggaagaatgtgaactggctaaacagctttatccaaaggaaaacgatttggtgtttttagctcctgagagaataaatgaagagaagaaagatacagagagaaatgacatacaagatctccacgaatatcattctggttatgttcataaatttcgccgcacgtcagtcatgcgtaatgggaaaactgagtgttacctttccatccagactcaagagaactttccggccaatttaaacgaacttgtgaattgtattgtaatcagttctctggtaactacacaaaggaagttgaaagccatgtctctgttgggtagtcggaaccaactggctagagctgttctgaatccaaaccctatggacttctgtacaaaagatttactgactacaacatctgagagaattattgcgtacttaagagatttcaatgaagatcaaaagaaagcaatagaaactgcatatgctatggtgaaacactcaccatcagttgccaaaatctgcttgattcatggaccacctggaacaggaaaatcaaaaactattgttggcctcctctatcgtctactgacagagaaccagaggaaggggcattcagacgaaaactccaatgccaaaatcaaacaaaaccgtgtcctcgtgtgtgcaccttccaatgcagctgttgatgaactcatgaaaaaaattatccttgaattcaaagaaaaatgtaaagacaagaagaatcctttaggaaactgtggagatataaatttagtacgactgggtccagaaaagtctattaatagtgaggttctaaagttcagtttggacagccaagtaaaccacagaatgaaaaaagagttaccttctcatgttcaggcgatgcataaaagaaaggaatttctagattatcagctggatgagctttcccggcagcgagctctatgccgaggtggacgggaaatacagaggcaagaattagatgaaaacatttccaaagtttctaaggaaaggcaggaacttgcttctaaaattaaagaggttcaaggacgcccacagaaaacacagagtatcatcatcttagagtcccatatcatctgctgcacgttgagcacaagtggtggtttactacttgagtctgctttccgtgggcaagggggtgtccccttcagctgtgtcattgttgatgaggctggacagtcttgtgaaattgagactcttactccactcatccatcgctgcaataagctcatcctagtaggagatcctaagcagctccctccgacagtcatctctatgaaagcacaggagtatggctacgaccagtcaatgatggctcgcttctgcagactgctggaagagaatgtagaacacaacatgatcagcaggctgcccattctacagctcactgttcagtacaggatgcatccagacatatgcctcttcccttctaattatgtttataacagaaacttaaaaacaaatagacagacagaagccattcgatgttcatcagattggccatttcagccataccttgtgtttgatgttggagatggttcagaaagacgggataatgactcatatataaatgttcaagaaataaaactggtgatggaaataattaagcttattaaagacaaaagaaaggatgttagttttcgaaacattggcataataactcattacaaggcccagaagacgatgattcagaaggatttggacaaagagttcgatagaaaaggaccagcagaagtagacactgtggatgcattccagggtcggcagaaggattgtgttattgttacgtgtgtcagagcaaatagcatccaaggttcaattggattcctggcaagtttgcagagattgaatgtcaccatcacacgagccaagtacagcctcttcatcctcggacatttgaggaccctgatgatgaggaaacaggctcagagaggtcaagtgacttgaccaaggtcacacagcaagtaaatactgtgcagcctcactgcttccctaacatacctttatgaacagtacaggagcccccatgagagggtagctatcctttttcttcttttctttcttctttctaaagagacccgaattctagtggttgtaaagcagcagcctcctctgaagaaactcgggaagagaggagaggtgcatgtgtttggcaactttcccgatgggatttaatatcttaagctcctgtaggaaacaggcagaaagtgagatgatatcttgagatctcggtggatgaagatgttttagccattcggggtttgggaggcctttagaaatccagtgaaagccttgggcctttttctagaatagtcacatgcactcagaagtttgctttctgaaaccaga

SEQ ID NO: 446359 - DNA, 1501 bp, Homo sapiens
cgagaatggctcaactctccaaatagagagaatttctatcagttgcaagtacgaaaatttcctgccgattatataaaatactgggagtttgcagtttatctggaagaatgtgaactggctaaacagctttatccaaaggaaaacgatttggtgtttttagctcctgagagaataaatgaagagaagaaagatacagagagaaatgacatacaagatctccacgaatatcattctggttatgttcataaatttcgccgcacgtcagtcatgcgtaatgggaaaactgagtgttacctttccatccagactcaagagaactttccggccaatttaaacgaacttgtgaattgtattgtaatcagttctctggtaactacacaaaggaagttgaaagccatgtctctgttgggtagtcggaaccaactggctagagctgttctgaatccaaaccctatggacttctgtacaaaagatttactgactacaacatctgagagaattattgcgtacttaagagatttcaatgaagatcaaaagaaagcaatagaaactgcatatgctatggtgaaacactcaccatcagttgccaaaatctgcttgattcatggaccacctggaacaggaaaatcaaaaactattgttggcctcctctatcgtctactgacagagaaccagaggaaggggcattcagacgaaaactccaatgccaaaatcaaacaaaaccgtgtcctcgtgtgtgcaccttccaatgcagctgttgatgaactcatgaaaaaaattatccttgaattcaaagaaaaatgtaaagacaagaagaatcctttaggaaactgtggagatataaatttagtacgactgggtccagaaaagtctattaatagtgaggttctaaagttcagtttggacagccaagtaaaccacagaatgaaaaaagagttaccttctcatgttcaggcgatgcataaaagaaaggaatttctagattatcagctggatgagctttcccggcagcgagctctatgccgaggtggacgggaaatacagaggcaagaattagatgaaaacatttccaaagtttctaaggaaaggcaggaacttgcttctaaaattaaagaggttcaaggacgcccacagaaaacacagagtatcatcatcttagagtcccatatcatctgctgcacgttgagcacaagtggtggtttactacttgagtctgctttccgtgggcaagggggtgtccccttcagctgtgtcattgttgatgaggctggacagtcttgtgaaattgagactcttactccactcatccatcgctgcaataagctcatcctagtaggagatcctaagcagctccctccgacagtcatctctatgttttaaccaagggaaaaagtaaggacaatgaatgaggactcgagttcgcaaactgcaggaagagatatgtagtacaccaatatgaacaagctggcagcccattggacagcttactgatcagtactgg

SEQ ID NO: 446360 - DNA, 2995 bp, Homo sapiens
cgcttccgggagagtccgcgtctcccgcaccttcctctctatcaaacgccgtctctgtggtagccggggccccgcccctcctcggactctacccagtactgaactaggggcagctgggctccagagtccctcgggtctcaggtcatggcggtcgcggggcccgcgcccggagctggcgccaggcccaggttagatctgcaatttctccagcggttcctgcagatactgaaggttttgtttccttcttggtcatcacaaaatgccttgatgttcctgacccttttgtgcctgaccctactggagcaatttgtgatctaccaggttggcttgatccccagtcagtactatggggtcctgggaaacaaagacttggaagggtttaagactctgacattcctggctgtcatgctcattgttctgaactccacgctgaagagctttgatcagttcacctgcaacctgctgtatgtgagctggaggaaggacctcactgagcaccttcaccgcctctacttccggggccgtgcgtactacaccctcaacgtgctgcgggatgacatcgataacccggaccagcgcatcagccaggacgtggagcgattctgccggcagctcagcagcatggccagcaagctcatcatctccccgttcaccctcgtctactacacttaccagtgcttccaaagcacaggctggctcgggcctgtgagcatcttcgggtatttcatcctggggaccgtggtgaacaaaactttgatgggccccattgtgatgaagctggtgcatcaggagaagctggagggagattttaggttcaagcacatgcagattcgggtgaatgcggagcctgctgctttctacagagctgggcatgtggagcacatgaggacagaccgcaggctgcagagactccttcagacccagagggagctgatgtccaaggagctctggctgtacatcggcatcaacacctttgactatctgggcagcatcctgagttacgttgtcatcgcaatccccattttcagcggggtctatggagacctgagtcccgcagagcttagcaccctggtcagcaagaatgcctttgtgtgcatctacctcatcagctgcttcacccagctcatcgacctgtccacgacgctctcagatgtggctggctacacgcacagaattgggcagcttcgggagacgcttctggacatgtccctgaagtcacaggactgcgagatcctgggcgagagcgagtggggcttggacacacccccagggtggccagcggcagagccagcagacacagcatttctccttgagcgggtctccatctctgccccctcctctgacaaacccctaatcaaggatctgagcctaaagatctccgagggacagagcctgctcatcacaggcaacacgggcactggcaagacctccttgctccgggttctgggtggcctctggacgagtacacggggctcagtgcagatgctgacggactttgggccccatggggtgctattcctgccacaaaagccattcttcactgacgggacccttcgggagcaggtgatatatcccctgaaggaggtctaccccgactcaggttctgccgatgatgagaggatcttgaggttcttggaattggcaggcctgtccaacttggtggcaaggacagagggcctggaccagcaggtggactggaactggtatgatgttctgtccccgggggagatgcaacggctctcctttgcccgactcttctacctgcagccgaagtacgcagtgcttgatgaagccaccagtgccctgacagaggaagtggagagcgagctctatcgcatcggccagcagctggggatgacgttcatcagtgtgggacatcggcagagccttgagaagtttcattccttggttctgaaactctgtggaggaggaagatgggagctgatgagaatcaaagtggaatgaagctctggcttttggaaggagagccacactgtggcgggtcggcggccctcaggagagaccaggaggactgacagcgaagatcgagctcaggttcgccacatagatcccgtgcaggagccacatgggtcctgtgcaggacccctagcagtggtgggctgagcccaggtctaggtttctgtgggggacactgaatctcccagtgttcagtctcccaggactctgctgcctcagccagagcctccatatgcttgaagtgctgattacctacaaatgatttcagatcatgtttgctaaagagaaatctggaagtgtgagatctgtaagaaatgaaagaaatgactcttggagtcaagagatctggaaatcttttaatcagttaaattgtgcagcaatagatttttaactttaactgaccatttaagttttttaataagttttttacaaagaaaagttaaacattaaaaagaattacagctttctgtcttctctatcatggaatgattttttttattgaatctccagatttgtatttgacagcttggtgggaagggaagcacactctgctgttctggaatcttatgcccagggtttttcacttctccccacatctccctttccacttgccagtgttgtgtagttagaacctgaaccactaacttctaggggcctttggtctgccctaccttaacccaaatgaaagtaaatccctttccccttagccaaaataaggttgggttttctaaaaaaatagtctatattagggaacaacaacagcaaattagacaaaacccagaaagcacaaagcatgaggtggagttactgtgcccaaagtcctcactcagaccagtgcccctccagttcagttgtctatgtattaccttccttaccttcataatgtttgccaggcttctgtacttctagtacttgagttacttaatatttttaaaaacaaaccttttaagtttaaatggatttttaagtgaaattttacacttaacatagatggaaagtaactaaaaataaatacaag

SEQ ID NO: 446361 - DNA, 3166 bp, Homo sapiens
cgcttccgggagagtccgcgtctcccgcaccttcctctctatcaaacgccgtctctgtggtagccggggccccgcccctcctcggactctacccagtactgaactaggggcagctgggctccagagtccctcgggtctcaggtcatggcggtcgcggggcccgcgcccggagctggcgccaggcccaggttagatctgcaatttctccagcggttcctgcagatactgaaggttttgtttccttcttggtcatcacaaaatgccttgatgttcctgacccttttgtgcctgaccctactggagcaatttgtgatctaccaggttggcttgatccccagtcagtactatggggtcctgggaaacaaagacttggaagggtttaagactctgacattcctggctgtcatgctcattgttctgaactccacgctgaagagctttgatcagttcacctgcaacctgctgtatgtgagctggaggaaggacctcactgagcaccttcaccgcctctacttccggggccgtgcgtactacaccctcaacgtgctgcgggatgacatcgataacccggaccagcgcatcagccaggacgtggagcgattctgccggcagctcagcagcatggccagcaagctcatcatctccccgttcaccctcgtctactacacttaccagtgcttccaaagcacaggctggctcgggcctgtgagcatcttcgggtatttcatcctggggaccgtggtgaacaaaactttgatgggccccattgtgatgaagctggtgcatcaggagaagctggagggagattttaggttcaagcacatgcagattcgggtgaatgcggagcctgctgctttctacagagctgggcatgtggagcacatgaggacagaccgcaggctgcagagactccttcagacccagagggagctgatgtccaaggagctctggctgtacatcggcatcaacacctttgactatctgggcagcatcctgagttacgttgtcatcgcaatccccattttcagcggggtctatggagacctgagtcccgcagagcttagcaccctggtcagcaagaatgcctttgtgtgcatctacctcatcagctgcttcacccagctcatcgacctgtccacgacgctctcagatgtggctggctacacgcacagaattgggcagcttcgggagacgcttctggacatgtccctgaagtcacaggactgcgagatcctgggcgagagcgagtggggcttggacacacccccagggtggccagcggcagagccagcagacacagcatttctccttgagcgggtctccatctctgccccctcctctgacaaacccctaatcaaggatctgagcctaaagatctccgagggacagagcctgctcatcacaggcaacacgggcactggcaagacctccttgctccgggttctgggtggcctctggacgagtacacggggctcagtgcagatgctgacggactttgggccccatggggtgctattcctgccacaaaagccattcttcactgacgggacccttcgggagcaggtgatatatcccctgaaggaggtctaccccgactcaggttctgccgatgatgagaggatcttgaggttcttggaattggcaggcctgtccaacttggtggcaaggacagagggcctggaccagcaggtggactggaactggtatgatgttctgtccccgggggagatgcaacggctctcctttgcccgactcttctacctgcagccgaagtacgcagtgcttgatgaagccaccagtgccctgacagaggaagtggagagcgagctctatcgcatcggccagcagctggggatgacgttcatcagtgtgggacatcggcagagccttgagaaggtacccgtgctcacaaggatggcctgaggaggagaaagaacccaaaggctcagcctggccagggccagaggcccctcaaaacggggagtagcagtagcagagagaaccgagtggcctcctctgccggcggccagggcagcctgatctccatgtggtggtggtctcttgtagtttcattccttggttctgaaactctgtggaggaggaagatgggagctgatgagaatcaaagtggaatgaagctctggcttttggaaggagagccacactgtggcgggtcggcggccctcaggagagaccaggaggactgacagcgaagatcgagctcaggttcgccacatagatcccgtgcaggagccacatgggtcctgtgcaggacccctagcagtggtgggctgagcccaggtctaggtttctgtgggggacactgaatctcccagtgttcagtctcccaggactctgctgcctcagccagagcctccatatgcttgaagtgctgattacctacaaatgatttcagatcatgtttgctaaagagaaatctggaagtgtgagatctgtaagaaatgaaagaaatgactcttggagtcaagagatctggaaatcttttaatcagttaaattgtgcagcaatagatttttaactttaactgaccatttaagttttttaataagttttttacaaagaaaagttaaacattaaaaagaattacagctttctgtcttctctatcatggaatgattttttttattgaatctccagatttgtatttgacagcttggtgggaagggaagcacactctgctgttctggaatcttatgcccagggtttttcacttctccccacatctccctttccacttgccagtgttgtgtagttagaacctgaaccactaacttctaggggcctttggtctgccctaccttaacccaaatgaaagtaaatccctttccccttagccaaaataaggttgggttttctaaaaaaatagtctatattagggaacaacaacagcaaattagacaaaacccagaaagcacaaagcatgaggtggagttactgtgcccaaagtcctcactcagaccagtgcccctccagttcagttgtctatgtattaccttccttaccttcataatgtttgccaggcttctgtacttctagtacttgagttacttaatatttttaaaaacaaaccttttaagtttaaatggatttttaagtgaaattttacacttaacatagatggaaagtaactaaaaataaatacaag

SEQ ID NO: 446362 - DNA, 1952 bp, Homo sapiens
cactttgttggttggggtacctctcagctcaagcttagctttggtgcaaagatgcgtgggaggctgctgctgctgcctaacttctaggcctctttctgatggctatggcttccatcctgcctctgccccctgagtagctgggactacaggtgtgcctcacagcctggagctttcacagccagataactaaaggggccaggctagggcttatataagagaaatttgggaggattgagataaaggggatagtcttcttgatcatccaaaacagctcatctaccttcaagtttttctttggctctgctcagagctggctcaggcccctgggtactggacctttcagttcccactttttcaggggattaactaaggcaccgtaagatgcaactctctagaaccctgtttaaaggccctgggatttagttgcccctaggaaaccagccttgtctggttccctcttcccatagggtcagtgttcacagcactgtgaggcaaggtcaagagcagaggtgatgtgaaagtttcttgttctctctacctttgggcccatctccctgggtccagctactctgtgtcattggctccagggaccagcgcatcagccaggacgtggagcgattctgccggcagctcagcagcatggccagcaagctcatcatctccccgttcaccctcgtctactacacttaccagtgcttccaaagcacaggctggctcgggcctgtgagcatcttcgggtatttcatcctggggaccgtggtgaacaaaactttgatgggccccattgtgatgaagctggtgcatcaggagaagctggagggagattttaggttcaagcacatgcagattcgggtgaatgcggagcctgctgctttctacaggtgagtctggagagatggttccccttctgccttgccagagctgagagtggagaaggacaagatgaatcctcaaacctcccaccaccaccgagctcaggggctgagtgttgtcacacttggctgtgaccctctccctctacctccccctgcccttgcctgcctcatccttaggtccaggggtttgcttctgaagcttggtggttcctttactgggccagctttagtcttagtggctagcgtggggcctgaaattgtcaaatgaatgaatgcctcatcctcttgctggtgactgtaagacatccgtctgcctctgctcttctgtctgttaagaagctttcttgccagtgcctgaggttcaagcctgatcctttgtctccgtagcgtgggatggaatgggagcttctcagaaaaccaggagacctgctccccacaatgctgtctaatggagccaagcgtctggtctcctgacggcagcagcaggagcagcagcagcggcatgaaatcccatcccttccctccagggccagaaccggtccctgtgctctgccttatgtgaggcctctgaaatcagcgttaggattgatagtgcaggcagaggtttgcgtttaagaagtggaagctactccttggctctgtacttggggtggatgtgatagccctgggacctttgctcctcagtctctgctgcagtttgcaacctccaccacttgagggcaccaagaatactgggaatctgcgctggggtggggttgtgaggtgggcagggctgggtgtgtaaaaaagttgcttttggaggccgggcatggtggctcatgcctgtaatcccagcactttgggaggccgaggcgggtggattgcctgaggtcaagagttcgagaccagccatggccaacatggtgaaaccctgtctctactaaaaatacaaaaaattagctgagcatggtggcgggcacctgtaatcccagctactggggaggctgaggcaggagaatcacttgaatccgggaggcagaggttgcagtaaggcaagatcctgccattgcactccagcctgggtgacagagcaagact

SEQ ID NO: 446363 - DNA, 1242 bp, Homo sapiens
cttcagaagctcatctactctcaaaataagacagtgtagaaagagggtcttgcctctggtaagccctttaatatttggtgaaggaggctgggtacagtggctcacgcctgtaatcccagcactttgagaggccgaggcgggcggatcacctgaggtcgggagttccagaccagcctgaccaagatggagaaaccccgtctctactaaaaatacaaaattagctgggcgtggtggtgcatgcctgtaatcccagctactcgggaggctgaggcaggagaatcgcttgaaactgggaggcggaggttgtggtgagccaagatcgcgccattgcactccagcctgggcaacaagagtaaaactccatctcagagaaaaaaaatttggtgaaggaatgaacacgtgagtgagtgaggaagggaaagtcccatgactcgatgatttaaaaaagaaaagtgctgagtggacggagtaatcagagtcagagtgggctgggatgggtcagcggaggctcttgcgagccttgagctttgagctgagattttcaggaagccatctctcccttccccttgcttcccccactgcacagctgaagagctttgatcagttcacctgcaacctgctgtatgtgagctggaggaaggacctcactgagcaccttcaccgcctctacttccggggccgtgcgtactacaccctcaacgtgctgcgggatgacatcgataacccgtaggcgccccaactcagtcctttctacactctgtgtggtcctttccttctggcctagccctggagactgctggtggcagacaccaaggagatcatctgcagtcgttttcaaatgctgctgcccagagtcatgggggagggtgccctgcagaggactcctggagaagctgcagggctgtgaataggcagctaaaaagaagaagcctgcccaggtgcagtggcatgcacctgtagtcccaacaactcaggaggctgaggcaggaggatcacttgagcccaggagtagtgcaccgtgagcacacttgggaatagccactgtactctagcctgggcaacatagcagaaacccccatctcttaaaaaaaagaaaaatgttaggagcagctttcttttgtccttttcatactttatatcttagtcttccagtaagaagactaaggggtttctttagagggttctaaagaaaatgtccttgctagaaaaaccagctcttagattttcatcagtaaaaaaaat

SEQ ID NO: 446364 - DNA, 1346 bp, Homo sapiens
caggaatctgcagtgtcctccccttcctgtgcttcctcctcccgctgattcctctccctgcccctttccttggggcatgtctgtctttgttcccccacctcactcagccccagagatgtctgtatccgtgtgtctgcgtggatctgtaatatttctgtgcattcaggatttgcttgatctccacactttccttgggcagattacctaactgttctgtttcttcatgtctgaaaaggaggtcataatgaacttccttcacttgttgtagggattagatatcatcatccatggaaagtgcttggacagtggccacatcataagctttcaaaaatcagtctgaattccagggcctacactcaacttgcttttcttaggagctaataccttaactgttgcttctgttccaaatgaaagcttcatgcaaccatgagtgcagaggctgggcatgaaggagggtctgtaggaaactggaattgctgttctgtggggagccaggcatccatgcagaggcagaaactccagaaccatttagctttaaccactcccattcttgttattagtactctggtcacactgtgatgccatgaagacccaccagcattagaatttgttgaataccgctctgcaacctgggcagttacttagccacctgattcttagtgtcctcatctgtgatgatatttgagactcatgggcattagactgagtaagatcagtcccataaggggctttgtccagccaggcagagagtagaagttccacccctacccctgtattaatgtgctcaggctgccatgacagaaaaccacaaaccggctggcttaaacaatagaaattaatttcctcacaattctggatgcttatggtccacgatcaagttgtcagcagggttggtttcttaggccactccttggcttgtagatggccaccttgttgctgtgtcctcacgtggcctttcctttatatgtgcgtgcccctgccacctctatcttaagaggacaccagtcatattggattagggtcccaccccaacaacttcatgttaacatcatctctttaaagaccctgcctccagctgggcacggaagctcacgtctataatcccaccactttgggaggctgaggtgggcagatcacctgaggtcacaagttcgagaccagactggccaacatagtgaaaccctgtctctactaaaaatatgggcacggtggtgggcacctgtaatccagctactcaggaggctgggacaggaaaatcgcttgaacccaggaggcggaggttgcagtgagctgagatagctccactgcactcaagcctgggtgacagcaagactttctctcaaaaa

SEQ ID NO: 446365 - DNA, 2855 bp, Homo sapiens
cgcttccgggagagtccgcgtctcccgcaccttcctctctatcaaacgccgtctctgtggtagccggggccccgcccctcctcggactctacccagtactgaactaggggcagctgggctccagagtccctcgggtctcaggtcatggcggtcgcggggcccgcgcccggagctggcgccaggcccaggttagatctgcaatttctccagcggttcctgcagatactgaaggttttgtttccttcttggtcatcacaaaatgccttgatgttcctgacccttttgtgcctgaccctactggagcaatttgtgatctaccaggttggcttgatccccagtcagtactatggggtcctgggaaacaaagacttggaagggtttaagactctgacattcctggctgtcatgctcattgttctgaactccacgggaccagcgcatcagccaggacgtggagcgattctgccggcagctcagcagcatggccagcaagctcatcatctccccgttcaccctcgtctactacacttaccagtgcttccaaagcacaggctggctcgggcctgtgagcatcttcgggtatttcatcctggggaccgtggtgaacaaaactttgatgggccccattgtgatgaagctggtgcatcaggagaagctggagggagattttaggttcaagcacatgcagattcgggtgaatgcggagcctgctgctttctacagagctgggcatgtggagcacatgaggacagaccgcaggctgcagagactccttcagacccagagggagctgatgtccaaggagctctggctgtacatcggcatcaacacctttgactatctgggcagcatcctgagttacgttgtcatcgcaatccccattttcagcggggtctatggagacctgagtcccgcagagcttagcaccctggtcagcaagaatgcctttgtgtgcatctacctcatcagctgcttcacccagctcatcgacctgtccacgacgctctcagatgtggctggctacacgcacagaattgggcagcttcgggagacgcttctggacatgtccctgaagtcacaggactgcgagatcctgggcgagagcgagtggggcttggacacacccccagggtggccagcggcagagccagcagacacagcatttctccttgagcgggtctccatctctgccccctcctctgacaaacccctaatcaaggatctgagcctaaagatctccgagggacagagcctgctcatcacaggcaacacgggcactggcaagacctccttgctccgggttctgggtggcctctggacgagtacacggggctcagtgcagatgctgacggactttgggccccatggggtgctattcctgccacaaaagccattcttcactgacgggacccttcgggagcaggtgatatatcccctgaaggaggtctaccccgactcaggttctgccgatgatgagaggatcttgaggttcttggaattggcaggcctgtccaacttggtggcaaggacagagggcctggaccagcaggtggactggaactggtatgatgttctgtccccgggggagatgcaacggctctcctttgcccgactcttctacctgcagccgaagtacgcagtgcttgatgaagccaccagtgccctgacagaggaagtggagagcgagctctatcgcatcggccagcagctggggatgacgttcatcagtgtgggacatcggcagagccttgagaagtttcattccttggttctgaaactctgtggaggaggaagatgggagctgatgagaatcaaagtggaatgaagctctggcttttggaaggagagccacactgtggcgggtcggcggccctcaggagagaccaggaggactgacagcgaagatcgagctcaggttcgccacatagatcccgtgcaggagccacatgggtcctgtgcaggacccctagcagtggtgggctgagcccaggtctaggtttctgtgggggacactgaatctcccagtgttcagtctcccaggactctgctgcctcagccagagcctccatatgcttgaagtgctgattacctacaaatgatttcagatcatgtttgctaaagagaaatctggaagtgtgagatctgtaagaaatgaaagaaatgactcttggagtcaagagatctggaaatcttttaatcagttaaattgtgcagcaatagatttttaactttaactgaccatttaagttttttaataagttttttacaaagaaaagttaaacattaaaaagaattacagctttctgtcttctctatcatggaatgattttttttattgaatctccagatttgtatttgacagcttggtgggaagggaagcacactctgctgttctggaatcttatgcccagggtttttcacttctccccacatctccctttccacttgccagtgttgtgtagttagaacctgaaccactaacttctaggggcctttggtctgccctaccttaacccaaatgaaagtaaatccctttccccttagccaaaataaggttgggttttctaaaaaaatagtctatattagggaacaacaacagcaaattagacaaaacccagaaagcacaaagcatgaggtggagttactgtgcccaaagtcctcactcagaccagtgcccctccagttcagttgtctatgtattaccttccttaccttcataatgtttgccaggcttctgtacttctagtacttgagttacttaatatttttaaaaacaaaccttttaagtttaaatggatttttaagtgaaattttacacttaacatagatggaaagtaactaaaaataaatacaag

SEQ ID NO: 446366 - DNA, 4431 bp, Homo sapiens
  misc_feature (1980)..(1980): n is a, c, g, or t
  misc_feature (1987)..(1987): n is a, c, g, or t
  misc_feature (1999)..(1999): n is a, c, g, or t
  misc_feature (2003)..(2003): n is a, c, g, or t
cgcttccgggagagtccgcgtctcccgcaccttcctctctatcaaacgccgtctctgtggtagccggggccccgcccctcctcggactctacccagtactgaactaggggcagctgggctccagagtccctcgggtctcaggtcatggcggtcgcggggcccgcgcccggagctggcgccaggcccaggttagatctgcaatttctccagcggttcctgcagatactgaaggttttgtttccttcttggtcatcacaaaatgccttgatgttcctgacccttttgtgcctgaccctactggagcaatttgtgatctaccaggttggcttgatccccagtcagtactatggggtcctgggaaacaaagacttggaagggtttaagactctgacattcctggctgtcatgctcattgttctgaactccacgctgaagagctttgatcagttcacctgcaacctgctgtatgtgagctggaggaaggacctcactgagcaccttcaccgcctctacttccggggccgtgcgtactacaccctcaacgtgctgcgggatgacatcgataacccggaccagcgcatcagccaggacgtggagcgattctgccggcagctcagcagcatggccagcaagctcatcatctccccgttcaccctcgtctactacacttaccagtgcttccaaagcacaggctggctcgggcctgtgagcatcttcgggtatttcatcctggggaccgtggtgaacaaaactttgatgggccccattgtgatgaagctggtgcatcaggagaagctggagggagattttaggttcaagcacatgcagattcgggtgaatgcggagcctgctgctttctacagagctgggcatgtggagcacatgaggacagaccgcaggctgcagagactccttcagacccagagggagctgatgtccaaggagctctggctgtacatcggcatcaacacctttgactatctgggcagcatcctgagttacgttgtcatcgcaatccccattttcagcggggtctatggagacctgagtcccgcagagcttagcaccctggtcagcaagaatgcctttgtgtgcatctacctcatcagctgcttcacccagctcatcgacctgtccacgacgctctcagatgtggctggctacacgcacagaattgggcagcttcgggagacgcttctggacatgtccctgaagtcacaggactgcgagatcctgggcgagagcgagtggggcttggacacacccccagggtggccagcggcagagccagcagacacagcatttctccttgagcgggtctccatctctgccccctcctctgacaaacccctaatcaaggatctgagcctaaagatctccgagggacagagcctgctcatcacaggcaacacgggcactggcaagacctccttgctccgggttctgggtggcctctggacgagtacacggggctcagtgcagatgctgacggactttgggccccatggggtgctattcctgccacaaaagccattcttcactgacgggacccttcgggagcagggtcagtctagttcagggggctcactcctccctcctcaaccccgcccacccacagctgggacctctggcactgtgacaagtctcaggtcctagagtcagggcaaaaggtgaggtggtgaagtggcccgggcctgggaactgctggctctaagaaccttctattcacatccatggattgggcccactactcatagcagctcctgaggcaggtaaatggggcaaggactcacgccaaataccacacgcgtatgtcaaacacccaaggtcggattctggggcccctgccctcaggaggctgtcagactgttccccctaaacacacttctgaaggttgtagggaccttgccctgctgtctgccggccagagcctctcccatctgacccaggccaggcgttcccacctctcctccttgggangttccantgggttctggangganggtgggctgtgtgcactccgtcttttgctcgccctcctaggttggtgtggtttttttcttttctcaggtgatatatcccctgaaggaggtctaccccgactcaggttctgccgatgatgagaggatcttgaggttcttggaattggcaggcctggtaagtggggagagggaccctcaggacccgagcccacctgggagcaccagctacaggtaggcaggtgctggccctgctatgctgggcccaggactggaagtctgaacctggggtggagaatgggagtatcagttgacagtgtgtgctgttggccaggtttaggcacgaagggggtagtgctctcattggagaattttaagacaagaataggattgatgaaggcggtttgctttttactgtcatcatgctccagcaagtctaaacagtgtcattggtagaatattcctctctgcctggggcagactgtcccacagtcccccgccttggtatgccactggggcatatatttgtcttagaggtgtgtgtgtatgctggggagtgagggaggttccccatgatggcaggtagcagggctggccatttcatggacatcctgccctctgggtctgttacagtccaacttggtggcaaggacagagggcctggaccagcaggtggactggaactggtaagaaaagagcttgggtgctccagagatagccccaccataaagacagtgggtttcagggtccctgtcaaggaatggaacggctcctgaccccaaagtccagatgtttggctggtcagtcgggtgcaagtttatgcccttgggaacagagttttgcctcactctgtgagggctgtaggcctatggtcgaaagggaaggggcttctgtctcctggggctcacctctgtgcagagaaacctcttcctacccagaccattctaggtaaaagccaagctatattcttcctcctctagcagtcctctctcctacctttcctcaggtatgatgttctgtccccgggggagatgcaacggctctcctttgcccgactcttctacctgcagccgaagtacgcagtgcttgatgaagccaccagtgccctgacagaggaagtggagagcgagctctatcgcatcggccagcagctggggatgacgttcatcagtgtgggacatcggcagagccttgagaagtttcattccttggttctgaaactctgtggaggaggaagatgggagctgatgagaatcaaagtggaatgaagctctggcttttggaaggagagccacactgtggcgggtcggcggccctcaggagagaccaggaggactgacagcgaagatcgagctcaggttcgccacatagatcccgtgcaggagccacatgggtcctgtgcaggacccctagcagtggtgggctgagcccaggtctaggtttctgtgggggacactgaatctcccagtgttcagtctcccaggactctgctgcctcagccagagcctccatatgcttgaagtgctgattacctacaaatgatttcagatcatgtttgctaaagagaaatctggaagtgtgagatctgtaagaaatgaaagaaatgactcttggagtcaagagatctggaaatcttttaatcagttaaattgtgcagcaatagatttttaactttaactgaccatttaagttttttaataagttttttacaaagaaaagttaaacattaaaaagaattacagctttctgtcttctctatcatggaatgattttttttattgaatctccagatttgtatttgacagcttggtgggaagggaagcacactctgctgttctggaatcttatgcccagggtttttcacttctccccacatctccctttccacttgccagtgttgtgtagttagaacctgaaccactaacttctaggggcctttggtctgccctaccttaacccaaatgaaagtaaatccctttccccttagccaaaataaggttgggttttctaaaaaaatagtctatattagggaacaacaacagcaaattagacaaaacccagaaagcacaaagcatgaggtggagttactgtgcccaaagtcctcactcagaccagtgcccctccagttcagttgtctatgtattaccttccttaccttcataatgtttgccaggcttctgtacttctagtacttgagttacttaatatttttaaaaacaaaccttttaagtttaaatggatttttaagtgaaattttacacttaacatagatggaaagtaactaaaaataaatacaagaaaaaccatcggtgttattaacttacggctagatgctgttgcctgcatagactctgggcctgaggcttgttcattttgtaaaaaagagaggtgaggagttagacggactggcactcaactgagatttttctccttaataaaatcagaaagatgg

SEQ ID NO: 446367 - DNA, 3167 bp, Homo sapiens
cactttgttggttggggtacctctcagctcaagcttagctttggtgcaaagatgcgtgggaggctgctgctgctgcctaacttctaggcctctttctgatggctatggcttccatcctgcctctgccccctgagtagctgggactacaggtgtgcctcacagcctggagctttcacagccagataactaaaggggccaggctagggcttatataagagaaatttgggaggattgagataaaggggatagtcttcttgatcatccaaaacagctcatctaccttcaagtttttctttggctctgctcagagctggctcaggcccctgggtactggacctttcagttcccactttttcaggggattaactaaggcaccgtaagatgcaactctctagaaccctgtttaaaggccctgggatttagttgcccctaggaaaccagccttgtctggttccctcttcccatagggtcagtgttcacagcactgtgaggcaaggtcaagagcagaggtgatgtgaaagtttcttgttctctctacctttgggcccatctccctgggtccagctactctgtgtcattggctccagggaccagcgcatcagccaggacgtggagcgattctgccggcagctcagcagcatggccagcaagctcatcatctccccgttcaccctcgtctactacacttaccagtgcttccaaagcacaggctggctcgggcctgtgagcatcttcgggtatttcatcctggggaccgtggtgaacaaaactttgatgggccccattgtgatgaagctggtgcatcaggagaagctggagggagattttaggttcaagcacatgcagattcgggtgaatgcggagcctgctgctttctacagagctgggcatgtggagcacatgaggacagaccgcaggctgcagagactccttcagacccagagggagctgatgtccaaggagctctggctgtacatcggcatcaacacctttgactatctgggcagcatcctgagttacgttgtcatcgcaatccccattttcagcggggtctatggagacctgagtcccgcagagcttagcaccctggtcagcaagaatgcctttgtgtgcatctacctcatcagctgcttcacccagctcatcgacctgtccacgacgctctcagatgtggctggctacacgcacagaattgggcagcttcgggagacgcttctggacatgtccctgaagtcacaggactgcgagatcctgggcgagagcgagtggggcttggacacacccccagggtggccagcggcagagccagcagacacagcatttctccttgagcgggtctccatctctgccccctcctctgacaaacccctaatcaaggatctgagcctaaagatctccgagggacagagcctgctcatcacaggcaacacgggcactggcaagacctccttgctccgggttctgggtggcctctggacgagtacacggggctcagtgcagatgctgacggactttgggccccatggggtgctattcctgccacaaaagccattcttcactgacgggacccttcgggagcaggtgatatatcccctgaaggaggtctaccccgactcaggttctgccgatgatgagaggatcttgaggttcttggaattggcaggcctgtccaacttggtggcaaggacagagggcctggaccagcaggtggactggaactggtatgatgttctgtccccgggggagatgcaacggctctcctttgcccgactcttctacctgcagccgaagtacgcagtgcttgatgaagccaccagtgccctgacagaggaagtggagagcgagctctatcgcatcggccagcagctggggatgacgttcatcagtgtgggacatcggcagagccttgagaagtttcattccttggttctgaaactctgtggaggaggaagatgggagctgatgagaatcaaagtggaatgaagctctggcttttggaaggagagccacactgtggcgggtcggcggccctcaggagagaccaggaggactgacagcgaagatcgagctcaggttcgccacatagatcccgtgcaggagccacatgggtcctgtgcaggacccctagcagtggtgggctgagcccaggtctaggtttctgtgggggacactgaatctcccagtgttcagtctcccaggactctgctgcctcagccagagcctccatatgcttgaagtgctgattacctacaaatgatttcagatcatgtttgctaaagagaaatctggaagtgtgagatctgtaagaaatgaaagaaatgactcttggagtcaagagatctggaaatcttttaatcagttaaattgtgcagcaatagatttttaactttaactgaccatttaagttttttaataagttttttacaaagaaaagttaaacattaaaaagaattacagctttctgtcttctctatcatggaatgattttttttattgaatctccagatttgtatttgacagcttggtgggaagggaagcacactctgctgttctggaatcttatgcccagggtttttcacttctccccacatctccctttccacttgccagtgttgtgtagttagaacctgaaccactaacttctaggggcctttggtctgccctaccttaacccaaatgaaagtaaatccctttccccttagccaaaataaggttgggttttctaaaaaaatagtctatattagggaacaacaacagcaaattagacaaaacccagaaagcacaaagcatgaggtggagttactgtgcccaaagtcctcactcagaccagtgcccctccagttcagttgtctatgtattaccttccttaccttcataatgtttgccaggcttctgtacttctagtacttgagttacttaatatttttaaaaacaaaccttttaagtttaaatggatttttaagtgaaattttacacttaacatagatggaaagtaactaaaaataaatacaagaaaaaccatcggtgttattaacttacggctagatgctgttgcctgcatagactctgggcctgaggcttgttcattttgtaaaaaagagaggtgaggagttagacggactggcactcaactgagatttttctccttaataaaatcagaaagatgg

SEQ ID NO: 446368 - DNA, 3057 bp, Homo sapiens
cgcttccgggagagtccgcgtctcccgcaccttcctctctatcaaacgccgtctctgtggtagccggggccccgcccctcctcggactctacccagtactgaactaggggcagctgggctccagagtccctcgggtctcaggtcatggcggtcgcggggcccgcgcccggagctggcgccaggcccaggttagatctgcaatttctccagcggttcctgcagatactgaaggttttgtttccttcttggtcatcacaaaatgccttgatgttcctgacccttttgtgcctgaccctactggagcaatttgtgatctaccaggttggcttgatccccagtcagtactatggggtcctgggaaacaaagacttggaagggtttaagactctgacattcctggctgtcatgctcattgttctgaactccacgctgaagagctttgatcagttcacctgcaacctgctgtatgtgagctggaggaaggacctcactgagcaccttcaccgcctctacttccggggccgtgcgtactacaccctcaacgtgctgcgggatgacatcgataacccggaccagcgcatcagccaggacgtggagcgattctgccggcagctcagcagcatggccagcaagctcatcatctccccgttcaccctcgtctactacacttaccagtgcttccaaagcacaggctggctcgggcctgtgagcatcttcgggtatttcatcctggggaccgtggtgaacaaaactttgatgggccccattgtgatgaagctggtgcatcaggagaagctggagggagattttaggttcaagcacatgcagattcgggtgaatgcggagcctgctgctttctacagagctgggcatgtggagcacatgaggacagaccgcaggctgcagagactccttcagacccagagggagctgatgtccaaggagctctggctgtacatcggcatcaacacctttgactatctgggcagcatcctgagttacgttgtcatcgcaatccccattttcagcggggtctatggagacctgagtcccgcagagcttagcaccctggtcagcaagaatgcctttgtgtgcatctacctcatcagctgcttcacccagctcatcgacctgtccacgacgctctcagatgtggctggctacacgcacagaattgggcagcttcgggagacgcttctggacatgtccctgaagtcacaggactgcgagatcctgggcgagagcgagtggggcttggacacacccccagggtggccagcggcagagccagcagacacagcatttctccttgagcgggtctccatctctgccccctcctctgacaaacccctaatcaaggatctgagcctaaagatctccgagggacagagcctgctcatcacaggcaacacgggcactggcaagacctccttgctccgggttctgggtggcctctggacgagtacacggggtgatatatcccctgaaggaggtctaccccgactcaggttctgccgatgatgagaggatcttgaggttcttggaattggcaggcctgtccaacttggtggcaaggacagagggcctggaccagcaggtggactggaactggtatgatgttctgtccccgggggagatgcaacggctctcctttgcccgactcttctacctgcagccgaagtacgcagtgcttgatgaagccaccagtgccctgacagaggaagtggagagcgagctctatcgcatcggccagcagctggggatgacgttcatcagtgtgggacatcggcagagccttgagaagtttcattccttggttctgaaactctgtggaggaggaagatgggagctgatgagaatcaaagtggaatgaagctctggcttttggaaggagagccacactgtggcgggtcggcggccctcaggagagaccaggaggactgacagcgaagatcgagctcaggttcgccacatagatcccgtgcaggagccacatgggtcctgtgcaggacccctagcagtggtgggctgagcccaggtctaggtttctgtgggggacactgaatctcccagtgttcagtctcccaggactctgctgcctcagccagagcctccatatgcttgaagtgctgattacctacaaatgatttcagatcatgtttgctaaagagaaatctggaagtgtgagatctgtaagaaatgaaagaaatgactcttggagtcaagagatctggaaatcttttaatcagttaaattgtgcagcaatagatttttaactttaactgaccatttaagttttttaataagttttttacaaagaaaagttaaacattaaaaagaattacagctttctgtcttctctatcatggaatgattttttttattgaatctccagatttgtatttgacagcttggtgggaagggaagcacactctgctgttctggaatcttatgcccagggtttttcacttctccccacatctccctttccacttgccagtgttgtgtagttagaacctgaaccactaacttctaggggcctttggtctgccctaccttaacccaaatgaaagtaaatccctttccccttagccaaaataaggttgggttttctaaaaaaatagtctatattagggaacaacaacagcaaattagacaaaacccagaaagcacaaagcatgaggtggagttactgtgcccaaagtcctcactcagaccagtgcccctccagttcagttgtctatgtattaccttccttaccttcataatgtttgccaggcttctgtacttctagtacttgagttacttaatatttttaaaaacaaaccttttaagtttaaatggatttttaagtgaaattttacacttaacatagatggaaagtaactaaaaataaatacaagaaaaaccatcggtgttattaacttacggctagatgctgttgcctgcatagactctgggcctgaggcttgttcattttgtaaaaaagagaggtgaggagttagacggactggcactcaactgagatttttctccttaataaaatcagaaagatgg

SEQ ID NO: 446369 - DNA, 2900 bp, Homo sapiens
gcaggctggtacggtcggagtgtgggatcggtcgcggggccgcgcccggagctggcgccaggcccaggttagatctgcaatttctccagcggttcctgcagatactgaaggttttgtttccttcttggtcatcacaaaatgccttgatgttcctgacccttttgtgcctgaccctactggctgaagagctttgatcagttcacctgcaacctgctgtatgtgagctggaggaaggacctcactgagcaccttcaccgcctctacttccggggccgtgcgtactacaccctcaacgtgctgcgggatgacatcgataacccggaccagcgcatcagccaggacgtggagcgattctgccggcagctcagcagcatggccagcaagctcatcatctccccgttcaccctcgtctactacacttaccagtgcttccaaagcacaggctggctcgggcctgtgagcatcttcgggtatttcatcctggggaccgtggtgaacaaaactttgatgggccccattgtgatgaagctggtgcatcaggagaagctggagggagattttaggttcaagcacatgcagattcgggtgaatgcggagcctgctgctttctacagagctgggcatgtggagcacatgaggacagaccgcaggctgcagagactccttcagacccagagggagctgatgtccaaggagctctggctgtacatcggcatcaacacctttgactatctgggcagcatcctgagttacgttgtcatcgcaatccccattttcagcggggtctatggagacctgagtcccgcagagcttagcaccctggtcagcaagaatgcctttgtgtgcatctacctcatcagctgcttcacccagctcatcgacctgtccacgacgctctcagatgtggctggctacacgcacagaattgggcagcttcgggagacgcttctggacatgtccctgaagtcacaggactgcgagatcctgggcgagagcgagtggggcttggacacacccccagggtggccagcggcagagccagcagacacagcatttctccttgagcgggtctccatctctgccccctcctctgacaaacccctaatcaaggatctgagcctaaagatctccgagggacagagcctgctcatcacaggcaacacgggcactggcaagacctccttgctccgggttctgggtggcctctggacgagtacacggggctcagtgcagatgctgacggactttgggccccatggggtgctattcctgccacaaaagccattcttcactgacgggacccttcgggagcaggtgatatatcccctgaaggaggtctaccccgactcaggttctgccgatgatgagaggatcttgaggttcttggaattggcaggcctgtccaacttggtggcaaggacagagggcctggaccagcaggtggactggaactggtatgatgttctgtccccgggggagatgcaacggctctcctttgcccgactcttctacctgcagccgaagtacgcagtgcttgatgaagccaccagtgccctgacagaggaagtggagagcgagctctatcgcatcggccagcagctggggatgacgttcatcagtgtgggacatcggcagagccttgagaagtttcattccttggttctgaaactctgtggaggaggaagatgggagctgatgagaatcaaagtggaatgaagctctggcttttggaaggagagccacactgtggcgggtcggcggccctcaggagagaccaggaggactgacagcgaagatcgagctcaggttcgccacatagatcccgtgcaggagccacatgggtcctgtgcaggacccctagcagtggtgggctgagcccaggtctaggtttctgtgggggacactgaatctcccagtgttcagtctcccaggactctgctgcctcagccagagcctccatatgcttgaagtgctgattacctacaaatgatttcagatcatgtttgctaaagagaaatctggaagtgtgagatctgtaagaaatgaaagaaatgactcttggagtcaagagatctggaaatcttttaatcagttaaattgtgcagcaatagatttttaactttaactgaccatttaagttttttaataagttttttacaaagaaaagttaaacattaaaaagaattacagctttctgtcttctctatcatggaatgattttttttattgaatctccagatttgtatttgacagcttggtgggaagggaagcacactctgctgttctggaatcttatgcccagggtttttcacttctccccacatctccctttccacttgccagtgttgtgtagttagaacctgaaccactaacttctaggggcctttggtctgccctaccttaacccaaatgaaagtaaatccctttccccttagccaaaataaggttgggttttctaaaaaaatagtctatattagggaacaacaacagcaaattagacaaaacccagaaagcacaaagcatgaggtggagttactgtgcccaaagtcctcactcagaccagtgcccctccagttcagttgtctatgtattaccttccttaccttcataatgtttgccaggcttctgtacttctagtacttgagttacttaatatttttaaaaacaaaccttttaagtttaaatggatttttaagtgaaattttacacttaacatagatggaaagtaactaaaaataaatacaagaaaaaccatcggtgttattaacttacggctagatgctgttgcctgcatagactctgggcctgaggcttgttcattttgtaaaaaagagaggtgaggagttagacggactggcactcaactgagatttttctccttaataaaatcagaaagatgg

SEQ ID NO: 446370 - DNA, 3072 bp, Homo sapiens
cactttgttggttggggtacctctcagctcaagcttagctttggtgcaaagatgcgtgggaggctgctgctgctgcctaacttctaggcctctttctgatggctatggcttccatcctgcctctgccccctgagtagctgggactacaggtgtgcctcacagcctggagctttcacagccagataactaaaggggccaggctagggcttatataagagaaatttgggaggattgagataaaggggatagtcttcttgatcatccaaaacagctcatctaccttcaagtttttctttggctctgctcagagctggctcaggcccctgggtactggacctttcagttcccactttttcaggggattaactaaggcaccgtaagatgcaactctctagaaccctgtttaaaggccctgggatttagttgcccctaggaaaccagccttgtctggttccctcttcccatagggtcagtgttcacagcactgtgaggcaaggtcaagagcagaggtgatgtgaaagtttcttgttctctctacctttgggcccatctccctgggtccagctactctgtgtcattggctccagggaccagcgcatcagccaggacgtggagcgattctgccggcagctcagcagcatggccagcaagctcatcatctccccgttcaccctcgtctactacacttaccagtgcttccaaagcacaggctggctcgggcctgtgagcatcttcgggtatttcatcctggggaccgtggtgaacaaaactttgatgggccccattgtgatgaagctggtgcatcaggagaagctggagggagattttaggttcaagcacatgcagattcgggtgaatgcggagcctgctgctttctacagtcggcatcaacacctttgactatctgggcagcatcctgagttacgttgtcatcgcaatccccattttcagcggggtctatggagacctgagtcccgcagagcttagcaccctggtcagcaagaatgcctttgtgtgcatctacctcatcagctgcttcacccagctcatcgacctgtccacgacgctctcagatgtggctggctacacgcacagaattgggcagcttcgggagacgcttctggacatgtccctgaagtcacaggactgcgagatcctgggcgagagcgagtggggcttggacacacccccagggtggccagcggcagagccagcagacacagcatttctccttgagcgggtctccatctctgccccctcctctgacaaacccctaatcaaggatctgagcctaaagatctccgagggacagagcctgctcatcacaggcaacacgggcactggcaagacctccttgctccgggttctgggtggcctctggacgagtacacggggctcagtgcagatgctgacggactttgggccccatggggtgctattcctgccacaaaagccattcttcactgacgggacccttcgggagcaggtgatatatcccctgaaggaggtctaccccgactcaggttctgccgatgatgagaggatcttgaggttcttggaattggcaggcctgtccaacttggtggcaaggacagagggcctggaccagcaggtggactggaactggtatgatgttctgtccccgggggagatgcaacggctctcctttgcccgactcttctacctgcagccgaagtacgcagtgcttgatgaagccaccagtgccctgacagaggaagtggagagcgagctctatcgcatcggccagcagctggggatgacgttcatcagtgtgggacatcggcagagccttgagaagtttcattccttggttctgaaactctgtggaggaggaagatgggagctgatgagaatcaaagtggaatgaagctctggcttttggaaggagagccacactgtggcgggtcggcggccctcaggagagaccaggaggactgacagcgaagatcgagctcaggttcgccacatagatcccgtgcaggagccacatgggtcctgtgcaggacccctagcagtggtgggctgagcccaggtctaggtttctgtgggggacactgaatctcccagtgttcagtctcccaggactctgctgcctcagccagagcctccatatgcttgaagtgctgattacctacaaatgatttcagatcatgtttgctaaagagaaatctggaagtgtgagatctgtaagaaatgaaagaaatgactcttggagtcaagagatctggaaatcttttaatcagttaaattgtgcagcaatagatttttaactttaactgaccatttaagttttttaataagttttttacaaagaaaagttaaacattaaaaagaattacagctttctgtcttctctatcatggaatgattttttttattgaatctccagatttgtatttgacagcttggtgggaagggaagcacactctgctgttctggaatcttatgcccagggtttttcacttctccccacatctccctttccacttgccagtgttgtgtagttagaacctgaaccactaacttctaggggcctttggtctgccctaccttaacccaaatgaaagtaaatccctttccccttagccaaaataaggttgggttttctaaaaaaatagtctatattagggaacaacaacagcaaattagacaaaacccagaaagcacaaagcatgaggtggagttactgtgcccaaagtcctcactcagaccagtgcccctccagttcagttgtctatgtattaccttccttaccttcataatgtttgccaggcttctgtacttctagtacttgagttacttaatatttttaaaaacaaaccttttaagtttaaatggatttttaagtgaaattttacacttaacatagatggaaagtaactaaaaataaatacaagaaaaaccatcggtgttattaacttacggctagatgctgttgcctgcatagactctgggcctgaggcttgttcattttgtaaaaaagagaggtgaggagttagacggactggcactcaactgagatttttctccttaataaaatcagaaagatgg

SEQ ID NO: 446371 - DNA, 4602 bp, Homo sapiens
  misc_feature (1980)..(1980): n is a, c, g, or t
  misc_feature (1987)..(1987): n is a, c, g, or t
  misc_feature (1999)..(1999): n is a, c, g, or t
  misc_feature (2003)..(2003): n is a, c, g, or t
cgcttccgggagagtccgcgtctcccgcaccttcctctctatcaaacgccgtctctgtggtagccggggccccgcccctcctcggactctacccagtactgaactaggggcagctgggctccagagtccctcgggtctcaggtcatggcggtcgcggggcccgcgcccggagctggcgccaggcccaggttagatctgcaatttctccagcggttcctgcagatactgaaggttttgtttccttcttggtcatcacaaaatgccttgatgttcctgacccttttgtgcctgaccctactggagcaatttgtgatctaccaggttggcttgatccccagtcagtactatggggtcctgggaaacaaagacttggaagggtttaagactctgacattcctggctgtcatgctcattgttctgaactccacgctgaagagctttgatcagttcacctgcaacctgctgtatgtgagctggaggaaggacctcactgagcaccttcaccgcctctacttccggggccgtgcgtactacaccctcaacgtgctgcgggatgacatcgataacccggaccagcgcatcagccaggacgtggagcgattctgccggcagctcagcagcatggccagcaagctcatcatctccccgttcaccctcgtctactacacttaccagtgcttccaaagcacaggctggctcgggcctgtgagcatcttcgggtatttcatcctggggaccgtggtgaacaaaactttgatgggccccattgtgatgaagctggtgcatcaggagaagctggagggagattttaggttcaagcacatgcagattcgggtgaatgcggagcctgctgctttctacagagctgggcatgtggagcacatgaggacagaccgcaggctgcagagactccttcagacccagagggagctgatgtccaaggagctctggctgtacatcggcatcaacacctttgactatctgggcagcatcctgagttacgttgtcatcgcaatccccattttcagcggggtctatggagacctgagtcccgcagagcttagcaccctggtcagcaagaatgcctttgtgtgcatctacctcatcagctgcttcacccagctcatcgacctgtccacgacgctctcagatgtggctggctacacgcacagaattgggcagcttcgggagacgcttctggacatgtccctgaagtcacaggactgcgagatcctgggcgagagcgagtggggcttggacacacccccagggtggccagcggcagagccagcagacacagcatttctccttgagcgggtctccatctctgccccctcctctgacaaacccctaatcaaggatctgagcctaaagatctccgagggacagagcctgctcatcacaggcaacacgggcactggcaagacctccttgctccgggttctgggtggcctctggacgagtacacggggctcagtgcagatgctgacggactttgggccccatggggtgctattcctgccacaaaagccattcttcactgacgggacccttcgggagcagggtcagtctagttcagggggctcactcctccctcctcaaccccgcccacccacagctgggacctctggcactgtgacaagtctcaggtcctagagtcagggcaaaaggtgaggtggtgaagtggcccgggcctgggaactgctggctctaagaaccttctattcacatccatggattgggcccactactcatagcagctcctgaggcaggtaaatggggcaaggactcacgccaaataccacacgcgtatgtcaaacacccaaggtcggattctggggcccctgccctcaggaggctgtcagactgttccccctaaacacacttctgaaggttgtagggaccttgccctgctgtctgccggccagagcctctcccatctgacccaggccaggcgttcccacctctcctccttgggangttccantgggttctggangganggtgggctgtgtgcactccgtcttttgctcgccctcctaggttggtgtggtttttttcttttctcaggtgatatatcccctgaaggaggtctaccccgactcaggttctgccgatgatgagaggatcttgaggttcttggaattggcaggcctggtaagtggggagagggaccctcaggacccgagcccacctgggagcaccagctacaggtaggcaggtgctggccctgctatgctgggcccaggactggaagtctgaacctggggtggagaatgggagtatcagttgacagtgtgtgctgttggccaggtttaggcacgaagggggtagtgctctcattggagaattttaagacaagaataggattgatgaaggcggtttgctttttactgtcatcatgctccagcaagtctaaacagtgtcattggtagaatattcctctctgcctggggcagactgtcccacagtcccccgccttggtatgccactggggcatatatttgtcttagaggtgtgtgtgtatgctggggagtgagggaggttccccatgatggcaggtagcagggctggccatttcatggacatcctgccctctgggtctgttacagtccaacttggtggcaaggacagagggcctggaccagcaggtggactggaactggtaagaaaagagcttgggtgctccagagatagccccaccataaagacagtgggtttcagggtccctgtcaaggaatggaacggctcctgaccccaaagtccagatgtttggctggtcagtcgggtgcaagtttatgcccttgggaacagagttttgcctcactctgtgagggctgtaggcctatggtcgaaagggaaggggcttctgtctcctggggctcacctctgtgcagagaaacctcttcctacccagaccattctaggtaaaagccaagctatattcttcctcctctagcagtcctctctcctacctttcctcaggtatgatgttctgtccccgggggagatgcaacggctctcctttgcccgactcttctacctgcagccgaagtacgcagtgcttgatgaagccaccagtgccctgacagaggaagtggagagcgagctctatcgcatcggccagcagctggggatgacgttcatcagtgtgggacatcggcagagccttgagaaggtacccgtgctcacaaggatggcctgaggaggagaaagaacccaaaggctcagcctggccagggccagaggcccctcaaaacggggagtagcagtagcagagagaaccgagtggcctcctctgccggcggccagggcagcctgatctccatgtggtggtggtctcttgtagtttcattccttggttctgaaactctgtggaggaggaagatgggagctgatgagaatcaaagtggaatgaagctctggcttttggaaggagagccacactgtggcgggtcggcggccctcaggagagaccaggaggactgacagcgaagatcgagctcaggttcgccacatagatcccgtgcaggagccacatgggtcctgtgcaggacccctagcagtggtgggctgagcccaggtctaggtttctgtgggggacactgaatctcccagtgttcagtctcccaggactctgctgcctcagccagagcctccatatgcttgaagtgctgattacctacaaatgatttcagatcatgtttgctaaagagaaatctggaagtgtgagatctgtaagaaatgaaagaaatgactcttggagtcaagagatctggaaatcttttaatcagttaaattgtgcagcaatagatttttaactttaactgaccatttaagttttttaataagttttttacaaagaaaagttaaacattaaaaagaattacagctttctgtcttctctatcatggaatgattttttttattgaatctccagatttgtatttgacagcttggtgggaagggaagcacactctgctgttctggaatcttatgcccagggtttttcacttctccccacatctccctttccacttgccagtgttgtgtagttagaacctgaaccactaacttctaggggcctttggtctgccctaccttaacccaaatgaaagtaaatccctttccccttagccaaaataaggttgggttttctaaaaaaatagtctatattagggaacaacaacagcaaattagacaaaacccagaaagcacaaagcatgaggtggagttactgtgcccaaagtcctcactcagaccagtgcccctccagttcagttgtctatgtattaccttccttaccttcataatgtttgccaggcttctgtacttctagtacttgagttacttaatatttttaaaaacaaaccttttaagtttaaatggatttttaagtgaaattttacacttaacatagatggaaagtaactaaaaataaatacaagaaaaaccatcggtgttattaacttacggctagatgctgttgcctgcatagactctgggcctgaggcttgttcattttgtaaaaaagagaggtgaggagttagacggactggcactcaactgagatttttctccttaataaaatcagaaagatgg

SEQ ID NO: 446372 - DNA, 2998 bp, Homo sapiens
cgcttccgggagagtccgcgtctcccgcaccttcctctctatcaaacgccgtctctgtggtagccggggccccgcccctcctcggactctacccagtactgaactaggggcagctgggctccagagtccctcgggtctcaggtcatggcggtcgcggggcccgcgcccggagctggcgccaggcccaggttagatctgcaatttctccagcggttcctgcagatactgaaggttttgtttccttcttggtcatcacaaaatgccttgatgttcctgacccttttgtgcctgaccctactggagcaatttgtgatctaccaggttggcttgatccccagtcagtactatggggtcctgggaaacaaagacttggaagggtttaagactctgacattcctggctgtcatgctcattgttctgaactccacgctgaagagctttgatcagttcacctgcaacctgctgtatgtgagctggaggaaggacctcactgagcaccttcaccgcctctacttccggggccgtgcgtactacaccctcaacgtgctgcgggatgacatcgataacccggaccagcgcatcagccaggacgtggagcgattctgccggcagctcagcagcatggccagcaagctcatcatctccccgttcaccctcgtctactacacttaccagtgcttccaaagcacaggctggctcgggcctgtgagcatcttcgggtatttcatcctggggaccgtggtgaacaaaactttgatgggccccattgtgatgaagctggtgcatcaggagaagctggagggagattttaggttcaagcacatgcagattcgggtgaatgcggagcctgctgctttctacagagctgggcatgtggagcacatgaggacagaccgcaggctgcagagactccttcagacccagagggagctgatgtccaaggagctctggctgtacatcggcatcaacacctttgactatctgggcagcatcctgagttacgttgtcatcgcaatccccattttcagcggggtctatggagacctgagtcccgcagagcttagcaccctggtcagcaagaatgcctttgtgtgcatctacctcatcagctgcttcacccagctcatcgacctgtccacgacgctctcagatgtggctggctacacgcacagaattgggcagcttcgggagacgcttctggacatgtccctgaagtcacaggactgcgagatcctgggcgagagcgagtggggcttggacacacccccagggtggccagcggcagagccagcagacacagcatttctccttgagcgggtctccatctctgccccctcctctgacaaacccctaatcaaggatctgagcctaaagatctccgagggacagagcctgctcatcacaggcaacacgggcactggcaagacctccttgctccgggttctgggtggcctctggacgagtacacggggctcagtgcagatgctgacggactttgggccccatggggtgctattcctgccacaaaagccattcttcactgacgggacccttcgggagcaggtgatatatcccctgaaggaggtctaccccgactcaggttctgccgatgatgagaggatcttgaggttcttggaattggcaggcctgtccaacttggtggcaaggacagagggcctggaccagcaggtggactggaactggtatgatgttctgtccccgggggagatgcaacggctctcctttgcccgactcttctacctgcagccgaagtacgcagtgcttgatgaagccaccagtgccctgacagaggaagtggagagcgagctctatcgcatcggccagcagctggggatgacgttcatcagtgtgggacatcggcagagccttgagaaggtacccgtgctcacaaggatggcctgaggaggagaaagaacccaaaggctcagcctggccagggccagaggcccctcaaaacggggagtagcagtagcagagagaaccgagtggcctcctctgccggcggccagggcagcctgatctccatgtggtggtggtctcttgtagtttcattccttggttctgaaactctgtggaggaggaagatgggagctgatgagaatcaaagtggaatgaagctctggcttttggaaggagagccacactgtggcgggtcggcggccctcaggagagaccaggaggactgacagcgaagatcgagctcaggttcgccacatagatcccgtgcaggagccacatgggtcctgtgcaggaccctgtgagatctgtaagaaatgaaagaaatgactcttggagtcaagagatctggaaatcttttaatcagttaaattgtgcagcaatagatttttaactttaactgaccatttaagttttttaataagttttttacaaagaaaagttaaacattaaaaagaattacagctttctgtcttctctatcatggaatgattttttttattgaatctccagatttgtatttgacagcttggtgggaagggaagcacactctgctgttctggaatcttatgcccagggtttttcacttctccccacatctccctttccacttgccagtgttgtgtagttagaacctgaaccactaacttctaggggcctttggtctgccctaccttaacccaaatgaaagtaaatccctttccccttagccaaaataaggttgggttttctaaaaaaatagtctatattagggaacaacaacagcaaattagacaaaacccagaaagcacaaagcatgaggtggagttactgtgcccaaagtcctcactcagaccagtgcccctccagttcagttgtctatgtattaccttccttaccttcataatgtttgccaggcttctgtacttctagtacttgagttacttaatatttttaaaaacaaaccttttaagtttaaatggatttttaagtgaaattttacacttaacatagatggaaagtaactaaaaataaatacaag

SEQ ID NO: 446373 - DNA, 3875 bp, Homo sapiens
  misc_feature (1980)..(1980): n is a, c, g, or t
  misc_feature (1987)..(1987): n is a, c, g, or t
  misc_feature (1999)..(1999): n is a, c, g, or t
  misc_feature (2003)..(2003): n is a, c, g, or t
cgcttccgggagagtccgcgtctcccgcaccttcctctctatcaaacgccgtctctgtggtagccggggccccgcccctcctcggactctacccagtactgaactaggggcagctgggctccagagtccctcgggtctcaggtcatggcggtcgcggggcccgcgcccggagctggcgccaggcccaggttagatctgcaatttctccagcggttcctgcagatactgaaggttttgtttccttcttggtcatcacaaaatgccttgatgttcctgacccttttgtgcctgaccctactggagcaatttgtgatctaccaggttggcttgatccccagtcagtactatggggtcctgggaaacaaagacttggaagggtttaagactctgacattcctggctgtcatgctcattgttctgaactccacgctgaagagctttgatcagttcacctgcaacctgctgtatgtgagctggaggaaggacctcactgagcaccttcaccgcctctacttccggggccgtgcgtactacaccctcaacgtgctgcgggatgacatcgataacccggaccagcgcatcagccaggacgtggagcgattctgccggcagctcagcagcatggccagcaagctcatcatctccccgttcaccctcgtctactacacttaccagtgcttccaaagcacaggctggctcgggcctgtgagcatcttcgggtatttcatcctggggaccgtggtgaacaaaactttgatgggccccattgtgatgaagctggtgcatcaggagaagctggagggagattttaggttcaagcacatgcagattcgggtgaatgcggagcctgctgctttctacagagctgggcatgtggagcacatgaggacagaccgcaggctgcagagactccttcagacccagagggagctgatgtccaaggagctctggctgtacatcggcatcaacacctttgactatctgggcagcatcctgagttacgttgtcatcgcaatccccattttcagcggggtctatggagacctgagtcccgcagagcttagcaccctggtcagcaagaatgcctttgtgtgcatctacctcatcagctgcttcacccagctcatcgacctgtccacgacgctctcagatgtggctggctacacgcacagaattgggcagcttcgggagacgcttctggacatgtccctgaagtcacaggactgcgagatcctgggcgagagcgagtggggcttggacacacccccagggtggccagcggcagagccagcagacacagcatttctccttgagcgggtctccatctctgccccctcctctgacaaacccctaatcaaggatctgagcctaaagatctccgagggacagagcctgctcatcacaggcaacacgggcactggcaagacctccttgctccgggttctgggtggcctctggacgagtacacggggctcagtgcagatgctgacggactttgggccccatggggtgctattcctgccacaaaagccattcttcactgacgggacccttcgggagcagggtcagtctagttcagggggctcactcctccctcctcaaccccgcccacccacagctgggacctctggcactgtgacaagtctcaggtcctagagtcagggcaaaaggtgaggtggtgaagtggcccgggcctgggaactgctggctctaagaaccttctattcacatccatggattgggcccactactcatagcagctcctgaggcaggtaaatggggcaaggactcacgccaaataccacacgcgtatgtcaaacacccaaggtcggattctggggcccctgccctcaggaggctgtcagactgttccccctaaacacacttctgaaggttgtagggaccttgccctgctgtctgccggccagagcctctcccatctgacccaggccaggcgttcccacctctcctccttgggangttccantgggttctggangganggtgggctgtgtgcactccgtcttttgctcgccctcctaggttggtgtggtttttttcttttctcaggtgatatatcccctgaaggaggtctaccccgactcaggttctgccgatgatgagaggatcttgaggttcttggaattggcaggcctggtaagtggggagagggaccctcaggacccgagcccacctgggagcaccagctacaggtaggcaggtgctggccctgctatgctgggcccaggactggaagtctgaacctggggtggagaatgggagtatcagttgacagtgtgtgctgttggccaggtttaggcacgaagggggtagtgctctcattggagaattttaagacaagaataggattgatgaaggcggtttgctttttactgtcatcatgctccagcaagtctaaacagtgtcattggtagaatattcctctctgcctggggcagactgtcccacagtcccccgccttggtatgccactggggcatatatttgtcttagaggtgtgtgtgtatgctggggagtgagggaggttccccatgatggcaggtagcagggctggccatttcatggacatcctgccctctgggtctgttacagtccaacttggtggcaaggacagagggcctggaccagcaggtggactggaactggtaagaaaagagcttgggtgctccagagatagccccaccataaagacagtgggtttcagggtccctgtcaaggaatggaacggctcctgaccccaaagtccagatgtttggctggtcagtcgggtgcaagtttatgcccttgggaacagagttttgcctcactctgtgagggctgtaggcctatggtcgaaagggaaggggcttctgtctcctggggctcacctctgtgcagagaaacctcttcctacccagaccattctaggtaaacatatgcttgaagtgctgattacctacaaatgatttcagatcatgtttgctaaagagaaatctggaagtgtgagatctgtaagaaatgaaagaaatgactcttggagtcaagagatctggaaatcttttaatcagttaaattgtgcagcaatagatttttaactttaactgaccatttaagttttttaataagttttttacaaagaaaagttaaacattaaaaagaattacagctttctgtcttctctatcatggaatgattttttttattgaatctccagatttgtatttgacagcttggtgggaagggaagcacactctgctgttctggaatcttatgcccagggtttttcacttctccccacatctccctttccacttgccagtgttgtgtagttagaacctgaaccactaacttctaggggcctttggtctgccctaccttaacccaaatgaaagtaaatccctttccccttagccaaaataaggttgggttttctaaaaaaatagtctatattagggaacaacaacagcaaattagacaaaacccagaaagcacaaagcatgaggtggagttactgtgcccaaagtcctcactcagaccagtgcccctccagttcagttgtctatgtattaccttccttaccttcataatgtttgccaggcttctgtacttctagtacttgagttacttaatatttttaaaaacaaaccttttaagtttaaatggatttttaagtgaaattttacacttaacatagatggaaagtaactaaaaataaatacaagaaaaaccatcggtgttattaacttacggctagatgctgttgcctgcatagactctgggcctgaggcttgttcattttgtaaaaaagagaggtgaggagttagacggactggcactcaactgagatttttctccttaataaaatcagaaagatgg

SEQ ID NO: 446374 - DNA, 2374 bp, Homo sapiens
  misc_feature (2374)..(2374): n is a, c, g, or t
cgcttccgggagagtccgcgtctcccgcaccttcctctctatcaaacgccgtctctgtggtagccggggccccgcccctcctcggactctacccagtactgaactaggggcagctgggctccagagtccctcgggtctcaggtcatggcggtcgcggggcccgcgcccggagctggcgccaggcccaggttagatctgcaatttctccagcggttcctgcagatactgaaggttttgtttccttcttggtcatcacaaaatgccttgatgttcctgacccttttgtgcctgaccctactggagcaatttgtgatctaccaggttggcttgatccccagtcagtactatggggtcctgggaaacaaagacttggaagggtttaagactctgacattcctggctgtcatgctcattgttctgaactccacgctgaagagctttgatcagttcacctgcaacctgctgtatgtgagctggaggaaggacctcactgagcaccttcaccgcctctacttccggggccgtgcgtactacaccctcaacgtgctgcgggatgacatcgataacccggaccagcgcatcagccaggacgtggagcgattctgccggcagctcagcagcatggccagcaagctcatcatctccccgttcaccctcgtctactacacttaccagtgcttccaaagcacaggctggctcgggcctgtgagcatcttcgggtatttcatcctggggaccgtggtgaacaaaactttgatgggccccattgtgatgaagctggtgcatcaggagaagctggagggagattttaggttcaagcacatgcagattcgggtgaatgcggagcctgctgctttctacagagctgggcatgtggagcacatgaggacagaccgcaggctgcagagactccttcagacccagagggagctgatgtccaaggagctctggctgtacatcggcatcaacacctttgactatctgggcagcatcctgagttacgttgtcatcgcaatccccattttcagcggggtctatggagacctgagtcccgcagagcttagcaccctggtcagcaagaatgcctttgtgtgcatctacctcatcagctgcttcacccagctcatcgacctgtccacgacgctctcagatgtggctggctacacgcacagaattgggcagcttcgggagacgcttctggacatgtccctgaagtcacaggactgcgagatcctgggcgagagcgagtggggcttggacacacccccagggtggccagcggcagagccagcagacacagcatttctccttgagcgggtctccatctctgccccctcctctgacaaacccctaatcaaggatctgagcctaaagatctccgagggacagagcctgctcatcacaggcaacacgggcactggcaagacctccttgctccgggttctgggtggcctctggacgagtacacggggctcagtgcagatgctgacggactttgggccccatggggtgctattcctgccacaaaagccattcttcactgacgggacccttcgggagcaggtgatatatcccctgaaggaggtctaccccgactcaggttctgccgatgatgagaggatcttgaggttcttggaattggcaggcctgtccaacttggtggcaaggacagagggcctggaccagcaggtggactggaactggtatgatgttctgtccccgggggagatgcaacggctctcctttgcccgactcttctacctgcagccgaagtacgcagtgcttgatgaagccaccagtgccctgacagaggaagtggagagcgagctctatcgcatcggccagcagctggggatgacgttcatcagtgtgggacatcggcagagccttgagaagtttcattccttggttctgaaactctgtggaggaggaagatgggagctgatgagaatcaaagtggaatgaagctctggcttttggaaggagagccacactgtggcgggtcggcggccctcaggagagaccaggaggactgacagcgaagatcgagctcaggttcgccacatagatcccgtgcaggagccacatgggtcctgtgcaggacccctagcagtggtgggctgagcccaggtctaggtttctgtgggggacactgaatctcccagtgttcagtctcccaggactctgctgcctcagccagagcctccatatgcttgaagtgctgattacctacaaatgatttcagatcatgtttgctaaagagaaatctggaagtgtgagatctgtaagaaatgatgctcttgagtaagagactgtctttaatagtaattgtgcacaatgatttaactttaccgccatcaagtttttagttttn

SEQ ID NO: 446375 - DNA, 1782 bp, Homo sapiens
cgcttccgggagagtccgcgtctcccgcaccttcctctctatcaaacgccgtctctgtggtagccggggccccgcccctcctcggactctacccagtactgaactaggggcagctgggctccagagtccctcgggtctcaggtcatggcggtcgcggggcccgcgcccggagctggcgccaggcccaggttagatctgcaatttctccagcggttcctgcagatactgaaggttttgtttccttcttggtcatcacaaaatgccttgatgttcctgacccttttgtgcctgaccctactggagcaatttgtgatctaccaggttggcttgatccccagtcagtactatggggtcctgggaaacaaagacttggaagggtttaagactctgacattcctggctgtcatgctcattgttctgaactccacgctgaagagctttgatcagttcacctgcaacctgctgtatgtgagctggaggaaggacctcactgagcaccttcaccgcctctacttccggggccgtgcgtactacaccctcaacgtgctgcgggatgacatcgataacccggaccagcgcatcagccaggacgtggagcgattctgccggcagctcagcagcatggccagcaagctcatcatctccccgttcaccctcgtctactacacttaccagtgcttccaaagcacaggctggctcgggcctgtgagcatcttcgggtatttcatcctggggaccgtggtgaacaaaactttgatgggccccattgtgatgaagctggtgcatcaggagaagctggagggagattttaggttcaagcacatgcagattcgggtgaatgcggagcctgctgctttctacagagctgggcatgtggagcacatgaggacagaccgcaggctgcagagactccttcagacccagagggagctgatgtccaaggagctctggctgtacatcggcatcaacacctttgactatctgggcagcatcctgagttacgttgtcatcgcaatccccattttcagcggggtctatggagacctgagtcccgcagagcttagcaccctggtcagcaagaatgcctttgtgtgcatctacctcatcagctgcttcacccagctcatcgacctgtccacgacgctctcagatgtggctggctacacgcacagaattgggcagcttcgggagacgcttctggacatgtccctgaagtcacaggactgcgagatcctgggcgagagcgagtggggcttggacacacccccagggtggccagcggcagagccagcagacacagcatttctccttgagcgggtctccatctctgccccctcctctgacaaacccctaatcaaggatctgagcctaaagatctccgagggacagagcctgctcatcacaggcaacacgggcactggcaagacctccttgctccgggttctgggtggcctctggacgagtacacggggctcagtgcagatgctgacggactttgggccccatggggtgctattcctgccacaaaagccattcttcactgacgggacccttcgggagcaggtgatatatcccctgaaggaggtctaccccgactcaggtgagctggtcctccttaggtcatgtcctctccttctgtcatggttgtccctgctctacctgactgtggcctcatctgtgcccttggggagaggctccagccaggccgctgattcaaggaagaggggctcctctcctcttcctttgactgttttggggtctgtacccagatctcacctcatt

SEQ ID NO: 446376 - DNA, 964 bp, Homo sapiens
gcaggctggtacggtcggagtgtgggatcggtcgcggggccgcgcccggagctggcgccaggcccaggttagatctgcaatttctccagcggttcctgcagatactgaaggttttgtttccttcttggtcatcacaaaatgccttgatgttcctgacccttttgtgcctgaccctactggagcaatttgtgatctaccaggttggcttgatccccagtcagtactatggggtcctgggaaacaaagacttggaagggtttaagactctgacattcctggctgtcatgctcattgttctgaactccacgctgaagagctttgatcagttcacctgcaacctgctgtatgtgagctggaggaaggacctcactgagcaccttcaccgcctctacttccggggccgtgcgtactacaccctcaacgtgctgcgggatgacatcgataacccgtaggcgccccaactcagtcctttctacactctgtgtggtcctttccttctggcctagccctggagactgctggtggcagacaccaaggagatcatctgcagtcgttttcaaatgctgctgcccagagtcatgggggagggtgccctgcagaggactcctggagaagctgcagggctgtgaataggcagctaaaaagaagaagcctgcccaggtgcagtggcatgcacctgtagtcccaacaactcaggaggctgaggcaggaggatcacttgagcccaggagtagtgcaccgtgagcacacttgggaatagccactgtactctagcctgggcaacatagcagaaacccccatctcttaaaaaaaagaaaaatgttaggagcagctttcttttgtccttttcatactttatatcttagtcttccagtaagaagactaaggggtttctttagagggttctaaagaaaatgtccttgctagaaaaaccagctcttagattttcatcagtaaaaaaaat

SEQ ID NO: 446377 - DNA, 428 bp, Homo sapiens
gtggtggctcccgggagcagtgcctcccccacagcaatactgaccctgcccatcttcctcacgccccctctcttctctgacacagacccccagggtggccagcggcagagccagcagacacagcatttctccttgagcgggtctccatctctgccccctcctctgacaaacccctaatcaaggatctgagcctaaagatctccgagggacagagcctgctcatcacaggcaacacgggcactggcaagacctccttgctccgggttctgggtggcctctggacgagtacacggggtgagagccaggccctccctgcctctgacccagcctgggccctaggggtggggtgaaggcggggacggtgtggtagaatccattcttttctgttggggaacaaggaagagaggagacaggcagttgcctcttct

SEQ ID NO: 446378 - DNA, 3502 bp, Homo sapiens
  misc_feature (1980)..(1980): n is a, c, g, or t
  misc_feature (1987)..(1987): n is a, c, g, or t
  misc_feature (1999)..(1999): n is a, c, g, or t
  misc_feature (2003)..(2003): n is a, c, g, or t
cgcttccgggagagtccgcgtctcccgcaccttcctctctatcaaacgccgtctctgtggtagccggggccccgcccctcctcggactctacccagtactgaactaggggcagctgggctccagagtccctcgggtctcaggtcatggcggtcgcggggcccgcgcccggagctggcgccaggcccaggttagatctgcaatttctccagcggttcctgcagatactgaaggttttgtttccttcttggtcatcacaaaatgccttgatgttcctgacccttttgtgcctgaccctactggagcaatttgtgatctaccaggttggcttgatccccagtcagtactatggggtcctgggaaacaaagacttggaagggtttaagactctgacattcctggctgtcatgctcattgttctgaactccacgctgaagagctttgatcagttcacctgcaacctgctgtatgtgagctggaggaaggacctcactgagcaccttcaccgcctctacttccggggccgtgcgtactacaccctcaacgtgctgcgggatgacatcgataacccggaccagcgcatcagccaggacgtggagcgattctgccggcagctcagcagcatggccagcaagctcatcatctccccgttcaccctcgtctactacacttaccagtgcttccaaagcacaggctggctcgggcctgtgagcatcttcgggtatttcatcctggggaccgtggtgaacaaaactttgatgggccccattgtgatgaagctggtgcatcaggagaagctggagggagattttaggttcaagcacatgcagattcgggtgaatgcggagcctgctgctttctacagagctgggcatgtggagcacatgaggacagaccgcaggctgcagagactccttcagacccagagggagctgatgtccaaggagctctggctgtacatcggcatcaacacctttgactatctgggcagcatcctgagttacgttgtcatcgcaatccccattttcagcggggtctatggagacctgagtcccgcagagcttagcaccctggtcagcaagaatgcctttgtgtgcatctacctcatcagctgcttcacccagctcatcgacctgtccacgacgctctcagatgtggctggctacacgcacagaattgggcagcttcgggagacgcttctggacatgtccctgaagtcacaggactgcgagatcctgggcgagagcgagtggggcttggacacacccccagggtggccagcggcagagccagcagacacagcatttctccttgagcgggtctccatctctgccccctcctctgacaaacccctaatcaaggatctgagcctaaagatctccgagggacagagcctgctcatcacaggcaacacgggcactggcaagacctccttgctccgggttctgggtggcctctggacgagtacacggggctcagtgcagatgctgacggactttgggccccatggggtgctattcctgccacaaaagccattcttcactgacgggacccttcgggagcagggtcagtctagttcagggggctcactcctccctcctcaaccccgcccacccacagctgggacctctggcactgtgacaagtctcaggtcctagagtcagggcaaaaggtgaggtggtgaagtggcccgggcctgggaactgctggctctaagaaccttctattcacatccatggattgggcccactactcatagcagctcctgaggcaggtaaatggggcaaggactcacgccaaataccacacgcgtatgtcaaacacccaaggtcggattctggggcccctgccctcaggaggctgtcagactgttccccctaaacacacttctgaaggttgtagggaccttgccctgctgtctgccggccagagcctctcccatctgacccaggccaggcgttcccacctctcctccttgggangttccantgggttctggangganggtgggctgtgtgcactccgtcttttgctcgccctcctaggttggtgtggtttttttcttttctcaggtgatatatcccctgaaggaggtctaccccgactcaggttctgccgatgatgagaggatcttgaggttcttggaattggcaggcctgtccaacttggtggcaaggacagagggcctggaccagcaggtggactggaactggtatgatgttctgtccccgggggagatgcaacggctctcctttgcccgactcttctacctgcagccgaagtacgcagtgcttgatgaagccaccagtgccctgacagaggaagtggagagcgagctctatcgcatcggccagcagctggggatgacgttcatcagtgtgggacatcggcagagccttgagaagtttcattccttggttctgaaactctgtggaggaggaagatgggagctgatgagaatcaaagtggaatgaagctctggcttttggaaggagagccacactgtggcgggtcggcggccctcaggagagaccaggaggactgacagcgaagatcgagctcaggttcgccacatagatcccgtgcaggagccacatgggtcctgtgcaggacccctagcagtggtgggctgagcccaggtctaggtttctgtgggggacactgaatctcccagtgttcagtctcccaggactctgctgcctcagccagagcctccatatgcttgaagtgctgattacctacaaatgatttcagatcatgtttgctaaagagaaatctggaagtgtgagatctgtaagaaatgaaagaaatgactcttggagtcaagagatctggaaatcttttaatcagttaaattgtgcagcaatagatttttaactttaactgaccatttaagttttttaataagttttttacaaagaaaagttaaacattaaaaagaattacagctttctgtcttctctatcatggaatgattttttttattgaatctccagatttgtatttgacagcttggtgggaagggaagcacactctgctgttctggaatcttatgcccagggtttttcacttctccccacatctccctttccacttgccagtgttgtgtagttagaacctgaaccactaacttctaggggcctttggtctgccctaccttaacccaaatgaaagtaaatccctttccccttagccaaaataaggttgggttttctaaaaaaatagtctatattagggaacaacaacagcaaattagacaaaacccagaaagcacaaagcatgaggtggagttactgtgcccaaagtcctcactcagaccagtgcccctccagttcagttgtctatgtattaccttccttaccttcataatgtttgccaggcttctgtacttctagtacttgagttacttaatatttttaaaaacaaaccttttaagtttaaatggatttttaagtgaaattttacacttaacatagatggaaagtaactaaaaataaatacaag

SEQ ID NO: 446379 - DNA, 2867 bp, Homo sapiens
cgcttccgggagagtccgcgtctcccgcaccttcctctctatcaaacgccgtctctgtggtagccggggccccgcccctcctcggactctacccagtactgaactaggggcagctgggctccagagtccctcgggtctcaggtcatggcggtcgcggggcccgcgcccggagctggcgccaggcccaggttagatctgcaatttctccagcggttcctgcagatactgaaggttttgtttccttcttggtcatcacaaaatgccttgatgttcctgacccttttgtgcctgaccctactggctgaagagctttgatcagttcacctgcaacctgctgtatgtgagctggaggaaggacctcactgagcaccttcaccgcctctacttccggggccgtgcgtactacaccctcaacgtgctgcgggatgacatcgataacccggaccagcgcatcagccaggacgtggagcgattctgccggcagctcagcagcatggccagcaagctcatcatctccccgttcaccctcgtctactacacttaccagtgcttccaaagcacaggctggctcgggcctgtgagcatcttcgggtatttcatcctggggaccgtggtgaacaaaactttgatgggccccattgtgatgaagctggtgcatcaggagaagctggagggagattttaggttcaagcacatgcagattcgggtgaatgcggagcctgctgctttctacagagctgggcatgtggagcacatgaggacagaccgcaggctgcagagactccttcagacccagagggagctgatgtccaaggagctctggctgtacatcggcatcaacacctttgactatctgggcagcatcctgagttacgttgtcatcgcaatccccattttcagcggggtctatggagacctgagtcccgcagagcttagcaccctggtcagcaagaatgcctttgtgtgcatctacctcatcagctgcttcacccagctcatcgacctgtccacgacgctctcagatgtggctggctacacgcacagaattgggcagcttcgggagacgcttctggacatgtccctgaagtcacaggactgcgagatcctgggcgagagcgagtggggcttggacacacccccagggtggccagcggcagagccagcagacacagcatttctccttgagcgggtctccatctctgccccctcctctgacaaacccctaatcaaggatctgagcctaaagatctccgagggacagagcctgctcatcacaggcaacacgggcactggcaagacctccttgctccgggttctgggtggcctctggacgagtacacggggctcagtgcagatgctgacggactttgggccccatggggtgctattcctgccacaaaagccattcttcactgacgggacccttcgggagcaggtgatatatcccctgaaggaggtctaccccgactcaggttctgccgatgatgagaggatcttgaggttcttggaattggcaggcctgtccaacttggtggcaaggacagagggcctggaccagcaggtggactggaactggtatgatgttctgtccccgggggagatgcaacggctctcctttgcccgactcttctacctgcagccgaagtacgcagtgcttgatgaagccaccagtgccctgacagaggaagtggagagcgagctctatcgcatcggccagcagctggggatgacgttcatcagtgtgggacatcggcagagccttgagaagtttcattccttggttctgaaactctgtggaggaggaagatgggagctgatgagaatcaaagtggaatgaagctctggcttttggaaggagagccacactgtggcgggtcggcggccctcaggagagaccaggaggactgacagcgaagatcgagctcaggttcgccacatagatcccgtgcaggagccacatgggtcctgtgcaggacccctagcagtggtgggctgagcccaggtctaggtttctgtgggggacactgaatctcccagtgttcagtctcccaggactctgctgcctcagccagagcctccatatgcttgaagtgctgattacctacaaatgatttcagatcatgtttgctaaagagaaatctggaagtgtgagatctgtaagaaatgaaagaaatgactcttggagtcaagagatctggaaatcttttaatcagttaaattgtgcagcaatagatttttaactttaactgaccatttaagttttttaataagttttttacaaagaaaagttaaacattaaaaagaattacagctttctgtcttctctatcatggaatgattttttttattgaatctccagatttgtatttgacagcttggtgggaagggaagcacactctgctgttctggaatcttatgcccagggtttttcacttctccccacatctccctttccacttgccagtgttgtgtagttagaacctgaaccactaacttctaggggcctttggtctgccctaccttaacccaaatgaaagtaaatccctttccccttagccaaaataaggttgggttttctaaaaaaatagtctatattagggaacaacaacagcaaattagacaaaacccagaaagcacaaagcatgaggtggagttactgtgcccaaagtcctcactcagaccagtgcccctccagttcagttgtctatgtattaccttccttaccttcataatgtttgccaggcttctgtacttctagtacttgagttacttaatatttttaaaaacaaaccttttaagtttaaatggatttttaagtgaaattttacacttaacatagatggaaagtaactaaaaataaatacaag

SEQ ID NO: 446380 - DNA, 3149 bp, Homo sapiens
cgcttccgggagagtccgcgtctcccgcaccttcctctctatcaaacgccgtctctgtggtagccggggccccgcccctcctcggactctacccagtactgaactaggggcagctgggctccagagtccctcgggtctcaggtcatggcggtcgcggggcccgcgcccggagctggcgccaggcccaggttagatctgcaatttctccagcggttcctgcagatactgaaggttttgtttccttcttggtcatcacaaaatgccttgatgttcctgacccttttgtgcctgaccctactggagcaatttgtgatctaccaggttggcttgatccccagtcagtactatggggtcctgggaaacaaagacttggaagggtttaagactctgacattcctggctgtcatgctcattgttctgaactccacgctgaagagctttgatcagttcacctgcaacctgctgtatgtgagctggaggaaggacctcactgagcaccttcaccgcctctacttccggggccgtgcgtactacaccctcaacgtgctgcgggatgacatcgataacccggaccagcgcatcagccaggacgtggagcgattctgccggcagctcagcagcatggccagcaagctcatcatctccccgttcaccctcgtctactacacttaccagtgcttccaaagcacaggctggctcgggcctgtgagcatcttcgggtatttcatcctggggaccgtggtgaacaaaactttgatgggccccattgtgatgaagctggtgcatcaggagaagctggagggagattttaggttcaagcacatgcagattcgggtgaatgcggagcctgctgctttctacagagctgggcatgtggagcacatgaggacagaccgcaggctgcagagactccttcagacccagagggagctgatgtccaaggagctctggctgtacatcggcatcaacacctttgactatctgggcagcatcctgagttacgttgtcatcgcaatccccattttcagcggggtctatggagacctgagtcccgcagagcttagcaccctggtcagcaagaatgcctttgtgtgcatctacctcatcagctgcttcacccagctcatcgacctgtccacgacgctctcagatgtggctggctacacgcacagaattgggcagcttcgggagacgcttctggacatgtccctgaagtcacaggactgcgagatcctgggcgagagcgagtggggcttggacacacccccagggtggccagcggcagagccagcagacacagcatttctccttgagcgggtctccatctctgccccctcctctgacaaacccctaatcaaggatctgagcctaaagatctccgagggacagagcctgctcatcacaggcaacacgggcactggcaagacctccttgctccgggttctgggtggcctctggacgagtacacggggctcagtgcagatgctgacggactttgggccccatggggtgctattcctgccacaaaagccattcttcactgacgggacccttcgggagcaggtgatatatcccctgaaggaggtctaccccgactcaggttctgccgatgatgagaggatcttgaggttcttggaattggcaggcctgtccaacttggtggcaaggacagagggcctggaccagcaggtggactggaactggtatgatgttctgtccccgggggagatgcaacggctctcctttgcccgactcttctacctgcagccgaagtacgcagtgcttgatgaagccaccagtgccctgacagaggaagtggagagcgagctctatcgcatcggccagcagctggggatgacgttcatcagtgtgggacatcggcagagccttgagaagtttcattccttggttctgaaactctgtggaggaggaagatgggagctgatgagaatcaaagtggaatgaagctctggcttttggaaggagagccacactgtggcgggtcggcggccctcaggagagaccaggaggactgacagcgaagatcgagctcaggttcgccacatagatcccgtgcaggagccacatgggtcctgtgcaggacccctagcagtggtgggctgagcccaggtctaggtttctgtgggggacactgaatctcccagtgttcagtctcccaggactctgctgcctcagccagagcctccatatgcttgaagtgctgattacctacaaatgatttcagatcatgtttgctaaagagaaatctggaagtgtgagatctgtaagaaatgaaagaaatgactcttggagtcaagagatctggaaatcttttaatcagttaaattgtgcagcaatagatttttaactttaactgaccatttaagttttttaataagttttttacaaagaaaagttaaacattaaaaagaattacagctttctgtcttctctatcatggaatgattttttttattgaatctccagatttgtatttgacagcttggtgggaagggaagcacactctgctgttctggaatcttatgcccagggtttttcacttctccccacatctccctttccacttgccagtgttgtgtagttagaacctgaaccactaacttctaggggcctttggtctgccctaccttaacccaaatgaaagtaaatccctttccccttagccaaaataaggttgggttttctaaaaaaatagtctatattagggaacaacaacagcaaattagacaaaacccagaaagcacaaagcatgaggtggagttactgtgcccaaagtcctcactcagaccagtgcccctccagttcagttgtctatgtattaccttccttaccttcataatgtttgccaggcttctgtacttctagtacttgagttacttaatatttttaaaaacaaaccttttaagtttaaatggatttttaagtgaaattttacacttaacatagatggaaagtaactaaaaataaatacaagaaaaaccatcggtgttattaacttacggctagatgctgttgcctgcatagactctgggcctgaggcttgttcattttgtaaaaaagagaggtgaggagttagacggactggcactcaactgagatttttctccttaataaaatcagaaagatgg

SEQ ID NO: 446381 - DNA, 3028 bp, Homo sapiens
gcaggctggtacggtcggagtgtgggatcggtcgcggggccgcgcccggagctggcgccaggcccaggttagatctgcaatttctccagcggttcctgcagatactgaaggttttgtttccttcttggtcatcacaaaatgccttgatgttcctgacccttttgtgcctgaccctactggagcaatttgtgatctaccaggttggcttgatccccagtcagtactatggggtcctgggaaacaaagacttggaagggtttaagactctgacattcctggctgtcatgctcattgttctgaactccacgctgaagagctttgatcagttcacctgcaacctgctgtatgtgagctggaggaaggacctcactgagcaccttcaccgcctctacttccggggccgtgcgtactacaccctcaacgtgctgcgggatgacatcgataacccggaccagcgcatcagccaggacgtggagcgattctgccggcagctcagcagcatggccagcaagctcatcatctccccgttcaccctcgtctactacacttaccagtgcttccaaagcacaggctggctcgggcctgtgagcatcttcgggtatttcatcctggggaccgtggtgaacaaaactttgatgggccccattgtgatgaagctggtgcatcaggagaagctggagggagattttaggttcaagcacatgcagattcgggtgaatgcggagcctgctgctttctacagagctgggcatgtggagcacatgaggacagaccgcaggctgcagagactccttcagacccagagggagctgatgtccaaggagctctggctgtacatcggcatcaacacctttgactatctgggcagcatcctgagttacgttgtcatcgcaatccccattttcagcggggtctatggagacctgagtcccgcagagcttagcaccctggtcagcaagaatgcctttgtgtgcatctacctcatcagctgcttcacccagctcatcgacctgtccacgacgctctcagatgtggctggctacacgcacagaattgggcagcttcgggagacgcttctggacatgtccctgaagtcacaggactgcgagatcctgggcgagagcgagtggggcttggacacacccccagggtggccagcggcagagccagcagacacagcatttctccttgagcgggtctccatctctgccccctcctctgacaaacccctaatcaaggatctgagcctaaagatctccgagggacagagcctgctcatcacaggcaacacgggcactggcaagacctccttgctccgggttctgggtggcctctggacgagtacacggggctcagtgcagatgctgacggactttgggccccatggggtgctattcctgccacaaaagccattcttcactgacgggacccttcgggagcaggtgatatatcccctgaaggaggtctaccccgactcaggttctgccgatgatgagaggatcttgaggttcttggaattggcaggcctgtccaacttggtggcaaggacagagggcctggaccagcaggtggactggaactggtatgatgttctgtccccgggggagatgcaacggctctcctttgcccgactcttctacctgcagccgaagtacgcagtgcttgatgaagccaccagtgccctgacagaggaagtggagagcgagctctatcgcatcggccagcagctggggatgacgttcatcagtgtgggacatcggcagagccttgagaagtttcattccttggttctgaaactctgtggaggaggaagatgggagctgatgagaatcaaagtggaatgaagctctggcttttggaaggagagccacactgtggcgggtcggcggccctcaggagagaccaggaggactgacagcgaagatcgagctcaggttcgccacatagatcccgtgcaggagccacatgggtcctgtgcaggacccctagcagtggtgggctgagcccaggtctaggtttctgtgggggacactgaatctcccagtgttcagtctcccaggactctgctgcctcagccagagcctccatatgcttgaagtgctgattacctacaaatgatttcagatcatgtttgctaaagagaaatctggaagtgtgagatctgtaagaaatgaaagaaatgactcttggagtcaagagatctggaaatcttttaatcagttaaattgtgcagcaatagatttttaactttaactgaccatttaagttttttaataagttttttacaaagaaaagttaaacattaaaaagaattacagctttctgtcttctctatcatggaatgattttttttattgaatctccagatttgtatttgacagcttggtgggaagggaagcacactctgctgttctggaatcttatgcccagggtttttcacttctccccacatctccctttccacttgccagtgttgtgtagttagaacctgaaccactaacttctaggggcctttggtctgccctaccttaacccaaatgaaagtaaatccctttccccttagccaaaataaggttgggttttctaaaaaaatagtctatattagggaacaacaacagcaaattagacaaaacccagaaagcacaaagcatgaggtggagttactgtgcccaaagtcctcactcagaccagtgcccctccagttcagttgtctatgtattaccttccttaccttcataatgtttgccaggcttctgtacttctagtacttgagttacttaatatttttaaaaacaaaccttttaagtttaaatggatttttaagtgaaattttacacttaacatagatggaaagtaactaaaaataaatacaagaaaaaccatcggtgttattaacttacggctagatgctgttgcctgcatagactctgggcctgaggcttgttcattttgtaaaaaagagaggtgaggagttagacggactggcactcaactgagatttttctccttaataaaatcagaaagatgg

SEQ ID NO: 446382 - DNA, 4111 bp, Homo sapiens
  misc_feature (1980)..(1980): n is a, c, g, or t
  misc_feature (1987)..(1987): n is a, c, g, or t
  misc_feature (1999)..(1999): n is a, c, g, or t
  misc_feature (2003)..(2003): n is a, c, g, or t
cgcttccgggagagtccgcgtctcccgcaccttcctctctatcaaacgccgtctctgtggtagccggggccccgcccctcctcggactctacccagtactgaactaggggcagctgggctccagagtccctcgggtctcaggtcatggcggtcgcggggcccgcgcccggagctggcgccaggcccaggttagatctgcaatttctccagcggttcctgcagatactgaaggttttgtttccttcttggtcatcacaaaatgccttgatgttcctgacccttttgtgcctgaccctactggagcaatttgtgatctaccaggttggcttgatccccagtcagtactatggggtcctgggaaacaaagacttggaagggtttaagactctgacattcctggctgtcatgctcattgttctgaactccacgctgaagagctttgatcagttcacctgcaacctgctgtatgtgagctggaggaaggacctcactgagcaccttcaccgcctctacttccggggccgtgcgtactacaccctcaacgtgctgcgggatgacatcgataacccggaccagcgcatcagccaggacgtggagcgattctgccggcagctcagcagcatggccagcaagctcatcatctccccgttcaccctcgtctactacacttaccagtgcttccaaagcacaggctggctcgggcctgtgagcatcttcgggtatttcatcctggggaccgtggtgaacaaaactttgatgggccccattgtgatgaagctggtgcatcaggagaagctggagggagattttaggttcaagcacatgcagattcgggtgaatgcggagcctgctgctttctacagagctgggcatgtggagcacatgaggacagaccgcaggctgcagagactccttcagacccagagggagctgatgtccaaggagctctggctgtacatcggcatcaacacctttgactatctgggcagcatcctgagttacgttgtcatcgcaatccccattttcagcggggtctatggagacctgagtcccgcagagcttagcaccctggtcagcaagaatgcctttgtgtgcatctacctcatcagctgcttcacccagctcatcgacctgtccacgacgctctcagatgtggctggctacacgcacagaattgggcagcttcgggagacgcttctggacatgtccctgaagtcacaggactgcgagatcctgggcgagagcgagtggggcttggacacacccccagggtggccagcggcagagccagcagacacagcatttctccttgagcgggtctccatctctgccccctcctctgacaaacccctaatcaaggatctgagcctaaagatctccgagggacagagcctgctcatcacaggcaacacgggcactggcaagacctccttgctccgggttctgggtggcctctggacgagtacacggggctcagtgcagatgctgacggactttgggccccatggggtgctattcctgccacaaaagccattcttcactgacgggacccttcgggagcagggtcagtctagttcagggggctcactcctccctcctcaaccccgcccacccacagctgggacctctggcactgtgacaagtctcaggtcctagagtcagggcaaaaggtgaggtggtgaagtggcccgggcctgggaactgctggctctaagaaccttctattcacatccatggattgggcccactactcatagcagctcctgaggcaggtaaatggggcaaggactcacgccaaataccacacgcgtatgtcaaacacccaaggtcggattctggggcccctgccctcaggaggctgtcagactgttccccctaaacacacttctgaaggttgtagggaccttgccctgctgtctgccggccagagcctctcccatctgacccaggccaggcgttcccacctctcctccttgggangttccantgggttctggangganggtgggctgtgtgcactccgtcttttgctcgccctcctaggttggtgtggtttttttcttttctcaggtgatatatcccctgaaggaggtctaccccgactcaggttctgccgatgatgagaggatcttgaggttcttggaattggcaggcctggtaagtggggagagggaccctcaggacccgagcccacctgggagcaccagctacaggtaggcaggtgctggccctgctatgctgggcccaggactggaagtctgaacctggggtggagaatgggagtatcagttgacagtgtgtgctgttggccaggtttaggcacgaagggggtagtgctctcattggagaattttaagacaagaataggattgatgaaggcggtttgctttttactgtcatcatgctccagcaagtctaaacagtgtcattggtagaatattcctctctgcctggggcagactgtcccacagtcccccgccttggtatgccactggggcatatatttgtcttagaggtgtgtgtgtatgctggggagtgagggaggttccccatgatggcaggtagcagggctggccatttcatggacatcctgccctctgggtctgttacagtccaacttggtggcaaggacagagggcctggaccagcaggtggactggaactggtatgatgttctgtccccgggggagatgcaacggctctcctttgcccgactcttctacctgcagccgaagtacgcagtgcttgatgaagccaccagtgccctgacagaggaagtggagagcgagctctatcgcatcggccagcagctggggatgacgttcatcagtgtgggacatcggcagagccttgagaagtttcattccttggttctgaaactctgtggaggaggaagatgggagctgatgagaatcaaagtggaatgaagctctggcttttggaaggagagccacactgtggcgggtcggcggccctcaggagagaccaggaggactgacagcgaagatcgagctcaggttcgccacatagatcccgtgcaggagccacatgggtcctgtgcaggacccctagcagtggtgggctgagcccaggtctaggtttctgtgggggacactgaatctcccagtgttcagtctcccaggactctgctgcctcagccagagcctccatatgcttgaagtgctgattacctacaaatgatttcagatcatgtttgctaaagagaaatctggaagtgtgagatctgtaagaaatgaaagaaatgactcttggagtcaagagatctggaaatcttttaatcagttaaattgtgcagcaatagatttttaactttaactgaccatttaagttttttaataagttttttacaaagaaaagttaaacattaaaaagaattacagctttctgtcttctctatcatggaatgattttttttattgaatctccagatttgtatttgacagcttggtgggaagggaagcacactctgctgttctggaatcttatgcccagggtttttcacttctccccacatctccctttccacttgccagtgttgtgtagttagaacctgaaccactaacttctaggggcctttggtctgccctaccttaacccaaatgaaagtaaatccctttccccttagccaaaataaggttgggttttctaaaaaaatagtctatattagggaacaacaacagcaaattagacaaaacccagaaagcacaaagcatgaggtggagttactgtgcccaaagtcctcactcagaccagtgcccctccagttcagttgtctatgtattaccttccttaccttcataatgtttgccaggcttctgtacttctagtacttgagttacttaatatttttaaaaacaaaccttttaagtttaaatggatttttaagtgaaattttacacttaacatagatggaaagtaactaaaaataaatacaagaaaaaccatcggtgttattaacttacggctagatgctgttgcctgcatagactctgggcctgaggcttgttcattttgtaaaaaagagaggtgaggagttagacggactggcactcaactgagatttttctccttaataaaatcagaaagatgg

SEQ ID NO: 446383 - DNA, 3198 bp, Homo sapiens
cactttgttggttggggtacctctcagctcaagcttagctttggtgcaaagatgcgtgggaggctgctgctgctgcctaacttctaggcctctttctgatggctatggcttccatcctgcctctgccccctgagtagctgggactacaggtgtgcctcacagcctggagctttcacagccagataactaaaggggccaggctagggcttatataagagaaatttgggaggattgagataaaggggatagtcttcttgatcatccaaaacagctcatctaccttcaagtttttctttggctctgctcagagctggctcaggcccctgggtactggacctttcagttcccactttttcaggggattaactaaggcaccgtaagatgcaactctctagaaccctgtttaaaggccctgggatttagttgcccctaggaaaccagccttgtctggttccctcttcccatagggtcagtgttcacagcactgtgaggcaaggtcaagagcagaggtgatgtgaaagtttcttgttctctctacctttgggcccatctccctgggtccagctactctgtgtcattggctccagggaccagcgcatcagccaggacgtggagcgattctgccggcagctcagcagcatggccagcaagctcatcatctccccgttcaccctcgtctactacacttaccagtgcttccaaagcacaggctggctcgggcctgtgagcatcttcgggtatttcatcctggggaccgtggtgaacaaaactttgatgggccccattgtgatgaagctggtgcatcaggagaagctggagggagattttaggttcaagcacatgcagattcgggtgaatgcggagcctgctgctttctacagccctgtggacatcccagcctttccttgtcagagctgggcatgtggagcacatgaggacagaccgcaggctgcagagactccttcagacccagagggagctgatgtccaaggagctctggctgtacatcggcatcaacacctttgactatctgggcagcatcctgagttacgttgtcatcgcaatccccattttcagcggggtctatggagacctgagtcccgcagagcttagcaccctggtcagcaagaatgcctttgtgtgcatctacctcatcagctgcttcacccagctcatcgacctgtccacgacgctctcagatgtggctggctacacgcacagaattgggcagcttcgggagacgcttctggacatgtccctgaagtcacaggactgcgagatcctgggcgagagcgagtggggcttggacacacccccagggtggccagcggcagagccagcagacacagcatttctccttgagcgggtctccatctctgccccctcctctgacaaacccctaatcaaggatctgagcctaaagatctccgagggacagagcctgctcatcacaggcaacacgggcactggcaagacctccttgctccgggttctgggtggcctctggacgagtacacggggctcagtgcagatgctgacggactttgggccccatggggtgctattcctgccacaaaagccattcttcactgacgggacccttcgggagcaggtgatatatcccctgaaggaggtctaccccgactcaggttctgccgatgatgagaggatcttgaggttcttggaattggcaggcctgtccaacttggtggcaaggacagagggcctggaccagcaggtggactggaactggtatgatgttctgtccccgggggagatgcaacggctctcctttgcccgactcttctacctgcagccgaagtacgcagtgcttgatgaagccaccagtgccctgacagaggaagtggagagcgagctctatcgcatcggccagcagctggggatgacgttcatcagtgtgggacatcggcagagccttgagaagtttcattccttggttctgaaactctgtggaggaggaagatgggagctgatgagaatcaaagtggaatgaagctctggcttttggaaggagagccacactgtggcgggtcggcggccctcaggagagaccaggaggactgacagcgaagatcgagctcaggttcgccacatagatcccgtgcaggagccacatgggtcctgtgcaggacccctagcagtggtgggctgagcccaggtctaggtttctgtgggggacactgaatctcccagtgttcagtctcccaggactctgctgcctcagccagagcctccatatgcttgaagtgctgattacctacaaatgatttcagatcatgtttgctaaagagaaatctggaagtgtgagatctgtaagaaatgaaagaaatgactcttggagtcaagagatctggaaatcttttaatcagttaaattgtgcagcaatagatttttaactttaactgaccatttaagttttttaataagttttttacaaagaaaagttaaacattaaaaagaattacagctttctgtcttctctatcatggaatgattttttttattgaatctccagatttgtatttgacagcttggtgggaagggaagcacactctgctgttctggaatcttatgcccagggtttttcacttctccccacatctccctttccacttgccagtgttgtgtagttagaacctgaaccactaacttctaggggcctttggtctgccctaccttaacccaaatgaaagtaaatccctttccccttagccaaaataaggttgggttttctaaaaaaatagtctatattagggaacaacaacagcaaattagacaaaacccagaaagcacaaagcatgaggtggagttactgtgcccaaagtcctcactcagaccagtgcccctccagttcagttgtctatgtattaccttccttaccttcataatgtttgccaggcttctgtacttctagtacttgagttacttaatatttttaaaaacaaaccttttaagtttaaatggatttttaagtgaaattttacacttaacatagatggaaagtaactaaaaataaatacaagaaaaaccatcggtgttattaacttacggctagatgctgttgcctgcatagactctgggcctgaggcttgttcattttgtaaaaaagagaggtgaggagttagacggactggcactcaactgagatttttctccttaataaaatcagaaagatgg

SEQ ID NO: 446384 - DNA, 1869 bp, Homo sapiens
tagaacaagcagaggagaagcaccgtccttctctggagatcgcctcatcctctttctcgttggttatccccctctcgtcgctccatatttcggtgtctccccttcttgcaccttctgttcgccactcttgtgggtgtgaccccctctgccaccgccccggcaaccccatctccagttttcgccctggccgtacatcgggtcatccagtcggaccgcctttgctcccggggtgctatctccaccgaccatggcttccgtgtccgggccctcgggtgcagctgatatatcccctcacgaggtcttccccgactccccttcggcctgatgatgagaggatccttgaggctcattggaatagacatgccctgtccaacctcggtgacaaacgccagaggtccgggaaccaccgttgactggccactggtatgatgttctgtccccgggggagatgcaacggctctcctttgcccgactcttctacctgcagccgaagtacgcagtgcttgatgaagccaccagtgccctgacagaggaagtggagagcgagctctatcgcatcggccagcagctggggatgacgttcatcagtgtgggacatcggcagagccttgagaagtttcattccttggttctgaaactctgtggaggaggaagatgggagctgatgagaatcaaagtggaatgaagctctggcttttggaaggagagccacactgtggcgggtcggcggccctcaggagagaccaggaggactgacagcgaagatcgagctcaggttcgccacatagatcccgtgcaggagccacatgggtcctgtgcaggacccctagcagtggtgggctgagcccaggtctaggtttctgtgggggacactgaatctcccagtgttcagtctcccaggactctgctgcctcagccagagcctccatatgcttgaagtgctgattacctacaaatgatttcagatcatgtttgctaaagagaaatctggaagtgtgagatctgtaagaaatgaaagaaatgactcttggagtcaagagatctggaaatcttttaatcagttaaattgtgcagcaatagatttttaactttaactgaccatttaagttttttaataagttttttacaaagaaaagttaaacattaaaaagaattacagctttctgtcttctctatcatggaatgattttttttattgaatctccagatttgtatttgacagcttggtgggaagggaagcacactctgctgttctggaatcttatgcccagggtttttcacttctccccacatctccctttccacttgccagtgttgtgtagttagaacctgaaccactaacttctaggggcctttggtctgccctaccttaacccaaatgaaagtaaatccctttccccttagccaaaataaggttgggttttctaaaaaaatagtctatattagggaacaacaacagcaaattagacaaaacccagaaagcacaaagcatgaggtggagttactgtgcccaaagtcctcactcagaccagtgcccctccagttcagttgtctatgtattaccttccttaccttcataatgtttgccaggcttctgtacttctagtacttgagttacttaatatttttaaaaacaaaccttttaagtttaaatggatttttaagtgaaattttacacttaacatagatggaaagtaactaaaaataaatacaagaaaaaccatcggtgttattaacttacggctagatgctgttgcctgcatagactctgggcctgaggcttgttcattttgtaaaaaagagaggtgaggagttagacggactggcactcaactgagatttttctccttaataaaatcagaaagatgg

SEQ ID NO: 446385 - DNA, 2339 bp, Homo sapiens
cgcttccgggagagtccgcgtctcccgcaccttcctctctatcaaacgccgtctctgtggtagccggggccccgcccctcctcggactctacccagtactgaactaggggcagctgggctccagagtccctcgggtctcaggtcatggcggtcgcggggcccgcgcccggagctggcgccaggcccaggttagatctgcaatttctccagcggttcctgcagatactgaaggttttgtttccttcttggtcatcacaaaatgccttgatgttcctgacccttttgtgcctgaccctactggagcaatttgtgatctaccaggttggcttgatccccagtcagtactatggggtcctgggaaacaaagacttggaagggtttaagactctgacattcctggctgtcatgctcattgttctgaactccacgctgaagagctttgatcagttcacctgcaacctgctgtatgtgagctggaggaaggacctcactgagcaccttcaccgcctctacttccggggccgtgcgtactacaccctcaacgtgctgcgggatgacatcgataacccggaccagcgcatcagccaggacgtggagcgattctgccggcagctcagcagcatggccagcaagctcatcatctccccgttcaccctcgtctactacacttaccagtgcttccaaagcacaggctggctcgggcctgtgagcatcttcgggtatttcatcctggggaccgtggtgaacaaaactttgatgggccccattgtgatgaagctggtgcatcaggagaagctggagggagattttaggttcaagcacatgcagattcgggtgaatgcggagcctgctgctttctacagagctgggcatgtggagcacatgaggacagaccgcaggctgcagagactccttcagacccagagggagctgatgtccaaggagctctggctgtacatcggcatcaacacctttgactatctgggcagcatcctgagttacgttgtcatcgcaatccccattttcagcggggtctatggagacctgagtcccgcagagcttagcaccctggtcagcaagaatgcctttgtgtgcatctacctcatcagctgcttcacccagctcatcgacctgtccacgacgctctcagatgtggctggctacacgcacagaattgggcagcttcgggagacgcttctggacatgtccctgaagtcacaggatgacagcgaagatcgagctcaggttcgccacatagatcccgtgcaggagccacatgggtcctgtgcaggacccctagcagtggtgggctgagcccaggtctaggtttctgtgggggacactgaatctcccagtgttcagtctcccaggactctgctgcctcagccagagcctccatatgcttgaagtgctgattacctacaaatgatttcagatcatgtttgctaaagagaaatctggaagtgtgagatctgtaagaaatgaaagaaatgactcttggagtcaagagatctggaaatcttttaatcagttaaattgtgcagcaatagatttttaactttaactgaccatttaagttttttaataagttttttacaaagaaaagttaaacattaaaaagaattacagctttctgtcttctctatcatggaatgattttttttattgaatctccagatttgtatttgacagcttggtgggaagggaagcacactctgctgttctggaatcttatgcccagggtttttcacttctccccacatctccctttccacttgccagtgttgtgtagttagaacctgaaccactaacttctaggggcctttggtctgccctaccttaacccaaatgaaagtaaatccctttccccttagccaaaataaggttgggttttctaaaaaaatagtctatattagggaacaacaacagcaaattagacaaaacccagaaagcacaaagcatgaggtggagttactgtgcccaaagtcctcactcagaccagtgcccctccagttcagttgtctatgtattaccttccttaccttcataatgtttgccaggcttctgtacttctagtacttgagttacttaatatttttaaaaacaaaccttttaagtttaaatggatttttaagtgaaattttacacttaacatagatggaaagtaactaaaaataaatacaagaaaaaccatcggtgttattaacttacggctagatgctgttgcctgcatagactctgggcctgaggcttgttcattttgtaaaaaagagaggtgaggagttagacggactggcactcaactgagatttttctccttaataaaatcagaaagatgg

SEQ ID NO: 446386 - DNA, 2910 bp, Homo sapiens
cgcttccgggagagtccgcgtctcccgcaccttcctctctatcaaacgccgtctctgtggtagccggggccccgcccctcctcggactctacccagtactgaactaggggcagctgggctccagagtccctcgggtctcaggtcatggcggtcgcggggcccgcgcccggagctggcgccaggcccaggttagatctgcaatttctccagcggttcctgcagatactgaaggttttgtttccttcttggtcatcacaaaatgccttgatgttcctgacccttttgtgcctgaccctactggagcaatttgtgatctaccaggttggcttgatccccagtcagtactatggggtcctgggaaacaaagacttggaagggtttaagactctgacattcctggctgtcatgctcattgttctgaactccacgctgaagagctttgatcagttcacctgcaacctgctgtatgtgagctggaggaaggacctcactgagcaccttcaccgcctctacttccggggccgtgcgtactacaccctcaacgtgctgcgggatgacatcgataacccggaccagcgcatcagccaggacgtggagcgattctgccggcagctcagcagcatggccagcaagctcatcatctccccgttcaccctcgtctactacacttaccagtgcttccaaagcacaggctggctcgggcctgtgagcatcttcgggtatttcatcctggggaccgtggtgaacaaaactttgatgggccccattgtgatgaagctggtgcatcaggagaagctggagggagattttaggttcaagcacatgcagattcgggtgaatgcggagcctgctgctttctacagagctgggcatgtggagcacatgaggacagaccgcaggctgcagagactccttcagacccagagggagctgatgtccaaggagctctggctgtacatcggcatcaacacctttgactatctgggcagcatcctgagttacgttgtcatcgcaatccccattttcagcggggtctatggagacctgagtcccgcagagcttagcaccctggtcagcaagaatgcctttgtgtgcatctacctcatcagctgcttcacccagctcatcgacctgtccacgacgctctcagatgtggctggctacacgcacagaattgggcagcttcgggagacgcttctggacatgtccctgaagtcacaggactgcgagatcctgggcgagagcgagtggggcttggacacacccccagggtggccagcggcagagccagcagacacagcatttctccttgagcgggtctccatctctgccccctcctctgacaaacccctaatcaaggatctgagcctaaagatctccgagggacagagcctgctcatcacaggcaacacgggcactggcaagacctccttgctccgggttctgggtggcctctggacgagtacacggggctcagtgcagatgctgacggactttgggccccatggggtgctattcctgccacaaaagccattcttcactgacgggacccttcgggagcaggtgatatatcccctgaaggaggtctaccccgactcaggttctgccgatgatgagaggatcttgaggttcttggaattggcaggcctgtccaacttggtggcaaggacagagggcctggaccagcaggtggactggaactggtatgatgttctgtccccgggggagatgcaacggctctcctttgcccgactcttctacctgcagccgaagtacgcagtgcttgatgaagccaccagtgccctgacagaggaagtggagagcgagctctatcgcatcggccagcagctggggatgacgttcatcagtgtgggacatcggcagagccttgagaagtttcattccttggttctgaaactctgtggaggaggaagatgggagctgatgagaatcaaagtggaatgaagcatatgcttgaagtgctgattacctacaaatgatttcagatcatgtttgctaaagagaaatctggaagtgtgagatctgtaagaaatgaaagaaatgactcttggagtcaagagatctggaaatcttttaatcagttaaattgtgcagcaatagatttttaactttaactgaccatttaagttttttaataagttttttacaaagaaaagttaaacattaaaaagaattacagctttctgtcttctctatcatggaatgattttttttattgaatctccagatttgtatttgacagcttggtgggaagggaagcacactctgctgttctggaatcttatgcccagggtttttcacttctccccacatctccctttccacttgccagtgttgtgtagttagaacctgaaccactaacttctaggggcctttggtctgccctaccttaacccaaatgaaagtaaatccctttccccttagccaaaataaggttgggttttctaaaaaaatagtctatattagggaacaacaacagcaaattagacaaaacccagaaagcacaaagcatgaggtggagttactgtgcccaaagtcctcactcagaccagtgcccctccagttcagttgtctatgtattaccttccttaccttcataatgtttgccaggcttctgtacttctagtacttgagttacttaatatttttaaaaacaaaccttttaagtttaaatggatttttaagtgaaattttacacttaacatagatggaaagtaactaaaaataaatacaagaaaaaccatcggtgttattaacttacggctagatgctgttgcctgcatagactctgggcctgaggcttgttcattttgtaaaaaagagaggtgaggagttagacggactggcactcaactgagatttttctccttaataaaatcagaaagatgg

SEQ ID NO: 446387 - DNA, 1934 bp, Homo sapiens
cgcttccgggagagtccgcgtctcccgcaccttcctctctatcaaacgccgtctctgtggtagccggggccccgcccctcctcggactctacccagtactgaactaggggcagctgggctccagagtccctcgggtctcaggtcatggcggtcgcggggcccgcgcccggagctggcgccaggcccaggttagatctgcaatttctccagcggttcctgcagatactgaaggttttgtttccttcttggtcatcacaaaatgccttgatgttcctgacccttttgtgcctgaccctactggagcaatttgtgatctaccaggttggcttgatccccagtcagtactatggggtcctgggaaacaaagacttggaagggtttaagactctgacattcctggctgtcatgctcattgttctgaactccacgctgaagagctttgatcagttcacctgcaacctgctgtatgtgagctggaggaaggacctcactgagcaccttcaccgcctctacttccggggccgtgcgtactacaccctcaacgtgctgcgggatgacatcgataacccggaccagcgcatcagccaggacgtggagcgattctgccggcagctcagcagcatggccagcaagctcatcatctccccgttcaccctcgtctactacacttaccagtgcttccaaagcacaggctggctcgggcctgtgagcatcttcgggtatttcatcctggggaccgtggtgaacaaaactttgatgggccccattgtgatgaagctggtgcatcaggagaagctggagggagattttaggttcaagcacatgcagattcgggtgaatgcggagcctgctgctttctacaggtgagtctggagagatggttccccttctgccttgccagagctgagagtggagaaggacaagatgaatcctcaaacctcccaccaccaccgagctcaggggctgagtgttgtcacacttggctgtgaccctctccctctacctccccctgcccttgcctgcctcatccttaggtccaggggtttgcttctgaagcttggtggttcctttactgggccagctttagtcttagtggctagcgtggggcctgaaattgtcaaatgaatgaatgcctcatcctcttgctggtgactgtaagacatccgtctgcctctgctcttctgtctgttaagaagctttcttgccagtgcctgaggttcaagcctgatcctttgtctccgtagcgtgggatggaatgggagcttctcagaaaaccaggagacctgctccccacaatgctgtctaatggagccaagcgtctggtctcctgacggcagcagcaggagcagcagcagcggcatgaaatcccatcccttccctccagggccagaaccggtccctgtgctctgccttatgtgaggcctctgaaatcagcgttaggattgatagtgcaggcagaggtttgcgtttaagaagtggaagctactccttggctctgtacttggggtggatgtgatagccctgggacctttgctcctcagtctctgctgcagtttgcaacctccaccacttgagggcaccaagaatactgggaatctgcgctggggtggggttgtgaggtgggcagggctgggtgtgtaaaaaagttgcttttggaggccgggcatggtggctcatgcctgtaatcccagcactttgggaggccgaggcgggtggattgcctgaggtcaagagttcgagaccagccatggccaacatggtgaaaccctgtctctactaaaaatacaaaaaattagctgagcatggtggcgggcacctgtaatcccagctactggggaggctgaggcaggagaatcacttgaatccgggaggcagaggttgcagtaaggcaagatcctgccattgcactccagcctgggtgacagagcaagact

SEQ ID NO: 446388 - DNA, 3130 bp, Homo sapiens
tcccgcgaaggagaagcgcgcttttttccctggcgggggatttggctagaaggctgggccggcagcggttgtgaggagttagctcgcggcattgcaggctctgagaggaggggacccggttcccgggtgagtgtccaggcatgccagcggaacggcccgcgggcagcggcggctcggaggctccagcaatggttgaacaactggacactgctgtgattaccccggccatgctagaagaggaagaacagcttgaagctgctggactagagagagagcggaagatgctggaaaaggctcgcatgtcttgggatagagagtcgacagaaattcggtaccgtagacttcaacatttgcttgaaaaaagcaatatctactccaaatttttattgacgaaaatggaacagcaacaattagaggaacagaagaagaaagaaaaattggagagaaaaaaggagtctttaaaagttaaaaagggtaaaaattcaattgatgcaagtgaagagaagccagttatgaggaaaaaaagaggaagagaagatgaatcatacaatatttcagaggtcatgtcaaaagaggaaattttgtctgtggctaaaaaaaataaaaaggagaatgaggatgaaaactcctcctctactaatctctgtgtggaagatcttcagaaaaataaagattcgaatagtataattaaagatagattgtctgaaacggttaggcagaatactaaattcttttttgacccagtccggaagtgtaatggtcagccagtaccttttcaacaaccaaagcacttcactggaggagtgatgcgatggtaccaagtagaaggcatggaatggcttaggatgctttgggaaaatggaattaatggcattttagcagatgaaatgggattgggtaagacagttcagtgcattgctactattgcattgatgattcagagaggagtaccaggaccttttcttgtctgtggccctttgtctacacttcctaactggatggctgaattcaaaagatttacaccagatatccctacaatgttatatcatggaacccaggaggaacgtcaaaaattggtaagaaatatttacaaacggaaagggactttgcagattcatcctgtggtaatcacgtcatttgaaatagccatgagagaccgaaatgcgttacagcattgctattggaaatacttaatagtagatgaaggacacaggattaagaatatgaagtgccgtctaatcagggagttaaaacgattcaatgctgataacaaacttcttttgactggtactcccttgcaaaacaatttatcagaactttggtcattgctaaactttttgttgccagatgtatttgatgacttgaaaagctttgagtcttggttgacatcactagtctttctgaaactgctgaagatattatgctaaagaaagagaacagaatgtattgcatatgctgcaccagattttaacacctttcttatgagaagactgaagtctgatgttgctcttgaagttcctcctaaacgagaagtagtcgtttatgctccactttcaaagaagcaggagatcttttatacagccattgtgaaccgtacaattgcaaacatgtttggatccagtgagaaagaaacaattgagttaagtcctactggtcgaccaaaacgacgaactagaaaatcaataaattacagcaaaatagatgatttccctaatgaattggaaaaactgatcagtcaaatacagccagaggtggaccgagaaagagctgttgtggaagtgaatatccctgtagaatctgaagttaatctgaagctgcagaatataatgatgctacttcgtaaatgttgtaatcatccatatttgattgaatatcctatagaccctgttacacaagaatttaagatcgatgaagaattggtaacaaattctgggaagttcttgattttggatcgaatgctgccagaactaaaaaaaagaggtcacaaggtgctgcttttttcacaaatgacaagcatgttggacattttgatggattactgccatctcagagatttcaacttcagcaggcttgatgggtccatgtcttactcagagagagaaaaaaacatgcacagcttcaacacggatccagaggtgtttatcttcttagtgagtacacgagctggtggcctgggcattaatctgactgcagcagatacagttatcatttatgatagtgattggaacccccagtcggatcttcaggcccaggatagatgtcatagaattggtcagacaaagccagttgttgtttatcgccttgttacagcaaatactatcgatcagaaaattgtggaaagagcagctgctaaaaggaaactggaaaagttgatcatccataaaaatcatttcaaaggtggtcagtctggattaaatctgtctaagaatttcttagatcctaaggaattaatggaattattaaaatctagagattatgaaagggaaataaaaggatcaagagagaaggtcattagtgataaagatctagagttgttgttagatcgaagtgatcttattgatcaaatgaatgcttcaggaccaattaaagagaagatggggatattcaagatattagaaaattctgaagattccagtcctgaatgtttgttttaaagtggagctcaagaatagcttttaaaagttcttatttacatctagtgatttccctgtattgggtttgaaatactgattgtccacttcaccttttttattatatcagttgacatgtaactagtaccatgcgtacttaaatagatggtaattttctgagccttaccaagaacaaagaagtatccatattaagtttagattttcagttaatttttgagactgagtagtattcttggatacaggctgatgtgtacttaaccacttccagatttatacagtcttcctgtggaagtttagtaaatgtctttttccctcctttcttctagtaatgcagttcatgggctttaggtacttcagttatgaagtaggcttttcatggggagagattgggattatgctctctgttgtttaagaaactgtttgattttagagtctatttctatgagatagtttaccaaataaatgttccttataagatg

SEQ ID NO: 446389 - DNA, 2723 bp, Homo sapiens
atttcttaaggtggagtctcgcactgtcacctgggctggagtgcagtggcatgatctcggctcactacaacctttgcctcttgggttcaagtgagtctcctgtctcagcctcccaagtagctgggattacaagtgcccaccaccacgcccagctaattttttgtatttttagtagagacagggtttcaccatgttggccaggctggtctcaaactcctgaccttgtgatttgcctgacttggcctcccaaagtgctgggattacaggcttgagccaccatgcccggccaagactattttttagaaccataaccacaatacagttaccacacttttgaaagtcgatgggaattccttaatatttaaatttctcaataggctaatttttatttttagggatgggggcttgctgtattgacgagactggagtgcagtggctattcctgagtattgtcatagtgactacacctcaaacacctgggctcacatgatcctcctgcctcagtgtcccgagtagtagtgcagggactgtaggcacttaccgctgtgatctgcttagctcatacattttaaaaaaatagttggttcaaatcaggatccaaaaaagttacataaattgtgtttgattaatgcgtatcttgggtctcttttagatctagagtgtctctcatcttttttaagaaacattatttgttgaagaaaatgagtaattctgtataattccccacattctagactttactgattgtatccccatgatttctctgcctcttgtgtttcctgttaactatagtaactataagttaaatacggaagtttgtgattaaggtgtttttttatttttttttttatttttatttttttttgggagacaagatctttctctgttgcccagggtggagtgcagtggtgccatctcggctcattgaacctctgattgctgggctcaagcaatcctcccacctcatcctcctgagtagctgggactacaggcgtgtaccaccaagcccagccaacatttatattttttgtagagatgggatctcaccatgttgcccatgcttgatttttaataagaatacttcattggtggtatttatagattttgatttatttccaaattgttctttcaagtttcattttatctagtcattttacaggacagcttttatcagttcctggtataaaatccttttagcctcagccttataatatgaatatctatacatacataatacttcatacacacacgatatacatatattcccatgtatatatatgtgtgtgtgtcagccacttacatgtcctgttactcttctatgaatcttaaatttgatattgctgttttgaatctacttcatcccctatgccttctatattctctctgcttgaaatctaccctcactatcttgaatgatgaagcctggtgacaactttttagataattttatgtaagataattatttgctaagtcatccagtgacatactcgggtattgtttgtctccctaccagcagcatctagtaggtacttcaaaatcagagcactttattctgtatttttaattttttctgtctttgcctcttacccaggaatgcaaactcagatgtctatccacagaggcctaaagtgggctgtaacatggtttggcaaactttttctgtaaatagccagatagtaaatatttttagcttttgagtagttttgtgggcaactactcaaccctgtactctgctgttgttgcttgaaagcagccatagacaaaccgtaaacaagtgaggctgactttgttccaatttatcccatttctttgcttttaaaaaaatacctgtgtattcgcttagctggagttggtctacaggctgtagtttgctgaccccaggactagaggtttgttgccatgtgtgaatttgtacttaatctactcagattaaaagaaagaaaagctggaaaatcactgtatttgatgaaatatcccattgtataagtgttcccaaattagcctagaatgttatgaaatattatgagccagtaatgtctataggcttatttctgcctgaaggctactagttttatcttgagaatctcatcctcatttcctggcaaaatgagcacagaataaatgcttgttgaataaataaataaatgaacttcatacattattaatttgtttttgttttctcaaactactaggaaattttgtctgtggctaaaaaaaataaaaaggagaatgaggatgaaaactcctcctctactaatctctgtgtggaagatcttcagaaaaataaagattcgaatagtataattaaagatagattgtctgaaacggttaggcagaatactaaattcttttttgacccagtccggaagtgtaatggtcagccagtaccttttcaacaaccaaagcacttcactggaggagtgatgcgatggtaccaagtagaaggcatggaatggcttagggtaatgaattggaatttttaatacaagatactggttttatttctatagtagcctaatgatttgaggtaccacaacttgagtcatttctatcatgtttcactattatacatttgtatgtggatacttgctttctgatttctttaccctgaatttttagaagtagaaattaccttgttaatggcttccagcacttttatggctttgataaaggactttcctgtgttgttataatttatggtgtgaatatatcagctttaacat

SEQ ID NO: 446390 - DNA, 772 bp, Homo sapiens
ttaaattagtctagaatatgtttataaatttatttacatttggttgaaatgtattcttaaaacttattccacagtttccagtttgaggataaatgaggtctaaagacagtatgaacttgttaataatttttcctattgtcctttttagaaatcttacatatcctttagcctaattatagattggccctgcaagcatgtcactgtatcttttatgtcttcctgagtcttagcactttaaattcttctatatccttcactgtctttcttacagcaccctaaaagagtagcatgtgaactgttgctcttctctaaggtattttaggacatttttaaaataatatatgagtggttgtcatgctaaatactgtctaccacaactcatacaattaaagtggtcaaagaaaggtctctttcatttcttttttcattttaaaaagaaatgttatttgtaaaacagtatagtcataacacagatatggcagttttttagtttttttttttctttttcttcactgtgtcatccaggcagtagcgtgattataattcactgcagcctccaactcctgggcttgagggatcctctcactgagccttctgagcagctgggactgcaaacgtgtgccagtactcctggctaatttttaaatttttttgtagaattgaggtgtatgaaggcttttggtctccctgggagtgggtggaggcagccagggcttacctgtacactgacttgagaccagttgaataaaagtgcacaccttaaaaaaaaaaa

SEQ ID NO: 446391 - DNA, 896 bp, Homo sapiens
agtttagtgttttattttgatgtttcttcagatgccttgggatcatttactgttcctcatatttaagagcaaatgcttaaaaattcttagaaataccttcttgaaaagcctgcattcctaccacctctcaccacttcaacatgaaataatgatcccttacatctttttagtgtagttatataacttttgattggctcaataattacttttattatggctgtgtaagtattattaaagctttagataagccatggaatatgctgtgattttattttcattcttgtgcagctttttttttctccctgaagttaatacttaactgttttttacctaccagtaatttatatctaatcactctggaaatataagcccctcagtatattaaaacagatctcatgattcagtaataaacctccccctccaaatatatcccatcacctctactccctggaacattcttctagtttggactgtagaactgattccatctggaaccttcctttaccatactcctgggtattcctgttggctgtttcatgttttggaattactgtttaatgtgtcttgtgtctcccccccccccctttttttttcctttaagacagagtttcactcttgttgcccaggctggagtgcaatggcttgatctcggctcactgcaacctctgtctcccaggtttaaacgatcctcctgcctcaacctcccatagtagctagaattacaagcgcccaccaccatgcccagctaatttttgtatttttagtagggacagggtttcaccatgttggccacgctggtctcgaactcctgacctcaggtgatccaccctcctcggctccaagtgtggtctgggtgtggcatggccggtggctactttttccctgtacgcactggg

SEQ ID NO: 446392 - DNA, 592 bp, Homo sapiens
ctcaacgctttatacttcccctaatgtaatatttttctgtaatccccactactctggaggctgaagcaggggaatctcttgaacctggcaggcggaggttgagtgagccgagatgtaccagtgcacactatcctgggcgacaagagtgaaactccgtctccaaaaaacaaacaaacgaaatgccaactatgtttaattttgaaatttctcttctaaatggaaaaaaatggacagaagtagagcccttgggaaaaagcagagattatgaacaagttatagtagggaaatacagaaaaatattacatgtaggtaagtataatagtgaaaaattgtggatgtggctcaatggcaggaaacatattttttctcaagttaatcagtgccttttaacgtataatactataaaggtccttaataaaatcaatattctgaatccttgttttgtagggtaaaaattcaattgatgcaagtgaagagaagccagtgatctttgagataacacaggaaaggaattcaaaaatttatcagaggaatttagcaaacagatggaaataatttacaaaatcaaaaatcttgggactaagaaatacat

SEQ ID NO: 446393 - DNA, 4167 bp, Homo sapiens
tcccgcgaaggagaagcgcgcttttttccctggcgggggatttggctagaaggctgggccggcagcggttgtgaggagttagctcgcggcattgcaggctctgagaggaggggacccggttcccgggtgagtgtccaggcatgccagcggaacggcccgcgggcagcggcggctcggaggctccagcaatggttgaacaactggacactgctgtgattaccccggccatgctagaagaggaagaacagcttgaagctgctggactagagagagagcggaagatgctggaaaaggctcgcatgtcttgggatagagagtcgacagaaattcggtaccgtagacttcaacatttgcttgaaaaaagcaatatctactccaaatttttattgacgaaaatggaacagcaacaattagaggaacagaagaagaaagaaaaattggagagaaaaaaggagtctttaaaagttaaaaagggtaaaaattcaattgatgcaagtgaagagaagccagttatgaggaaaaaaagaggaagagaagatgaatcatacaatatttcagaggtcatgtcaaaagaggaatgcaaactcagatgtctatccacagaggcctaaagtgggctgtaacatggtttggcaaactttttctgtaaatagccagatagtaaatatttttagcttttgagtagttttgtgggcaactactcaaccctgtactctgctgttgttgcttgaaagcagccatagacaaaccgtaaacaagtgaggctgactttgttccaatttatcccatttctttgcttttaaaaaaatacctgtgtattcgcttagctggagttggtctacaggctgtagtttgctgaccccaggactagaggtttgttgccatgtgtgaatttgtacttaatctactcagattaaaagaaagaaaagctggaaaatcactgtatttgatgaaatatcccattgtataagtgttcccaaattagcctagaatgttatgaaatattatgagccagtaatgtctataggcttatttctgcctgaaggctactagttttatcttgagaatctcatcctcatttcctggcaaaatgagcacagaataaatgcttgttgaataaataaataaatgaacttcatacattattaatttgtttttgttttctcaaactactaggaaattttgtctgtggctaaaaaaaataaaaaggagaatgaggatgaaaactcctcctctactaatctctgtgtggaagatcttcagaaaaataaagattcgaatagtataattaaagatagattgtctgaaacggttaggcagaatactaaattcttttttgacccagtccggaagtgtaatggtcagccagtaccttttcaacaaccaaagcacttcactggaggagtgatgcgatggtaccaagtagaaggcatggaatggcttaggatgctttgggaaaatggaattaatggcattttagcagatgaaatgggattgggtaagacagttcagtgcattgctactattgcattgatgattcagagaggagtaccaggaccttttcttgtctgtggccctttgtctacacttcctaactggatggctgaattcaaaagatttacaccagatatccctacaatgttatatcatggaacccaggaggaacgtcaaaaattggtaagaaatatttacaaacggaaagggactttgcagattcatcctgtggtaatcacgtcatttgaaatagccatgagagaccgaaatgcgttacagcattgctattggaaatacttaatagtagatgaaggacacaggattaagaatatgaagtgccgtctaatcagggagttaaaacgattcaatgctgataacaaacttcttttgactggtactcccttgcaaaacaatttatcagaactttggtcattgctaaactttttgttgccagatgtatttgatgacttgaaaagctttgagtcttggttgacatcactagtctttctgaaactgctgaagatattatgctaaagaaagagaacagaatgtattgcatatgctgcaccagattttaacacctttcttatgagaagactgaagtctgatgttgctcttgaagttcctcctaaacgagaagtagtcgtttatgctccactttcaaagaagcaggagatcttttatacagccattgtgaaccgtacaattgcaaacatgtttggatccagtgagaaagaaacaattgagttaagtcctactggtcgaccaaaacgacgaactagaaaatcaataaattacagcaaaatagatgatttccctaatgaattggaaaaactgatcagtcaaatacagccagaggtggaccgagaaagagctgttgtggaagtgaatatccctgtagaatctgaagttaatctgaagctgcagaatataatgatgctacttcgtaaatgttgtaatcatccatatttgattgaatatcctatagaccctgttacacaagaatttaagatcgatgaagaattggtaacaaattctgggaagttcttgattttggatcgaatgctgccagaactaaaaaaaagaggtcacaaggtgctgcttttttcacaaatgacaagcatgttggacattttgatggattactgccatctcagagatttcaacttcagcaggcttgatgggtccatgtcttactcagagagagaaaaaaacatgcacagcttcaacacggatccagaggtgtttatcttcttagtgagtacacgagctggtggcctgggcattaatctgactgcagcagatacagttatcatttatgatagtgattggaacccccagtcggatcttcaggcccaggatagatgtcatagaattggtcagacaaagccagttgttgtttatcgccttgttacagcaaatactatcgatcagaaaattgtggaaagagcagctgctaaaaggaaactggaaaagttgatcatccataaaaatcatttcaaaggtggtcagtctggattaaatctgtctaagaatttcttagatcctaaggaattaatggaattattaaaatctagagattatgaaagggaaataaaaggatcaagagagaaggtcattagtgataaagatctagagttgttgttagatcgaagtgatcttattgatcaaatgaatgcttcaggaccaattaaagagaagatggggatattcaagatattagaaaattctgaagattccagtcctgaattggagacggggtttcaccatcttggcctgactggtcccgaactgatctcaggtgatctgcccacctcggcctcccaaagtgctgggattacaagcgtgagccactgcgtggcctgagcactagggcgcaagagaagccgtactggaatattacactactcagcacaagacaggtttaatctttttcttgggggacaagattggaaaattgaggtctgagcagacctgaagagaggcatccagcaactctgagattaaattcatcattgatcaattcgttattgtttggaattgacgtttagctgtgttcctcactcagatacgtgcatgatagctgcttgctaatttggtcttagctcacatttcacctagaatgtatggtctccctctcccctgcaaaatatcccactgttgctaatctgtctgcctcataatttccatgagattgagcatcttgtttgttttgtcaccactatataacagcatgttggaaacaaagcagtaataaagctagaaaaaccaagcgaatacactggattaaaaaaaatactgtttcctagaattaaagaaataaatgaggccgggcgcagtggtgcctgtaatcccagcagtttgggaggctgaggctagtggatcatgtggccgagatcgcgtcactgcactccagtctagcaacagagcgataccttgtttcttacttaaaaaaaaaaaaagacctcatttgttaactgttaaacagaaaacaagaaattccctatacctgtatgcattatagagcaaataagagcatcaaaaacaatcttagaaatctttcagagaaaggtcacctacaaaggaacattgatcagataatagatttttttttttctcagatggagttctgctccagtctagcaacagagcgataccttgtttcttacttaa

SEQ ID NO: 446394 - DNA, 3521 bp, Homo sapiens
tcccgcgaaggagaagcgcgcttttttccctggcgggggatttggctagaaggctgggccggcagcggttgtgaggagttagctcgcggcattgcaggctctgagaggaggggacccggttcccgggctcggaggctccagcaatggttgaacaactggacactgctgtgattaccccggccatgctagaagaggaagaacagcttgaagctgctggactagagagagagcggaagatgctggaaaaggctcgcatgtcttgggatagagagtcgacagaaattcggtaccgtagacttcaacatttgcttgaaaaaagcaatatctactccaaatttttattgacgaaaatggaacagcaacaattagaggaacagaagaagaaagaaaaattggagagaaaaaaggagtctttaaaagttaaaaagggtaaaaattcaattgatgcaagtgaagagaagccagttatgaggaaaaaaagaggaagagaagatgaatcatacaatatttcagaggtcatgtcaaaagaggaaattttgtctgtggctaaaaaaaataaaaaggagaatgaggatgaaaactcctcctctactaatctctgtgtggaagatcttcagaaaaataaagattcgaatagtataattaaagatagattgtctgaaacggttaggcagaatactaaattcttttttgacccagtccggaagtgtaatggtcagccagtaccttttcaacaaccaaagcacttcactggaggagtgatgcgatggtaccaagtagaaggcatggaatggcttaggatgctttgggaaaatggaattaatggcattttagcagatgaaatgggattgggtaagacagttcagtgcattgctactattgcattgatgattcagagaggagtaccaggaccttttcttgtctgtggccctttgtctacacttcctaactggatggctgaattcaaaagatttacaccagatatccctacaatgttatatcatggaacccaggaggaacgtcaaaaattggtaagaaatatttacaaacggaaagggactttgcagattcatcctgtggtaatcacgtcatttgaaatagccatgagagaccgaaatgcgttacagcattgctattggaaatacttaatagtagatgaaggacacaggattaagaatatgaagtgccgtctaatcagggagttaaaacgattcaatgctgataacaaacttcttttgactggtactcccttgcaaaacaatttatcagaactttggtcattgctaaactttttgttgccagatgtatttgatgacttgaaaagctttgagtcttggttgacatcactagtctttctgaaactgctgaagatattatgctaaagaaagagaacagaatgtattgcatatgctgcaccagattttaacacctttcttatgagaagactgaagtctgatgttgctcttgaagttcctcctaaacgagaagtagtcgtttatgctccactttcaaagaagcaggagatcttttatacagccattgtgaaccgtacaattgcaaacatgtttggatccagtgagaaagaaacaattgagttaagtcctactggtcgaccaaaacgacgaactagaaaatcaataaattacagcaaaatagatgatttccctaatgaattggaaaaactgatcagtcaaatacagccagaggtggaccgagaaagagctgttgtggaagtgaatatccctgtagaatctgaagttaatctgaagctgcagaatataatgatgctacttcgtaaatgttgtaatcatccatatttgattgaatatcctatagaccctgttacacaagaatttaagatcgatgaagaattggtaacaaattctgggaagttcttgattttggatcgaatgctgccagaactaaaaaaaagaggtcacaaggtgctgcttttttcacaaatgacaagcatgttggacattttgatggattactgccatctcagagatttcaacttcagcaggcttgatgggtccatgtcttactcagagagagaaaaaaacatgcacagcttcaacacggatccagaggtgtttatcttcttagtgagtacacgagctggtggcctgggcattaatctgactgcagcagatacagttatcatttatgatagtgattggaacccccagtcggatcttcaggcccaggatagatgtcatagaattggtcagacaaagccagttgttgtttatcgccttgttacagcaaatactatcgatcagaaaattgtggaaagagcagctgctaaaaggaaactggaaaagttgatcatccataaaaatcatttcaaaggtggtcagtctggattaaatctgtctaagaatttcttagatcctaaggaattaatggaattattaaaatctagagattatgaaagggaaataaaaggatcaagagagaaggtcattagtgataaagatctagagttgttgttagatcgaagtgatcttattgatcaaatgaatgcttcaggaccaattaaagagaagatggggatattcaagatattagaaaattctgaagattccagtcctgaattggagacggggtttcaccatcttggcctgactggtcccgaactgatctcaggtgatctgcccacctcggcctcccaaagtgctgggattacaagcgtgagccactgcgtggcctgagcactagggcgcaagagaagccgtactggaatattacactactcagcacaagacaggtttaatctttttcttgggggacaagattggaaaattgaggtctgagcagacctgaagagaggcatccagcaactctgagattaaattcatcattgatcaattcgttattgtttggaattgacgtttagctgtgttcctcactcagatacgtgcatgatagctgcttgctaatttggtcttagctcacatttcacctagaatgtatggtctccctctcccctgcaaaatatcccactgttgctaatctgtctgcctcataatttccatgagattgagcatcttgtttgttttgtcaccactatataacagcatgttggaaacaaagcagtaataaagctagaaaaaccaagcgaatacactggattaaaaaaaatactgtttcctagaattaaagaaataaatgaggccgggcgcagtggtgcctgtaatcccagcagtttgggaggctgaggctagtggatcatgtggccgagatcgcgtcactgcactccagtctagcaacagagcgataccttgtttcttacttaaaaaaaaaaaaagacctcatttgttaactgttaaacagaaaacaagaaattccctatacctgtatgcattatagagcaaataagagcatcaaaaacaatcttagaaatctttcagagaaaggtcacctacaaaggaacattgatcagataatagatttttttttttctcagatggagttctgctccagtctagcaacagagcgataccttgtttcttacttaa

SEQ ID NO: 446395 - DNA, 3312 bp, Homo sapiens
ggaaataggaaagtatttaatggtttcaacataaaatcaaaacacataagtcataaatagaataattatgacttgcataattatgaccagtattgtcaggttttatgtgtctgctggtaaaactttggaatatgatttgcagaaatctcagttcaggagtttagcaaagtttatgaatgtgtacagcattaaaaagtatttaaaccaggctagcctcgaactcctgaactcaggtgatctgcctgcctcggcctcacaaagtgctgtgattacagggtgtgagccactgcacctggccgataacagatgttttaatagtaagataaaaagtaaaatttccagtgtgtcgaaggaagaaaattacagcctagaattttatcttcatgtacattatttaagtgtgagggaatagtttcagtgacattatgtcattgaagaccttagaagatttccctcgctaaaggagataaagcgactggcacaacatgtatttctctgagtaattagaagtgttcttttctggctgtactgaagggactttcatgatttcttcgtttttgtactcttagttttataatattgcatagtagctaaggcctggctgtagcagttataaactgttctgcaagtgcgggaagtaatagttattcctatctcaaggatgtggggtttaaatgggttagtgcacaaaaggacatttattaaatttagtcataatcatctcaaggacatggtaagtgaaagagtgtacataaagtacttaatgtaatgtttgctacttaatgttcaataactcaaagagaccaccaccactactacattttacttttattagtaattaataataattaataattagtaattcagtggtaattagtatactaccaaagaaagtacttgagcagaagagccaaaattcaaaccatagaatcattttactgtgcttttattctacctcaaacactaatctccaggccttggataaagggattatttctctgaaggggaaagttatcctcttttgcccaagtcacacttgtgtcatttcttatactgtaaacatgtggttccaattctgaggtattttcccggcttgtaggacccaaaaagaagttaggcttgagaaattttaagtgaagagaacaattctagttcagagtgattggctcttcctaaaagctgacatttgactgaaaattttgaggggagggaaagaaacaataccttttacggcatgtaataggaagaagacctggattttagttgctgctctgatgtcccaacttgggtaaggcaacataacataaatgtcagtttcttcagatttgtgatgaagctgataatccatgctcagcttcctttatgggtctcttgcctatcaaataaggtacagtatgtgaagatacattgcagattatcttatgcattgcttcaggggatgattaaaccatcctttattatagccagagtctagtctaagggaagaaggtcattctctataccagtgaaggctccatccaaaccagtgtttgggggcatagtcataattgaaaaatgattgttttccttatctgtaagacaggtaaatggtattaatcctcaggtggttgtgaggattaagtgatacatgtaaaaaaaagaaagctttggatagtacctattataagaaactcagtgttgctgcaatgtatgtattataatggatttgaaatttgccctaaccaagagtcacagacagaaaaaaggaagttaatgtatctcttgatcactatcaagatgtggtattgaaccttcaagatccttttcagggaatatgtgagatcaaaatttttatactggcactatgatgttatttgccttttcctcatattcacaagtgaacagtggagttttacagaagctatataatgtcatgacatcactgatgggtaatagaatgtgtgcttgtatattccgaaactttcagttccaatttcttcgatcaatgtaatcctcataagtaaaagttatttgaggacctcagacatttttaaaaatgtaaagggggtggggtcaggctcagtggctcatgcctgtaatcccagcattttggaaggccgaggcgaacggatcacttgaggccaggagtttgaaactagtctggtcaacatggtgaaaccccgtctccactaaaacaaaaagttttctggatgtggtggcacacatacctgtaatcccagctactttggtggctgaggcatgagaatcacttgaacccagaagacaggttgcagtgagccaagattgtgcccctgcattctagcctgggtgacagtgagactgtctcaaaaaataaaggtgtacagggattgtatatttgacaacttggtatgtaggatgtgctacctctaatgttccatgctgttacttagttttcactcactactatattttggagatttgttcatattgctctgtgtacatttaattcttcagtgtgtatccaccacatttaacttattcacttacagaactatgcaagaatttctctggtaaatttcactaagtacttatgtacttttcagaacgattgtgagtttacacccctaccagcaggactgagttgagtacccatttcctcacatccttgccagtacttcatttgcctaatttttgccattctcataatgtggcaattgttcaattttgcatttcttccattttatttttttgcatctctgcttttcttttggttagctttgccagttctgcctattatattaatctcccagaatcagcttttagttttgttaaatctctgacatgtttcgttgattcctgctttcatcttaaacatttcttcgttgttaatttgtgtttgctataaaataagcaacatcttaaatgcttgatttgctttcgatgtttattctgtaataagatatttaaagatataattttttccctaaatgctttattagacttttctcataagttttgactggtactgttttcattgttatttaattttgtgttttttaacttctttcatgatttccttttaactgaaggttttcttagatatttagtttgctggtatattcttttaaaattgtatcattgctttctttctatattggattattgtcagagaacatgatttgcatgatattaactttttggagtatattgttgcatctttgtggcctagtacatagttaatttagtgaatgcttccagttgtacttgaaaagaatgtatattttctgattattgagggtaaatttctctatatatgttttcctgtttaataaatatgtagctatgtgctta

SEQ ID NO: 446396 - DNA, 3809 bp, Homo sapiens
tcccgcgaaggagaagcgcgcttttttccctggcgggggatttggctagaaggctgggccggcagcggttgtgaggagttagctcgcggcattgcaggctctgagaggaggggacccggttcccgggtgagtgtccaggcatgccagcggaacggcccgcgggcagcggcggctcggaggctccagcaatggttgaacaactggacactgctgtgattaccccggccatgctagaagaggaagaacagcttgaagctgctggactagagagagagcggaagatgctggaaaaggctcgcatgtcttgggatagagagtcgacagaaattcggtaccgtagacttcaacatttgcttgaaaaaagcaatatctactccaaatttttattgacgaaaatggaacagcaacaattagaggaacagaagaagaaagaaaaattggagagaaaaaaggagtctttaaaagttaaaaagggtaaaaattcaattgatgcaagtgaagagaagccagttatgaggaaaaaaagaggaagagaagatgaatcatacaatatttcagaggtcatgtcaaaagaggaatgcaaactcagatgtctatccacagaggcctaaagtgggctgtaacatggtttggcaaactttttctgtaaatagccagatagtaaatatttttagcttttgagtagttttgtgggcaactactcaaccctgtactctgctgttgttgcttgaaagcagccatagacaaaccgtaaacaagtgaggctgactttgttccaatttatcccatttctttgcttttaaaaaaatacctgtgtattcgcttagctggagttggtctacaggctgtagtttgctgaccccaggactagaggtttgttgccatgtgtgaatttgtacttaatctactcagattaaaagaaagaaaagctggaaaatcactgtatttgatgaaatatcccattgtataagtgttcccaaattagcctagaatgttatgaaatattatgagccagtaatgtctataggcttatttctgcctgaaggctactagttttatcttgagaatctcatcctcatttcctggcaaaatgagcacagaataaatgcttgttgaataaataaataaatgaacttcatacattattaatttgtttttgttttctcaaactactaggaaattttgtctgtggctaaaaaaaataaaaaggagaatgaggatgaaaactcctcctctactaatctctgtgtggaagatcttcagaaaaataaagattcgaatagtataattaaagatagattgtctgaaacggttaggcagaatactaaattcttttttgacccagtccggaagtgtaatggtcagccagtaccttttcaacaaccaaagcacttcactggaggagtgatgcgatggtaccaagtagaaggcatggaatggcttaggatgctttgggaaaatggaattaatggcattttagcagatgaaatgggattgggtaagacagttcagtgcattgctactattgcattgatgattcagagaggagtaccaggaccttttcttgtctgtggccctttgtctacacttcctaactggatggctgaattcaaaagatttacaccagatatccctacaatgttatatcatggaacccaggaggaacgtcaaaaattggtaagaaatatttacaaacggaaagggactttgcagattcatcctgtggtaatcacgtcatttgaaatagccatgagagaccgaaatgcgttacagcattgctattggaaatacttaatagtagatgaaggacacaggattaagaatatgaagtgccgtctaatcagggagttaaaacgattcaatgctgataacaaacttcttttgactggtactcccttgcaaaacaatttatcagaactttggtcattgctaaactttttgttgccagatgtatttgatgacttgaaaagctttgagtcttggttgacatcactagtctttctgaaactgctgaagatattatgctaaagaaagagaacagaatgtattgcatatgctgcaccagattttaacacctttcttatgagaagactgaagtctgatgttgctcttgaagttcctcctaaacgagaagtagtcgtttatgctccactttcaaagaagcaggagatcttttatacagccattgtgaaccgtacaattgcaaacatgtttggatccagtgagaaagaaacaattgagttaagtcctactggtcgaccaaaacgacgaactagaaaatcaataaattacagcaaaatagatgatttccctaatgaattggaaaaactgatcagtcaaatacagccagaggtggaccgagaaagagctgttgtggaagtgaatatccctgtagaatctgaagttaatctgaagctgcagaatataatgatgctacttcgtaaatgttgtaatcatccatatttgattgaatatcctatagaccctgttacacaagaatttaagatcgatgaagaattggtaacaaattctgggaagttcttgattttggatcgaatgctgccagaactaaaaaaaagaggtcacaaggtgctgcttttttcacaaatgacaagcatgttggacattttgatggattactgccatctcagagatttcaacttcagcaggcttgatgggtccatgtcttactcagagagagaaaaaaacatgcacagcttcaacacggatccagaggtgtttatcttcttagtgagtacacgagctggtggcctgggcattaatctgactgcagcagatacagttatcatttatgatagtgattggaacccccagtcggatcttcaggcccaggatagatgtcatagaattggtcagacaaagccagttgttgtttatcgccttgttacagcaaatactatcgatcagaaaattgtggaaagagcagctgctaaaaggaaactggaaaagttgatcatccataaaaatcatttcaaaggtggtcagtctggattaaatctgtctaagaatttcttagatcctaaggaattaatggaattattaaaatctagagattatgaaaggtgagtttttaattttagaaagatttaatttgtagctttgaattattcacatagacttgaatattttgttttctatagggaaataaaaggatcaagagagaaggtcattagtgataaagatctagagttgttgttagatcgaagtgatcttattgatcaaatgaatgcttcaggaccaattaaagagaagatggggatattcaagatattagaaaattctgaagattccagtcctgaatgtttgttttaaagtggagctcaagaatagcttttaaaagttcttatttacatctagtgatttccctgtattgggtttgaaatactgattgtccacttcaccttttttattatatcagttgacatgtaactagtaccatgcgtacttaaatagatggtaattttctgagccttaccaagaacaaagaagtatccatattaagtttagattttcagttaatttttgagactgagtagtattcttggatacaggctgatgtgtacttaaccacttccagatttatacagtcttcctgtggaagtttagtaaatgtctttttccctcctttcttctagtaatgcagttcatgggctttaggtacttcagttatgaagtaggcttttcatggggagagattgggattatgctctctgttgtttaagaaactgtttgattttagagtctatttctatgagatagtttaccaaataaatgttccttataagatg

SEQ ID NO: 446397 - DNA, 4260 bp, Homo sapiens
tcccgcgaaggagaagcgcgcttttttccctggcgggggatttggctagaaggctgggccggcagcggttgtgaggagttagctcgcggcattgcaggctctgagaggaggggacccggttcccgggtgagtgtccaggcatgccagcggaacggcccgcgggcagcggcggctcggaggctccagcaatggttgaacaactggacactgctgtgattaccccggccatgctagaagaggaagaacagcttgaagctgctggactagagagagagcggaagatgctggaaaaggctcgcatgtcttgggatagagagtcgacagaaattcggtaccgtagacttcaacatttgcttgaaaaaagcaatatctactccaaatttttattgacgaaaatggaacagcaacaattagaggaacagaagaagaaagaaaaattggagagaaaaaaggagtctttaaaagttaaaaagggtaaaaattcaattgatgcaagtgaagagaagccagttatgaggaaaaaaagaggaagagaagatgaatcatacaatatttcagaggtcatgtcaaaagaggaatgcaaactcagatgtctatccacagaggcctaaagtgggctgtaacatggtttggcaaactttttctgtaaatagccagatagtaaatatttttagcttttgagtagttttgtgggcaactactcaaccctgtactctgctgttgttgcttgaaagcagccatagacaaaccgtaaacaagtgaggctgactttgttccaatttatcccatttctttgcttttaaaaaaatacctgtgtattcgcttagctggagttggtctacaggctgtagtttgctgaccccaggactagaggtttgttgccatgtgtgaatttgtacttaatctactcagattaaaagaaagaaaagctggaaaatcactgtatttgatgaaatatcccattgtataagtgttcccaaattagcctagaatgttatgaaatattatgagccagtaatgtctataggcttatttctgcctgaaggctactagttttatcttgagaatctcatcctcatttcctggcaaaatgagcacagaataaatgcttgttgaataaataaataaatgaacttcatacattattaatttgtttttgttttctcaaactactaggaaattttgtctgtggctaaaaaaaataaaaaggagaatgaggatgaaaactcctcctctactaatctctgtgtggaagatcttcagaaaaataaagattcgaatagtataattaaagatagattgtctgaaacggttaggcagaatactaaattcttttttgacccagtccggaagtgtaatggtcagccagtaccttttcaacaaccaaagcacttcactggaggagtgatgcgatggtaccaagtagaaggcatggaatggcttaggatgctttgggaaaatggaattaatggcattttagcagatgaaatgggattgggtaagacagttcagtgcattgctactattgcattgatgattcagagaggagtaccaggaccttttcttgtctgtggccctttgtctacacttcctaactggatggctgaattcaaaagatttacaccagatatccctacaatgttatatcatggaacccaggaggaacgtcaaaaattggtaagaaatatttacaaacggaaagggactttgcagattcatcctgtggtaatcacgtcatttgaaatagccatgagagaccgaaatgcgttacagcattgctattggaaatacttaatagtagatgaaggacacaggattaagaatatgaagtgccgtctaatcagggagttaaaacgattcaatgctgataacaaacttcttttgactggtactcccttgcaaaacaatttatcagaactttggtcattgctaaactttttgttgccagatgtatttgatgacttgaaaagctttgagtcttggttgacatcactagtctttctgaaactgctgaagatattatgctaaagaaagagaacagaatgtattgcatatgctgcaccagattttaacacctttcttatgagaagactgaagtctgatgttgctcttgaagttcctcctaaacgagaagtagtcgtttatgctccactttcaaagaagcaggagatcttttatacagccattgtgaaccgtacaattgcaaacatgtttggatccagtgagaaagaaacaattgagttaagtcctactggtcgaccaaaacgacgaactagaaaatcaataaattacagcaaaatagatgatttccctaatgaattggaaaaactgatcagtcaaatacagccagaggtggaccgagaaagagctgttgtggaagtgaatatccctgtagaatctgaagttaatctgaagctgcagaatataatgatgctacttcgtaaatgttgtaatcatccatatttgattgaatatcctatagaccctgttacacaagaatttaagatcgatgaagaattggtaacaaattctgggaagttcttgattttggatcgaatgctgccagaactaaaaaaaagaggtcacaagttcacaaatgacaaggcgccctaagacagaggttgacaaagttctttttttttgagatggagtttcgctcttactgcccaggctggagtgcagtggtgcgatcttggctcattgcaacttccacctcccaggttcaagcgattctcctgcctccatcttccgagtaggtggcattacaggcatgtgccaccacgcccggcgagttttgtatttttagtagagatgaggtttctccatgttggtcaggctagtctcgaactcctgacctcaggtgatccacccaccttggcctcccaaagtgctgggattacaggcatgagccactgcgcccagtatatatccaccactttaccatccacattagcatttcattagcttctctttgcccttttagttaataaccccatctcagggtgattcactttcataatccgtattaccatggattaattctgcatagcaaaaactatgataggtgtgttaagtaatgaagtttggggaatgttaataagatgatttctcttactgtagatgaaatacatcgtaagagaatccctcgtgagaccagatcagttacatgtatatcttgcctctcttaagtctctaccatttattactgtacttgagttaggatttggaagtgccactgaacactaaaattattctgtctgggtatttgaatggtatgagacaaaaatccattttaatgttttatcaagttgagatgtctcacatgagtagttagtgctgagaatcagacacaggcacatttgggagcatggcgtggcaagaagctttgctttttcctgttcctattgtactcaaacttgtttctacatttttcattgatttctcttcgtactagcactagggcgcaagagaagccgtactggaatattacactactcagcacaagacaggtttaatctttttcttgggggacaagattggaaaattgaggtctgagcagacctgaagagaggcatccagcaactctgagattaaattcatcattgatcaattcgttattgtttggaattgacgtttagctgtgttcctcactcagatacgtgcatgatagctgcttgctaatttggtcttagctcacatttcacctagaatgtatggtctccctctcccctgcaaaatatcccactgttgctaatctgtctgcctcataatttccatgagattgagcatcttgtttgttttgtcaccactatataacagcatgttggaaacaaagcagtaataaagctagaaaaaccaagcgaatacactggattaaaaaaaatactgtttcctagaattaaagaaataaatgaggccgggcgcagtggtgcctgtaatcccagcagtttgggaggctgaggctagtggatcatgtggccgagatcgcgtcactgcactccagtctagcaacagagcgataccttgtttcttacttaaaaaaaaaaaaagacctcatttgttaactgttaaacagaaaacaagaaattccctatacctgtatgcattatagagcaaataagagcatcaaaaacaatcttagaaatctttcagagaaaggtcacctacaaaggaacattgatcagataatagatttttttttttctcagatggagttctgctccagtctagcaacagagcgataccttgtttcttacttaa

SEQ ID NO: 446398 - DNA, 2162 bp, Homo sapiens
catggccgggagtggtgaacgacacgttcattccttaggcccctattcaccccagggagggaaagaaacaataccttttacggcatgtaataggaagaagacctggattttagttgctgctctgatgtcccaacttgggtaaggcaacataacataaatgtcagtttcttcagatttgtgatgaagctgataatccatgctcagcttcctttatgggtctcttgcctatcaaataaggtacagtatgtgaagatacattgcagattatcttatgcattgcttcaggggatgattaaaccatcctttattatagccagagtctagtctaagggaagaaggtcattctctataccagtgaaggctccatccaaaccagtgtttgggggcatagtcataattgaaaaatgattgttttccttatctgtaagacaggtaaatggtattaatcctcaggtggttgtgaggattaagtgatacatgtaaaaaaaagaaagctttggatagtacctattataagaaactcagtgttgctgcaatgtatgtattataatggatttgaaatttgccctaaccaagagtcacagacagaaaaaaggaagttaatgtatctcttgatcactatcaagatgtggtattgaaccttcaagatccttttcagggaatatgtgagatcaaaatttttatactggcactatgatgttatttgccttttcctcatattcacaagtgaacagtggagttttacagaagctatataatgtcatgacatcactgatgggtaatagaatgtgtgcttgtatattccgaaactttcagttccaatttcttcgatcaatgtaatcctcataagtaaaagttatttgaggacctcagacatttttaaaaatgtaaagggggtggggtcaggctcagtggctcatgcctgtaatcccagcattttggaaggccgaggcgaacggatcacttgaggccaggagtttgaaactagtctggtcaacatggtgaaaccccgtctccactaaaacaaaaagttttctggatgtggtggcacacatacctgtaatcccagctactttggtggctgaggcatgagaatcacttgaacccagaagacaggttgcagtgagccaagattgtgcccctgcattctagcctgggtgacagtgagactgtctcaaaaaataaaggtgtacagggattgtatatttgacaacttggtatgtaggatgtgctacctctaatgttccatgctgttacttagttttcactcactactatattttggagatttgttcatattgctctgtgtacatttaattcttcagtgtgtatccaccacatttaacttattcacttacagaactatgcaagaatttctctggtaaatttcactaagtacttatgtacttttcagaacgattgtgagtttacacccctaccagcaggactgagttgagtacccatttcctcacatccttgccagtacttcatttgcctaatttttgccattctcataatgtggcaattgttcaattttgcatttcttccattttatttttttgcatctctgcttttcttttggttagctttgccagttctgcctattatattaatctcccagaatcagcttttagttttgttaaatctctgacatgtttcgttgattcctgctttcatcttaaacatttcttcgttgttaatttgtgtttgctataaaataagcaacatcttaaatgcttgatttgctttcgatgtttattctgtaataagatatttaaagatataattttttccctaaatgctttattagacttttctcataagttttgactggtactgttttcattgttatttaattttgtgttttttaacttctttcatgatttccttttaactgaaggttttcttagatatttagtttgctggtatattcttttaaaattgtatcattgctttctttctatattggattattgtcagagaacatgatttgcatgatattaactttttggagtatattgttgcatctttgtggcctagtacatagttaatttagtgaatgcttccagttgtacttgaaaagaatgtatattttctgattattgagggtaaatttctctatatatgttttcctgtttaataaatatgtagctatgtgctta

SEQ ID NO: 446399 - DNA, 3781 bp, Homo sapiens
aatgtctctccataccgtgaaccctgcgtagctgggaccgcagacgcacaccaccaagctcagctaaatttttttgatgttttttgtagacacagggtctcaccacgttgcccaggctggtcttgaactcctgaacccgagagatcctcctgcctcaacctcccatagtagctagaattacaagcgcccaccaccatgcccagctaatttttgtatttttagtagggacagggtttcaccatgttggccacgctggtctcgaactcctgacctcaggtgatccaccctcctcggcctcccaaagtgttggtactacaggtgtgagccactgcgcctggctggatctaactttttttcctccttggtttactcgctcactttgatggattatgttgtcttgtgttttcccaagaaaagaattcaagggaaatgaattttttgagaactcgcatatctggctgtatttttgttggattcttatatttgatggatagttctggtttgggattttagagtaggaattattatcttctcagaatttcgaaagttgttgtgttgtctcagaacttccagtgttgtgggagagaaaattaatggttcctttttttttttgagacagggtctcattctgtcacctaggcatgaatacagctcactgcagccttgacctcccgggctcaagtgatcctcctgcctcagccaccaatttagtttggaccacagccatgcaccaaatgccctgctaaatttttaattttttgtggagacagggtctcaccatgttgcccaggctggtcctgaactcctgggctccagcaattccccccggcttggcctcccaaagggctgggattacaggtgtgagctcctgcacctggcccgaatgctgctttgatttccagtctgttgaaggtggggggaaccagccttttgttaatgtgagcttccagtgtttctttgtcttttgtattctaaattaataacacagtgatgtgtcttggtatgggtcttttttttttttctttttttttttcatttttaaagagactcctgctatgttgcacagacttgtgaattcctggtttcaagttatctttccccctatgtcactcaagtaatgtggactacactcatgtgacaccatgcccatctttatgttgtgtatcttatttttgttttgttttactcttgaatcagctcagtctgaaaatctgtcttttaattcatggggattttttagaatgatttcttggagggttttgtcttttgaatgtgtggtcccttctctgcctagaatttttttgtttgaatgagacatggtcttgctgttgtccaggttggagagcagtggtgcaactatagctcactacattcttgaatttctgggctcaagccatcttcccatctcagctttcagaatatcttggctacaggcatgtgacactatgcccagataatttaaaaaaaaaaaaaaaatttcttgagacagggtcttgctatgttgcccaggctcgtcttgaattcctgttctcagagggtcctcctatgtttgcttcccaaagcattggtattatatgtatgagccaccaccactagcacttctgcctagaactcgtaacaaaatttctttcccccatctgcatagtcttgtttcattaaatgattcttccctttttaaagtttagtctgtcttttattttgatgcttcttcaaatgccttgggatcatttactgttcctcaaatttaagagctagaagaaatctctctaagctccatgcatgagggttctcaacaggtggattttactccagtgtgatttcactagaccatttatttgagggtcacccaattgtcagtatatgtatatgagagagaatatgtacatatatatctgagagaaattctctaatcacttgtcctgtgtgagtatatgtactttgccagttttcttttggggtgaggtggagggacagtgtattagagattttactgttcaaaatgtagacttcctcagttttcagtaaaatactctaccctgtctatatgtggattcccctattccagactgattcacccttttcagtgagttagtcgtgacatttcttacactgtgagggggagtggtaattactttacagggaggtatggggccatggtgtttgactcttctttcaaccacttctgggttttttagtgaaaacctctatctaacactgatactttcatttctgttgtctattgagtcagttaacactgatccatttatttttcagttcccaaaatcttgctttgccattgcttctattttattgtctgggggtgtttaacacctgtttcattttttacagtcatttagtttccagattttagtaagggacagaggggaatagatggactcatttcatgatgtagaaacaaatactccctgtcttgtcttacatgaaaaattattcttaaactaggccttgtctttgagaacctgatcaaagtataaaaaatactttttggctttatttctttagtgagtcactattccatattttgaaggtgttaagaggtatggtaaaggtggtacttgaacatttccaagcaaacgtgtgatgaaatctttcatcaatgtcttagcaatggtatatgatttttttagtcttagcaattttagataagttttttttttgtcttgtttttttgagacggagtcttgctctgtcgcctaggctacagtgtagtggcgtgatctcggctcactgcagcctctgcctccgagcggggtccagcgattctcctgcatcagcctcctgggtagttgggattacaggtgcatgccaccacacccaactgatttttgtatttttagtggagacggggtttcaccatcttggcctgactggtcccgaactgatctcaggtgatctgcccacctcggcctcccaaagtgctgggattacaagcgtgagccactgcgtggcctgagcactagggcgcaagagaagccgtactggaatattacactactcagcacaagacaggtttaatctttttcttgggggacaagattggaaaattgaggtctgagcagacctgaagagaggcatccagcaactctgagattaaattcatcattgatcaattcgttattgtttggaattgacgtttagctgtgttcctcactcagatacgtgcatgatagctgcttgctaatttggtcttagctcacatttcacctagaatgtatggtctccctctcccctgcaaaatatcccactgttgctaatctgtctgcctcataatttccatgagattgagcatcttgtttgttttgtcaccactatataacagcatgttggaaacaaagcagtaataaagctagaaaaaccaagcgaatacactggattaaaaaaaatactgtttcctagaattaaagaaataaatgaggccgggcgcagtggtgcctgtaatcccagcagtttgggaggctgaggctagtggatcatgtggccgagatcgcgtcactgcactccagtctagcaacagagcgataccttgtttcttacttaaaaaaaaaaaaagacctcatttgttaactgttaaacagaaaacaagaaattccctatacctgtatgcattatagagcaaataagagcatcaaaaacaatcttagaaatctttcagagaaaggtcacctacaaaggaacattgatcagataatagatttttttttttctcagatggagttctgctccagtctagcaacagagcgataccttgtttcttacttaa

SEQ ID NO: 446400 - DNA, 4300 bp, Homo sapiens
ggaaataggaaagtatttaatggtttcaacataaaatcaaaacacataagtcataaatagaataattatgacttgcataattatgaccagtattgtcaggttttatgtgtctgctggtaaaactttggaatatgatttgcagaaatctcagttcaggagtttagcaaagtttatgaatgtgtacagcattaaaaagtatttaaaccaggctagcctcgaactcctgaactcaggtgatctgcctgcctcggcctcacaaagtgctgtgattacagggtgtgagccactgcacctggccgataacagatgttttaatagtaagataaaaagtaaaatttccagtgtgtcgaaggaagaaaattacagcctagaattttatcttcatgtacattatttaagtgtgagggaatagtttcagtgacattatgtcattgaagaccttagaagatttccctcgctaaaggagataaagcgactggcacaacatgtatttctctgagtaattagaagtgttcttttctggctgtactgaagggactttcatgatttcttcgtttttgtactcttagttttataatattgcatagtagctaaggcctggctgtagcagttataaactgttctgcaagtgcgggaagtaatagttattcctatctcaaggatgtggggtttaaatgggttagtgcacaaaaggacatttattaaatttagtcataatcatctcaaggacatggtaagtgaaagagtgtacataaagtacttaatgtaatgtttgctacttaatgttcaataactcaaagagaccaccaccactactacattttacttttattagtaattaataataattaataattagtaattcagtggtaattagtatactaccaaagaaagtacttgagcagaagagccaaaattcaaaccatagaatcattttactgtgcttttattctacctcaaacactaatctccaggccttggataaagggattatttctctgaaggggaaagttatcctcttttgcccaagtcacacttgtgtcatttcttatactgtaaacatgtggttccaattctgaggtattttcccggcttgtaggacccaaaaagaagttaggcttgagaaattttaagtgaagagaacaattctagttcagagtgattggctcttcctaaaagctgacatttgactgaaaattttgaggggagggaaagaaacaataccttttacggcatgtaataggaagaagacctggattttagttgctgctctgatgtcccaacttgggtaaggcaacataacataaatgtcagtttcttcagatttgtgatgaagctgataatccatgctcagcttcctttatgggtctcttgcctatcaaataaggtacagtatgtgaagatacattgcagattatcttatgcattgcttcaggggatgattaaaccatcctttattatagccagagtctagtctaagggaagaaggtcattctctataccagtgaaggctccatccaaaccagtgtttgggggcatagtcataattgaaaaatgattgttttccttatctgtaagacaggtaaatggtattaatcctcaggtggttgtgaggattaagtgatacatgtaaaaaaaagaaagctttggatagtacctattataagaaactcagtgttgctgcaatgtatgtattataatggatttgaaatttgccctaaccaagagtcacagacagaaaaaaggaagttaatgtatctcttgatcactatcaagatgtggtattgaaccttcaagatccttttcagggaatatgtgagatcaaaatttttatactggcactatgatgttatttgccttttcctcatattcacaagtgaacagtggagttttacagaagctatataatgtcatgacatcactgatgggtaatagaatgtgtgcttgtatattccgaaactttcagttccaatttcttcgatcaatgtaatcctcataagtaaaagttatttgaggacctcagacatttttaaaaatgtaaagggggtggggtcaggctcagtggctcatgcctgtaatcccagcattttggaaggccgaggcgaacggatcacttgaggccaggagtttgaaactagtctggtcaacatggtgaaaccccgtctccactaaaacaaaaagttttctggatgtggtggcacacatacctgtaatcccagctactttggtggctgaggcatgagaatcacttgaacccagaagacaggttgcagtgagccaagattgtgcccctgcattctagcctgggtgacagtgagactgtctcaaaaaataaaggtgtacagggattgtatatttgacaacttggtatgtaggatgtgctacctctaatgttccatgctgttacttagttttcactcactactatattttggagatttgttcatattgctctgtgtacatttaattcttcagtgtgtatccaccacatttaacttattcacttacagaactatgcaagaatttctctggtaaatttcactaagtacttatgtacttttcagaacgattgtgagtttacacccctaccagcaggactgagttgagtacccatttcctcacatccttgccagtacttcatttgcctaatttttgccattctcataatgtggcaattgttcaattttgcatttcttccattttatttttttgcatctctgcttttcttttggttagctttgccagttctgcctattatattaatctcccagaatcagcttttagttttgttaaatctctgacatgtttcgttgattcctgctttcatcttaaacatttcttcgttgttaatttgtgtttgctataaaataagcaacatcttaaatgcttgatttgctttcgatgtttattctgtaataagatatttaaagatataattttttccctaaatgctttattagacttttctcataagttttgactggtactgttttcattgttatttaattttgtgttttttaacttctttcatgatttccttttaactgaaggttttcttagatatttagtttgctggtatattcttttaaaattgtatcattgctttctttctatattggattattgtcagagaacatgatttgcatgatattaactttttggagtatattgttgcatctttgtggcctagtacatagttaatttagtgaatgcttccagttgtacttgaaaagaatgtatattttctgattattgagggtaaatttctctatatatgttttcctgtttaataaatatgtagctatgtgcttaaaaaaaaaaaaaaaaaaaaaaaaaaaaaaaaaaaaaaaaaaaaaaaaaaaaaaaaaaaaacaagccacacacaaagagacacaacgctacacccacaaaaaacaccaacagggacgaccacagacgcacccgccataacctaccgccagatctttgccacccccatgggccgcgccacatctcagcaccgaccaccaaagaccaaggcgacagtcgctcacacagacgcaacgtaacaccgaaggaatggccgagagagacaaccactgagcacacgcggaggacaacacaccacgagagagacgcgacccaagccggtaccggagacatcacacacaagacccgacgacccaactcaaccacatcaaggtcataaagacggaagaccaaacagcgaaagcaacacacaacgagactacagacgcccagacacagacctcagcaaaaccacaacgcccaagcaacacagggcagcgtccgcaggagaaaaacccagcctcgacacagacgacgccagcctcgcatcacaccaaccgcccaacaaccgaccagcaccgacgcccacaaaccacccaacccaacgagcagaccgacaaagagccaacccacacatcgaaacaaaggggcgcagcggacgacgacgaagacaacagacgagcacacgaagagggggacgagaaggaagcagaaaaggcgagcagagcgacgcagactaacaagcgaaaggacacgaagacacgagaaccgaacgcgagcccgggagacagactagggcagcagaccggagcaaacgacaccgagacacagcagggacgaacggacagacgcaccgagcgaggcgacggcgcagccacggcacaccgcagagcgccaccgcaccgaccgagacgagccaagccgagagcaacccctagatgctccgaggcacgacgcaccacacagcgcaaggcccaaggcagaagacgcccacgagacgacgcgaccgcgc

SEQ ID NO: 446401 - DNA, 4323 bp, Homo sapiens
agtttagtgttttattttgatgtttcttcagatgccttgggatcatttactgttcctcatatttaagagcaaatgcttaaaaattcttagaaataccttcttgaaaagcctgcattcctaccacctctcaccacttcaacatgaaataatgatcccttacatctttttagtgtagttatataacttttgattggctcaataattacttttattatggctgtgtaagtattattaaagctttagataagccatggaatatgctgtgattttattttcattcttgtgcagctttttttttctccctgaagttaatacttaactgttttttacctaccagtaatttatatctaatcactctggaaatataagcccctcagtatattaaaacagatctcatgattcagtaataaacctccccctccaaatatatcccatcacctctactccctggaacattcttctagtttggactgtagaactgattccatctggaaccttcctttaccatactcctgggtattcctgttggctgtttcatgttttggaattactgtttaatgtgtcttgtgtctcccccccccccctttttttttcctttaagacagagtttcactcttgttgcccaggctggagtgcaatggcttgatctcggctcactgcaacctctgtctcccaggtttaaacgatcctcctgcctcaacctcccatagtagctagaattacaagcgcccaccaccatgcccagctaatttttgtatttttagtagggacagggtttcaccatgttggccacgctggtctcgaactcctgacctcaggtgatccaccctcctcggcctcccaaagtgttggtactacaggtgtgagccactgcgcctggctggatctaactttttttcctccttggtttactcgctcactttgatggattatgttgtcttgtgttttcccaagaaaagaattcaagggaaatgaattttttgagaactcgcatatctggctgtatttttgttggattcttatatttgatggatagttctggtttgggattttagagtaggaattattatcttctcagaatttcgaaagttgttgtgttgtctcagaacttccagtgttgtgggagagaaaattaatggttcctttttttttttgagacagggtctcattctgtcacctaggcatgaatacagctcactgcagccttgacctcccgggctcaagtgatcctcctgcctcagccaccaatttagtttggaccacagccatgcaccaaatgccctgctaaatttttaattttttgtggagacagggtctcaccatgttgcccaggctggtcctgaactcctgggctccagcaattccccccggcttggcctcccaaagggctgggattacaggtgtgagctcctgcacctggcccgaatgctgctttgatttccagtctgttgaaggtggggggaaccagccttttgttaatgtgagcttccagtgtttctttgtcttttgtattctaaattaataacacagtgatgtgtcttggtatgggtcttttttttttttctttttttttttcatttttaaagagactcctgctatgttgcacagacttgtgaattcctggtttcaagttatctttccccctatgtcactcaagtaatgtggactacactcatgtgacaccatgcccatctttatgttgtgtatcttatttttgttttgttttactcttgaatcagctcagtctgaaaatctgtcttttaattcatggggattttttagaatgatttcttggagggttttgtcttttgaatgtgtggtcccttctctgcctagaatttttttgtttgaatgagacatggtcttgctgttgtccaggttggagagcagtggtgcaactatagctcactacattcttgaatttctgggctcaagccatcttcccatctcagctttcagaatatcttggctacaggcatgtgacactatgcccagataatttaaaaaaaaaaaaaaaatttcttgagacagggtcttgctatgttgcccaggctcgtcttgaattcctgttctcagagggtcctcctatgtttgcttcccaaagcattggtattatatgtatgagccaccaccactagcacttctgcctagaactcgtaacaaaatttctttcccccatctgcatagtcttgtttcattaaatgattcttccctttttaaagtttagtctgtcttttattttgatgcttcttcaaatgccttgggatcatttactgttcctcaaatttaagagctagaagaaatctctctaagctccatgcatgagggttctcaacaggtggattttactccagtgtgatttcactagaccatttatttgagggtcacccaattgtcagtatatgtatatgagagagaatatgtacatatatatctgagagaaattctctaatcacttgtcctgtgtgagtatatgtactttgccagttttcttttggggtgaggtggagggacagtgtattagagattttactgttcaaaatgtagacttcctcagttttcagtaaaatactctaccctgtctatatgtggattcccctattccagactgattcacccttttcagtgagttagtcgtgacatttcttacactgtgagggggagtggtaattactttacagggaggtatggggccatggtgtttgactcttctttcaaccacttctgggttttttagtgaaaacctctatctaacactgatactttcatttctgttgtctattgagtcagttaacactgatccatttatttttcagttcccaaaatcttgctttgccattgcttctattttattgtctgggggtgtttaacacctgtttcattttttacagtcatttagtttccagattttagtaagggacagaggggaatagatggactcatttcatgatgtagaaacaaatactccctgtcttgtcttacatgaaaaattattcttaaactaggccttgtctttgagaacctgatcaaagtataaaaaatactttttggctttatttctttagtgagtcactattccatattttgaaggtgttaagaggtatggtaaaggtggtacttgaacatttccaagcaaacgtgtgatgaaatctttcatcaatgtcttagcaatggtatatgatttttttagtcttagcaattttagataagttttttttttgtcttgtttttttgagacggagtcttgctctgtcgcctaggctacagtgtagtggcgtgatctcggctcactgcagcctctgcctccgagcggggtccagcgattctcctgcatcagcctcctgggtagttgggattacaggtgcatgccaccacacccaactgatttttgtatttttagtggagacggggtttcaccatcttggcctgactggtcccgaactgatctcaggtgatctgcccacctcggcctcccaaagtgctgggattacaagcgtgagccactgcgtggcctgagcactagggcgcaagagaagccgtactggaatattacactactcagcacaagacaggtttaatctttttcttgggggacaagattggaaaattgaggtctgagcagacctgaagagaggcatccagcaactctgagattaaattcatcattgatcaattcgttattgtttggaattgacgtttagctgtgttcctcactcagatacgtgcatgatagctgcttgctaatttggtcttagctcacatttcacctagaatgtatggtctccctctcccctgcaaaatatcccactgttgctaatctgtctgcctcataatttccatgagattgagcatcttgtttgttttgtcaccactatataacagcatgttggaaacaaagcagtaataaagctagaaaaaccaagcgaatacactggattaaaaaaaatactgtttcctagaattaaagaaataaatgaggccgggcgcagtggtgcctgtaatcccagcagtttgggaggctgaggctagtggatcatgtggccgagatcgcgtcactgcactccagtctagcaacagagcgataccttgtttcttacttaaaaaaaaaaaaagacctcatttgttaactgttaaacagaaaacaagaaattccctatacctgtatgcattatagagcaaataagagcatcaaaaacaatcttagaaatctttcagagaaaggtcacctacaaaggaacattgatcagataatagatttttttttttctcagatggagttctgctccagtctagcaacagagcgataccttgtttcttacttaa

SEQ ID NO: 446402 - DNA, 1446 bp, Homo sapiens
ctacgtaatatgtaactcatttttttaattttatttctacctgaacagtcctatgcagaatctgttccctcaattgaaaatgttacaggcatgagccactgcgcccagtatatatccaccactttaccatccacattagcatttcattagcttctctttgcccttttagttaataaccccatctcagggtgattcactttcataatccgtattaccatggattaattctgcatagcaaaaactatgataggtgtgttaagtaatgaagtttggggaatgttaataagatgatttctcttactgtagatgaaatacatcgtaagagaatccctcgtgagaccagatcagttacatgtatatcttgcctctcttaagtctctaccatttattactgtacttgagttaggatttggaagtgccactgaacactaaaattattctgtctgggtatttgaatggtatgagacaaaaatccattttaatgttttatcaagttgagatgtctcacatgagtagttagtgctgagaatcagacacaggcacatttgggagcatggcgtggcaagaagctttgctttttcctgttcctattgtactcaaacttgtttctacatttttcattgatttctcttcgtactagcactagggcgcaagagaagccgtactggaatattacactactcagcacaagacaggtttaatctttttcttgggggacaagattggaaaattgaggtctgagcagacctgaagagaggcatccagcaactctgagattaaattcatcattgatcaattcgttattgtttggaattgacgtttagctgtgttcctcactcagatacgtgcatgatagctgcttgctaatttggtcttagctcacatttcacctagaatgtatggtctccctctcccctgcaaaatatcccactgttgctaatctgtctgcctcataatttccatgagattgagcatcttgtttgttttgtcaccactatataacagcatgttggaaacaaagcagtaataaagctagaaaaaccaagcgaatacactggattaaaaaaaatactgtttcctagaattaaagaaataaatgaggccgggcgcagtggtgcctgtaatcccagcagtttgggaggctgaggctagtggatcatgtggccgagatcgcgtcactgcactccagtctagcaacagagcgataccttgtttcttacttaaaaaaaaaaaaagacctcatttgttaactgttaaacagaaaacaagaaattccctatacctgtatgcattatagagcaaataagagcatcaaaaacaatcttagaaatctttcagagaaaggtcacctacaaaggaacattgatcagataatagatttttttttttctcagatggagttctgctccagtctagcaacagagcgataccttgtttcttacttaa

SEQ ID NO: 446403 - DNA, 1431 bp, Homo sapiens
cctggcttgctcaggtctgtaatcccagcacttagtccgaggcagatgatcagttgaggtgaggagtttacaggcatgagccactgcgcccagtatatatccaccactttaccatccacattagcatttcattagcttctctttgcccttttagttaataaccccatctcagggtgattcactttcataatccgtattaccatggattaattctgcatagcaaaaactatgataggtgtgttaagtaatgaagtttggggaatgttaataagatgatttctcttactgtagatgaaatacatcgtaagagaatccctcgtgagaccagatcagttacatgtatatcttgcctctcttaagtctctaccatttattactgtacttgagttaggatttggaagtgccactgaacactaaaattattctgtctgggtatttgaatggtatgagacaaaaatccattttaatgttttatcaagttgagatgtctcacatgagtagttagtgctgagaatcagacacaggcacatttgggagcatggcgtggcaagaagctttgctttttcctgttcctattgtactcaaacttgtttctacatttttcattgatttctcttcgtactagcactagggcgcaagagaagccgtactggaatattacactactcagcacaagacaggtttaatctttttcttgggggacaagattggaaaattgaggtctgagcagacctgaagagaggcatccagcaactctgagattaaattcatcattgatcaattcgttattgtttggaattgacgtttagctgtgttcctcactcagatacgtgcatgatagctgcttgctaatttggtcttagctcacatttcacctagaatgtatggtctccctctcccctgcaaaatatcccactgttgctaatctgtctgcctcataatttccatgagattgagcatcttgtttgttttgtcaccactatataacagcatgttggaaacaaagcagtaataaagctagaaaaaccaagcgaatacactggattaaaaaaaatactgtttcctagaattaaagaaataaatgaggccgggcgcagtggtgcctgtaatcccagcagtttgggaggctgaggctagtggatcatgtggccgagatcgcgtcactgcactccagtctagcaacagagcgataccttgtttcttacttaaaaaaaaaaaaagacctcatttgttaactgttaaacagaaaacaagaaattccctatacctgtatgcattatagagcaaataagagcatcaaaaacaatcttagaaatctttcagagaaaggtcacctacaaaggaacattgatcagataatagatttttttttttctcagatggagttctgctccagtctagcaacagagcgataccttgtttcttacttaa

SEQ ID NO: 446404 - DNA, 2843 bp, Homo sapiens
tcccgcgaaggagaagcgcgcttttttccctggcgggggatttggctagaaggctgggccggcagcggttgtgaggagttagctcgcggcattgcaggctctgagaggaggggacccggttcccgggtgagtgtccaggcatgccagcggaacggcccgcgggcagcggcggctcggaggctccagcaatggttgaacaactggacactgctgtgattaccccggccatgctagaagaggaagaacagcttgaagctgctggactagagagagagcggaagatgctggaaaaggctcgcatgtcttgggatagagagtcgacagaaattcggtaccgtagacttcaacatttgcttgaaaaaagcaatatctactccaaatttttattgacgaaaatggaacagcaacaattagaggaacagaagaagaaagaaaaattggagagaaaaaaggagtctttaaaagttaaaaagggtaaaaattcaattgatgcaagtgaagagaagccagttatgaggaaaaaaagaggaagagaagatgaatcatacaatatttcagaggtcatgtcaaaagaggaatgcaaactcagatgtctatccacagaggcctaaagtgggctgtaacatggtttggcaaactttttctgtaaatagccagatagtaaatatttttagcttttgagtagttttgtgggcaactactcaaccctgtactctgctgttgttgcttgaaagcagccatagacaaaccgtaaacaagtgaggctgactttgttccaatttatcccatttctttgcttttaaaaaaatacctgtgtattcgcttagctggagttggtctacaggctgtagtttgctgaccccaggactagaggtttgttgccatgtgtgaatttgtacttaatctactcagattaaaagaaagaaaagctggaaaatcactgtatttgatgaaatatcccattgtataagtgttcccaaattagcctagaatgttatgaaatattatgagccagtaatgtctataggcttatttctgcctgaaggctactagttttatcttgagaatctcatcctcatttcctggcaaaatgagcacagaataaatgcttgttgaataaataaataaatgaacttcatacattattaatttgtttttgttttctcaaactactaggaaattttgtctgtggctaaaaaaaataaaaaggagaatgaggatgaaaactcctcctctactaatctctgtgtggaagatcttcagaaaaataaagattcgaatagtataattaaagatagattgtctgaaacggttaggcagaatactaaattcttttttgacccagtccggaagtgtaatggtcagccagtaccttttcaacaaccaaagcacttcactggaggagtgatgcgatggtaccaagtagaaggcatggaatggcttaggatgctttgggaaaatggaattaatggcattttagcagatgaaatgggattgggtaagacagttcagtgcattgctactattgcattgatgattcagagaggagtaccaggaccttttcttgtctgtggccctttgtctacacttcctaactggatggctgaattcaaaagatttacaccagatatccctacaatgttatatcatggaacccaggaggaacgtcaaaaattggtaagaaatatttacaaacggaaagggactttgcagattcatcctgtggtaatcacgtcatttgaaatagccatgagagaccgaaatgcgttacagcattgctattggaaatacttaatagtagatgaaggacacaggattaagaatatgaagtgccgtctaatcagggagttaaaacgattcaatgctgataacaaacttcttttgactggtactcccttgcaaaacaatttatcagaactttggtcattgctaaactttttgttgccagatgtatttgatgacttgaaaagctttgagtcttggttgacatcactagtctttctgaaactgctgaagatattatgctaaagaaagagaacagaatgtattgcatatgctgcaccagattttaacacctttcttatgagaagactgaagtctgatgttgctcttgaagttcctcctaaacgagaagtagtcgtttatgctccactttcaaagaagcaggagatcttttatacagccattgtgaaccgtacaattgcaaacatgtttggatccagtgagaaagaaacaattgagttaagtcctactggtcgaccaaaacgacgaactagaaaatcaataaattacagcaaaatagatgatttccctaatgaattggaaaaactgatcagtcaaatacagccagaggtggaccgagaaagagctgttgtggaagtgaatatccctgtagaatctgaagttaatctgaagctgcagaatataatgatgctacttcgtaaatgttgtaatcatccatatttgattgaatatcctatagaccctgttacacaagaatttaagatcgatgaagaattggtaacaaattctgggaagttcttgattttggatcgaatgctgccagaactaaaaaaaagaggtcacaaggtacttttgattggaattttggattgttcaattatttttttatcaatcattagaaatattaagatatgtttaatttcaggtgctgcttttttcacaaatgacaagcatgttggacattttgatggattactgccatctcagagatttcaacttcagcaggcttgatgggtccatgtcttactcagagagagaaaaaaactgcactccagcctgggtgacagagcgagactctgtctcttaaaaaaaaaaaaaaa

SEQ ID NO: 446405 - DNA, 1180 bp, Homo sapiens
ttaaattagtctagaatatgtttataaatttatttacatttggttgaaatgtattcttaaaacttattccacagtttccagtttgaggataaatgaggtctaaagacagtatgaacttgttaataatttttcctattgtcctttttagaaatcttacatatcctttagcctaattatagattggccctgcaagcatgtcactgtatcttttatgtcttcctgagtcttagcactttaaattcttctatatccttcactgtctttcttacagcaccctaaaagagtagcatgtgaactgttgctcttctctaaggtattttaggacatttttaaaataatatatgagtggttgtcatgctaaatactgtctaccacaactcatacaattaaagtggtcaaagaaaggtctctttcatttcttttttcattttaaaaagaaatgttatttgtaaaacagtatagtcataacacagatatggcagttttttagtttttttttttctttttcttcactgtgtcatccaggcagtagcgtgattataattcactgcagcctccaactcctgggcttgagggatcctctcactgagccttctgagcagctgggactgcaaacgtgtgccagtactcctggctaatttttaaatttttttgtagaattgaggtgtttttttaaatttttttaaagccttgtttgcaaactgttgcaacttctggcggctgcaacttctggcctcaagcaatcttcctgtcttggcctcccaatagcataagctaccgcacccagcccacaattttctttcagtacaatataaacatcttgcaagcgctagcttgatttacactttttgcctgtaatcccagcagtttgggaggctgaggctagtggatcatgtggccgagatcgcgtcactgcactccagtctagcaacagagcgataccttgtttcttacttaaaaaaaaaaaaagacctcatttgttaactgttaaacagaaaacaagaaattccctatacctgtatgcattatagagcaaataagagcatcaaaaacaatcttagaaatctttcagagaaaggtcacctacaaaggaacattgatcagataatagatttttttttttctcagatggagttctgctccagtctagcaacagagcgataccttgtttcttacttaa

SEQ ID NO: 446406 - DNA, 410 bp, Homo sapiens
agaaatctttcagagaaaggtcacctacaaaggaacattgatcagataatagatttttttttttctcagatggagttctgctcttgtcgcccagactggagtgcaatggcacgatgttggctcactgcaatctccgcttcccaggttcaagcagttctccagccttagcctcccaagtagctgggattacaggctcccactaccattcccagaatttttgtattttaattagtagagacggggtttcgccatgttggccaggctagcctcgaactcctgaactcaggtgatctgcctgcctcggcctcacaaagtgctgtgattacagggtgtgagccactgcacctggccgataacagatgttttaatagtaagataaaaagtaaaatttccagtgtgtcgaaggaaga

SEQ ID NO: 446407 - DNA, 429 bp, Homo sapiens
acacataagtcataaatagaataattatgacttgcataattatgaccagtattgtcaggttttatgtgtctgctggtaaaactttggaatatgatttgcagaaatctcagttcaggagtttagcaaagtttatgaatgtgtacagcattaaaaagtatttaaaccaggccgggcatgaaggcttatgccagtaattccagcacttgggagtctgaggtgggcagatcccttgaggccaggagttccagaccagcctggccaacatgacgaaaccctgtctccactaaaaatacaaaaattaggccggacgcggtggctcacgcctgtaatcccagcactttgggaggccgaggcgggtggatcatgaggtcaggatatcgagaccatcctggctaacaaggtgaaaccccgtctctactaaaaattaca

SEQ ID NO: 446408 - DNA, 447 bp, Homo sapiens
atttgactgaaaattttgaggggagggaaagaaacaataccttttacggcatgtaataggaagaagacctggattttagttgctgctctgatgtcccaacttgggtaaggcaacataacataaatgtcagtttcttcagatttgtgatgaagctgataatccatgctcagcttcctttatgggtctcttgcctatcaaataaggtacagtatgtgaagatacattgcagattatcttatgcattgcttcaggggatgattaaaccatcctttattatagccagagtctagtctaagggaagaaggtcattctctataccagtgaaggctccatccaaaccagtgtttgggggcatagtcataattgaaaaatgattgttttccttatctgtaagacaggtaaatggtattaatcctcaggtggttgtgaggattaagtgatacatgt

SEQ ID NO: 446409 - DNA, 4122 bp, Homo sapiens
tcccgcgaaggagaagcgcgcttttttccctggcgggggatttggctagaaggctgggccggcagcggttgtgaggagttagctcgcggcattgcaggctctgagaggaggggacccggttcccgggctcggaggctccagcaatggttgaacaactggacactgctgtgattaccccggccatgctagaagaggaagaacagcttgaagctgctggactagagagagagcggaagatgctggaaaaggctcgcatgtcttgggatagagagtcgacagaaattcggtaccgtagacttcaacatttgcttgaaaaaagcaatatctactccaaatttttattgacgaaaatggaacagcaacaattagaggaacagaagaagaaagaaaaattggagagaaaaaaggagtctttaaaagttaaaaagggtaaaaattcaattgatgcaagtgaagagaagccagttatgaggaaaaaaagaggaagagaagatgaatcatacaatatttcagaggtcatgtcaaaagaggaatgcaaactcagatgtctatccacagaggcctaaagtgggctgtaacatggtttggcaaactttttctgtaaatagccagatagtaaatatttttagcttttgagtagttttgtgggcaactactcaaccctgtactctgctgttgttgcttgaaagcagccatagacaaaccgtaaacaagtgaggctgactttgttccaatttatcccatttctttgcttttaaaaaaatacctgtgtattcgcttagctggagttggtctacaggctgtagtttgctgaccccaggactagaggtttgttgccatgtgtgaatttgtacttaatctactcagattaaaagaaagaaaagctggaaaatcactgtatttgatgaaatatcccattgtataagtgttcccaaattagcctagaatgttatgaaatattatgagccagtaatgtctataggcttatttctgcctgaaggctactagttttatcttgagaatctcatcctcatttcctggcaaaatgagcacagaataaatgcttgttgaataaataaataaatgaacttcatacattattaatttgtttttgttttctcaaactactaggaaattttgtctgtggctaaaaaaaataaaaaggagaatgaggatgaaaactcctcctctactaatctctgtgtggaagatcttcagaaaaataaagattcgaatagtataattaaagatagattgtctgaaacggttaggcagaatactaaattcttttttgacccagtccggaagtgtaatggtcagccagtaccttttcaacaaccaaagcacttcactggaggagtgatgcgatggtaccaagtagaaggcatggaatggcttaggatgctttgggaaaatggaattaatggcattttagcagatgaaatgggattgggtaagacagttcagtgcattgctactattgcattgatgattcagagaggagtaccaggaccttttcttgtctgtggccctttgtctacacttcctaactggatggctgaattcaaaagatttacaccagatatccctacaatgttatatcatggaacccaggaggaacgtcaaaaattggtaagaaatatttacaaacggaaagggactttgcagattcatcctgtggtaatcacgtcatttgaaatagccatgagagaccgaaatgcgttacagcattgctattggaaatacttaatagtagatgaaggacacaggattaagaatatgaagtgccgtctaatcagggagttaaaacgattcaatgctgataacaaacttcttttgactggtactcccttgcaaaacaatttatcagaactttggtcattgctaaactttttgttgccagatgtatttgatgacttgaaaagctttgagtcttggttgacatcactagtctttctgaaactgctgaagatattatgctaaagaaagagaacagaatgtattgcatatgctgcaccagattttaacacctttcttatgagaagactgaagtctgatgttgctcttgaagttcctcctaaacgagaagtagtcgtttatgctccactttcaaagaagcaggagatcttttatacagccattgtgaaccgtacaattgcaaacatgtttggatccagtgagaaagaaacaattgagttaagtcctactggtcgaccaaaacgacgaactagaaaatcaataaattacagcaaaatagatgatttccctaatgaattggaaaaactgatcagtcaaatacagccagaggtggaccgagaaagagctgttgtggaagtgaatatccctgtagaatctgaagttaatctgaagctgcagaatataatgatgctacttcgtaaatgttgtaatcatccatatttgattgaatatcctatagaccctgttacacaagaatttaagatcgatgaagaattggtaacaaattctgggaagttcttgattttggatcgaatgctgccagaactaaaaaaaagaggtcacaaggtgctgcttttttcacaaatgacaagcatgttggacattttgatggattactgccatctcagagatttcaacttcagcaggcttgatgggtccatgtcttactcagagagagaaaaaaacatgcacagcttcaacacggatccagaggtgtttatcttcttagtgagtacacgagctggtggcctgggcattaatctgactgcagcagatacagttatcatttatgatagtgattggaacccccagtcggatcttcaggcccaggatagatgtcatagaattggtcagacaaagccagttgttgtttatcgccttgttacagcaaatactatcgatcagaaaattgtggaaagagcagctgctaaaaggaaactggaaaagttgatcatccataaaaatcatttcaaaggtggtcagtctggattaaatctgtctaagaatttcttagatcctaaggaattaatggaattattaaaatctagagattatgaaagggaaataaaaggatcaagagagaaggtcattagtgataaagatctagagttgttgttagatcgaagtgatcttattgatcaaatgaatgcttcaggaccaattaaagagaagatggggatattcaagatattagaaaattctgaagattccagtcctgaattggagacggggtttcaccatcttggcctgactggtcccgaactgatctcaggtgatctgcccacctcggcctcccaaagtgctgggattacaagcgtgagccactgcgtggcctgagcactagggcgcaagagaagccgtactggaatattacactactcagcacaagacaggtttaatctttttcttgggggacaagattggaaaattgaggtctgagcagacctgaagagaggcatccagcaactctgagattaaattcatcattgatcaattcgttattgtttggaattgacgtttagctgtgttcctcactcagatacgtgcatgatagctgcttgctaatttggtcttagctcacatttcacctagaatgtatggtctccctctcccctgcaaaatatcccactgttgctaatctgtctgcctcataatttccatgagattgagcatcttgtttgttttgtcaccactatataacagcatgttggaaacaaagcagtaataaagctagaaaaaccaagcgaatacactggattaaaaaaaatactgtttcctagaattaaagaaataaatgaggccgggcgcagtggtgcctgtaatcccagcagtttgggaggctgaggctagtggatcatgtggccgagatcgcgtcactgcactccagtctagcaacagagcgataccttgtttcttacttaaaaaaaaaaaaagacctcatttgttaactgttaaacagaaaacaagaaattccctatacctgtatgcattatagagcaaataagagcatcaaaaacaatcttagaaatctttcagagaaaggtcacctacaaaggaacattgatcagataatagatttttttttttctcagatggagttctgctccagtctagcaacagagcgataccttgtttcttacttaa

SEQ ID NO: 446410 - DNA, 5183 bp, Homo sapiens
atttcttaaggtggagtctcgcactgtcacctgggctggagtgcagtggcatgatctcggctcactacaacctttgcctcttgggttcaagtgagtctcctgtctcagcctcccaagtagctgggattacaagtgcccaccaccacgcccagctaattttttgtatttttagtagagacagggtttcaccatgttggccaggctggtctcaaactcctgaccttgtgatttgcctgacttggcctcccaaagtgctgggattacaggcttgagccaccatgcccggccaagactattttttagaaccataaccacaatacagttaccacacttttgaaagtcgatgggaattccttaatatttaaatttctcaataggctaatttttatttttagggatgggggcttgctgtattgacgagactggagtgcagtggctattcctgagtattgtcatagtgactacacctcaaacacctgggctcacatgatcctcctgcctcagtgtcccgagtagtagtgcagggactgtaggcacttaccgctgtgatctgcttagctcatacattttaaaaaaatagttggttcaaatcaggatccaaaaaagttacataaattgtgtttgattaatgcgtatcttgggtctcttttagatctagagtgtctctcatcttttttaagaaacattatttgttgaagaaaatgagtaattctgtataattccccacattctagactttactgattgtatccccatgatttctctgcctcttgtgtttcctgttaactatagtaactataagttaaatacggaagtttgtgattaaggtgtttttttatttttttttttatttttatttttttttgggagacaagatctttctctgttgcccagggtggagtgcagtggtgccatctcggctcattgaacctctgattgctgggctcaagcaatcctcccacctcatcctcctgagtagctgggactacaggcgtgtaccaccaagcccagccaacatttatattttttgtagagatgggatctcaccatgttgcccatgcttgatttttaataagaatacttcattggtggtatttatagattttgatttatttccaaattgttctttcaagtttcattttatctagtcattttacaggacagcttttatcagttcctggtataaaatccttttagcctcagccttataatatgaatatctatacatacataatacttcatacacacacgatatacatatattcccatgtatatatatgtgtgtgtgtcagccacttacatgtcctgttactcttctatgaatcttaaatttgatattgctgttttgaatctacttcatcccctatgccttctatattctctctgcttgaaatctaccctcactatcttgaatgatgaagcctggtgacaactttttagataattttatgtaagataattatttgctaagtcatccagtgacatactcgggtattgtttgtctccctaccagcagcatctagtaggtacttcaaaatcagagcactttattctgtatttttaattttttctgtctttgcctcttacccaggaatgcaaactcagatgtctatccacagaggcctaaagtgggctgtaacatggtttggcaaactttttctgtaaatagccagatagtaaatatttttagcttttgagtagttttgtgggcaactactcaaccctgtactctgctgttgttgcttgaaagcagccatagacaaaccgtaaacaagtgaggctgactttgttccaatttatcccatttctttgcttttaaaaaaatacctgtgtattcgcttagctggagttggtctacaggctgtagtttgctgaccccaggactagaggtttgttgccatgtgtgaatttgtacttaatctactcagattaaaagaaagaaaagctggaaaatcactgtatttgatgaaatatcccattgtataagtgttcccaaattagcctagaatgttatgaaatattatgagccagtaatgtctataggcttatttctgcctgaaggctactagttttatcttgagaatctcatcctcatttcctggcaaaatgagcacagaataaatgcttgttgaataaataaataaatgaacttcatacattattaatttgtttttgttttctcaaactactaggaaattttgtctgtggctaaaaaaaataaaaaggagaatgaggatgaaaactcctcctctactaatctctgtgtggaagatcttcagaaaaataaagattcgaatagtataattaaagatagattgtctgaaacggttaggcagaatactaaattcttttttgacccagtccggaagtgtaatggtcagccagtaccttttcaacaaccaaagcacttcactggaggagtgatgcgatggtaccaagtagaaggcatggaatggcttaggatgctttgggaaaatggaattaatggcattttagcagatgaaatgggattgggtaagacagttcagtgcattgctactattgcattgatgattcagagaggagtaccaggaccttttcttgtctgtggccctttgtctacacttcctaactggatggctgaattcaaaagatttacaccagatatccctacaatgttatatcatggaacccaggaggaacgtcaaaaattggtaagaaatatttacaaacggaaagggactttgcagattcatcctgtggtaatcacgtcatttgaaatagccatgagagaccgaaatgcgttacagcattgctattggaaatacttaatagtagatgaaggacacaggattaagaatatgaagtgccgtctaatcagggagttaaaacgattcaatgctgataacaaacttcttttgactggtactcccttgcaaaacaatttatcagaactttggtcattgctaaactttttgttgccagatgtatttgatgacttgaaaagctttgagtcttggttgacatcactagtctttctgaaactgctgaagatattatgctaaagaaagagaacagaatgtattgcatatgctgcaccagattttaacacctttcttatgagaagactgaagtctgatgttgctcttgaagttcctcctaaacgagaagtagtcgtttatgctccactttcaaagaagcaggagatcttttatacagccattgtgaaccgtacaattgcaaacatgtttggatccagtgagaaagaaacaattgagttaagtcctactggtcgaccaaaacgacgaactagaaaatcaataaattacagcaaaatagatgatttccctaatgaattggaaaaactgatcagtcaaatacagccagaggtggaccgagaaagagctgttgtggaagtgaatatccctgtagaatctgaagttaatctgaagctgcagaatataatgatgctacttcgtaaatgttgtaatcatccatatttgattgaatatcctatagaccctgttacacaagaatttaagatcgatgaagaattggtaacaaattctgggaagttcttgattttggatcgaatgctgccagaactaaaaaaaagaggtcacaaggtgctgcttttttcacaaatgacaagcatgttggacattttgatggattactgccatctcagagatttcaacttcagcaggcttgatgggtccatgtcttactcagagagagaaaaaaacatgcacagcttcaacacggatccagaggtgtttatcttcttagtgagtacacgagctggtggcctgggcattaatctgactgcagcagatacagttatcatttatgatagtgattggaacccccagtcggatcttcaggcccaggatagatgtcatagaattggtcagacaaagccagttgttgtttatcgccttgttacagcaaatactatcgatcagaaaattgtggaaagagcagctgctaaaaggaaactggaaaagttgatcatccataaaaatcatttcaaaggtggtcagtctggattaaatctgtctaagaatttcttagatcctaaggaattaatggaattattaaaatctagagattatgaaagggaaataaaaggatcaagagagaaggtcattagtgataaagatctagagttgttgttagatcgaagtgatcttattgatcaaatgaatgcttcaggaccaattaaagagaagatggggatattcaagatattagaaaattctgaagattccagtcctgaattggagacggggtttcaccatcttggcctgactggtcccgaactgatctcaggtgatctgcccacctcggcctcccaaagtgctgggattacaagcgtgagccactgcgtggcctgagcactagggcgcaagagaagccgtactggaatattacactactcagcacaagacaggtttaatctttttcttgggggacaagattggaaaattgaggtctgagcagacctgaagagaggcatccagcaactctgagattaaattcatcattgatcaattcgttattgtttggaattgacgtttagctgtgttcctcactcagatacgtgcatgatagctgcttgctaatttggtcttagctcacatttcacctagaatgtatggtctccctctcccctgcaaaatatcccactgttgctaatctgtctgcctcataatttccatgagattgagcatcttgtttgttttgtcaccactatataacagcatgttggaaacaaagcagtaataaagctagaaaaaccaagcgaatacactggattaaaaaaaatactgtttcctagaattaaagaaataaatgaggccgggcgcagtggtgcctgtaatcccagcagtttgggaggctgaggctagtggatcatgtggccgagatcgcgtcactgcactccagtctagcaacagagcgataccttgtttcttacttaaaaaaaaaaaaagacctcatttgttaactgttaaacagaaaacaagaaattccctatacctgtatgcattatagagcaaataagagcatcaaaaacaatcttagaaatctttcagagaaaggtcacctacaaaggaacattgatcagataatagatttttttttttctcagatggagttctgctccagtctagcaacagagcgataccttgtttcttacttaa

SEQ ID NO: 446411 - DNA, 3809 bp, Homo sapiens
tcccgcgaaggagaagcgcgcttttttccctggcgggggatttggctagaaggctgggccggcagcggttgtgaggagttagctcgcggcattgcaggctctgagaggaggggacccggttcccgggtgagtgtccaggcatgccagcggaacggcccgcgggcagcggcggctcggaggctccagcaatggttgaacaactggacactgctgtgattaccccggccatgctagaagaggaagaacagcttgaagctgctggactagagagagagcggaagatgctggaaaaggctcgcatgtcttgggatagagagtcgacagaaattcggtaccgtagacttcaacatttgcttgaaaaaagcaatatctactccaaatttttattgacgaaaatggaacagcaacaattagaggaacagaagaagaaagaaaaattggagagaaaaaaggagtctttaaaagttaaaaagggtaaaaattcaattgatgcaagtgaagagaagccagttatgaggaaaaaaagaggaagagaagatgaatcatacaatatttcagaggtcatgtcaaaagaggaatgcaaactcagatgtctatccacagaggcctaaagtgggctgtaacatggtttggcaaactttttctgtaaatagccagatagtaaatatttttagcttttgagtagttttgtgggcaactactcaaccctgtactctgctgttgttgcttgaaagcagccatagacaaaccgtaaacaagtgaggctgactttgttccaatttatcccatttctttgcttttaaaaaaatacctgtgtattcgcttagctggagttggtctacaggctgtagtttgctgaccccaggactagaggtttgttgccatgtgtgaatttgtacttaatctactcagattaaaagaaagaaaagctggaaaatcactgtatttgatgaaatatcccattgtataagtgttcccaaattagcctagaatgttatgaaatattatgagccagtaatgtctataggcttatttctgcctgaaggctactagttttatcttgagaatctcatcctcatttcctggcaaaatgagcacagaataaatgcttgttgaataaataaataaatgaacttcatacattattaatttgtttttgttttctcaaactactaggaaattttgtctgtggctaaaaaaaataaaaaggagaatgaggatgaaaactcctcctctactaatctctgtgtggaagatcttcagaaaaataaagattcgaatagtataattaaagatagattgtctgaaacggttaggcagaatactaaattcttttttgacccagtccggaagtgtaatggtcagccagtaccttttcaacaaccaaagcacttcactggaggagtgatgcgatggtaccaagtagaaggcatggaatggcttaggatgctttgggaaaatggaattaatggcattttagcagatgaaatgggattgggtaagacagttcagtgcattgctactattgcattgatgattcagagaggagtaccaggaccttttcttgtctgtggccctttgtctacacttcctaactggatggctgaattcaaaagatttacaccagatatccctacaatgttatatcatggaacccaggaggaacgtcaaaaattggtaagaaatatttacaaacggaaagggactttgcagattcatcctgtggtaatcacgtcatttgaaatagccatgagagaccgaaatgcgttacagcattgctattggaaatacttaatagtagatgaaggacacaggattaagaatatgaagtgccgtctaatcagggagttaaaacgattcaatgctgataacaaacttcttttgactggtactcccttgcaaaacaatttatcagaactttggtcattgctaaactttttgttgccagatgtatttgatgacttgaaaagctttgagtcttggttgacatcactagtctttctgaaactgctgaagatattatgctaaagaaagagaacagaatgtattgcatatgctgcaccagattttaacacctttcttatgagaagactgaagtctgatgttgctcttgaagttcctcctaaacgagaagtagtcgtttatgctccactttcaaagaagcaggagatcttttatacagccattgtgaaccgtacaattgcaaacatgtttggatccagtgagaaagaaacaattgagttaagtcctactggtcgaccaaaacgacgaactagaaaatcaataaattacagcaaaatagatgatttccctaatgaattggaaaaactgatcagtcaaatacagccagaggtggaccgagaaagagctgttgtggaagtgaatatccctgtagaatctgaagttaatctgaagctgcagaatataatgatgctacttcgtaaatgttgtaatcatccatatttgattgaatatcctatagaccctgttacacaagaatttaagatcgatgaagaattggtaacaaattctgggaagttcttgattttggatcgaatgctgccagaactaaaaaaaagaggtcacaaggtgctgcttttttcacaaatgacaagcatgttggacattttgatggattactgccatctcagagatttcaacttcagcaggcttgatgggtccatgtcttactcagagagagaaaaaaacatgcacagcttcaacacggatccagaggtgtttatcttcttagtgagtacacgagctggtggcctgggcattaatctgactgcagcagatacagttatcatttatgatagtgattggaacccccagtcggatcttcaggcccaggatagatgtcatagaattggtcagacaaagccagttgttgtttatcgccttgttacagcaaatactatcgatcagaaaattgtggaaagagcagctgctaaaaggaaactggaaaagttgatcatccataaaaatcatttcaaaggtggtcagtctggattaaatctgtctaagaatttcttagatcctaaggaattaatggaattattaaaatctagagattatgaaagggaaataaaaggatcaagagagaaggtcattagtgataaagatctagagttgttgttagatcgaagtgatcttattgatcaaatgaatgcttcaggaccaattaaagagaagatggggatattcaagatattagaaaattctgaagattccagtcctgaatgtttgttttaaagtggagctcaagaatagcttttaaaagttcttatttacatctagtgatttccctgtattgggtttgaaatactgattgtccacttcaccttttttattatatcagttgacatgtaactagtaccatgcgtacttaaatagatggtaattttctgagccttaccaagaacaaagaagtatccatattaagtttagattttcagttaatttttgagactgagtagtattcttggatacaggctgatgtgtacttaaccacttccagatttatacagtcttcctgtggaagtttagtaaatgtctttttccctcctttcttctagtaatgcagttcatgggctttaggtacttcagttatgaagtaggcttttcatggggagagattgggattatgctctctgttgtttaagaaactgtttgattttagagtctatttctatgagatagtttaccaaataaatgttccttataagatgatctcattaaattatttcttcaggaatagcttaggtgcaataatagcaaaagacttggctgtcggtaggatttggtta

SEQ ID NO: 446412 - DNA, 1032 bp, Homo sapiens
tcccgcgaaggagaagcgcgcttttttccctggcgggggatttggctagaaggctgggccggcagcggttgtgaggagttagctcgcggcattgcaggctctgagaggaggggacccggttcccgggtgagtgtccaggcatgccagcggaacggcccgcgggcagcggcggctcggaggctccagcaatggttgaacaactggacactgctgtgattaccccggccatgctagaagaggaagaacagcttgaagctgctggactagagagagagcggaagatgctggaaaaggctcgcatgtcttgggatagagagtcgacagaaattcggtaccgtagacttcaacatttgcttgaaaaaagcaatatctactccaaatttttattgacgaaaatggaacagcaacaattagaggaacagaagaagaaagaaaaattggagagaaaaaaggagtctttaaaagttaaaaagggtaaaaattcaattgatgcaagtgaagagaagccagttatgaggaaaaaaagaggaagagaagatgaatcatacaatatttcagaggtcatgtcaaaagaggtaaaaataaaagggagagggcacctaacatttgatgttgagtaaaatgtaggttttaaaccaccttaaatctgtaaagattgaatattcaatatcacatgaaatatgttttgaatttaatattatatatcatttataggtgaagctgccaaaatgtttgaagctatctaccaacctacagtagacttgagactaatctgaaactaatgtcatctgaccttcatagacttttttttttttttgagatggagctctgtggtccatgctgccttgcagtgtcactatatctgctcactgcaacctccacctcgcgggttcaagcgattctcctgtctcagcctcccaagtagctgggataacaggtgccaaccaccacgcctggccaatttttgtattttcagtagagatggggtttcaccatgttggccaggctggtcttgaactcctgacttaaggt

SEQ ID NO: 446413 - DNA, 1659 bp, Homo sapiens
tgatccgcccgccctggcctctcagagtgctgggattacaggcatgacccaccccatccggccctctgagtctttcttatctgtaaaatgggtataataatacctatctaatcggctttagtaatggtggagataatgcctgaaagtgctagtatagaggtttaatagccagcaaggactgttattagaatgaatagtaatatgactactgtcacattttgcaaatgtgtaaagaagaaagagggctaagtgaatcaaagggagacagccccactcaccctgttctgccccagaggactgagcgatccccaccatctggcaagctgcctcaccaggaggtccagctggggctacaggactggctactttgctacaatggcccgtctttcctgagcccagtggagggtcccaggggggcagaagtcattgataggggccagtagggttgtagagccactgtctgaacttctgtggaggtctggtgcaggggaggtgtgaacagataggaggctaggtgaggatgcagcagaggaagggggcaggagtgccccaggagggggcggtaccgaggcagggattcagctgggtctgagagggaggcaaggctgagggggatggccctttggagtgggcagggacatgaccacagaaagcctgggaagtggaaacagacaggagcctgctggagctcttggagctttgtgtggggcactaggggaaggaggcaggcactccaccctgacctgcccctacctctggatgagggtcttctctgcctgttggatgatgtgctgcccctgctcttggaggaagaggcctcccagccaccccctcctgccagtcgccttgccctgctgacccagacagatctgctatccctacagcatccaggaaggccacagggagggggcccaggtggcatgggtttctgaggcctgggatctgctctcagtcccgctctcgccaaccccctttgcccctctgtgacagtgtgtgtacatatgcgtgcatgtgtgtacctgtgtggtgtggctcacaaggtcacccctgggggtgggataataagaggtaaagtgtgaccccctctcttccgtacattcattttttcaagcttgtgaatattcacattgttaatataatcttctgcagtcccatgacttcgaatagcacttagatgccgatgacccccccaccaaagaaaccccactgtctcccacagactccaggtctgtatctccaactgcctactcaatacaacacgtccacctgatgcaatgaacttaatgtgtctaaaccccaattccacatttccagtcctcctaccggctcctcccccagtcttctctactttactatatgacaactccatttttcccaatactggttttaaaaaccctggagtagtccttgactccagtctctctcacctttcaaccaattcagcagcaaatactgacagctctacctttgctcatcaaagcatatccccaaatcaccctattccagactgcacactgtcatctctcccttcaattacagcagtagcctcctaactagttttcttgattccactcttgcccatcagcagtgaaattaccccagagcagttaaaatgatcttttaggatgggcacagtggctcacgcctgtaataccagca

SEQ ID NO: 446414 - DNA, 475 bp, Homo sapiens
ggaagctggagccctagagcctggagaaaggatgagaaaaagaagagaacctggcagcccctgttgcacactgacctctgccctctcttaggtggaagagatcatgcagctggtgaatgcctacttggccaacccctcccccgagaggccctgcagcagctcttctcctccatgccaagacctgccagacacctcccctcccagccagcgcccgggcctggacgagccccagggacagtctggctgcttggggcagctgcaggactgagcctgccaagaggtcacgacttccctcctgcctgcagcctgggccaggactgctctgagatttgagggaaacatggacccttttggccctgcagggacagggcacatcccacacccaagggctacaatgggtgtgggtaattttctagtttgtttcttaatttatttgtagaagagaagcaaaaaaaaaaaagtttcttatttacac

SEQ ID NO: 446415 - DNA, 3395 bp, Homo sapiens
gtgacgaaacctggaccctgcctagtaaagaagggaggagagaaagaagagagagggggggcggggtcccagctctgtgctcgcgcccccagcgcgccagtcccggggctgcagggagcgcagcgcgcgcggcccgggccccggccaccggacgccctaccggacacgaccctccctggagcttggacaactgcccacctcggacgctgcaccggacactgccccccacagggctggacactccaacggacactacttcccagctccggacattgctccctcctctcccggggccctggacgcttttccccctcccccctccgggggcccagacactgagcccccctcagcgtctggctagcgtccccttgcaccccagcccaggacactgcctcctccctgtcctcttctcccttctgctcctcccacctcatctttcccctgctcgggtcggagccccgccagttcctccgaccccctactgctcggccgcggctgcccgcgcccccatccgcagctcctcgcccggatgcctctccccgggggactatggtggcttctctgctgccgtcgaggcttcactcttctgcaccgggactacggggacggcgagcttagcggggacggggacgaggacgaggacgaggaaacctttgagctgcggaccccgagtccagcgggcggcgggaggggtcccctggaagtgacgctgactcagccagtgaggagcgggcctgtctccaacaggctgcagagctgggaggagacttggagcctcatcccggagaaagggctgccggaggacgacccggacatcgttgtgaaaggttggctgtaccgggagccccgcggaggaggggcgcggccctggctgcccccgcgccgagcctggtttgtgctcacgcgggactccctggatcagttcagcagcagcgggaaaggggcgcggcgtctcgggagcctcgtgctcaccagcctgtgctcggtgaccggcccagagcgcaggcgtaaggagacaggtctgtggtcagtgactgtgtctggtcggaaacacagtgtccgcctctgctccccacgccaggcagaggctgagcgctggggggtggcattgcgggaagtgatcgcctccaaggcacccctggagacccccacccagctactgctcagggacatacaggaaagttgcggggacccagaggccgttgccctcatttacctgaggaacccgattctgagacacactagtggagccttgtatgccccactcctgcccctgccctatggagtcagcgccccaggtccgggctatgcacccctgcgcgaggaggcggtgcggctgttcttggcgctgcaggcgctggagggggcgcggcgccccgggcccttgatgcagggtgtgctccaaacctgccgggacttgcccgcgctccgggatgaactcttcctgcagctggctaagcagacctcgggccctgcaggtccccccgggctcccggctacccaagaccctgcggccctgcggtactggcaactcctcacctgcatgagctgcaccttccgacctgggggagctgtgcgggggcacctcctggggcacttggagaggaccgagcaggcactcccggactcggaactggcggaatatgcgcgcttcatccggaaagcgctgggccggacgcgcggcagagagctggtgccctcgctggcggagatttccgcgttgagccaacggcaggagctgctgtgtaccgtgcactgtccgggggctcccaacgcctttactttcacagcctctgcagcaaactgcggtcactataatcgctcctgtggcacagaggcatacccaggggaatctgcccagggggccactctgtgcccacgtgggaacccacacctgcttgtaaagcctcccctccctctgaccagcaaccaggacagtttgttgttccaagcagtgggctcatgtctgttttggctcagaacagggtggggagagcgggccagggacccgcaggaaggcttatccttgagattgcgtgggagacacaacaaggggtgggggcccgcaggcggggcggggcgaagcaggtgatatcaagcccagagccccagcctctccccacagtctcaccatggcccgcaccgtggtgctcatcaccggctgttcctcgggcatcggcctgcacttggccgtacgtctggcttcagatccatcccagagcttcaaagtgtatgccacgttgagggacctgaaaacacagggccggctgtgggaggcggcccgggccctggcatgccctccgggatccctggagacgttgcagctggacgtaagggactcaaaatccgtggccgctgcccgggaacgcgtgactgagggccgcgtggacgtgctggtgtgtaacgcaggcctgggcctgctggggccgctggaggcgctgggggaggacgccgtggcctctgtgctggacgtgaatgtagtagggactgtgcggatgctgcaggccttcctgccagacatgaagaggcgcggttcgggacgcgtgttggtgaccgggagcgtgggaggattgatggggctgcctttcaatgacgtttattgcgccagcaagttcgcgctcgaaggcttatgcgagagtctggcggttctgctgctgccctttggggtccacttgagcctgatcgagtgcggcccagtgcacaccgccttcatggagaaggtgttgggcagcccagaggaggtgctggaccgcacggacatccacaccttccaccgcttctaccaatacctcgcccacagcaagcaagtctttcgcgaggcggcgcagaaccctgaggaggtggcggaggtcttcctcaccgctttgcgcgccccgaagccgaccctgcgctacttcaccaccgagcgcttcctgcccctgctgcggatgcgcctggacgaccccagcggctccaactacgtcaccgccatgcaccgggaagtgttcggcgacgttccggcaaaggccgaggctggggccgaggctgggggcggggccgggcctggggcagaggacgaggccgggcgcggtgcggtgggggaccctgagctcggcgatcctccggccgccccgcagtaaaggcttcctcagccgctgtctcccgcgcccttctttgtcccctgggtctgtgtggtccctggggatggggcggcggtagcagctgtgggtggctaattaagatagatcgcgttagccagttttaccagcgcagctaggcgcgatgctgtcgcctgtaatgccagcgctttgggaggcggaggcaggaggatcgctcaagccccggagttggagaccagccagagcaacacagtgagacccccatctctacaaaaataaagaaaatttaaaaatcaa

SEQ ID NO: 446416 - DNA, 3038 bp, Homo sapiens
ctgggctccaacaatcccctttcctgggcctcccaaagtgctgggattagaggcatgagccaccgtgcccagcctcaaagcatattttaaaggatagaaataaacagccatatgaagagatacagacagggcggtctggaagggtccagagcaggagcttctatctccatagagttggggttacgtcaccctctgggcacattctgtcagcctccacacgttcagctctcagaagctcccgaaccctgtcctttgggccttttatggagaactccattggctgtccatgactgaagcatggacaactgtgataatgtgattgggcaaaaagggtctgatctaagcccagcaaggccagtccagattctttgggcctttgtgcagcattcctttctccagggtatggggcaaggacccactctggaatgaggatcctacaacccacaatcagattagagtcctgccttgggcagctgaaaagaggacaggagaaggtcagagagacgaaaggctgttttttgaggcctgaggcaccccaacatgacaacgtaagactgtaaccatggtcatgtgagttatgagctaggaaccctggacgaaaccaacacatatacaatcatctcccacctcccaacgcctttactttcacagcctctgcagcaaactgcggtcactataatcgctcctgtggcacagaggcatacccaggggaatctgcccagggggccactctgtgcccacgtgggaacccacacctgcttgtaaagcctcccctccctctgaccagcaaccaggacagtttgttgttccaagcagtgggctcatgtctgttttggctcagaacagggtggggagagcgggccagggacccgcaggaaggcttatccttgagattgcgtgggagacacaacaaggggtgggggcccgcaggcggggcggggcgaagcaggtgatatcaagcccagagccccagcctctccccacagtctcaccatggcccgcaccgtggtgctcatcaccggctgttcctcgggcatcggcctgcacttggccgtacgtctggcttcagatccatcccagagcttcaaagtgtatgccacgttgagggacctgaaaacacagggccggctgtgggaggcggcccgggccctggcatgccctccgggatccctggagacgttgcagctggacgtaagggactcaaaatccgtggccgctgcccgggaacgcgtgactgagggccgcgtggacgtgctggtgtgtaacgcaggcctgggcctgctggggccgctggaggcgctgggggaggacgccgtggcctctgtgctggacgtgaatgtagtagggactgtgcggatgctgcaggccttcctgccagacatgaagaggcgcggttcgggacgcgtgttggtgaccgggagcgtgggaggattgatggtgggtgagtggtagggagtggcctcggcagctccagattctttgtgtgcggagctgagccttgaaggcaggttccgcggggggggtggagtggggtgccgtcagcttggaggggcaccgtctgcccggggatgaccccctggccgctgcgcctcaggaacctcgtctccccacctaagggctgcctttcaatgacgtttattgcgccagcaagttcgcgctcgaaggcttatgcgagagtctggcggttctgctgctgccctttggggtccagtgagtcaacacccccgttccccgaaccctcttaactctgacctagagacgccgagcaccctgtcctgcgggagccgctctggggcgatctccctggccctctctgcccggctcacattagctgtgtgccaggcacttgggctgggcgcatggcacgcattgtgccacctgctgacctagctgctgaagtgttggtattgttatggggaagctccagcccagagaggttaggtgactggcccaaggtcacacagcggccagggaccccgctagattcgaatcctgacaccagggctcccttgtagcctcagatggatttgggagggctgctccggcaggaacccgcgtttcaaatgttctggttatccccagcgccctttccgcctcacttccccagcgcagcggtgctgctcgcggtcgggggccgggacgtggttggggctgggactggggttggggctgggactggggcctggctggcgtccgccccctcccactcgttgctctccggccagcagcttgagcctgatcgagtgcggcccagtgcacaccgccttcatggagaaggtgttgggcagcccagaggaggtgctggaccgcacggacatccacaccttccaccgcttctaccaatacctcgcccacagcaagcaagtctttcgcgaggcggcgcagaaccctgaggaggtggcggaggtgagcgccgggctggactccaggagtgggggcggtgcgtcctccggcgcgcagcggtggccacagctctcctcccgccgccgcaggtcttcctcaccgctttgcgcgccccgaagccgaccctgcgctacttcaccaccgagcgcttcctgcccctgctgcggatgcgcctggacgaccccagcggctccaactacgtcaccgccatgcaccgggaagtgttcggcgacgttccggcaaaggccgaggctggggccgaggctgggggcggggccgggcctggggcagaggacgaggccgggcgcggtgcggtgggggaccctgagctcggcgatcctccggccgccccgcagtaaaggcttcctcagccgctgtctcccgcgcccttctttgtcccctgggtctgtgtggtccctggggatggggcggcggtagcagctgtgggtggctaattaagatagatcgcgttagccagttttaccagcgcagctaggcgcgatgctgtcgcctgtaatgccagcgctttgggaggcggaggcaggaggatcgctcaagccccggagttggagaccagccagagcaacacagtgagacccccatctctacaaaaataaagaaaatttaaaaatcaa

SEQ ID NO: 446417 - DNA, 3188 bp, Homo sapiens
ctgggctccaacaatcccctttcctgggcctcccaaagtgctgggattagaggcatgagccaccgtgcccagcctcaaagcatattttaaaggatagaaataaacagccatatgaagagatacagacagggcggtctggaagggtccagagcaggagcttctatctccatagagttggggttacgtcaccctctgggcacattctgtcagcctccacacgttcagctctcagaagctcccgaaccctgtcctttgggccttttatggagaactccattggctgtccatgactgaagcatggacaactgtgataatgtgattgggcaaaaagggtctgatctaagcccagcaaggccagtccagattctttgggcctttgtgcagcattcctttctccagggtatggggcaaggacccactctggaatgaggatcctacaacccacaatcagattagagtcctgccttgggcagctgaaaagaggacaggagaaggtcagagagacgaaaggctgttttttgaggcctgaggcaccccaacatgacaacgtaagactgtaaccatggtcatgtgagttatgagctaggaaccctggacgaaaccaacacatatacaatcatctcccacctcccaacgcctttactttcacagcctctgcagcaaactgcggtcactataatcgctcctgtggcacagaggcatacccaggggaatctgcccagggggccactctgtgcccacgtgggaacccacacctgcttgtaaagcctcccctccctctgaccagcaaccaggacagtttgttgttccaagcagtgggctcatgtctgttttggctcagaacagggtggggagagcgggccagggacccgcaggaaggcttatccttgagattgcgtgggagacacaacaaggggtgggggcccgcaggcggggcggggcgaagcaggtgatatcaagcccagagccccagcctctccccacagtctcaccatggcccgcaccgtggtgctcatcaccggctgttcctcgggcatcggcctgcacttggccgtacgtctggcttcagatccatcccagagcttcaaagtgtatgccacgttgagggacctgaaaacacagggccggctgtgggaggcggcccgggccctggcatgccctccgggatccctggagacgttgcagctggacgtaagggactcaaaatccgtggccgctgcccgggaacgcgtgactgagggccgcgtggacgtgctgggtgagcctcctggaagcatatgggctcctaggagccttctccgccctgcgttgaaaccaacatgttcccaggcccagggagcacgaggggacaggccgtgctgagggtgatgctgaggcgggctggtcgggcctcttgtctccgcagtgttgtgtaacgcaggcctgggcctgctggggccgctggaggcgctgggggaggacgccgtggcctctgtgctggacgtgaatgtagtagggactgtgcggatgctgcaggccttcctgccagacatgaagaggcgcggttcgggacgcgtgttggtgaccgggagcgtgggaggattgatggtgggtgagtggtagggagtggcctcggcagctccagattctttgtgtgcggagctgagccttgaaggcaggttccgcggggggggtggagtggggtgccgtcagcttggaggggcaccgtctgcccggggatgaccccctggccgctgcgcctcaggaacctcgtctccccacctaagggctgcctttcaatgacgtttattgcgccagcaagttcgcgctcgaaggcttatgcgagagtctggcggttctgctgctgccctttggggtccagtgagtcaacacccccgttccccgaaccctcttaactctgacctagagacgccgagcaccctgtcctgcgggagccgctctggggcgatctccctggccctctctgcccggctcacattagctgtgtgccaggcacttgggctgggcgcatggcacgcattgtgccacctgctgacctagctgctgaagtgttggtattgttatggggaagctccagcccagagaggttaggtgactggcccaaggtcacacagcggccagggaccccgctagattcgaatcctgacaccagggctcccttgtagcctcagatggatttgggagggctgctccggcaggaacccgcgtttcaaatgttctggttatccccagcgccctttccgcctcacttccccagcgcagcggtgctgctcgcggtcgggggccgggacgtggttggggctgggactggggttggggctgggactggggcctggctggcgtccgccccctcccactcgttgctctccggccagcagcttgagcctgatcgagtgcggcccagtgcacaccgccttcatggagaaggtgttgggcagcccagaggaggtgctggaccgcacggacatccacaccttccaccgcttctaccaatacctcgcccacagcaagcaagtctttcgcgaggcggcgcagaaccctgaggaggtggcggaggtgagcgccgggctggactccaggagtgggggcggtgcgtcctccggcgcgcagcggtggccacagctctcctcccgccgccgcaggtcttcctcaccgctttgcgcgccccgaagccgaccctgcgctacttcaccaccgagcgcttcctgcccctgctgcggatgcgcctggacgaccccagcggctccaactacgtcaccgccatgcaccgggaagtgttcggcgacgttccggcaaaggccgaggctggggccgaggctgggggcggggccgggcctggggcagaggacgaggccgggcgcggtgcggtgggggaccctgagctcggcgatcctccggccgccccgcagtaaaggcttcctcagccgctgtctcccgcgcccttctttgtcccctgggtctgtgtggtccctggggatggggcggcggtagcagctgtgggtggctaattaagatagatcgcgttagccagttttaccagcgcagctaggcgcgatgctgtcgcctgtaatgccagcgctttgggaggcggaggcaggaggatcgctcaagccccggagttggagaccagccagagcaacacagtgagacccccatctctacaaaaataaagaaaatttaaaaatcaa

SEQ ID NO: 446418 - DNA, 2434 bp, Homo sapiens
ctgggctccaacaatcccctttcctgggcctcccaaagtgctgggattagaggcatgagccaccgtgcccagcctcaaagcatattttaaaggatagaaataaacagccatatgaagagatacagacagggcggtctggaagggtccagagcaggagcttctatctccatagagttggggttacgtcaccctctgggcacattctgtcagcctccacacgttcagctctcagaagctcccgaaccctgtcctttgggccttttatggagaactccattggctgtccatgactgaagcatggacaactgtgataatgtgattgggcaaaaagggtctgatctaagcccagcaaggccagtccagattctttgggcctttgtgcagcattcctttctccagggtatggggcaaggacccactctggaatgaggatcctacaacccacaatcagattagagtcctgccttgggcagctgaaaagaggacaggagaaggtcagagagacgaaaggctgttttttgaggcctgaggcaccccaacatgacaacgtaagactgtaaccatggtcatgtgagttatgagctaggaaccctggacgaaaccaacacatatacaatcatctcccacctcccaacgcctttactttcacagcctctgcagcaaactgcggtcactataatcgctcctgtggcacagaggcatacccaggggaatctgcccagggggccactctgtgcccacgtgggaacccacacctgcttgtaaagcctcccctccctctgaccagcaaccaggacagtttgttgttccaagcagtgggctcatgtctgttttggctcagaacagggtggggagagcgggccagggacccgcaggaaggcttatccttgagattgcgtgggagacacaacaaggggtgggggcccgcaggcggggcggggcgaagcaggtgatatcaagcccagagccccagcctctccccacagtctcaccatggcccgcaccgtggtgctcatcaccggctgttcctcgggcatcggcctgcacttggccgtacgtctggcttcagatccatcccagagcttcaaagtgtatgccacgttgagggacctgaaaacacagggccggctgtgggaggcggcccgggccctggcatgccctccgggatccctggagacgttgcagctggacgtaagggactcaaaatccgtggccgctgcccgggaacgcgtgactgagggccgcgtggacgtgctggtgtgtaacgcaggcctgggcctgctggggccgctggaggcgctgggggaggacgccgtggcctctgtgctggacgtgaatgtagtagggactgtgcggatgctgcaggccttcctgccagacatgaagaggcgcggttcgggacgcgtgttggtgaccgggagcgtgggaggattgatggtgggtgagtggtagggagtggcctcggcagctccagattctttgtgtgcggagctgagccttgaaggcaggttccgcggggggggtggagtggggtgccgtcagcttggaggggcaccgtctgcccggggatgaccccctggccgctgcgcctcaggaacctcgtctccccacctaagggctgcctttcaatgacgtttattgcgccagcaagttcgcgctcgaaggcttatgcgagagtctggcggttctgctgctgccctttggggtccacttgagcctgatcgagtgcggcccagtgcacaccgccttcatggagaaggtgttgggcagcccagaggaggtgctggaccgcacggacatccacaccttccaccgcttctaccaatacctcgcccacagcaagcaagtctttcgcgaggcggcgcagaaccctgaggaggtggcggaggtcttcctcaccgctttgcgcgccccgaagccgaccctgcgctacttcaccaccgagcgcttcctgcccctgctgcggatgcgcctggacgaccccagcggctccaactacgtcaccgccatgcaccgggaagtgttcggcgacgttccggcaaaggccgaggctggggccgaggctgggggcggggccgggcctggggcagaggacgaggccgggcgcggtgcggtgggggaccctgagctcggcgatcctccggccgccccgcagtaaaggcttcctcagccgctgtctcccgcgcccttctttgtcccctgggtctgtgtggtccctggggatggggcggcggtagcagctgtgggtggctaattaagatagatcgcgttagccagttttaccagcgcagctaggcgcgatgctgtcgcctgtaatgccagcgctttgggaggcggaggcaggaggatcgctcaagccccggagttggagaccagccagagcaacacagtgagacccccatctctacaaaaataaagaaaatttaaaaatcaa

SEQ ID NO: 446419 - DNA, 2005 bp, Homo sapiens
tgatccgcccgccctggcctctcagagtgctgggattacaggcatgacccaccccatccggccctctgagtctttcttatctgtaaaatgggtataataatacctatctaatcggctttagtaatggtggagataatgcctgaaagtgctagtatagaggtttaatagccagcaaggactgttattagaatgaatagtaatatgactactgtcacattttgcaaatgtgtaaagaagaaagagggctaagtgaatcaaagggagacagccccactcaccctgttctgccccagaggactgagcgatccccaccatctggcaagctgcctcaccaggaggtccagctggggctacaggactggctactttgctacaatggcccgtctttcctgagcccagtggaggtgggtgagtggtagggagtggcctcggcagctccagattctttgtgtgcggagctgagccttgaaggcaggttccgcggggggggtggagtggggtgccgtcagcttggaggggcaccgtctgcccggggatgaccccctggccgctgcgcctcaggaacctcgtctccccacctaagggctgcctttcaatgacgtttattgcgccagcaagttcgcgctcgaaggcttatgcgagagtctggcggttctgctgctgccctttggggtccagtgagtcaacacccccgttccccgaaccctcttaactctgacctagagacgccgagcaccctgtcctgcgggagccgctctggggcgatctccctggccctctctgcccggctcacattagctgtgtgccaggcacttgggctgggcgcatggcacgcattgtgccacctgctgacctagctgctgaagtgttggtattgttatggggaagctccagcccagagaggttaggtgactggcccaaggtcacacagcggccagggaccccgctagattcgaatcctgacaccagggctcccttgtagcctcagatggatttgggagggctgctccggcaggaacccgcgtttcaaatgttctggttatccccagcgccctttccgcctcacttccccagcgcagcggtgctgctcgcggtcgggggccgggacgtggttggggctgggactggggttggggctgggactggggcctggctggcgtccgccccctcccactcgttgctctccggccagcagcttgagcctgatcgagtgcggcccagtgcacaccgccttcatggagaaggtgttgggcagcccagaggaggtgctggaccgcacggacatccacaccttccaccgcttctaccaatacctcgcccacagcaagcaagtctttcgcgaggcggcgcagaaccctgaggaggtggcggaggtgagcgccgggctggactccaggagtgggggcggtgcgtcctccggcgcgcagcggtggccacagctctcctcccgccgccgcaggtcttcctcaccgctttgcgcgccccgaagccgaccctgcgctacttcaccaccgagcgcttcctgcccctgctgcggatgcgcctggacgaccccagcggctccaactacgtcaccgccatgcaccgggaagtgttcggcgacgttccggcaaaggccgaggctggggccgaggctgggggcggggccgggcctggggcagaggacgaggccgggcgcggtgcggtgggggaccctgagctcggcgatcctccggccgccccgcagtaaaggcttcctcagccgctgtctcccgcgcccttctttgtcccctgggtctgtgtggtccctggggatggggcggcggtagcagctgtgggtggctaattaagatagatcgcgttagccagttttaccagcgcagctaggcgcgatgctgtcgcctgtaatgccagcgctttgggaggcggaggcaggaggatcgctcaagccccggagttggagaccagccagagcaacacagtgagacccccatctctacaaaaataaagaaaatttaaaaatcaa

SEQ ID NO: 446420 - DNA, 2637 bp, Homo sapiens
ctgggctccaacaatcccctttcctgggcctcccaaagtgctgggattagaggcatgagccaccgtgcccagcctcaaagcatattttaaaggatagaaataaacagccatatgaagagatacagacagggcggtctggaagggtccagagcaggagcttctatctccatagagttggggttacgtcaccctctgggcacattctgtcagcctccacacgttcagctctcagaagctcccgaaccctgtcctttgggccttttatggagaactccattggctgtccatgactgaagcatggacaactgtgataatgtgattgggcaaaaagggtctgatctaagcccagcaaggccagtccagattctttgggcctttgtgcagcattcctttctccagggtatggggcaaggacccactctggaatgaggatcctacaacccacaatcagattagagtcctgccttgggcagctgaaaagaggacaggagaaggtcagagagacgaaaggctgttttttgaggcctgaggcaccccaacatgacaacgtaagactgtaaccatggtcatgtgagttatgagctaggaaccctggacgaaaccaacacatatacaatcatctcccacctcccaacgcctttactttcacagcctctgcagcaaactgcggtcactataatcgctcctgtggcacagaggcatacccaggggaatctgcccagggggccactctgtgcccacgtgggaacccacacctgcttgtaaagcctcccctccctctgaccagcaaccaggacagtttgttgttccaagcagtgggctcatgtctgttttggctcagaacagggtggggagagcgggccagggacccgcaggaaggcttatccttgagattgcgtgggagacacaacaaggggtgggggcccgcaggcggggcggggcgaagcaggtgatatcaagcccagagccccagcctctccccacagtctcaccatggcccgcaccgtggtgctcatcaccggctgttcctcgggcatcggcctgcacttggccgtacgtctggcttcagatccatcccagagcttcaaagtgtatgccacgttgagggacctgaaaacacagggccggctgtgggaggcggcccgggccctggcatgccctccgggatccctggagacgttgcagctggacgtaagggactcaaaatccgtggccgctgcccgggaacgcgtgactgagggccgcgtggacgtgctggtgtgtaacgcaggcctgggcctgctggggccgctggaggcgctgggggaggacgccgtggcctctgtgctggacgtgaatgtagtagggactgtgcggatgctgcaggccttcctgccagacatgaagaggcgcggttcgggacgcgtgttggtgaccgggagcgtgggaggattgatggtgggtgagtggtagggagtggcctcggcagctccagattctttgtgtgcggagctgagccttgaaggcaggttccgcggggggggtggagtggggtgccgtcagcttggaggggcaccgtctgcccggggatgaccccctggccgctgcgcctcaggaacctcgtctccccacctaagggctgcctttcaatgacgtttattgcgccagcaagttcgcgctcgaaggcttatgcgagagtctggcggttctgctgctgccctttggggtccagtgagtcaacacccccgttccccgaaccctcttaactctgacctagagacgccgagcaccctgtcctgcgggagccgctctggggcgatctccctggccctctctgcccggctcacattagctgtgtgccaggcacttgggctgggcgcatggcacgcattgtgccacctgctgacctagctgctgaagtgttggtattgttatggggaagctccagcccagagaggttaggtgactggcccaaggtcacacagcggccagggaccccgctagattcgaatcctgacaccagggctcccttgtagcctcagatggatttgggagggctgctccggcaggaacccgcgtttcaaatgttctggttatccccagcgccctttccgcctcacttccccagcgcagcggtgctgctcgcggtcgggggccgggacgtggttggggctgggactggggttggggctgggactggggcctggctggcgtccgccccctcccactcgttgctctccggccagcagcttgagcctgatcgagtgcggcccagtgcacaccgccttcatggagaaggtgttgggcagcccagaggaggtgctggaccgcacggacatccacaccttccaccgcttctaccaatacctcgccccgcagtaaaggcttcctcagccgctgtctcccgcgcccttctttgtcccctgggtctgtgtggtccctggggatggggcggcggtagcagctgtgggtggctaattaagatagatcgcgttagccagttttaccagcgcagctaggcgcgatgctgtcgcctgtaatgccagcgctttgggaggcggaggcaggaggatcgctcaagccccggagttggagaccagccagagcaacacagtgagacccccatctctacaaaaataaagaaaatttaaaaatcaa

SEQ ID NO: 446421 - DNA, 3127 bp, Homo sapiens
gtgacgaaacctggaccctgcctagtaaagaagggaggagagaaagaagagagagggggggcggggtcccagctctgtgctcgcgcccccagcgcgccagtcccggggctgcagggagcgcagcgcgcgcggcccgggccccggccaccggacgccctaccggacacgaccctccctggagcttggacaactgcccacctcggacgctgcaccggacactgccccccacagggctggacactccaacggacactacttcccagctccggacattgctccctcctctcccggggccctggacgcttttccccctcccccctccgggggcccagacactgagcccccctcagcgtctggctagcgtccccttgcaccccagcccaggacactgcctcctccctgtcctcttctcccttctgctcctcccacctcatctttcccctgctcgggtcggagccccgccagttcctccgaccccctactgctcggccgcggctgcccgcgcccccatccgcagctcctcgcccggatgcctctccccgggggactatggtggcttctctgctgccgtcgaggcttcactcttctgcaccgggactacggggacggcgagcttagcggggacggggacgaggacgaggacgaggaaacctttgagctgcggaccccgagtccagcgggcggcgggaggggtcccctggaagtgacgctgactcagccagtgaggagcgggcctgtctccaacaggctgcagagctgggaggagacttggagcctcatcccggagaaagggctgccggaggacgacccggacatcgttgtgaaaggttggctgtaccgggagccccgcggaggaggggcgcggccctggctgcccccgcgccgagcctggtttgtgctcacgcgggactccctggatcagttcagcagcagcgggaaaggggcgcggcgtctcgggagcctcgtgctcaccagcctgtgctcggtgaccggcccagagcgcaggcgtaaggagacaggtctgtggtcagtgactgtgtctggtcggaaacacagtgtccgcctctgctccccacgccaggcagaggctgagcgctggggggtggcattgcgggaagtgatcgcctccaaggcacccctggagacccccacccagctactgctcagggacatacaggaaagttgcggggacccagaggccgttgccctcatttacctgaggaacccgattctgagacacactagtggagccttgtatgccccactcctgcccctgccctatggagtcagcgccccaggtccgggctatgcacccctgcgcgaggaggcggtgcggctgttcttggcgctgcaggcgctggagggggcgcggcgccccgggcccttgatgcagggtgtgctccaaacctgccgggacttgcccgcgctccgggatgaactcttcctgcagctggctaagcagacctcgggccctgcaggtccccccgggctcccggctacccaagaccctgcggccctgcggtactggcaactcctcacctgcatgagctgcaccttccgacctgggggagctgtgcgggggcacctcctggggcacttggagaggaccgagcaggcactcccggactcggaactggcggaatatgcgcgcttcatccggaaagcgctgggccggacgcgcggcagagagctggtgccctcgctggcggagatttccgcgttgagccaacggcaggagctgctgtgtaccgtgcactgtccgggggctggtgcctgtgctgtggccatcgactcccacaccacggcgggggagggtggctcgagagctggtggggcggctgggcttggcccggagccgcaacgcattcgcgctgtacgagcagcgaggggcccaggagcgagccctggctggggggaccctcgtggccgacgtgctcaccaggtttgacttggccgcggaggaagctgggttggaggactcgcccgactccgggtggagactatgtctgcgtcttcacggacctctgcaccctgaggggctgtccccagacggtcacgaactgcctttcctctttgagcaggctcacgctctgctgctgcggggccggccgcccccacccgacgacacgctgcgcgccctggcggcgctgcgcctgcagagcctgcatcgggacttctctccgcgggtgcccctgccccgcctggaccgctgtcccgcgcgcggctcccgcccccggccccgccgcgcgaagacccgccccgcccgacccccaggccgcccccttccgctgccctgctggccggggcgctctggagcccgggcctggccaagaggcgggcggagcgggcccggcgcggcggggccggccgcactgcgggaagcattgcccgcgagggaggaggcggcgccggcacggcagctgccgtgctgggcggctggaagcggctacggggcatgggccgagctgaggccatggccgcctacctggccctggcggcgcagtgtccggggttcggcgctgctcggtatgacgttctggagctgagcacggagcctggtcggggtgctccacagaagctgtgcctgggcttgggagccaaggccatgtccctctcccggccaggggagacggagcccatccacagtgtcagctatggccatgtggccgcctgccagctaatgggcccccacaccctggccttgagggtgggagagagccagctcctcctgcagagcccccaggtggaagagatcatgcagctggtgaatgcctacttggccaacccctcccccgagaggccctgcagcagctcttctcctccatgccaagacctgccagacacctcccctcccagccagcgcccgggcctggacgagccccagggacagtctggctgcttggggcagctgcaggactgagcctgccaagaggtcacgacttccctcctgcctgcagcctgggccaggactgctctgagatttgagggaaacatggacccttttggccctgcagggacagggcacatcccacacccaagggctacaatgggtgtgggtaattttctagtttgtttcttaatttatttgtagaagagaagcaaaaaaaaaaaagtttcttatttacac

SEQ ID NO: 446422 - DNA, 1702 bp, Homo sapiens
gtgacgaaacctggaccctgcctagtaaagaagggaggagagaaagaagagagagggggggcggggtcccagctctgtgctcgcgcccccagcgcgccagtcccggggctgcagggagcgcagcgcgcgcggcccgggccccggccaccggacgccctaccggacacgaccctccctggagcttggacaactgcccacctcggacgctgcaccggacactgccccccacagggctggacactccaacggacactacttcccagctccggacattgctccctcctctcccggggccctggacgcttttccccctcccccctccgggggcccagacactgagcccccctcagcgtctggctagcgtccccttgcaccccagcccaggacactgcctcctccctgtcctcttctcccttctgctcctcccacctcatctttcccctgctcgggtcggagccccgccagttcctccgaccccctactgctcggccgcggctgcccgcgcccccatccgcagctcctcgcccggatgcctctccccgggggactatggtggcttctctgctgccgtcgaggcttcactcttctgcaccgggactacggggacggcgagcttagcggggacggggacgaggacgaggacgaggaaacctttgagctgcggaccccgagtccagcgggcggcgggaggggtcccctggaagtgacgctgactcagccagtgaggagcgggcctgtctccaacaggctgcagagctgggaggagacttggagcctcatcccggagaaagggctgccggaggacgacccggacatcgttgtgaaaggttggctgtaccgggagccccgcggaggaggggcgcggccctggctgcccccgcgccgagcctggtttgtgctcacgcgggactccctggatcagttcagcagcagcggggccggccgcactgcgggaagcattgcccgcgagggaggaggcggcgccggcacggcagctgccgtgctgggcggctggaagcggctacggggcatgggccgagctgaggccatggccgcctacctggccctggcggcgcagtgtccggggttcggcgctgctcggtatgacgttctggagctgagcacggagcctggtcggggtgctccacagaagctgtgcctgggcttgggagccaaggccatgtccctctcccggccaggggagacggagcccatccacagtgtcagctatggccatgtggccgcctgccagctaatgggcccccacaccctggccttgagggtgggagagagccagctcctcctgcagagcccccaggtggaagagatcatgcagctggtgaatgcctacttggccaacccctcccccgagaggccctgcagcagctcttctcctccatgccaagacctgccagacacctcccctcccagccagcgcccgggcctggacgagccccagggacagtctggctgcttggggcagctgcaggactgagcctgccaagaggtcacgacttccctcctgcctgcagcctgggccaggactgctctgagatttgagggaaacatggacccttttggccctgcagggacagggcacatcccacacccaagggctacaatgggtgtgggtaattttctagtttgtttcttaatttatttgtagaagagaagcaaaaaaaaaaaagtttcttatttacac

SEQ ID NO: 446423 - DNA, 3109 bp, Homo sapiens
  misc_feature (1815)..(1815): n is a, c, g, or t
  misc_feature (1826)..(1827): n is a, c, g, or t
  misc_feature (1829)..(1829): n is a, c, g, or t
  misc_feature (1835)..(1835): n is a, c, g, or t
  misc_feature (1838)..(1839): n is a, c, g, or t
  misc_feature (1849)..(1849): n is a, c, g, or t
  misc_feature (1854)..(1854): n is a, c, g, or t
  misc_feature (1884)..(1886): n is a, c, g, or t
  misc_feature (1909)..(1911): n is a, c, g, or t
  misc_feature (1921)..(1921): n is a, c, g, or t
  misc_feature (1926)..(1926): n is a, c, g, or t
  misc_feature (3061)..(3061): n is a, c, g, or t
  misc_feature (3073)..(3073): n is a, c, g, or t
gtgacgaaacctggaccctgcctagtaaagaagggaggagagaaagaagagagagggggggcggggtcccagctctgtgctcgcgcccccagcgcgccagtcccggggctgcagggagcgcagcgcgcgcggcccgggccccggccaccggacgccctaccggacacgaccctccctggagcttggacaactgcccacctcggacgctgcaccggacactgccccccacagggctggacactccaacggacactacttcccagctccggacattgctccctcctctcccggggccctggacgcttttccccctcccccctccgggggcccagacactgagcccccctcagcgtctggctagcgtccccttgcaccccagcccaggacactgcctcctccctgtcctcttctcccttctgctcctcccacctcatctttcccctgctcgggtcggagccccgccagttcctccgaccccctactgctcggccgcggctgcccgcgcccccatccgcagctcctcgcccggatgcctctccccgggggactatggtggcttctctgctgccgtcgaggcttcactcttctgcaccgggactacggggacggcgagcttagcggggacggggacgaggacgaggacgaggaaacctttgagctgcggaccccgagtccagcgggcggcgggaggggtcccctggaagtgacgctgactcagccagtgaggagcgggcctgtctccaacaggctgcagagctgggaggagacttggagcctcatcccggagaaagggctgccggaggacgacccggacatcgttgtgaaaggttggctgtaccgggagccccgcggaggaggggcgcggccctggctgcccccgcgccgagcctggtttgtgctcacgcgggactccctggatcagttcagcagcagcgggaaaggggcgcggcgtctcgggagcctcgtgctcaccagcctgtgctcggtgaccggcccagagcgcaggcgtaaggagacaggtctgtggtcagtgactgtgtctggtcggaaacacagtgtccgcctctgctccccacgccaggcagaggctgagcgctggggggtggcattgcgggaagtgatcgcctccaaggcacccctggagacccccacccagctactgctcagggacatacaggaaagttgcggggacccagaggccgttgccctcatttacctgaggaacccgattctgagacacactagtggagccttgtatgccccactcctgcccctgccctatggagtcagcgccccaggtccgggctatgcacccctgcgcgaggaggcggtgcggctgttcttggcgctgcaggcgctggagggggcgcggcgccccgggcccttgatgcagggtgtgctccaaacctgccgggacttgcccgcgctccgggatgaactcttcctgcagctggctaagcagacctcgggccctgcaggtccccccgggctcccggctacccaagaccctgcggccctgcggtactggcaactcctcacctgcatgagctgcaccttccgacctgggggagctgtgcgggggcacctcctggggcacttggagaggaccgagcaggcactcccggactcggaactggcggaatatgcgcgcttcatccggaaagcgctgggccggacgcgcggcagagagctggtgccctcgctggcggagatttccgcgttgagccaacggcaggagctgctgtgtaccgtgcactgtccgggggctggtgcctgtgctgtggccatcgactcccacaccacggcgggggaggnctctatatctnntntttctnctnntcttttcctnagccncaactcattctctctttactatcatctatnnncccaggatctagccctttcttgnnngacctctttnccgangtgctcaccagcttggccgcggaggaagctgggttggaggactcgcccgactccgggtggagactatgtctgcgtcttcacggacctctgcaccctgaggggctgtccccagacggtcacgaactgcctttcctctttgagcaggctcacgctctgctgctgcggggccggccgcccccacccgacgacacgctgcgcgccctggcggcgctgcgcctgcagagcctgcatcgggacttctctccgcgggtgcccctgccccgcctggaccgctgtcccgcgcgcggctcccgcccccggccccgccgcgcgaagacccgccccgcccgacccccaggccgcccccttccgctgccctgctggccggggcgctctggagcccgggcctggccaagaggcgggcggagcgggcccggcgcggcggggccggccgcactgcgggaagcattgcccgcgagggaggaggcggcgccggcacggcagctgccgtgctgggcggctggaagcggctacggggcatgggccgagctgaggccatggccgcctacctggccctggcggcgcagtgtccggggttcggcgctgctcggtatgacgttctggagctgagcacggagcctggtcggggtgctccacagaagctgtgcctgggcttgggagccaaggccatgtccctctcccggccaggggagacggagcccatccacagtgtcagctatggccatgtggccgcctgccagctaatgggcccccacaccctggccttgagggtgggagagagccagctcctcctgcagagcccccaggtggaagagatcatgcagctggtgaatgcctacttggccaacccctcccccgagaggccctgcagcagctcttctcctccatgccaagacctgccagacacctcccctcccagccagcgcccgggcctggacgagccccagggacagtctggctgcttggggcagctgcaggactgagcctgccaagaggtcacgacttccctcctgcctgcagcctgggccaggactgctctgagatttgagggaaacatggacccttttggccctgcagggacagggcacatcccacacccaagggctacaatgggtgtgggtaatttctctgcctntgtgattttgtnatttcaagaatgcttgataaatggaaacacacagta

SEQ ID NO: 446424 - DNA, 2397 bp, Homo sapiens
gtgacgaaacctggaccctgcctagtaaagaagggaggagagaaagaagagagagggggggcggggtcccagctctgtgctcgcgcccccagcgcgccagtcccggggctgcagggagcgcagcgcgcgcggcccgggccccggccaccggacgccctaccggacacgaccctccctggagcttggacaactgcccacctcggacgctgcaccggacactgccccccacagggctggacactccaacggacactacttcccagctccggacattgctccctcctctcccggggccctggacgcttttccccctcccccctccgggggcccagacactgagcccccctcagcgtctggctagcgtccccttgcaccccagcccaggacactgcctcctccctgtcctcttctcccttctgctcctcccacctcatctttcccctgctcgggtcggagccccgccagttcctccgaccccctactgctcggccgcggctgcccgcgcccccatccgcagctcctcgcccggatgcctctccccgggggactatggtggcttctctgctgccgtcgaggcttcactcttctgcaccgggactacggggacggcgagcttagcggggacggggacgaggacgaggacgaggaaacctttgagctgcggaccccgagtccagcgggcggcgggaggggtcccctggaagtgacgctgactcagccagtgaggagcgggcctgtctccaacaggctgcagagctgggaggagacttggagcctcatcccggagaaagggctgccggaggacgacccggacatcgttgtgaaaggttggctgtaccgggagccccgcggaggaggggcgcggccctggctgcccccgcgccgagcctggtttgtgctcacgcgggactccctggatcagttcagcagcagcgggaaaggggcgcggcgtctcgggagcctcgtgctcaccagcctgtgctcggtgaccggcccagagcgcaggcgtaaggagacaggtctgtggtcagtgactgtgtctggtcggaaacacagtgtccgcctctgctccccacgccaggcagaggctgagcgctggggggtggcattgcgggaagtgatcgcctccaaggcacccctggagacccccacccagctactgctcagggacatacaggaaagttgcggggacccagaggccgttgccctcatttacctgaggaacccgattctgagacacactagtggagccttgtatgccccactcctgcccctgccctatggagtcagcgccccaggtccgggctatgcacccctgcgcgaggaggcggtgcggctgttcttggcgctgcaggcgctggagggggcgcggcgccccgggcccttgatgcagggtgtgctccaaacctgccgggacttgcccgcgctccgggatgaactcttcctgcagctggctaagcagacctcgggccctgcaggtccccccgggctcccggctacccaagaccctgcggccctgcggtactggcaactcctcacctgcatgagctgcaccttccgacctgggggagctgtgcgggggcacctcctggggcacttggagaggaccgagcaggcactcccggactcggaactggcggaatatgcgcgcttcatccggaaagcgctgggccggacgcgcggcagagagctggtgccctcgctggcggagatttccgcgttgagccaacggcaggagctgctgtgtaccgtgcactgtccgggggctggtgcctgtgctgtggccatcgactcccacaccacggcgggggagggtggctcgagagctggtggggcggctgggcttggcccggagccgcaacgcattcgcgctgtacgagcagcgaggggcccaggagcgagccctggctggggggaccctcgtggccgacgtgctcaccaggtttgacttggccgcggaggaagctgggttggaggactcgcccgactccgggtggagactatgtctgcgtcttcacggacctctgcaccctgaggggctgtccccagacggtcacgaactgcctttcctctttgagcagctcttctcctccatgccaagacctgccagacacctcccctcccagccagcgcccgggcctggacgagccccagggacagtctggctgcttggggcagctgcaggactgagcctgccaagaggtcacgacttccctcctgcctgcagcctgggccaggactgctctgagatttgagggaaacatggacccttttggccctgcagggacagggcacatcccacacccaagggctacaatgggtgtgggtaattttctagtttgtttcttaatttatttgtagaagagaagcaaaaaaaaaaaagtttcttatttacac

SEQ ID NO: 446425 - DNA, 3039 bp, Homo sapiens
  misc_feature (1815)..(1815): n is a, c, g, or t
  misc_feature (1826)..(1827): n is a, c, g, or t
  misc_feature (1829)..(1829): n is a, c, g, or t
  misc_feature (1835)..(1835): n is a, c, g, or t
  misc_feature (1838)..(1839): n is a, c, g, or t
  misc_feature (1849)..(1849): n is a, c, g, or t
  misc_feature (1854)..(1854): n is a, c, g, or t
  misc_feature (1884)..(1886): n is a, c, g, or t
  misc_feature (1909)..(1911): n is a, c, g, or t
  misc_feature (1921)..(1921): n is a, c, g, or t
  misc_feature (1926)..(1926): n is a, c, g, or t
gtgacgaaacctggaccctgcctagtaaagaagggaggagagaaagaagagagagggggggcggggtcccagctctgtgctcgcgcccccagcgcgccagtcccggggctgcagggagcgcagcgcgcgcggcccgggccccggccaccggacgccctaccggacacgaccctccctggagcttggacaactgcccacctcggacgctgcaccggacactgccccccacagggctggacactccaacggacactacttcccagctccggacattgctccctcctctcccggggccctggacgcttttccccctcccccctccgggggcccagacactgagcccccctcagcgtctggctagcgtccccttgcaccccagcccaggacactgcctcctccctgtcctcttctcccttctgctcctcccacctcatctttcccctgctcgggtcggagccccgccagttcctccgaccccctactgctcggccgcggctgcccgcgcccccatccgcagctcctcgcccggatgcctctccccgggggactatggtggcttctctgctgccgtcgaggcttcactcttctgcaccgggactacggggacggcgagcttagcggggacggggacgaggacgaggacgaggaaacctttgagctgcggaccccgagtccagcgggcggcgggaggggtcccctggaagtgacgctgactcagccagtgaggagcgggcctgtctccaacaggctgcagagctgggaggagacttggagcctcatcccggagaaagggctgccggaggacgacccggacatcgttgtgaaaggttggctgtaccgggagccccgcggaggaggggcgcggccctggctgcccccgcgccgagcctggtttgtgctcacgcgggactccctggatcagttcagcagcagcgggaaaggggcgcggcgtctcgggagcctcgtgctcaccagcctgtgctcggtgaccggcccagagcgcaggcgtaaggagacaggtctgtggtcagtgactgtgtctggtcggaaacacagtgtccgcctctgctccccacgccaggcagaggctgagcgctggggggtggcattgcgggaagtgatcgcctccaaggcacccctggagacccccacccagctactgctcagggacatacaggaaagttgcggggacccagaggccgttgccctcatttacctgaggaacccgattctgagacacactagtggagccttgtatgccccactcctgcccctgccctatggagtcagcgccccaggtccgggctatgcacccctgcgcgaggaggcggtgcggctgttcttggcgctgcaggcgctggagggggcgcggcgccccgggcccttgatgcagggtgtgctccaaacctgccgggacttgcccgcgctccgggatgaactcttcctgcagctggctaagcagacctcgggccctgcaggtccccccgggctcccggctacccaagaccctgcggccctgcggtactggcaactcctcacctgcatgagctgcaccttccgacctgggggagctgtgcgggggcacctcctggggcacttggagaggaccgagcaggcactcccggactcggaactggcggaatatgcgcgcttcatccggaaagcgctgggccggacgcgcggcagagagctggtgccctcgctggcggagatttccgcgttgagccaacggcaggagctgctgtgtaccgtgcactgtccgggggctggtgcctgtgctgtggccatcgactcccacaccacggcgggggaggnctctatatctnntntttctnctnntcttttcctnagccncaactcattctctctttactatcatctatnnncccaggatctagccctttcttgnnngacctctttnccgangtgctcaccagcttggccgcggaggaagctgggttggaggactcgcccgactccgggtggagactatgtctgcgtcttcacggacctctgcaccctgaggggctgtccccagacggtcacgaactgcctttcctctttgagcaggctcacgctctgctgctgcggggccggccgcccccacccgacgacacgctgcgcgccctggcggcgctgcgcctgcagagcctgcatcgggacttctctccgcgggtgcccctgccccgcctggaccgctgtcccgcgcgcggctcccgcccccggccccgccgcgcgaagacccgccccgcccgacccccaggccgcccccttccgctgccctgctggccggggcgctctggagcccgggcctggccaagaggcgggcggagcgggcccggcgcggcggggccggccgcactgcgggaagcattgcccgcgagggaggaggcggcgccggcacggcagctgccgtgctgggcggctggaagcggctacggggcatgggccgagctgaggccatggccgcctacctggccctggcggcgcagtgtccggggttcggcgctgctcggtatgacgttctggagctgagcacggagcctggtcggggtgctccacagaagctgtgcctgggcttgggagccaaggccatgtccctctcccggccaggggagacggagcccatccacagtgtcagctatggccatgtggccgcctgccagctaatgggcccccacaccctggccttgagggtgggagagagccagctcctcctgcagagcccccaggtggaagagatcatgcagctggtgaatgcctacttggccaacccctcccccgagaggccctgcagcagctcttctcctccatgccaagacctgccagacacctcccctcccagccagcgcccgggcctggacgagccccagggacagtctggctgcttggggcagctgcaggactgagcctgccaagaggtcacgacttccctcctgcctgcagcctgggccaggactgctctgagatttgaggggaaaagaccctggtgtgatccttcgtaaagctcgaactgcagtgcatgcaatgcttgtgcac

SEQ ID NO: 446426 - DNA, 2256 bp, Homo sapiens
ctgggctccaacaatcccctttcctgggcctcccaaagtgctgggattagaggcatgagccaccgtgcccagcctcaaagcatattttaaaggatagaaataaacagccatatgaagagatacagacagggcggtctggaagggtccagagcaggagcttctatctccatagagttggggttacgtcaccctctgggcacattctgtcagcctccacacgttcagctctcagaagctcccgaaccctgtcctttgggccttttatggagaactccattggctgtccatgactgaagcatggacaactgtgataatgtgattgggcaaaaagggtctgatctaagcccagcaaggccagtccagattctttgggcctttgtgcagcattcctttctccagggtatggggcaaggacccactctggaatgaggatcctacaacccacaatcagattagagtcctgccttgggcagctgaaaagaggacaggagaaggtcagagagacgaaaggctgttttttgaggcctgaggcaccccaacatgacaacgtaagactgtaaccatggtcatgtgagttatgagctaggaaccctggacgaaaccaacacatatacaatcatctcccacctcccaacgcctttactttcacagcctctgcagcaaactgcggtcactataatcgctcctgtggcacagaggcatacccaggggaatctgcccagggggccactctgtgcccacgtgggaacccacacctgcttgtaaagcctcccctccctctgaccagcaaccaggacagtttgttgttccaagcagtgggctcatgtctgttttggctcagaacagggtggggagagcgggccagggacccgcaggaaggcttatccttgagattgcgtgggagacacaacaaggggtgggggcccgcaggcggggcggggcgaagcaggtgatatcaagcccagagccccagcctctccccacagtctcaccatggcccgcaccgtggtgctcatcaccggctgttcctcgggcatcggcctgcacttggccgtacgtctggcttcagatccatcccagagcttcaaagtgtatgccacgttgagggacctgaaaacacagggccggctgtgggaggcggcccgggccctggcatgccctccgggatccctggagacgttgcagctggacgtaagggactcaaaatccgtggccgctgcccgggaacgcgtgactgagggccgcgtggacgtgctggtgtgtaacgcaggcctgggcctgctggggccgctggaggcgctgggggaggacgccgtggcctctgtgctggacgtgaatgtagtagggactgtgcggatgctgcaggccttcctgccagacatgaagaggcgcggttcgggacgcgtgttggtgaccgggagcgtgggaggattgatggggctgcctttcaatgacgtttattgcgccagcaagttcgcgctcgaaggcttatgcgagagtctggcggttctgctgctgccctttggggtccacttgagcctgatcgagtgcggcccagtgcacaccgccttcatggagaaggtgttgggcagcccagaggaggtgctggaccgcacggacatccacaccttccaccgcttctaccaatacctcgcccacagcaagcaagtctttcgcgaggcggcgcagaaccctgaggaggtggcggaggtcttcctcaccgctttgcgcgccccgaagccgaccctgcgctacttcaccaccgagcgcttcctgcccctgctgcggatgcgcctggacgaccccagcggctccaactacgtcaccgccatgcaccgggaagtgttcggcgacgttccggcaaaggccgaggctggggccgaggctgggggcggggccgggcctggggcagaggacgaggccgggcgcggtgcggtgggggaccctgagctcggcgatcctccggccgccccgcagtaaaggcttcctcagccgctgtctcccgcgcccttctttgtcccctgggtctgtgtggtccctggggatggggcggcggtagcagctgtgggtggctaattaagatagatcgcgttagccagttttaccagcgcagctaggcgcgatgctgtcgcctgtaatgccagcgctttgggaggcggaggcaggaggatcgctcaagccccggagttggagaccagccagagcaacacagtgagacccccatctctacaaaaataaagaaaatttaaaaatcaa

SEQ ID NO: 446427 - DNA, 430 bp, Homo sapiens
gaccgccagtggttggagggatgtctctagtagttgaatttgagtggcctggtaagcgcgcggcccgaggctgagcagcatgaccggcggcgggacgtgtgtgcgtggccgtcctcccgcttcccgggagaggggacgccacgtccacagagcaggcttggccagggcagtggtaggacagggctgtggaggcccacgtgtggacggcgccagccagaagcaggcctgccaagaggtcacgacttccctcctgcctgcagcctgggccaggactgctctgagatttgagggaaacatggacccttttggccctgcagggacagggcacatcccacacccaagggctacaatgggtgtgggtaattttctagtttgtttcttaatttatttgtagaagagaagcaaaaaaaaaaaagtttcttatttacac

SEQ ID NO: 446428 - DNA, 3281 bp, Homo sapiens
ctgggctccaacaatcccctttcctgggcctcccaaagtgctgggattagaggcatgagccaccgtgcccagcctcaaagcatattttaaaggatagaaataaacagccatatgaagagatacagacagggcggtctggaagggtccagagcaggagcttctatctccatagagttggggttacgtcaccctctgggcacattctgtcagcctccacacgttcagctctcagaagctcccgaaccctgtcctttgggccttttatggagaactccattggctgtccatgactgaagcatggacaactgtgataatgtgattgggcaaaaagggtctgatctaagcccagcaaggccagtccagattctttgggcctttgtgcagcattcctttctccagggtatggggcaaggacccactctggaatgaggatcctacaacccacaatcagattagagtcctgccttgggcagctgaaaagaggacaggagaaggtcagagagacgaaaggctgttttttgaggcctgaggcaccccaacatgacaacgtaagactgtaaccatggtcatgtgagttatgagctaggaaccctggacgaaaccaacacatatacaatcatctcccacctcccaacgcctttactttcacagcctctgcagcaaactgcggtcactataatcgctcctgtggcacagaggcatacccaggggaatctgcccagggggccactctgtgcccacgtgggaacccacacctgcttgtaaagcctcccctccctctgaccagcaaccaggacagtttgttgttccaagcagtgggctcatgtctgttttggctcagaacagggtggggagagcgggccagggacccgcaggaaggcttatccttgagattgcgtgggagacacaacaaggggtgggggcccgcaggcggggcggggcgaagcaggtgatatcaagcccagagccccagcctctccccacagtctcaccatggcccgcaccgtggtgctcatcaccggctgttcctcgggcatcggcctgcacttggccgtacgtctggcttcagatccatcccagagcttcaaaggtatagataggcagggacagggagggagagaagggaggagcccttggaggccagaagggaagtcagatcttcctcctctcccaaaacctccagtgtatgccacgttgagggacctgaaaacacagggccggctgtgggaggcggcccgggccctggcatgccctccgggatccctggagacgttgcagctggacgtaagggactcaaaatccgtggccgctgcccgggaacgcgtgactgagggccgcgtggacgtgctgggtgagcctcctggaagcatatgggctcctaggagccttctccgccctgcgttgaaaccaacatgttcccaggcccagggagcacgaggggacaggccgtgctgagggtgatgctgaggcgggctggtcgggcctcttgtctccgcagtgttgtgtaacgcaggcctgggcctgctggggccgctggaggcgctgggggaggacgccgtggcctctgtgctggacgtgaatgtagtagggactgtgcggatgctgcaggccttcctgccagacatgaagaggcgcggttcgggacgcgtgttggtgaccgggagcgtgggaggattgatggtgggtgagtggtagggagtggcctcggcagctccagattctttgtgtgcggagctgagccttgaaggcaggttccgcggggggggtggagtggggtgccgtcagcttggaggggcaccgtctgcccggggatgaccccctggccgctgcgcctcaggaacctcgtctccccacctaagggctgcctttcaatgacgtttattgcgccagcaagttcgcgctcgaaggcttatgcgagagtctggcggttctgctgctgccctttggggtccagtgagtcaacacccccgttccccgaaccctcttaactctgacctagagacgccgagcaccctgtcctgcgggagccgctctggggcgatctccctggccctctctgcccggctcacattagctgtgtgccaggcacttgggctgggcgcatggcacgcattgtgccacctgctgacctagctgctgaagtgttggtattgttatggggaagctccagcccagagaggttaggtgactggcccaaggtcacacagcggccagggaccccgctagattcgaatcctgacaccagggctcccttgtagcctcagatggatttgggagggctgctccggcaggaacccgcgtttcaaatgttctggttatccccagcgccctttccgcctcacttccccagcgcagcggtgctgctcgcggtcgggggccgggacgtggttggggctgggactggggttggggctgggactggggcctggctggcgtccgccccctcccactcgttgctctccggccagcagcttgagcctgatcgagtgcggcccagtgcacaccgccttcatggagaaggtgttgggcagcccagaggaggtgctggaccgcacggacatccacaccttccaccgcttctaccaatacctcgcccacagcaagcaagtctttcgcgaggcggcgcagaaccctgaggaggtggcggaggtgagcgccgggctggactccaggagtgggggcggtgcgtcctccggcgcgcagcggtggccacagctctcctcccgccgccgcaggtcttcctcaccgctttgcgcgccccgaagccgaccctgcgctacttcaccaccgagcgcttcctgcccctgctgcggatgcgcctggacgaccccagcggctccaactacgtcaccgccatgcaccgggaagtgttcggcgacgttccggcaaaggccgaggctggggccgaggctgggggcggggccgggcctggggcagaggacgaggccgggcgcggtgcggtgggggaccctgagctcggcgatcctccggccgccccgcagtaaaggcttcctcagccgctgtctcccgcgcccttctttgtcccctgggtctgtgtggtccctggggatggggcggcggtagcagctgtgggtggctaattaagatagatcgcgttagccagttttaccagcgcagctaggcgcgatgctgtcgcctgtaatgccagcgctttgggaggcggaggcaggaggatcgctcaagccccggagttggagaccagccagagcaacacagtgagacccccatctctacaaaaataaagaaaatttaaaaatcaa

SEQ ID NO: 446429 - DNA, 3131 bp, Homo sapiens
ctgggctccaacaatcccctttcctgggcctcccaaagtgctgggattagaggcatgagccaccgtgcccagcctcaaagcatattttaaaggatagaaataaacagccatatgaagagatacagacagggcggtctggaagggtccagagcaggagcttctatctccatagagttggggttacgtcaccctctgggcacattctgtcagcctccacacgttcagctctcagaagctcccgaaccctgtcctttgggccttttatggagaactccattggctgtccatgactgaagcatggacaactgtgataatgtgattgggcaaaaagggtctgatctaagcccagcaaggccagtccagattctttgggcctttgtgcagcattcctttctccagggtatggggcaaggacccactctggaatgaggatcctacaacccacaatcagattagagtcctgccttgggcagctgaaaagaggacaggagaaggtcagagagacgaaaggctgttttttgaggcctgaggcaccccaacatgacaacgtaagactgtaaccatggtcatgtgagttatgagctaggaaccctggacgaaaccaacacatatacaatcatctcccacctcccaacgcctttactttcacagcctctgcagcaaactgcggtcactataatcgctcctgtggcacagaggcatacccaggggaatctgcccagggggccactctgtgcccacgtgggaacccacacctgcttgtaaagcctcccctccctctgaccagcaaccaggacagtttgttgttccaagcagtgggctcatgtctgttttggctcagaacagggtggggagagcgggccagggacccgcaggaaggcttatccttgagattgcgtgggagacacaacaaggggtgggggcccgcaggcggggcggggcgaagcaggtgatatcaagcccagagccccagcctctccccacagtctcaccatggcccgcaccgtggtgctcatcaccggctgttcctcgggcatcggcctgcacttggccgtacgtctggcttcagatccatcccagagcttcaaaggtatagataggcagggacagggagggagagaagggaggagcccttggaggccagaagggaagtcagatcttcctcctctcccaaaacctccagtgtatgccacgttgagggacctgaaaacacagggccggctgtgggaggcggcccgggccctggcatgccctccgggatccctggagacgttgcagctggacgtaagggactcaaaatccgtggccgctgcccgggaacgcgtgactgagggccgcgtggacgtgctggtgtgtaacgcaggcctgggcctgctggggccgctggaggcgctgggggaggacgccgtggcctctgtgctggacgtgaatgtagtagggactgtgcggatgctgcaggccttcctgccagacatgaagaggcgcggttcgggacgcgtgttggtgaccgggagcgtgggaggattgatggtgggtgagtggtagggagtggcctcggcagctccagattctttgtgtgcggagctgagccttgaaggcaggttccgcggggggggtggagtggggtgccgtcagcttggaggggcaccgtctgcccggggatgaccccctggccgctgcgcctcaggaacctcgtctccccacctaagggctgcctttcaatgacgtttattgcgccagcaagttcgcgctcgaaggcttatgcgagagtctggcggttctgctgctgccctttggggtccagtgagtcaacacccccgttccccgaaccctcttaactctgacctagagacgccgagcaccctgtcctgcgggagccgctctggggcgatctccctggccctctctgcccggctcacattagctgtgtgccaggcacttgggctgggcgcatggcacgcattgtgccacctgctgacctagctgctgaagtgttggtattgttatggggaagctccagcccagagaggttaggtgactggcccaaggtcacacagcggccagggaccccgctagattcgaatcctgacaccagggctcccttgtagcctcagatggatttgggagggctgctccggcaggaacccgcgtttcaaatgttctggttatccccagcgccctttccgcctcacttccccagcgcagcggtgctgctcgcggtcgggggccgggacgtggttggggctgggactggggttggggctgggactggggcctggctggcgtccgccccctcccactcgttgctctccggccagcagcttgagcctgatcgagtgcggcccagtgcacaccgccttcatggagaaggtgttgggcagcccagaggaggtgctggaccgcacggacatccacaccttccaccgcttctaccaatacctcgcccacagcaagcaagtctttcgcgaggcggcgcagaaccctgaggaggtggcggaggtgagcgccgggctggactccaggagtgggggcggtgcgtcctccggcgcgcagcggtggccacagctctcctcccgccgccgcaggtcttcctcaccgctttgcgcgccccgaagccgaccctgcgctacttcaccaccgagcgcttcctgcccctgctgcggatgcgcctggacgaccccagcggctccaactacgtcaccgccatgcaccgggaagtgttcggcgacgttccggcaaaggccgaggctggggccgaggctgggggcggggccgggcctggggcagaggacgaggccgggcgcggtgcggtgggggaccctgagctcggcgatcctccggccgccccgcagtaaaggcttcctcagccgctgtctcccgcgcccttctttgtcccctgggtctgtgtggtccctggggatggggcggcggtagcagctgtgggtggctaattaagatagatcgcgttagccagttttaccagcgcagctaggcgcgatgctgtcgcctgtaatgccagcgctttgggaggcggaggcaggaggatcgctcaagccccggagttggagaccagccagagcaacacagtgagacccccatctctacaaaaataaagaaaatttaaaaatcaa

SEQ ID NO: 446430 - DNA, 2263 bp, Homo sapiens
gtgacgaaacctggaccctgcctagtaaagaagggaggagagaaagaagagagagggggggcggggtcccagctctgtgctcgcgcccccagcgcgccagtcccggggctgcagggagcgcagcgcgcgcggcccgggccccggccaccggacgccctaccggacacgaccctccctggagcttggacaactgcccacctcggacgctgcaccggacactgccccccacagggctggacactccaacggacactacttcccagctccggacattgctccctcctctcccggggccctggacgcttttccccctcccccctccgggggcccagacactgagcccccctcagcgtctggctagcgtccccttgcaccccagcccaggacactgcctcctccctgtcctcttctcccttctgctcctcccacctcatctttcccctgctcgggtcggagccccgccagttcctccgaccccctactgctcggccgcggctgcccgcgcccccatccgcagctcctcgcccggatgcctctccccgggggactatggtggcttctctgctgccgtcgaggcttcactcttctgcaccgggactacggggacggcgagcttagcggggacggggacgaggacgaggacgaggaaacctttgagctgcggaccccgagtccagcgggcggcgggaggggtcccctggaagtgacgctgactcagccagtgaggagcgggcctgtctccaacaggctgcagagctgggaggagacttggagcctcatcccggagaaagggctgccggaggacgacccggacatcgttgtgaaaggttggctgtaccgggagccccgcggaggaggggcgcggccctggctgcccccgcgccgagcctggtttgtgctcacgcgggactccctggatcagttcagcagcagcgggaaaggggcgcggcgtctcgggagcctcgtgctcaccagcctgtgctcggtgaccggcccagagcgcaggcgtaaggagacaggtctgtggtcagtgactgtgtctggtcggaaacacagtgtccgcctctgctccccacgccaggcagaggctgagcgctggggggtggcattgcgggaagtgatcgcctccaaggcacccctggagacccccacccagctactgctcagggacatacaggaaagttgcggggacccagaggccgttgccctcatttacctgaggaacccgattctgagacacactagtggagccttgtatgccccactcctgcccctgccctatggagtcagcgccccaggtccgggctatgcacccctgcgcgaggaggcggtgcggctgttcttggcgctgcaggcgctggagggggcgcggcgccccgggcccttgatgcagggtgtgctccaaacctgccgggacttgcccgcgctccgggatgaactcttcctgcagctggctaagcagacctcgggccctgcaggtccccccgggctcccggctacccaagaccctgcggccctgcggtactggcaactcctcacctgcatgagctgcaccttccgacctgggggagctgtgcgggggcacctcctggggcacttggagaggaccgagcaggcactcccggactcggaactggcggaatatgcgcgcttcatccggaaagcgctgggccggacgcgcggcagagagctggtgccctcgctggcggagatttccgcgttgagccaacggcaggagctgctgtgtaccgtgcactgtccgggggctggtgcctgtgctgtggccatcgactcccacaccacggcgggggagggtggctcgagagctggtggggcggctgggcttggcccggagccgcaacgcattcgcgctgtacgagcagcgaggggcccaggagcgagccctggctggggggaccctcgtggccgacgtgctcaccaggtttgacttggccgcggaggaagctgggttggaggactcgcccgactccgggtggagactatgtctgcgtcttcacggacctctgcaccctgaggggctgtccccagacggtcagcctgccaagaggtcacgacttccctcctgcctgcagcctgggccaggactgctctgagatttgagggaaacatggacccttttggccctgcagggacagggcacatcccacacccaagggctacaatgggtgtgggtaattttctagtttgtttcttaatttatttgtagaagagaagcaaaaaaaaaaaagtttcttatttacac

SEQ ID NO: 446431 - DNA, 3116 bp, Homo sapiens
  misc_feature (1815)..(1815): n is a, c, g, or t
  misc_feature (1826)..(1827): n is a, c, g, or t
  misc_feature (1829)..(1829): n is a, c, g, or t
  misc_feature (1835)..(1835): n is a, c, g, or t
  misc_feature (1838)..(1839): n is a, c, g, or t
  misc_feature (1849)..(1849): n is a, c, g, or t
  misc_feature (1854)..(1854): n is a, c, g, or t
  misc_feature (1884)..(1886): n is a, c, g, or t
  misc_feature (1909)..(1911): n is a, c, g, or t
  misc_feature (1921)..(1921): n is a, c, g, or t
  misc_feature (1926)..(1926): n is a, c, g, or t
gtgacgaaacctggaccctgcctagtaaagaagggaggagagaaagaagagagagggggggcggggtcccagctctgtgctcgcgcccccagcgcgccagtcccggggctgcagggagcgcagcgcgcgcggcccgggccccggccaccggacgccctaccggacacgaccctccctggagcttggacaactgcccacctcggacgctgcaccggacactgccccccacagggctggacactccaacggacactacttcccagctccggacattgctccctcctctcccggggccctggacgcttttccccctcccccctccgggggcccagacactgagcccccctcagcgtctggctagcgtccccttgcaccccagcccaggacactgcctcctccctgtcctcttctcccttctgctcctcccacctcatctttcccctgctcgggtcggagccccgccagttcctccgaccccctactgctcggccgcggctgcccgcgcccccatccgcagctcctcgcccggatgcctctccccgggggactatggtggcttctctgctgccgtcgaggcttcactcttctgcaccgggactacggggacggcgagcttagcggggacggggacgaggacgaggacgaggaaacctttgagctgcggaccccgagtccagcgggcggcgggaggggtcccctggaagtgacgctgactcagccagtgaggagcgggcctgtctccaacaggctgcagagctgggaggagacttggagcctcatcccggagaaagggctgccggaggacgacccggacatcgttgtgaaaggttggctgtaccgggagccccgcggaggaggggcgcggccctggctgcccccgcgccgagcctggtttgtgctcacgcgggactccctggatcagttcagcagcagcgggaaaggggcgcggcgtctcgggagcctcgtgctcaccagcctgtgctcggtgaccggcccagagcgcaggcgtaaggagacaggtctgtggtcagtgactgtgtctggtcggaaacacagtgtccgcctctgctccccacgccaggcagaggctgagcgctggggggtggcattgcgggaagtgatcgcctccaaggcacccctggagacccccacccagctactgctcagggacatacaggaaagttgcggggacccagaggccgttgccctcatttacctgaggaacccgattctgagacacactagtggagccttgtatgccccactcctgcccctgccctatggagtcagcgccccaggtccgggctatgcacccctgcgcgaggaggcggtgcggctgttcttggcgctgcaggcgctggagggggcgcggcgccccgggcccttgatgcagggtgtgctccaaacctgccgggacttgcccgcgctccgggatgaactcttcctgcagctggctaagcagacctcgggccctgcaggtccccccgggctcccggctacccaagaccctgcggccctgcggtactggcaactcctcacctgcatgagctgcaccttccgacctgggggagctgtgcgggggcacctcctggggcacttggagaggaccgagcaggcactcccggactcggaactggcggaatatgcgcgcttcatccggaaagcgctgggccggacgcgcggcagagagctggtgccctcgctggcggagatttccgcgttgagccaacggcaggagctgctgtgtaccgtgcactgtccgggggctggtgcctgtgctgtggccatcgactcccacaccacggcgggggaggnctctatatctnntntttctnctnntcttttcctnagccncaactcattctctctttactatcatctatnnncccaggatctagccctttcttgnnngacctctttnccgangtgctcaccagcttggccgcggaggaagctgggttggaggactcgcccgactccgggtggagactatgtctgcgtcttcacggacctctgcaccctgaggggctgtccccagacggtcacgaactgcctttcctctttgagcaggctcacgctctgctgctgcggggccggccgcccccacccgacgacacgctgcgcgccctggcggcgctgcgcctgcagagcctgcatcgggacttctctccgcgggtgcccctgccccgcctggaccgctgtcccgcgcgcggctcccgcccccggccccgccgcgcgaagacccgccccgcccgacccccaggccgcccccttccgctgccctgctggccggggcgctctggagcccgggcctggccaagaggcgggcggagcgggcccggcgcggcggggccggccgcactgcgggaagcattgcccgcgagggaggaggcggcgccggcacggcagctgccgtgctgggcggctggaagcggctacggggcatgggccgagctgaggccatggccgcctacctggccctggcggcgcagtgtccggggttcggcgctgctcggtatgacgttctggagctgagcacggagcctggtcggggtgctccacagaagctgtgcctgggcttgggagccaaggccatgtccctctcccggccaggggagacggagcccatccacagtgtcagctatggccatgtggccgcctgccagctaatgggcccccacaccctggccttgagggtgggagagagccagctcctcctgcagagcccccaggtggaagagatcatgcagctggtgaatgcctacttggccaacccctcccccgagaggccctgcagcagctcttctcctccatgccaagacctgccagacacctcccctcccagccagcgcccgggcctggacgagccccagggacagtctggctgcttggggcagctgcaggactgagcctgccaagaggtcacgacttccctcctgcctgcagcctgggccaggactgctctgagatttgagggaaacatggacccttttggccctgcagggacagggcacatcccacacccaagggctacaatgggtgtgggtaattttctagtttgtttcttaatttatttgtagaagagaagcaaaaaaaaaaaagtttcttatttacac

SEQ ID NO: 446432 - DNA, 2163 bp, Homo sapiens
ctgggctccaacaatcccctttcctgggcctcccaaagtgctgggattagaggcatgagccaccgtgcccagcctcaaagcatattttaaaggatagaaataaacagccatatgaagagatacagacagggcggtctggaagggtccagagcaggagcttctatctccatagagttggggttacgtcaccctctgggcacattctgtcagcctccacacgttcagctctcagaagctcccgaaccctgtcctttgggccttttatggagaactccattggctgtccatgactgaagcatggacaactgtgataatgtgattgggcaaaaagggtctgatctaagcccagcaaggccagtccagattctttgggcctttgtgcagcattcctttctccagggtatggggcaaggacccactctggaatgaggatcctacaacccacaatcagattagagtcctgccttgggcagctgaaaagaggacaggagaaggtcagagagacgaaaggctgttttttgaggcctgaggcaccccaacatgacaacgtaagactgtaaccatggtcatgtgagttatgagctaggaaccctggacgaaaccaacacatatacaatcatctcccacctcccaacgcctttactttcacagcctctgcagcaaactgcggtcactataatcgctcctgtggcacagaggcatacccaggggaatctgcccagggggccactctgtgcccacgtgggaacccacacctgcttgtaaagcctcccctccctctgaccagcaaccaggacagtttgttgttccaagcagtgggctcatgtctgttttggctcagaacagggtggggagagcgggccagggacccgcaggaaggcttatccttgagattgcgtgggagacacaacaaggggtgggggcccgcaggcggggcggggcgaagcaggtgatatcaagcccagagccccagcctctccccacagtctcaccatggcccgcaccgtggtgctcatcaccggctgttcctcgggcatcggcctgcacttggccgtacgtctggcttcagatccatcccagagcttcaaaggtatagataggcagggacagggagggagagaagggaggagcccttggaggccagaagggaagtcagatcttcctcctctcccaaaacctccagtgtatgccacgttgagggacctgaaaacacagggccggctgtgggaggcggcccgggccctggcatgccctccgggatccctggagacgttgcagctggacgtaagggactcaaaatccgtggccgctgcccgggaacgcgtgactgagggccgcgtggacgtgctgggtgagcctcctggaagcatatgggctcctaggagccttctccgccctgcgttgaaaccaacatgttcccaggcccagggagcacgaggggacaggccgtgctgagggtgatgctgaggcgggctggtcgggcctcttgtctccgcagtgtgcggcgcagaaccctgaggaggtggcggaggtgagcgccgggctggactccaggagtgggggcggtgcgtcctccggcgcgcagcggtggccacagctctcctcccgccgccgcaggtcttcctcaccgctttgcgcgccccgaagccgaccctgcgctacttcaccaccgagcgcttcctgcccctgctgcggatgcgcctggacgaccccagcggctccaactacgtcaccgccatgcaccgggaagtgttcggcgacgttccggcaaaggccgaggctggggccgaggctgggggcggggccgggcctggggcagaggacgaggccgggcgcggtgcggtgggggaccctgagctcggcgatcctccggccgccccgcagtaaaggcttcctcagccgctgtctcccgcgcccttctttgtcccctgggtctgtgtggtccctggggatggggcggcggtagcagctgtgggtggctaattaagatagatcgcgttagccagttttaccagcgcagctaggcgcgatgctgtcgcctgtaatgccagcgctttgggaggcggaggcaggaggatcgctcaagccccggagttggagaccagccagagcaacacagtgagacccccatctctacaaaaataaagaaaatttaaaaatcaa

SEQ ID NO: 446433 - DNA, 729 bp, Homo sapiens
ggccctcacatccctggagcctcagccccctccacacacgtgctgtgaatcatagggggatcaggatactcctgctcacagacacccatctccccctaccaaaaataacgctgggctcctccttccaccctgactctgcctctctgtctgcaggagcctggtcggggtgctccacagaagctgtgcctgggcttgggagccaaggccatgtccctctcccggccaggggagacggagcccatccacagtgtcagctatggccatgtggccgcctgccagctaatgggcccccacaccctggccttgagggtgggagagagccagctcctcctgcagagcccccaggtggaagagatcatgcagctggtgaatgcctacttggccaacccctcccccgagaggccctgcagcagctcttctcctccatgccaagacctgccagacacctcccctcccagccagcgcccgggcctggacgagccccagggacagtctggctgcttggggcagctgcaggactgagcctgccaagaggtcacgacttccctcctgcctgcagcctgggccaggactgctctgagatttgagggaaacatggacccttttggccctgcagggacagggcacatcccacacccaagggctacaatgggtgtgggtaattttctagtttgtttcttaatttatttgtagaagagaagcaaaaaaaaaaaagtttcttatttacac

SEQ ID NO: 446434 - DNA, 2760 bp, Homo sapiens
  misc_feature (1815)..(1815): n is a, c, g, or t
  misc_feature (1826)..(1827): n is a, c, g, or t
  misc_feature (1829)..(1829): n is a, c, g, or t
  misc_feature (1835)..(1835): n is a, c, g, or t
  misc_feature (1838)..(1839): n is a, c, g, or t
  misc_feature (1849)..(1849): n is a, c, g, or t
  misc_feature (1854)..(1854): n is a, c, g, or t
  misc_feature (1884)..(1886): n is a, c, g, or t
  misc_feature (1909)..(1911): n is a, c, g, or t
  misc_feature (1921)..(1921): n is a, c, g, or t
  misc_feature (1926)..(1926): n is a, c, g, or t
gtgacgaaacctggaccctgcctagtaaagaagggaggagagaaagaagagagagggggggcggggtcccagctctgtgctcgcgcccccagcgcgccagtcccggggctgcagggagcgcagcgcgcgcggcccgggccccggccaccggacgccctaccggacacgaccctccctggagcttggacaactgcccacctcggacgctgcaccggacactgccccccacagggctggacactccaacggacactacttcccagctccggacattgctccctcctctcccggggccctggacgcttttccccctcccccctccgggggcccagacactgagcccccctcagcgtctggctagcgtccccttgcaccccagcccaggacactgcctcctccctgtcctcttctcccttctgctcctcccacctcatctttcccctgctcgggtcggagccccgccagttcctccgaccccctactgctcggccgcggctgcccgcgcccccatccgcagctcctcgcccggatgcctctccccgggggactatggtggcttctctgctgccgtcgaggcttcactcttctgcaccgggactacggggacggcgagcttagcggggacggggacgaggacgaggacgaggaaacctttgagctgcggaccccgagtccagcgggcggcgggaggggtcccctggaagtgacgctgactcagccagtgaggagcgggcctgtctccaacaggctgcagagctgggaggagacttggagcctcatcccggagaaagggctgccggaggacgacccggacatcgttgtgaaaggttggctgtaccgggagccccgcggaggaggggcgcggccctggctgcccccgcgccgagcctggtttgtgctcacgcgggactccctggatcagttcagcagcagcgggaaaggggcgcggcgtctcgggagcctcgtgctcaccagcctgtgctcggtgaccggcccagagcgcaggcgtaaggagacaggtctgtggtcagtgactgtgtctggtcggaaacacagtgtccgcctctgctccccacgccaggcagaggctgagcgctggggggtggcattgcgggaagtgatcgcctccaaggcacccctggagacccccacccagctactgctcagggacatacaggaaagttgcggggacccagaggccgttgccctcatttacctgaggaacccgattctgagacacactagtggagccttgtatgccccactcctgcccctgccctatggagtcagcgccccaggtccgggctatgcacccctgcgcgaggaggcggtgcggctgttcttggcgctgcaggcgctggagggggcgcggcgccccgggcccttgatgcagggtgtgctccaaacctgccgggacttgcccgcgctccgggatgaactcttcctgcagctggctaagcagacctcgggccctgcaggtccccccgggctcccggctacccaagaccctgcggccctgcggtactggcaactcctcacctgcatgagctgcaccttccgacctgggggagctgtgcgggggcacctcctggggcacttggagaggaccgagcaggcactcccggactcggaactggcggaatatgcgcgcttcatccggaaagcgctgggccggacgcgcggcagagagctggtgccctcgctggcggagatttccgcgttgagccaacggcaggagctgctgtgtaccgtgcactgtccgggggctggtgcctgtgctgtggccatcgactcccacaccacggcgggggaggnctctatatctnntntttctnctnntcttttcctnagccncaactcattctctctttactatcatctatnnncccaggatctagccctttcttgnnngacctctttnccgangtgctcaccagcttggccgcggaggaagctgggttggaggactcgcccgactccgggtggagactatgtctgcgtcttcacggacctctgcaccctgaggggctgtccccagacggtcacgaactgcctttcctctttgagcaggctcacgctctgctgctgcggggccggccgcccccacccgacgacacgctgcgcgccctggcggcgctgcgcctgcagagcctgcatcgggacttctctccgcgggtgcccctgccccgcctggaccgctgtcccgcgcgcggctcccgcccccggccccgccgcgcgaagacccgccccgcccgacccccaggccgcccccttccgctgccctgctggccggggcgctctggagcccgggcctggccaagaggcgggcggagcgggcccggcgcggcggggccggccgcactgcgggaagcattgcccgcgagggaggaggcggcgccggcacggcagctgccgtgctgggcggctggaagcggctacggggcatgggccgagctgaggccatggccgcctacctggccctggcggcgcagtgtccggggttcggcgctgctcggtatgacgttctggagctgagcacggagcctggtcggggtgctccacagaagctgtgcctgggcttgggagccaaggccatgtccctctcccggccaggggagacggagcccatccacagtgtcagctatggccatgtggccgcctgccagctaatgggcccccacaccctggccttgagggtgggagagagccagctcctcctgcagagcccccaggcggaggtgaaacgagccgagtggcagg

SEQ ID NO: 446435 - DNA, 1517 bp, Homo sapiens
gtgacgaaacctggaccctgcctagtaaagaagggaggagagaaagaagagagagggggggcggggtcccagctctgtgctcgcgcccccagcgcgccagtcccggggctgcagggagcgcagcgcgcgcggcccgggccccggccaccggacgccctaccggacacgaccctccctggagcttggacaactgcccacctcggacgctgcaccggacactgccccccacagggctggacactccaacggacactacttcccagctccggacattgctccctcctctcccggggccctggacgcttttccccctcccccctccgggggcccagacactgagcccccctcagcgtctggctagcgtccccttgcaccccagcccaggacactgcctcctccctgtcctcttctcccttctgctcctcccacctcatctttcccctgctcgggtcggagccccgccagttcctccgaccccctactgctcggccgcggctgcccgcgcccccatccgcagctcctcgcccggatgcctctccccgggggactatggtggcttctctgctgccgtcgaggcttcactcttctgcaccgggactacggggacggcgagcttagcggggacggggacgaggacgaggacgaggaaacctttgagctgcggaccccgagtccagcgggcggcgggaggggtcccctggaagtgacgctgactcagccagtgaggagcgggcctgtctccaacaggctgcagagctgggaggagacttggagcctcatcccggagaaagggctgccggaggacgacccggacatcgttgtgaaaggttggctgtaccgggagccccgcggaggaggggcgcggccctggctgcccccgcgccgagcctggtttgtgctcacgcgggactccctggatcagttcagcagcagcgggaaaggggcgcggcgtctcgggagcctcgtgctcaccagcctgtgctcggtgaccggcccagagcgcaggcgtaaggagacaggtctgtggtcagtgactgtgtctggtcggaaacacagtgtccgcctctgctccccacgccaggcagaggctgagcgctggggggtggcattgcgggaagtgatcgcctccaaggcacccctggagacccccacccagctactgctcagggacatacaggaaagttgcggggacccagaggccgttgccctcatttacctgaggaacccgattctgagacacactagtggagccttgtatgccccactcctgcccctgccctatggagtcagcgccccaggtccgggctatgcacccctgcgcgaggaggcggtgcggctgttcttggcgctgcaggcgctggagggggcgcggtggccccccggggggggccccccttttttttgggggacaaaattttggggggcccccaaaaaagggggggggggggactttttggggggggttattgtggggccccctttatttacccccgaagaaaaccttgggcccgggggac

SEQ ID NO: 446436 - DNA, 3239 bp, Homo sapiens
cagacagcgaatgaccgcagccagacagtcgctcttgctcttcctcggccctgcggcaggatccgccggtgcaggggcctctccccggactccacgcgtgtctggagggctctcgggttagggaagggggctttggagacgccccgggcggccgggcggtggcgggacgcgggccctttaagaaggagcgaggggcgcggccaggtaggggcgggtccagggcggatcagcgctgcgccggcgccggcccgggagccggatttggagcgcgaggcgccggtgggggcggagggggctgcgcggcggaggctcccgtggcctcggacgctcctcctagctagcggccgccgcccgccgccgcctgcgcctccagctccttcgccccggcgggcccggccgccgcttccggcagctcacctgggaagcgctcacctgggacgcgctcacctgggacgcgctacctgcctccgggcgcctgggcttcaggatgaaggaccgtctggagcagctgaaggccaagcagctgacacaggatgatgatactgatgcggttgagattgctatcgacaacacggcttttatggacgagttcttttctgagattgaggaaactcggcttaacattgacaagatctcagaacatgtagaggaggctaagaaactctacagtatcattctctctgcaccgattccagagccaaaaaccaaggatgacctagagcagctcacgactgagattaagaaaagggccaacaacgtccggaacaaactgaagagcatggagaagcatattgaagaagatgaggtcaggtcatcggcagaccttcggattcggaaatcccagcactctgtcctttctcggaagtttgtggaggtgatgaccaaatacaatgaagctcaagtggacttccgagaacgcagcaaagggcgaatccagcggcagctcgaaattactggcaaaaagacaaccgatgaggagctggaggagatgttggagagtggcaacccggccatcttcacttctgggatcattgactcacagatttccaagcaagccctcagtgagattgagggacgacacaaggacattgtgaggctggagagcagcatcaaggagcttcacgacatgtttatggacatcgccatgctggtggagaatcagggtgagatgttagataacatagagttgaatgtcatgcacacagtggaccacgtggagaaggcacgagatgaaacgaaaaaagctgtgaaataccagagtcaggcccggaagaaattgataattatcattgtgctagtagttgtgttgctgggcattttagcattgattattggactttccgttgggctgaattaagagtggcctaagaggctgctgcactgaaataaactgatttcactccagactggtgtggccacccttgtcttcagatgagaatggagtctgaatggccttcctgagagcgagtgcgacccgttcctttgtttccttgcaaccacccttggacctgactcagctaacaatctagccctgggggaatgtgatctacctgatgcgaccctgagttctccccagagcctcctcctgccccaccagctctcaagtaccttttctcctggactgtgtggacccacccagctttcttcctccctgttgtgtgtcagattatgccttgcacttgggaaagctcttgtgagactctcccaaggtgctgtatttttctacctcatggagtattctcccagaaactgcaatgtatttttttaggggagtatctttaacaaagcagaatgattcttctaagtttggcaacaagaaggcttggatctgagtcttctacctggcaggatgccaatcctgtttgttgtccgtatgtcctgaaaacatgagggactggcagatgtcattttggtctaaagagctgacttgtttgaaattcagccttaaattaagctcttagttgttcagcttggggggcaactttgatttttctctgtgttgtagtctctcatatttactcaaggagggaccaggatgatacagtcatctgaggttatgctttgcaaaaggctgacggtatggaatatgtttccatgtctgagtcttagaaactggctgctcattgttagaaagtgatgctttgtgagactattgtcttggggccaaaaataatcagggattttaaattgggcaagggacaaggtgctagaatcctaagctctggaaatatttcatgacactggtgtattcactcatgtgttccagatgtattctaattgtgtatgaaatgtatgtacacataagtgtgtgtgtctcaggaagtaggaaataaaaatggaagctattatgacctcaaaaaaaaaaagccaactttgagctaggataaaaattgggtaaaggacatttgcttacctgcaaatgaatcactgtggaaatgtgatcttcccatatcatcaagaaacttgttttctggatgaatactgggagaataaaatgagaactctggagtgagctaaattgatcccaattaagtttttctgcttagcagacagaaggtataattttttgacaccctttcccacctggtgcctatgctaggcttgtcctgagaacatccctcagtaacttgatattcacatgacctacaggatgtcccatctgcagggctgagtcagttggggaacaccagaggctacacagtagctcttcctgctactcggttaatgagcttggcaggttctttgtctcactgaattcttatcatggaaacagcagcagcagccgctaggaaatcttcaagtgtagtgtctgtgctaacccagtggtaaatcccttagatcccctgctggtctctggcagtctccttgattttgggtaccatgtatattttccgctttgactttaacgctttctaggatagggtaagcacccttaattcaggcactgtccattagcttcctttgcaaaggctacttatggccggtcacaatccagcactcagacagagccaaggcaatatcctcttgcccatggctatgatgtcagacagtggatgggctccagcaacaagagacaaaataactaaaggcctttgctctcctctgacattgaggcctggggcttacagtttggaatacaacatgtgaaggtttttgttgttgtttgtattttttagatgtaaacttgattattttattgctaatttaaaaataaaaatgactttgtattgattgtgaaa

SEQ ID NO: 446437 - DNA, 1123 bp, Homo sapiens
ctgaggcaggaggatcacttgagcccaggaggtcgaggctgcagtgagccatgatcatgccactgcactctagcctgagtgatagagaaaaaccctgtcttaaaaataaatgaagtatcctagaaggatgtctgtatgtagagatgtaggcctcttactcagactggtaagatattttctatgtagaggtgacaggggttaggttttggatgagttgttatttttttggttgtttgtaataatgatttgtttttgtcttattcctctctccagaaattgataattatcattgtgctagtagttgtgttgctgggcattttagcattgattattggactttccgttgggctgaattaagagtggcctaagaggctgctgcactgaaatgtaagtaaacgagtggttcttggggactctggatttggctcctcaagaggaaattagcttgggatttcaaattcctcttctttccccctatgattgtccttggacacactgagctttctaaaactttcagtagcctgtggattctttatctccttatagttctattggtttctggctgcagtacgtggattagctctccgtttgttctatcctgtagattctgtccccaatctctgtcttgtcgtattaccacttctcccagcatacctgagcaccccaggtgactccccttactcaggaagcatgcttctaagttgggtacatctctgtcttggatctggagtctgtcttctgaattcttactgattttcatggatgttgggctttactttctgtatccttttcaatgtaaatgaaactctgaattgggatttggatctgcagagttttctctgttgctgagtggttgggtcttaaatgatgatagttaacacacttttgagtgttgtgttgtaccagacaatgtactaaacaccttatacacatatcattgaatccttacaacatcctttgagacagatacagtgttatgcacattttacagacaaagaaactcagtcaaagagaatgttgaataacagggccaagttcacacagctaatagtggacctagcttctctttgtaaaagaaggtagccacttatcattaactataaagcctggagaaccttagagg

SEQ ID NO: 446438 - DNA, 496 bp, Homo sapiens
catactctcaaatatttaacattttcacaatgttggaggtttatgttattttgctgtagctaacagtgtgactaaccttatttaatatttttctcatttaaattttctctttattaccaactcatataagttggagtactgaaataacaggtataaacatttttaagacttggcacataataccatgccagtacccagagctgtgccttccttttatatttgtttcagtgtgtctcttcttattcctcctccttccatgtgaccaggggatctaaaagtcagcttattacagcattgagcattcaacttcatcttgaaagataagcaacagtgagatgaacaacctctcatagacaggtggttggttgattttttttttcccctcttttttctggcacttggagtctagcccttgacttttttgtatgtgaactttaaattttggtttggctctgaacaatctgattgaaatagatgttgaaattttaaaaagaaa

SEQ ID NO: 446439 - DNA, 3816 bp, Homo sapiens
cagacagcgaatgaccgcagccagacagtcgctcttgctcttcctcggccctgcggcaggatccgccggtgcaggggcctctccccggactccacgcgtgtctggagggctctcgggttagggaagggggctttggagacgccccgggcggccgggcggtggcgggacgcgggccctttaagaaggagcgaggggcgcggccaggtaggggcgggtccagggcggatcagcgctgcgccggcgccggcccgggagccggatttggagcgcgaggcgccggtgggggcggagggggctgcgcggcggaggctcccgtggcctcggacgctcctcctagctagcggccgccgcccgccgccgcctgcgcctccagctccttcgccccggcgggcccggccgccgcttccggcagctcacctgggaagcgctcacctgggacgcgctcacctgggacgcgctacctgcctccgggcgcctgggcttcaggatgaaggaccgtctggagcagctgaaggccaagcagctgacacaggatgatgatactgatgcggttgagattgctatcgacaacacggcttttatggacgagttcttttctgagattgaggaaactcggcttaacattgacaagatctcagaacatgtagaggaggctaagaaactctacagtatcattctctctgcaccgattccagagccaaaaaccaaggatgacctagagcagctcacgactgagattaagaaaagggccaacaacgtccggaacaaactgaagagcatggagaagcatattgaagaagatgaggtcaggtcatcggcagaccttcggattcggaaatcccagcactctgtcctttctcggaagtttgtggaggtgatgaccaaatacaatgaagctcaagtggacttccgagaacgcagcaaagggcgaatccagcggcagctcgaaattactggcaaaaagacaaccgatgaggagctggaggagatgttggagagtggcaacccggccatcttcacttctgggatcattgactcacagatttccaagcaagccctcagtgagattgagggacgacacaaggacattgtgaggctggagagcagcatcaaggagcttcacgacatgtttatggacatcgccatgctggtggagaatcagggtgagatgttagataacatagagttgaatgtcatgcacacagtggaccacgtggagaaggcacgagatgaaacgaaaaaagctgtgaaataccagagtcaggcccggaagaaattgataattatcattgtgctagtagttgtgttgctgggcattttagcattgattattggactttccgttgggctgaattaagagtggcctaagaggctgctgcactgaaataaactgatttcactccagactggtgtggccacccttgtcttcagatgagaatggagtctgaatggccttcctgagagcgagtgcgacccgttcctttgtttccttgcaaccacccttggacctgactcagctaacaatctagccctgggggaatgtgatctacctgatgcgaccctgagttctccccagagcctcctcctgccccaccagctctcaagtaccttttctcctggactgtgtggacccacccagctttcttcctccctgttgtgtgtcagattatgccttgcacttgggaaagctcttgtgagactctcccaaggtgctgtatttttctacctcatggagtattctcccagaaactgcaatgtatttttttaggggagtatctttaacaaagcagaatgattcttctaagtttggcaacaagaaggcttggatctgagtcttctacctggcaggatgccaatcctgtttgttgtccgtatgtcctgaaaacatgagggactggcagatgtcattttggtctaaagagctgacttgtttgaaattcagccttaaattaagctcttagttgttcagcttggggggcaactttgatttttctctgtgttgtagtctctcatatttactcaaggagggaccaggatgatacagtcatctgaggttatgctttgcaaaaggctgacggtatggaatatgtttccatgtctgagtcttagaaactggctgctcattgttagaaagtgatgctttgtgagactattgtcttggggccaaaaataatcagggattttaaattgggcaagggacaaggtgctagaatcctaagctctggaaatatttcatgacactggtgtattcactcatgtgttccagatgtattctaattgtgtatgaaatgtatgtacacataagtgtgtgtgtctcaggaagtaggaaataaaaatggaagctattatgacctcaaaaaaaaaaagccaactttgagctaggataaaaattgggtaaaggacatttgcttacctgcaaatgaatcactgtggaaatgtgatcttcccatatcatcaagaaacttgttttctggatgaatactgggagaataaaatgagaactctggagtgagctaaattgatcccaattaagtttttctgcttagcagacagaaggtataattttttgacaccctttcccacctggtgcctatgctaggcttgtcctgagaacatccctcagtaacttgatattcacatgacctacaggatgtcccatctgcagggctgagtcagttggggaacaccagaggctacacagtagctcttcctgctactcggttaatgagcttggcaggttctttgtctcactgaattcttatcatggaaacagcagcagcagccgctaggaaatcttcaagtgtagtgtctgtgctaacccagtggtaaatcccttagatcccctgctggtctctggcagtctccttgattttgggtaccatgtatattttccgctttgactttaacgctttctaggatagggtaagcacccttaattcaggcactgtccattagcttcctttgcaaaggctacttatggccggtcacaatccagcactcagacagagccaaggcaatatcctcttgcccatggctatgatgtcagacagtggatgggctccagcaacaagagacaaaataactaaaggcctttgctctcctctgacattgaggcctggggcttacagtttggaatacaacatgtgaaggtttttgttgttgtttgtattttttagatgtaaacttgattattttattgctaatttaaaaataaaaatgactttgtattgattgtgaaaaaaaaaaaaaaaaaaaaaaaaaaaaacaaaaaaaaaaagagaagagagagacaaaaaaaacaaagaaaaaatacaacaaaagagagagcgaacacaaaaagaaataaaaagcaaacacaccagacgacgcggagaaccagaggcgaggcccaccccaggacgacgcacaaaaaccccagccagacgaccgtataaagcacacccacccaggccgacacatgcgaaaacaacggagcaccactgccgggacacccctatcgcggcaacacggaaagacaatcacaagctacaaagcacaggtgaaatccaccccgagactgaggaaaccgagcatcacgccgatgacaaaccgcacacggcggccgcaccaccgcggcgaccaaacgagacacaagagacgacaacaacacgcaaagaagaggggagaaaaacaaacccagcgaggagaaaaaagacgaagagatgaaagaaagaaagagacatagacaacagacgaaggaacaacaaagccgagacaacaagaaagaaccaagaaccaaggcggacactacaccgacacagaaaaggaaacacaaaa

SEQ ID NO: 446440 - DNA, 3125 bp, Homo sapiens
cagacagcgaatgaccgcagccagacagtcgctcttgctcttcctcggccctgcggcaggatccgccggtgcaggggcctctccccggactccacgcgtgtctggagggctctcgggttagggaagggggctttggagacgccccgggcggccgggcggtggcgggacgcgggccctttaagaaggagcgaggggcgcggccaggtaggggcgggtccagggcggatcagcgctgcgccggcgccggcccgggagccggatttggagcgcgaggcgccggtgggggcggagggggctgcgcggcggaggctcccgtggcctcggacgctcctcctagctagcggccgccgcccgccgccgcctgcgcctccagctccttcgccccggcgggcccggccgccgcttccggcagctcacctgggaagcgctcacctgggacgcgctcacctgggacgcgctacctgcctccgggcgcctgggcttcaggatgaaggaccgtctggagcagctgaaggccaagcagctgacacaggatgatgatactgatgcggttgagattgctatcgacaacacggcttttatggacgagttcttttctgagattgaggaaactcggcttaacattgacaagatctcagaacatgtagaggaggctaagaaactctacagtatcattctctctgcaccgattccagagccaaaaaccaaggatgacctagagcagctcacgactgagattaagaaaagggccaacaacgtccggaacaaactgaagagcatggagaagcatattgaagaagatgaggtcaggtcatcggcagaccttcggattcggaaatcccagcactctgtcctttctcggaagtttgtggaggtgatgaccaaatacaatgaagctcaagtggacttccgagaacgcagcaaagggcgaatccagcggcagctcgaaattactggcaaaaagacaaccgatgaggagctggaggagatgttggagagtggcaacccggccatcttcacttctgggatcattgactcacagatttccaagcaagccctcagtgagattgagggacgacacaaggacattgtgaggctggagagcagcatcaaggagcttcacgacatgtttatggacatcgccatgctggtggagaatcagggtgagatgttagataacatagagttgaatgtcatgcacacagtggaccacgtggagaaggcacgagatgaaacgaaaaaagctgtgaaataccagagtcaggcccggaagaaactgatttcactccagactggtgtggccacccttgtcttcagatgagaatggagtctgaatggccttcctgagagcgagtgcgacccgttcctttgtttccttgcaaccacccttggacctgactcagctaacaatctagccctgggggaatgtgatctacctgatgcgaccctgagttctccccagagcctcctcctgccccaccagctctcaagtaccttttctcctggactgtgtggacccacccagctttcttcctccctgttgtgtgtcagattatgccttgcacttgggaaagctcttgtgagactctcccaaggtgctgtatttttctacctcatggagtattctcccagaaactgcaatgtatttttttaggggagtatctttaacaaagcagaatgattcttctaagtttggcaacaagaaggcttggatctgagtcttctacctggcaggatgccaatcctgtttgttgtccgtatgtcctgaaaacatgagggactggcagatgtcattttggtctaaagagctgacttgtttgaaattcagccttaaattaagctcttagttgttcagcttggggggcaactttgatttttctctgtgttgtagtctctcatatttactcaaggagggaccaggatgatacagtcatctgaggttatgctttgcaaaaggctgacggtatggaatatgtttccatgtctgagtcttagaaactggctgctcattgttagaaagtgatgctttgtgagactattgtcttggggccaaaaataatcagggattttaaattgggcaagggacaaggtgctagaatcctaagctctggaaatatttcatgacactggtgtattcactcatgtgttccagatgtattctaattgtgtatgaaatgtatgtacacataagtgtgtgtgtctcaggaagtaggaaataaaaatggaagctattatgacctcaaaaaaaaaaagccaactttgagctaggataaaaattgggtaaaggacatttgcttacctgcaaatgaatcactgtggaaatgtgatcttcccatatcatcaagaaacttgttttctggatgaatactgggagaataaaatgagaactctggagtgagctaaattgatcccaattaagtttttctgcttagcagacagaaggtataattttttgacaccctttcccacctggtgcctatgctaggcttgtcctgagaacatccctcagtaacttgatattcacatgacctacaggatgtcccatctgcagggctgagtcagttggggaacaccagaggctacacagtagctcttcctgctactcggttaatgagcttggcaggttctttgtctcactgaattcttatcatggaaacagcagcagcagccgctaggaaatcttcaagtgtagtgtctgtgctaacccagtggtaaatcccttagatcccctgctggtctctggcagtctccttgattttgggtaccatgtatattttccgctttgactttaacgctttctaggatagggtaagcacccttaattcaggcactgtccattagcttcctttgcaaaggctacttatggccggtcacaatccagcactcagacagagccaaggcaatatcctcttgcccatggctatgatgtcagacagtggatgggctccagcaacaagagacaaaataactaaaggcctttgctctcctctgacattgaggcctggggcttacagtttggaatacaacatgtgaaggtttttgttgttgtttgtattttttagatgtaaacttgattattttattgctaatttaaaaataaaaatgactttgtattgattgtgaaa

SEQ ID NO: 446441 - DNA, 3851 bp, Homo sapiens
aaggaaagaggcttctggtggcattcattgcccatggaattctaagtgttcgagagtgctatatcttggacttagagggtcagaggctgatgaagcttgtgaagaagcaggtgtggggggtttatcccctgcctcacctccacctttcacaacagtcagttctctgtgcttagaaatcagcaatgtgctgtgcagcagctgtctgggaagaacattgaacaggaatgtagaaacagctcaggcccttatgctgggtgggaatggaatcacttcctttagatggccattttgtgaatttttacagaggaagttgaatgagattgagaaagcttgggtccccagaggtggctgggggccgggggagagcttcctctttcttataaacaggagcttctgacagggagtgacatagcattgtttcctttgtgataggtggtttctgaaaacaggaaaatctttactcctaatgtgaaaattgaaagcttgtcctttgtaggaattgtgtctggaacctgtttgaacagcatggagaagggtttagcgaccctggggttcagatccaaaagataagtttgattctacctgttgccatgttttagctgtgtggtttttgccaagttacctaacctccctaagttttaggttcctcaactgtagtgagttacagtaactaccaccacaaccaacagcaacaaaacctagcatgtgttgaacttacagtgtaccaggcaccatacaaaagcatcctatattcattatctcttttataccttacacaatcctatgaagcaggtagtgtttttatcagcatttaacagataaggaaacctaggcacagcaagataggtaacttgccagttcctccctttctcacccctcaccccctgaaagaaacacacacacacacacacacacacacacacacacacacaacccagcaattggtagagctaggatttaatttcagatgttgagacaccggaatttgatatatcagagagctgttatgagttttaaaggaaattatgtgtaaaatgctgaatatagttcctagtacttcgtgagcattcaataatttagccatttattgtgtttttagcctcactctgctcttttttgccttttgcagaagcagctgacacaggatgatgatactgatgcggttgagattgctatcgacaacacggcttttatggacgagttcttttctgagattgaggaaactcggcttaacattgacaagatctcagaacatgtagaggaggctaagaaactctacagtatcattctctctgcaccgattccagagccaaaaaccaaggatgacctagagcagctcacgactgagattaagaaaagggccaacaacgtccggaacaaactgaagagcatggagaagcatattgaagaagatgaggtcaggtcatcggcagaccttcggattcggaaatcccagcactctgtcctttctcggaagtttgtggaggtgatgaccaaatacaatgaagctcaagtggacttccgagaacgcagcaaagggcgaatccagcggcagctcgaaattactggcaaaaagacaaccgatgaggagctggaggagatgttggagagtggcaacccggccatcttcacttctgggatcattgactcacagatttccaagcaagccctcagtgagattgagggacgacacaaggacattgtgaggctggagagcagcatcaaggagcttcacgacatgtttatggacatcgccatgctggtggagaatcagggtgagatgttagataacatagagttgaatgtcatgcacacagtggaccacgtggagaaggcacgagatgaaacgaaaaaagctgtgaaataccagagtcaggcccggaagaaattgataattatcattgtgctagtagttgtgttgctgggcattttagcattgattattggactttccgttgggctgaattaagagtggcctaagaggctgctgcactgaaataaactgatttcactccagactggtgtggccacccttgtcttcagatgagaatggagtctgaatggccttcctgagagcgagtgcgacccgttcctttgtttccttgcaaccacccttggacctgactcagctaacaatctagccctgggggaatgtgatctacctgatgcgaccctgagttctccccagagcctcctcctgccccaccagctctcaagtaccttttctcctggactgtgtggacccacccagctttcttcctccctgttgtgtgtcagattatgccttgcacttgggaaagctcttgtgagactctcccaaggtgctgtatttttctacctcatggagtattctcccagaaactgcaatgtatttttttaggggagtatctttaacaaagcagaatgattcttctaagtttggcaacaagaaggcttggatctgagtcttctacctggcaggatgccaatcctgtttgttgtccgtatgtcctgaaaacatgagggactggcagatgtcattttggtctaaagagctgacttgtttgaaattcagccttaaattaagctcttagttgttcagcttggggggcaactttgatttttctctgtgttgtagtctctcatatttactcaaggagggaccaggatgatacagtcatctgaggttatgctttgcaaaaggctgacggtatggaatatgtttccatgtctgagtcttagaaactggctgctcattgttagaaagtgatgctttgtgagactattgtcttggggccaaaaataatcagggattttaaattgggcaagggacaaggtgctagaatcctaagctctggaaatatttcatgacactggtgtattcactcatgtgttccagatgtattctaattgtgtatgaaatgtatgtacacataagtgtgtgtgtctcaggaagtaggaaataaaaatggaagctattatgacctcaaaaaaaaaaagccaactttgagctaggataaaaattgggtaaaggacatttgcttacctgcaaatgaatcactgtggaaatgtgatcttcccatatcatcaagaaacttgttttctggatgaatactgggagaataaaatgagaactctggagtgagctaaattgatcccaattaagtttttctgcttagcagacagaaggtataattttttgacaccctttcccacctggtgcctatgctaggcttgtcctgagaacatccctcagtaacttgatattcacatgacctacaggatgtcccatctgcagggctgagtcagttggggaacaccagaggctacacagtagctcttcctgctactcggttaatgagcttggcaggttctttgtctcactgaattcttatcatggaaacagcagcagcagccgctaggaaatcttcaagtgtagtgtctgtgctaacccagtggtaaatcccttagatcccctgctggtctctggcagtctccttgattttgggtaccatgtatattttccgctttgactttaacgctttctaggatagggtaagcacccttaattcaggcactgtccattagcttcctttgcaaaggctacttatggccggtcacaatccagcactcagacagagccaaggcaatatcctcttgcccatggctatgatgtcagacagtggatgggctccagcaacaagagacaaaataactaaaggcctttgctctcctctgacattgaggcctggggcttacagtttggaatacaacatgtgaaggtttttgttgttgtttgtattttttagatgtaaacttgattattttattgctaatttaaaaataaaaatgactttgtattgattgtgaaa

SEQ ID NO: 446442 - DNA, 3211 bp, Homo sapiens
cagacagcgaatgaccgcagccagacagtcgctcttgctcttcctcggccctgcggcaggatccgccggtgcaggggcctctccccggactccacgcgtgtctggagggctctcgggttagggaagggggctttggagacgccccgggcggccgggcggtggcgggacgcgggccctttaagaaggagcgaggggcgcggccaggtaggggcgggtccagggcggatcagcgctgcgccggcgccggcccgggagccggatttggagcgcgaggcgccggtgggggcggagggggctgcgcggcggaggctcccgtggcctcggacgctcctcctagctagcggccgccgcccgccgccgcctgcgcctccagctccttcgccccggcgggcccggccgccgcttccggcagctcacctgggaagcgctcacctgggacgcgctcacctgggacgcgctacctgcctccgggcgcctgggcttcaggatgaaggaccgtctggagcagctgaaggccaagcagctgacacaggatgatgatactgatgcggttgagattgctatcgacaacacggcttttatggacgagttcttttctgagattgaggaaactcggcttaacattgacaagatctcagaacatgtagaggaggctaagaaactctacagtatcattctctctgcaccgattccagagccaaaaaccaaggatgacctagagcagctcacgactgagattaagaaaagggccaacaacgtccggaacaaactgaagagcatggagaagcatattgaagaagatgaggtcaggtcatcggcagaccttcggattcggaaatcccagcactctgtcctttctcggaagtttgtggaggtgatgaccaaatacaatgaagctcaagtggacttccgagaacgcagcaaagggcgaatccagcggcagctcgaaattactggcaaaaagacaaccgatgaggagctggaggagatgttggagagtggcaacccggccatcttcacttctgggatcattgactcacagatttccaagcaagccctcagtgagattgagggacgacacaaggacattgtgaggctggagagcagcatcaaggagcttcacgacatgtttatggacatcgccatgctggtggagaatcagggtgagatgttagataacatagagttgaatgtcatgcacacagtggaccacgtggagaaggcacgagatgaaacgaaaaaagctgtgaaataccagagtcaggcccggaagaaattgataattatcattgtgctagtagttgtgttgctgggcattttagcattgattattggactttccgttgggctgaattaagagtggcctaagaggctgctgcactgaaataaactgatttcactccagactggtgtggccacccttgtcttcagatgagaatggagtctgaatggccttcctgagagcgagtgcgacccgttcctttgtttccttgcaaccacccttggacctgactcagctaacaatctagccctgggggaatgtgatctacctgatgcgaccctgagttctccccagagcctcctcctgccccaccagctctcaagtaccttttctcctggactgtgtggacccacccagctttcttcctccctgttgtgtgtcagattatgccttgcacttgggaaagctcttgtgagactctcccaaggtgctgtatttttctacctcatggagtattctcccagaaactgcaatgtatttttttaggggagtatctttaacaaagcagaatgattcttctaagtttggcaacaagaaggcttggatctgagtcttctacctggcaggatgccaatcctgtttgttgtccgtatgtcctgaaaacatgagggactggcagatgtcattttggtctaaagagctgacttgtttgaaattcagccttaaattaagctcttagttgttcagcttggggggcaactttgatttttctctgtgttgtagtctctcatatttactcaaggagggaccaggatgatacagtcatctgaggttatgctttgcaaaaggctgacggtatggaatatgtttccatgtctgagtcttagaaactggctgctcattgttagaaagtgatgctttgtgagactattgtcttggggccaaaaataatcagggattttaaattgggcaagggacaaggtgctagaatcctaagctctggaaatatttcatgacactggtgtattcactcatgtgttccagatgtattctaattgtgtatgaaatgtatgtacacataagtgtgtgtgtctcaggaagtaggaaataaaaatggaagctattatgacctcaaaaaaaaaaagccaactttgagctaggataaaaattgggtaaaggacatttgcttacctgcaaatgaatcactgtggaaatgtgatcttcccatatcatcaagaaacttgttttctggatgaatactgggagaataaaatgagaactctggagtgagctaaattgatcccaattaagtttttctgcttagcagacagaaggtataattttttgacaccctttcccacctggtgcctatgctaggcttgtcctgagaacatccctcagtaacttgatattcacatgacctacaggatgtcccatctgcagggctgagtcagttggggaacaccagaggctacacagtagctcttcctgctactcggttaatgagcttggcaggttctttgtctcactgaattcttatcatggaaacagcagcagcagccgctaggaaatcttcaagtgtagtgtctgtgctaacccagtggtaaatcccttagatcccctgctggtctctggcagtctccttgattttgggtaccatgtatattttccgctttgactttaacgctttctaggatagggtaagcaccctttgcaaaggctacttatggccggtcacaatccagcactcagacagagccaaggcaatatcctcttgcccatggctatgatgtcagacagtggatgggctccagcaacaagagacaaaataactaaaggcctttgctctcctctgacattgaggcctggggcttacagtttggaatacaacatgtgaaggtttttgttgttgtttgtattttttagatgtaaacttgattattttattgctaatttaaaaataaaaatgactttgtattgattgtgaaa

SEQ ID NO: 446443 - DNA, 3751 bp, Homo sapiens
aaggaaagaggcttctggtggcattcattgcccatggaattctaagtgttcgagagtgctatatcttggacttagagggtcagaggctgatgaagcttgtgaagaagcaggtgtggggggtttatcccctgcctcacctccacctttcacaacagtcagttctctgtgcttagaaatcagcaatgtgctgtgcagcagctgtctgggaagaacattgaacaggaatgtagaaacagctcaggcccttatgctgggtgggaatggaatcacttcctttagatggccattttgtgaatttttacagaggaagttgaatgagattgagaaagcttgggtccccagaggtggctgggggccgggggagagcttcctctttcttataaacaggagcttctgacagggagtgacatagcattgtttcctttgtgataggtggtttctgaaaacaggaaaatctttactcctaatgtgaaaattgaaagcttgtcctttgtaggaattgtgtctggaacctgtttgaacagcatggagaagggtttagcgaccctggggttcagatccaaaagataagtttgattctacctgttgccatgttttagctgtgtggtttttgccaagttacctaacctccctaagttttaggttcctcaactgtagtgagttacagtaactaccaccacaaccaacagcaacaaaacctagcatgtgttgaacttacagtgtaccaggcaccatacaaaagcatcctatattcattatctcttttataccttacacaatcctatgaagcaggtagtgtttttatcagcatttaacagataaggaaacctaggcacagcaagataggtaacttgccagttcctccctttctcacccctcaccccctgaaagaaacacacacacacacacacacacacacacacacacacacaacccagcaattggtagagctaggatttaatttcagatgttgagacaccggaatttgatatatcagagagctgttatgagttttaaaggaaattatgtgtaaaatgctgaatatagttcctagtacttcgtgagcattcaataatttagccatttattgtgtttttagcctcactctgctcttttttgccttttgcagaagcagctgacacaggatgatgatactgatgcggttgagattgctatcgacaacacggcttttatggacgagttcttttctgagaaaccaaggatgacctagagcagctcacgactgagattaagaaaagggccaacaacgtccggaacaaactgaagagcatggagaagcatattgaagaagatgaggtcaggtcatcggcagaccttcggattcggaaatcccagcactctgtcctttctcggaagtttgtggaggtgatgaccaaatacaatgaagctcaagtggacttccgagaacgcagcaaagggcgaatccagcggcagctcgaaattactggcaaaaagacaaccgatgaggagctggaggagatgttggagagtggcaacccggccatcttcacttctgggatcattgactcacagatttccaagcaagccctcagtgagattgagggacgacacaaggacattgtgaggctggagagcagcatcaaggagcttcacgacatgtttatggacatcgccatgctggtggagaatcagggtgagatgttagataacatagagttgaatgtcatgcacacagtggaccacgtggagaaggcacgagatgaaacgaaaaaagctgtgaaataccagagtcaggcccggaagaaattgataattatcattgtgctagtagttgtgttgctgggcattttagcattgattattggactttccgttgggctgaattaagagtggcctaagaggctgctgcactgaaataaactgatttcactccagactggtgtggccacccttgtcttcagatgagaatggagtctgaatggccttcctgagagcgagtgcgacccgttcctttgtttccttgcaaccacccttggacctgactcagctaacaatctagccctgggggaatgtgatctacctgatgcgaccctgagttctccccagagcctcctcctgccccaccagctctcaagtaccttttctcctggactgtgtggacccacccagctttcttcctccctgttgtgtgtcagattatgccttgcacttgggaaagctcttgtgagactctcccaaggtgctgtatttttctacctcatggagtattctcccagaaactgcaatgtatttttttaggggagtatctttaacaaagcagaatgattcttctaagtttggcaacaagaaggcttggatctgagtcttctacctggcaggatgccaatcctgtttgttgtccgtatgtcctgaaaacatgagggactggcagatgtcattttggtctaaagagctgacttgtttgaaattcagccttaaattaagctcttagttgttcagcttggggggcaactttgatttttctctgtgttgtagtctctcatatttactcaaggagggaccaggatgatacagtcatctgaggttatgctttgcaaaaggctgacggtatggaatatgtttccatgtctgagtcttagaaactggctgctcattgttagaaagtgatgctttgtgagactattgtcttggggccaaaaataatcagggattttaaattgggcaagggacaaggtgctagaatcctaagctctggaaatatttcatgacactggtgtattcactcatgtgttccagatgtattctaattgtgtatgaaatgtatgtacacataagtgtgtgtgtctcaggaagtaggaaataaaaatggaagctattatgacctcaaaaaaaaaaagccaactttgagctaggataaaaattgggtaaaggacatttgcttacctgcaaatgaatcactgtggaaatgtgatcttcccatatcatcaagaaacttgttttctggatgaatactgggagaataaaatgagaactctggagtgagctaaattgatcccaattaagtttttctgcttagcagacagaaggtataattttttgacaccctttcccacctggtgcctatgctaggcttgtcctgagaacatccctcagtaacttgatattcacatgacctacaggatgtcccatctgcagggctgagtcagttggggaacaccagaggctacacagtagctcttcctgctactcggttaatgagcttggcaggttctttgtctcactgaattcttatcatggaaacagcagcagcagccgctaggaaatcttcaagtgtagtgtctgtgctaacccagtggtaaatcccttagatcccctgctggtctctggcagtctccttgattttgggtaccatgtatattttccgctttgactttaacgctttctaggatagggtaagcacccttaattcaggcactgtccattagcttcctttgcaaaggctacttatggccggtcacaatccagcactcagacagagccaaggcaatatcctcttgcccatggctatgatgtcagacagtggatgggctccagcaacaagagacaaaataactaaaggcctttgctctcctctgacattgaggcctggggcttacagtttggaatacaacatgtgaaggtttttgttgttgtttgtattttttagatgtaaacttgattattttattgctaatttaaaaataaaaatgactttgtattgattgtgaaa

SEQ ID NO: 446444 - DNA, 2441 bp, Homo sapiens
gagggtagacagtgtgtttatatttcctagtaatgtgccagctgcttgctctaagatcatagtatcctcattttacagacggggaaagagcaatgaagttaaggaacttgcccaagactacatagctcataaggtggagcagccataatatgacccctgaactttttccataggcttttcattgtgtccttctgttttctaaaagaaaggcagcagggagttcatgaagatcgagaaccagaaagcagctcctgcagcctgtcttcaggagcggtgttgctgtgggacctgcagagcaggtgttttcactagggattgtcccttcccaccacgtccttccatgggtgtggacagcctgtgagaaggcttataaaaggcctagaggcttttctatttttttcccctctcacagtagggctttttgttctttgtacagtgggatatttaactccaagttctgtcctgggtttgtctatttcatagtgatttctggtctttcctccccaccttccaggtttgtggctgactccttctgttgccctttgccttcttcctgtgtactgatcagctcctcctttccctgcctcctaaactgatttcactccagactggtgtggccacccttgtcttcagatgagaatggagtctgaatggccttcctgagagcgagtgcgacccgttcctttgtttccttgcaaccacccttggacctgactcagctaacaatctagccctgggggaatgtgatctacctgatgcgaccctgagttctccccagagcctcctcctgccccaccagctctcaagtaccttttctcctggactgtgtggacccacccagctttcttcctccctgttgtgtgtcagattatgccttgcacttgggaaagctcttgtgagactctcccaaggtgctgtatttttctacctcatggagtattctcccagaaactgcaatgtatttttttaggggagtatctttaacaaagcagaatgattcttctaagtttggcaacaagaaggcttggatctgagtcttctacctggcaggatgccaatcctgtttgttgtccgtatgtcctgaaaacatgagggactggcagatgtcattttggtctaaagagctgacttgtttgaaattcagccttaaattaagctcttagttgttcagcttggggggcaactttgatttttctctgtgttgtagtctctcatatttactcaaggagggaccaggatgatacagtcatctgaggttatgctttgcaaaaggctgacggtatggaatatgtttccatgtctgagtcttagaaactggctgctcattgttagaaagtgatgctttgtgagactattgtcttggggccaaaaataatcagggattttaaattgggcaagggacaaggtgctagaatcctaagctctggaaatatttcatgacactggtgtattcactcatgtgttccagatgtattctaattgtgtatgaaatgtatgtacacataagtgtgtgtgtctcaggaagtaggaaataaaaatggaagctattatgacctcaaaaaaaaaaagccaactttgagctaggataaaaattgggtaaaggacatttgcttacctgcaaatgaatcactgtggaaatgtgatcttcccatatcatcaagaaacttgttttctggatgaatactgggagaataaaatgagaactctggagtgagctaaattgatcccaattaagtttttctgcttagcagacagaaggtataattttttgacaccctttcccacctggtgcctatgctaggcttgtcctgagaacatccctcagtaacttgatattcacatgacctacaggatgtcccatctgcagggctgagtcagttggggaacaccagaggctacacagtagctcttcctgctactcggttaatgagcttggcaggttctttgtctcactgaattcttatcatggaaacagcagcagcagccgctaggaaatcttcaagtgtagtgtctgtgctaacccagtggtaaatcccttagatcccctgctggtctctggcagtctccttgattttgggtaccatgtatattttccgctttgactttaacgctttctaggatagggtaagcacccttaattcaggcactgtccattagcttcctttgcaaaggctacttatggccggtcacaatccagcactcagacagagccaaggcaatatcctcttgcccatggctatgatgtcagacagtggatgggctccagcaacaagagacaaaataactaaaggcctttgctctcctctgacattgaggcctggggcttacagtttggaatacaacatgtgaaggtttttgttgttgtttgtattttttagatgtaaacttgattattttattgctaatttaaaaataaaaatgactttgtattgattgtgaaa

SEQ ID NO: 446445 - DNA, 2123 bp, Homo sapiens
cagacagcgaatgaccgcagccagacagtcgctcttgctcttcctcggccctgcggcaggatccgccggtgcaggggcctctccccggactccacgcgtgtctggagggctctcgggttagggaagggggctttggagacgccccgggcggccgggcggtggcgggacgcgggccctttaagaaggagcgaggggcgcggccaggtaggggcgggtccagggcggatcagcgctgcgccggcgccggcccgggagccggatttggagcgcgaggcgccggtgggggcggagggggctgcgcggcggaggctcccgtggcctcggacgctcctcctagctagcggccgccgcccgccgccgcctgcgcctccagctccttcgccccggcgggcccggccgccgcttccggcagctcacctgggaagcgctcacctgggacgcgctcacctgggacgcgctacctgcctccgggcgcctgggcttcaggatgaaggaccgtctggagcagctgaaggccaagcagctgacacaggatgatgatactgatgcggttgagattgctatcgacaacacggcttttatggacgagttcttttctgagattgaggaaactcggcttaacattgacaagatctcagaacatgtagaggaggctaagaaactctacagtatcattctctctgcaccgattccagagccaaaaaccaaggatgacctagagcagctcacgactgagattaagaaaagggccaacaacgtccggaacaaactgaagagcatggagaagcatattgaagaagatgaggtcaggtcatcggcagaccttcggattcggaaatcccagcactctgtcctttctcggaagtttgtggaggtgatgaccaaatacaatgaagctcaagtggacttccgagaacgcagcaaagggcgaatccagcggcagctcgaaattactggcaaaaagacaaccgatgaggagctggaggagatgttggagagtggcaacccggccatcttcacttctgggatcattgactcacagatttccaagcaagccctcagtgagattgagggacgacacaaggacattgtgaggctggagagcagcatcaaggagcttcacgacatgtttatggacatcgccatgctggtggagaatcagggtgagatgttagataacatagagttgaatgtcatgcacacagtggaccacgtggagaaggcacgagatgaaacgaaaaaagctgtgaaataccagagtcaggcccggaagaaattgataattatcattgtgctagtagttgtgttgctgggcattttagcattgattattggactttccgttgggctgaattaagagtggcctaagaggctgctgcactgaaatgtaagtaaacgagtggttcttggggactctggatttggctcctcaagaggaaattagcttgggatttcaaattcctcttctttccccctatgattgtccttggacacactgagctttctaaaactttcagtagcctgtggattctttatctccttatagttctattggtttctggctgcagtacgtggattagctctccgtttgttctatcctgtagattctgtccccaatctctgtcttgtcgtattaccacttctcccagcatacctgagcaccccaggtgactccccttactcaggaagcatgcttctaagttgggtacatctctgtcttggatctggagtctgtcttctgaattcttactgattttcatggatgttgggctttactttctgtatccttttcaatgtaaatgaaactctgaattgggatttggatctgcagagttttctctgttgctgagtggttgggtcttaaatgatgatagttaacacacttttgagtgttgtgttgtaccagacaatgtactaaacaccttatacacatatcattgaatccttacaacatcctttgagacagatacagtgttatgcacattttacagacaaagaaactcagtcaaagagaatgttgaataacagggccaagttcacacagctaatagtggacctagcttctctttgtaaaagaaggtagccacttatcattaactataaagcctggagaaccttagagg

SEQ ID NO: 446446 - DNA, 1655 bp, Homo sapiens
cagacagcgaatgaccgcagccagacagtcgctcttgctcttcctcggccctgcggcaggatccgccggtgcaggggcctctccccggactccacgcgtgtctggagggctctcgggttagggaagggggctttggagacgccccgggcggccgggcggtggcgggacgcgggccctttaagaaggagcgaggggcgcggccaggtaggggcgggtccagggcggatcagcgctgcgccggcgccggcccgggagccggatttggagcgcgaggcgccggtgggggcggagggggctgcgcggcggaggctcccgtggcctcggacgctcctcctagctagcggccgccgcccgccgccgcctgcgcctccagctccttcgccccggcgggcccggccgccgcttccggcagctcacctgggaagcgctcacctgggacgcgctcacctgggacgcgctacctgcctccgggcgcctgggcttcaggatgaaggaccgtctggagcagctgaaggccaagcagctgacacaggatgatgatactgatgcggttgagattgctatcgacaacacggcttttatggacgagttcttttctgagattgaggaaactcggcttaacattgacaagatctcagaacatgtagaggaggctaagaaactctacagtatcattctctctgcaccgattccagagccaaaaaccaaggatgacctagagcagctcacgactgagattaagaaaagggccaacaacgtccggaacaaactgaagagcatggagaagcatattgaagaagatgaggtcaggtcatcggcagaccttcggattcggaaatcccagcactctgtcctttctcggaagtttgtggaggtgatgaccaaatacaatgaagctcaagtggacttccgagaacgcagcaaagggcgaatccagcggcagctcgaaattactggcaaaaagacaaccgatgaggagctggaggagatgttggagagtggcaacccggccatcttcacttctgggatcattgactcacagatttccaagcaagccctcagtgagattgagggacgacacaaggacattgtgaggctggagagcagcatcaaggagcttcacgacatgtttatggacatcgccatgctggtggagaatcagggtgagatgttagataacatagagttgaatgtcatgcacacagtggaccacgtggagaaggcacgagatgaaacgaaaaaagctgtgaaataccagagtcaggcccggaagaaattgataattatcattgtgctagtagttgtgttgctgggcattttagcattgattattggactttccgttgggctgaattaagagtggcctaagaggctgctgcactgaaattgtgtctcttcttattcctcctccttccatgtgaccaggggatctaaaagtcagcttattacagcattgagcattcaacttcatcttgaaagataagcaacagtgagatgaacaacctctcatagacaggtggttggttgattttttttttcccctcttttttctggcacttggagtctagcccttgacttttttgtatgtgaactttaaattttggtttggctctgaacaatctgattgaaatagatgttgaaattttaaaaagaaa

SEQ ID NO: 446447 - DNA, 1603 bp, Homo sapiens
cagacagcgaatgaccgcagccagacagtcgctcttgctcttcctcggccctgcggcaggatccgccggtgcaggggcctctccccggactccacgcgtgtctggagggctctcgggttagggaagggggctttggagacgccccgggcggccgggcggtggcgggacgcgggccctttaagaaggagcgaggggcgcggccaggtaggggcgggtccagggcggatcagcgctgcgccggcgccggcccgggagccggatttggagcgcgaggcgccggtgggggcggagggggctgcgcggcggaggctcccgtggcctcggacgctcctcctagctagcggccgccgcccgccgccgcctgcgcctccagctccttcgccccggcgggcccggccgccgcttccggcagctcacctgggaagcgctcacctgggacgcgctcacctgggacgcgctacctgcctccgggcgcctgggcttcaggatgaaggaccgtctggagcagctgaaggccaagcagctgacacaggatgatgatactgatgcggttgagattgctatcgacaacacggcttttatggacgagttcttttctgagattgaggaaactcggcttaacattgacaagatctcagaacatgtagaggaggctaagaaactctacagtatcattctctctgcaccgattccagagccaaaaaccaaggatgacctagagcagctcacgactgagattaagaaaagggccaacaacgtccggaacaaactgaagagcatggagaagcatattgaagaagatgaggtcaggtcatcggcagaccttcggattcggaaatcccagcactctgtcctttctcggaagtttgtggaggtgatgaccaaatacaatgaagctcaagtggacttccgagaacgcagcaaagggcgaatccagcggcagctcgaaattactggcaaaaagacaaccgatgaggagctggaggagatgttggagagtggcaacccggccatcttcacttctgggatcattgactcacagatttccaagcaagccctcagtgagattgagggacgacacaaggacattgtgaggctggagagcagcatcaaggagcttcacgacatgtttatggacatcgccatgctggtggagaatcaggtaagtggcagtgagtcccagcgtggggagggaggagaggaaagctcagggtctactgagaacagggagaaagggaatactggaagccagtgaggtagggtgggagaaccattgggaatttgcataaaggagaaacagaatcccatgggaaagtgtgcattcaaattgaatgttgacactttgggtgatcttaaccttgtcattcttgcctgtcccttggccttgcagtcgttgctagttgatacagggtttgatgtgttctgtcaagtacccagttttcctggatttttgattttttttttttttttaagatggagtattgctctgttgcacaggctggagtgcagtggcgtgatcacagctcactgcagcttgacctcccaggatcaagcaatcctcccaggatttgtctttttttctttcttaaaaatcagagatccg

SEQ ID NO: 446448 - DNA, 1032 bp, Homo sapiens
cagacagcgaatgaccgcagccagacagtcgctcttgctcttcctcggccctgcggcaggatccgccggtgcaggggcctctccccggactccacgcgtgtctggagggctctcgggttagggaagggggctttggagacgccccgggcggccgggcggtggcgggacgcgggccctttaagaaggagcgaggggcgcggccaggtaggggcgggtccagggcggatcagcgctgcgccggcgccggcccgggagccggatttggagcgcgaggcgccggtgggggcggagggggctgcgcggcggaggctcccgtggcctcggacgctcctcctagctagcggccgccgcccgccgccgcctgcgcctccagctccttcgccccggcgggcccggccgccgcttccggcagctcacctgggaagcgctcacctgggacgcgctcacctgggacgcgctacctgcctccgggcgcctgggcttcaggatgaaggaccgtctggagcagctgaaggccaagcagctgacacaggatgatgatactgatgcggttgagattgctatcgacaacacggcttttatggacgagttcttttctgagattgaggaaactcggcttaacattgacaagatctcagaacatgtagaggaggctaagaaactctacagtatcattctctctgcaccgattccagagccaaaaaccaaggatgacctagagcagctcacgactgagattaagaaaagggccaacaacgtccggaacaaactgaagagtaagaagggaacaaagaaaacaaggccgtccccaccaccatctatctcagctcccctagggtccagctttccgaactgaaactcctcttgatggaagtgacaccacttggtccatctttgcttgtggtttgggctctgtccccgcaatgatccattgtagccccagaaatttaccttttcttaaatcctgactgtactggaaagagtccagaattgaagctaggagatgagaattaaaatgtgctttcagctgct

SEQ ID NO: 446449 - DNA, 3128 bp, Homo sapiens
cagacagcgaatgaccgcagccagacagtcgctcttgctcttcctcggccctgcggcaggatccgccggtgcaggggcctctccccggactccacgcgtgtctggagggctctcgggttagggaagggggctttggagacgccccgggcggccgggcggtggcgggacgcgggccctttaagaaggagcgaggggcgcggccaggtaggggcgggtccagggcggatcagcgctgcgccggcgccggcccgggagccggatttggagcgcgaggcgccggtgggggcggagggggctgcgcggcggaggctcccgtggcctcggacgctcctcctagctagcggccgccgcccgccgccgcctgcgcctccagctccttcgccccggcgggcccggccgccgcttccggcagctcacctgggaagcgctcacctgggacgcgctcacctgggacgcgctacctgcctccgggcgcctgggcttcaggatgaaggaccgtctggagcagctgaaggccaagcagctgacacaggatgatgatactgatgcggttgagattgctatcgacaacacggcttttatggacgagttcttttctgagattgaggaaactcggcttaacattgacaagatctcagaacatgtagaggaggctaagaaactctacagtatcattctctctgcaccgattccagagccaaaaaccaaggatgacctagagcagctcacgactgagattaagaaaagggccaacaacgtccggaacaaactgaagagcatggagaagcatattgaagaagatgaggtcaggtcatcggcagaccttcggattcggaaatcccagcactctgtcctttctcggaagtttgtggaggtgatgaccaaatacaatgaagctcaagtggacttccgagaacgcagcaaagggcgaatccagcggcagctcgaaattactggcaaaaagacaaccgatgaggagctggaggagatgttggagagtggcaacccggccatcttcacttctgggatcattgactcacagatttccaagcaagccctcagtgagattgagggacgacacaaggacattgtgaggctggagagcagcatcaaggagcttcacgacatgtttatggacatcgccatgctggtggagaatcagaaattgataattatcattgtgctagtagttgtgttgctgggcattttagcattgattattggactttccgttgggctgaattaagagtggcctaagaggctgctgcactgaaataaactgatttcactccagactggtgtggccacccttgtcttcagatgagaatggagtctgaatggccttcctgagagcgagtgcgacccgttcctttgtttccttgcaaccacccttggacctgactcagctaacaatctagccctgggggaatgtgatctacctgatgcgaccctgagttctccccagagcctcctcctgccccaccagctctcaagtaccttttctcctggactgtgtggacccacccagctttcttcctccctgttgtgtgtcagattatgccttgcacttgggaaagctcttgtgagactctcccaaggtgctgtatttttctacctcatggagtattctcccagaaactgcaatgtatttttttaggggagtatctttaacaaagcagaatgattcttctaagtttggcaacaagaaggcttggatctgagtcttctacctggcaggatgccaatcctgtttgttgtccgtatgtcctgaaaacatgagggactggcagatgtcattttggtctaaagagctgacttgtttgaaattcagccttaaattaagctcttagttgttcagcttggggggcaactttgatttttctctgtgttgtagtctctcatatttactcaaggagggaccaggatgatacagtcatctgaggttatgctttgcaaaaggctgacggtatggaatatgtttccatgtctgagtcttagaaactggctgctcattgttagaaagtgatgctttgtgagactattgtcttggggccaaaaataatcagggattttaaattgggcaagggacaaggtgctagaatcctaagctctggaaatatttcatgacactggtgtattcactcatgtgttccagatgtattctaattgtgtatgaaatgtatgtacacataagtgtgtgtgtctcaggaagtaggaaataaaaatggaagctattatgacctcaaaaaaaaaaagccaactttgagctaggataaaaattgggtaaaggacatttgcttacctgcaaatgaatcactgtggaaatgtgatcttcccatatcatcaagaaacttgttttctggatgaatactgggagaataaaatgagaactctggagtgagctaaattgatcccaattaagtttttctgcttagcagacagaaggtataattttttgacaccctttcccacctggtgcctatgctaggcttgtcctgagaacatccctcagtaacttgatattcacatgacctacaggatgtcccatctgcagggctgagtcagttggggaacaccagaggctacacagtagctcttcctgctactcggttaatgagcttggcaggttctttgtctcactgaattcttatcatggaaacagcagcagcagccgctaggaaatcttcaagtgtagtgtctgtgctaacccagtggtaaatcccttagatcccctgctggtctctggcagtctccttgattttgggtaccatgtatattttccgctttgactttaacgctttctaggatagggtaagcacccttaattcaggcactgtccattagcttcctttgcaaaggctacttatggccggtcacaatccagcactcagacagagccaaggcaatatcctcttgcccatggctatgatgtcagacagtggatgggctccagcaacaagagacaaaataactaaaggcctttgctctcctctgacattgaggcctggggcttacagtttggaatacaacatgtgaaggtttttgttgttgtttgtattttttagatgtaaacttgattattttattgctaatttaaaaataaaaatgactttgtattgattgtgaaa

SEQ ID NO: 446450 - DNA, 3095 bp, Homo sapiens
  misc_feature (3066)..(3066): n is a, c, g, or t
cagacagcgaatgaccgcagccagacagtcgctcttgctcttcctcggccctgcggcaggatccgccggtgcaggggcctctccccggactccacgcgtgtctggagggctctcgggttagggaagggggctttggagacgccccgggcggccgggcggtggcgggacgcgggccctttaagaaggagcgaggggcgcggccaggtaggggcgggtccagggcggatcagcgctgcgccggcgccggcccgggagccggatttggagcgcgaggcgccggtgggggcggagggggctgcgcggcggaggctcccgtggcctcggacgctcctcctagctagcggccgccgcccgccgccgcctgcgcctccagctccttcgccccggcgggcccggccgccgcttccggcagctcacctgggaagcgctcacctgggacgcgctcacctgggacgcgctacctgcctccgggcgcctgggcttcaggatgaaggaccgtctggagcagctgaaggccaagcagctgacacaggatgatgatactgatgcggttgagattgctatcgacaacacggcttttatggacgagttcttttctgagattgaggaaactcggcttaacattgacaagatctcagaacatgtagaggaggctaagaaactctacagtatcattctctctgcaccgattccagagccaaaaaccaaggatgacctagagcagctcacgactgagattaagaaaagggccaacaacgtccggaacaaactgaagagcatggagaagcatattgaagaagatgaggtcaggtcatcggcagaccttcggattcggaaatcccagcactctgtcctttctcggaagtttgtggaggtgatgaccaaatacaatgaagctcaagtggacttccgagaacgcagcaaagggcgaatccagcggcagctcgaaattactggcaaaaagacaaccgatgaggagctggaggagatgttggagagtggcaacccggccatcttcacttctgggatcattgactcacagatttccaagcaagccctcagtgagattgagggacgacacaaggacattgtgaggctggagagcagcatcaaggagcttcacgacatgtttatggacatcgccatgctggtggagaatcagggtgagatgttagataacatagagttgaatgtcatgcacacagtggaccacgtggagaaggcacgagatgaaacgaaaaaagctgtgaaataccagagtcaggcccggaagaaattgataattatcattgtgctagtagttgtgttgctgggcattttagcattgattattggactttccgttgggctgaattaagagtggcctaagaggctgctgcactgaaataaactgatttcactccagactggtgtggccacccttgtcttcagatgagaatggagtctgaatggccttcctgagagcgagtgcgacccgttcctttgtttccttgcaaccacccttggacctgactcagctaacaatctagccctgggggaatgtgatctacctgatgcgaccctgagttctccccagagcctcctcctgccccaccagctctcaagtaccttttctcctggactgtgtggacccacccagctttcttcctccctgttgtgtgtcagattatgccttgcacttgggaaagctcttgtgagactctcccaaggtgctgtatttttctacctcatggagtattctcccagaaactgcaatgtatttttttaggggagtatctttaacaaagcagaatgattcttctaagtttggcaacaagaaggcttggatctgagtcttctacctggcaggatgccaatcctgtttgttgtccgtatgtcctgaaaacatgagggactggcagatgtcattttggtctaaagagctgacttgtttgaaattcagccttaaattaagctcttagttgttcagcttggggggcaactttgatttttctctgtgttgtagtctctcatatttactcaaggagggaccaggatgatacagtcatctgaggttatgctttgcaaaaggctgacggtatggaatatgtttccatgtctgagtcttagaaactggctgctcattgttagaaagtgatgctttgtgagactattgtcttggggccaaaaataatcagggattttaaattgggcaagggacaaggtgctagaatcctaagctctggaaatatttcatgacactggtgtattcactcatgtgttccagatgtattctaattgtgtatgaaatgtatgtacacataagtgtgtgtgtctcaggaagtaggaaataaaaatggaagctattatgacctcaaaaaaaaaaagccaactttgagctaggataaaaattgggtaaaggacatttgcttacctgcaaatgaatcactgtggaaatgtgatcttcccatatcatcaagaaacttgttttctggatgaatactgggagaataaaatgagaactctggagtgagctaaattgatcccaattaagtttttctgcttagcagacagaaggtataattttttgacaccctttcccacctggtgcctatgctaggcttgtcctgagaacatccctcagtaacttgatattcacatgacctacaggatgtcccatctgcagggctgagtcagttggggaacaccagaggctacacagtagctcttcctgctactcggttaatgagcttggcaggttctttgtctcactgaattcttatcatggaaacagcagcagcagccgctaggaaatcttcaagtgtagtgtctgtgctaacccagtggtaaatcccttagatcccctgctggtctctggcagtctccttgattttgggtaccatgtatattttccgctttgactttaacgctttctaggatagggtaagcacccttaattcaggcactgtccattagcttcctttgcaaaggctacttatggccggtcacaatccagcactcagacagagccaaggcaatatcctcttgcccatggctatgatgtcagacagtggatgggctcctatnagtcctcttgcgtttgggggatccgcagt

SEQ ID NO: 446451 - DNA, 3004 bp, Homo sapiens
cagacagcgaatgaccgcagccagacagtcgctcttgctcttcctcggccctgcggcaggatccgccggtgcaggggcctctccccggactccacgcgtgtctggagggctctcgggttagggaagggggctttggagacgccccgggcggccgggcggtggcgggacgcgggccctttaagaaggagcgaggggcgcggccaggtaggggcgggtccagggcggatcagcgctgcgccggcgccggcccgggagccggatttggagcgcgaggcgccggtgggggcggagggggctgcgcggcggaggctcccgtggcctcggacgctcctcctagctagcggccgccgcccgccgccgcctgcgcctccagctccttcgccccggcgggcccggccgccgcttccggcagctcacctgggaagcgctcacctgggacgcgctcacctgggacgcgctacctgcctccgggcgcctgggcttcaggatgaaggaccgtctggagcagctgaaggccaagcagctgacacaggatgatgatactgatgcggttgagattgctatcgacaacacggcttttatggacgagttcttttctgagattgaggaaactcggcttaacattgacaagatctcagaacatgtagaggaggctaagaaactctacagtatcattctctctgcaccgattccagagccaaaaaccaaggatgacctagagcagctcacgactgagattaagaaaagggccaacaacgtccggaacaaactgaagagcatggagaagcatattgaagaagatgaggtcaggtcatcggcagaccttcggattcggaaatcccagcactctgtcctttctcggaagtttgtggaggtgatgaccaaatacaatgaagctcaagtggacttccgagaacgcagcaaagggcgaatccagcggcagctcgaaattactggcaaaaagacaaccgatgaggagctggaggagatgttggagagtggcaacccggccatcttcacttctgggatcattgactcacagatttccaagcaagccctcagtgagattgagggacgacacaaggacattgtgaggctggagagcagcatcaaggagcttcacgacatgtttatggacatcgccatgctggtggagaatcagggtgagatgttagataacatagagttgaatgtcatgcacacagtggaccacgtggagaaggcacgagatgaaacgaaaaaagctgtgaaataccagagtcaggcccggaagaaattgataattatcattgtgctagtagttgtgttgctgggcattttagcattgattattggactttccgttgggctgaattaagagtggcctaagaggctgctgcactgaaataaactgatttcactccagactggtgtggccacccttgtcttcagatgagaatggagtctgaatggccttcctgagagcgagtgcgacccgttcctttgtttccttgcaaccacccttggacctgactcagctaacaatctagccctgggggaatgtgatctacctgatgcgaccctgagttctccccagagcctcctcctgccccaccagctctcaagtaccttttctcctggactgtgtggacccacccagctttcttcctccctgttgtgtgtcagattatgccttgcacttgggaaagctcttgtgagactctcccaaggtgctgtatttttctacctcatggagtattctcccagaaactgcaatgtatttttttaggggagtatctttaacaaagcagaatgattcttctaagtttggcaacaagaaggcttggatctgagtcttctacctggcaggatgccaatcctgtttgttgtccgtatgtcctgaaaacatgagggactggcagatgtcattttggtctaaagagctgacttgtttgaaattcagccttaaattaagctcttagttgttcagcttggggggcaactttgatttttctctgtgttgtagtctctcatatttactcaaggagggaccaggatgatacagtcatctgaggttatgctttgcaaaaggctgacggtatggaatatgtttccatgtctgagtcttagaaactggctgctcattgttagaaagtgatgctttgtgagactattgtcttggggccaaaaataatcagggattttaaattgggcaagggacaaggtgctagaatcctaagctctggaaatatttcatgacactggtgtattcactcatgtgttccagatgtattctaattgtgtatgaaatgtatgtacacataagtgtgtgtgtctcaggaagtaggaaataaaaatggaagctattatgacctcaaaaaaaaaaagccaactttgagctaggataaaaattgggtaaaggacatttgcttacctgcaaatgaatcactgtggaaatgtgatcttcccatatcatcaagaaacttgttttctggatgaatactgggagaataaaatgagaactctggagtgagctaaattgatcccaattaagtttttctgcttagcagacagaaggtataattttttgacaccctttcccacctggtgcctatgctaggcttgtcctgagaacatccctcagtaacttgatattcacatgacctacaggatgtcccatctgcagggctgagtcagttggggaacaccagaggctacacagtagctcttcctgctactcggttaatgagcttggcaggttctttgtctcactgaattcttatcatggaaacagcagcagcagccgctaggaaatcttcaagtgtagtgtctgtgctaacccagtggtaaatcccttagatcccctgctggtctctggcagtctccttgaggtcggtgtaaaagcataggccactcttagaccatgacgctttctaggacaggggatgctccagtcaatcaggtcacattccattagtgtactgagcgatggtcggaatggccggttacgcgccaacattctgcc

SEQ ID NO: 446452 - DNA, 1689 bp, Homo sapiens
cagacagcgaatgaccgcagccagacagtcgctcttgctcttcctcggccctgcggcaggatccgccggtgcaggggcctctccccggactccacgcgtgtctggagggctctcgggttagggaagggggctttggagacgccccgggcggccgggcggtggcgggacgcgggccctttaagaaggagcgaggggcgcggccaggtaggggcgggtccagggcggatcagcgctgcgccggcgccggcccgggagccggatttggagcgcgaggcgccggtgggggcggagggggctgcgcggcggaggctcccgtggcctcggacgctcctcctagctagcggccgccgcccgccgccgcctgcgcctccagctccttcgccccggcgggcccggccgccgcttccggcagctcacctgggaagcgctcacctgggacgcgctcacctgggacgcgctacctgcctccgggcgcctgggcttcaggatgaaggaccgtctggagcagctgaaggccaagcagctgacacaggatgatgatactgatgcggttgagattgctatcgacaacacggcttttatggacgagttcttttctgagattgaggaaactcggcttaacattgacaagatctcagaacatgtagaggaggctaagaaactctacagtatcattctctctgcaccgattccagagccaaaaaccaaggatgacctagagcagctcacgactgagattaagaaaagggccaacaacgtccggaacaaactgaagagcatggagaagcatattgaagaagatgaggtcaggtcatcggcagaccttcggattcggaaatcccagcactctgtcctttctcggaagtttgtggaggtgatgaccaaatacaatgaagctcaagtggacttccgagaacgcagcaaagggcgaatccagcggcagctcgaaattactggcaaaaagacaaccgatgaggagctggaggagatgttggagagtggcaacccggccatcttcacttctgggatcattgactcacagatttccaagcaagccctcagtgagattgagggacgacacaaggacattgtgaggctggagagcagcatcaaggagcttcacgacatgtttatggacatcgccatgctggtggagaatcagggtgagatgttagataacatagagttgaatgtcatgcacacagtggaccacgtggagaaggcacgagatgaaacgaaaaaagctgtgaaataccagagtcaggcccggaagaaattgataattatcattgtgctagtagttgtgttgctgggcattttagcattgattattggactttccgttgggctgaattaagagtggcctaagaggctgctgcactgaaataaactgatttcactccagactggtgtggccacccttgtcttcagatgagaatggagtctgaatggccttcctgagagcgagtgcgacccgttcctttgtttccttgcaaccacccttggacctgactcagctaacaatctagccctgggggaatgtgatctacctgaccagttcctgcttcttgaaaactgacttctcaatctctggaagttgggggttttgttgtggcaatttgcttgtgttgttttttaatgtggactgcgagaaacaggggcagttgaggtcatgttgaaatctgctgt

SEQ ID NO: 446453 - DNA, 1544 bp, Homo sapiens
cagacagcgaatgaccgcagccagacagtcgctcttgctcttcctcggccctgcggcaggatccgccggtgcaggggcctctccccggactccacgcgtgtctggagggctctcgggttagggaagggggctttggagacgccccgggcggccgggcggtggcgggacgcgggccctttaagaaggagcgaggggcgcggccaggtaggggcgggtccagggcggatcagcgctgcgccggcgccggcccgggagccggatttggagcgcgaggcgccggtgggggcggagggggctgcgcggcggaggctcccgtggcctcggacgctcctcctagctagcggccgccgcccgccgccgcctgcgcctccagctccttcgccccggcgggcccggccgccgcttccggcagctcacctgggaagcgctcacctgggacgcgctcacctgggacgcgctacctgcctccgggcgcctgggcttcaggatgaaggaccgtctggagcagctgaaggccaagcagctgacacaggatgatgatactgatgcggttgagattgctatcgacaacacggcttttatggacgagttcttttctgagattgaggaaactcggcttaacattgacaagatctcagaacatgtagaggaggctaagaaactctacagtatcattctctctgcaccgattccagagccaaaaaccaaggatgacctagagcagctcacgactgagattaagaaaagggccaacaacgtccggaacaaactgaagagcatggagaagcatattgaagaagatgaggtcaggtcatcggcagaccttcggattcggaaatcccagcactctgtcctttctcggaagtttgtggaggtgatgaccaaatacaatgaagctcaagtggacttccgagaacgcagcaaagggcgaatccagcggcagctcgaaattactggcaaaaagacaaccgatgaggagctggaggagatgttggagagtggcaacccggccatcttcacttctgggatcattgactcacagatttccaagcaagccctcagtgagattgagggacgacacaaggacattgtgaggctggagagcagcatcaaggagcttcacgacatgtttatggacatcgccatgctggtggagaatcagaaattgataattatcattgtgctagtagttgtgttgctgggcattttagcattgattattggactttccgttgggctgaattaagagtggcctaagaggctgctgcactgaaattgtgtctcttcttattcctcctccttccatgtgaccaggggatctaaaagtcagcttattacagcattgagcattcaacttcatcttgaaagataagcaacagtgagatgaacaacctctcatagacaggtggttggttgattttttttttcccctcttttttctggcacttggagtctagcccttgacttttttgtatgtgaactttaaattttggtttggctctgaacaatctgattgaaatagatgttgaaattttaaaaagaaa

SEQ ID NO: 446454 - DNA, 660 bp, Homo sapiens
cagctctacggcggccgcgcgctccaggccggtcgctccaccccccggctcccgggactgtggactccacgaccctgtcctcggccctgtccgcgccgaagcagcccgggactgcgcagcgccccgcgtgccggtgagcgaccccggacgtgcagtccccaggtccccttccggagcgaggctgagcggctgcgccgcggcttgagccgggcctgacaaggaggggaggccgctggggtgctgggccagccgcaggtacggcggcggtcagggctggtgatcgagttgctgtgtcgcctctaatgaggcccagccagggaacactcggcttcggcccaagccctacctctgggttgcctctaggccctcacaccttgagcgccaggtggccctcttccttttgctgttgatgaatgttcttgccgtggtgccgggatcttattttgcagctttacagagtaggctttgtgctaggtgttgtttatggagcttttcaaaggcgcttgtttccttagttctcaagcccttttagaactaaaaccagtgtctacacagaagatcaggagccatttaaattggagtgctgtgatatattttttctctccaaactgagtctgatatccatgttgactttcagtaaactaaggaaccgctataata

SEQ ID NO: 446455 - DNA, 533 bp, Homo sapiens
aaaaataaaattctgagccccccaactaagtggaacccgcttctctgtcaagggcattccaaagtaaacctaaaaaggtagttcaggccatgatgaaaaggtgggtggaggggattgaacatgccccgttgtaccttcctctctttggaattcaggcacaactgaccagcatcaattaaaacagagatttgaagactaacaagagtctctttgtagcaataagatatcaaatcccaacctgactctaatatagaatcactcgacagatagcaggccctgagagaaattgaaatatcttaccccaaattctgtacagaatcccctttcctttccagatcttttcctaattcagcagcgatttaaccaagagcctggaatattttaaggagtaataagagacatttacaaactattctctctgaagcctgctacctggaggcatcatctagataatcagaaccttggcttccacatcctcctcccttgtcttaactacaaacatttctttctgctgacttcaactcctcaggtag

SEQ ID NO: 446456 - DNA, 325 bp, Homo sapiens
  misc_feature (7)..(7): n is a, c, g, or t
  misc_feature (62)..(62): n is a, c, g, or t
gaaattnttggagagaatagtcatacctactttaaaagagaataaattgcctttcctaaatncctctgcttcgctcctttcctggcgttgctctggaaccttgtgagttatatgtatgatttctgtactctgatatccatcaaagtgcataacatagtactcatgatgcagtaagtacaaatcttttttgaaagagattttgcttgttaacattttggatttataacattggcttataatatacacaacatctttataaatgccacctcagttgggttttaagccttacaagagtgctatgagtaaatatcacccactttaaaaa

SEQ ID NO: 446457 - DNA, 331 bp, Homo sapiens
cagctctacggcggccgcgcgctccaggccggtcgctccaccccccggctcccgggactgtggactccacgaccctgtcctcggccctgtccgcgccgaagcagcccgggactgcgcagcgccccgcgtgccgatcttttcctaattcagcagcgatttaaccaagagcctggaatattttaaggagtaataagagacatttacaaactattctctctgaagcctgctacctggaggcatcatctagataatcagaaccttggcttccacatcctcctcccttgtcttaactacaaacatttctttctgctgacttcaactcctcaggtag

SEQ ID NO: 446458 - DNA, 6299 bp, Homo sapiens
cagctctacggcggccgcgcgctccaggccggtcgctccaccccccggctcccgggactgtggactccacgaccctgtcctcggccctgtccgcgccgaagcagcccgggactgcgcagcgccccgcgtgccgacatgggaaagtctctttctcatttgcctttgcattcaagcaaagaagatgcttatgatggagtcacatctgaaaacatgaggaatggactggttaatagtgaagtccataatgaagatggaagaaatggagatgtctctcagtttccatatgtggaatttacaggaagagatagtgtcacctgccctacttgtcagggaacaggaagaattcctagggggcaagaaaaccaactggtggcattgattccatatagtgatcagagattaaggccaagaagaacaaagctgtatgtgatggcttctgtgtttgtctgtctactcctttctggattggctgtgtttttccttttccctcgctctatcgacgtgaaatacattggtgtaaaatcagcctatgtcagttatgatgttcagaagcgtacaatttatttaaatatcacaaacacactaaatataacaaacaataactattactctgtcgaagttgaaaacatcactgcccaagttcaattttcaaaaacagttattggaaaggcacgcttaaacaacataaccattattggtccacttgatatgaaacaaattgattacacagtacctaccgttatagcagaggaaatgagttatatgtatgatttctgtactctgatatccatcaaagtgcataacatagtactcatgatgcaagttactgtgacaacaacatactttggccactctgaacagatatcccaggagaggtatcagtatgtcgactgtggaagaaacacaacttatcagttggggcagtctgaatatttaaatgtacttcagccacaacagtaaaaactggaagagatggatttaaagaagaaatatctattgatatttcctatactctcaatgaagaggtatttcctaataggagaccttaaattgaacaaacctaaagtttacacttctaagagtacagttaaaagtatgtggacctgcagttcttgtaactctccactctgtgttaatgatatatttgtactaggatcttttacttgaatctaaatttactggttgatttccttctccagcctatcccctacagggaaaagctgatacttcccctatagtacaataaataattatttaaaagtcatagctccagtcactactgaaaacataattttggtgataaacataatttgagaaacttaatttctgaatgtttttatagaaaattactgaaaatctattactcatggaagacttttaaagaataaccttttttcctgttttataaattcccattgttatatggtagtatttcagctacacaatattttagcttttagctagacatttataggttttcatttgttgaaatggtaatcatctgcatgtttttgtcacttatttcaggttagtgattgcctaacacttataagccaaaataatctttgcaaaattccatacctaaaattttgaaagcccctaatgttttcacacatctttctgtattagttatagttttgtgaaatctttgtgtgatcttcaaacattatcatttaatgtacaatactgtaaataaactgtgcatggcttttatacagctttagtaaatgtcaaataaagtggtacagactcattacaacaagtttctcataaaaatacaataaataggaaaatgaaattcagaaacccatagactgggaataggttccagttacagcttggatctggcataaaataaatttgaaataaaatattttgatgctccatttttttatgttgcttttcatactaaagaatggtgtagacttgttttgcaactgttaggtacccagttatcaattttatcaatgttttagaggaggaaattatttttttggtagaaattgttcaagaaatccttaattgaatgtcattaaatgatggtggccaaaataaaacctatttagaaatttaatcactttgcacatcacttggaatatgatgcctctagtagttacttttttatagttttctacttttggttttatttaaaattgttttcaaatatagattattgacttattcaactttgctgttttatattttcagtatcatttttcatttgttttttttttttttgtcttttcacttaccaagttctagggacatttaaaatatgtactaagtgtaggagtggttatgataccaaaaaatgtagctgggttgagattaatttcgttctgttttctcatgacagaaatcaggtttccctttccccacccctaagtgcctaacttaggtctgaaacagcctgtttattagtctgactctctcaaccataaaacataagctttatttaattctgcctttaaacacactcaggtttccccttaattttcatattattttctgcaagttttcttgagtatcttcaattcgttgaatgtggtttttggtttttttttgttttaacactagtcttcccttaattcattgctaactcaagccatccttactattaaacccaaatcagtcctttaagttcattatggcctttctagtatttaaaaaaaaaaaaatcattttcatttttcttctgctacgtttcctgactactactgcatacttctctgatacaggttctgtttgtattttttatatcattctcattttctcatttgacatgatctatgtctatatatgatataggtccccttttgtctcaaaatttttaattatgtgacttcaaaaatcacctgtatctgtagtagggcttccaaatctgcttctccatatgtgaccagtcacctgtctgctttcacatttagctagtgaactacacatttactaaaatgtgtaaattttacacatttagtgactgtgtaaaataaaaaaaaagttattttatcatatcctttctattatgttcccatcctgtcctcatgtcccatttactttattatcaccattcatttcttcaaaattatcttttagatacgctcatacaaaaatcaatccttgttttcttgcttgtgtcttttaaccttggaaaattacatcgtgtaaattaaacagatttttctgatgatctgtgcttcttatatactattagagtgcatgatagtatctcctgaaaaggatggaaagtagaagcatttgcttttagtcacttaattttgaatcttttttcttcatcttttgaattaattttttttattatatctacttttagtggagtttgagtcagaaaaaaacaagaatttgaaacaagtaaaaagatagaagagaaataaagatggtatgtgactactttcagagagagttaagtaactgtcagaataagcctggaacaaaacaggctgtaaattaataaaactacaaacacacattcaggtgaagcagaagtatagccataaaacatctagaaagagtgaatgaggcttttagcttttcttaggtcaatgtccagtgtgcttttttccatgggaataggataggtattaatacgcttttctaaactgctctcagaccttatccagaggacatggtaaagatatgttacagaaatttttctgatacttcctggaataactttaagttacaccctagtagactggtcattctaataaaatccagtactataacaaacctctgtatgttgatagcacattggccctttttagagttctttcctatgtttttcttacgtgatttcccacagttccatgagtccaacaaaggagagtgataggctccttatcttttagaagaggaaggaaaggcatgaagaagttgagggactggctgaagatcacgtacttactaagtagtacaactggagcaagatcaagtatctctgtctcccatatctgtgttctatcatttaaaatatatattggaaatccctgctgactcagattggtatgattaaaaatgagaggaaagttcaaatagttagtagtgacaaactaatactgctggactaagattttggtagcattgttttctaaaatattttaaatggagaatgaacacttataaaatgctttggaacataatctttagcttaattttctgttaaaatttagtaccccttcatcattccaataaagataagactgatccattgtctaaggaaattatttataaataatagagattaatttatttgagatttgaaataagaatagtatgaaaatattagataccacataaattgtttgaaattactgaataaccatcttaagtatggaacatttaaatggctatattttatttgtgtacagtttttctgtgccttgttaggccagtgaagcaattattttctctaagaaaatgacaataaaatataacacacttcagattgtctgatttacagtttggaaaggacaccgcaatgttcaaataggtaggagaccatcaaaaacacaattaaagtaacatattaggagacttgaaacttcagcctaataaatccttcatggttcttagccttattattgtgatataattctagatattttcttggagggcatgtgcccaactctcccgcaccccattttgtttgtcttttaaagttcttagaataaacagttctttatataataattatattttatttaagaaaatagtttgttaggtactttttaaaagatgtaaatttttaaatttacaaatacatatgggtctttgataagcaataggaattgaattacaagttactagggttataagcaaaaggttgcttaccataatgtcattaggtcacgatttttagctcacatctggaagcagcaactacttggctcaagtacatataagagtaattagttttattctctcttttttataaaatcgggtttcagatgagatgtttatcttagactattttagggaaaaattttacatgtttgagatggtggagtaaaaagactgttaaacatttcttttaaaaaattatttttacattacaacaatatatttatgatgtgttcagatcaaaaatttaacttctgtgtcccagatctactttcaaagtgagattttcacttgtcagcttaaatttctgactagaactaacgtttgtgtatttttgtgcttagtcggaatacaaatttcacagtggatttttgaagtttgtccttaaattggataaaatcaagtgattaaagttactaaagagataaaaatggtaatttccatttttaaaagtaatttggttgtgtttatagttatttgtacaagtatttatcacagactctaaattgaaaaatatagtatgatctatatttgaccctaaaaatgttggattaatttaacaaatatggcagatttttcataactaagtcttaagtcttctaaaaggaagctgttacccttctgtttttaattacattaattgaaatgtgttttaagagatacaatttcagcatattttatatattaaaaaacaaaaaaggattagtattgagccagtggccaaaaggtaatattactaccatgtagactgttatagttcaaattgtcccacttcacccagaattttagaaactagaagtctgggaggtactatatcagctgtagttgggtaattccaagtgctgatagtactattcatcttttttattattgtgtcagatgaaacaaatgccaagttgcaaaatatgcagatttttattatataatggttttaggcataaattattaacaagccatgccttatgtgtttcatcttatatttttctttagaactaaactataacagattttggaaaatgatttgacgtgcttgctcacttgattgacttggtcagatatttgaatgatggtattacctagattctaatccttgattctagttatataataaataatatagaatatgaaaatatgtttgggcatttactgtttatattatgtagtagcctccatcatgacacacttactacatttatgaattgagcagttctgtaattgtaattattattgctgttcatgtaacaaaacatgcttatgataatagcaaacaaatagaaatgcccccaaaatgctatttttttaattcagttataactgttactcttgtagttgtgtatgacgcaataaaatttgtaaaaaaatttcagcatgaaaaataaaatttgtatccctcaatcgacgccggtcgacgatatgccaaactgcggggccgtacagccttg

SEQ ID NO: 446459 - DNA, 5708 bp, Homo sapiens
cagctctacggcggccgcgcgctccaggccggtcgctccaccccccggctcccgggactgtggactccacgaccctgtcctcggccctgtccgcgccgaagcagcccgggactgcgcagcgccccgcgtgccgacatgggaaagtctctttctcatttgcctttgcattcaagcaaagaagatgcttatgatggagtcacatctgaaaacatgaggaatggactggttaatagtgaagtccataatgaagatggaagaaatggagatgtctctcagtttccatatgtggaatttacaggaagagatagtgtcacctgccctacttgtcagggaacaggaagaattcctagggggcaagaaaaccaactggtggcattgattccatatagtgatcagagattaaggccaagaagaacaaagctgtatgtgatggcttctgtgtttgtctgtctactcctttctggattggctgtgtttttccttttccctcgctctatcgacgtgaaatacattggtgtaaaatcagcctatgtcagttatgatgttcagaagcgtacaatttatttaaatatcacaaacacactaaatataacaaacaataactattactctgtcgaagttgaaaacatcactgcccaagttcaattttcaaaaacagttattggaaaggcacgcttaaacaacataaccattattggtccacttgatatgaaacaaattgattacacagtacctaccgttatagcagaggaaatgagttatatgtatgatttctgtactctgatatccatcaaagtgcataacatagtactcatgatgcaagttactgtgacaacaacatactttggccactctgaacagatatcccaggagaggtatcagtatgtcgactgtggaagaaacacaacttatcagttggggcagtctgaatatttaaatgtacttcagccacaacagtaaaaactggaagagatggatttaaagaagaaatatctattgatatttcctatactctcaatgaagaggtatttcctaataggagaccttaaattgaacaaacctaaagtttacacttctaagagtacagttaaaagtatgtggacctgcagttcttgtaactctccactctgtgttaatgatatatttgtactaggatcttttacttgaatctaaatttactggttgatttccttctccagcctatcccctacagggaaaagctgatacttcccctatagtacaataaataattatttaaaagtcatagctccagtcactactgaaaacataattttggtgataaacataatttgagaaacttaatttctgaatgtttttatagaaaattactgaaaatctattactcatggaagacttttaaagaataaccttttttcctgttttataaattcccattgttatatggtagtatttcagctacacaatattttagcttttagctagacatttataggttttcatttgttgaaatggtaatcatctgcatgtttttgtcacttatttcaggttagtgattgcctaacacttataagccaaaataatctttgcaaaattccatacctaaaattttgaaagcccctaatgttttcacacatctttctgtattagttatagttttgtgaaatctttgtgtgatcttcaaacattatcatttaatgtacaatactgtaaataaactgtgcatggcttttatacagctttagtaaatgtcaaataaagtggtacagactcattacaacaagtttctcataaaaatacaataaataggaaaatgaaattcagaaacccatagactgggaataggttccagttacagcttggatctggcataaaataaatttgaaataaaatattttgatgctccatttttttatgttgcttttcatactaaagaatggtgtagacttgttttgcaactgttaggtacccagttatcaattttatcaatgttttagaggaggaaattatttttttggtagaaattgttcaagaaatccttaattgaatgtcattaaatgatggtggccaaaataaaacctatttagaaatttaatcactttgcacatcacttggaatatgatgcctctagtagttacttttttatagttttctacttttggttttatttaaaattgttttcaaatatagattattgacttattcaactttgctgttttatattttcagtatcatttttcatttgttttttttttttttgtcttttcacttaccaagttctagggacatttaaaatatgtactaagtgtaggagtggttatgataccaaaaaatgtagctgggttgagattaatttcgttctgttttctcatgacagaaatcaggtttccctttccccacccctaagtgcctaacttaggtctgaaacagcctgtttattagtctgactctctcaaccataaaacataagctttatttaattctgcctttaaacacactcaggtttccccttaattttcatattattttctgcaagttttcttgagtatcttcaattcgttgaatgtggtttttggtttttttttgttttaacactagtcttcccttaattcattgctaactcaagccatccttactattaaacccaaatcagtcctttaagttcattatggcctttctagtatttaaaaaaaaaaaaatcattttcatttttcttctgctacgtttcctgactactactgcatacttctctgatacaggttctgtttgtattttttatatcattctcattttctcatttgacatgatctatgtctatatatgatataggtccccttttgtctcaaaatttttaattatgtgacttcaaaaatcacctgtatctgtagtagggcttccaaatctgcttctccatatgtgaccagtcacctgtctgctttcacatttagctagtgaactacacatttactaaaatgtgtaaattttacacatttagtgactgtgtaaaataaaaaaaaagttattttatcatatcctttctattatgttcccatcctgtcctcatgtcccatttactttattatcaccattcatttcttcaaaattatcttttagatacgctcatacaaaaatcaatccttgttttcttgcttgtgtcttttaaccttggaaaattacatcgtgtaaattaaacagatttttctgatgatctgtgcttcttatatactattagagtgcatgatagtatctcctgaaaaggatggaaagtagaagcatttgcttttagtcacttaattttgaatcttttttcttcatcttttgaattaattttttttattatatctacttttagtggagtttgagtcagaaaaaaacaagaatttgaaacaagtaaaaagatagaagagaaataaagatggtatgtgactactttcagagagagttaagtaactgtcagaataagcctggaacaaaacaggctgtaaattaataaaactacaaacacacattcaggtgaagcagaagtatagccataaaacatctagaaagagtgaatgaggcttttagcttttcttaggtcaatgtccagtgtgcttttttccatgggaataggataggtattaatacgcttttctaaactgctctcagaccttatccagaggacatggtaaagatatgttacagaaatttttctgatacttcctggaataactttaagttacaccctagtagactggtcattctaataaaatccagtactataacaaacctctgtatgttgatagcacattggccctttttagagttctttcctatgtttttcttacgtgatttcccacagttccatgagtccaacaaaggagagtgataggctccttatcttttagaagaggaaggaaaggcatgaagaagttgagggactggctgaagatcacgtacttactaagtagtacaactggagcaagatcaagtatctctgtctcccatatctgtgttctatcatttaaaatatatattggaaatccctgctgactcagattggtatgattaaaaatgagaggaaagttcaaatagttagtagtgacaaactaatactgctggactaagattttggtagcattgttttctaaaatattttaaatggagaatgaacacttataaaatgctttggaacataatctttagcttaattttctgttaaaatttagtaccccttcatcattccaataaagataagactgatccattgtctaaggaaattatttataaataatagagattaatttatttgagatttgaaataagaatagtatgaaaatattagataccacataaattgtttgaaattactgaataaccatcttaagtatggaacatttaaatggctatattttatttgtgtacagtttttctgtgccttgttaggccagtgaagcaattattttctctaagaaaatgacaataaaatataacacacttcagattgtctgatttacagtttggaaaggacaccgcaatgttcaaataggtaggagaccatcaaaaacacaattaaagtaacatattaggagacttgaaacttcagcctaataaatccttcatggttcttagccttattattgtgatataattctagatattttcttggagggcatgtgcccaactctcccgcaccccattttgtttgtcttttaaagttcttagaataaacagttctttatataataattatattttatttaagaaaatagtttgttaggtactttttaaaagatgtaaatttttaaatttacaaatacatatgggtctttgataagcaataggaattgaattacaagttactagggttataagcaaaaggttgcttaccataatgtcattaggtcacgatttttagctcacatctggaagcagcaactacttggctcaagtacatataagagtaattagttttattctctcttttttataaaatcgggtttcagatgagatgtttatcttagactattttagggaaaaattttacatgtttgagatggtggagtaaaaagactgttaaacatttcttttaaaaaattatttttacattacaacaatatatttatgatgtgttcagatcaaaaatttaacttctgtgtcccagatctactttcaaagtgagattttcacttgtcagcttaaatttctgactagaactaacgtttgtgtatttttgtgcttagtcggaatacaaatttcacagtggatttttgaagtttgtccttaaattggataaaatcaagtgattaaagttactaaagagataaaaatggtaatttccatttttaaaagtaatttggttgtgtttatagttatttgtacaagtatttatcacagactctaaattgaaaaatatagtatgatctatatttgaccctaaaaatgttggattaatttaacaaatatggcagatttttcataactaagtcttaagtcttctaaaaggaagctgttacccttctgtttttaaattccttatgaatgtgtttagagatacatcgatattttttttttaaccaacaggtggtttgtgccgggaggggtttatacagggcgggtggtaagggcctcccgattgaaaagggggacaaagggggacagggggaaaatttttggggaaagagggaacaaatgttgtggaaaccgggtttaagaaggggggggggtgctggtgaataattgtgtatcag

SEQ ID NO: 446460 - DNA, 6295 bp, Homo sapiens
ccgggctgcaggaattcggcacaaatggagatgtctctcagtttccatatgtggaatttacaggaagagatagtgtcacctgccctacttgtcagggaacaggaagaattcctagggggcaagaaaaccaactggtggcattgattccatatagtgatcagagattaaggccaagaagaacaaagctgtatgtgatggcttctgtgtttgtctgtctactcctttctggattggctgtgtttttccttttccctcgctctatcgacgtgaaatacattggtgtaaaatcagcctatgtcagttatgatgttcagaagcgtacaatttatttaaatatcacaaacacactaaatataacaaacaataactattactctgtcgaagttgaaaacatcactgcccaagttcaattttcaaaaacagttattggaaaggcacgcttaaacaacataaccattattggtccacttgatatgaaacaaattgattacacagtacctaccgttatagcagaggaaatgagttatatgtatgatttctgtactctgatatccatcaaagtgcataacatagtactcatgatgcaagttactgtgacaacaacatactttggccactctgaacagatatcccaggagaggtatcagtatgtcgactgtggaagaaacacaacttatcagttggggcagtctgaatatttaaatgtacttcagccacaacagtaaaaactggaagagatggatttaaagaagaaatatctattgatatttcctatactctcaatgaagaggtatttcctaataggagaccttaaattgaacaaacctaaagtttacacttctaagagtacagttaaaagtatgtggacctgcagttcttgtaactctccactctgtgttaatgatatatttgtactaggatcttttacttgaatctaaatttactggttgatttccttctccagcctatcccctacagggaaaagctgatacttcccctatagtacaataaataattatttaaaagtcatagctccagtcactactgaaaacataattttggtgataaacataatttgagaaacttaatttctgaatgtttttatagaaaattactgaaaatctattactcatggaagacttttaaagaataaccttttttcctgttttataaattcccattgttatatggtagtatttcagctacacaatattttagcttttagctagacatttataggttttcatttgttgaaatggtaatcatctgcatgtttttgtcacttatttcaggttagtgattgcctaacacttataagccaaaataatctttgcaaaattccatacctaaaattttgaaagcccctaatgttttcacacatctttctgtattagttatagttttgtgaaatctttgtgtgatcttcaaacattatcatttaatgtacaatactgtaaataaactgtgcatggcttttatacagctttagtaaatgtcaaataaagtggtacagactcattacaacaagtttctcataaaaatacaataaataggaaaatgaaattcagaaacccatagactgggaataggttccagttacagcttggatctggcataaaataaatttgaaataaaatattttgatgctccatttttttatgttgcttttcatactaaagaatggtgtagacttgttttgcaactgttaggtacccagttatcaattttatcaatgttttagaggaggaaattatttttttggtagaaattgttcaagaaatccttaattgaatgtcattaaatgatggtggccaaaataaaacctatttagaaatttaatcactttgcacatcacttggaatatgatgcctctagtagttacttttttatagttttctacttttggttttatttaaaattgttttcaaatatagattattgacttattcaactttgctgttttatattttcagtatcatttttcatttgttttttttttttttgtcttttcacttaccaagttctagggacatttaaaatatgtactaagtgtaggagtggttatgataccaaaaaatgtagctgggttgagattaatttcgttctgttttctcatgacagaaatcaggtttccctttccccacccctaagtgcctaacttaggtctgaaacagcctgtttattagtctgactctctcaaccataaaacataagctttatttaattctgcctttaaacacactcaggtttccccttaattttcatattattttctgcaagttttcttgagtatcttcaattcgttgaatgtggtttttggtttttttttgttttaacactagtcttcccttaattcattgctaactcaagccatccttactattaaacccaaatcagtcctttaagttcattatggcctttctagtatttaaaaaaaaaaaaatcattttcatttttcttctgctacgtttcctgactactactgcatacttctctgatacaggttctgtttgtattttttatatcattctcattttctcatttgacatgatctatgtctatatatgatataggtccccttttgtctcaaaatttttaattatgtgacttcaaaaatcacctgtatctgtagtagggcttccaaatctgcttctccatatgtgaccagtcacctgtctgctttcacatttagctagtgaactacacatttactaaaatgtgtaaattttacacatttagtgactgtgtaaaataaaaaaaaagttattttatcatatcctttctattatgttcccatcctgtcctcatgtcccatttactttattatcaccattcatttcttcaaaattatcttttagatacgctcatacaaaaatcaatccttgttttcttgcttgtgtcttttaaccttggaaaattacatcgtgtaaattaaacagatttttctgatgatctgtgcttcttatatactattagagtgcatgatagtatctcctgaaaaggatggaaagtagaagcatttgcttttagtcacttaattttgaatcttttttcttcatcttttgaattaattttttttattatatctacttttagtggagtttgagtcagaaaaaaacaagaatttgaaacaagtaaaaagatagaagagaaataaagatggtatgtgactactttcagagagagttaagtaactgtcagaataagcctggaacaaaacaggctgtaaattaataaaactacaaacacacattcaggtgaagcagaagtatagccataaaacatctagaaagagtgaatgaggcttttagcttttcttaggtcaatgtccagtgtgcttttttccatgggaataggataggtattaatacgcttttctaaactgctctcagaccttatccagaggacatggtaaagatatgttacagaaatttttctgatacttcctggaataactttaagttacaccctagtagactggtcattctaataaaatccagtactataacaaacctctgtatgttgatagcacattggccctttttagagttctttcctatgtttttcttacgtgatttcccacagttccatgagtccaacaaaggagagtgataggctccttatcttttagaagaggaaggaaaggcatgaagaagttgagggactggctgaagatcacgtacttactaagtagtacaactggagcaagatcaagtatctctgtctcccatatctgtgttctatcatttaaaatatatattggaaatccctgctgactcagattggtatgattaaaaatgagaggaaagttcaaatagttagtagtgacaaactaatactgctggactaagattttggtagcattgttttctaaaatattttaaatggagaatgaacacttataaaatgctttggaacataatctttagcttaattttctgttaaaatttagtaccccttcatcattccaataaagataagactgatccattgtctaaggaaattatttataaataatagagattaatttatttgagatttgaaataagaatagtatgaaaatattagataccacataaattgtttgaaattactgaataaccatcttaagtatggaacatttaaatggctatattttatttgtgtacagtttttctgtgccttgttaggccagtgaagcaattattttctctaagaaaatgacaataaaatataacacacttcagattgtctgatttacagtttggaaaggacaccgcaatgttcaaataggtaggagaccatcaaaaacacaattaaagtaacatattaggagacttgaaacttcagcctaataaatccttcatggttcttagccttattattgtgatataattctagatattttcttggagggcatgtgcccaactctcccgcaccccattttgtttgtcttttaaagttcttagaataaacagttctttatataataattatattttatttaagaaaatagtttgttaggtactttttaaaagatgtaaatttttaaatttacaaatacatatgggtctttgataagcaataggaattgaattacaagttactagggttataagcaaaaggttgcttaccataatgtcattaggtcacgatttttagctcacatctggaagcagcaactacttggctcaagtacatataagagtaattagttttattctctcttttttataaaatcgggtttcagatgagatgtttatcttagactattttagggaaaaattttacatgtttgagatggtggagtaaaaagactgttaaacatttcttttaaaaaattatttttacattacaacaatatatttatgatgtgttcagatcaaaaatttaacttctgtgtcccagatctactttcaaagtgagattttcacttgtcagcttaaatttctgactagaactaacgtttgtgtatttttgtgcttagtcggaatacaaatttcacagtggatttttgaagtttgtccttaaattggataaaatcaagtgattaaagttactaaagagataaaaatggtaatttccatttttaaaagtaatttggttgtgtttatagttatttgtacaagtatttatcacagactctaaattgaaaaatatagtatgatctatatttgaccctaaaaatgttggattaatttaacaaatatggcagatttttcataactaagtcttaagtcttctaaaaggaagctgttacccttctgtttttaattacattaattgaaatgtgttttaagagatacaatttcagcatattttatatattaaaaaacaaaaaaggattagtattgagccagtggccaaaaggtaatattactaccatgtagactgttatagttcaaattgtcccacttcacccagaattttagaaactagaagtctgggaggtactatatcagctgtagttgggtaattccaagtgctgatagtactattcatcttttttattattgtgtcagatgaaacaaatgccaagttgcaaaatatgcagatttttattatataatggttttaggcataaattattaacaagccatgccttatgtgtttcatcttatatttttctttagaactaaactataacagattttggaaaatgatttgacgtgcttgctcacttgattgacttggtcagatatttgaatgatggtattacctagattctaatccttgattctagttatataataaataatatagaatatgaaaatatgtttgggcatttactgtttatattatgtagtagcctccatcatgacacacttactacatttatgaattgagcagttctgtaattgtaattattattgctgttcatgtaacaaaacatgcttatgataatagcaaacaaatagaaatgcccccaaaatgctatttttttaattcagttataactgttactcttgtagttgtgtatgacgcaataaaatttgtaaaaaaatttcagcatgaaaaataaaatttgtatcactcatgtattttggctatgcttttgaaatttccttaacataaacaaatcagtgtagatattcaaaatcttttacctttaatccttttcatccttatagtccttacctgaactctactttagcattatctttgatttctttttttcattcacttaacttccaatcagtactcaagctttatccattctacctctgtaatgtctctggaatttatctcatacgtgaaatttcccttgatattatagacataccttggatatattgcaggtttggttccacaccat

SEQ ID NO: 446461 - DNA, 2599 bp, Homo sapiens
cagctctacggcggccgcgcgctccaggccggtcgctccaccccccggctcccgggactgtggactccacgaccctgtcctcggccctgtccgcgccgaagcagcccgggactgcgcagcgccccgcgtgccgacatgggaaagtctctttctcatttgcctttgcattcaagcaaagaagatgcttatgatggagtcacatctgaaaacatgaggaatggactggttaatagtgaagtccataatgaagatggaagaaatggagatgtctctcagtttccatatgtggaatttacaggaagagatagtgtcacctgccctacttgtcagggaacaggaagaattcctagggggcaagaaaaccaactggtggcattgattccatatagtgatcagagattaaggccaagaagaacaaagctgtatgtgatggcttctgtgtttgtctgtctactcctttctggattggctgtgtttttccttttccctcgctctatcgacgtgaaatacattggtgtaaaatcagcctatgtcagttatgatgttcagaagcgtacaatttatttaaatatcacaaacacactaaatataacaaacaataactattactctgtcgaagttgaaaacatcactgcccaagttcaattttcaaaaacagttattggaaaggcacgcttaaacaacataaccattattggtccacttgatatgaaacaaattgattacacagtacctaccgttatagcagaggaaatgagttatatgtatgatttctgtactctgatatccatcaaagtgcataacatagtactcatgatgcaagttactgtgacaacaacatactttggccactctgaacagatatcccaggagaggtatcagtatgtcgactgtggaagaaacacaacttatcagttggggcagtctgaatatttaaatgtacttcagccacaacagtaaaaactggaagagatggatttaaagaagaaatatctattgatatttcctatactctcaatgaagaggtatttcctaataggagaccttaaattgaacaaacctaaagtttacacttctaagagtacagttaaaagtatgtggacctgcagttcttgtaactctccactctgtgttaatgatatatttgtactaggatcttttacttgaatctaaatttactggttgatttccttctccagcctatcccctacagggaaaagctgatacttcccctatagtacaataaataattatttaaaagtcatagctccagtcactactgaaaacataattttggtgataaacataatttgagaaacttaatttctgaatgtttttatagaaaattactgaaaatctattactcatggaagacttttaaagaataaccttttttcctgttttataaattcccattgttatatggtagtatttcagctacacaatattttagcttttagctagacatttataggttttcatttgttgaaatggtaatcatctgcatgtttttgtcacttatttcaggttagtgattgcctaacacttataagccaaaataatctttgcaaaattccatacctaaaattttgaaagcccctaatgttttcacacatctttctgtattagttatagttttgtgaaatctttgtgtgatcttcaaacattatcatttaatgtacaatactgtaaataaactgtgcatggcttttatacagctttagtaaatgtcaaataaagtggtacagactcattacaacaagtttctcataaaaatacaataaataggaaaatgaaattcagaaacccatagactgggaataggttccagttacagcttggatctggcataaaataaatttgaaataaaatattttgatgctccatttttttatgttgcttttcatactaaagaatggtgtagacttgttttgcaactgttaggtacccagttatcaattttatcaatgttttagaggaggaaattatttttttggtagaaattgttcaagaaatccttaattgaatgtcattaaatgatggtggccaaaataaaacctatttagaaatttaatcactttgcacatcacttggaatatgatgcctctagtagttacttttttatagttttctacttttggttttatttaaaattgttttcaaatatagattattgacttattcaactttgctgttttatattttcagtatcatttttcatttgttttttttttttttgtcttttcacttaccaagttctagggacatttaaaatatgtactaagtgtaggagtggttatgataccaaaaaatgtagctgggttgagattaatttcgttctgttttctcatgacagaaatcaggtttccctttccccacccctaagtgcctaacttaggtctgaaacagcctgtttattagtctgactctctcaaccatattctcactatattttctgcaggttttcctggagatcctcaattcgcttgatgtggcttctgctcctctcctcgtttaaccctcttgtcccttaatccatcgttcactacgccaccctctctcttaccctctatcctgcctcgttcctatttacctcccc

SEQ ID NO: 446462 - DNA, 440 bp, Homo sapiens
aaacaacataaccattattggtccacttgatatgaaacaagtaagaatcaatcatgaaatactttgtaagagttaaatgaatgtcagctttgtatatcatataacttgaaggaggtgggggatttcctcaaaaacttgatttagaaatgtgtctctgctgggtacagtggctcatgcctgtgatccccgcaccttgggaggctgagctcagtggactgcttgagcccaggaattcgagaccagcctgggcaacatggtgaaacctcatctctacaaaaaaatacaaaaatgtgctgagtgtggtagtgtgcacctctcttcccacctactggggaggctgaggtgggaggatcactggagcccagtaggtcgaggctcgcgagccgtgatcacaccgccgtactccaaactgggtgacacagtgagatcctgtctcaaaa

SEQ ID NO: 446463 - DNA, 712 bp, Homo sapiens
ataagcatgataggacatcatttcacattatttgtttaaaaaaacacttctggactctagtaaatggctcctttgtttcagacattattttgattggatataatcctaatccaaaaggtataatccaaaaggtagtttgaacattctcttaatgtttgttctgtaaaccaaaaataaaattctgagccccccaactaagtggaacccgcttctctgtcaagggcattccaaagtaaacctaaaaaggtagttcaggccatgatgaaaaggtgggtggaggggattgaacatgccccgttgtaccttcctctctttggaattcaggcacaactgaccagcatcaattaaaacagagatttgaagactaacaagagtctctttgtagcaataagatatcaaatcccaacctgactctaatatagaatcactcgacagatagcaggccctgagagaaattgaaatatcttaccccaaaatatatttctttgaaatggccttgcaaagctgtctctcgtggggaagatccacattctgtacagaatcccctttcctttccagatcttttcctaattcagcagcgatttaaccaagagcctggaatattttaaggagtaataagagacatttacaaactattctctctgaagcctgctacctggaggcatcatctagataatcagaaccttggcttccacatcctcctcccttgtct

SEQ ID NO: 446464 - DNA, 6530 bp, Homo sapiens
cagctctacggcggccgcgcgctccaggccggtcgctccaccccccggctcccgggactgtggactccacgaccctgtcctcggccctgtccgcgccgaagcagcccgggactgcgcagcgccccgcgtgccgacatgggaaagtctctttctcatttgcctttgcattcaagcaaagaagatgcttatgatggagtcacatctgaaaacatgaggaatggactggttaatagtgaagtccataatgaagatggaagaaatggagatgtctctcagtttccatatgtggaatttacaggaagagatagtgtcacctgccctacttgtcagggaacaggaagaattcctagggggcaagaaaaccaactggtggcattgattccatatagtgatcagagattaaggccaagaagaacaaagctgtatgtgatggcttctgtgtttgtctgtctactcctttctggattggctgtgtttttccttttccctcgctctatcgacgtgaaatacattggtgtaaaatcagcctatgtcagttatgatgttcagaagcgtacaatttatttaaatatcacaaacacactaaatataacaaacaataactattactctgtcgaagttgaaaacatcactgcccaagttcaattttcaaaaacagttattggaaaggcacgcttaaacaacataaccattattggtccacttgatatgaaacaaattgattacacagtacctaccgttatagcagaggaaatgagttatatgtatgatttctgtactctgatatccatcaaagtgcataacatagtactcatgatgcaagttactgtgacaacaacatactttggccactctgaacagatatcccaggagaggtatcagtatgtcgactgtggaagaaacacaacttatcagttggggcagtctgaatatttaaatgtacttcagccacaacagtaaaaactggaagagatggatttaaagaagaaatatctattgatatttcctatactctcaatgaagaggtatttcctaataggagaccttaaattgaacaaacctaaagtttacacttctaagagtacagttaaaagtatgtggacctgcagttcttgtaactctccactctgtgttaatgatatatttgtactaggatcttttacttgaatctaaatttactggttgatttccttctccagcctatcccctacagggaaaagctgatacttcccctatagtacaataaataattatttaaaagtcatagctccagtcactactgaaaacataattttggtgataaacataatttgagaaacttaatttctgaatgtttttatagaaaattactgaaaatctattactcatggaagacttttaaagaataaccttttttcctgttttataaattcccattgttatatggtagtatttcagctacacaatattttagcttttagctagacatttataggttttcatttgttgaaatggtaatcatctgcatgtttttgtcacttatttcaggttagtgattgcctaacacttataagccaaaataatctttgcaaaattccatacctaaaattttgaaagcccctaatgttttcacacatctttctgtattagttatagttttgtgaaatctttgtgtgatcttcaaacattatcatttaatgtacaatactgtaaataaactgtgcatggcttttatacagctttagtaaatgtcaaataaagtggtacagactcattacaacaagtttctcataaaaatacaataaataggaaaatgaaattcagaaacccatagactgggaataggttccagttacagcttggatctggcataaaataaatttgaaataaaatattttgatgctccatttttttatgttgcttttcatactaaagaatggtgtagacttgttttgcaactgttaggtacccagttatcaattttatcaatgttttagaggaggaaattatttttttggtagaaattgttcaagaaatccttaattgaatgtcattaaatgatggtggccaaaataaaacctatttagaaatttaatcactttgcacatcacttggaatatgatgcctctagtagttacttttttatagttttctacttttggttttatttaaaattgttttcaaatatagattattgacttattcaactttgctgttttatattttcagtatcatttttcatttgttttttttttttttgtcttttcacttaccaagttctagggacatttaaaatatgtactaagtgtaggagtggttatgataccaaaaaatgtagctgggttgagattaatttcgttctgttttctcatgacagaaatcaggtttccctttccccacccctaagtgcctaacttaggtctgaaacagcctgtttattagtctgactctctcaaccataaaacataagctttatttaattctgcctttaaacacactcaggtttccccttaattttcatattattttctgcaagttttcttgagtatcttcaattcgttgaatgtggtttttggtttttttttgttttaacactagtcttcccttaattcattgctaactcaagccatccttactattaaacccaaatcagtcctttaagttcattatggcctttctagtatttaaaaaaaaaaaaatcattttcatttttcttctgctacgtttcctgactactactgcatacttctctgatacaggttctgtttgtattttttatatcattctcattttctcatttgacatgatctatgtctatatatgatataggtccccttttgtctcaaaatttttaattatgtgacttcaaaaatcacctgtatctgtagtagggcttccaaatctgcttctccatatgtgaccagtcacctgtctgctttcacatttagctagtgaactacacatttactaaaatgtgtaaattttacacatttagtgactgtgtaaaataaaaaaaaagttattttatcatatcctttctattatgttcccatcctgtcctcatgtcccatttactttattatcaccattcatttcttcaaaattatcttttagatacgctcatacaaaaatcaatccttgttttcttgcttgtgtcttttaaccttggaaaattacatcgtgtaaattaaacagatttttctgatgatctgtgcttcttatatactattagagtgcatgatagtatctcctgaaaaggatggaaagtagaagcatttgcttttagtcacttaattttgaatcttttttcttcatcttttgaattaattttttttattatatctacttttagtggagtttgagtcagaaaaaaacaagaatttgaaacaagtaaaaagatagaagagaaataaagatggtatgtgactactttcagagagagttaagtaactgtcagaataagcctggaacaaaacaggctgtaaattaataaaactacaaacacacattcaggtgaagcagaagtatagccataaaacatctagaaagagtgaatgaggcttttagcttttcttaggtcaatgtccagtgtgcttttttccatgggaataggataggtattaatacgcttttctaaactgctctcagaccttatccagaggacatggtaaagatatgttacagaaatttttctgatacttcctggaataactttaagttacaccctagtagactggtcattctaataaaatccagtactataacaaacctctgtatgttgatagcacattggccctttttagagttctttcctatgtttttcttacgtgatttcccacagttccatgagtccaacaaaggagagtgataggctccttatcttttagaagaggaaggaaaggcatgaagaagttgagggactggctgaagatcacgtacttactaagtagtacaactggagcaagatcaagtatctctgtctcccatatctgtgttctatcatttaaaatatatattggaaatccctgctgactcagattggtatgattaaaaatgagaggaaagttcaaatagttagtagtgacaaactaatactgctggactaagattttggtagcattgttttctaaaatattttaaatggagaatgaacacttataaaatgctttggaacataatctttagcttaattttctgttaaaatttagtaccccttcatcattccaataaagataagactgatccattgtctaaggaaattatttataaataatagagattaatttatttgagatttgaaataagaatagtatgaaaatattagataccacataaattgtttgaaattactgaataaccatcttaagtatggaacatttaaatggctatattttatttgtgtacagtttttctgtgccttgttaggccagtgaagcaattattttctctaagaaaatgacaataaaatataacacacttcagattgtctgatttacagtttggaaaggacaccgcaatgttcaaataggtaggagaccatcaaaaacacaattaaagtaacatattaggagacttgaaacttcagcctaataaatccttcatggttcttagccttattattgtgatataattctagatattttcttggagggcatgtgcccaactctcccgcaccccattttgtttgtcttttaaagttcttagaataaacagttctttatataataattatattttatttaagaaaatagtttgttaggtactttttaaaagatgtaaatttttaaatttacaaatacatatgggtctttgataagcaataggaattgaattacaagttactagggttataagcaaaaggttgcttaccataatgtcattaggtcacgatttttagctcacatctggaagcagcaactacttggctcaagtacatataagagtaattagttttattctctcttttttataaaatcgggtttcagatgagatgtttatcttagactattttagggaaaaattttacatgtttgagatggtggagtaaaaagactgttaaacatttcttttaaaaaattatttttacattacaacaatatatttatgatgtgttcagatcaaaaatttaacttctgtgtcccagatctactttcaaagtgagattttcacttgtcagcttaaatttctgactagaactaacgtttgtgtatttttgtgcttagtcggaatacaaatttcacagtggatttttgaagtttgtccttaaattggataaaatcaagtgattaaagttactaaagagataaaaatggtaatttccatttttaaaagtaatttggttgtgtttatagttatttgtacaagtatttatcacagactctaaattgaaaaatatagtatgatctatatttgaccctaaaaatgttggattaatttaacaaatatggcagatttttcataactaagtcttaagtcttctaaaaggaagctgttacccttctgtttttaattacattaattgaaatgtgttttaagagatacaatttcagcatattttatatattaaaaaacaaaaaaggattagtattgagccagtggccaaaaggtaatattactaccatgtagactgttatagttcaaattgtcccacttcacccagaattttagaaactagaagtctgggaggtactatatcagctgtagttgggtaattccaagtgctgatagtactattcatcttttttattattgtgtcagatgaaacaaatgccaagttgcaaaatatgcagatttttattatataatggttttaggcataaattattaacaagccatgccttatgtgtttcatcttatatttttctttagaactaaactataacagattttggaaaatgatttgacgtgcttgctcacttgattgacttggtcagatatttgaatgatggtattacctagattctaatccttgattctagttatataataaataatatagaatatgaaaatatgtttgggcatttactgtttatattatgtagtagcctccatcatgacacacttactacatttatgaattgagcagttctgtaattgtaattattattgctgttcatgtaacaaaacatgcttatgataatagcaaacaaatagaaatgcccccaaaatgctatttttttaattcagttataactgttactcttgtagttgtgtatgacgcaataaaatttgtaaaaaaatttcagcatgaaaaataaaatttgtatcactcatgtattttggctatgcttttgaaatttccttaacataaacaaatcagtgtagatattcaaaatcttttacctttaatccttttcatccttatagtccttacctgaactctactttagcattatctttgatttctttttttcattcacttaacttccaatcagtactcaagctttatccattctacctctgtaatgtctctggaatttatctcatacgtgaaatttcccttgatattatagacataccttggatatattgcaggtttggttccacaccat

SEQ ID NO: 446465 - DNA, 6098 bp, Homo sapiens
attgggtgttatctaagccaataaaacattgttgattataggtttggtgttttgaccattagctgacatttgattaacctttttttctatgataagagaaccatggtcacttttaagcatataatgaacttttatatttttaacagaagataattgttttaaaatattacacttattacgtgtaattatgtctacagggctcactcagctatccatttttgttgtctgttggggaaatactccttaagaggattgtgtgcacaatattaagttatcattaatcaaatattctcttctgggagataatttttatgtgttaaagtagtctcactatggaaaaacttctaatataactattaaatgtctctcctcacttacgttatttttagagttactgtgacaacaacatactttggccactctgaacagatatcccaggagaggtatcagtatgtcgactgtggaagaaacacaacttatcagttggggcagtctgaatatttaaatgtacttcagccacaacagtaaaaactggaagagatggatttaaagaagaaatatctattgatatttcctatactctcaatgaagaggtatttcctaataggagaccttaaattgaacaaacctaaagtttacacttctaagagtacagttaaaagtatgtggacctgcagttcttgtaactctccactctgtgttaatgatatatttgtactaggatcttttacttgaatctaaatttactggttgatttccttctccagcctatcccctacagggaaaagctgatacttcccctatagtacaataaataattatttaaaagtcatagctccagtcactactgaaaacataattttggtgataaacataatttgagaaacttaatttctgaatgtttttatagaaaattactgaaaatctattactcatggaagacttttaaagaataaccttttttcctgttttataaattcccattgttatatggtagtatttcagctacacaatattttagcttttagctagacatttataggttttcatttgttgaaatggtaatcatctgcatgtttttgtcacttatttcaggttagtgattgcctaacacttataagccaaaataatctttgcaaaattccatacctaaaattttgaaagcccctaatgttttcacacatctttctgtattagttatagttttgtgaaatctttgtgtgatcttcaaacattatcatttaatgtacaatactgtaaataaactgtgcatggcttttatacagctttagtaaatgtcaaataaagtggtacagactcattacaacaagtttctcataaaaatacaataaataggaaaatgaaattcagaaacccatagactgggaataggttccagttacagcttggatctggcataaaataaatttgaaataaaatattttgatgctccatttttttatgttgcttttcatactaaagaatggtgtagacttgttttgcaactgttaggtacccagttatcaattttatcaatgttttagaggaggaaattatttttttggtagaaattgttcaagaaatccttaattgaatgtcattaaatgatggtggccaaaataaaacctatttagaaatttaatcactttgcacatcacttggaatatgatgcctctagtagttacttttttatagttttctacttttggttttatttaaaattgttttcaaatatagattattgacttattcaactttgctgttttatattttcagtatcatttttcatttgttttttttttttttgtcttttcacttaccaagttctagggacatttaaaatatgtactaagtgtaggagtggttatgataccaaaaaatgtagctgggttgagattaatttcgttctgttttctcatgacagaaatcaggtttccctttccccacccctaagtgcctaacttaggtctgaaacagcctgtttattagtctgactctctcaaccataaaacataagctttatttaattctgcctttaaacacactcaggtttccccttaattttcatattattttctgcaagttttcttgagtatcttcaattcgttgaatgtggtttttggtttttttttgttttaacactagtcttcccttaattcattgctaactcaagccatccttactattaaacccaaatcagtcctttaagttcattatggcctttctagtatttaaaaaaaaaaaaatcattttcatttttcttctgctacgtttcctgactactactgcatacttctctgatacaggttctgtttgtattttttatatcattctcattttctcatttgacatgatctatgtctatatatgatataggtccccttttgtctcaaaatttttaattatgtgacttcaaaaatcacctgtatctgtagtagggcttccaaatctgcttctccatatgtgaccagtcacctgtctgctttcacatttagctagtgaactacacatttactaaaatgtgtaaattttacacatttagtgactgtgtaaaataaaaaaaaagttattttatcatatcctttctattatgttcccatcctgtcctcatgtcccatttactttattatcaccattcatttcttcaaaattatcttttagatacgctcatacaaaaatcaatccttgttttcttgcttgtgtcttttaaccttggaaaattacatcgtgtaaattaaacagatttttctgatgatctgtgcttcttatatactattagagtgcatgatagtatctcctgaaaaggatggaaagtagaagcatttgcttttagtcacttaattttgaatcttttttcttcatcttttgaattaattttttttattatatctacttttagtggagtttgagtcagaaaaaaacaagaatttgaaacaagtaaaaagatagaagagaaataaagatggtatgtgactactttcagagagagttaagtaactgtcagaataagcctggaacaaaacaggctgtaaattaataaaactacaaacacacattcaggtgaagcagaagtatagccataaaacatctagaaagagtgaatgaggcttttagcttttcttaggtcaatgtccagtgtgcttttttccatgggaataggataggtattaatacgcttttctaaactgctctcagaccttatccagaggacatggtaaagatatgttacagaaatttttctgatacttcctggaataactttaagttacaccctagtagactggtcattctaataaaatccagtactataacaaacctctgtatgttgatagcacattggccctttttagagttctttcctatgtttttcttacgtgatttcccacagttccatgagtccaacaaaggagagtgataggctccttatcttttagaagaggaaggaaaggcatgaagaagttgagggactggctgaagatcacgtacttactaagtagtacaactggagcaagatcaagtatctctgtctcccatatctgtgttctatcatttaaaatatatattggaaatccctgctgactcagattggtatgattaaaaatgagaggaaagttcaaatagttagtagtgacaaactaatactgctggactaagattttggtagcattgttttctaaaatattttaaatggagaatgaacacttataaaatgctttggaacataatctttagcttaattttctgttaaaatttagtaccccttcatcattccaataaagataagactgatccattgtctaaggaaattatttataaataatagagattaatttatttgagatttgaaataagaatagtatgaaaatattagataccacataaattgtttgaaattactgaataaccatcttaagtatggaacatttaaatggctatattttatttgtgtacagtttttctgtgccttgttaggccagtgaagcaattattttctctaagaaaatgacaataaaatataacacacttcagattgtctgatttacagtttggaaaggacaccgcaatgttcaaataggtaggagaccatcaaaaacacaattaaagtaacatattaggagacttgaaacttcagcctaataaatccttcatggttcttagccttattattgtgatataattctagatattttcttggagggcatgtgcccaactctcccgcaccccattttgtttgtcttttaaagttcttagaataaacagttctttatataataattatattttatttaagaaaatagtttgttaggtactttttaaaagatgtaaatttttaaatttacaaatacatatgggtctttgataagcaataggaattgaattacaagttactagggttataagcaaaaggttgcttaccataatgtcattaggtcacgatttttagctcacatctggaagcagcaactacttggctcaagtacatataagagtaattagttttattctctcttttttataaaatcgggtttcagatgagatgtttatcttagactattttagggaaaaattttacatgtttgagatggtggagtaaaaagactgttaaacatttcttttaaaaaattatttttacattacaacaatatatttatgatgtgttcagatcaaaaatttaacttctgtgtcccagatctactttcaaagtgagattttcacttgtcagcttaaatttctgactagaactaacgtttgtgtatttttgtgcttagtcggaatacaaatttcacagtggatttttgaagtttgtccttaaattggataaaatcaagtgattaaagttactaaagagataaaaatggtaatttccatttttaaaagtaatttggttgtgtttatagttatttgtacaagtatttatcacagactctaaattgaaaaatatagtatgatctatatttgaccctaaaaatgttggattaatttaacaaatatggcagatttttcataactaagtcttaagtcttctaaaaggaagctgttacccttctgtttttaattacattaattgaaatgtgttttaagagatacaatttcagcatattttatatattaaaaaacaaaaaaggattagtattgagccagtggccaaaaggtaatattactaccatgtagactgttatagttcaaattgtcccacttcacccagaattttagaaactagaagtctgggaggtactatatcagctgtagttgggtaattccaagtgctgatagtactattcatcttttttattattgtgtcagatgaaacaaatgccaagttgcaaaatatgcagatttttattatataatggttttaggcataaattattaacaagccatgccttatgtgtttcatcttatatttttctttagaactaaactataacagattttggaaaatgatttgacgtgcttgctcacttgattgacttggtcagatatttgaatgatggtattacctagattctaatccttgattctagttatataataaataatatagaatatgaaaatatgtttgggcatttactgtttatattatgtagtagcctccatcatgacacacttactacatttatgaattgagcagttctgtaattgtaattattattgctgttcatgtaacaaaacatgcttatgataatagcaaacaaatagaaatgcccccaaaatgctatttttttaattcagttataactgttactcttgtagttgtgtatgacgcaataaaatttgtaaaaaaatttcagcatgaaaaataaaatttgtatcactcatgtattttggctatgcttttgaaatttccttaacataaacaaatcagtgtagatattcaaaatcttttacctttaatccttttcatccttatagtccttacctgaactctactttagcattatctttgatttctttttttcattcacttaacttccaatcagtactcaagctttatccattctacctctgtaatgtctctggaatttatctcatacgtgaaatttcccttgatattatagacataccttggatatattgcaggtttggttccacaccat

SEQ ID NO: 446466 - DNA, 6333 bp, Homo sapiens
cagctctacggcggccgcgcgctccaggccggtcgctccaccccccggctcccgggactgtggactccacgaccctgtcctcggccctgtccgcgccgaagcagcccgggactgcgcagcgccccgcgtgccgacatgggaaagtctctttctcatttgcctttgcattcaagcaaagaagatgcttatgatggagtcacatctgaaaacatgaggaatggactggttaatagtgaagtccataatgaagatggaagaaatggagatgtctctcagtttccatatgtggaatttacaggaagagatagtgtcacctgccctacttgtcagggaacaggaagaattcctagggggcaagaaaaccaactggtggcattgattccatatagtgatcagagattaaggccaagaagaacaaagctgtatgtgatggcttctgtgtttgtctgtctactcctttctggattggctgtgtttttccttttccctcgctctatcgacgtgaaatacattggtgtaaaatcagcctatgtcagttatgatgttcagaagcgtacaatttatttaaatatcacaattgattacacagtacctaccgttatagcagaggaaatgagttatatgtatgatttctgtactctgatatccatcaaagtgcataacatagtactcatgatgcaagttactgtgacaacaacatactttggccactctgaacagatatcccaggagaggtatcagtatgtcgactgtggaagaaacacaacttatcagttggggcagtctgaatatttaaatgtacttcagccacaacatctcaatgaagaggtatttcctaataggagaccttaaattgaacaaacctaaagtttacacttctaagagtacagttaaaagtatgtggacctgcagttcttgtaactctccactctgtgttaatgatatatttgtactaggatcttttacttgaatctaaatttactggttgatttccttctccagcctatcccctacagggaaaagctgatacttcccctatagtacaataaataattatttaaaagtcatagctccagtcactactgaaaacataattttggtgataaacataatttgagaaacttaatttctgaatgtttttatagaaaattactgaaaatctattactcatggaagacttttaaagaataaccttttttcctgttttataaattcccattgttatatggtagtatttcagctacacaatattttagcttttagctagacatttataggttttcatttgttgaaatggtaatcatctgcatgtttttgtcacttatttcaggttagtgattgcctaacacttataagccaaaataatctttgcaaaattccatacctaaaattttgaaagcccctaatgttttcacacatctttctgtattagttatagttttgtgaaatctttgtgtgatcttcaaacattatcatttaatgtacaatactgtaaataaactgtgcatggcttttatacagctttagtaaatgtcaaataaagtggtacagactcattacaacaagtttctcataaaaatacaataaataggaaaatgaaattcagaaacccatagactgggaataggttccagttacagcttggatctggcataaaataaatttgaaataaaatattttgatgctccatttttttatgttgcttttcatactaaagaatggtgtagacttgttttgcaactgttaggtacccagttatcaattttatcaatgttttagaggaggaaattatttttttggtagaaattgttcaagaaatccttaattgaatgtcattaaatgatggtggccaaaataaaacctatttagaaatttaatcactttgcacatcacttggaatatgatgcctctagtagttacttttttatagttttctacttttggttttatttaaaattgttttcaaatatagattattgacttattcaactttgctgttttatattttcagtatcatttttcatttgttttttttttttttgtcttttcacttaccaagttctagggacatttaaaatatgtactaagtgtaggagtggttatgataccaaaaaatgtagctgggttgagattaatttcgttctgttttctcatgacagaaatcaggtttccctttccccacccctaagtgcctaacttaggtctgaaacagcctgtttattagtctgactctctcaaccataaaacataagctttatttaattctgcctttaaacacactcaggtttccccttaattttcatattattttctgcaagttttcttgagtatcttcaattcgttgaatgtggtttttggtttttttttgttttaacactagtcttcccttaattcattgctaactcaagccatccttactattaaacccaaatcagtcctttaagttcattatggcctttctagtatttaaaaaaaaaaaaatcattttcatttttcttctgctacgtttcctgactactactgcatacttctctgatacaggttctgtttgtattttttatatcattctcattttctcatttgacatgatctatgtctatatatgatataggtccccttttgtctcaaaatttttaattatgtgacttcaaaaatcacctgtatctgtagtagggcttccaaatctgcttctccatatgtgaccagtcacctgtctgctttcacatttagctagtgaactacacatttactaaaatgtgtaaattttacacatttagtgactgtgtaaaataaaaaaaaagttattttatcatatcctttctattatgttcccatcctgtcctcatgtcccatttactttattatcaccattcatttcttcaaaattatcttttagatacgctcatacaaaaatcaatccttgttttcttgcttgtgtcttttaaccttggaaaattacatcgtgtaaattaaacagatttttctgatgatctgtgcttcttatatactattagagtgcatgatagtatctcctgaaaaggatggaaagtagaagcatttgcttttagtcacttaattttgaatcttttttcttcatcttttgaattaattttttttattatatctacttttagtggagtttgagtcagaaaaaaacaagaatttgaaacaagtaaaaagatagaagagaaataaagatggtatgtgactactttcagagagagttaagtaactgtcagaataagcctggaacaaaacaggctgtaaattaataaaactacaaacacacattcaggtgaagcagaagtatagccataaaacatctagaaagagtgaatgaggcttttagcttttcttaggtcaatgtccagtgtgcttttttccatgggaataggataggtattaatacgcttttctaaactgctctcagaccttatccagaggacatggtaaagatatgttacagaaatttttctgatacttcctggaataactttaagttacaccctagtagactggtcattctaataaaatccagtactataacaaacctctgtatgttgatagcacattggccctttttagagttctttcctatgtttttcttacgtgatttcccacagttccatgagtccaacaaaggagagtgataggctccttatcttttagaagaggaaggaaaggcatgaagaagttgagggactggctgaagatcacgtacttactaagtagtacaactggagcaagatcaagtatctctgtctcccatatctgtgttctatcatttaaaatatatattggaaatccctgctgactcagattggtatgattaaaaatgagaggaaagttcaaatagttagtagtgacaaactaatactgctggactaagattttggtagcattgttttctaaaatattttaaatggagaatgaacacttataaaatgctttggaacataatctttagcttaattttctgttaaaatttagtaccccttcatcattccaataaagataagactgatccattgtctaaggaaattatttataaataatagagattaatttatttgagatttgaaataagaatagtatgaaaatattagataccacataaattgtttgaaattactgaataaccatcttaagtatggaacatttaaatggctatattttatttgtgtacagtttttctgtgccttgttaggccagtgaagcaattattttctctaagaaaatgacaataaaatataacacacttcagattgtctgatttacagtttggaaaggacaccgcaatgttcaaataggtaggagaccatcaaaaacacaattaaagtaacatattaggagacttgaaacttcagcctaataaatccttcatggttcttagccttattattgtgatataattctagatattttcttggagggcatgtgcccaactctcccgcaccccattttgtttgtcttttaaagttcttagaataaacagttctttatataataattatattttatttaagaaaatagtttgttaggtactttttaaaagatgtaaatttttaaatttacaaatacatatgggtctttgataagcaataggaattgaattacaagttactagggttataagcaaaaggttgcttaccataatgtcattaggtcacgatttttagctcacatctggaagcagcaactacttggctcaagtacatataagagtaattagttttattctctcttttttataaaatcgggtttcagatgagatgtttatcttagactattttagggaaaaattttacatgtttgagatggtggagtaaaaagactgttaaacatttcttttaaaaaattatttttacattacaacaatatatttatgatgtgttcagatcaaaaatttaacttctgtgtcccagatctactttcaaagtgagattttcacttgtcagcttaaatttctgactagaactaacgtttgtgtatttttgtgcttagtcggaatacaaatttcacagtggatttttgaagtttgtccttaaattggataaaatcaagtgattaaagttactaaagagataaaaatggtaatttccatttttaaaagtaatttggttgtgtttatagttatttgtacaagtatttatcacagactctaaattgaaaaatatagtatgatctatatttgaccctaaaaatgttggattaatttaacaaatatggcagatttttcataactaagtcttaagtcttctaaaaggaagctgttacccttctgtttttaattacattaattgaaatgtgttttaagagatacaatttcagcatattttatatattaaaaaacaaaaaaggattagtattgagccagtggccaaaaggtaatattactaccatgtagactgttatagttcaaattgtcccacttcacccagaattttagaaactagaagtctgggaggtactatatcagctgtagttgggtaattccaagtgctgatagtactattcatcttttttattattgtgtcagatgaaacaaatgccaagttgcaaaatatgcagatttttattatataatggttttaggcataaattattaacaagccatgccttatgtgtttcatcttatatttttctttagaactaaactataacagattttggaaaatgatttgacgtgcttgctcacttgattgacttggtcagatatttgaatgatggtattacctagattctaatccttgattctagttatataataaataatatagaatatgaaaatatgtttgggcatttactgtttatattatgtagtagcctccatcatgacacacttactacatttatgaattgagcagttctgtaattgtaattattattgctgttcatgtaacaaaacatgcttatgataatagcaaacaaatagaaatgcccccaaaatgctatttttttaattcagttataactgttactcttgtagttgtgtatgacgcaataaaatttgtaaaaaaatttcagcatgaaaaataaaatttgtatcactcatgtattttggctatgcttttgaaatttccttaacataaacaaatcagtgtagatattcaaaatcttttacctttaatccttttcatccttatagtccttacctgaactctactttagcattatctttgatttctttttttcattcacttaacttccaatcagtactcaagctttatccattctacctctgtaatgtctctggaatttatctcatacgtgaaatttcccttgatattatagacataccttggatatattgcaggtttggttccacaccat

SEQ ID NO: 446467 - DNA, 1713 bp, Homo sapiens
cagctctacggcggccgcgcgctccaggccggtcgctccaccccccggctcccgggactgtggactccacgaccctgtcctcggccctgtccgcgccgaagcagcccgggactgcgcagcgccccgcgtgccgacatgggaaagtctctttctcatttgcctttgcattcaagcaaagaagatgcttatgatggagtcacatctgaaaacatgaggaatggactggttaatagtgaagtccataatgaagatggaagaaatggagatgtctctcagtttccatatgtggaatttacaggaagagatagtgtcacctgccctacttgtcagggaacaggaagaattcctagggggcaagaaaaccaactggtggcattgattccatatagtgatcagagattaaggccaagaagaacaaagctgtatgtgatggcttctgtgtttgtctgtctactcctttctggattggctgtgtttttccttttccctcgctctatcgacgtgaaatacattggtgtaaaatcagcctatgtcagttatgatgttcagaagcgtacaatttatttaaatatcacaaacacactaaatataacaaacaataactattactctgtcgaagttgaaaacatcactgcccaagttcaattttcaaaaacagttattggaaaggcacgcttaaacaacataaccattattggtccacttgatatgaaacaaattgattacacagtacctaccgttatagcagaggaaatgagttatatgtatgatttctgtactctgatatccatcaaagtgcataacatagtactcatgatgcaagttactgtgacaacaacatactttggccactctgaacagatatcccaggagaggtatcagtatgtcgactgtggaagaaacacaacttatcagttggggcagtctgaatatttaaatgtacttcagccacaacagtaaaaactggaagagatggatttaaagaagaaatatctattgatatttcctatactctcaatgaagaggtatttcctaataggagaccttaaattgaacaaacctaaagtttacacttctaagagtacagttaaaagtatgtggacctgcagttcttgtaactctccactctgtgttaatgatatatttgtactaggatcttttacttgaatctaaatttactggttgatttccttctccagcctatcccctacagggaaaagctgatacttcccctatagtacaataaataattatttaaaagtcatagctccagtcactactgaaaacataattttggtgataaacataatttgagaaacttaatttctgaatgtttttatagaaaattactgaaaatctattactcatggaagacttttaaagaataaccttttttcctgttttataaattcccattgttatatggtagtatttcagctacacaatattttagcttttagctagacatttataggttttcatttgttgaaatggtaatcatctgcatgtttttgtcacttatttcaggttagtgattgcctaacacttataagccaaaataatctttgcaaaattccatacctaaaattttgaaagcccctaatgttttcacacatctttctgtattagttatagttttgtgaaatctttgtgtgatcttcaaacattatcatttaatgtacaatactgtaaataaactgtgcatggctttta

SEQ ID NO: 446468 - DNA, 3109 bp, Homo sapiens
gagtataaacattatcttttattatatatgattgttaaactttgctttccacaacacttcataaccttggatgtaaacatgagaaaaaatgctaattaagaatccttacgcacccagtccagtgctcccttaattaatcaaactggtaagtctactgcttcttgattccatcctgaggtattaacttttgaaccaagacatgtttatcttttaccaacaacagggatggtcactgttaaagtttctaaataatttattagggaaataagttcccacaaagtcaggctgaactgggagctgattaacaaagctgtgtaagttagtgtgtttgctttaaggtattacaagaagtacacagagcacacatctgggttataaaagcccttttataaagccatttttaaacaaaacaaaaaaaaagtttacaaaagaaaaaaagatacagaaaaagaataacttgcttcatatgtcccaaaaagagaaaaaaataaaggggacaatgccaacatgctcaacaataaaggcttctttttcttatttttttaatacaaaatacaagcaaaggatacacatacttaaaacagagctcaggagcagacacgcagtcctggaaacccttcaataaaagcaaagcaggagtttgttttttctttgtctatgcagatacatacagagactgggatatgtaaaaattaagtatcacaaaagaccatcacacgattctaccaatgcatgttgcatctgtaattcacgaacatggtcaacaaaatcatgttcacttcaaccccatttcatttaaattaaagaaaaaaaccttttaaataaagtggttacattcaaactttaacttccttagtaccatgctgcagatttcagcactgttaaggtattgcaagaatgcccaaccctctggtgtctgatcatgtatctagcaacattgcagtatgaagaaaagagatgccccggtctcagcccatggactagttaatacagtgaagcaggttcctgtcttttacccttcctgctcagaacataaaagattaaggactaaaatcaaggaagactgggagttttagagctggcaaaatgaagtctaaaagataaatcaaggcaaacaattactgagaacttggctgttgcttaacctggcaagtctaaaagcctttctttaaccttgtaggaattagatgcataaggtttgctgcaacatgttcatggtaaacaaactaagtagagctcttatttacaaatcttgtaacaaatacttctggaggaaaaagagaaaagaattcactaagttccagaagacaaagctttaattgccagacgtatacaaacacacactcacacgtacacacccacacaatacttcaggggtttttatacatgttattttagggcataagctgagtactatacccccacaccccatcaaaaaaggaacaacaaaaaaatcccaattttaccctcccccaataatctagaaaaccctcccttcacccctgatgtacaaagtgtatgcacaacggtggcattctaccagccacacaaagcatgctcaaacagatgtcaccagttcagtcactccattggcatggcaacaggcaggtttacgggatgtttcccaatagtggttattacacagtcagcaccactgtgaattttgtgaatttgaaaaaaaaaagtgtaatttatggattcgcagtctgtaccctccgccccaccccccaaagcccagtcagtttctcccgtgcaggccccgcccccgggtggctcagcccagctgctgcctgggaaggtcctagtgcctctggccgcccctagcatgtcagtgcggggtggaggggccggccagccactgccactggtgagcccgcccttctcagtacctgtgcagaatggtgcccagccccccagcaagatcatccagctgaccccggtgcctgtgagcacacccagcggcctggtgccgcccctgagcccagccacactccctggacccacctctcagcctcagaaggtcctgttgccctcctccaccagaatcacctatgtgcagtcagcgggcgggcacgcgctgcccctgggtaccagccctgcgtccagccaggctggaacagtcacctcgtacgggcccacgagctctgtagctctaggcttcacctcgctggggcccagcggccccgccttcgtgcagcccctgctctcagcaggccaagccccactgctggctcccggtcaggtgggcgtgtcacctgtgcccagtccccagctgccgcctgcctgtgcagcccccggaggtcctgtcataacagcattttactctggcagccctgcacccacctcctcagcacccctggcccagccatcccaggcccccccaagcctggtctacactgtggccaccagcacaaccccacctgcagccaccattctgcccaagggcccgccagcccctgccactgccaccccagccccgactagccctttccccagcgccacagcaggttccatgacctacagcttagtggcccccaaggcccagcggcccagcccgaaggccccccagaaagtgaaggcagccatcgccagcattcccgtggggtcctttgaggcaggtgcctctgggcggcctggccctgcaccccggcagcctctggagcctggcccagtccgagagccaactgccccagagtctgagcttgaggggcagcccacaccaccagcccctccacccctgccagagacctggactcccacggcccggagcagccccccactgcccccacctgctgaggagcggaccagcgccaagggccctgagaccatggccagcaaattccccagctcatcttcagactggcgcgtccctgggcagggcctggagaatcgtggggagcctcccactcctcccagcccggccccagctccagctgtagcccctggtggcagcagcgagagcagcagtgggcgggcagccggggacaccccggagcgcaaggaggcggctggtactggcaagaaggtgaaggtgcggcccccgcccctgaagaagacctttgactctgtggacaaaagtggacttcgaagagccctcggccgattcacc

SEQ ID NO: 446469 - DNA, 419 bp, Homo sapiens
agcaggggcctctctcctctgctggttccacttcccccagggagccaggcagtgtgaggggaagcccactggtatcctaggcccgccccaaaagtccagccaggggtaggtcccagcctagggcttgctcttccaccacccacctcttggggctgaaggttggacccctgggaccagcctcttggtgaggaagcatcttcctgtgcatatcctcaaggaaacacctggcacttgtgccctctctgggtagagacttgttacaattctctcttctgccctcccaacttgggttgtactttctaagaaggtgattccccctgcccttgcccccttccccagaacaaaacatgttgatcatgtgcaatatttcttactgtgccgagaagccgcaatgagcgagattaaagctgtttaacaca

SEQ ID NO: 446470 - DNA, 5468 bp, Homo sapiens
ttccacccctcacctgctgccctgttgcccgttttggtgcccagcagctataccagccaccctgcccccaagaaggaagtcatcatgggccggcctggaacagtgtggacgaatgtggaacctcgctctgtggctgtgttcccttggcactccttagtccccttcctggcacccagccagcctgacccctccgtgcagccgagcgaggcccagcaacctgccagccacccagtggcctccaaccagagcaaagaacctgctgagtcggcagctgttgctcatgaacggccaccaggtgggacagggagtgctgaccctgagcggccccctggagccacatgccctgagagcccaggacccggacccccacaccctttgggggtggtggaatctggtaagggtccgcctcccaccacggaggaggaggcctccggccccccaggagagccccggctggacagtgagacagagagtgaccatgatgatgccttcctctccatcatgtctcctgagatccagttgcctctaccgcccggaaaacgtcggacccagtccctcagtgccctacccaaggaacgggactcatcttctgagaaggatggacgcagccccaacaagcgggagaaggaccacatccggcggcccatgaatgccttcatgatcttcagcaagcggcaccgggccctggtccaccagcgtcatcccaaccaggacaaccggaccgtcagcaagatcctgggcgagtggtggtatgccctggggcccaaggagaagcagaagtaccacgacctggccttccaggtgaaggaggcccacttcaaggcccacccagattggaagtggtgcaacaaggaccgaaagaagtccagctcagaggccaagcccacgagcctggggctggcaggagggcacaaggagacgcgggagcggagcatgtcggagacgggcactgctgctgcccctggggtgtcctctgagctcctgtccgttgcagcccagacactcctgagctcagacaccaaggctccggggagcagctcctgtggggcagaacggctacacacagttgggggacctggctcagcccggccccgagctttctcccacagcggggtacacagcctggacggcggagaagtagacagtcaggcgctacaggaactgacgcagatggtgtctggccctgcatcgtactctggcccaaagccttctacccagtatggagctccaggaccctttgcagcccctggtgagggaggtgccttggcggccactgggcggcccccgctgctgcccacccgagcttctcgttctcagcgtgcggccagtgaggacatgacgagtgatgaggagcgcatggtcatctgtgaggaggaaggggatgatgatgtcattgctgacgatggcttcggcaccactgacattgatctcaagtgcaaggagcgggtgaccgacagcgagagtggggacagctctggggaggacccagagggcaacaagggctttggtcggaaggtgttttcacctgtgatccgttcctcctttacccactgccgccccccactggaccctgagcccccagggcccccggatcctcctgtagcctttggcaaaggctatggttccgccccatcctcctctgcgtcctcgcctgcttcctcctcagcctcggcagccacctccttctcactgggctcaggaaccttcaaggcccaggagtctggtcagggcagcacagcgggccccctacggcccccaccccctggggctgggggtccagcgacaccttccaaggcaacccggttcctcccaatggatcctgccaccttccggcgcaagagacccgaaagtgtgggtggcctggagccaccaggcccctcagtcatcgcggcccctcccagcggaggaggaaacatcctgcagacactggtgctgcccccaaacaaggaggagcaagagggcggcggagccagagtgccctccgcccccgccccatcactggcctatggggccccagcagctcccctgtcccgtcctgccgccaccatggtcaccaatgtggtgcggcctgtcagcagcactcctgtgcccatcgcctctaagcccttccccacctctggccgggctgaggcgtctccaaatgacacagcaggtgccaggactgaaatgggcactgggtctcgggtgcctgggggctccccgctgggtgtcagcttagtgtattcggacaagaagtcggcagcagccacctcaccagccccacacttggtggctggacccctgctgggcactgtggggaaggcgcctgccactgtcactaacctactggtgggcaccccggggtatggggcccctgcgccccctgctgtccagttcattgcccagggggcccctggtggtgggaccactgcgggctcaggagcaggtgctgggagtggccccaatgggccagtacccctgggcatcctgcaaccaggtgccctgggcaaggctgggggaatcacccaggtacagtacatcctgcccacgctgccccagcagcttcaggtggcacctgccccagcaccagcccctgggaccaaggcagcggctcccagcggccctgcacccaccaccagcatccgtttcaccctcccaccgggcacttccaccaacggcaaagtcctggctgccactgcacccactcctggcatccccatcctgcagtctgtaccctccgccccaccccccaaagcccagtcagtttctcccgtgcaggccccgcccccgggtggctcagcccagctgctgcctgggaaggtcctagtgcctctggccgcccctagcatgtcagtgcggggtggaggggccggccagccactgccactggtgagcccgcccttctcagtacctgtgcagaatggtgcccagccccccagcaagatcatccagctgaccccggtgcctgtgagcacacccagcggcctggtgccgcccctgagcccagccacactccctggacccacctctcagcctcagaaggtcctgttgccctcctccaccagaatcacctatgtgcagtcagcgggcgggcacgcgctgcccctgggtaccagccctgcgtccagccaggctggaacagtcacctcgtacgggcccacgagctctgtagctctaggcttcacctcgctggggcccagcggccccgccttcgtgcagcccctgctctcagcaggccaagccccactgctggctcccggtcaggtgggcgtgtcacctgtgcccagtccccagctgccgcctgcctgtgcagcccccggaggtcctgtcataacagcattttactctggcagccctgcacccacctcctcagcacccctggcccagccatcccaggcccccccaagcctggtctacactgtggccaccagcacaaccccacctgcagccaccattctgcccaagggcccgccagcccctgccactgccaccccagccccgactagccctttccccagcgccacagcaggttccatgacctacagcttagtggcccccaaggcccagcggcccagcccgaaggccccccagaaagtgaaggcagccatcgccagcattcccgtggggtcctttgaggcaggtgcctctgggcggcctggccctgcaccccggcagcctctggagcctggcccagtccgagagccaactgccccagagtctgagcttgaggggcagcccacaccaccagcccctccacccctgccagagacctggactcccacggcccggagcagccccccactgcccccacctgctgaggagcggaccagcgccaagggccctgagaccatggccagcaaattccccagctcatcttcagactggcgcgtccctgggcagggcctggagaatcgtggggagcctcccactcctcccagcccggccccagctccagctgtagcccctggtggcagcagcgagagcagcagtgggcgggcagccggggacaccccggagcgcaaggaggcggctggtactggcaagaaggtgaaggtgcggcccccgcccctgaagaagacctttgactctgtggacaacagggtcctgtcagaagtggacttcgaagagcgctttgctgagttgcctgagtttcggcctgaggaggtgctgccctcccccaccctgcagtctctggccacctcaccccgggccatcctgggctcttaccgcaagaagaggaagaactccacggacctggattcagcacccgaggaccccacctcgcccaagcgcaagatgagaagacgctccagctgcagctcggagcccaacacccccaagagtgccaagtgcgagggggacatcttcacctttgaccgtacaggtacagaagccgaggacgtgcttggggagctagagtatgacaaggtgccatactcctccctgcggcgcaccctggaccagcgccgggccctggtcatgcagctctttcaggaccatggcttcttcccgtcagcccaggccacagccgccttccaggcccgctatgcagacatctttccctccaaggtttgtctgcagttgaagatccgtgaggtgcgccagaagatcatgcaggctgccactcccacggagcagccccctggagctgaggctcctctccctgtaccgccccccactggcaccgctgctgcccctgcccccactcccagccccgcagggggccctgaccccacctcacccagctcggactctggcacggcccaggctgccccgccactgcctccacccccagagtcggggcctggacagcctggctgggagggggctccccagccctcccccccacccccaggtccctccacagctgccacaggcaggtgagggacccctgagaagatgccaggacttatagtaccccctcaggacatggacagtatgtgggggcaggaaggttatctcctcccgggtaaagccatttcgtcctctccagtttggggcggaatgaggcctgctcctcttgtaaatacccccttccctcgaagctccctcccggtgctggggggcagctgaggggctgcaggggcagtctccctcctccaagcccctgtacataacctggagcgtgtgaccttcagagcttttcactttatgcaaaatggctcctgtgagggctgcaagctggagggtggtgcaggccttgggccacagggaggcgcctgtggaatagggggagttcatgcaccccttttttccccagaggggctggactcaggttagtttgggggtgggggctcctgcactttgccacaggcacggggagggttttctcctcaccccctctgccctcccaacttgggttgtactttctaagaaggtgattccccctgcccttgcccccttccccagaacaaaacatgttgatcatgtgcaatatttcttactgtgccgagaagccgcaatgagcgagattaaagctgtttaacaca

SEQ ID NO: 446471 - DNA, 2489 bp, Homo sapiens
ctaaccctgccccccaggcagttgtatactgtaggctagaagttaacagagacccccttctcctcaaaaataaatgagtgaaggggcacaacactgtggagagaagccttctagtttttactcatttcaaggagaaactggaactaattaatgaatggaccatatatctagtttattttattaagactcccaataactcactcagtaaccttcgtgcagccactgctctcagcaggccaagccccactgctggctcccggtcaggtgggcgtgtcacctgtgcccagtccccagctgccgcctgcctgtgcagcccccggaggtcctgtcataacagcattttactctggcagccctgcacccacctcctcagcacccctggcccagccatcccaggcccccccaagcctggtctacactgtggccaccagcacaaccccacctgcagccaccattctgcccaagggcccgccagcccctgccactgccaccccagccccgactagccctttccccagcgccacagcaggttccatgacctacagcttagtggcccccaaggcccagcggcccagcccgaaggccccccagaaagtgaaggcagccatcgccagcattcccgtggggtcctttgaggcaggtgcctctgggcggcctggccctgcaccccggcagcctctggagcctggcccagtccgagagccaactgccccagagtctgagcttgaggggcagcccacaccaccagcccctccacccctgccagagacctggactcccacggcccggagcagccccccactgcccccacctgctgaggagcggaccagcgccaagggccctgagaccatggccagcaaattccccagctcatcttcagactggcgcgtccctgggcagggcctggagaatcgtggggagcctcccactcctcccagcccggccccagctccagctgtagcccctggtggcagcagcgagagcagcagtgggcgggcagccggggacaccccggagcgcaaggaggcggctggtactggcaagaaggtgaaggtgcggcccccgcccctgaagaagacctttgactctgtggacaacagggtcctgtcagaagtggacttcgaagagcgctttgctgagttgcctgagtttcggcctgaggaggtgctgccctcccccaccctgcagtctctggccacctcaccccgggccatcctgggctcttaccgcaagaagaggaagaactccacggacctggattcagcacccgaggaccccacctcgcccaagcgcaagatgagaagacgctccagctgcagctcggagcccaacacccccaagagtgccaagtgcgagggggacatcttcacctttgaccgtacaggtacagaagccgaggacgtgcttggggagctagagtatgacaaggtgccatactcctccctgcggcgcaccctggaccagcgccgggccctggtcatgcagctctttcaggaccatggcttcttcccgtcagcccaggccacagccgccttccaggcccgctatgcagacatctttccctccaaggtttgtctgcagttgaagatccgtgaggtgcgccagaagatcatgcaggctgccactcccacggagcagccccctggagctgaggctcctctccctgtaccgccccccactggcaccgctgctgcccctgcccccactcccagccccgcagggggccctgaccccacctcacccagctcggactctggcacggcccaggctgccccgccactgcctccacccccagagtcggggcctggacagcctggctgggagggggctccccagccctcccccccacccccaggtccctccacagctgccacaggcaggtgagggacccctgagaagatgccaggacttatagtaccccctcaggacatggacagtatgtgggggcaggaaggttatctcctcccgggtaaagccatttcgtcctctccagtttggggcggaatgaggcctgctcctcttgtaaatacccccttccctcgaagctccctcccggtgctggggggcagctgaggggctgcaggggcagtctccctcctccaagcccctgtacataacctggagcgtgtgaccttcagagcttttcactttatgcaaaatggctcctgtgagggctgcaagctggagggtggtgcaggccttgggccacagggaggcgcctgtggaatagggggagttcatgcaccccttttttccccagaggggctggactcaggttagtttgggggtgggggctcctgcactttgccacaggcacggggagggttttctcctcaccccctctgccctcccaacttgggttgtactttctaagaaggtgattccccctgcccttgcccccttccccagaacaaaacatgttgatcatgtgcaatatttcttactgtgccgagaagccgcaatgagcgagattaaagctgtttaacaca

SEQ ID NO: 446472 - DNA, 4393 bp, Homo sapiens
ttccacccctcacctgctgccctgttgcccgttttggtgcccagcagctataccagccaccctgcccccaagaaggaagtcatcatgggccggcctggaacagtgtggacgaatgtggaacctcgctctgtggctgtgttcccttggcactccttagtccccttcctggcacccagccagcctgacccctccgtgcagccgagcgaggcccagcaacctgccagccacccagtggcctccaaccagagcaaagaacctgctgagtcggcagctgttgctcatgaacggccaccaggtgggacagggagtgctgaccctgagcggccccctggagccacatgccctgagagcccaggacccggacccccacaccctttgggggtggtggaatctggtaagggtccgcctcccaccacggaggaggaggcctccggccccccaggagagccccggctggacagtgagacagagagtgaccatgatgatgccttcctctccatcatgtctcctgagatccagttgcctctaccgcccggaaaacgtcggacccagtccctcagtgccctacccaaggaacgggactcatcttctgagaaggatggacgcagccccaacaagcgggagaaggaccacatccggcggcccatgaatgccttcatgatcttcagcaagcggcaccgggccctggtccaccagcgtcatcccaaccaggacaaccggaccgtcagcaagatcctgggcgagtggtggtatgccctggggcccaaggagaagcagaagtaccacgacctggccttccaggtgaaggaggcccacttcaaggcccacccagattggaagtggtgcaacaaggaccgaaagaagtccagctcagaggccaagcccacgagcctggggctggcaggagggcacaaggagacgcgggagcggagcatgtcggagacgggcactgctgctgcccctggggtgtcctctgagctcctgtccgttgcagcccagacactcctgagctcagacaccaaggctccggggagcagctcctgtggggcagaacggctacacacagttgggggacctggctcagcccggccccgagctttctcccacagcggggtacacagcctggacggcggagaagtagacagtcaggcgctacaggaactgacgcagatggtgtctggccctgcatcgtactctggcccaaagccttctacccagtatggagctccaggaccctttgcagcccctggtgagggaggtgccttggcggccactgggcggcccccgctgctgcccacccgagcttctcgttctcagcgtgcggccagtgaggacatgacgagtgatgaggagcgcatggtcatctgtgaggaggaaggggatgatgatgtcattgctgacgatggcttcggcaccactgacattgatctcaagtgcaaggagcgggtgaccgacagcgagagtggggacagctctggggaggacccagagggcaacaagggctttggtcggaaggtgttttcacctgtgatccgttcctcctttacccactgccgccccccactggaccctgagcccccagggcccccggatcctcctgtagcctttggcaaaggctatggttccgccccatcctcctctgcgtcctcgcctgcttcctcctcagcctcggcagccacctccttctcactgggctcaggaaccttcaaggcccaggagtctggtcagggcagcacagcgggccccctacggcccccaccccctggggctgggggtccagcgacaccttccaaggcaacccggttcctcccaatggatcctgccaccttccggcgcaagagacccgaaagtgtgggtggcctggagccaccaggcccctcagtcatcgcggcccctcccagcggaggaggaaacatcctgcagacactggtgctgcccccaaacaaggaggagcaagagggcggcggagccagagtgccctccgcccccgccccatcactggcctatggggccccagcagctcccctgtcccgtcctgccgccaccatggtcaccaatgtggtgcggcctgtcagcagcactcctgtgcccatcgcctctaagcccttccccacctctggccgggctgaggcgtctccaaatgacacagcaggtgccaggactgaaatgggcactgggtctcgggtgcctgggggctccccgctgggtgtcagcttagtgtattcggacaagaagtcggcagcagccacctcaccagccccacacttggtggctggacccctgctgggcactgtggggaaggcgcctgccactgtcactaacctactggtgggcaccccggggtatggggcccctgcgccccctgctgtccagttcattgcccagggggcccctggtggtgggaccactgcgggctcaggagcaggtgctgggagtggccccaatgggccagtacccctgggcatcctgcaaccaggtgccctgggcaaggctgggggaatcacccaggtacagtacatcctgcccacgctgccccagcagcttcaggtggcacctgccccagcaccagcccctgggaccaaggcagcggctcccagcggccctgcacccaccaccagcatccgtttcaccctcccaccgggcacttccaccaacggcaaagtcctggctgccactgcacccactcctggcatccccatcctgcagtctgtaccctccgccccaccccccaaagcccagtcagtttctcccgtgcaggccccgcccccgggtggctcagcccagctgctgcctgggaaggtcctagtgcctctggccgcccctagcatgtcagtgcggggtggaggggccggccagccactgccactggtgagcccgcccttctcagtacctgtgcagaatggtgcccagccccccagcaagatcatccagctgaccccggtgcctgtgagcacacccagcggcctggtgccgcccctgagcccagccacactccctggacccacctctcagcctcagaaggtcctgttgccctcctccaccagaatcacctatgtgcagtcagcgggcgggcacgcgctgcccctgggtaccagccctgcgtccagccaggctggaacagtcacctcgtacgggcccacgagctctgtagctctaggcttcacctcgctggggcccagcggccccgccttcgtgcagcccctgctctcagcaggccaagccccactgctggctcccggtcaggtgggcgtgtcacctgtgcccagtccccagctgccgcctgcctgtgcagcccccggaggtcctgtcataacagcattttactctggcagccctgcacccacctcctcagcacccctggcccagccatcccaggcccccccaagcctggtctacactgtggccaccagcacaaccccacctgcagccaccattctgcccaagggcccgccagcccctgccactgccaccccagccccgactagccctttccccagcgccacagcaggttccatgacctacagcttagtggcccccaaggcccagcggcccagcccgaaggccccccagaaagtgaaggcagccatcgccagcattcccgtggggtcctttgaggcaggtgcctctgggcggcctggccctgcaccccggcagcctctggagcctggcccagtccgagagccaactgccccagagtctgagcttgaggggcagcccacaccaccagcccctccacccctgccagagacctggactcccacggcccggagcagccccccactgcccccacctgctgaggagcggaccagcgccaagggccctgagaccatggccagcaaattccccagctcatcttcagactggcgcgtccctgggcagggcctggagaatcgtggggagcctcccactcctcccagcccggccccagctccagctgtagcccctggtggcagcagcgagagcagcagtgggcgggcagccggggacaccccggagcgcaaggaggcggctggtactggcaagaaggtgaaggtgcggcccccgcccctgaagaagacctttgactctgtggacaacagggtcctgtcagaagtggacttcgaagagcgctttgctgagttgcctgagtttcggcctgaggaggtgctgccctcccccaccctgcagtctctggccacctcaccccgggccatcctgggctcttaccgcaagaagaggaagaactccacggacctggattcagcacccgaggaccccacctcgcccaagcgcaagatgagaagacgctccagctgcagctcggagcccaacacccccaagagtgccaagtgcgagggggacatcttcacctttgaccgtacaggtgccgtggtgggcagaactttgggggcct

SEQ ID NO: 446473 - DNA, 212 bp, Homo sapiens
cccagagggcaggaatcagcaggaatgagatgctggactggtggtgggtggtggtttttttttttcaccaagtggcccagaaattccagcctgcttctgcctagtacctagaaatatctatgggttgttgggccagtctaggtgctggtgacaggcttactgactgtcatagcgccactctctactttacagtgtcctctgagctcctgtcc

SEQ ID NO: 446474 - DNA, 5472 bp, Homo sapiens
ggaggtgcgagcccctgccgggtcccccctgcgccggaccatgtattcggcccacaggcccctgatgcccgcgtccagcgcggcctcccgtggcctcggcatgttcgtgtggacgaatgtggaacctcgctctgtggctgtgttcccttggcactccttagtccccttcctggcacccagccagcctgacccctccgtgcagccgagcgaggcccagcaacctgccagccacccagtggcctccaaccagagcaaagaacctgctgagtcggcagctgttgctcatgaacggccaccaggtgggacagggagtgctgaccctgagcggccccctggagccacatgccctgagagcccaggacccggacccccacaccctttgggggtggtggaatctggtaagggtccgcctcccaccacggaggaggaggcctccggccccccaggagagccccggctggacagtgagacagagagtgaccatgatgatgccttcctctccatcatgtctcctgagatccagttgcctctaccgcccggaaaacgtcggacccagtccctcagtgccctacccaaggaacgggactcatcttctgagaaggatggacgcagccccaacaagcgggagaaggaccacatccggcggcccatgaatgccttcatgatcttcagcaagcggcaccgggccctggtccaccagcgtcatcccaaccaggacaaccggaccgtcagcaagatcctgggcgagtggtggtatgccctggggcccaaggagaagcagaagtaccacgacctggccttccaggtgaaggaggcccacttcaaggcccacccagattggaagtggtgcaacaaggaccgaaagaagtccagctcagaggccaagcccacgagcctggggctggcaggagggcacaaggagacgcgggagcggagcatgtcggagacgggcactgctgctgcccctggggtgtcctctgagctcctgtccgttgcagcccagacactcctgagctcagacaccaaggctccggggagcagctcctgtggggcagaacggctacacacagttgggggacctggctcagcccggccccgagctttctcccacagcggggtacacagcctggacggcggagaagtagacagtcaggcgctacaggaactgacgcagatggtgtctggccctgcatcgtactctggcccaaagccttctacccagtatggagctccaggaccctttgcagcccctggtgagggaggtgccttggcggccactgggcggcccccgctgctgcccacccgagcttctcgttctcagcgtgcggccagtgaggacatgacgagtgatgaggagcgcatggtcatctgtgaggaggaaggggatgatgatgtcattgctgacgatggcttcggcaccactgacattgatctcaagtgcaaggagcgggtgaccgacagcgagagtggggacagctctggggaggacccagagggcaacaagggctttggtcggaaggtgttttcacctgtgatccgttcctcctttacccactgccgccccccactggaccctgagcccccagggcccccggatcctcctgtagcctttggcaaaggctatggttccgccccatcctcctctgcgtcctcgcctgcttcctcctcagcctcggcagccacctccttctcactgggctcaggaaccttcaaggcccaggagtctggtcagggcagcacagcgggccccctacggcccccaccccctggggctgggggtccagcgacaccttccaaggcaacccggttcctcccaatggatcctgccaccttccggcgcaagagacccgaaagtgtgggtggcctggagccaccaggcccctcagtcatcgcggcccctcccagcggaggaggaaacatcctgcagacactggtgctgcccccaaacaaggaggagcaagagggcggcggagccagagtgccctccgcccccgccccatcactggcctatggggccccagcagctcccctgtcccgtcctgccgccaccatggtcaccaatgtggtgcggcctgtcagcagcactcctgtgcccatcgcctctaagcccttccccacctctggccgggctgaggcgtctccaaatgacacagcaggtgccaggactgaaatgggcactgggtctcgggtgcctgggggctccccgctgggtgtcagcttagtgtattcggacaagaagtcggcagcagccacctcaccagccccacacttggtggctggacccctgctgggcactgtggggaaggcgcctgccactgtcactaacctactggtgggcaccccggggtatggggcccctgcgccccctgctgtccagttcattgcccagggggcccctggtggtgggaccactgcgggctcaggagcaggtgctgggagtggccccaatgggccagtacccctgggcatcctgcaaccaggtgccctgggcaaggctgggggaatcacccaggtacagtacatcctgcccacgctgccccagcagcttcaggtggcacctgccccagcaccagcccctgggaccaaggcagcggctcccagcggccctgcacccaccaccagcatccgtttcaccctcccaccgggcacttccaccaacggcaaagtcctggctgccactgcacccactcctggcatccccatcctgcagtctgtaccctccgccccaccccccaaagcccagtcagtttctcccgtgcaggccccgcccccgggtggctcagcccagctgctgcctgggaaggtcctagtgcctctggccgcccctagcatgtcagtgcggggtggaggggccggccagccactgccactggtgagcccgcccttctcagtacctgtgcagaatggtgcccagccccccagcaagatcatccagctgaccccggtgcctgtgagcacacccagcggcctggtgccgcccctgagcccagccacactccctggacccacctctcagcctcagaaggtcctgttgccctcctccaccagaatcacctatgtgcagtcagcgggcgggcacgcgctgcccctgggtaccagccctgcgtccagccaggctggaacagtcacctcgtacgggcccacgagctctgtagctctaggcttcacctcgctggggcccagcggccccgccttcgtgcagcccctgctctcagcaggccaagccccactgctggctcccggtcaggtgggcgtgtcacctgtgcccagtccccagctgccgcctgcctgtgcagcccccggaggtcctgtcataacagcattttactctggcagccctgcacccacctcctcagcacccctggcccagccatcccaggcccccccaagcctggtctacactgtggccaccagcacaaccccacctgcagccaccattctgcccaagggcccgccagcccctgccactgccaccccagccccgactagccctttccccagcgccacagcaggttccatgacctacagcttagtggcccccaaggcccagcggcccagcccgaaggccccccagaaagtgaaggcagccatcgccagcattcccgtggggtcctttgaggcaggtgcctctgggcggcctggccctgcaccccggcagcctctggagcctggcccagtccgagagccaactgccccagagtctgagcttgaggggcagcccacaccaccagcccctccacccctgccagagacctggactcccacggcccggagcagccccccactgcccccacctgctgaggagcggaccagcgccaagggccctgagaccatggccagcaaattccccagctcatcttcagactggcgcgtccctgggcagggcctggagaatcgtggggagcctcccactcctcccagcccggccccagctccagctgtagcccctggtggcagcagcgagagcagcagtgggcgggcagccggggacaccccggagcgcaaggaggcggctggtactggcaagaaggtgaaggtgcggcccccgcccctgaagaagacctttgactctgtggacaacagggtcctgtcagaagtggacttcgaagagcgctttgctgagttgcctgagtttcggcctgaggaggtgctgccctcccccaccctgcagtctctggccacctcaccccgggccatcctgggctcttaccgcaagaagaggaagaactccacggacctggattcagcacccgaggaccccacctcgcccaagcgcaagatgagaagacgctccagctgcagctcggagcccaacacccccaagagtgccaagtgcgagggggacatcttcacctttgaccgtacaggtacagaagccgaggacgtgcttggggagctagagtatgacaaggtgccatactcctccctgcggcgcaccctggaccagcgccgggccctggtcatgcagctctttcaggaccatggcttcttcccgtcagcccaggccacagccgccttccaggcccgctatgcagacatctttccctccaaggtttgtctgcagttgaagatccgtgaggtgcgccagaagatcatgcaggctgccactcccacggagcagccccctggagctgaggctcctctccctgtaccgccccccactggcaccgctgctgcccctgcccccactcccagccccgcagggggccctgaccccacctcacccagctcggactctggcacggcccaggctgccccgccactgcctccacccccagagtcggggcctggacagcctggctgggagggggctccccagccctcccccccacccccaggtccctccacagctgccacaggcaggtgagggacccctgagaagatgccaggacttatagtaccccctcaggacatggacagtatgtgggggcaggaaggttatctcctcccgggtaaagccatttcgtcctctccagtttggggcggaatgaggcctgctcctcttgtaaatacccccttccctcgaagctccctcccggtgctggggggcagctgaggggctgcaggggcagtctccctcctccaagcccctgtacataacctggagcgtgtgaccttcagagcttttcactttatgcaaaatggctcctgtgagggctgcaagctggagggtggtgcaggccttgggccacagggaggcgcctgtggaatagggggagttcatgcaccccttttttccccagaggggctggactcaggttagtttgggggtgggggctcctgcactttgccacaggcacggggagggttttctcctcaccccctctgccctcccaacttgggttgtactttctaagaaggtgattccccctgcccttgcccccttccccagaacaaaacatgttgatcatgtgcaatatttcttactgtgccgagaagccgcaatgagcgagattaaagctgtttaacaca

SEQ ID NO: 446475 - DNA, 254 bp, Homo sapiens
ggaggtgcgagcccctgccgggtcccccctgcgccggaccatgtattcggcccacaggcccctgatgcccgcgtccagcgcggcctcccgtggcctcggcatgttcgtgtggacgaatgtggaacctcgctctgtggctgtgttcccttggcactccttagcccccttccccagaacaaaacatgttgatcatgtgcaatatttcttactgtgccgagaagccgcaatgagcgagattaaagctgtttaacaca

SEQ ID NO: 446476 - DNA, 1347 bp, Homo sapiens
cccgggcatcctggggtgaggtggcagagactgcagggtgggggagggcagcacctcctcaccccgggccatcctgggctcttaccgcaagaagaggaagaactccacggacctggattcagcacccgaggaccccacctcgcccaagcgcaagatgagaagacgctccagctgcagctcggagcccaacacccccaagagtgccaagtgcgagggggacatcttcacctttgaccgtacaggtacagaagccgaggacgtgcttggggagctagagtatgacaaggtgccatactcctccctgcggcgcaccctggaccagcgccgggccctggtcatgcagctctttcaggaccatggcttcttcccgtcagcccaggccacagccgccttccaggcccgctatgcagacatctttccctccaaggtttgtctgcagttgaagatccgtgaggtgcgccagaagatcatgcaggctgccactcccacggagcagccccctggagctgaggctcctctccctgtaccgccccccactggcaccgctgctgcccctgcccccactcccagccccgcagggggccctgaccccacctcacccagctcggactctggcacggcccaggctgccccgccactgcctccacccccagagtcggggcctggacagcctggctgggagggggctccccagccctcccccccacccccaggtccctccacagctgccacaggcaggtgagggacccctgagaagatgccaggacttatagtaccccctcaggacatggacagtatgtgggggcaggaaggttatctcctcccgggtaaagccatttcgtcctctccagtttggggcggaatgaggcctgctcctcttgtaaatacccccttccctcgaagctccctcccggtgctggggggcagctgaggggctgcaggggcagtctccctcctccaagcccctgtacataacctggagcgtgtgaccttcagagcttttcactttatgcaaaatggctcctgtgagggctgcaagctggagggtggtgcaggccttgggccacagggaggcgcctgtggaatagggggagttcatgcaccccttttttccccagaggggctggactcaggttagtttgggggtgggggctcctgcactttgccacaggcacggggagggttttctcctcaccccctctgccctcccaacttgggttgtactttctaagaaggtgattccccctgcccttgcccccttccccagaacaaaacatgttgatcatgtgcaatatttcttactgtgccgagaagccgcaatgagcgagattaaagctgtttaacaca

SEQ ID NO: 446477 - DNA, 516 bp, Homo sapiens
gtgggcgtgtcacctgtgcccagtccccagctgccgcctgcctgtgcagcccccggaggtcctgtcataacagcattttactctggcagccctgcacccacctcctcagcacccctggcccagccatcccaggcccccccaagcctggtctacactgtggccaccagcacaaccccacctgcagccaccattctgcccaagggcccgccagcccctgccactgccaccccagccccgactagccctttccccagcgccacaggtaggtgtcagatcaacccagagcagagtgagttgggggacccaggggatgggctccagtcaggcctggctcagcaaacaattttctccccactagcaggttccatgacctacagcttagtggcccccaaggcccagcggcccagcccgaaggccccccagaaagtgaaggcagccatcgccagcattcccgtggggtcctttgaggcaggtgcctctgggcggcctggccctgcaccccggcagcctctggag

SEQ ID NO: 446478 - DNA, 931 bp, Homo sapiens
ccaccgcgcccggcctagaatattctttttgtaaccctcagtatacttgggaaaacagtcatcactgatcgtttaccaaataattttgtagcagaaagaatgaaagggtagtaaggtcgttattggaccttttttttttttgagacagggtctcgctctgtcacccagtttagagtatagtggcatgatcatggctcactgcagccttgacctcccagtctcaagtgatcctccttcctcagcctcccgagtagctgggactagaggcatgcaccaaccacacctggctaattaaaaaaaaattttttttatagagacgaaatcttcctgtgttgtccaggttggtctcaaactcctgggctcaagcagtcctcctgcctcagcctccaaaagtgctgggattacaggcatgagccactgtgccccccattattagacttttttaaaggccattattgactccatgctggagtatagtgaagcaaacacaactcactgcagccttgacttcctgggctcaagagatccttccaccctaccccaggcccccaagtagctgagattacaggcacatgccaccatgcctggctaacttttgtattttgcatagtgatggtgtttcaccatgttgtccaggctggtctcgaactctggagccaaagtgatctgcccacctcagcctcccagagtactcggattacgggcgtgagccccaccacgcatggccttattagacattttagtgagggtttaaacatagcaaatctaactttttcatattttccaggttttgatgatatatgtatctacaatgaatgcagttctctaaatgtaactaactgctcactgttatacatgaacctagaacataccaatcttataaatattgatagcagatttaaaatatatctctaataaattctagcttatt

SEQ ID NO: 446479 - DNA, 2229 bp, Homo sapiens
taacttcctaaaattctccgattctaaaagaaagctcctaaatagaagccaaaaagtagccgcccaacttgaaactccccacaagccgggtaaatagcgcgatacgcagcagctagagttctcgcgtttcccacggcgcaggagcactggagggcccccctccgcccccggccccgccaggaaattagtgcgcatgtgccggtcatccggaagttaccgcagtggccgccggaattaggcgaaaagccggaagtaaacattacgagattggcttggattctgtcggatggacttggggctagctgcggcggggctggaggaggccagataaccatgtcagccacagttgtagatgcagttaatgctgcacccctatcggggtccaaagaaatgagtttggaagaaccaaagaagatgaccagagaggactggagaaagaagaaggagctagaagaacagcgaaaattgggcaatgctcctgcagaagttgatgaagaaggaaaagacatcaacccccatattcctcagtatatttcttcagtgccatggtatattgatccttcaaaaagacctactttaaaacaccagagaccacaaccagaaaaacaaaagcagttcagctcatctggagaatggtacaagaggggtgtaaaagagaattccataattactaagtaccgcaaaggagcatgtgaaaattgtggggccatgacacacaaaaagaaagactgctttgagagacctaggcgagttggagccaaatttacaggtactaatatagctccagatgaacatgtccagcctcaactgatgtttgactatgatgggaagagggatcggtggaatggctacaatccagaagaacacatgaaaattgttgaagagtatgccaaagttgatttggcaaaacgaacattgaaagcccagaaactccaagaggaattagcctcaggaaaattagtggaacaggctaattctccaaaacaccagtggggagaagaggaaccaaattctcagacggaaaaagatcataatagtgaagatgaggatgaagataaatatgcagatgatattgacatgcctggacagaattttgactccaagagacgaattactgtccggaatctcaggattcgagaagatattgcaaaatatttgaggaatttagatccaaattctgcctactatgatccaaaaactagagcaatgagagagaatccttatgccaatgcaggaaagaatccagatgaagtgagttatgctggagataactttgttaggtacacaggagataccatttcaatggctcagacacagttgtttgcatgggaagcctatgacaagggatctgaagtgcatctacaggcagatcctacaaagctagagctgttgtataagtccttcaaagtcaaaaaagaagatttcaaagaacagcagaaagaaagcatcctggaaaagtatggtggccaagaacatttggatgcccctccagctgaattgcttttagcccagactgaagactatgtggagtactcaagacatgggacagtcatcaaaggacaggagcgggctgttgcctgctctaagtatgaggaggatgtgaagatccacaatcacacacatatctggggatcgtactggaaagaaggccgatggggatacaaatgctgtcactcttttttcaagtattcctattgtactggagaagctgggaaggagattgttaactctgaggagtgtattataaatgagataactggggaagaatctgtgaaaaaacctcaaaccctcatggagctgcatcaagaaaaactgaaagaggaaaagaagaagaagaaaaagaaaaagaagaagcatcgaaagagcagttcagatagtgatgatgaagaaaagaagcatgaaaaattgaaaaaggcactgaacgcagaggaggcccgccttcttcatgtcaaggagaccatgcagattgatgagaggaagcggccttacaatagcatgtatgaaactcgagaacctactgaagaggaaatggaggcatatagaatgaaacgtcagaggccagatgaccccatggcctctttccttggacagtagcaactagtcagaagaccatccaagatagatgcagctgatacattcttttcagcttcttattgatgattgtagatagaaaaatccttgtttattcttcttgctgcctggctttaataaatatttcagatgcctcac

SEQ ID NO: 446480 - DNA, 466 bp, Homo sapiens
agtagaagggctgactccaaagctctttcaggcaatctgcgtttttgatagagcagttcatattcagtggggtgtgttggtactctgccacttttgaagaaaagacatctgatgtagagctgtgatacacattttattcctctcactataggcactgaacgcagaggaggcccgccttcttcatgtcaaggagaccatgcagattgatgagaggaagcggccttacaatagcatgtatgaaactcgagaacctactgaagaggaaatggaggcatatagaatgaaacgtcagaggccagatgaccccatggcctctttccttggacagtagcaactagtcagaagaccatccaagatagatgcagctgatacattcttttcagcttcttattgatgattgtagatagaaaaatccttgtttattcttcttgctgcctggctttaataaatatttcagatgcctcac

SEQ ID NO: 446481 - DNA, 239 bp, Homo sapiens
ggctcggtacctattcgtgtcggggttggaggaggccagataaccatgtcagccacagttgtagatgcagttaatgctgcacccctatcggggtccaaagaaatgagtttggaagaaccaaagaagatgaccagagaggactggagaaagaagaaggagctagaagaacagcgaaaattgggcaatgctcctgcagaagttgatgaagaaggaaaagacatcaaccccgaacacggata

SEQ ID NO: 446482 - DNA, 364 bp, Homo sapiens
ggctgtgtcataactttatcctgtgttaacccagactgaagactatgtggagtactcaagacatgggacagtcatcaaaggacaggagcgggctgttgcctgctctaagtatgaggaggatgtgaagatccacaatcacacacatatctggggatcgtactggaaagaaggccgatggggatacaaatgctgtcactcttttttcaagtattcctattgtactggagaagctgggaaggagattgttaactctgaggagtgtattataaatgagataactggggaagaaggaggctggtggaagggagctggtggaagggagaagtactgggctccagccccgcgttgatatggtggaagggag

SEQ ID NO: 446483 - DNA, 3736 bp, Homo sapiens
taacttcctaaaattctccgattctaaaagaaagctcctaaatagaagccaaaaagtagccgcccaacttgaaactccccacaagccgggtaaatagcgcgatacgcagcagctagagttctcgcgtttcccacggcgcaggagcactggagggcccccctccgcccccggccccgccaggaaattagtgcgcatgtgccggtcatccggaagttaccgcagtggccgccggaattaggcgaaaagccggaagtaaacattacgagattggcttggattctgtcggatggacttggggctagctgcggcggggctggaggaggccagataaccatgtcagccacagttgtagatgcagttaatgctgcacccctatcggggtccaaagaaatgagtttggaagaaccaaagaagatgaccagagaggactggagaaagaagaaggagctagaagaacagcgaaaattgggcaatgctcctgcagaagttgatgaagaaggaaaagacatcaacccccatattcctcagtatatttcttcagtgccatggtatattgatccttcaaaaagacctactttaaaacaccagagaccacaaccagaaaaacaaaagcagttcagctcatctggagaatggtacaagaggggtgtaaaagagaattccataattactaagtaccgcaaaggagcatgtgaaaattgtggggccatgacacacaaaaagaaagactgctttgagagacctaggcgagttggagccaaatttacaggtactaatatagctccagatgaacatgtccagcctcaactgatgtttgactatgatgggaagagggatcggtggaatggctacaatccagaagaacacatgaaaattgttgaagagtatgccaaagttgatttggcaaaacgaacattgaaagcccagaaactccaagaggaattagcctcaggaaaattagtggaacaggctaattctccaaaacaccagtggggagaagaggaaccaaattctcagacggaaaaagatcataatagtgaagatgaggatgaagataaatatgcagatgatattgacatgcctggacagaattttgactccaagagacgaattactgtccggaatctcaggattcgagaagatattgcaaaatatttgaggaatttagatccaaattctgcctactatgatccaaaaactagagcaatgagagagaatccttatgccaatgcaggaaagaatccagatgaagtgagttatgctggagataactttgttaggtacacaggagataccatttcaatggctcagacacagttgtttgcatgggaagcctatgacaagggatctgaagtgcatctacaggcagatcctacaaagctagagctgttgtataagtccttcaaagtcaaaaaagaagatttcaaagaacagcagaaagaaagcatcctggaaaagtatggtggccaagaacatttggatgcccctccagctgaattgcttttagcccagactgaagactatgtggagtactcaagacatgggacagtcatcaaaggacaggagcgggctgttgcctgctctaagtatgaggaggatgtgaagatccacaatcacacacatatctggggatcgtactggaaagaaggccgatggggatacaaatgctgtcactcttttttcaagtattcctattgtactggagaagctgggaaggagattgttaactctgaggagtgtattataaatgagataactggggaagaatctgtgaaaaaacctcaaaccctcatggagctgcatcaagaaaaactgaaagaggaaaagaagaagaagaaaaagaaaaagaagaagcatcgaaagagcagttcagatagtgatgatgaagaaaagaagcatgaaaaattgaaaaaggcactgaacgcagaggaggcccgccttcttcatgtcaaggagaccatgcagattgatgagaggaagcggccttacaatagcatgtatgaaactcgagaacctactgaagaggaaatggaggcatatagaatgaaacgtcagaggccagatgaccccatggcctctttccttggacagtagcaactagtcagaagaccatccaagatagatgcagctgatacattcttttcagcttcttattgatgattgtagatagaaaaatccttgtttattcttcttgctgcctggctttaataaatatttcagatgcctcacagtaagttcactcctttccatactgaggaaacaagaaaagaagaagaggcacatgaagtgtgcttttgggaatagaatttaaaattggattaagattttatttccagttttttttatttatttatttttttttttggagacggagtcttgctctgtcgcccaggctgaagtgcggtggcgcgatctcggctcactgcaagctccacctcccaggttcacgccattctcctgcctcagcctccctagtagttgggactacaggcgcccgccaccatgctcagctaattttttgtatttttagtagagacggtttcatcgtgttagccaggatggtctcgatctcctgaccttgtgatccacccgcctcagcctcccaaagtgctgagattacaggcgtgagccacccgcgcctggcctatttccagttttatgtgagtcatgtaaaaaagccttggctctctacctattaagaatgtctctttctctatatttattaagcttcaaactttattgcttcgatttttgtggccctatatttagtattagcacaccttggttttgagaaaaaaacagggctttgtttttttaaataattactagcaactctgtgactacatttatttttattttttttagagacaggatcttgctatgttgcccaggctagagagcagtggcttttcacagacaaagtcataatgccctgcagtcttgggctcaagcgattctctcttccttggcctctggagtagactaaatgtgttagtctttgaatggaaaacaactattttctcatcattgggtcaatattgactgatcagtagtaggtcttttaccattctggacataagtctaggtgtagaaatcctttcctttatcatagaggatatggtttacattaccgtttgttttcattgtgattgcccctatgtaacaatcatgaatattagattttttaaattgtagaatatcctaatatttatagccagcagctgttactttgtttgtaaaatttgcaaaaaaacaaaacctgaagttggtttattgaaagaattataaggatagcttctagggatattagtaatagattgccatgatcctgaagcctcttctcagaacactgtgaagataatactgacagagtagaatcagtgaaaacagcctaacaaaacctctgacatcagtatatcaacttttaacagcccactcactggcttttctaaactaccaaaaaccacctgtaggatactgcattaagtcagcatctcagaaacagtggtgtgagtaactgagtcaaattgtcaagtactttggatatacatagtgtcgagctttagattggtatgaaattaaacagcaatgcaaatagatttaattcctatttactttaagaatgaaaaacaatgttcattttcctacctaaacagggtggttcaacataaaggctgatgttgtgtccgttttgtattttatcttttgttaaagatacataaatgacaatacttaa

SEQ ID NO: 446484 - DNA, 3904 bp, Homo sapiens
tccttgatgacttaatgatgtaactcttttctttagaatggtagggaatggagggctaagttagagtgagtgaggatgaaaatagaaggtgaggaaatggaggcagtgaatatagataactcttgagatgttcattcttgaaggggtacagagataggaccctcttttctctcattaagagttactgtgttagaaaagtttgagacatacacagaaagagggattaaggatggatatgagaaaagagtcctgtgaaattttaaatacacgtgtgtgtctctctccatttgtaaattggagttgagagagaaacagtgctaacagtatgtagagacctcgaggagggggaagagacccttccttacacataatataggagaaaaaaaaacatatgaaacagtatatattattaggatgtatttttggtagtttgagtgaattcatgaaggcctactttttactgtaagtttcacttcttttcctagaggaggccagataaccatgtcagccacagttgtagatgcagttaatgctgcacccctatcggggtccaaagaaatgagtttggaagaaccaaagaagatgaccagagaggactggagaaagaagaaggagctagaagaacagcgaaaattgggcaatgctcctgcagaagttgatgaagaaggaaaagacatcaacccccatattcctcagtatatttcttcagtgccatggtatattgatccttcaaaaagacctactttaaaacaccagagaccacaaccagaaaaacaaaagcagttcagctcatctggagaatggtacaagaggggtgtaaaagagaattccataattactaagtaccgcaaaggagcatgtgaaaattgtggggccatgacacacaaaaagaaagactgctttgagagacctaggcgagttggagccaaatttacaggtactaatatagctccagatgaacatgtccagcctcaactgatgtttgactatgatgggaagagggatcggtggaatggctacaatccagaagaacacatgaaaattgttgaagagtatgccaaagttgatttggcaaaacgaacattgaaagcccagaaactccaagaggaattagcctcaggaaaattagtggaacaggctaattctccaaaacaccagtggggagaagaggaaccaaattctcagacggaaaaagatcataatagtgaagatgaggatgaagataaatatgcagatgatattgacatgcctggacagaattttgactccaagagacgaattactgtccggaatctcaggattcgagaagatattgcaaaatatttgaggaatttagatccaaattctgcctactatgatccaaaaactagagcaatgagagagaatccttatgccaatgcaggaaagaatccagatgaagtgagttatgctggagataactttgttaggtacacaggagataccatttcaatggctcagacacagttgtttgcatgggaagcctatgacaagggatctgaagtgcatctacaggcagatcctacaaagctagagctgttgtataagtccttcaaagtcaaaaaagaagatttcaaagaacagcagaaagaaagcatcctggaaaagtatggtggccaagaacatttggatgcccctccagctgaattgcttttagcccagactgaagactatgtggagtactcaagacatgggacagtcatcaaaggacaggagcgggctgttgcctgctctaagtatgaggaggatgtgaagatccacaatcacacacatatctggggatcgtactggaaagaaggccgatggggatacaaatgctgtcactcttttttcaagtattcctattgtactggagaagctgggaaggagattgttaactctgaggagtgtattataaatgagataactggggaagaatctgtgaaaaaacctcaaaccctcatggagctgcatcaagaaaaactgaaagaggaaaagaagaagaagaaaaagaaaaagaagaagcatcgaaagagcagttcagatagtgatgatgaagaaaagaagcatgaaaaattgaaaaaggcactgaacgcagaggaggcccgccttcttcatgtcaaggagaccatgcagattgatgagaggaagcggccttacaatagcatgtatgaaactcgagaacctactgaagaggaaatggaggcatatagaatgaaacgtcagaggccagatgaccccatggcctctttccttggacagtagcaactagtcagaagaccatccaagatagatgcagctgatacattcttttcagcttcttattgatgattgtagatagaaaaatccttgtttattcttcttgctgcctggctttaataaatatttcagatgcctcacagtaagttcactcctttccatactgaggaaacaagaaaagaagaagaggcacatgaagtgtgcttttgggaatagaatttaaaattggattaagattttatttccagttttttttatttatttatttttttttttggagacggagtcttgctctgtcgcccaggctgaagtgcggtggcgcgatctcggctcactgcaagctccacctcccaggttcacgccattctcctgcctcagcctccctagtagttgggactacaggcgcccgccaccatgctcagctaattttttgtatttttagtagagacggtttcatcgtgttagccaggatggtctcgatctcctgaccttgtgatccacccgcctcagcctcccaaagtgctgagattacaggcgtgagccacccgcgcctggcctatttccagttttatgtgagtcatgtaaaaaagccttggctctctacctattaagaatgtctctttctctatatttattaagcttcaaactttattgcttcgatttttgtggccctatatttagtattagcacaccttggttttgagaaaaaaacagggctttgtttttttaaataattactagcaactctgtgactacatttatttttattttttttagagacaggatcttgctatgttgcccaggctagagagcagtggcttttcacagacaaagtcataatgccctgcagtcttgggctcaagcgattctctcttccttggcctctggagtagactaaatgtgttagtctttgaatggaaaacaactattttctcatcattgggtcaatattgactgatcagtagtaggtcttttaccattctggacataagtctaggtgtagaaatcctttcctttatcatagaggatatggtttacattaccgtttgttttcattgtgattgcccctatgtaacaatcatgaatattagattttttaaattgtagaatatcctaatatttatagccagcagctgttactttgtttgtaaaatttgcaaaaaaacaaaacctgaagttggtttattgaaagaattataaggatagcttctagggatattagtaatagattgccatgatcctgaagcctcttctcagaacactgtgaagataatactgacagagtagaatcagtgaaaacagcctaacaaaacctctgacatcagtatatcaacttttaacagcccactcactggcttttctaaactaccaaaaaccacctgtaggatactgcattaagtcagcatctcagaaacagtggtgtgagtaactgagtcaaattgtcaagtactttggatatacatagtgtcgagctttagattggtatgaaattaaacagcaatgcaaatagatttaattcctatttactttaagaatgaaaaacaatgttcattttcctacctaaacagggtggttcaacataaaggctgatgttgtgtccgttttgtattttatcttttgttaaagatacataaatgacaatacttaa

SEQ ID NO: 446485 - DNA, 2572 bp, Homo sapiens
tgtagtaggaaccctctctgcgtccaaattgaaaactagagcatgagagagaatctatatgccaatgccggacagaatccagatgaagtgagttatgctggagataactttgttaggtacacaggagataccatttcaatggctcagacacagttgtttgcatgggaagcctatgacaagggatctgaagtgcatctacaggcagatcctacaaagctagagctgttgtataagtccttcaaagtcaaaaaagaagatttcaaagaacagcagaaagaaagcatcctggaaaagtatggtggccaagaacatttggatgcccctccagctgaattgcttttagcccagactgaagactatgtggagtactcaagacatgggacagtcatcaaaggacaggagcgggctgttgcctgctctaagtatgaggaggatgtgaagatccacaatcacacacatatctggggatcgtactggaaagaaggccgatggggatacaaatgctgtcactcttttttcaagtattcctattgtactggagaagctgggaaggagattgttaactctgaggagtgtattataaatgagataactggggaagaatctgtgaaaaaacctcaaaccctcatggagctgcatcaagaaaaactgaaagaggaaaagaagaagaagaaaaagaaaaagaagaagcatcgaaagagcagttcagatagtgatgatgaagaaaagaagcatgaaaaattgaaaaaggcactgaacgcagaggaggcccgccttcttcatgtcaaggagaccatgcagattgatgagaggaagcggccttacaatagcatgtatgaaactcgagaacctactgaagaggaaatggaggcatatagaatgaaacgtcagaggccagatgaccccatggcctctttccttggacagtagcaactagtcagaagaccatccaagatagatgcagctgatacattcttttcagcttcttattgatgattgtagatagaaaaatccttgtttattcttcttgctgcctggctttaataaatatttcagatgcctcacagtaagttcactcctttccatactgaggaaacaagaaaagaagaagaggcacatgaagtgtgcttttgggaatagaatttaaaattggattaagattttatttccagttttttttatttatttatttttttttttggagacggagtcttgctctgtcgcccaggctgaagtgcggtggcgcgatctcggctcactgcaagctccacctcccaggttcacgccattctcctgcctcagcctccctagtagttgggactacaggcgcccgccaccatgctcagctaattttttgtatttttagtagagacggtttcatcgtgttagccaggatggtctcgatctcctgaccttgtgatccacccgcctcagcctcccaaagtgctgagattacaggcgtgagccacccgcgcctggcctatttccagttttatgtgagtcatgtaaaaaagccttggctctctacctattaagaatgtctctttctctatatttattaagcttcaaactttattgcttcgatttttgtggccctatatttagtattagcacaccttggttttgagaaaaaaacagggctttgtttttttaaataattactagcaactctgtgactacatttatttttattttttttagagacaggatcttgctatgttgcccaggctagagagcagtggcttttcacagacaaagtcataatgccctgcagtcttgggctcaagcgattctctcttccttggcctctggagtagactaaatgtgttagtctttgaatggaaaacaactattttctcatcattgggtcaatattgactgatcagtagtaggtcttttaccattctggacataagtctaggtgtagaaatcctttcctttatcatagaggatatggtttacattaccgtttgttttcattgtgattgcccctatgtaacaatcatgaatattagattttttaaattgtagaatatcctaatatttatagccagcagctgttactttgtttgtaaaatttgcaaaaaaacaaaacctgaagttggtttattgaaagaattataaggatagcttctagggatattagtaatagattgccatgatcctgaagcctcttctcagaacactgtgaagataatactgacagagtagaatcagtgaaaacagcctaacaaaacctctgacatcagtatatcaacttttaacagcccactcactggcttttctaaactaccaaaaaccacctgtaggatactgcattaagtcagcatctcagaaacagtggtgtgagtaactgagtcaaattgtcaagtactttggatatacatagtgtcgagctttagattggtatgaaattaaacagcaatgcaaatagatttaattcctatttactttaagaatgaaaaacaatgttcattttcctacctaaacagggtggttcaacataaaggctgatgttgtgtccgttttgtattttatcttttgttaaagatacataaatgacaatacttaa

SEQ ID NO: 446486 - DNA, 2807 bp, Homo sapiens
cgcacgctctgggtctggggctccaggtgagaccaactgatctgcaccggaatctcaggatcctgtaaggctattgctatacagtatttcgagcgaactatagactccgatagttctgcctagtagtgactccaccgacatactatgagcaggtgagacgacgacatcgctgtactgtcgcaagtgccctgcgagaaggaataccaggagtggacacgctgaagcttcagtgtcccttgggaggaagtaacctattggtctcaggggtaccgacacgtgtacgcactcagcccactcttgcaacagggattgcgaggagcatcacgttgtgctatatgccattgcgcgtaacggtcctaactcgaactacattggcggactcattggatagggtggctacttcatagcacggcgaagagtccctaccacacacgtctacgcatgtctgtggtagtaaagatccttcaaagtcaaggagagaagatttcgaaagcaacatggactaggaaatgaaagcatcctggaaaagtatggtggccaagaacatttggatgcccctccagctgaattgcttttagcccagactgaagactatgtggagtactcaagacatgggacagtcatcaaaggacaggagcgggctgttgcctgctctaagtatgaggaggatgtgaagatccacaatcacacacatatctggggatcgtactggaaagaaggccgatggggatacaaatgctgtcactcttttttcaagtattcctattgtactggagaagctgggaaggagattgttaactctgaggagtgtattataaatgagataactggggaagaatctgtgaaaaaacctcaaaccctcatggagctgcatcaagaaaaactgaaagaggaaaagaagaagaagaaaaagaaaaagaagaagcatcgaaagagcagttcagatagtgatgatgaagaaaagaagcatgaaaaattgaaaaaggcactgaacgcagaggaggcccgccttcttcatgtcaaggagaccatgcagattgatgagaggaagcggccttacaatagcatgtatgaaactcgagaacctactgaagaggaaatggaggcatatagaatgaaacgtcagaggccagatgaccccatggcctctttccttggacagtagcaactagtcagaagaccatccaagatagatgcagctgatacattcttttcagcttcttattgatgattgtagatagaaaaatccttgtttattcttcttgctgcctggctttaataaatatttcagatgcctcacagtaagttcactcctttccatactgaggaaacaagaaaagaagaagaggcacatgaagtgtgcttttgggaatagaatttaaaattggattaagattttatttccagttttttttatttatttatttttttttttggagacggagtcttgctctgtcgcccaggctgaagtgcggtggcgcgatctcggctcactgcaagctccacctcccaggttcacgccattctcctgcctcagcctccctagtagttgggactacaggcgcccgccaccatgctcagctaattttttgtatttttagtagagacggtttcatcgtgttagccaggatggtctcgatctcctgaccttgtgatccacccgcctcagcctcccaaagtgctgagattacaggcgtgagccacccgcgcctggcctatttccagttttatgtgagtcatgtaaaaaagccttggctctctacctattaagaatgtctctttctctatatttattaagcttcaaactttattgcttcgatttttgtggccctatatttagtattagcacaccttggttttgagaaaaaaacagggctttgtttttttaaataattactagcaactctgtgactacatttatttttattttttttagagacaggatcttgctatgttgcccaggctagagagcagtggcttttcacagacaaagtcataatgccctgcagtcttgggctcaagcgattctctcttccttggcctctggagtagactaaatgtgttagtctttgaatggaaaacaactattttctcatcattgggtcaatattgactgatcagtagtaggtcttttaccattctggacataagtctaggtgtagaaatcctttcctttatcatagaggatatggtttacattaccgtttgttttcattgtgattgcccctatgtaacaatcatgaatattagattttttaaattgtagaatatcctaatatttatagccagcagctgttactttgtttgtaaaatttgcaaaaaaacaaaacctgaagttggtttattgaaagaattataaggatagcttctagggatattagtaatagattgccatgatcctgaagcctcttctcagaacactgtgaagataatactgacagagtagaatcagtgaaaacagcctaacaaaacctctgacatcagtatatcaacttttaacagcccactcactggcttttctaaactaccaaaaaccacctgtaggatactgcattaagtcagcatctcagaaacagtggtgtgagtaactgagtcaaattgtcaagtactttggatatacatagtgtcgagctttagattggtatgaaattaaacagcaatgcaaatagatttaattcctatttactttaagaatgaaaaacaatgttcattttcctacctaaacagggtggttcaacataaaggctgatgttgtgtccgttttgtattttatcttttgttaaagatacataaatgacaatacttaa

SEQ ID NO: 446487 - DNA, 2031 bp, Homo sapiens
taacttcctaaaattctccgattctaaaagaaagctcctaaatagaagccaaaaagtagccgcccaacttgaaactccccacaagccgggtaaatagcgcgatacgcagcagctagagttctcgcgtttcccacggcgcaggagcactggagggcccccctccgcccccggccccgccaggaaattagtgcgcatgtgccggtcatccggaagttaccgcagtggccgccggaattaggcgaaaagccggaagtaaacattacgagattggcttggattctgtcggatggacttggggctagctgcggcggggctggaggaggccagataaccatgtcagccacagttgtagatgcagttaatgctgcacccctatcggggtccaaagaaatgagtttggaagaaccaaagaagatgaccagagaggactggagaaagaagaaggagctagaagaacagcgaaaattgggcaatgctcctgcagaagttgatgaagaaggaaaagacatcaacccccatattcctcagtatatttcttcagtgccatggtatattgatccttcaaaaagacctactttaaaacaccagagaccacaaccagaaaaacaaaagcagttcagctcatctggagaatggtacaagaggggtgtaaaagagaattccataattactaagtaccgcaaaggagcatgtgaaaattgtggggccatgacacacaaaaagaaagactgctttgagagacctaggcgagttggagccaaatttacaggtactaatatagctccagatgaacatgtccagcctcaactgatgtttgactatgatgggaagagggatcggtggaatggctacaatccagaagaacacatgaaaattgttgaagagtatgccaaagttgatttggcaaaacgaacattgaaagcccagaaactccaagaggaattagcctcaggaaaattagtggaacaggctaattctccaaaacaccagtggggagaagaggaaccaaattctcagacggaaaaagatcataatagtgaagatgaggatgaagataaatatgcagatgatattgacatgcctggacagaattttgactccaagagacgaattactgtccggaatctcaggattcgagaagatattgcaaaatatttgaggaatttagatccaaattctgcctactatgatccaaaaactagagcaatgagagagaatccttatgccaatgcaggaaagaatccagatgaagtgagttatgctggagataactttgttaggtacacaggagataccatttcaatggctcagacacagttgtttgcatgggaagcctatgacaagggatctgaagtgcatctacaggcagatcctacaaagctagagctgttgtataagtccttcaaagtcaaaaaagaagatttcaaagaacagcagaaagaaagcatcctggaaaagtatggtggccaagaacatttggatgcccctccagctgaattgcttttagcccagactgaagactatgtggagtactcaagacatgggacagtcatcaaaggacaggagcgggctgttgcctgctctaagtatgaggaggatgtgaagatccacaatcacacacatatctggggatcgtactggaaagaaggccgatggggatacaaatgctgtcactcttttttcaagtattcctattgtactggagaagctgggaaggagattgttaactctgaggagtgtattataaatgagataactggggaagaatctgtgaaaaaacctcaaaccctcatggagctgcatcaagaaaaactgaaagaggaaaagaagaagaagaaaaagaaaaagaagaagcatcgaaagagcagttcagatagtgatgatgaagaaaagaagcatgaaaaattgaaaaaggccctgagctaactagaactccaaagagtgcaaacaacttggcagcgatcctggctttaccttggcttttgcaaaagcggcagagcccaagcttacaagctctctgaatgggcaaca

SEQ ID NO: 446488 - DNA, 1998 bp, Homo sapiens
  misc_feature (38)..(39): n is a, c, g, or t
  misc_feature (49)..(49): n is a, c, g, or t
tgatccttacagtgcactcttctatatctacctgtgannaaactcaaancctcatggagctgcatcaagaaaaactgaaagaggaaaagaagaagaagaaaaagaaaaagaagaagcatcgaaagagcagttcagatagtgatgatgaagaaaagaagcatgaaaaattgaaaaaggcactgaacgcagaggaggcccgccttcttcatgtcaaggagaccatgcagattgatgagaggaagcggccttacaatagcatgtatgaaactcgagaacctactgaagaggaaatggaggcatatagaatgaaacgtcagaggccagatgaccccatggcctctttccttggacagtagcaactagtcagaagaccatccaagatagatgcagctgatacattcttttcagcttcttattgatgattgtagatagaaaaatccttgtttattcttcttgctgcctggctttaataaatatttcagatgcctcacagtaagttcactcctttccatactgaggaaacaagaaaagaagaagaggcacatgaagtgtgcttttgggaatagaatttaaaattggattaagattttatttccagttttttttatttatttatttttttttttggagacggagtcttgctctgtcgcccaggctgaagtgcggtggcgcgatctcggctcactgcaagctccacctcccaggttcacgccattctcctgcctcagcctccctagtagttgggactacaggcgcccgccaccatgctcagctaattttttgtatttttagtagagacggtttcatcgtgttagccaggatggtctcgatctcctgaccttgtgatccacccgcctcagcctcccaaagtgctgagattacaggcgtgagccacccgcgcctggcctatttccagttttatgtgagtcatgtaaaaaagccttggctctctacctattaagaatgtctctttctctatatttattaagcttcaaactttattgcttcgatttttgtggccctatatttagtattagcacaccttggttttgagaaaaaaacagggctttgtttttttaaataattactagcaactctgtgactacatttatttttattttttttagagacaggatcttgctatgttgcccaggctagagagcagtggcttttcacagacaaagtcataatgccctgcagtcttgggctcaagcgattctctcttccttggcctctggagtagactaaatgtgttagtctttgaatggaaaacaactattttctcatcattgggtcaatattgactgatcagtagtaggtcttttaccattctggacataagtctaggtgtagaaatcctttcctttatcatagaggatatggtttacattaccgtttgttttcattgtgattgcccctatgtaacaatcatgaatattagattttttaaattgtagaatatcctaatatttatagccagcagctgttactttgtttgtaaaatttgcaaaaaaacaaaacctgaagttggtttattgaaagaattataaggatagcttctagggatattagtaatagattgccatgatcctgaagcctcttctcagaacactgtgaagataatactgacagagtagaatcagtgaaaacagcctaacaaaacctctgacatcagtatatcaacttttaacagcccactcactggcttttctaaactaccaaaaaccacctgtaggatactgcattaagtcagcatctcagaaacagtggtgtgagtaactgagtcaaattgtcaagtactttggatatacatagtgtcgagctttagattggtatgaaattaaacagcaatgcaaatagatttaattcctatttactttaagaatgaaaaacaatgttcattttcctacctaaacagggtggttcaacataaaggctgatgttgtgtccgttttgtattttatcttttgttaaagatacataaatgacaatacttaa

SEQ ID NO: 446489 - DNA, 1973 bp, Homo sapiens
agtagaagggctgactccaaagctctttcaggcaatctgcgtttttgatagagcagttcatattcagtggggtgtgttggtactctgccacttttgaagaaaagacatctgatgtagagctgtgatacacattttattcctctcactataggcactgaacgcagaggaggcccgccttcttcatgtcaaggagaccatgcagattgatgagaggaagcggccttacaatagcatgtatgaaactcgagaacctactgaagaggaaatggaggcatatagaatgaaacgtcagaggccagatgaccccatggcctctttccttggacagtagcaactagtcagaagaccatccaagatagatgcagctgatacattcttttcagcttcttattgatgattgtagatagaaaaatccttgtttattcttcttgctgcctggctttaataaatatttcagatgcctcacagtaagttcactcctttccatactgaggaaacaagaaaagaagaagaggcacatgaagtgtgcttttgggaatagaatttaaaattggattaagattttatttccagttttttttatttatttatttttttttttggagacggagtcttgctctgtcgcccaggctgaagtgcggtggcgcgatctcggctcactgcaagctccacctcccaggttcacgccattctcctgcctcagcctccctagtagttgggactacaggcgcccgccaccatgctcagctaattttttgtatttttagtagagacggtttcatcgtgttagccaggatggtctcgatctcctgaccttgtgatccacccgcctcagcctcccaaagtgctgagattacaggcgtgagccacccgcgcctggcctatttccagttttatgtgagtcatgtaaaaaagccttggctctctacctattaagaatgtctctttctctatatttattaagcttcaaactttattgcttcgatttttgtggccctatatttagtattagcacaccttggttttgagaaaaaaacagggctttgtttttttaaataattactagcaactctgtgactacatttatttttattttttttagagacaggatcttgctatgttgcccaggctagagagcagtggcttttcacagacaaagtcataatgccctgcagtcttgggctcaagcgattctctcttccttggcctctggagtagactaaatgtgttagtctttgaatggaaaacaactattttctcatcattgggtcaatattgactgatcagtagtaggtcttttaccattctggacataagtctaggtgtagaaatcctttcctttatcatagaggatatggtttacattaccgtttgttttcattgtgattgcccctatgtaacaatcatgaatattagattttttaaattgtagaatatcctaatatttatagccagcagctgttactttgtttgtaaaatttgcaaaaaaacaaaacctgaagttggtttattgaaagaattataaggatagcttctagggatattagtaatagattgccatgatcctgaagcctcttctcagaacactgtgaagataatactgacagagtagaatcagtgaaaacagcctaacaaaacctctgacatcagtatatcaacttttaacagcccactcactggcttttctaaactaccaaaaaccacctgtaggatactgcattaagtcagcatctcagaaacagtggtgtgagtaactgagtcaaattgtcaagtactttggatatacatagtgtcgagctttagattggtatgaaattaaacagcaatgcaaatagatttaattcctatttactttaagaatgaaaaacaatgttcattttcctacctaaacagggtggttcaacataaaggctgatgttgtgtccgttttgtattttatcttttgttaaagatacataaatgacaatacttaa

SEQ ID NO: 446490 - DNA, 1675 bp, Homo sapiens
gtttattcttctgctgcctggctttaataaataaggatttttctatctacaatcatcaataagaagctgaaaagaatgtatcagacttcttattgatgattgtagatagaaaaatccttgtttattcttcttgctgcctggctttaataaatatttcagatgcctcacagtaagttcactcctttccatactgaggaaacaagaaaagaagaagaggcacatgaagtgtgcttttgggaatagaatttaaaattggattaagattttatttccagttttttttatttatttatttttttttttggagacggagtcttgctctgtcgcccaggctgaagtgcggtggcgcgatctcggctcactgcaagctccacctcccaggttcacgccattctcctgcctcagcctccctagtagttgggactacaggcgcccgccaccatgctcagctaattttttgtatttttagtagagacggtttcatcgtgttagccaggatggtctcgatctcctgaccttgtgatccacccgcctcagcctcccaaagtgctgagattacaggcgtgagccacccgcgcctggcctatttccagttttatgtgagtcatgtaaaaaagccttggctctctacctattaagaatgtctctttctctatatttattaagcttcaaactttattgcttcgatttttgtggccctatatttagtattagcacaccttggttttgagaaaaaaacagggctttgtttttttaaataattactagcaactctgtgactacatttatttttattttttttagagacaggatcttgctatgttgcccaggctagagagcagtggcttttcacagacaaagtcataatgccctgcagtcttgggctcaagcgattctctcttccttggcctctggagtagactaaatgtgttagtctttgaatggaaaacaactattttctcatcattgggtcaatattgactgatcagtagtaggtcttttaccattctggacataagtctaggtgtagaaatcctttcctttatcatagaggatatggtttacattaccgtttgttttcattgtgattgcccctatgtaacaatcatgaatattagattttttaaattgtagaatatcctaatatttatagccagcagctgttactttgtttgtaaaatttgcaaaaaaacaaaacctgaagttggtttattgaaagaattataaggatagcttctagggatattagtaatagattgccatgatcctgaagcctcttctcagaacactgtgaagataatactgacagagtagaatcagtgaaaacagcctaacaaaacctctgacatcagtatatcaacttttaacagcccactcactggcttttctaaactaccaaaaaccacctgtaggatactgcattaagtcagcatctcagaaacagtggtgtgagtaactgagtcaaattgtcaagtactttggatatacatagtgtcgagctttagattggtatgaaattaaacagcaatgcaaatagatttaattcctatttactttaagaatgaaaaacaatgttcattttcctacctaaacagggtggttcaacataaaggctgatgttgtgtccgttttgtattttatcttttgttaaagatacataaatgacaatacttaa

SEQ ID NO: 446491 - DNA, 742 bp, Homo sapiens
tggaggaatatatttgcgtatcaggctcttggtgagggtcaatattgactgatcagtagtaggtcttttaccattctggacataagtctaggtgtagaaatcctttcctttatcatagaggatatggtttacattaccgtttgttttcattgtgattgcccctatgtaacaatcatgaatattagattttttaaattgtagaatatcctaatatttatagccagcagctgttactttgtttgtaaaatttgcaaaaaaacaaaacctgaagttggtttattgaaagaattataaggatagcttctagggatattagtaatagattgccatgatcctgaagcctcttctcagaacactgtgaagataatactgacagagtagaatcagtgaaaacagcctaacaaaacctctgacatcagtatatcaacttttaacagcccactcactggcttttctaaactaccaaaaaccacctgtaggatactgcattaagtcagcatctcagaaacagtggtgtgagtaactgagtcaaattgtcaagtactttggatatacatagtgtcgagctttagattggtatgaaattaaacagcaatgcaaatagatttaattcctatttactttaagaatgaaaaacaatgttcattttcctacctaaacagggtggttcaacataaaggctgatgttgtgtccgttttgtattttatcttttgttaaagatacataaatgacaatacttaa

SEQ ID NO: 446492 - DNA, 639 bp, Homo sapiens
  misc_feature (91)..(91): n is a, c, g, or t
acatatatgcatagacataggtcaattatatgtctccattagaaaaataataattggaaaacatgttctagaactagttacaaaaataatntaaggtgaatatcctaatatttatagccagcagctgttactttgtttgtaaaatttgcaaaaaaacaaaacctgaagttggtttattgaaagaattataaggatagcttctagggatattagtaatagattgccatgatcctgaagcctcttctcagaacactgtgaagataatactgacagagtagaatcagtgaaaacagcctaacaaaacctctgacatcagtatatcaacttttaacagcccactcactggcttttctaaactaccaaaaaccacctgtaggatactgcattaagtcagcatctcagaaacagtggtgtgagtaactgagtcaaattgtcaagtactttggatatacatagtgtcgagctttagattggtatgaaattaaacagcaatgcaaatagatttaattcctatttactttaagaatgaaaaacaatgttcattttcctacctaaacagggtggttcaacataaaggctgatgttgtgtccgttttgtattttatcttttgttaaagatacataaatgacaatacttaa

SEQ ID NO: 446493 - DNA, 1864 bp, Homo sapiens
taacttcctaaaattctccgattctaaaagaaagctcctaaatagaagccaaaaagtagccgcccaacttgaaactccccacaagccgggtaaatagcgcgatacgcagcagctagagttctcgcgtttcccacggcgcaggagcactggagggcccccctccgcccccggccccgccaggaaattagtgcgcatgtgccggtcatccggaagttaccgcagtggccgccggaattaggcgaaaagccggaagtaaacattacgagattggcttggattctgtcggatggacttggggctagctgcggcggggctggaggaggccagataaccatgtcagccacagttgtagatgcagttaatgctgcacccctatcggggtccaaagaaatgagtttggaagaaccaaagaagatgaccagagaggactggagaaagaagaaggagctagaagaacagcgaaaattgggcaatgctcctgcagaagttgatgaagaaggaaaagacatcaacccccatattcctcagtatatttcttcagtgccatggtatattgatccttcaaaaagacctactttaaaacaccagagaccacaaccagaaaaacaaaagcagttcagctcatctggagaatggtacaagaggggtgtaaaagagaattccataattactaagtaccgcaaaggagcatgtgaaaattgtggggccatgacacacaaaaagaaagactgctttgagagacctaggcgagttggagccaaatttacaggtactaatatagctccagatgaacatgtccagcctcaactgatgtttgactatgatgggaagagggatcggtggaatggctacaatccagaagaacacatgaaaattgttgaagagtatgccaaagttgatttggcaaaacgaacattgaaagcccagaaactccaagaggaattagcctcaggaaaattagtggaacaggctaattctccaaaacaccagtggggagaagaggaaccaaattctcagacggaaaaagatcataatagtgaagatgaggatgaagataaatatgcagatgatattgacatgcctggacagaattttgactccaagagacgaattactgtccggaatctcaggattcgagaagatattgcaaaatatttgaggaatttagatccaaattctgcctactatgatccaaaaactagagcaatgagagagaatccttatgccaatgcaggaaagaatccagatgaagtgagttatgctggagataactttgttaggtacacaggagataccatttcaatggctcagacacagtgtaagtgtttcctctatgtcaagccattttatatcagctcataagacgtttgggattgtttaaagcttgttttcaagaagcatacagtaatgcagctgccaactcactaagatgttttgaattactctagtgtttgcatgggaagcctatgacaagggatctgaagtgcatctacaggcagatcctacaaagctagagctgttgtataagtccttcaaagtcaaaaaagaagatttcaaagaacagcagaaagaaagcatcctggaaaagtatggtggccaagaacatttggatgcccctccagctgaattgcttttagcccagactgaagactatgtggagtactcaagacatgggacagtcatcaaaggacaggagcgggctgttgcctgctctaagtatgaggaggatgtgaagatccacaatcacacagtatgtgctaaactggaacaattttgtgtccttgttggttttgctctgtattgcatttttccactacaactttattagctaaccatttgtattctctatgctttaaaaaaaaaa

SEQ ID NO: 446494 - DNA, 1198 bp, Homo sapiens
  misc_feature (1014)..(1014): n is a, c, g, or t
taacttcctaaaattctccgattctaaaagaaagctcctaaatagaagccaaaaagtagccgcccaacttgaaactccccacaagccgggtaaatagcgcgatacgcagcagctagagttctcgcgtttcccacggcgcaggagcactggagggcccccctccgcccccggccccgccaggaaattagtgcgcatgtgccggtcatccggaagttaccgcagtggccgccggaattaggcgaaaagccggaagtaaacattacgagattggcttggattctgtcggatggacttggggctagctgcggcggggctggaggaggccagataaccatgtcagccacagttgtagatgcagttaatgctgcacccctatcggggtccaaagaaatgagtttggaagaaccaaagaagatgaccagagaggactggagaaagaagaaggagctagaagaacagcgaaaattgggcaatgctcctgcagaagttgatgaagaaggaaaagacatcaacccccatattcctcagtatatttcttcagtgccatggtatattgatccttcaaaaagacctactttaaaacaccagagaccacaaccagaaaaacaaaagcagttcagctcatctggagaatggtacaagaggggtgtaaaagagaattccataattactaagtaccgcaaaggagcatgtgaaaattgtggggccatgacacacaaaaagaaagactgctttgagagacctaggcgagttggagccaaatttacaggtactaatatagctccagatgaacatgtccagcctcaactgatgtttgactatgatgggaagagggatcggtggaatggctacaatccagaagaacacatgaaaattgttgaagagtatgccaaagttgatttggcaaaacgaacattgaaagcccagaaactccaagaggaattagcctcaggaaaattagtggaacaggctaattctcccaaaacaccagtgggggggaagagggacccaaanttctccgaacgggaaaagatcctactaggggaacatgaggttagagatattttgcgcttattttgctgcccggccgattttggtccgaggcgaattctgggcgggatctcgggtctcagtctggcgattgggggttatccccgtcgcgccatggtcatagcggggaaccttgccgggagaacct

SEQ ID NO: 446495 - DNA, 549 bp, Homo sapiens
atgggaagaaaagcaaagccctgtggcaaaagggcatgtatacaaagataagaggaatttatggccatcttgtaacttactgtactcaacagatgaatagcaactgagacatcttctatttgcctcagaaaaaatttgtggctttttttttcctactgtgctttctataacaaaacccagtaaagaatgttccctttctttctgattagaaataaatgttttctggaaatttaaatgcaaatcaggttgtaaaatgtattgaataatgtccaatgtccttttagtatggtggccaagaacatttggatgcccctccagctgaattgcttttagcccagactgaagactatgtggagtactcaagacatgggacagtcatcaaaggacaggagcgggctgttgcctgctctaagtatgaggaggatgtgaagatccacaatcacacagtatgtgctaaactggaacaattttgtgtccttgttggttttgctctgtattgcatttttccactacaactttattagctaaccatttgtattctctatgctt

SEQ ID NO: 446496 - DNA, 495 bp, Homo sapiens
caagtagtgcacctgagctttgttttcacattaataacactgcatttcaatcctccctttcagctgcatcaagaaaaactgaaagaggaaaagaagaagaagaaaaagaaaaagaagaagcatcgaaagagcagttcagatagtgatgatgaagaaaagaagcatgaaaaattgaaaaaggcactgaacgcagaggaggcccgccttcttcatgtcaaggagaccatgcagattgatgagaggaagcggccttacaatagcatgtatgaaactcgagaacctactgaagaggaaatggaggcatatagaatgaaacgtcagaggccagatgaccccatggcctctttccttggacagtagcaactagtcagaagaccatccaagatagatgcagctgatacattcttttcagcttcttattgatgattgtagatagaaaaatccttgtttattcttcttgctgcctggctttaataaatatttcagatgcctcac

SEQ ID NO: 446497 - DNA, 299 bp, Homo sapiens
ctccccgccttttacaactatctcagtcatcaaaggacaggagcgggctgttgcctgctctaagtatgaggaggatgtgaagatccacaatcacacacatatctggggatcgtactggaaagaaggccgatggggatacaaatgctgtcactcttttttcaagtattcctattgtactggagaagctgggaaggagattgttaactctgaggagtgtattataaatgagataactggggaagaagaaagagcagttcagatagttgtaaatggcgccatttacaactatctcatgaagt

SEQ ID NO: 446498 - DNA, 3866 bp, Homo sapiens
taacttcctaaaattctccgattctaaaagaaagctcctaaatagaagccaaaaagtagccgcccaacttgaaactccccacaagccgggtaaatagcgcgatacgcagcagctagagttctcgcgtttcccacggcgcaggagcactggagggcccccctccgcccccggccccgccaggaaattagtgcgcatgtgccggtcatccggaagttaccgcagtggccgccggaattaggcgaaaagccggaagtaaacattacgagattggcttggattctgtcggatggacttggggctagctgcggcggggctggatggtgctgtattgaatttttggacggtactgcattggaggattttaagcttgggcagtaggacattgtattaatctgttttcacattgccaatgaagacatagcccagacctgccaatttactaaagaaaggaggccagataaccatgtcagccacagttgtagatgcagttaatgctgcacccctatcggggtccaaagaaatgagtttggaagaaccaaagaagatgaccagagaggactggagaaagaagaaggagctagaagaacagcgaaaattgggcaatgctcctgcagaagttgatgaagaaggaaaagacatcaacccccatattcctcagtatatttcttcagtgccatggtatattgatccttcaaaaagacctactttaaaacaccagagaccacaaccagaaaaacaaaagcagttcagctcatctggagaatggtacaagaggggtgtaaaagagaattccataattactaagtaccgcaaaggagcatgtgaaaattgtggggccatgacacacaaaaagaaagactgctttgagagacctaggcgagttggagccaaatttacaggtactaatatagctccagatgaacatgtccagcctcaactgatgtttgactatgatgggaagagggatcggtggaatggctacaatccagaagaacacatgaaaattgttgaagagtatgccaaagttgatttggcaaaacgaacattgaaagcccagaaactccaagaggaattagcctcaggaaaattagtggaacaggctaattctccaaaacaccagtggggagaagaggaaccaaattctcagacggaaaaagatcataatagtgaagatgaggatgaagataaatatgcagatgatattgacatgcctggacagaattttgactccaagagacgaattactgtccggaatctcaggattcgagaagatattgcaaaatatttgaggaatttagatccaaattctgcctactatgatccaaaaactagagcaatgagagagaatccttatgccaatgcaggaaagaatccagatgaagtgagttatgctggagataactttgttaggtacacaggagataccatttcaatggctcagacacagttgtttgcatgggaagcctatgacaagggatctgaagtgcatctacaggcagatcctacaaagctagagctgttgtataagtccttcaaagtcaaaaaagaagatttcaaagaacagcagaaagaaagcatcctggaaaagtatggtggccaagaacatttggatgcccctccagctgaattgcttttagcccagactgaagactatgtggagtactcaagacatgggacagtcatcaaaggacaggagcgggctgttgcctgctctaagtatgaggaggatgtgaagatccacaatcacacacatatctggggatcgtactggaaagaaggccgatggggatacaaatgctgtcactcttttttcaagtattcctattgtactggagaagctgggaaggagattgttaactctgaggagtgtattataaatgagataactggggaagaatctgtgaaaaaacctcaaaccctcatggagctgcatcaagaaaaactgaaagaggaaaagaagaagaagaaaaagaaaaagaagaagcatcgaaagagcagttcagatagtgatgatgaagaaaagaagcatgaaaaattgaaaaaggcactgaacgcagaggaggcccgccttcttcatgtcaaggagaccatgcagattgatgagaggaagcggccttacaatagcatgtatgaaactcgagaacctactgaagaggaaatggaggcatatagaatgaaacgtcagaggccagatgaccccatggcctctttccttggacagtagcaactagtcagaagaccatccaagatagatgcagctgatacattcttttcagcttcttattgatgattgtagatagaaaaatccttgtttattcttcttgctgcctggctttaataaatatttcagatgcctcacagtaagttcactcctttccatactgaggaaacaagaaaagaagaagaggcacatgaagtgtgcttttgggaatagaatttaaaattggattaagattttatttccagttttttttatttatttatttttttttttggagacggagtcttgctctgtcgcccaggctgaagtgcggtggcgcgatctcggctcactgcaagctccacctcccaggttcacgccattctcctgcctcagcctccctagtagttgggactacaggcgcccgccaccatgctcagctaattttttgtatttttagtagagacggtttcatcgtgttagccaggatggtctcgatctcctgaccttgtgatccacccgcctcagcctcccaaagtgctgagattacaggcgtgagccacccgcgcctggcctatttccagttttatgtgagtcatgtaaaaaagccttggctctctacctattaagaatgtctctttctctatatttattaagcttcaaactttattgcttcgatttttgtggccctatatttagtattagcacaccttggttttgagaaaaaaacagggctttgtttttttaaataattactagcaactctgtgactacatttatttttattttttttagagacaggatcttgctatgttgcccaggctagagagcagtggcttttcacagacaaagtcataatgccctgcagtcttgggctcaagcgattctctcttccttggcctctggagtagactaaatgtgttagtctttgaatggaaaacaactattttctcatcattgggtcaatattgactgatcagtagtaggtcttttaccattctggacataagtctaggtgtagaaatcctttcctttatcatagaggatatggtttacattaccgtttgttttcattgtgattgcccctatgtaacaatcatgaatattagattttttaaattgtagaatatcctaatatttatagccagcagctgttactttgtttgtaaaatttgcaaaaaaacaaaacctgaagttggtttattgaaagaattataaggatagcttctagggatattagtaatagattgccatgatcctgaagcctcttctcagaacactgtgaagataatactgacagagtagaatcagtgaaaacagcctaacaaaacctctgacatcagtatatcaacttttaacagcccactcactggcttttctaaactaccaaaaaccacctgtaggatactgcattaagtcagcatctcagaaacagtggtgtgagtaactgagtcaaattgtcaagtactttggatatacatagtgtcgagctttagattggtatgaaattaaacagcaatgcaaatagatttaattcctatttactttaagaatgaaaaacaatgttcattttcctacctaaacagggtggttcaacataaaggctgatgttgtgtccgttttgtattttatcttttgttaaagatacataaatgacaatacttaa

SEQ ID NO: 446499 - DNA, 3475 bp, Homo sapiens
caggctgtaccggccgagtctaaggatggacttggggctagctgcggcggggctggaggaggccagataaccatgtcagccacagttgtagatgcagttaatgctgcacccctatcggggtccaaagaaatgagtttggaagaaccaaagaagatgaccagagaggactggagaaagaagaaggagctagaagaacagcgaaaattgggcaatgctcctgcagaagttgatgaagaaggaaaagacatcaacccccatattcctcagtatatttcttcagtgccatggtatattgatccttcaaaaagacctactttaaaacaccagagaccacaaccagaaaaacaaaagcagttcagctcatctggagaatggtacaagaggggtgtaaaagagaattccataattactaagtaccgcaaaggagcatgtgaaaattgtggggccatgacacacaaaaagaaagactgctttgagagacctaggcgagttggagccaaatttacaggtactaatatagctccagatgaacatgtccagcctcaactgatgtttgactatgatgggaagagggatcggtggaatggctacaatccagaagaacacatgaaaattgttgaagagtatgccaaagttgatttggcaaaacgaacattgaaagcccagaaactccaagaggaattagcctcaggaaaattagtggaacaggctaattctccaaaacaccagtggggagaagaggaaccaaattctcagacggaaaaagatcataatagtgaagatgaggatgaagataaatatgcagatgatattgacatgcctggacagaattttgactccaagagacgaattactgtccggaatctcaggattcgagaagatattgcaaaatatttgaggaatttagatccaaattctgcctactatgatccaaaaactagagcaatgagagagaatccttatgccaatgcaggaaagaatccagatgaagtgagttatgctggagataactttgttaggtacacaggagataccatttcaatggctcagacacagttgtttgcatgggaagcctatgacaagggatctgaagtgcatctacaggcagatcctacaaagctagagctgttgtataagtccttcaaagtcaaaaaagaagatttcaaagaacagcagaaagaaagcatcctggaaaagtatggtggccaagaacatttggatgcccctccagctgaattgcttttagcccagactgaagactatgtggagtactcaagacatgggacagtcatcaaaggacaggagcgggctgttgcctgctctaagtatgaggaggatgtgaagatccacaatcacacacatatctggggatcgtactggaaagaaggccgatggggatacaaatgctgtcactcttttttcaagtattcctattgtactggagaagctgggaaggagattgttaactctgaggagtgtattataaatgagataactggggaagaatctgtgaaaaaacctcaaaccctcatggagctgcatcaagaaaaactgaaagaggaaaagaagaagaagaaaaagaaaaagaagaagcatcgaaagagcagttcagatagtgatgatgaagaaaagaagcatgaaaaattgaaaaaggcactgaacgcagaggaggcccgccttcttcatgtcaaggagaccatgcagattgatgagaggaagcggccttacaatagcatgtatgaaactcgagaacctactgaagaggaaatggaggcatatagaatgaaacgtcagaggccagatgaccccatggcctctttccttggacagtagcaactagtcagaagaccatccaagatagatgcagctgatacattcttttcagcttcttattgatgattgtagatagaaaaatccttgtttattcttcttgctgcctggctttaataaatatttcagatgcctcacagtaagttcactcctttccatactgaggaaacaagaaaagaagaagaggcacatgaagtgtgcttttgggaatagaatttaaaattggattaagattttatttccagttttttttatttatttatttttttttttggagacggagtcttgctctgtcgcccaggctgaagtgcggtggcgcgatctcggctcactgcaagctccacctcccaggttcacgccattctcctgcctcagcctccctagtagttgggactacaggcgcccgccaccatgctcagctaattttttgtatttttagtagagacggtttcatcgtgttagccaggatggtctcgatctcctgaccttgtgatccacccgcctcagcctcccaaagtgctgagattacaggcgtgagccacccgcgcctggcctatttccagttttatgtgagtcatgtaaaaaagccttggctctctacctattaagaatgtctctttctctatatttattaagcttcaaactttattgcttcgatttttgtggccctatatttagtattagcacaccttggttttgagaaaaaaacagggctttgtttttttaaataattactagcaactctgtgactacatttatttttattttttttagagacaggatcttgctatgttgcccaggctagagagcagtggcttttcacagacaaagtcataatgccctgcagtcttgggctcaagcgattctctcttccttggcctctggagtagactaaatgtgttagtctttgaatggaaaacaactattttctcatcattgggtcaatattgactgatcagtagtaggtcttttaccattctggacataagtctaggtgtagaaatcctttcctttatcatagaggatatggtttacattaccgtttgttttcattgtgattgcccctatgtaacaatcatgaatattagattttttaaattgtagaatatcctaatatttatagccagcagctgttactttgtttgtaaaatttgcaaaaaaacaaaacctgaagttggtttattgaaagaattataaggatagcttctagggatattagtaatagattgccatgatcctgaagcctcttctcagaacactgtgaagataatactgacagagtagaatcagtgaaaacagcctaacaaaacctctgacatcagtatatcaacttttaacagcccactcactggcttttctaaactaccaaaaaccacctgtaggatactgcattaagtcagcatctcagaaacagtggtgtgagtaactgagtcaaattgtcaagtactttggatatacatagtgtcgagctttagattggtatgaaattaaacagcaatgcaaatagatttaattcctatttactttaagaatgaaaaacaatgttcattttcctacctaaacagggtggttcaacataaaggctgatgttgtgtccgttttgtattttatcttttgttaaagatacataaatgacaatacttaa

SEQ ID NO: 446500 - DNA, 2242 bp, Homo sapiens
taacttcctaaaattctccgattctaaaagaaagctcctaaatagaagccaaaaagtagccgcccaacttgaaactccccacaagccgggtaaatagcgcgatacgcagcagctagagttctcgcgtttcccacggcgcaggagcactggagggcccccctccgcccccggccccgccaggaaattagtgcgcatgtgccggtcatccggaagttaccgcagtggccgccggaattaggcgaaaagccggaagtaaacattacgagattggcttggattctgtcggatggacttggggctagctgcggcggggctggaggaggccagataaccatgtcagccacagttgtagatgcagttaatgctgcacccctatcggggtccaaagaaatgagtttggaagaaccaaagaagatgaccagagaggactggagaaagaagaaggagctagaagaacagcgaaaattgggcaatgctcctgcagaagttgatgaagaaggaaaagacatcaacccccatattcctcagtatatttcttcagtgccatggtatattgatccttcaaaaagacctactttaaaacaccagagaccacaaccagaaaaacaaaagcagttcagctcatctggagaatggtacaagaggggtgtaaaagagaattccataattactaagtaccgcaaaggagcatgtgaaaattgtggggccatgacacacaaaaagaaagactgctttgagagacctaggcgagttggagccaaatttacaggtactaatatagctccagatgaacatgtccagcctcaactgatgtttgactatgatgggaagagggatcggtggaatggctacaatccagaagaacacatgaaaattgttgaagagtatgccaaagttgatttggcaaaacgaacattgaaagcccagaaactccaagaggaattagcctcaggaaaattagtggaacaggctaattctccaaaacaccagtggggagaagaggaaccaaattctcagacggaaaaagatcataatagtgaagatgaggatgaagataaatatgcagatgatattgacatgcctggacagaattttgactccaagagacgaattactgtccggaatctcaggattcgagaagatattgcaaaatatttgaggaatttagatccaaattctgcctactatgatccaaaaactagagcaatgagagagaatccttatgccaatgcaggaaagaatccagatgaagtgagttatgctggagataactttgttaggtacacaggagataccatttcaatggctcagacacagttgtttgcatgggaagcctatgacaagggatctgaagtgcatctacaggcagatcctacaaagctagagctgttgtataagtccttcaaagtcaaaaaagaagatttcaaagaacagcagaaagaaagcatcctggaaaagtatggtggccaagaacatttggatgcccctccagctgaattgcttttagcccagactgaagactatgtggagtactcaagacatgggacagtcatcaaaggacaggagcgggctgttgcctgctctaagtatgaggaggatgtgaagatccacaatcacacacatatctggggatcgtactggaaagaaggccgatggggatacaaatgctgtcactcttttttcaagtattcctattgtactggagaagctgggaaggagattgttaactctgaggagtgtattataaatgagataactggggaagaatctgtgaaaaaacctcaaaccctcatggagctgcatcaagaaaaactgaaagaggaaaagaagaagaagaaaaagaaaaaggccaaggctctgagcacctggcgtcagaagatccgaaaatacaaccgtgatttcgagtcccatatcacaagctacaagcagaaccccgagcagtcggcggatgaagatgctgagaaaaatgaggaggattcagaaggctcttcagatgaggatgaggatgaggacggagtcagtgcggcaactttcttgaagaagaaatcagaagctccttctggggagagtcgcaagttcctcaaaaagatggctgatgacgatgaggactcagaagattccgaagatgatgaagactgcgacacgggtccacatcttcgattcgactcaaggaggagagggaacaacggctggctaagattttaaaggcccacaagtgatgctgtgggcgagcaatgatgaa

SEQ ID NO: 446501 - DNA, 2171 bp, Homo sapiens
tgtagacccccgccttcatcatacctacccgccttcatcatacctacctcacacacatatctggggatcgtactggaaagaaggccgatggggatacaaatgctgtcactcttttttcaagtattcctattgtactggagaagctgggaaggagattgttaactctgaggagtgtattataaatgagataactggggaagaatctgtgaaaaaacctcaaaccctcatggagctgcatcaagaaaaactgaaagaggaaaagaagaagaagaaaaagaaaaagaagaagcatcgaaagagcagttcagatagtgatgatgaagaaaagaagcatgaaaaattgaaaaaggcactgaacgcagaggaggcccgccttcttcatgtcaaggagaccatgcagattgatgagaggaagcggccttacaatagcatgtatgaaactcgagaacctactgaagaggaaatggaggcatatagaatgaaacgtcagaggccagatgaccccatggcctctttccttggacagtagcaactagtcagaagaccatccaagatagatgcagctgatacattcttttcagcttcttattgatgattgtagatagaaaaatccttgtttattcttcttgctgcctggctttaataaatatttcagatgcctcacagtaagttcactcctttccatactgaggaaacaagaaaagaagaagaggcacatgaagtgtgcttttgggaatagaatttaaaattggattaagattttatttccagttttttttatttatttatttttttttttggagacggagtcttgctctgtcgcccaggctgaagtgcggtggcgcgatctcggctcactgcaagctccacctcccaggttcacgccattctcctgcctcagcctccctagtagttgggactacaggcgcccgccaccatgctcagctaattttttgtatttttagtagagacggtttcatcgtgttagccaggatggtctcgatctcctgaccttgtgatccacccgcctcagcctcccaaagtgctgagattacaggcgtgagccacccgcgcctggcctatttccagttttatgtgagtcatgtaaaaaagccttggctctctacctattaagaatgtctctttctctatatttattaagcttcaaactttattgcttcgatttttgtggccctatatttagtattagcacaccttggttttgagaaaaaaacagggctttgtttttttaaataattactagcaactctgtgactacatttatttttattttttttagagacaggatcttgctatgttgcccaggctagagagcagtggcttttcacagacaaagtcataatgccctgcagtcttgggctcaagcgattctctcttccttggcctctggagtagactaaatgtgttagtctttgaatggaaaacaactattttctcatcattgggtcaatattgactgatcagtagtaggtcttttaccattctggacataagtctaggtgtagaaatcctttcctttatcatagaggatatggtttacattaccgtttgttttcattgtgattgcccctatgtaacaatcatgaatattagattttttaaattgtagaatatcctaatatttatagccagcagctgttactttgtttgtaaaatttgcaaaaaaacaaaacctgaagttggtttattgaaagaattataaggatagcttctagggatattagtaatagattgccatgatcctgaagcctcttctcagaacactgtgaagataatactgacagagtagaatcagtgaaaacagcctaacaaaacctctgacatcagtatatcaacttttaacagcccactcactggcttttctaaactaccaaaaaccacctgtaggatactgcattaagtcagcatctcagaaacagtggtgtgagtaactgagtcaaattgtcaagtactttggatatacatagtgtcgagctttagattggtatgaaattaaacagcaatgcaaatagatttaattcctatttactttaagaatgaaaaacaatgttcattttcctacctaaacagggtggttcaacataaaggctgatgttgtgtccgttttgtattttatcttttgttaaagatacataaatgacaatacttaa

SEQ ID NO: 446502 - DNA, 1734 bp, Homo sapiens
taacttcctaaaattctccgattctaaaagaaagctcctaaatagaagccaaaaagtagccgcccaacttgaaactccccacaagccgggtaaatagcgcgatacgcagcagctagagttctcgcgtttcccacggcgcaggagcactggagggcccccctccgcccccggccccgccaggaaattagtgcgcatgtgccggtcatccggaagttaccgcagtggccgccggaattaggcgaaaagccggaagtaaacattacgagattggcttggattctgtcggatggacttggggctagctgcggcggggctggaggaggccagataaccatgtcagccacagttgtagatgcagttaatgctgcacccctatcggggtccaaagaaatgagtttggaagaaccaaagaagatgaccagagaggactggagaaagaagaaggagctagaagaacagcgaaaattgggcaatgctcctgcagaagttgatgaagaaggaaaagacatcaacccccatattcctcagtatatttcttcagtgccatggtatattgatccttcaaaaagacctactttaaaacaccagagaccacaaccagaaaaacaaaagcagttcagctcatctggagaatggtacaagaggggtgtaaaagagaattccataattactaagtaccgcaaaggagcatgtgaaaattgtggggccatgacacacaaaaagaaagactgctttgagagacctaggcgagttggagccaaatttacaggtactaatatagctccagatgaacatgtccagcctcaactgatgtttgactatgatgggaagagggatcggtggaatggctacaatccagaagaacacatgaaaattgttgaagagtatgccaaagttgatttggcaaaacgaacattgaaagcccagaaactccaagaggaattagcctcaggaaaattagtggaacaggctaattctccaaaacaccagtggggagaagaggaaccaaattctcagacggaaaaagatcataatagtgaagatgaggatgaagataaatatgcagatgatattgacatgcctggacagaattttgactccaagagacgaattactgtccggaatctcaggattcgagaagatattgcaaaatatttgaggaatttagatccaaattctgcctactatgatccaaaaactagagcaatgagagagaatccttatgccaatgcaggaaagaatccagatgaagtgagttatgctggagataactttgttaggtacacaggagataccatttcaatggctcagacacagttgtttgcatgggaagcctatgacaagggatctgaagtgcatctacaggcagatcctacaaagctagagctgttgtataagtccttcaaagtcaaaaaagaagatttcaaagaacagcagaaagaaagcatcctggaaaagtatggtggccaagaacatttggatgcccctccagctgaattgcttttagcccagactgaagactatgtggagtactcaagacatgggacagtcatcaaaggacaggagcgggctgttgcctgctctaagtatgaggaggatgtgaagatccacaatcacacagtatgtgctaaactggaacaattttgtgtccttgttggttttgctctgtattgcatttttccactacaactttattagctaaccatttgtattctctatgctttaaaaaaaaaa

SEQ ID NO: 446503 - DNA, 888 bp, Homo sapiens
  misc_feature (2)..(2): n is a, c, g, or t
anttcggcacagttcctccgctcgctgcctctcctccgcttccttctctctgcgtagtgggactcttctttggcagcgcatccgtcatgtacatggcccctaagtcccgccatcctgaggagcagcagaaggtcctttttctattttacagttctttcaacccgatgctaaaccccctgatttacaacctgaggaatgtagaggtcaagggtgccctgaggagagcactgtgcaaggaaagtcattcctaagaggtgtgacatttgaactgccagcctcagttgtcacgtggactcttgatgcccaattattgcctcaatccagaaaagtttacttctctttatctgtgctttactgacagaagggcaagtcttctctcgttttttgcagataaaattttagatgtgttgcattcattgggtttctatgagatgtggttttatcagacaattttttcttttatttcacaattactttaatatctgtaaaataaagaattattttaattcattttcccagtcccaaaagttaaatacaggccacttacttctttaaccaaatgatatagtttggctctgtgtccccacccaaatctcatgtcaaattgtaatccccgcatgtcaggggagggacctggtgggaggtgattggatcatggggagggatttcccccttgctgttctgttgatagtgaacgagttctcacgaaatctgatggtttaaaagtgcagcacttctccctttgctctctctctcctgctgtgccatggtaagacgtgccttgcttcccctgtggcttccgccatgattgtacctttcctgaggcctctccagccatgtggaactgtgagccaattaaacttcttttctttagaaattatccagtcc

SEQ ID NO: 446504 - DNA, 751 bp, Homo sapiens
gtttccttgacccagagtctggtcctcacattttagattcagctttgggaattttgttcaggaactgcatcatacaacccaaaagcaaaagaggaaaatgcataagccaggatacctaaatgttcctttatttaaacttgaaaatgtgactgcaaaaggagtcaagaagtttagtactcaacacatttcttctttgtagaaataactgctcaagaagataaattgttacctaacagttgattgatgaatatgaaatcagagcaagaggggctaattagagattttactagctagggctatttacccaaaccatctatccagactgtagacatagaatcaccagatggctaggatcctggtgcagctggttcccctttttccttaccctgaatgtcattaaggatgcattgccaaatgctgcccctctggcctgatgactacactccatattggtcacctgccttctttttcctacagtcttcctccagacaggcacgccatacaaccgactacacttgggctcactgaatgaatcacattcttctgctgtgcctcccagagatttcatcaaagcacccgcagtggccttctggaggctcctcaaactctccactcaatgtttcctgaaagtgtcgtgtttctcacctctagattgttattctcatcagttacatgtgggtttcacaaatttatttctcagaatgcaagtctgtctcttatatcctcgggaaacacacctttatatcccagt

SEQ ID NO: 446505 - DNA, 679 bp, Homo sapiens
gataatttctaaagaaaagaagtttaattggctcacagttccacatggctggagaggcctcaggaaaggtacaatcatggcggaagccacaggggaagcaaggcacgtcttaccatggcacagcaggagagagagagcaaagggagaagtgctgcacttttaaaccatcagatttcgtgagaactcgttcactatcaacagaacagcaagggggaaatccctccccatgatccaatcacctcccaccaggtccctccgctgacatgcggggattacaatttgacatgagatttgggtggggacacagagccaaactatatcatttggttaaagaagtaagtggcctgtatttaacttttgggactgggaaaatgaattaaaataattctttattttacagatattaaagtaattgtgaaataaaagaaaaaattgtctgataaaaccacatctcatagaaacccaatgaatgcaacacatctaaaattttatctgcaaaaaacgagagaagacttgcccttctgtcagtaaagcacagataaagagaagtaaacttttctggattgaggcaataattgggcatcaagagtccacgtgacaactgaggctggcagttcaaatgtcacacctcttaggaatgactttccttgcacagtgctctcctcagggcacccttgac

SEQ ID NO: 446506 - DNA, 403 bp, Homo sapiens
tgtagtttgcaggtcattcaacatttattcaaccaaaaatactaagtcagctctatacaaactaatggaaggatacagctatgcaaatatagaacactaaagtgttacatgacagatgtatgagatattaaagtaattgtgaaataaaagaaaaaattgtctgataaaaccacatctcatagaaacccaatgaatgcaacacatctaaaattttatctgcaaaaaacgagagaagacttgcccttctgtcagtaaagcacagataaagagaagtaaacttttctggattgaggcaataattgggcatcaagagtccacgtgacaactgaggctggcagttcaaatgtcacacctcttaggaatgactttccttgcacagtgctctcctcagggcacccttgac

SEQ ID NO: 446507 - DNA, 434 bp, Homo sapiens
tgtagtttgcaggtcattcaacatttattcaaccaaaaatactaagtcagctctatacaaactaatggaaggatacagctatgcaaatatagaacactaaagtgttacatgacagatgtatgagaagtaccttttgcctcccactgtgattctgaggcctccccagccatgtgcaactaactgggaagaaaggaccctgaaaagttagctggttccaagtgaccctccaaggggaagagtgctggattcagagcccacctcaggggaagacaggaccctctccaagatggtttccctagaagctactacctctccctggagggtggagatatttgctggtcaaagcaagaaggccctctgcagatgctgacaccttgatattggacttcccagattccagaactctgagaaataaatttctattttaaataaat

SEQ ID NO: 446508 - DNA, 1754 bp, Homo sapiens
aacagcaagttttcaagtaaaactttacttatgtataactgaatgagttcttaaagacatttactaacaattttccacaaactaaaaatttataaaacaataaataaaatagactttaaaaaaaagcgtgtcacacagctgcttgttttttgtttgtttctttgtttgttttttagtagtgaaatggtgaaaaatcagacaatggtcacagagttcctcctactgggatttctcctgggcccaaggattcagatgctcctctttgggctcttctccctgttctatgtcttcaccctgctggggaatgggaccatcctggggctcatctcactggactccagactccacacccccatgtacttcttcctctcacacctggccgtcgtcaacatcgcctatgcctgcaacacagtgccccagatgctggtgaacctcctgcatccagccaagcccatctcctttgctggctgcatgacatagacctttctctttttgagttttgcacatactgaatgcctcctgttggtgctgatgtcctacgatcggtacgtggccatctgccaccctctccgatatttcatcatcatgacctggaaagtctgcatcactctggccatcacttcctggacatgtggctccctcctggctatggtccatgtgagcctcatcctaagactgcccttttgtgggcctcgtgaaatcaaccacttcttctgtgaaatcctgtctgtccctcaggctggcctgtgctgatacctggctcaaccaggtggtcatctttgcagcctgcatgttcatcctggtgggaccactctgcctggtgctggtctcctactcacacatcctggcggccatcctgaggatccagtctggggagggccgcagaaaggccttctccacctgctcctcccacctctgcgtagtgggactcttctttggcagcgcatccgtcatgtacatggcccctaagtcccgccatcctgaggagcagcagaaggtcctttttctattttacagttctttcaacccgatgctaaaccccctgatttacaacctgaggaatgtagaggtcaagggtgccctgaggagagcactgtgcaaggaaagtcattcctaagaggtgtgacatttgaactgccagcctcagttgtcacgtggactcttgatgcccaattattgcctcaatccagaaaagtttacttctctttatctgtgctttactgacagaagggcaagtcttctctcgttttttgcagataaaattttagatgtgttgcattcattgggtttctatgagatgtggttttatcagacaattttttcttttatttcacaattactttaatatctgtaaaataaagaattattttaattcattttcccagtcccaaaagttaaatacaggccacttacttctttaaccaaatgatatagtttggctctgtgtccccacccaaatctcatgtcaaattgtaatccccgcatgtcaggggagggacctggtgggaggtgattggatcatggggagggatttcccccttgctgttctgttgatagtgaacgagttctcacgaaatctgatggtttaaaagtgcagcacttctccctttgctctctctctcctgctgtgccatggtaagacgtgccttgcttcccctgtggcttccgccatgattgtacctttcctgaggcctctccagccatgtggaactgtgagccaattaaacttcttttctttagaaattatccagtcc

SEQ ID NO: 446509 - DNA, 2251 bp, Homo sapiens
gcggggtgacccggggaaggggcgcgcacagagacagagggagccagccgggccccacggtgtcctcggacgcctccgaaatctccctgcgtgtttgtttcttcggagcttcaccggagcctgactctggaaccggcctgtctgcctgctgcagtctgcacatcttcacaatgaaatcttcacaagctcagaaccatcaacttgctacactgtgttcctccagtgcccagttcacaggaagcactcaagagtaggatcaattgttatcaacctctagcagattattgaatagacggtcgttacatgaaactgacactcagttcttcatggtccacgatagttcttatatccagaaaacgtacttacgttatcaactctgactccataagacaactttgcaaagtcttggctcataactataaatcaaggctgaatcaaacaggactactgttctgaaagaatactcagactatgagtcttcctccagacaggcacgccatacaaccgactacacttgggctcactgaatgaatcacattcttctgctgtgcctcccagagatttcatcaaagcacccgcagtggccttctggaggctcctcaaactctccactcaatgtttcctgaaagtgtcgtgtttctcacctctagattgttattctcatcagttacattagtgaaatggtgaaaaatcagacaatggtcacagagttcctcctactgggatttctcctgggcccaaggattcagatgctcctctttgggctcttctccctgttctatgtcttcaccctgctggggaatgggaccatcctggggctcatctcactggactccagactccacacccccatgtacttcttcctctcacacctggccgtcgtcaacatcgcctatgcctgcaacacagtgccccagatgctggtgaacctcctgcatccagccaagcccatctcctttgctggctgcatgacatagacctttctctttttgagttttgcacatactgaatgcctcctgttggtgctgatgtcctacgatcggtacgtggccatctgccaccctctccgatatttcatcatcatgacctggaaagtctgcatcactctggccatcacttcctggacatgtggctccctcctggctatggtccatgtgagcctcatcctaagactgcccttttgtgggcctcgtgaaatcaaccacttcttctgtgaaatcctgtctgtccctcaggctggcctgtgctgatacctggctcaaccaggtggtcatctttgcagcctgcatgttcatcctggtgggaccactctgcctggtgctggtctcctactcacacatcctggcggccatcctgaggatccagtctggggagggccgcagaaaggccttctccacctgctcctcccacctctgcgtagtgggactcttctttggcagcgcatccgtcatgtacatggcccctaagtcccgccatcctgaggagcagcagaaggtcctttttctattttacagttctttcaacccgatgctaaaccccctgatttacaacctgaggaatgtagaggtcaagggtgccctgaggagagcactgtgcaaggaaagtcattcctaagaggtgtgacatttgaactgccagcctcagttgtcacgtggactcttgatgcccaattattgcctcaatccagaaaagtttacttctctttatctgtgctttactgacagaagggcaagtcttctctcgttttttgcagataaaattttagatgtgttgcattcattgggtttctatgagatgtggttttatcagacaattttttcttttatttcacaattactttaatatctgtaaaataaagaattattttaattcattttcccagtcccaaaagttaaatacaggccacttacttctttaaccaaatgatatagtttggctctgtgtccccacccaaatctcatgtcaaattgtaatccccgcatgtcaggggagggacctggtgggaggtgattggatcatggggagggatttcccccttgctgttctgttgatagtgaacgagttctcacgaaatctgatggtttaaaagtgcagcacttctccctttgctctctctctcctgctgtgccatggtaagacgtgccttgcttcccctgtggcttccgccatgattgtacctttcctgaggcctctccagccatgtggaactgtgagccaattaaacttcttttctttagaaattatccagtcc

SEQ ID NO: 446510 - DNA, 2332 bp, Homo sapiens
gattgtccacactgttcctgcttcctgacaggttcacttgaaccatctggagatggggaacaagggcaatgagttgaacatgtaggaagtttcatggcccagcccctcctgagagccctgaactgccaaccagactgagcccatcagagaataacacctcattttctgaggattctgataccttttcaatcagaaacagaagcaaagattctgcagctcccacagaaactcccagaaaccttgcggtgcttcacccttctgagatccttgagtccgaatgtgggagctaaccaggcacatcttcacaatgaaatcttcacaagctcagaaccatcaacttgctacactgtgttcctccagtgcccagttcacaggaagcactcaagagtaggatcaattgttatcaacctctagcagattattgaatagacggtcgttacatgaaactgacactcagttcttcatggtccacgatagttcttatatccagaaaacgtacttacgttatcaactctgactccataagacaactttgcaaagtcttggctcataactattcttcctccagacaggcacgccatacaaccgactacacttgggctcactgaatgaatcacattcttctgctgtgcctcccagagatttcatcaaagcacccgcagtggccttctggaggctcctcaaactctccactcaatgtttcctgaaagtgtcgtgtttctcacctctagattgttattctcatcagttacattagtgaaatggtgaaaaatcagacaatggtcacagagttcctcctactgggatttctcctgggcccaaggattcagatgctcctctttgggctcttctccctgttctatgtcttcaccctgctggggaatgggaccatcctggggctcatctcactggactccagactccacacccccatgtacttcttcctctcacacctggccgtcgtcaacatcgcctatgcctgcaacacagtgccccagatgctggtgaacctcctgcatccagccaagcccatctcctttgctggctgcatgacatagacctttctctttttgagttttgcacatactgaatgcctcctgttggtgctgatgtcctacgatcggtacgtggccatctgccaccctctccgatatttcatcatcatgacctggaaagtctgcatcactctggccatcacttcctggacatgtggctccctcctggctatggtccatgtgagcctcatcctaagactgcccttttgtgggcctcgtgaaatcaaccacttcttctgtgaaatcctgtctgtccctcaggctggcctgtgctgatacctggctcaaccaggtggtcatctttgcagcctgcatgttcatcctggtgggaccactctgcctggtgctggtctcctactcacacatcctggcggccatcctgaggatccagtctggggagggccgcagaaaggccttctccacctgctcctcccacctctgcgtagtgggactcttctttggcagcgcatccgtcatgtacatggcccctaagtcccgccatcctgaggagcagcagaaggtcctttttctattttacagttctttcaacccgatgctaaaccccctgatttacaacctgaggaatgtagaggtcaagggtgccctgaggagagcactgtgcaaggaaagtcattcctaagaggtgtgacatttgaactgccagcctcagttgtcacgtggactcttgatgcccaattattgcctcaatccagaaaagtttacttctctttatctgtgctttactgacagaagggcaagtcttctctcgttttttgcagataaaattttagatgtgttgcattcattgggtttctatgagatgtggttttatcagacaattttttcttttatttcacaattactttaatatctgtaaaataaagaattattttaattcattttcccagtcccaaaagttaaatacaggccacttacttctttaaccaaatgatatagtttggctctgtgtccccacccaaatctcatgtcaaattgtaatccccgcatgtcaggggagggacctggtgggaggtgattggatcatggggagggatttcccccttgctgttctgttgatagtgaacgagttctcacgaaatctgatggtttaaaagtgcagcacttctccctttgctctctctctcctgctgtgccatggtaagacgtgccttgcttcccctgtggcttccgccatgattgtacctttcctgaggcctctccagccatgtggaactgtgagccaattaaacttcttttctttagaaattatccagtcc

SEQ ID NO: 446511 - DNA, 229 bp, Homo sapiens
gtcccggaatgcttggatttcatgaatcccagcactgcccttgttccccaagcttcagatggttcaagtgaacctgtcaggaagcagaaccagtgtgacaatgaataagctcctggcaggaacctctgtagctcagcctctccctgatgtaatctgggttacttgtgttgcagcagaactgggaagaaaggaccctgaaaagttagctggttccaagtgaccctccaag

SEQ ID NO: 446512 - DNA, 2252 bp, Homo sapiens
gtttccttgacccagagtctggtcctcacattttagattcagctttgggaattttgttcaggaactgcatcatacaacccaaaagcaaaagaggaaaatgcataagccaggatacctaaatgttcctttatttaaacttgaaaatgtgactgcaaaaggagtcaagaagtttagtactcaacacatttcttctttgtagaaataactgctcaagaagataaattgttacctaacagttgattgatgaatatgaaatcagagcaagaggggctaattagagattttactagctagggctatttacccaaaccatctatccagactgtagacatagaatcaccagatggctaggatcctggtgcagctggttcccctttttccttaccctgaatgtcattaaggatgcattgccaaatgctgcccctctggcctgatgactacactccatattggtcacctgccttctttttcctacagtcttcctccagacaggcacgccatacaaccgactacacttgggctcactgaatgaatcacattcttctgctgtgcctcccagagatttcatcaaagcacccgcagtggccttctggaggctcctcaaactctccactcaatgtttcctgaaagtgtcgtgtttctcacctctagattgttattctcatcagttacattagtgaaatggtgaaaaatcagacaatggtcacagagttcctcctactgggatttctcctgggcccaaggattcagatgctcctctttgggctcttctccctgttctatgtcttcaccctgctggggaatgggaccatcctggggctcatctcactggactccagactccacacccccatgtacttcttcctctcacacctggccgtcgtcaacatcgcctatgcctgcaacacagtgccccagatgctggtgaacctcctgcatccagccaagcccatctcctttgctggctgcatgacatagacctttctctttttgagttttgcacatactgaatgcctcctgttggtgctgatgtcctacgatcggtacgtggccatctgccaccctctccgatatttcatcatcatgacctggaaagtctgcatcactctggccatcacttcctggacatgtggctccctcctggctatggtccatgtgagcctcatcctaagactgcccttttgtgggcctcgtgaaatcaaccacttcttctgtgaaatcctgtctgtccctcaggctggcctgtgctgatacctggctcaaccaggtggtcatctttgcagcctgcatgttcatcctggtgggaccactctgcctggtgctggtctcctactcacacatcctggcggccatcctgaggatccagtctggggagggccgcagaaaggccttctccacctgctcctcccacctctgcgtagtgggactcttctttggcagcgcatccgtcatgtacatggcccctaagtcccgccatcctgaggagcagcagaaggtcctttttctattttacagttctttcaacccgatgctaaaccccctgatttacaacctgaggaatgtagaggtcaagggtgccctgaggagagcactgtgcaaggaaagtcattcctaagaggtgtgacatttgaactgccagcctcagttgtcacgtggactcttgatgcccaattattgcctcaatccagaaaagtttacttctctttatctgtgctttactgacagaagggcaagtcttctctcgttttttgcagataaaattttagatgtgttgcattcattgggtttctatgagatgtggttttatcagacaattttttcttttatttcacaattactttaatatctgtaaaataaagaattattttaattcattttcccagtcccaaaagttaaatacaggccacttacttctttaaccaaatgatatagtttggctctgtgtccccacccaaatctcatgtcaaattgtaatccccgcatgtcaggggagggacctggtgggaggtgattggatcatggggagggatttcccccttgctgttctgttgatagtgaacgagttctcacgaaatctgatggtttaaaagtgcagcacttctccctttgctctctctctcctgctgtgccatggtaagacgtgccttgcttcccctgtggcttccgccatgattgtacctttcctgaggcctctccagccatgtggaactgtgagccaattaaacttcttttctttagaaattatccagtcc

SEQ ID NO: 446513 - DNA, 1998 bp, Homo sapiens
gcggggtgacccggggaaggggcgcgcacagagacagagggagccagccgggccccacggtgtcctcggacgcctccgaaatctccctgcgtgtttgtttcttcggagcttcaccggagcctgactctggaaccggcctgtctgcctgctgcagtctgcacatcttcacaatgaaatcttcacaagctcagaaccatcaacttgctacactgtgttcctccagtgcccagttcacaggaagcactcaagagtaggatcaattgttatcaacctctagcagattattgaatagacggtcgttacatgaaactgacactcagttcttcatggtccacgatagttcttatatccagaaaacgtacttacgttatcaactctgactccataagacaactttgcaaagtcttggctcataactattagtgaaatggtgaaaaatcagacaatggtcacagagttcctcctactgggatttctcctgggcccaaggattcagatgctcctctttgggctcttctccctgttctatgtcttcaccctgctggggaatgggaccatcctggggctcatctcactggactccagactccacacccccatgtacttcttcctctcacacctggccgtcgtcaacatcgcctatgcctgcaacacagtgccccagatgctggtgaacctcctgcatccagccaagcccatctcctttgctggctgcatgacatagacctttctctttttgagttttgcacatactgaatgcctcctgttggtgctgatgtcctacgatcggtacgtggccatctgccaccctctccgatatttcatcatcatgacctggaaagtctgcatcactctggccatcacttcctggacatgtggctccctcctggctatggtccatgtgagcctcatcctaagactgcccttttgtgggcctcgtgaaatcaaccacttcttctgtgaaatcctgtctgtccctcaggctggcctgtgctgatacctggctcaaccaggtggtcatctttgcagcctgcatgttcatcctggtgggaccactctgcctggtgctggtctcctactcacacatcctggcggccatcctgaggatccagtctggggagggccgcagaaaggccttctccacctgctcctcccacctctgcgtagtgggactcttctttggcagcgcatccgtcatgtacatggcccctaagtcccgccatcctgaggagcagcagaaggtcctttttctattttacagttctttcaacccgatgctaaaccccctgatttacaacctgaggaatgtagaggtcaagggtgccctgaggagagcactgtgcaaggaaagtcattcctaagaggtgtgacatttgaactgccagcctcagttgtcacgtggactcttgatgcccaattattgcctcaatccagaaaagtttacttctctttatctgtgctttactgacagaagggcaagtcttctctcgttttttgcagataaaattttagatgtgttgcattcattgggtttctatgagatgtggttttatcagacaattttttcttttatttcacaattactttaatatctgtaaaataaagaattattttaattcattttcccagtcccaaaagttaaatacaggccacttacttctttaaccaaatgatatagtttggctctgtgtccccacccaaatctcatgtcaaattgtaatccccgcatgtcaggggagggacctggtgggaggtgattggatcatggggagggatttcccccttgctgttctgttgatagtgaacgagttctcacgaaatctgatggtttaaaagtgcagcacttctccctttgctctctctctcctgctgtgccatggtaagacgtgccttgcttcccctgtggcttccgccatgattgtacctttcctgaggcctctccagccatgtggaactgtgagccaattaaacttcttttctttagaaattatccagtcc

SEQ ID NO: 446514 - DNA, 1702 bp, Homo sapiens
tgtagtttgcaggtcattcaacatttattcaaccaaaaatactaagtcagctctatacaaactaatggaaggatacagctatgcaaatatagaacactaaagtgttacatgacagatgtatgagtagtgaaatggtgaaaaatcagacaatggtcacagagttcctcctactgggatttctcctgggcccaaggattcagatgctcctctttgggctcttctccctgttctatgtcttcaccctgctggggaatgggaccatcctggggctcatctcactggactccagactccacacccccatgtacttcttcctctcacacctggccgtcgtcaacatcgcctatgcctgcaacacagtgccccagatgctggtgaacctcctgcatccagccaagcccatctcctttgctggctgcatgacatagacctttctctttttgagttttgcacatactgaatgcctcctgttggtgctgatgtcctacgatcggtacgtggccatctgccaccctctccgatatttcatcatcatgacctggaaagtctgcatcactctggccatcacttcctggacatgtggctccctcctggctatggtccatgtgagcctcatcctaagactgcccttttgtgggcctcgtgaaatcaaccacttcttctgtgaaatcctgtctgtccctcaggctggcctgtgctgatacctggctcaaccaggtggtcatctttgcagcctgcatgttcatcctggtgggaccactctgcctggtgctggtctcctactcacacatcctggcggccatcctgaggatccagtctggggagggccgcagaaaggccttctccacctgctcctcccacctctgcgtagtgggactcttctttggcagcgcatccgtcatgtacatggcccctaagtcccgccatcctgaggagcagcagaaggtcctttttctattttacagttctttcaacccgatgctaaaccccctgatttacaacctgaggaatgtagaggtcaagggtgccctgaggagagcactgtgcaaggaaagtcattcctaagaggtgtgacatttgaactgccagcctcagttgtcacgtggactcttgatgcccaattattgcctcaatccagaaaagtttacttctctttatctgtgctttactgacagaagggcaagtcttctctcgttttttgcagataaaattttagatgtgttgcattcattgggtttctatgagatgtggttttatcagacaattttttcttttatttcacaattactttaatatctgtaaaataaagaattattttaattcattttcccagtcccaaaagttaaatacaggccacttacttctttaaccaaatgatatagtttggctctgtgtccccacccaaatctcatgtcaaattgtaatccccgcatgtcaggggagggacctggtgggaggtgattggatcatggggagggatttcccccttgctgttctgttgatagtgaacgagttctcacgaaatctgatggtttaaaagtgcagcacttctccctttgctctctctctcctgctgtgccatggtaagacgtgccttgcttcccctgtggcttccgccatgattgtacctttcctgaggcctctccagccatgtggaactgtgagccaattaaacttcttttctttagaaattatccagtcc

SEQ ID NO: 446515 - DNA, 1950 bp, Homo sapiens
gccccaaccatcctgaagctacaggtgctccctcctggaatctccaatggatttcagtcgcagaagcttccacagaagcctgagctcctccttgcaggcccctgtagtcagtacagtgggcatgcagcgcctcgggacgacacccagcgtttatgggggtgctggaggccggggcatccgcatctccaactccagacacacggtgaactatgggagcgatctcacaggcggcggggacctgtttgttggcaatgagaaaatggccatgcagaacctaaatgaccgtctagcgagctacctagaaaaggtgcggaccctggagcagtccaactccaaacttgaagtgcaaatcaagcagtggtacgaaaccaacgccccgagggctggtcgcgactacagtgcatattacagacaaattgaagagctgcgaagtcagattaaggatgctcaactgcaaaatgctcggtgtgtcctgcaaattgataatgctaaactggctgctgaggacttcagactgaagtatgagactgagagaggaatacgtctaacagtggaagctgatctccaaggcctgaataaggtctttgatgacctaaccctacataaaacagatttggagattcaaattgaagaactgaataaagacctagctctcctcaaaaaggagcatcaggaggaagtcgatggcctacacaagcatctgggcaacactgtcaatgtggaggttgatgctgctccaggcctgaaccttggcgtcatcatgaatgaaatgaggcagaagtatgaagtcatggcccagaagaaccttcaagaggccaaagaacagtttgagagacagactgcagttctgcagcaacaggtcacagtgaatactgaagaattaaaaggaactgaggttcaactaacggagctgagacgcacctcccagagccttgagatagaactccagtcccatctcagcatgaaagagtctttggagcacactctagaggagaccaaggcccgttacagcagccagttagccaacctccagtcgctgttgagctctctggaggcccaactgatgcagattcggagtaacatggaacgccagaacaacgaataccatatccttcttgacataaagactcgacttgaacaggaaattgctacttaccgccgccttctggaaggagaagacgtaaaaactacagaatatcagttaagcaccctggaagagagagatataaagaaaaccaggaagattaagacagtcgtgcaagaagtagtggatggcaaggtcgtgtcatctgaagtcaaagaggtggaagaaaatatctaaatagctaccagaaggagatgctgctgaggttttgaaagaaatttggctataatcttatctttgctccctgcaagaaatcagccataagaaagcactattaatactctgcagtgattagaaggggtggggtggcgggaatcctatttatcagactctgtaattgaatataaatgttttactcagaggagctgcaaattgcctgcaaaaatgaaatccagtgagcactagaatatttaaaacatcattactgccatctttatcatgaagcacatcaattacaagctgtagaccacctaatatcaatttgtaggtaatgttcctgaaaattgcaatacatttcaattatactaaacctcacaaagtagaggaatccatgtaaattgcaaataaaccactttctaattttttcctgtttctgaattgtaaaaccccctttgggagtccctggtttcttattgagccaatttctgggttaatcttattgatttttcagcatcagtacaactctacaacctttgagctatatctgctttttcccattgcttccactgccttttaaaactcaacacagctttttgaataatttgagagtcaaattcaatcacaaatgctgagcagaataagagtga

SEQ ID NO: 446516 - DNA, 753 bp, Homo sapiens
ggtaccaaagtgatcctccatcttaaagaagatcagcaagagtacctagaagacagtcgtgcaagaagtagtggatggcaaggtcgtgtcatctgaagtcaaagaggtggaagaaaatatctaaatagctaccagaaggagatgctgctgaggttttgaaagaaatttggctataatcttatctttgctccctgcaagaaatcagccataagaaagcactattaatactctgcagtgattagaaggggtggggtggcgggaatcctatttatcagactctgtaattgaatataaatgttttactcagaggagctgcaaattgcctgcaaaaatgaaatccagtgagcactagaatatttaaaacatcattactgccatctttatcatgaagcacatcaattacaagctgtagaccacctaatatcaatttgtaggtaatgttcctgaaaattgcaatacatttcaattatactaaacctcacaaagtagaggaatccatgtaaattgcaaataaaccactttctaattttttcctgtttctgaattgtaaaaccccctttgggagtccctggtttcttattgagccaatttctgggttaatcttattgatttttcagcatcagtacaactctacaacctttgagctatatctgctttttcccattgcttccactgccttttaaaactcaacacagctttttgaataatttgagagtcaaattcaatcacaaatgctgagcagaataagagtga

SEQ ID NO: 446517 - DNA, 745 bp, Homo sapiens
gccccaaccatcctgaagctacaggtgctccctcctggaatctccaatggatttcagtcgcagaagcttccacagaagcctgagctcctccttgcaggcccctgtagtcagtacagtgggcatgcagcgcctcgggacgacacccagcgtttatgggggtgctggaggccggggcatccgcatctccaactccagacacacggtgaactatgggagcgatctcacaggcggcggggacctgtttgttggcaatgagaaaatggccatgcagaacctaaatgaccgtctagcgagctacctagaaaaggtgcggaccctggagcagtccaactccaaacttgaagtgcaaatcaagcagtggtacgaaaccaacgccccgagggctggtcgcgactacagtgcatattacagacaaattgaagagctgcgaagtcagattaaggatgctcaactgcaaaatgctcggtgtgtcctgcaaattgataatgctaaactggctgctgaggacttcagactgaagtaggttccctaatacgtggcaaaagtttctgaaaaagaattcctttagtagtccttccagatactcagctttccatatcattgttgataaaggaagcacggttcaattcctcatccttggaaggatgagaaattggtgtatgcatcggggtagtccgagtaacgtcggggcattccggatagccgagaaagtgttgtgggaagaaagttagatttacgcctattc

SEQ ID NO: 446518 - DNA, 310 bp, Homo sapiens
tgagctctctggaggcccaactgatgcagattcggagtaacatggaacgccagaacaacgaataccatatccttcttgacataaagactcgacttgaacaggaaattgctacttaccgccgccttctggaaggagaagacgtaaagtaaggctcttagaatcaaggaataggtgtcaatatctgtatgcacttctattttaatgtccctgtcactcattacccagcaccaatgcaatccctaggacagaagcaattatactcacacatgcctcaccacgaacaacaaaacgaaaatataccaaaaaatac

SEQ ID NO: 446519 - DNA, 1726 bp, Homo sapiens
gccccaaccatcctgaagctacaggtgctccctcctggaatctccaatggatttcagtcgcagaagcttccacagaagcctgagctcctccttgcaggcccctgtagtcagtacagtgggcatgcagcgcctcgggacgacacccagcgtttatgggggtgctggaggccggggcatccgcatctccaactccagacacacggtgaactatgggagcgatctcacaggcggcggggacctgtttgttggcaatgagaaaatggccatgcagaacctaaatgaccgtctagcgagctacctagaaaaggtgcggaccctggagcagtccaactccaaacttgaagtgcaaatcaagcagtggtacgaaaccaacgccccgagggctggtcgcgactacagtgcatattacagacaaattgaagagctgcgaagtcagattaaggatgctcaactgcaaaatgctcggtgtgtcctgcaaattgataatgctaaactggctgctgaggacttcagactgaagtatgagactgagagaggaatacgtctaacagtggaagctgatctccaaggcctgaataaggtctttgatgacctaaccctacataaaacagatttggagattcaaattgaagaactgaataaagacctagctctcctcaaaaaggagcatcaggaggaagtcgatggcctacacaagcatctgggcaacactgtcaatgtggaggttgatgctgctccaggcctgaaccttggcgtcatcatgaatgaaatgaggcagaagtatgaagtcatggcccagaagaaccttcaagaggccaaagaacagtttgagagacagactgcagttctgcagcaacaggtcacagtgaatactgaagaattaaaaggaactgaggttcaactaacggagctgagacgcacctcccagagccttgagatagaactccagtcccatctcagcatgaaagagtctttggagcacactctagaggagaccaaggcccgttacagcagccagttagccaacctccagtcgctgttgagctctctggaggcccaactgatgcagattcggagtaacatggaacgccagaacaacgaataccatatccttcttgacataaagactcgacttgaacaggaaattgctacttaccgccgccttctggaaggagaagacgtaaaaactacagaatatcagttaagcaccctggaagagagagatataaagaaaaccaggaagattaagacagtcgtgcaagaagtagtggatggcaaggtcgtgtcatctgaagtcaaagaggtggaagaaaatatctaaatagctaccagaaggagatgctgctgaggttttgaaagaaatttggctataatcttatctttgctccctgcaagaaatcagccataagaaagcactattaatactctgcagtgattagaaggggtggggtggcgggaatcctatttatcagactctgtaattgaatataaatgttttactcagaggagctgcaaattgcctgcaaaaatgaaatccagtgagcactagaatatttaaaacatcattactgccatctttatcatgaagcacatcaattacaagctgtagaccacctaatatcaatttgtaggtaatgttcctgaaaattgcaatacatttcaattatactaaacctcacaaagtagaggaatccatgtaaattgcaaataaaccactttctaattt

SEQ ID NO: 446520 - DNA, 1489 bp, Homo sapiens
gccccaaccatcctgaagctacaggtgctccctcctggaatctccaatggatttcagtcgcagaagcttccacagaagcctgagctcctccttgcaggcccctgtagtcagtacagtgggcatgcagcgcctcgggacgacacccagcgtttatgggggtgctggaggccggggcatccgcatctccaactccagacacacggtgaactatgggagcgatctcacaggcggcggggacctgtttgttggcaatgagaaaatggccatgcagaacctaaatgaccgtctagcgagctacctagaaaaggtgcggaccctggagcagtccaactccaaacttgaagtgcaaatcaagcagtggtacgaaaccaacgccccgagggctggtcgcgactacagtgcatattacagacaaattgaagagctgcgaagtcagattaaggatgctcaactgcaaaatgctcggtgtgtcctgcaaattgataatgctaaactggctgctgaggacttcagactgaagtatgagactgagagaggaatacgtctaacagtggaagctgatctccaaggcctgaataaggtctttgatgacctaaccctacataaaacagatttggagattcaaattgaagaactgaataaagacctagctctcctcaaaaaggagcatcaggaggaagtcgatggcctacacaagcatctgggcaacactgtcaatgtggaggttgatgctgctccaggcctgaaccttggcgtcatcatgaatgaaatgaggcagaagtatgaagtcatggcccagaagaaccttcaagaggccaaagaacagtttgagagacagactgcagttctgcagcaacaggtcacagtgaatactgaagaattaaaaggaactgaggttcaactaacggagctgagacgcacctcccagagccttgagatagaactccagtcccatctcagcatgaaagagtctttggagcacactctagaggagaccaaggcccgttacagcagccagttagccaacctccagtcgctgttgagctctctggaggcccaactgatgcagattcggagtaacatggaacgccagaacaacgaataccatatccttcttgacataaagactcgacttgaacaggaaattgctacttaccgccgccttctggaaggagaagacgtaaaaactacagaatatcagttaagcaccctggaagagagagatataaagaaaaccaggaagattaagacagtcgtgcaagaagtagtggatggcaaggtcgtgtcatctgaagtcaaagaggtggaagaaaatatctaaatagctaccagaaggagatgctgctgaggttttgaaagaaatttggctataatcttatctttgctccctgcaagaaatcagccataagaaagcactattaatactctgcagagaggggcggagcagcagagaggggcggagcagcagagaggggcgagcaggggtacc

SEQ ID NO: 446521 - DNA, 260 bp, Homo sapiens
tttctctattgactactccaccttatcctcagttaccacctccaacttattcagggtttctcccattcctgttccttcacagctcatatcaggacatcctgtgagactcttccccctgactcccccattgtgttaagaacccagcaacccaggagcctagtacaatatagtgatgccatcccgtcgactctccatttaaattgtttctctttctgcataataaacatttgttaataaaaaccaaattctaatttggaatg

SEQ ID NO: 446522 - DNA, 1353 bp, Homo sapiens
tgcacgagggcagttgaggaagggaagtagatataatggagcttagtggcagagcagctggaatcctgagagaagagaataactttagttcagagcaggtggggaaatgagagattgagtaggaggaccaaggttgagggaagcagatcttcttagttgctgtcagcggctgatggggaagattgttggtagaaggaagtcagaatataggtacagagggataagtttgctaagaacagagatcagcaaacagcttttctgagagaaagaaacatctgcaaatgacatgctgtttctgcagtttctgctgctagctcttcttctcccaggtggtgacaatgcagacgcatcccaggaacacgtctccttccatgtcatccagatcttctcatttgtcaaccaatcctgggcacgaggtcagggctcaggatggctggacgagttgcagactcatggctgggacagtgaatcaggcacaataattttcctgcataactggtccaagggcaacttcagcaatgaagagttgtcagacctagagttgttatttcgtttctacctctttggattaactcgggagattcaagaccatgcaagtcaagattactcgaaatatccctttgaagtacaggtgaaagcgggctgtgagctgcattctggaaagagcccagaaggcttctttcaggtagctttcaacggattagatttactgagtttccagaatacaacatgggtgccatctccaggctgtggaagtttggcccaaagtgtctgtcatctactcaatcatcagtatgaaggcgtcacagaaacagtgtataatctcataagaagcacttgcccccgatttctcttgggtctcctggatgcagggaagatgtatgtacacaggcaagtgaggccagaagcctggctgtccagtcgccccagccttgggtctggccagctgttgctggtttgtcatgcctccggcttctacccaaagcctgtttgggtgacatggatgcggaatgaacaggagcaactgggcactaaacatggtgatattcttcctaatgctgatgggacatggtatcttcaggtgatcctggaggtggcatctgaggagcctgctggcctgtcttgtcgagtgagacacagcagtctaggaggccaggacatcatcctctactgggctcatatcaggacatcctgtgagactcttccccctgactcccccattgtgttaagaacccagcaacccaggagcctagtacaatatagtgatgccatcccgtcgactctccatttaaattgtttctctttctgcataataaacatttgttaataaaaaccaaattctaatttggaatg

SEQ ID NO: 446523 - DNA, 741 bp, Homo sapiens
  misc_feature (699)..(699): n is a, c, g, or t
tgcacgagggcagttgaggaagggaagtagatataatggagcttagtggcagagcagctggaatcctgagagaagagaataactttagttcagagcaggtggggaaatgagagattgagtaggaggaccaaggttgagggaagcagatcttcttagttgctgtcagcggctgatggggaagattgttggtagaaggaagtcagaatataggtacagagggataagtttgctaagaacagagatcagcaaacagcttttctgagagaaagaaacatctgcaaatgacatgctgtttctgcagtttctgctgctagctcttcttctcccaggtggtgacaatgcagacgcatcccaggaacacgtctccttccatgtcatccagatcttctcatttgtcaaccaatcctgggcacgaggtcagggctcaggatggctggacgagttgcagactcatggctgggacagtgaatcaggcacaataattttcctgcataactggtccaagggcaacttcagcaatgaagagttgtcagacctagagttgttatttcgtttctacctctttggattaactcgggagattcaagaccatgcaagtcaagattactcgaaatatccctttgaagtacaggtgaaagcgggctgtgagctgcattctggaaagagccccaacaagggcttccccctgaaggtaccctnttaaacgccccctccccacccccactcgagccctcccaacaa

SEQ ID NO: 446524 - DNA, 708 bp, Homo sapiens
ggaggccaggacatcatcctctactggggtaagactggaggttggaagtgtaggtaggtggttcttgagcctagaggttaggggagaggaaattttgaggatagcagacctaggtgagggattgtaggaagaaatgtatagggtaatttaaagaatagtggagtaagacctaagggatacatggatactagagatttaaggggaaatgaggaatccttccttgagtaagttttggaatagagtgactgaaataggataactgatgcaactcatccaatgcatatgttaagtaaggaaatcaatagatggaatagaatcagcagtgagtttaaaatggcatccatgtatctttccaatatgtgcaggacaccacttttccatgaattggattgccttggtagtgatagtgcccttggtgattctaatagtccttgtgttatggtttaagaagcactggtgagttttttgtatttcctcctctcctcccagtttcttatttcacattccatttttcactctcttagcttttctctattgactactccaccttatcctcagttaccacctccaacttattcagggtttctcccattcctgttccttcacagctcatatcaggacatcctgtgagactcttccccctgactcccccattgtgttaagaacccagcaacccaggagcctagtacaatatagtgatgccatccc

SEQ ID NO: 446525 - DNA, 1444 bp, Homo sapiens
tgcacgagggcagttgaggaagggaagtagatataatggagcttagtggcagagcagctggaatcctgagagaagagaataactttagttcagagcaggtggggaaatgagagattgagtaggaggaccaaggttgagggaagcagatcttcttagttgctgtcagcggctgatggggaagattgttggtagaaggaagtcagaatataggtacagagggataagtttgctaagaacagagatcagcaaacagcttttctgagagaaagaaacatctgcaaatgacatgctgtttctgcagtttctgctgctagctcttcttctcccaggtggtgacaatgcagacgcatcccaggaacacgtctccttccatgtcatccagatcttctcatttgtcaaccaatcctgggcacgaggtcagggctcaggatggctggacgagttgcagactcatggctgggacagtgaatcaggcacaataattttcctgcataactggtccaagggcaacttcagcaatgaagagttgtcagacctagagttgttatttcgtttctacctctttggattaactcgggagattcaagaccatgcaagtcaagattactcgaaatatccctttgaagtacaggtgaaagcgggctgtgagctgcattctggaaagagcccagaaggcttctttcaggtagctttcaacggattagatttactgagtttccagaatacaacatgggtgccatctccaggctgtggaagtttggcccaaagtgtctgtcatctactcaatcatcagtatgaaggcgtcacagaaacagtgtataatctcataagaagcacttgcccccgatttctcttgggtctcctggatgcagggaagatgtatgtacacaggcaagtgaggccagaagcctggctgtccagtcgccccagccttgggtctggccagctgttgctggtttgtcatgcctccggcttctacccaaagcctgtttgggtgacatggatgcggaatgaacaggagcaactgggcactaaacatggtgatattcttcctaatgctgatgggacatggtatcttcaggtgatcctggaggtggcatctgaggagcctgctggcctgtcttgtcgagtgagacacagcagtctaggaggccaggacatcatcctctactggggacaccacttttccatgaattggattgccttggtagtgatagtgcccttggtgattctaatagtccttgtgttatggtttaagaagcactgctcatatcaggacatcctgtgagactcttccccctgactcccccattgtgttaagaacccagcaacccaggagcctagtacaatatagtgatgccatcccgtcgactctccatttaaattgtttctctttctgcataataaacatttgttaataaaaaccaaattctaatttggaatg

SEQ ID NO: 446526 - DNA, 907 bp, Homo sapiens
gtgggcagtgtacagtgcagaaacaaagttctaggcagaggaaaaaggatttacagaaagcctggcatacagggcagggggacggggcctgcacacggggctgtttcaccgttagacgttataagcacagtacttggggctatgggcttcctgaaggtcccaagtatttgagacctgaaaaaaatttattgacacctacataggaaaagtgaacttttaaattaataattccaaaattcaaatcacgaattgtttcaaaaattttacatgatagaattcatatttagtaagcgatacgggtatattttaatgcatttgattttaaaaacggggtagggcctactaagaacaggccaagccctggccccagtgggtttggatataatcctgagggcagctgggaaccactgagagaagcaggagaatgttctctgtggctacagtgaggagaatggattggagggaggccagactggaggcccagtggctagagaccagataggcagttacagtcttccagactgcgagacaatctctctttagtgccaagattagcataaaatcatagcattatataacccaattattctttgattcctgcatccccaatctgactcagcattctaaatttacttaagatctggggacaagggtttttggcaaatccttgaaggcaaatgatgttacagtcaatcagtatatgccttgagccagacagacatgggtacgggcctcagttctgctgcttgctagctatgtgactttgcacaagtgatttaacttctctgggccttggattccttactggtaacacgagcataatcgattcctcacagaattaagtgagaaaactatgtatgtaggacttcttatggagtgggtacttagaaataaatggtagccgtta

SEQ ID NO: 446527 - DNA, 468 bp, Homo sapiens
gctcccagggggccagagtttcccaggaacaccattgagtaccactgaactaagaccagataggcagttacagtcttccagactgcgagacaatctctctttagtgccaagattagcataaaatcatagcattatataacccaattattctttgattcctgcatccccaatctgactcagcattctaaatttacttaagatctggggacaagggtttttggcaaatccttgaaggcaaatgatgttacagtcaatcagtatatgccttgagccagacagacatgggtacgggcctcagttctgctgcttgctagctatgtgactttgcacaagtgatttaacttctctgggccttggattccttactggtaacacgagcataatcgattcctcacagaattaagtgagaaaactatgtatgtaggacttcttatggagtgggtacttagaaataaatggtagccgtta

SEQ ID NO: 446528 - DNA, 1380 bp, Homo sapiens
gtgggcagtgtacagtgcagaaacaaagttctaggcagaggaaaaaggatttacagaaagcctggcatacagggcagggggacggggcctgcacacggggctgtttcaccgttagacgttataagcacagtacttggggctatgggcttcctgaaggtcccaagtatttgagacctgaaaaaaatttattgacacctacataggaaaagtgaacttttaaattaataattccaaaattcaaatcacgaattgtttcaaaaattttacatgatagaattcatatttagtaagcgatacgggtatattttaatgcatttgattttaaaaacggggtagggcctactaagaacaggccaagccctggccccagtgggtttggatataatcctgagggcagctgggaaccactgagagaagcaggagaatgttctctgtggctacagtgaggagaatggattggagggaggccagactggaggcccagtggctagagaccagataggcagttacagtcttccagactgcgagacaatctctctttagtgccaagattagcataaaatcatagcattatataacccaattattctttgattcctgcatccccaatctgactcagcattctaaatttacttaagatctggggacaagggtttttggcaaatccttgaaggcaaatgatgttacagtcaatcagtatatgccttgagccagacagacatgggtacgggcctcagttctgctgcttgctagctatgtgactttgcacaagtgatttaacttctctgggccttggattccttactggtaacacgagcataatcgattcctcacagaattaagtgagaaaactatgtatgtaggacttcttatggagtgggtacttagaaataaatggtagccgttatcatttatgtgcctttgttctgaaatctgcttaagttttctctaggaagtaacagagggtagaataaattatttagtattttcatcaatcttctgagataaaaattattatcctcattttgcagataaggaaaagggctcagagattagatcacagctctgtgaagtaggggcacaaagtggtcaacctggaagagctggactttattttgcttgcacttctgtccatgcactctctccagcagttgacatttgccctctttgatggctccacgaccaatttcccttagtcatggcatgagtcagctgtgagggctgatggcacaccaccgaatactctgctgtggcgccactagcctccatttaccttcttctccaacgttttccagcctccctcataccttgccccccagttttatagcttctggattttccttattaaagagcttgtttctgagactcaaaaaaaaaaac

SEQ ID NO: 446529 - DNA, 2964 bp, Homo sapiens
ggagggagtctatgcgagctggacagcagtgggaggtttgtgaggctcgcactggccgcagaccctcgggctcgatcgcccgggagccaggactcggcgacgcgaggctgccgggctacccggccgaggcttcgggggcgcaaactaatgggactggctcgctcggcagcatctccccgctcttctaagtacactgagcagggcccgcgctgaagtagaagctgtccgggggcgcgtagcccggagtcccagtgtggcccggaggaacggagcccgtgccagggcggcccagtcgggagcccggggaccgagcttgtgctgtggggaaacccccacttcttccaagggacagcgatcccgggacggtcgaggcgtcggggcggtcaccgagacctctgcgggaagaccccgtcggggagagggcgcgcagccccgaagcgtctcgggaagtcgagcggaatcgggcgggatcacccgggggcgcagagcccccgtcgcgcctcgtgcggcagcggagagcccaggagaacgagccctcgggggccgaagcccatgcccgggttgggggcggctgcccagtgagtcctcctggccggccgggcggagaagagcgacaccgaagccggcgggaggggagcacttcaaggccggcggctgcggaggatgggcgcctgagcggctccgagcgcagcgcggcagaggaaggcgaggcgagctttggtgaggaggcgccaagggatcccgaagtgcagtctgcccccgggaagatggctcggcctgggcagcgttggctcggcaagtggcttgtggcgatggtcgtgtgggcgctgtgccggctcgccacaccgctggccaagaacctggagcccgtatcctggagctccctcaaccccaagttcctgagtgggaagggcttggtgatctatccgaaaattggagacaagctggacatcatctgcccccgagcagaagcagggcggccctatgagtactacaagctgtacctggtgcggcctgagcaggcagctgcctgtagcacagttctcgaccccaacgtgttggtcacctgcaataggccagagcaggaaatacgctttaccatcaagttccaggagttcagccccaactacatgggcctggagttcaagaagcaccatgattactacattacctcaacatccaatggaagcctggaggggctggaaaaccgggagggcggtgtgtgccgcacacgcaccatgaagatcatcatgaaggttgggcaagatcccaatgctgtgacgcctgagcagctgactaccagcaggcccagcaaggaggcagacaacactgtcaagatggccacacaggcccctggtagtcggggctccctgggtgactctgatggcaagcatgagactgtgaaccaggaagagaagagtggcccaggtgcaagtgggggcagcagcggggaccctgatggcttcttcaactccaaggtggcattgttcgcggctgtcggtgccggttgcgtcatcttcctgctcatcatcatcttcctgacggtcctactactgaagctacgcaagcggcaccgcaagcacacacagcagcgggcggctgccctctcgctcagtaccctggccagtcccaaggggggcagtggcacagcgggcaccgagcccagcgacatcatcattcccttacggactacagagaacaactactgcccccactatgagaaggtgagtggggactacgggcaccctgtctacatcgtccaagagatgccgccccagagcccggcgaacatctactacaaggtctgagtgcccggcacggcctcaggcccccgagggacagtcggcctggaccggacctctcctttcgcccccacaccccctccccttgccagctgtgcccacctttgtatttagttttgtagtttcttggcttttataatccccctttttccctgccccctgggcttcggaggggggtgcttgtgcccctaacccccatgctcttgtgccttccccctctggccaggcctctgggctccgtgggggcgccccttcttggaaggcagggctggacactgatggacagcaggcagggagacagtcccctggccctgcccctccctcgccccccttgccaccttcccaggactgcttgtccgctatcatcactgtttttaatgcttttgtgttcattttttagctgtcaactcattttcatctgttttttgaagaaaaatggaaaaatgtaaaaggcagcccctccccaggctttgtgagcctggcccaagccagtacaagagggcctggggcacgatgtggtcagccaggaagcataggatgccatttcttttatagattccttggtatttctggtggggtaaggggcaggccagggctgttcacgcccatgagggaagaggaaagtgccactgggcaaggtgtcccaccctcccctcctgaccctcctacgaggcttatcctggcaatggggtagtcactgccacccttccacacacacacacacacacacacacacacacacaaaaatcccttccttgtgggattcttgggcatctcctgcctccctcactctcacggtaattaatgtcttaattggctgttgcctggggaacaggagagctgctgcaggcagatgacctcatggggggtggagggaggtgaggtgcccaggtggctatttgccctgcagagctgggagtttcacccccaccccccaccctgttctctccttacctttggcatcctttggcctggtggggaaacagaggcccagggtggagacctaagcgggtataagaccaggtggcctgctccttttctgggccctagcacaggtgggtaacccccacccaacccagctcctgctgctgtcccagtcttgggctggggcctggaaagaggaagaggctgcctgggagcaggtcgtctcgttccaagatct

SEQ ID NO: 446530 - DNA, 2492 bp, Homo sapiens
ttgatctctcagccctggagtaggagaaggcagctttagttttcttctcctcgattaaggttcctgagtgggaagggcttggtgatctatccgaaaattggagacaagctggacatcatctgcccccgagcagaagcagggcggccctatgagtactacaagctgtacctggtgcggcctgagcaggcagctgcctgtagcacagttctcgaccccaacgtgttggtcacctgcaataggccagagcaggaaatacgctttaccatcaagttccaggagttcagccccaactacatgggcctggagttcaagaagcaccatgattactacattacctcaacatccaatggaagcctggaggggctggaaaaccgggagggcggtgtgtgccgcacacgcaccatgaagatcatcatgaaggttgggcaagatcccaatgctgtgacgcctgagcagctgactaccagcaggcccagcaaggaggcagacaacactgtcaagatggccacacaggcccctggtagtcggggctccctgggtgactctgatggcaagcatgagactgtgaaccaggaagagaagagtggcccaggtgcaagtgggggcagcagcggggaccctgatggcttcttcaactccaaggtggcattgttcgcggctgtcggtgccggttgcgtcatcttcctgctcatcatcatcttcctgacggtcctactactgaagctacgcaagcggcaccgcaagcacacacagcagcgggcggctgccctctcgctcagtaccctggccagtcccaaggggggcagtggcacagcgggcaccgagcccagcgacatcatcattcccttacggactacagagaacaactactgcccccactatgagaaggtgagtggggactacgggcaccctgtctacatcgtccaagagatgccgccccagagcccggcgaacatctactacaaggtctgagtgcccggcacggcctcaggcccccgagggacagtcggcctggaccggacctctcctttcgcccccacaccccctccccttgccagctgtgcccacctttgtatttagttttgtagtttcttggcttttataatccccctttttccctgccccctgggcttcggaggggggtgcttgtgcccctaacccccatgctcttgtgccttccccctctggccaggcctctgggctccgtgggggcgccccttcttggaaggcagggctggacactgatggacagcaggcagggagacagtcccctggccctgcccctccctcgccccccttgccaccttcccaggactgcttgtccgctatcatcactgtttttaatgcttttgtgttcattttttagctgtcaactcattttcatctgttttttgaagaaaaatggaaaaatgtaaaaggcagcccctccccaggctttgtgagcctggcccaagccagtacaagagggcctggggcacgatgtggtcagccaggaagcataggatgccatttcttttatagattccttggtatttctggtggggtaaggggcaggccagggctgttcacgcccatgagggaagaggaaagtgccactgggcaaggtgtcccaccctcccctcctgaccctcctacgaggcttatcctggcaatggggtagtcactgccacccttccacacacacacacacacacacacacacacacacaaaaatcccttccttgtgggattcttgggcatctcctgcctccctcactctcacggtaattaatgtcttaattggctgttgcctggggaacaggagagctgctgcaggcagatgacctcatggggggtggagggaggtgaggtgcccaggtggctatttgccctgcagagctgggagtttcacccccaccccccaccctgttctctccttacctttggcatcctttggcctggtggggaaacagaggcccagggtggagacctaagcgggtataagaccaggtggcctgctccttttctgggccctagcacaggtgggtaacccccacccaacccagctcctgctgctgtcccagtcttgggctggggcctggaaagaggaagaggctgcctggggctgggccagcccgctgtgcactttgaccccagttccttgccagcacggctgctaacagactgccacttgagtgcgccttgcaggcactcccagagcagccatggaaggagctggccctcacaccatccacctccacactgcctcctggccagctgcccaccccagtgccaggtgggagagggagcagaacagccagccccttccaggtggcagtcggaagggtttttgtttttgtttctgttgccatttgtgtaaatactagtctttttggaaaaaaaataatgtaaagatgttttgtataaactctgaattattttcttgttgcttttttcttagaaaaaaatgagaactaaaaaaaaaaaattaaccacatggaaaaaaaaaaata

SEQ ID NO: 446531 - DNA, 2715 bp, Homo sapiens
ggagggagtctatgcgagctggacagcagtgggaggtttgtgaggctcgcactggccgcagaccctcgggctcgatcgcccgggagccaggactcggcgacgcgaggctgccgggctacccggccgaggcttcgggggcgcaaactaatgggactggctcgctcggcagcatctccccgctcttctaagtacactgagcagggcccgcgctgaagtagaagctgtccgggggcgcgtagcccggagtcccagtgtggcccggaggaacggagcccgtgccagggcggcccagtcgggagcccggggaccgagcttgtgctgtggggaaacccccacttcttccaagggacagcgatcccgggacggtcgaggcgtcggggcggtcaccgagacctctgcgggaagaccccgtcggggagagggcgcgcagccccgaagcgtctcgggaagtcgagcggaatcgggcgggatcacccgggggcgcagagcccccgtcgcgcctcgtgcggcagcggagagcccaggagaacgagccctcgggggccgaagcccatgcccgggttgggggcggctgcccagtgagtcctcctggccggccgggcggagaagagcgacaccgaagccggcgggaggggagcacttcaaggccggcggctgcggaggatgggcgcctgagcggctccgagcgcagcgcggcagaggaaggcgaggcgagctttggtgaggaggcgccaagggatcccgaagtgcagtctgcccccgggaagatggctcggcctgggcagcgttggctcggcaagtggcttgtggcgatggtcgtgtgggcgctgtgccggctcgccacaccgctggccaagaacctggagcccgtatcctggagctccctcaaccccaagttcctgagtgggaagggcttggtgatctatccgaaaattggagacaagctggacatcatctgcccccgagcagaagcagggcggccctatgagtactacaagctgtacctggtgcggcctgagcaggcagctgcctgtagcacagttctcgaccccaacgtgttggtcacctgcaataggccagagcaggaaatacgctttaccatcaagttccaggagttcagccccaactacatgggcctggagttcaagaagcaccatgattactacattacctcaacatccaatggaagcctggaggggctggaaaaccgggagggcggtgtgtgccgcacacgcaccatgaagatcatcatgaaggttgggcaagatcccaatgctgtgacgcctgagcagctgactaccagcaggcccagcaaggaggcagacaacactgtcaagatggccacacaggcccctggtagtcggggctccctgggtgactctgatggcaagcatgagactgtgaaccaggaagagaagagtggcccaggtgcaagtgggggcagcagcggggaccctgatggcttcttcaactccaaggtggcattgttcgcggctgtcggtgccggttgcgtcatcttcctgctcatcatcatcttcctgacggtcctactactgaagctacgcaagcggcaccgcaagcacacacagcagcgggcggctgccctctcgctcagtaccctggccagtcccaaggggggcagtggcacagcgggcaccgagcccagcgacatcatcattcccttacggactacagagaacaactactgcccccactatgagaaggtgagtggggactacgggcaccctgtctacatcgtccaagagatgccgccccagagcccggcgaacatctactacaaggtctgagtgcccggcacggcctcaggcccccgagggacagtcggcctggaccggacctctcctttcgcccccacaccccctccccttgccagctgtgcccacctttgtatttagttttgtagtttcttggcttttataatccccctttttccctgccccctgggcttcggaggggggtgcttgtgcccctaacccccatgctcttgtgccttccccctctggccaggcctctgggctccgtgggggcgccccttcttggaaggcagggctggacactgatggacagcaggcagggagacagtcccctggccctgcccctccctcgccccccttgccaccttcccaggactgcttgtccgctatcatcactgtttttaatgcttttgtgttcattttttagctgtcaactcattttcatctgttttttgaagaaaaatggaaaaatgtaaaaggcagcccctccccaggctttgtgagcctggcccaagccagtacaagagggcctggggcacgatgtggtcagccaggaagcataggatgccatttcttttatagattccttggtatttctggtggggtaaggggcaggccagggctgttcacgcccatgagggaagaggaaagtgccactgggcaaggtgtcccacccatccacctccacactgcctcctggccagctgcccaccccagtgccaggtgggagagggagcagaacagccagccccttccaggtggcagtcggaagggtttttgtttttgtttctgttgccatttgtgtaaatactagtctttttggaaaaaaaataatgtaaagatgttttgtataaactctgaattattttcttgttgcttttttcttagaaaaaaatgagaactaaaaaaaaaaaattaaccacatggaaaaaaaaaaata

SEQ ID NO: 446532 - DNA, 3328 bp, Homo sapiens
ggagggagtctatgcgagctggacagcagtgggaggtttgtgaggctcgcactggccgcagaccctcgggctcgatcgcccgggagccaggactcggcgacgcgaggctgccgggctacccggccgaggcttcgggggcgcaaactaatgggactggctcgctcggcagcatctccccgctcttctaagtacactgagcagggcccgcgctgaagtagaagctgtccgggggcgcgtagcccggagtcccagtgtggcccggaggaacggagcccgtgccagggcggcccagtcgggagcccggggaccgagcttgtgctgtggggaaacccccacttcttccaagggacagcgatcccgggacggtcgaggcgtcggggcggtcaccgagacctctgcgggaagaccccgtcggggagagggcgcgcagccccgaagcgtctcgggaagtcgagcggaatcgggcgggatcacccgggggcgcagagcccccgtcgcgcctcgtgcggcagcggagagcccaggagaacgagccctcgggggccgaagcccatgcccgggttgggggcggctgcccagtgagtcctcctggccggccgggcggagaagagcgacaccgaagccggcgggaggggagcacttcaaggccggcggctgcggaggatgggcgcctgagcggctccgagcgcagcgcggcagaggaaggcgaggcgagctttggtgaggaggcgccaagggatcccgaagtgcagtctgcccccgggaagatggctcggcctgggcagcgttggctcggcaagtggcttgtggcgatggtcgtgtgggcgctgtgccggctcgccacaccgctggccaagaacctggagcccgtatcctggagctccctcaaccccaagttcctgagtgggaagggcttggtgatctatccgaaaattggagacaagctggacatcatctgcccccgagcagaagcagggcggccctatgagtactacaagctgtacctggtgcggcctgagcaggcagctgcctgtagcacagttctcgaccccaacgtgttggtcacctgcaataggccagagcaggaaatacgctttaccatcaagttccaggagttcagccccaactacatgggcctggagttcaagaagcaccatgattactacattacctcaacatccaatggaagcctggaggggctggaaaaccgggagggcggtgtgtgccgcacacgcaccatgaagatcatcatgaaggttgggcaagatcccaatgctgtgacgcctgagcagctgactaccagcaggcccagcaaggaggcagacaacactgtcaagatggccacacaggcccctggtagtcggggctccctgggtgactctgatggcaagcatgagactgtgaaccaggaagagaagagtggcccaggtgcaagtgggggcagcagcggggaccctgatggcttcttcaactccaaggtggcattgttcgcggctgtcggtgccggttgcgtcatcttcctgctcatcatcatcttcctgacggtcctactactgaagctacgcaagcggcaccgcaagcacacacagcagcgggcggctgccctctcgctcagtaccctggccagtcccaaggggggcagtggcacagcgggcaccgagcccagcgacatcatcattcccttacggactacagagaacaactactgcccccactatgagaaggtgagtggggactacgggcaccctgtctacatcgtccaagagatgccgccccagagcccggcgaacatctactacaaggtctgagtgcccggcacggcctcaggcccccgagggacagtcggcctggaccggacctctcctttcgcccccacaccccctccccttgccagctgtgcccacctttgtatttagttttgtagtttcttggcttttataatccccctttttccctgccccctgggcttcggaggggggtgcttgtgcccctaacccccatgctcttgtgccttccccctctggccaggcctctgggctccgtgggggcgccccttcttggaaggcagggctggacactgatggacagcaggcagggagacagtcccctggccctgcccctccctcgccccccttgccaccttcccaggactgcttgtccgctatcatcactgtttttaatgcttttgtgttcattttttagctgtcaactcattttcatctgttttttgaagaaaaatggaaaaatgtaaaaggcagcccctccccaggctttgtgagcctggcccaagccagtacaagagggcctggggcacgatgtggtcagccaggaagcataggatgccatttcttttatagattccttggtatttctggtggggtaaggggcaggccagggctgttcacgcccatgagggaagaggaaagtgccactgggcaaggtgtcccaccctcccctcctgaccctcctacgaggcttatcctggcaatggggtagtcactgccacccttccacacacacacacacacacacacacacacacacaaaaatcccttccttgtgggattcttgggcatctcctgcctccctcactctcacggtaattaatgtcttaattggctgttgcctggggaacaggagagctgctgcaggcagatgacctcatggggggtggagggaggtgaggtgcccaggtggctatttgccctgcagagctgggagtttcacccccaccccccaccctgttctctccttacctttggcatcctttggcctggtggggaaacagaggcccagggtggagacctaagcgggtataagaccaggtggcctgctccttttctgggccctagcacaggtgggtaacccccacccaacccagctcctgctgctgtcccagtcttgggctggggcctggaaagaggaagaggctgcctggggctgggccagcccgctgtgcactttgaccccagttccttgccagcacggctgctaacagactgccacttgagtgcgccttgcaggcactcccagagcagccatggaaggagctggccctcacaccatccacctccacactgcctcctggccagctgcccaccccagtgccaggtgggagagggagcagaacagccagccccttccaggtggcagtcggaagggtttttgtttttgtttctgttgccatttgtgtaaatactagtctttttggaaaaaaaataatgtaaagatgttttgtataaactctgaattattttcttgttgcttttttcttagaaaaaaatgagaactaaaaaaaaaaaattaaccacatggaaaaaaaaaaata

SEQ ID NO: 446533 - DNA, 3235 bp, Homo sapiens
ggagggagtctatgcgagctggacagcagtgggaggtttgtgaggctcgcactggccgcagaccctcgggctcgatcgcccgggagccaggactcggcgacgcgaggctgccgggctacccggccgaggcttcgggggcgcaaactaatgggactggctcgctcggcagcatctccccgctcttctaagtacactgagcagggcccgcgctgaagtagaagctgtccgggggcgcgtagcccggagtcccagtgtggcccggaggaacggagcccgtgccagggcggcccagtcgggagcccggggaccgagcttgtgctgtggggaaacccccacttcttccaagggacagcgatcccgggacggtcgaggcgtcggggcggtcaccgagacctctgcgggaagaccccgtcggggagagggcgcgcagccccgaagcgtctcgggaagtcgagcggaatcgggcgggatcacccgggggcgcagagcccccgtcgcgcctcgtgcggcagcggagagcccaggagaacgagccctcgggggccgaagcccatgcccgggttgggggcggctgcccagtgagtcctcctggccggccgggcggagaagagcgacaccgaagccggcgggaggggagcacttcaaggccggcggctgcggaggatgggcgcctgagcggctccgagcgcagcgcggcagaggaaggcgaggcgagctttggtgaggaggcgccaagggatcccgaagtgcagtctgcccccgggaagatggctcggcctgggcagcgttggctcggcaagtggcttgtggcgatggtcgtgtgggcgctgtgccggctcgccacaccgctggccaagaacctggagcccgtatcctggagctccctcaaccccaagttcctgagtgggaagggcttggtgatctatccgaaaattggagacaagctggacatcatctgcccccgagcagaagcagggcggccctatgagtactacaagctgtacctggtgcggcctgagcaggcagctgcctgtagcacagttctcgaccccaacgtgttggtcacctgcaataggccagagcaggaaatacgctttaccatcaagttccaggagttcagccccaactacatgggcctggagttcaagaagcaccatgattactacattacctcaacatccaatggaagcctggaggggctggaaaaccgggagggcggtgtgtgccgcacacgcaccatgaagatcatcatgaaggttgggcaagatcccaatgctgtgacgcctgagcagctgactaccagcaggcccagcaaggaggcagacaacactgtcaagatggccacacaggcccctggtagtcggggctccctgggtgactctgatggcaagcatgagactgtgaaccaggaagagaagagtggcccaggtgcaagtgggggcagcagcggggaccctgatggcttcttcaactccaaggtggcattgttcgcggctgtcggtgccggttgcgtcatcttcctgctcatcatcatcttcctgacggtcctactactgaagctacgcaagcggcaccgcaagcacacacagcagcgggcggctgccctctcgctcagtaccctggccagtcccaaggggggcagtggcacagcgggcaccgagcccagcgacatcatcattcccttacggactacagagaacaactactgcccccactatgagaaggtgagtggggactacgggcaccctgtctacatcgtccaagagatgccgccccagagcccggcgaacatctactacaaggtctgagtgcccggcacggcctcaggcccccgagggacagtcggcctggaccggacctctcctttcgcccccacaccccctccccttgccagctgtgcccacctttgtatttagttttgtagtttcttggcttttataatccccctttttccctgccccctgggcttcggaggggggtgcttgtgcccctaacccccatgctcttgtgccttccccctctggccaggcctctgggctccgtgggggcgccccttcttggaaggcagggctggacactgatggacagcaggcagggagacagtcccctggccctgcccctccctcgccccccttgccaccttcccaggactgcttgtccgctatcatcactgtttttaatgcttttgtgttcattttttagctgtcaactcattttcatctgttttttgaagaaaaatggaaaaatgtaaaaggcagcccctccccaggctttgtgagcctggcccaagccagtacaagagggcctggggcacgatgtggtcagccaggaagcataggatgccatttcttttatagattccttggtatttctggtggggtaaggggcaggccagggctgttcacgcccatgagggaagaggaaagtgccactgggcaaggtgtcccaccctcccctcctgaccctcctacgaggcttatcctggcaatggggtagtcactgccacccttccacacacacacacacacacacacacacacacacaaaaatcccttccttgtgggattcttgggcatctcctgcctccctcactctcacggtaattaatgtcttaattggctgttgcctggggaacaggagagctgctgcaggcagatgacctcatggggggtggagggaggtgaggtgcccaggtggctatttgccctgcagagctgggagtttcacccccaccccccaccctgttctctccttacctttggcatcctttggcctggtggggaaacagaggcccagggtggagacctaagcgggtataagaccaggtggcctgctccttttctgggccctagcacaggtgggtaacccccacccaacccagctcctgctgctgtcccagtcttgggctggggcctggaaagaggaagaggctgcctggggctgggccagcccgctgtgcactttgaccccagttccttgccagcacggctgctaacagactgccacttgagtgcgccttgcaggcactcccagaaacagccagccccttccaggtggcagtcggaagggtttttgtttttgtttctgttgccatttgtgtaaatactagtctttttggaaaaaaaataatgtaaagatgttttgtataaactctgaattattttcttgttgcttttttcttagaaaaaaatgagaactaaaaaaaaaaaattaaccacatggaaaaaaaaaaata

SEQ ID NO: 446534 - DNA, 745 bp, Homo sapiens
agaagaggcggcgcgtgcgtagaggggcggtgagagctaagaggggcagcgcgtgtgcagaggggcggtgtgacttaggacggggcgatggcggctgagaggagctgcgcgtgcgcgaacatgtaactggtgggatctgcggcggctcccagatgatggtcgtcctcctgggcgcgacgaccctagtgctcgtcgccgtggcgccatgggtgttgtccgcagccgcaggtggaaaaaatctaaaatctcctcaaaaagtagaggtcgacatcatagatgacaactttatcctgaggtggaacaggagcgatgagtctgtcgggaatgtgactttttcattcgattatcaaaaaactgggatggataattggataaaattgtctgggtgtcagaatattactagtaccaaatgcaacttttcttcactcaagctgaatgtttatgaagaaattaaattgcgtataagagcagaaaaagaaaacacttcttcatggtatgaggttgactcatttacaccatttcgcaaagctcagattggtcctccagaagtacatttagaagctgaagataaggcaatagtgatacacatctctcctggaacaaaagatagtgttatgtgggctttggatggtttaagctttacatatagcttagttatctggaaaaactcttcaggtgtagaaaaaaaaggattggaaaatttattcccgacttaaattttttaacctttacccgagattctttt

SEQ ID NO: 446535 - DNA, 3345 bp, Homo sapiens
agaagaggcggcgcgtgcgtagaggggcggtgagagctaagaggggcagcgcgtgtgcagaggggcggtgtgacttaggacggggcgatggcggctgagaggagctgcgcgtgcgcgaacatgtaactggtgggatctgcggcggctcccagatgatggtcgtcctcctgggcgcgacgaccctagtgctcgtcgccgtggcgccatgggtgttgtccgcagccgcaggtggaaaaaatctaaaatctcctcaaaaagtagaggtcgacatcatagatgacaactttatcctgaggtggaacaggagcgatgagtctgtcgggaatgtgactttttcattcgattatcaaaaaactgggatggataattggataaaattgtctgggtgtcagaatattactagtaccaaatgcaacttttcttcactcaagctgaatgtttatgaagaaattaaattgcgtataagagcagaaaaagaaaacacttcttcatggtatgaggttgactcatttacaccatttcgcaaagctcagattggtcctccagaagtacatttagaagctgaagataaggcaatagtgatacacatctctcctggaacaaaagatagtgttatgtgggctttggatggtttaagctttacatatagcttagttatctggaaaaactcttcaggtgtagaagaaaggattgaaaatatttattccagacataaaatttataaactctcaccagagactacttattgtctaaaagttaaagcagcactacttacgtcatggaaaattggtgtctatagtccagtacattgtataaagaccacagttgaaaatgaactacctccaccagaaaatatagaagtcagtgtccaaaatcagaactatgttcttaaatgggattatacatatgcaaacatgacctttcaagttcagtggctccacgcctttttaaaaaggaatcctggaaaccatttgtataaatggaaacaaatacctgactgtgaaaatgtcaaaactacccagtgtgtctttcctcaaaacgttttccaaaaaggaatttaccttctccgcgtacaagcatctgatggaaataacacatctttttggtctgaagagataaagtttgatactgaaatacaagctttcctacttcctccagtctttaacattagatcccttagtgattcattccatatctatatcggtgctccaaaacagtctggaaacacgcctgtgatccaggattatccactgatttatgaaattattttttgggaaaacacttcaaatgctgagagaaaaattatcgagaaaaaaactgatgttacagttcctaatttgaaaccactgactgtatattgtgtgaaagccagagcacacaccatggatgaaaagctgaataaaagcagtgtttttagtgacgctgtatgtgagaaaacaaaaccaggaaatacctctaaaatttggcttatagttggaatttgtattgcattatttgctctcccgtttgtcatttatgctgcgaaagtcttcttgagatgcatcaattatgtcttctttccatcacttaaaccttcttccagtatagatgagtatttctctgaacagccattgaagaatcttctgctttcaacttctgaggaacaaatcgaaaaatgtttcataattgaaaatataagcacaattgctacagtagaagaaactaatcaaactgatgaagatcataaaaaatacagttcccaaactagccaagattcaggaaattattctaatgaagatgaaagcgaaagtaaaacaagtgaagaactacagcaggactttgtatgaccagaaatgaactgtgtcaagtataaggtttttcagcaggagttacactgggagcctgaggtcctcaccttcctctcagtaactacagagaggacgtttccctgtttagggaaagaaaaaacatcttcagatcataggtcctaaaaatacgggcaagctcttaactatttaaaaatgaaattacaggcccgggcacggtggctcacacctgtaatcccagcactttgggaggctgaggcaggcagatcatgaggtcaagagatcgagaccagcctggccaacgtggtgaaaccccatctctactaaaaatacaaaaattagccgggtgtggtggcgcgcgcctgttgtcttagctactcaggaggctgaggcaggagaatcgcttgaaaacaggaggtggaggttgcagtgagccgagatcacgccactgcactccagcctggtgacagcgtgagactctttaaaaaaagaaattaaaagagttgagacaaacgtttcctacattcttttccatgtgtaaaatcatgaaaaagcctgtcaccggacttgcattggatgagatgagtcagaccaaaacagtggccacccgtcttcctcctgtgagcctaagtgcagccgtgctagctgcgcaccgtggctaaggatgacgtctgtgttcctgtccatcactgatgctgctggctactgcatgtgccacacctgtctgttcgccattcctaacattctgtttcattcttcctcgggagatatttcaaacatttggtcttttcttttaacactgagggtaggcccttaggaaatttatttaggaaagtctgaacacgttatcacttggttttctggaaagtagcttaccctagaaaacagctgcaaatgccagaaagatgatccctaaaaatgttgagggacttctgttcattcatcccgagaacattggcttccacatcacagtatctacccttacatggtttaggattaaagccaggcaatcttttactatgcattaagaccctttgctatgtagtctcatggtctagcatgcatcttgtagaaacaaggcatgctggcagattgcagggttgagatgtgtttatctgtttatattttaaaagattctgccagaaaataaaaccagaccttgttctaaagcccaggttatggaccaactcagtgcttcaggtcttaatgcctccatacctcttcctcaccaactttactagtagctgagatttaatgggcactattatgctacatatcatgttaggtaaatctgactgactctttccccacctcctttggtgtgcttccctgaatgagtattaccccaggatgaggtctgcatcagcttagttagccattgatgcaatactagggaaagactaggaggatgagccagggtgctaataaggataagtgttggaccaaggttgctttgtttgcttaagaaggagtgactggtcaggttggccgtatccatatggagcgagcgagggcaaaaccgtaaggaccgtcttaaaaa

SEQ ID NO: 446536 - DNA, 3361 bp, Homo sapiens
  misc_feature (119)..(119): n is a, c, g, or t
gtagagcattcatgggcggctgtgacgttaagaaggtaagatagcgtggtgaataggatgtgtgctatggacaatacttgtaattgagtaggtagtctgggatcgtcatcctcaagtanatgaaatgagcgtcgctggctgcgctggagccgacgacggtatcctgcatagatgacttcgcatgatgcgaggtgctcggcagggtgcatgttagctggcgtactactgaagcgggagatccaagtcgtagacattgcttctcaaaatatgtagcacgcggtcgacatcatagatgacaactttatcctgaggtggaacaggagcgatgagtctgtcgggaatgtgactttttcattcgattatcaaaaaactgggatggataattggataaaattgtctgggtgtcagaatattactagtaccaaatgcaacttttcttcactcaagctgaatgtttatgaagaaattaaattgcgtataagagcagaaaaagaaaacacttcttcatggtatgaggttgactcatttacaccatttcgcaaagctcagattggtcctccagaagtacatttagaagctgaagataaggcaatagtgatacacatctctcctggaacaaaagatagtgttatgtgggctttggatggtttaagctttacatatagcttagttatctggaaaaactcttcaggtgtagaagaaaggattgaaaatatttattccagacataaaatttataaactctcaccagagactacttattgtctaaaagttaaagcagcactacttacgtcatggaaaattggtgtctatagtccagtacattgtataaagaccacagttgaaaatgaactacctccaccagaaaatatagaagtcagtgtccaaaatcagaactatgttcttaaatgggattatacatatgcaaacatgacctttcaagttcagtggctccacgcctttttaaaaaggaatcctggaaaccatttgtataaatggaaacaaatacctgactgtgaaaatgtcaaaactacccagtgtgtctttcctcaaaacgttttccaaaaaggaatttaccttctccgcgtacaagcatctgatggaaataacacatctttttggtctgaagagataaagtttgatactgaaatacaagctttcctacttcctccagtctttaacattagatcccttagtgattcattccatatctatatcggtgctccaaaacagtctggaaacacgcctgtgatccaggattatccactgatttatgaaattattttttgggaaaacacttcaaatgctgagagaaaaattatcgagaaaaaaactgatgttacagttcctaatttgaaaccactgactgtatattgtgtgaaagccagagcacacaccatggatgaaaagctgaataaaagcagtgtttttagtgacgctgtatgtgagaaaacaaaaccaggaaatacctctaaaatttggcttatagttggaatttgtattgcattatttgctctcccgtttgtcatttatgctgcgaaagtcttcttgagatgcatcaattatgtcttctttccatcacttaaaccttcttccagtatagatgagtatttctctgaacagccattgaagaatcttctgctttcaacttctgaggaacaaatcgaaaaatgtttcataattgaaaatataagcacaattgctacagtagaagaaactaatcaaactgatgaagatcataaaaaatacagttcccaaactagccaagattcaggaaattattctaatgaagatgaaagcgaaagtaaaacaagtgaagaactacagcaggactttgtatgaccagaaatgaactgtgtcaagtataaggtttttcagcaggagttacactgggagcctgaggtcctcaccttcctctcagtaactacagagaggacgtttccctgtttagggaaagaaaaaacatcttcagatcataggtcctaaaaatacgggcaagctcttaactatttaaaaatgaaattacaggcccgggcacggtggctcacacctgtaatcccagcactttgggaggctgaggcaggcagatcatgaggtcaagagatcgagaccagcctggccaacgtggtgaaaccccatctctactaaaaatacaaaaattagccgggtgtggtggcgcgcgcctgttgtcttagctactcaggaggctgaggcaggagaatcgcttgaaaacaggaggtggaggttgcagtgagccgagatcacgccactgcactccagcctggtgacagcgtgagactctttaaaaaaagaaattaaaagagttgagacaaacgtttcctacattcttttccatgtgtaaaatcatgaaaaagcctgtcaccggacttgcattggatgagatgagtcagaccaaaacagtggccacccgtcttcctcctgtgagcctaagtgcagccgtgctagctgcgcaccgtggctaaggatgacgtctgtgttcctgtccatcactgatgctgctggctactgcatgtgccacacctgtctgttcgccattcctaacattctgtttcattcttcctcgggagatatttcaaacatttggtcttttcttttaacactgagggtaggcccttaggaaatttatttaggaaagtctgaacacgttatcacttggttttctggaaagtagcttaccctagaaaacagctgcaaatgccagaaagatgatccctaaaaatgttgagggacttctgttcattcatcccgagaacattggcttccacatcacagtatctacccttacatggtttaggattaaagccaggcaatcttttactatgcattaagaccctttgctatgtagtctcatggtctagcatgcatcttgtagaaacaaggcatgctggcagattgcagggttgagatgtgtttatctgtttatattttaaaagattctgccagaaaataaaaccagaccttgttctaaagcccaggttatggaccaactcagtgcttcaggtcttaatgcctccatacctcttcctcaccaactttactagtagctgagatttaatgggcactattatgctacatatcatgttaggtaaatctgactgactctttccccacctcctttggtgtgcttccctgaatgagtattaccccaggatgaggtctgcatcagcttagttagccattgatgcaatactagggaaagactaggaggatgagccagggtgctaataaggataagtgttggaccaaggttgctttgtttgcttaagaaggagtgactggtcaggttggccgtatccatatggagcgagcgagggcaaaaccgtaaggaccgtcttaaaaa

SEQ ID NO: 446537 - DNA, 1525 bp, Homo sapiens
agaagaggcggcgcgtgcgtagaggggcggtgagagctaagaggggcagcgcgtgtgcagaggggcggtgtgacttaggacggggcgatggcggctgagaggagctgcgcgtgcgcgaacatgtaactggtgggatctgcggcggctcccagatgatggtcgtcctcctgggcgcgacgaccctagtgctcgtcgccgtggcgccatgggtgttgtccgcagccgcaggtggaaaaaatctaaaatctcctcaaaaagtagaggtcgacatcatagatgacaactttatcctgaggtggaacaggagcgatgagtctgtcgggaatgtgactttttcattcgattatcaaaaaactgggatggataattggataaaattgtctgggtgtcagaatattactagtaccaaatgcaacttttcttcactcaagctgaatgtttatgaagaaattaaattgcgtataagagcagaaaaagaaaacacttcttcatggtatgaggttgactcatttacaccatttcgcaaagctcagattggtcctccagaagtacatttagaagctgaagataaggcaatagtgatacacatctctcctggaacaaaagatagtgttatgtgggctttggatggtttaagctttacatatagcttagttatctggaaaaactcttcaggtgtagaagaaaggattgaaaatatttattccagacataaaatttataaactctcaccagagactacttattgtctaaaagttaaagcagcactacttacgtcatggaaaattggtgtctatagtccagtacattgtataaagaccacagttgaaaatgaactacctccaccagaaaatatagaagtcagtgtccaaaatcagaactatgttcttaaatgggattatacatatgcaaacatgacctttcaagttcagtggctccacgcctttttaaaaaggaatcctggaaaccatttgtataaatggaaacaaatacctgactgtgaaaatgtcaaaactacccagtgtgtctttcctcaaaacgttttccaaaaaggaatttaccttctccgcgtacaagcatctgatggaaataacacatctttttggtctgaagagataaagtttgatactgaaatacaagctttcctacttcctccagtctttaacattagatcccttagtgattcattccatatctatatcggtgctccaaaacagtctggaaacacgcctgtgatccaggattatccactgatttatgaaattattttttgggaaaacacttcaaatgctgaggtaaaaagactgtatagtataattttgtaacttagagttataattatgatttgggtaaataaagcttgaatgtaaaatttgggggaaatttttaaactttatgtgggctggatgcagtggcctgtaatcccagcacttcaggaggccaaggcgagaggatcacttgagcctaagggtttgagaccagcctgggcaacatagggagaccctgtctcaataaaaattttaaa

SEQ ID NO: 446538 - DNA, 1360 bp, Homo sapiens
gtggaaaatctggtgtccccatgatctcaccagaaatggtttggtagttacaaagcaagatagagcagttgagcaaatacttagcccatctagtcctctaccactaccaccttcgccttttaatgagcaggactttgtagtaagcgagttgttgaaaaggagctccacatacttagtaacagcctcggagcggatggaaagaagtaggcattgctgcagagctgagatgaacctgcacggagacagccttggccccagggaatgatcactgcactccagcctggtgacagcgtgagactctttaaaaaaagaaattaaaagagttgagacaaacgtttcctacattcttttccatgtgtaaaatcatgaaaaagcctgtcaccggacttgcattggatgagatgagtcagaccaaaacagtggccacccgtcttcctcctgtgagcctaagtgcagccgtgctagctgcgcaccgtggctaaggatgacgtctgtgttcctgtccatcactgatgctgctggctactgcatgtgccacacctgtctgttcgccattcctaacattctgtttcattcttcctcgggagatatttcaaacatttggtcttttcttttaacactgagggtaggcccttaggaaatttatttaggaaagtctgaacacgttatcacttggttttctggaaagtagcttaccctagaaaacagctgcaaatgccagaaagatgatccctaaaaatgttgagggacttctgttcattcatcccgagaacattggcttccacatcacagtatctacccttacatggtttaggattaaagccaggcaatcttttactatgcattaagaccctttgctatgtagtctcatggtctagcatgcatcttgtagaaacaaggcatgctggcagattgcagggttgagatgtgtttatctgtttatattttaaaagattctgccagaaaataaaaccagaccttgttctaaagcccaggttatggaccaactcagtgcttcaggtcttaatgcctccatacctcttcctcaccaactttactagtagctgagatttaatgggcactattatgctacatatcatgttaggtaaatctgactgactctttccccacctcctttggtgtgcttccctgaatgagtattaccccaggatgaggtctgcatcagcttagttagccattgatgcaatactagggaaagactaggaggatgagccagggtgctaataaggataagtgttggaccaaggttgctttgtttgcttaagaaggagtgactggtcaggttggccgtatccatatggagcgagcgagggcaaaaccgtaaggaccgtcttaaaaa

SEQ ID NO: 446539 - DNA, 1512 bp, Homo sapiens
agaagaggcggcgcgtgcgtagaggggcggtgagagctaagaggggcagcgcgtgtgcagaggggcggtgtgacttaggacggggcgatggcggctgagaggagctgcgcgtgcgcgaacatgtaactggtgggatctgcggcggctcccagatgatggtcgtcctcctgggcgcgacgaccctagtgctcgtcgccgtggcgccatgggtgttgtccgcagccgcaggtggaaaaaatctaaaatctcctcaaaaagtagaggtcgacatcatagatgacaactttatcctgaggtggaacaggagcgatgagtctgtcgggaatgtgactttttcattcgattatcaaaaaactgggatggataattggataaaattgtctgggtgtcagaatattactagtaccaaatgcaacttttcttcactcaagctgaatgtttatgaagaaattaaattgcgtataagagcagaaaaagaaaacacttcttcatggtatgaggttgactcatttacaccatttcgcaaagctcagattggtcctccagaagtacatttagaagctgaagataaggcaatagtgatacacatctctcctggaacaaaagatagtgttatgtgggctttggatggtttaagctttacatatagcttagttatctggaaaaactcttcaggtgtagaagaaaggattgaaaatatttattccagacataaaatttataaactctcaccagagactacttattgtctaaaagttaaagcagcactacttacgtcatggaaaattggtgtctatagtccagtacattgtataaagaccacagttgaaaatgaactacctccaccagaaaatatagaagtcagtgtccaaaatcagaactatgttcttaaatgggattatacatatgcaaacatgacctttcaagttcagtggctccacgcctttttaaaaaggaatcctggaaaccatttgtataaatggaaacaaatacctgactgtgaaaatgtcaaaactacccagtgtgtctttcctcaaaacgttttccaaaaaggaatttaccttctccgcgtacaagcatctgatggaaataacacatctttttggtctgaagagataaagtttgatactgaaatacaagctttcctacttcctccagtctttaacattagatcccttagtgattcattccatatctatatcggtgctccaaaacagtctggaaacacgcctgtgatccaggattatccactgatttatgaaattattttttgggaaaacacttcaaatgctgagagaaaaattatcgagaaaaaaactgatgttacagttcctaatttgaaaccactgactgtatattgtgtgaaagccagagcacacaccatggatgaaaagctgaataaaagcagtgtttttagtgacgctgtatgtgagaaaacaaaaccaggtcagaatcttttattgtcttttttaaaaatgtagctagacataataaaagtaattctatactgta

SEQ ID NO: 446540 - DNA, 3190 bp, Homo sapiens
agaagaggcggcgcgtgcgtagaggggcggtgagagctaagaggggcagcgcgtgtgcagaggggcggtgtgacttaggacggggcgatggcggctgagaggagctgcgcgtgcgcgaacatgtaactggtgggatctgcggcggctcccagatgatggtcgtcctcctgggcgcgacgaccctagtgctcgtcgccgtggcgccatgggtgttgtccgcagccgcaggtggaaaaaatctaaaatctcctcaaaaagtagaggtcgacatcatagatgacaactttatcctgaggtggaacaggagcgatgagtctgtcgggaatgtgactttttcattcgattatcaaaaaactgggatggataattggataaaattgtctgggtgtcagaatattactagtaccaaatgcaacttttcttcactcaagctgaatgtttatgaagaaattaaattgcgtataagagcagaaaaagaaaacacttcttcatggtatgaggttgactcatttacaccatttcgcaaaggaaaggattgaaaatatttattccagacataaaatttataaactctcaccagagactacttattgtctaaaagttaaagcagcactacttacgtcatggaaaattggtgtctatagtccagtacattgtataaagaccacagttgaaaatgaactacctccaccagaaaatatagaagtcagtgtccaaaatcagaactatgttcttaaatgggattatacatatgcaaacatgacctttcaagttcagtggctccacgcctttttaaaaaggaatcctggaaaccatttgtataaatggaaacaaatacctgactgtgaaaatgtcaaaactacccagtgtgtctttcctcaaaacgttttccaaaaaggaatttaccttctccgcgtacaagcatctgatggaaataacacatctttttggtctgaagagataaagtttgatactgaaatacaagctttcctacttcctccagtctttaacattagatcccttagtgattcattccatatctatatcggtgctccaaaacagtctggaaacacgcctgtgatccaggattatccactgatttatgaaattattttttgggaaaacacttcaaatgctgagagaaaaattatcgagaaaaaaactgatgttacagttcctaatttgaaaccactgactgtatattgtgtgaaagccagagcacacaccatggatgaaaagctgaataaaagcagtgtttttagtgacgctgtatgtgagaaaacaaaaccaggaaatacctctaaaatttggcttatagttggaatttgtattgcattatttgctctcccgtttgtcatttatgctgcgaaagtcttcttgagatgcatcaattatgtcttctttccatcacttaaaccttcttccagtatagatgagtatttctctgaacagccattgaagaatcttctgctttcaacttctgaggaacaaatcgaaaaatgtttcataattgaaaatataagcacaattgctacagtagaagaaactaatcaaactgatgaagatcataaaaaatacagttcccaaactagccaagattcaggaaattattctaatgaagatgaaagcgaaagtaaaacaagtgaagaactacagcaggactttgtatgaccagaaatgaactgtgtcaagtataaggtttttcagcaggagttacactgggagcctgaggtcctcaccttcctctcagtaactacagagaggacgtttccctgtttagggaaagaaaaaacatcttcagatcataggtcctaaaaatacgggcaagctcttaactatttaaaaatgaaattacaggcccgggcacggtggctcacacctgtaatcccagcactttgggaggctgaggcaggcagatcatgaggtcaagagatcgagaccagcctggccaacgtggtgaaaccccatctctactaaaaatacaaaaattagccgggtgtggtggcgcgcgcctgttgtcttagctactcaggaggctgaggcaggagaatcgcttgaaaacaggaggtggaggttgcagtgagccgagatcacgccactgcactccagcctggtgacagcgtgagactctttaaaaaaagaaattaaaagagttgagacaaacgtttcctacattcttttccatgtgtaaaatcatgaaaaagcctgtcaccggacttgcattggatgagatgagtcagaccaaaacagtggccacccgtcttcctcctgtgagcctaagtgcagccgtgctagctgcgcaccgtggctaaggatgacgtctgtgttcctgtccatcactgatgctgctggctactgcatgtgccacacctgtctgttcgccattcctaacattctgtttcattcttcctcgggagatatttcaaacatttggtcttttcttttaacactgagggtaggcccttaggaaatttatttaggaaagtctgaacacgttatcacttggttttctggaaagtagcttaccctagaaaacagctgcaaatgccagaaagatgatccctaaaaatgttgagggacttctgttcattcatcccgagaacattggcttccacatcacagtatctacccttacatggtttaggattaaagccaggcaatcttttactatgcattaagaccctttgctatgtagtctcatggtctagcatgcatcttgtagaaacaaggcatgctggcagattgcagggttgagatgtgtttatctgtttatattttaaaagattctgccagaaaataaaaccagaccttgttctaaagcccaggttatggaccaactcagtgcttcaggtcttaatgcctccatacctcttcctcaccaactttactagtagctgagatttaatgggcactattatgctacatatcatgttaggtaaatctgactgactctttccccacctcctttggtgtgcttccctgaatgagtattaccccaggatgaggtctgcatcagcttagttagccattgatgcaatactagggaaagactaggaggatgagccagggtgctaataaggataagtgttggaccaaggttgctttgtttgcttaagaaggagtgactggtcaggttggccgtatccatatggagcgagcgagggcaaaaccgtaaggaccgtcttaaaaa

SEQ ID NO: 446541 - DNA, 3048 bp, Homo sapiens
agaagaggcggcgcgtgcgtagaggggcggtgagagctaagaggggcagcgcgtgtgcagaggggcggtgtgacttaggacggggcgatggcggctgagaggagctgcgcgtgcgcgaacatgtaactggtgggatctgcggcggctcccagatgatggtcgtcctcctgggcgcgacgaccctagtgctcgtcgccgtggcgccatgggtgttgtccgcagccgcaggtggaaaaaatctaaaatctcctcaaaaagtagaggtcgacatcatagatgacaactttatcctgaggtggaacaggagcgatgagtctgtcgggaatgtgactttttcattcgattatcaaaaaactgggatggataattggataaaattgtctgggtgtcagaatattactagtaccaaatgcaacttttcttcactcaagctgaatgtttatgaagaaattaaattgcgtataagagcagaaaaagaaaacacttcttcatggtatgaggttgactcatttacaccatttcgcaaagttgaaaatgaactacctccaccagaaaatatagaagtcagtgtccaaaatcagaactatgttcttaaatgggattatacatatgcaaacatgacctttcaagttcagtggctccacgcctttttaaaaaggaatcctggaaaccatttgtataaatggaaacaaatacctgactgtgaaaatgtcaaaactacccagtgtgtctttcctcaaaacgttttccaaaaaggaatttaccttctccgcgtacaagcatctgatggaaataacacatctttttggtctgaagagataaagtttgatactgaaatacaagctttcctacttcctccagtctttaacattagatcccttagtgattcattccatatctatatcggtgctccaaaacagtctggaaacacgcctgtgatccaggattatccactgatttatgaaattattttttgggaaaacacttcaaatgctgagagaaaaattatcgagaaaaaaactgatgttacagttcctaatttgaaaccactgactgtatattgtgtgaaagccagagcacacaccatggatgaaaagctgaataaaagcagtgtttttagtgacgctgtatgtgagaaaacaaaaccaggaaatacctctaaaatttggcttatagttggaatttgtattgcattatttgctctcccgtttgtcatttatgctgcgaaagtcttcttgagatgcatcaattatgtcttctttccatcacttaaaccttcttccagtatagatgagtatttctctgaacagccattgaagaatcttctgctttcaacttctgaggaacaaatcgaaaaatgtttcataattgaaaatataagcacaattgctacagtagaagaaactaatcaaactgatgaagatcataaaaaatacagttcccaaactagccaagattcaggaaattattctaatgaagatgaaagcgaaagtaaaacaagtgaagaactacagcaggactttgtatgaccagaaatgaactgtgtcaagtataaggtttttcagcaggagttacactgggagcctgaggtcctcaccttcctctcagtaactacagagaggacgtttccctgtttagggaaagaaaaaacatcttcagatcataggtcctaaaaatacgggcaagctcttaactatttaaaaatgaaattacaggcccgggcacggtggctcacacctgtaatcccagcactttgggaggctgaggcaggcagatcatgaggtcaagagatcgagaccagcctggccaacgtggtgaaaccccatctctactaaaaatacaaaaattagccgggtgtggtggcgcgcgcctgttgtcttagctactcaggaggctgaggcaggagaatcgcttgaaaacaggaggtggaggttgcagtgagccgagatcacgccactgcactccagcctggtgacagcgtgagactctttaaaaaaagaaattaaaagagttgagacaaacgtttcctacattcttttccatgtgtaaaatcatgaaaaagcctgtcaccggacttgcattggatgagatgagtcagaccaaaacagtggccacccgtcttcctcctgtgagcctaagtgcagccgtgctagctgcgcaccgtggctaaggatgacgtctgtgttcctgtccatcactgatgctgctggctactgcatgtgccacacctgtctgttcgccattcctaacattctgtttcattcttcctcgggagatatttcaaacatttggtcttttcttttaacactgagggtaggcccttaggaaatttatttaggaaagtctgaacacgttatcacttggttttctggaaagtagcttaccctagaaaacagctgcaaatgccagaaagatgatccctaaaaatgttgagggacttctgttcattcatcccgagaacattggcttccacatcacagtatctacccttacatggtttaggattaaagccaggcaatcttttactatgcattaagaccctttgctatgtagtctcatggtctagcatgcatcttgtagaaacaaggcatgctggcagattgcagggttgagatgtgtttatctgtttatattttaaaagattctgccagaaaataaaaccagaccttgttctaaagcccaggttatggaccaactcagtgcttcaggtcttaatgcctccatacctcttcctcaccaactttactagtagctgagatttaatgggcactattatgctacatatcatgttaggtaaatctgactgactctttccccacctcctttggtgtgcttccctgaatgagtattaccccaggatgaggtctgcatcagcttagttagccattgatgcaatactagggaaagactaggaggatgagccagggtgctaataaggataagtgttggaccaaggttgctttgtttgcttaagaaggagtgactggtcaggttggccgtatccatatggagcgagcgagggcaaaaccgtaaggaccgtcttaaaaa

SEQ ID NO: 446542 - DNA, 830 bp, Homo sapiens
gttgacaagagacattccagcccaccacttcccaagtaaagaattaaaatgcagcatgatggctaaggcaagggcctgcagaagaatgtaaaggagggaggaagagcaggggattcagagcaggaaggaggagacagttactgtctatcccgcagacgtggtgctctttgaagggatcctggccttctactcccaggaggtacgagacctgttccagatgaagctttttgtggatacagatgcggacacccggctctcacgcagagtattaagggacatcagcgagagaggcagggatcttgagcagattttatctcagtacattacgttcgtcaagcctgcctttgaggaattctgcttgccaacaaagaagtatgctgatgtgatcatccctagaggtgcagataatctggtggccatcaacctcatcgtgcagcacatccaggacatcctgaatggagggccctccaaacggcagaccaatggctgtctcaacggctacaccccttcacgcaagaggcaggcatcggagtccagcagcaggccgcattgacccgtctccatcggaccccagcccctatctccaagagacagaggaggggtcaggaggcactgctcatctgtacatactgtttcctatgacattactgtatttaagaaaacaccatggagatgaaatgcctttgattttttttttctttttgtactttggaacgacaaaatgaaacagaacttgaccctgagcttaaataacaaaactgtgccaactactactggtgatgcctaattatgaatccaacgtgtaaccagttataaatacatatatatat

SEQ ID NO: 446543 - DNA, 719 bp, Homo sapiens
ctcgccgcctccgcctcggcgaatagcagcgcgctgcccgcccggattggagcagcagcatcacgctgacctctgcctgggatgtaaaccggaccagccgctgcgggcaaaggaaggctcttggctccttcgggaaacccagccccgtcaccgggctccgagcggctcgcaggcgagcgacagcggcctcagccccggcagcgcccagcggcggctgcggaaagcggagggagtccgacgcgggcgcgggcggggagcgtgcgtccgttcgcacaggcagcgggaggaggggcggcgcgaaccatggccggggacagcgagcagaccctgcagaaccaccagcagcccaacggcggcgagcccttccttataggcgtcagcgggggaacagctagcggcaagtcttccgtgtgtgctaagatcgtgcagctcctggggcagaatgaggtggactatcgccagaagcaggtggtcatcctgagccaggatagcttctaccgtgtccttacctcggagcagaaggccaaagccctgaagggccagttcaactttgaccacccggatgccctttgacaatgaaacctcattttcttcgaagaacatcttccaagagcaaaaattctactttgaaaacgggggcaacaataccgagggtctccccaacggatttcgccccccggcgtggttcatttggaacccttttatgggttcattccccc

SEQ ID NO: 446544 - DNA, 5172 bp, Homo sapiens
  misc_feature (5096)..(5096): n is a, c, g, or t
ctcgccgcctccgcctcggcgaatagcagcgcgctgcccgcccggattggagcagcagcatcacgctgacctctgcctgggatgtaaaccggaccagccgctgcgggcaaaggaaggctcttggctccttcgggaaacccagccccgtcaccgggctccgagcggctcgcaggcgagcgacagcggcctcagccccggcagcgcccagcggcggctgcggaaagcggagggagtccgacgcgggcgcgggcggggagcgtgcgtccgttcgcacaggcagcgggaggaggggcggcgcgaaccatggccggggacagcgagcagaccctgcagaaccaccagcagcccaacggcggcgagcccttccttataggcgtcagcgggggaacagctagcggcaagtcttccgtgtgtgctaagatcgtgcagctcctggggcagaatgaggtggactatcgccagaagcaggtggtcatcctgagccaggatagcttctaccgtgtccttacctcggagcagaaggccaaagccctgaagggccagttcaactttgaccacccggatgcctttgacaatgaactcattctcaaaacactcaaagaaatcactgaagggaaaacagtccagatccccgtgtatgactttgtctcccattcccggaaggaggagacagttactgtctatcccgcagacgtggtgctctttgaagggatcctggccttctactcccaggaggtacgagacctgttccagatgaagctttttgtggatacagatgcggacacccggctctcacgcagagtattaagggacatcagcgagagaggcagggatcttgagcagattttatctcagtacattacgttcgtcaagcctgcctttgaggaattctgcttgccaacaaagaagtatgctgatgtgatcatccctagaggtgcagataatctggtggccatcaacctcatcgtgcagcacatccaggacatcctgaatggagggccctccaaacggcagaccaatggctgtctcaacggctacaccccttcacgcaagaggcaggcatcggagtccagcagcaggccgcattgacccgtctccatcggaccccagcccctatctccaagagacagaggaggggtcaggaggcactgctcatctgtacatactgtttcctatgacattactgtatttaagaaaacaccatggagatgaaatgcctttgattttttttttctttttgtactttggaacgacaaaatgaaacagaacttgaccctgagcttaaataacaaaactgtgccaactactactggtgatgcctaattatgaatccaacgtgtaaccagttataaatacatatatatataaaaaaggatctatttttgtgtaaatgtacaaatactgtaaagctgttgccataagtattttgcaggagggtctgtacttgagtgttttaggactggagctggaatttcaccaaggggaaattgcctgttgtgtcccagggtggggaggctcgggcatctgtgagagacagggagggtggctaaggtccagttgcttttgagtgccccgtggaacttgatgggaatggggttggaacaccttgattgcctcctctgtcacatgccactcttggagctggagcttagtgatatgtcaatgagagatactcttgtcttttttttttttcttttcttttttttttggagttgaaattaggtaaaatctcaactcaaaaatcaaactcagggaagaggcccactgaggagaacaagtcttctgcattttcttcctgccctgctcccaccttctcgcctctggctgcttggatagctgtggtgactccttcctcaccctcctgcttctctgtctctccaagaagccagagctgcctctttccttccctggaagagattttatggggatcgcttcctgatagaagatgggaaggagagggcagaactttgcctgctgtcatatctgaagaatcacgggttctttctgcatcccaggggcgtaactgatctgactcctggggcttttcctgtatggtggaatatagaggggaccattgcaggctgggtgtgggtgagggcttcggtaactgatgccggcagcagcgcctcatggagtggcaggggagctctgtctgtggaggggtagtagtttccgcttcctggaggtttgcagtgaggtgaggagagtaactttggtcagggattctcactagcagcgtcatggccaggatgctttacttatttgcaataccacctagtggatatggcaactgcagagcataaaaggggctcggaaaagcagtttttacaaagtatttaaaaggagagtatttaaatcataggtacctaagttggagcctgaggttgaaatatttggggtggagatttctagctttcctgagagctgctgcttggtggtagtgttttctctggaagtacagattcctgacattctgggtggaggggagcccaagtgagcctgaaggagttctgattatagagtcccgagcctcagtttctgactgcagaagagccagagatgttcatttcattgttgaccaccctagtgcttggtggactgtgcccttagctatcccactgtggctgccattgccagaaacattttggagaaccttttcttcccattgctctcagagcctgttcgagccattcaggtaaattggtctccattattacctggtcacaccagattttcccccagactcagcaccatccagtctgattccccgtttctgggctcagtttgactctaaatctgttttgctattttaaaaagtcaaacctggtccccagcagagcttgccacccggagactttcaggagaccgtgcaggctctgaagggagctcccagtcacagcagccgcctacttggagcaagggaaggctcccaagatgcctcctttgaaagccggtgctcaccaagatcagttcaggatcaatcattatccttgtagtcatgccttgatcagttctgagatgaagcagggaatgcaggcctgggttagcatcctgaggacacagggcccctggccttgatggcactgggccgtgctcaggtgaagcccacccgtgtctgggagagccttggcttttcagtgggcagcatgctcaactttacttgaagctcccaggtgccaaaccatttagtgccttggctgtttatcccactgccttggaagatggactcctctcatctctgagcctttacctagctgcttcctcatctacctgtggtgttgggaccaagcctccaatatctctgaatagcccactcctagcttggaaacagctataagggctgccctgccccttgtcaaatgatcaccaattcttggtggcttggctggggacaatgaacagtgtctgctggggtctgtgacacactgtttctggaacaaggaagggatggaaggctctacccctccgtggcagcccagcatttggccaactctgtatctgaacttgagctttctatggaacaaacaatggtcttagttttttaagagcctctgggtctctgattccatggagagtcaggagtagaattagtggaccagaaaccatgacatttgccatctaggtactctgctgttcagggtggaggcacagatgagcagagtggggtgatgttggttgtatgtgcatagaagtcccctggctccagagccatccagtggtgcttggttctctcttcctgcccaggtattgtgtgtggaccaagtgtttaggaaacaagcatagaagcattatgtcacaggaaggcctggcctctcactccttcacactaatgagccttctactgacccaagtttctttttctcgggcagcctgggaccactatgagcagagagatgggagtctgtgtaagaaggatgcaagtatcctttgatttggagtggacagagcaggtccttgcaaaggcagtgggttaaacaacgggatgtctgtgggacaggccagggaaggagggcagagacagggtctccagttcaccttgccgcagaactagcctaatcgtccctgcttctggtcttggccacttggcaatcatggggaagttgactccccgcctcacttgggcttggagctggatactcgtggccacgcccaggataggttgccagagtttcattaggccgctgggtcgggctggaggcttgtgtacacctcggagcagtcgggcagcaggagggccggaagcctggttggtttgtatatgacctctcttgcccttgtgcactttccttgatttagcaaccttgacctgcactggccctcacagctgttggagggaagtagcctcttgcagggaaatattttcccctgccctggaatctcctatgtgcctgttaaagattccagggccaagaactcggcaggctgaggagcagctaggtaggtgggttatgcggttcaggactgcttctggaagggactgcctgtacttctgtaccaccgttgccctttacactttgctcagggcggggtgggggaagcattcaaacaaaacaaggaagggaactgtctggcaaagcataagtggatgcatccagagctcagtcccctttaatcttttgtctctgggcgttctgctgccttcctcataccggggactggcattccaggtcagcttggctgtggtcttagaggcagggagtgcctacccagtcctgcctcaggagcagggtgagtagctaaatacagacttaggcttttttttccccccttttaagatgcttgctcctctcccttttctttttaccaccctacctttattgttagtggttacaaagtgaccacatattatgtactttgctgtaaataaagacagacaaaaaggcaaaaaaaaaaaaaaaaaaaaaaaaaactgggggggaccaagagggggggggggaaaaagggcgatcgaacggggccacggcccaacagcggtcccggacccagtttccgggtccaagggggaaaaccggggggctcccccaataggggggagaggggaaaaaattgcgaaaagcgcgggcttaccgctagatgtgttcacacaaacacacacngacaacacaaaacgacggaccagaaagaacgaggggggacaacaactccaaaaacagaggggcgaaaacagataga

SEQ ID NO: 446545 - DNA, 5432 bp, Homo sapiens
ctcgccgcctccgcctcggcgaatagcagcgcgctgcccgcccggattggagcagcagcatcacgctgacctctgcctgggatgtaaaccggaccagccgctgcgggcaaaggaaggctcttggctccttcgggaaacccagccccgtcaccgggctccgagcggctcgcaggcgagcgacagcggcctcagccccggcagcgcccagcggcggctgcggaaagcggagggagtccgacgcgggcgcgggcggggagcgtgcgtccgttcgcacaggcagcgggaggaggggcggcgcgaaccatggccggggacagcgagcagaccctgcagaaccaccagcagcccaacggcggcgagcccttccttataggcgtcagcgggggaacagctagcggcaagtcttccgtgtgtgctaagatcgtgcagctcctggggcagaatgaggtggactatcgccagaagcaggtggtcatcctgagccaggatagcttctaccgtgtccttacctcggagcagaaggccaaagccctgaagggccagttcaactttgaccacccggatgcctttgacaatgaactcattctcaaaacactcaaagaaatcactgaagggaaaacagtccagatccccgtgtatgactttgtctcccattcccggaaggaggagacagttactgtctatcccgcagacgtggtgctctttgaagggatcctggccttctactcccaggaggtacgagacctgttccagatgaagctttttgtggatacagatgcggacacccggctctcacgcagagtattaagggacatcagcgagagaggcagggatcttgagcagattttatctcagtacattacgttcgtcaagcctgcctttgaggaattctgcttgccaacaaagaagtatgctgatgtgatcatccctagaggtgcagataatctggtggccatcaacctcatcgtgcagcacatccaggacatcctgaatggagggccctccaaacggcagaccaatggctgtctcaacggctacaccccttcacgcaagaggcaggcatcggagtccagcagcaggccgcattgacccgtctccatcggaccccagcccctatctccaagagacagaggaggggtcaggaggcactgctcatctgtacatactgtttcctatgacattactgtatttaagaaaacaccatggagatgaaatgcctttgattttttttttctttttgtactttggaacgacaaaatgaaacagaacttgaccctgagcttaaataacaaaactgtgccaactactactggtgatgcctaattatgaatccaacgtgtaaccagttataaatacatatatatataaaaaaggatctatttttgtgtaaatgtacaaatactgtaaagctgttgccataagtattttgcaggagggtctgtacttgagtgttttaggactggagctggaatttcaccaaggggaaattgcctgttgtgtcccagggtggggaggctcgggcatctgtgagagacagggagggtggctaaggtccagttgcttttgagtgccccgtggaacttgatgggaatggggttggaacaccttgattgcctcctctgtcacatgccactcttggagctggagcttagtgatatgtcaatgagagatactcttgtcttttttttttttcttttcttttttttttggagttgaaattaggtaaaatctcaactcaaaaatcaaactcagggaagaggcccactgaggagaacaagtcttctgcattttcttcctgccctgctcccaccttctcgcctctggctgcttggatagctgtggtgactccttcctcaccctcctgcttctctgtctctccaagaagccagagctgcctctttccttccctggaagagattttatggggatcgcttcctgatagaagatgggaaggagagggcagaactttgcctgctgtcatatctgaagaatcacgggttctttctgcatcccaggggcgtaactgatctgactcctggggcttttcctgtatggtggaatatagaggggaccattgcaggctgggtgtgggtgagggcttcggtaactgatgccggcagcagcgcctcatggagtggcaggggagctctgtctgtggaggggtagtagtttccgcttcctggaggtttgcagtgaggtgaggagagtaactttggtcagggattctcactagcagcgtcatggccaggatgctttacttatttgcaataccacctagtggatatggcaactgcagagcataaaaggggctcggaaaagcagtttttacaaagtatttaaaaggagagtatttaaatcataggtacctaagttggagcctgaggttgaaatatttggggtggagatttctagctttcctgagagctgctgcttggtggtagtgttttctctggaagtacagattcctgacattctgggtggaggggagcccaagtgagcctgaaggagttctgattatagagtcccgagcctcagtttctgactgcagaagagccagagatgttcatttcattgttgaccaccctagtgcttggtggactgtgcccttagctatcccactgtggctgccattgccagaaacattttggagaaccttttcttcccattgctctcagagcctgttcgagccattcaggtaaattggtctccattattacctggtcacaccagattttcccccagactcagcaccatccagtctgattccccgtttctgggctcagtttgactctaaatctgttttgctattttaaaaagtcaaacctggtccccagcagagcttgccacccggagactttcaggagaccgtgcaggctctgaagggagctcccagtcacagcagccgcctacttggagcaagggaaggctcccaagatgcctcctttgaaagccggtgctcaccaagatcagttcaggatcaatcattatccttgtagtcatgccttgatcagttctgagatgaagcagggaatgcaggcctgggttagcatcctgaggacacagggcccctggccttgatggcactgggccgtgctcaggtgaagcccacccgtgtctgggagagccttggcttttcagtgggcagcatgctcaactttacttgaagctcccaggtgccaaaccatttagtgccttggctgtttatcccactgccttggaagatggactcctctcatctctgagcctttacctagctgcttcctcatctacctgtggtgttgggaccaagcctccaatatctctgaatagcccactcctagcttggaaacagctataagggctgccctgccccttgtcaaatgatcaccaattcttggtggcttggctggggacaatgaacagtgtctgctggggtctgtgacacactgtttctggaacaaggaagggatggaaggctctacccctccgtggcagcccagcatttggccaactctgtatctgaacttgagctttctatggaacaaacaatggtcttagttttttaagagcctctgggtctctgattccatggagagtcaggagtagaattagtggaccagaaaccatgacatttgccatctaggtactctgctgttcagggtggaggcacagatgagcagagtggggtgatgttggttgtatgtgcatagaagtcccctggctccagagccatccagtggtgcttggttctctcttcctgcccaggtattgtgtgtggaccaagtgtttaggaaacaagcatagaagcattatgtcacaggaaggcctggcctctcactccttcacactaatgagccttctactgacccaagtttctttttctcgggcagcctgggaccactatgagcagagagatgggagtctgtgtaagaaggatgcaagtatcctttgatttggagtggacagagcaggtccttgcaaaggcagtgggttaaacaacgggatgtctgtgggacaggccagggaaggagggcagagacagggtctccagttcaccttgccgcagaactagcctaatcgtccctgcttctggtcttggccacttggcaatcatggggaagttgactccccgcctcacttgggcttggagctggatactcgtggccacgcccaggataggttgccagagtttcattaggccgctgggtcgggctggaggcttgtgtacacctcggagcagtcgggcagcaggagggccggaagcctggttggtttgtatatgacctctcttgcccttgtgcactttccttgatttagcaaccttgacctgcactggccctcacagctgttggagggaagtagcctcttgcagggaaatattttcccctgccctggaatctcctatgtgcctgttaaagattccagggccaagaactcggcaggctgaggagcagctaggtaggtgggttatgcggttcaggactgcttctggaagggactgcctgtacttctgtaccaccgttgccctttacactttgctcagggcggggtgggggaagcattcaaacaaaacaaggaagggaactgtctggcaaagcataagtggatgcatccagagctcagtcccctttaatcttttgtctctgggcgttctgctgccttcctcataccggggactggcattccaggtcagcttggctgtggtcttagaggcagggagtgcctacccagtcctgcctcaggagcagggtgagtagctaaatacagacttaggcttttttttccccccttttaagatgcttgctcctctcccttttctttttaccaccctacctttattgttagtggttacaaagtgaccacatattatgtactttgctgtaaataaagacagacaaaaaggcaaaaacccaaacacacaacaacaaaaataaaaaaacaacaaaatcatacaacgaaaaaaaaaaacaaagaggcggggcacccaacaaatacacacacacgacgggcccgcacaagcacccaacccacaccctatcttgcaccaagggcagccccataagggagcgacactaatcaaaacgaccagcggcgggcccgacaaccaacactcgatggcgaaacacccgcacacgtgcatcaccttggcagaagaacccctaccccgcggccgaccagaaacaggcgcacgacaacacacgagagtgtaaagccccgaggcggcaacaaccagcagcgcgactgggtgaacaacccagctactactagcggagactactgcaccggggtctttgagcctatccgcggtcgcaacaggagctgcaacagaccactgcaccaccgaccgggcagaccggcagagcagcagcgaagctagcaggtacagcaggaggcgacgggggagcgcccacaagggcgaccagaccccacccggcacacagaccgacagcgag

SEQ ID NO: 446546 - DNA, 5415 bp, Homo sapiens
  misc_feature (5339)..(5339): n is a, c, g, or t
cctaagtggtatattatgccaggtatgactccttgcacattctgggctagtagttgctcaataaatttgttgttgttttttaaaaactctgagctgttatgacagtttttagacctgcgtttggacttgggaaatgattaattctaacttcttaaggcaccaccaacaaattaggcagttaattttctccttccgaaggaaaaccacttttcctttttagtatttatcagttaggcatcctaaaatgctcttaatatctagtgtcagtacagattgaacatccctaatctaaaaacccaaaatgtgaaatgctccaaaatctgaaactttttgagtgccagtgtgacgttcaaaggaaatgctcattggagcatttcagattttggattttcatgttagggaggctcattgtagatcctctctccccctgccatattagggatgccctaaatataatgcagatattccaaaatctgaaaaaaatccaaaattcaaaaattctaaacacctaagcatttcatataagggatacttaacctggatatgtaaacttagtgcagccattgtgttctctgttagtgtgttcaagtggactcttgcacatacattcactttatttttggacaaagccttcccacactctccttggtgtaggggagttgcctagagagtggctcactatttcacttacccattggttctgttttctgaacttctctaggttgccttcttatgcacaatgacaatgggcacaccattttctggcagctgacattcctctagactggtgcttctctaccctggctgcatgttagaaatatcttgggagcttctaaatagtgttgaagttctagctccacttcagactcattaaatcagagctccttgggggtaggatccaggaaggaggagacagttactgtctatcccgcagacgtggtgctctttgaagggatcctggccttctactcccaggaggtacgagacctgttccagatgaagctttttgtggatacagatgcggacacccggctctcacgcagagtattaagggacatcagcgagagaggcagggatcttgagcagattttatctcagtacattacgttcgtcaagcctgcctttgaggaattctgcttgccaacaaagaagtatgctgatgtgatcatccctagaggtgcagataatctggtggccatcaacctcatcgtgcagcacatccaggacatcctgaatggagggccctccaaacggcagaccaatggctgtctcaacggctacaccccttcacgcaagaggcaggcatcggagtccagcagcaggccgcattgacccgtctccatcggaccccagcccctatctccaagagacagaggaggggtcaggaggcactgctcatctgtacatactgtttcctatgacattactgtatttaagaaaacaccatggagatgaaatgcctttgattttttttttctttttgtactttggaacgacaaaatgaaacagaacttgaccctgagcttaaataacaaaactgtgccaactactactggtgatgcctaattatgaatccaacgtgtaaccagttataaatacatatatatataaaaaaggatctatttttgtgtaaatgtacaaatactgtaaagctgttgccataagtattttgcaggagggtctgtacttgagtgttttaggactggagctggaatttcaccaaggggaaattgcctgttgtgtcccagggtggggaggctcgggcatctgtgagagacagggagggtggctaaggtccagttgcttttgagtgccccgtggaacttgatgggaatggggttggaacaccttgattgcctcctctgtcacatgccactcttggagctggagcttagtgatatgtcaatgagagatactcttgtcttttttttttttcttttcttttttttttggagttgaaattaggtaaaatctcaactcaaaaatcaaactcagggaagaggcccactgaggagaacaagtcttctgcattttcttcctgccctgctcccaccttctcgcctctggctgcttggatagctgtggtgactccttcctcaccctcctgcttctctgtctctccaagaagccagagctgcctctttccttccctggaagagattttatggggatcgcttcctgatagaagatgggaaggagagggcagaactttgcctgctgtcatatctgaagaatcacgggttctttctgcatcccaggggcgtaactgatctgactcctggggcttttcctgtatggtggaatatagaggggaccattgcaggctgggtgtgggtgagggcttcggtaactgatgccggcagcagcgcctcatggagtggcaggggagctctgtctgtggaggggtagtagtttccgcttcctggaggtttgcagtgaggtgaggagagtaactttggtcagggattctcactagcagcgtcatggccaggatgctttacttatttgcaataccacctagtggatatggcaactgcagagcataaaaggggctcggaaaagcagtttttacaaagtatttaaaaggagagtatttaaatcataggtacctaagttggagcctgaggttgaaatatttggggtggagatttctagctttcctgagagctgctgcttggtggtagtgttttctctggaagtacagattcctgacattctgggtggaggggagcccaagtgagcctgaaggagttctgattatagagtcccgagcctcagtttctgactgcagaagagccagagatgttcatttcattgttgaccaccctagtgcttggtggactgtgcccttagctatcccactgtggctgccattgccagaaacattttggagaaccttttcttcccattgctctcagagcctgttcgagccattcaggtaaattggtctccattattacctggtcacaccagattttcccccagactcagcaccatccagtctgattccccgtttctgggctcagtttgactctaaatctgttttgctattttaaaaagtcaaacctggtccccagcagagcttgccacccggagactttcaggagaccgtgcaggctctgaagggagctcccagtcacagcagccgcctacttggagcaagggaaggctcccaagatgcctcctttgaaagccggtgctcaccaagatcagttcaggatcaatcattatccttgtagtcatgccttgatcagttctgagatgaagcagggaatgcaggcctgggttagcatcctgaggacacagggcccctggccttgatggcactgggccgtgctcaggtgaagcccacccgtgtctgggagagccttggcttttcagtgggcagcatgctcaactttacttgaagctcccaggtgccaaaccatttagtgccttggctgtttatcccactgccttggaagatggactcctctcatctctgagcctttacctagctgcttcctcatctacctgtggtgttgggaccaagcctccaatatctctgaatagcccactcctagcttggaaacagctataagggctgccctgccccttgtcaaatgatcaccaattcttggtggcttggctggggacaatgaacagtgtctgctggggtctgtgacacactgtttctggaacaaggaagggatggaaggctctacccctccgtggcagcccagcatttggccaactctgtatctgaacttgagctttctatggaacaaacaatggtcttagttttttaagagcctctgggtctctgattccatggagagtcaggagtagaattagtggaccagaaaccatgacatttgccatctaggtactctgctgttcagggtggaggcacagatgagcagagtggggtgatgttggttgtatgtgcatagaagtcccctggctccagagccatccagtggtgcttggttctctcttcctgcccaggtattgtgtgtggaccaagtgtttaggaaacaagcatagaagcattatgtcacaggaaggcctggcctctcactccttcacactaatgagccttctactgacccaagtttctttttctcgggcagcctgggaccactatgagcagagagatgggagtctgtgtaagaaggatgcaagtatcctttgatttggagtggacagagcaggtccttgcaaaggcagtgggttaaacaacgggatgtctgtgggacaggccagggaaggagggcagagacagggtctccagttcaccttgccgcagaactagcctaatcgtccctgcttctggtcttggccacttggcaatcatggggaagttgactccccgcctcacttgggcttggagctggatactcgtggccacgcccaggataggttgccagagtttcattaggccgctgggtcgggctggaggcttgtgtacacctcggagcagtcgggcagcaggagggccggaagcctggttggtttgtatatgacctctcttgcccttgtgcactttccttgatttagcaaccttgacctgcactggccctcacagctgttggagggaagtagcctcttgcagggaaatattttcccctgccctggaatctcctatgtgcctgttaaagattccagggccaagaactcggcaggctgaggagcagctaggtaggtgggttatgcggttcaggactgcttctggaagggactgcctgtacttctgtaccaccgttgccctttacactttgctcagggcggggtgggggaagcattcaaacaaaacaaggaagggaactgtctggcaaagcataagtggatgcatccagagctcagtcccctttaatcttttgtctctgggcgttctgctgccttcctcataccggggactggcattccaggtcagcttggctgtggtcttagaggcagggagtgcctacccagtcctgcctcaggagcagggtgagtagctaaatacagacttaggcttttttttccccccttttaagatgcttgctcctctcccttttctttttaccaccctacctttattgttagtggttacaaagtgaccacatattatgtactttgctgtaaataaagacagacaaaaaggcaaaaaaaaaaaaaaaaaaaaaaaaaactgggggggaccaagagggggggggggaaaaagggcgatcgaacggggccacggcccaacagcggtcccggacccagtttccgggtccaagggggaaaaccggggggctcccccaataggggggagaggggaaaaaattgcgaaaagcgcgggcttaccgctagatgtgttcacacaaacacacacngacaacacaaaacgacggaccagaaagaacgaggggggacaacaactccaaaaacagaggggcgaaaacagataga

SEQ ID NO: 446547 - DNA, 5140 bp, Homo sapiens
  misc_feature (5064)..(5064): n is a, c, g, or t
tgtggccactttgttggtttggggtagagccagaccagacagacgtcgggattctgtacttcctcacaaatgctttctcgtctgtatcctctttcccaaaacttttctttattttccctccttcccttccccttctgtcctttcctccctcctttcaattgcctcaggactggcggggaggggatggagttgttgagagaaaactgtgagtttctgtttttaaagttcagagtgttaggttccataaatgccaggccatgagagcattcctggagacgccttcagagaaaaaaagaaatcacatctgtttttgtctgcctttattcttcattcaacagcaggtttttttaattccaaggagaaggatgtctgccgtgtatttctgtttcatggtgaaagctcagaagtggtcaaaggagacctttgtcccggccgtgatcacccttggctctttggtggtggtccgagggctctgtaagaccatattagccaagtctttagcccccgcttgaagtctgtgggggcaaggaacccagaacccagcccagccagatgttctggcccttgttctctgtcccttgctagcccctgcctggcttggcccattatctgctctgtgctttgcaggaaggaggagacagttactgtctatcccgcagacgtggtgctctttgaagggatcctggccttctactcccaggaggtacgagacctgttccagatgaagctttttgtggatacagatgcggacacccggctctcacgcagagtattaagggacatcagcgagagaggcagggatcttgagcagattttatctcagtacattacgttcgtcaagcctgcctttgaggaattctgcttgccaacaaagaagtatgctgatgtgatcatccctagaggtgcagataatctggtggccatcaacctcatcgtgcagcacatccaggacatcctgaatggagggccctccaaacggcagaccaatggctgtctcaacggctacaccccttcacgcaagaggcaggcatcggagtccagcagcaggccgcattgacccgtctccatcggaccccagcccctatctccaagagacagaggaggggtcaggaggcactgctcatctgtacatactgtttcctatgacattactgtatttaagaaaacaccatggagatgaaatgcctttgattttttttttctttttgtactttggaacgacaaaatgaaacagaacttgaccctgagcttaaataacaaaactgtgccaactactactggtgatgcctaattatgaatccaacgtgtaaccagttataaatacatatatatataaaaaaggatctatttttgtgtaaatgtacaaatactgtaaagctgttgccataagtattttgcaggagggtctgtacttgagtgttttaggactggagctggaatttcaccaaggggaaattgcctgttgtgtcccagggtggggaggctcgggcatctgtgagagacagggagggtggctaaggtccagttgcttttgagtgccccgtggaacttgatgggaatggggttggaacaccttgattgcctcctctgtcacatgccactcttggagctggagcttagtgatatgtcaatgagagatactcttgtcttttttttttttcttttcttttttttttggagttgaaattaggtaaaatctcaactcaaaaatcaaactcagggaagaggcccactgaggagaacaagtcttctgcattttcttcctgccctgctcccaccttctcgcctctggctgcttggatagctgtggtgactccttcctcaccctcctgcttctctgtctctccaagaagccagagctgcctctttccttccctggaagagattttatggggatcgcttcctgatagaagatgggaaggagagggcagaactttgcctgctgtcatatctgaagaatcacgggttctttctgcatcccaggggcgtaactgatctgactcctggggcttttcctgtatggtggaatatagaggggaccattgcaggctgggtgtgggtgagggcttcggtaactgatgccggcagcagcgcctcatggagtggcaggggagctctgtctgtggaggggtagtagtttccgcttcctggaggtttgcagtgaggtgaggagagtaactttggtcagggattctcactagcagcgtcatggccaggatgctttacttatttgcaataccacctagtggatatggcaactgcagagcataaaaggggctcggaaaagcagtttttacaaagtatttaaaaggagagtatttaaatcataggtacctaagttggagcctgaggttgaaatatttggggtggagatttctagctttcctgagagctgctgcttggtggtagtgttttctctggaagtacagattcctgacattctgggtggaggggagcccaagtgagcctgaaggagttctgattatagagtcccgagcctcagtttctgactgcagaagagccagagatgttcatttcattgttgaccaccctagtgcttggtggactgtgcccttagctatcccactgtggctgccattgccagaaacattttggagaaccttttcttcccattgctctcagagcctgttcgagccattcaggtaaattggtctccattattacctggtcacaccagattttcccccagactcagcaccatccagtctgattccccgtttctgggctcagtttgactctaaatctgttttgctattttaaaaagtcaaacctggtccccagcagagcttgccacccggagactttcaggagaccgtgcaggctctgaagggagctcccagtcacagcagccgcctacttggagcaagggaaggctcccaagatgcctcctttgaaagccggtgctcaccaagatcagttcaggatcaatcattatccttgtagtcatgccttgatcagttctgagatgaagcagggaatgcaggcctgggttagcatcctgaggacacagggcccctggccttgatggcactgggccgtgctcaggtgaagcccacccgtgtctgggagagccttggcttttcagtgggcagcatgctcaactttacttgaagctcccaggtgccaaaccatttagtgccttggctgtttatcccactgccttggaagatggactcctctcatctctgagcctttacctagctgcttcctcatctacctgtggtgttgggaccaagcctccaatatctctgaatagcccactcctagcttggaaacagctataagggctgccctgccccttgtcaaatgatcaccaattcttggtggcttggctggggacaatgaacagtgtctgctggggtctgtgacacactgtttctggaacaaggaagggatggaaggctctacccctccgtggcagcccagcatttggccaactctgtatctgaacttgagctttctatggaacaaacaatggtcttagttttttaagagcctctgggtctctgattccatggagagtcaggagtagaattagtggaccagaaaccatgacatttgccatctaggtactctgctgttcagggtggaggcacagatgagcagagtggggtgatgttggttgtatgtgcatagaagtcccctggctccagagccatccagtggtgcttggttctctcttcctgcccaggtattgtgtgtggaccaagtgtttaggaaacaagcatagaagcattatgtcacaggaaggcctggcctctcactccttcacactaatgagccttctactgacccaagtttctttttctcgggcagcctgggaccactatgagcagagagatgggagtctgtgtaagaaggatgcaagtatcctttgatttggagtggacagagcaggtccttgcaaaggcagtgggttaaacaacgggatgtctgtgggacaggccagggaaggagggcagagacagggtctccagttcaccttgccgcagaactagcctaatcgtccctgcttctggtcttggccacttggcaatcatggggaagttgactccccgcctcacttgggcttggagctggatactcgtggccacgcccaggataggttgccagagtttcattaggccgctgggtcgggctggaggcttgtgtacacctcggagcagtcgggcagcaggagggccggaagcctggttggtttgtatatgacctctcttgcccttgtgcactttccttgatttagcaaccttgacctgcactggccctcacagctgttggagggaagtagcctcttgcagggaaatattttcccctgccctggaatctcctatgtgcctgttaaagattccagggccaagaactcggcaggctgaggagcagctaggtaggtgggttatgcggttcaggactgcttctggaagggactgcctgtacttctgtaccaccgttgccctttacactttgctcagggcggggtgggggaagcattcaaacaaaacaaggaagggaactgtctggcaaagcataagtggatgcatccagagctcagtcccctttaatcttttgtctctgggcgttctgctgccttcctcataccggggactggcattccaggtcagcttggctgtggtcttagaggcagggagtgcctacccagtcctgcctcaggagcagggtgagtagctaaatacagacttaggcttttttttccccccttttaagatgcttgctcctctcccttttctttttaccaccctacctttattgttagtggttacaaagtgaccacatattatgtactttgctgtaaataaagacagacaaaaaggcaaaaaaaaaaaaaaaaaaaaaaaaaactgggggggaccaagagggggggggggaaaaagggcgatcgaacggggccacggcccaacagcggtcccggacccagtttccgggtccaagggggaaaaccggggggctcccccaataggggggagaggggaaaaaattgcgaaaagcgcgggcttaccgctagatgtgttcacacaaacacacacngacaacacaaaacgacggaccagaaagaacgaggggggacaacaactccaaaaacagaggggcgaaaacagataga

SEQ ID NO: 446548 - DNA, 3881 bp, Homo sapiens
ctcgccgcctccgcctcggcgaatagcagcgcgctgcccgcccggattggagcagcagcatcacgctgacctctgcctgggatgtaaaccggaccagccgctgcgggcaaaggaaggctcttggctccttcgggaaacccagccccgtcaccgggctccgagcggctcgcaggcgagcgacagcggcctcagccccggcagcgcccagcggcggctgcggaaagcggagggagtccgacgcgggcgcgggcggggagcgtgcgtccgttcgcacaggcagcgggaggaggggcggcgcgaaccatggccggggacagcgagcagaccctgcagaaccaccagcagcccaacggcggcgagcccttccttataggcgtcagcgggggaacagctagcggcaagtcttccgtgtgtgctaagatcgtgcagctcctggggcagaatgaggtggactatcgccagaagcaggtggtcatcctgagccaggatagcttctaccgtgtccttacctcggagcagaaggccaaagccctgaagggccagttcaactttgaccacccggatgcctttgacaatgaactcattctcaaaacactcaaagaaatcactgaagggaaaacagtccagatccccgtgtatgactttgtctcccattcccggaaggaggagacagttactgtctatcccgcagacgtggtgctctttgaagggatcctggccttctactcccaggaggtacgagacctgttccagatgaagctttttgtggatacagatgcggacacccggctctcacgcagagtattaagggacatcagcgagagaggcagggatcttgagcagattttatctcagtacattacgttcgtcaagcctgcctttgaggaattctgcttgccaacaaagaagtatgctgatgtgatcatccctagaggtgcagataatctggtggccatcaacctcatcgtgcagcacatccaggacatcctgaatggagggccctccaaacggcagaccaatggctgtctcaacggctacaccccttcacgcaagaggcaggcatcggagtccagcagcaggccgcattgacccgtctccatcggaccccagcccctatctccaagagacagaggaggggtcaggaggcactgctcatctgtacatactgtttcctatgacattactgtatttaagaaaacaccatggagatgaaatgcctttgattttttttttctttttgtactttggaacgacaaaatgaaacagaacttgaccctgagcttaaataacaaaactgtgccaactactactggtgatgcctaattatgaatccaacgtgtaaccagttataaatacatatatatataaaaaaggatctatttttgtgtaaatgtacaaatactgtaaagctgttgccataagtattttgcaggagggtctgtacttgagtgttttaggactggagctggaatttcaccaaggggaaattgcctgttgtgtcccagggtggggaggctcgggcatctgtgagagacagggagggtggctaaggtccagttgcttttgagtgccccgtggaacttgatgggaatggggttggaacaccttgattgcctcctctgtcacatgccactcttggagctggagcttagtgatatgtcaatgagagatactcttgtcttttttttttttcttttcttttttttttggagttgaaattaggtaaaatctcaactcaaaaatcaaactcagggaagaggcccactgaggagaacaagtcttctgcattttcttcctgccctgctcccaccttctcgcctctggctgcttggatagctgtggtgactccttcctcaccctcctgcttctctgtctctccaagaagccagagctgcctctttccttccctggaagagattttatggggatcgcttcctgatagaagatgggaaggagagggcagaactttgcctgctgtcatatctgaagaatcacgggttctttctgcatcccaggggcgtaactgatctgactcctggggcttttcctgtatggtggaatatagaggggaccattgcaggctgggtgtgggtgagggcttcggtaactgatgccggcagcagcgcctcatggagtggcaggggagctctgtctgtggaggggtagtagtttccgcttcctggaggtttgcagtgaggtgaggagagtaactttggtcagggattctcactagcagcgtcatggccaggatgctttacttatttgcaataccacctagtggatatggcaactgcagagcataaaaggggctcggaaaagcagtttttacaaagtatttaaaaggagagtatttaaatcataggtacctaagttggagcctgaggttgaaatatttggggtggagatttctagctttcctgagagctgctgcttggtggtagtgttttctctggaagtacagattcctgacattctgggtggaggggagcccaagtgagcctgaaggagttctgattatagagtcccgagcctcagtttctgactgcagaagagccagagatgttcatttcattgttgaccaccctagtgcttggtggactgtgcccttagctatcccactgtggctgccattgccagaaacattttggagaaccttttcttcccattgctctcagagcctgttcgagccattcaggtaaattggtctccattattacctggtcacaccagattttcccccagactcagcaccatccagtctgattccccgtttctgggctcagtttgactctaaatctgttttgctattttaaaaagtcaaacctggtccccagcagagcttgccacccggagactttcaggagaccgtgcaggctctgaagggagctcccagtcacagcagccgcctacttggagcaagggaaggctcccaagatgcctcctttgaaagccggtgctcaccaagatcagttcaggatcaatcattatccttgtagtcatgccttgatcagttctgagatgaagcagggaatgcaggcctgggttagcatcctgaggacacagggcccctggccttgatggcactgggccgtgctcaggtgaagcccacccgtgtctgggagagccttggcttttcagtgggcagcatgctcaactttacttgaagctcccaggtgccaaaccatttagtgccttggctgtttatcccactgccttggaagatggactcctctcatctctgagcctttacctagctgcttcctcatctacctgtggtgttgggaccaagcctccaatatctctgaatagcccactcctagcttggaaacagctataagggctgccctgccccttgtcaaatgatcaccaattcttggtggcttggctggggacaatgaacagtgtctgctggggtctgtgacacactgtttctggaacaaggaagggatggaaggctctacccctccgtggcagcccagcatttggccaactctgtatctgaacttgagctttctatggaacaaacaatggtcttagttttttaagagcctctgggtctctgattccatggagagtcaggagtagaattagtggaccagaaaccatgacatttgccatctaggtactctgctgttcagggtggaggcacagatgagcagagtggggtgatgttggttgtatgtgcatagaagtcccctggctccagagccatccagtggtgcttggttctctcttcctgcccaggtattgtgtgtggaccaagtgtttaggaaacaagcatttgggagaaccttttcttcccattgctctcagagcctgttcgagccattcaggtaaatgggtctccattattacctggtcacaccagattttcccccaga

SEQ ID NO: 446549 - DNA, 1695 bp, Homo sapiens
ctcgccgcctccgcctcggcgaatagcagcgcgctgcccgcccggattggagcagcagcatcacgctgacctctgcctgggatgtaaaccggaccagccgctgcgggcaaaggaaggctcttggctccttcgggaaacccagccccgtcaccgggctccgagcggctcgcaggcgagcgacagcggcctcagccccggcagcgcccagcggcggctgcggaaagcggagggagtccgacgcgggcgcgggcggggagcgtgcgtccgttcgcacaggcagcgggaggaggggcggcgcgaaccatggccggggacagcgagcagaccctgcagaaccaccagcagcccaacggcggcgagcccttccttataggcgtcagcgggggaacagctagcggcaagtcttccgtgtgtgctaagatcgtgcagctcctggggcagaatgaggtggactatcgccagaagcaggtggtcatcctgagccaggatagcttctaccgtgtccttacctcggagcagaaggccaaagccctgaagggccagttcaactttgaccacccggatgcctttgacaatgaactcattctcaaaacactcaaagaaatcactgaagggaaaacagtccagatccccgtgtatgactttgtctcccattcccggaaggaggagacagttactgtctatcccgcagacgtggtgctctttgaagggatcctggccttctactcccaggaggtacgagacctgttccagatgaagctttttgtggatacagatgcggacacccggctctcacgcagagtattaagggacatcagcgagagaggcagggatcttgagcagattttatctcagtacattacgttcgtcaagcctgcctttgaggaattctgcttgccaacaaagaagtatgctgatgtgatcatccctagaggtgcagataatctggtggccatcaacctcatcgtgcagcacatccaggacatcctgaatggagggccctccaaacggcagaccaatggctgtctcaacggctacaccccttcacgcaagaggcaggcatcggagtccagcagcaggccgcattgacccgtctccatcggaccccagcccctatctccaagagacagaggaggggtcaggaggcactgctcatctgtacatactgtttcctatgacattactgtatttaagaaaacaccatggagatgaaatgcctttgattttttttttctttttgtactttggaacgacaaaatgaaacagaacttgaccctgagcttaaataacaaaactgtgccaactaaaaaaccatccaaagccagtgttgcactatggtttcatcagaacaacgattcagcaggacctcacacagaaactatcagtaacatcaacagaacttcccacgggcaccacaccttgacacttccatcacaattgtagcccaggcacttgcttcagacaaactcgcacaccgaaacattatacacgcttattgcaggaacttcacaagagggttccctccttcccaagcaaggaccccaacaacgtcttgaaatgggaaccaagaccacatagcacatagggcgaccctgcaatccacaaccccaatctggcttccaccatgtactaccggctccgaccccctgcacccgcggacatcacctcacagcatcacctgtcgccatacttaca

SEQ ID NO: 446550 - DNA, 449 bp, Homo sapiens
acttttctttattttccctccttcccttccccttctgtcctttcctccctcctttcaattgcctcaggactggcggggaggggatggagttgttgagagaaaactgtgagtttctgtttttaaagttcagagtgttaggttccataaatgccaggccatgagagcattcctggagacgccttcagagaaaaaaagaaatcacatctgtttttgtctgcctttattcttcattcaacagcaggtttttttaattccaaggagaaggatgtctgccgtgtatttctgtttcatggtgaaagctcagaagtggtcaaaggagacctttgtcccggccgtgatcacccttggctctttggtggtggtccgagggctctgtaagaccatattagccaagtctttagcccccgcttgaagtctgtgggggcaaggaacccagaacccagcccagc

SEQ ID NO: 446551 - DNA, 513 bp, Homo sapiens
aagctcagaagtggtcaaaggagacctttgtcccggccgtgatcacccttggctctttggtggtggtccgagggctctgtaagaccatattagccaagtctttagcccccgcttgaagtctgtgggggcaaggaacccagaacccagcccagccagatgttctggcccttgttctctgtcccttgctagcccctgcctggcttggcccattatctgctctgtgctttgcaggaaggaggagacagttactgtctatcccgcagacgtggtgctctttgaagggatcctggccttctactcccaggaggtacgagacctgttccagatgaagctttttgtggatacagatgcggacacccggctctcacgcagaggtgcgttctaaaagcctcaggtggccctgttggtggccaccttgagggcgggggagctgggagcctgtgacaggaccccacccgcctgagtctgaagcccatgccttccctgaggcagctgtgtgtcgcatggtccagc

SEQ ID NO: 446552 - DNA, 1366 bp, Homo sapiens
ctcgccgcctccgcctcggcgaatagcagcgcgctgcccgcccggattggagcagcagcatcacgctgacctctgcctgggatgtaaaccggaccagccgctgcgggcaaaggaaggctcttggctccttcgggaaacccagccccgtcaccgggctccgagcggctcgcaggcgagcgacagcggcctcagccccggcagcgcccagcggcggctgcggaaagcggagggagtccgacgcgggcgcgggcggggagcgtgcgtccgttcgcacaggcagcgggaggaggggcggcgcgaaccatggccggggacagcgagcagaccctgcagaaccaccagcagcccaacggcggcgagcccttccttataggcgtcagcgggggaacagctagcggcaagtcttccgtgtgtgctaagatcgtgcagctcctggggcagaatgaggtggactatcgccagaagcaggtggtcatcctgagccaggatagcttctaccgtgtccttacctcggagcagaaggccaaagccctgaagggccagttcaactttgaccacccggatgcctttgacaatgaactcattctcaaaacactcaaagaaatcactgaagggaaaacagtccagatccccgtgtatgactttgtctcccattcccggaaggaggagacagttactgtctatcccgcagacgtggtgctctttgaagggatcctggccttctactcccaggaggtacgagacctgttccagatgaagctttttgtggatacagatgcggacacccggctctcacgcagagtattaagggacatcagcgagagaggcagggatcttgagcagattttatctcagtacattacgttcgtcaagcctgcctttgaggaattctgcttgccaacaaagaagtatgctgatgtgatcatccctagaggtgcagataatctggtggccatcaacctcatcgtgcagcacatccaggacatcctgaatggagggccctccaaacggcagaccaatggctgtctcaacggctacaccccttcacgcaagaggcaggcatcggagtccagcagcaggccgcattgacccgtctccatcggaccccagcccctatctccaagagacagaggaggggtcaggaggcactgctcatctgtacatactgtttcctatgacattactgtatttaagaaaacaccatggagatgaaatgcctttgattttttttttctttttgtactttggaacgacaaaatgaaacagaacttgaccctgagcttaaataacaaaactgtgccaactactactggtgatgcctaattatgaatccaacgtgtaaccagttataaatacatatatatat

SEQ ID NO: 446553 - DNA, 437 bp, Homo sapiens
cttgcagattccttccttcaaacaaggcttgtctgtgtgactccgcattcagcctcacctcctgtgttcactccagctccctgcctgggtctgggcaagtccctacctgagcatcctgtcatgctttgctacctggcgtgtcactgactttgaggaattctgcttgccaacaaagaagtatgctgatgtgatcatccctagaggtgcagataatctggtggccatcaacctcatcgtgcagcacatccaggacatcctgaatggagggccctccgggccattcaacgcctccgggccattcaacgcctccgggccattcaacgcctccgggccattcaacgcctccgggccattcaacgcctccgggccattcaacgcctccgggccattcaacgcctccggccattcaaggggatcctgctagagcgaccggcagc

SEQ ID NO: 446554 - DNA, 4312 bp, Homo sapiens
  misc_feature (4236)..(4236): n is a, c, g, or t
ctcgccgcctccgcctcggcgaatagcagcgcgctgcccgcccggattggagcagcagcatcacgctgacctctgcctgggatgtaaaccggaccagccgctgcgggcaaaggaaggctcttggctccttcgggaaacccagccccgtcaccgggctccgagcggctcgcaggcgagcgacagcggcctcagccccggcagcgcccagcggcggctgcggaaagcggagggagtccgacgcgggcgcgggcggggagcgtgcgtccgttcgcacaggcagcgggaggaggggcggcgcgaaccatggccggggacagcgagcagaccctgcagaaccaccagcagcccaacggcggcgagcccttccttataggcgtcagcgggggaacagctagcggcaagtcttccgtgtgtgctaagatcgtgcagctcctggggcagaatgaggtggactatcgccagaagcaggtggtcatcctgagccaggatagcttctaccgtgtccttacctcggagcagaaggccaaagccctgaagggccagttcaactttgaccacccggatgcctttgacaatgaactcattctcaaaacactcaaagaaatcactgaagggaaaacagtccagatccccgtgtatgactttgtctcccattcccggaaggaggagacagttactgtctatcccgcagacgtggtgctctttgaagggatcctggccttctactcccaggaggtacgagacctgttccagatgaagctttttgtggatacagatgcggacacccggctctcacgcagagtattaagggacatcagcgagagaggcagggatcttgagcagattttatctcagtacattacgttcgtcaagcctgcctttgaggaattctgcttgccaacaaagaagtatgctgatgtgatcatccctagaggtgcagataatctggtggccatcaacctcatcgtgcagcacatccaggacatcctgaatggagggccctccaaacggcagaccaatggctgtctcaacggctacaccccttcacgcaagaggcaggcatcggagtccagcagcaggccgcattgacccgtctccatcggaccccagcccctatctccaagagacagaggaggggtcaggaggcactgctcatctgtacatactgtttcctatgacattactgtatttaagaaaacaccatggagatgaaatgcctttgattttttttttctttttgtactttggaacgacaaaatgaaacagaacttgaccctgagcttaaataacaaaactgtgccaactactactggtgatgcctaattatgaatccaacgtgtaaccagttataaatacatatatatataaaaaaggatctatttttgtgtaaatgtacaaatactgtaaagctgttgccataagtattttgcaggagggtctgtacttgagtgttttaggactggagctggaatttcaccaaggggaaattgcctgttgtgtcccagggtggggaggctcgggcatctgtgagagacagggagggtggctaaggtccagttgcttttgagtgccccgtggaacttgatgggaatggggttggaacaccttgattgcctcctctgtcacatgccactcttggagctggagcttagtgatatgtcaatgagagatactcttgtcttttttttttttcttttcttttttttttggagttgaaattaggtaaaatctcaactcaaaaatcaaactcagggaagaggcccactgaggagaacaagtcttctgcattttcttcctgccctgctcccaccttctcgcctctggctgcttggatagctgtggtgactccttcctcaccctcctgcttctctgtctctccaagaagccagagctgcctctttccttccctggaagagattttatggggatcgcttcctgatagaagatgggaaggagagggcagaactttgcctgctgtcatatctgaagaatcacgggttctttctgcatcccaggggcgtaactgatctgactcctggggcttttcctgtatggtggaatatagaggggaccattgcaggctgggtgtgggtgagggcttcggtaactgatgccggcagcagcgcctcatggagtggcaggggagctctgtctgtggaggggtagtagtttccgcttcctggaggtttgcagtgaggtgaggagagtaactttggtcagggattctcactagcagcgtcatggccaggatgctttacttatttgcaataccacctagtggatatggcaactgcagagcataaaaggggctcggaaaagcagtttttacaaagtatttaaaaggagagtatttaaatcataggtacctaagttggagcctgaggttgaaatatttggggtggagatttctagctttcctgagagctgctgcttggtggtagtgttttctctggaagtacagattcctgacattctgggtggaggggagcccaagtgagcctgaaggagttctgattatagagtcccgagcctcagtttctgactgcagaagagccagagatgttcatttcattgttgaccaccctagtgcttggtggactgtgcccttagctatcccaccatttggccaactctgtatctgaacttgagctttctatggaacaaacaatggtcttagttttttaagagcctctgggtctctgattccatggagagtcaggagtagaattagtggaccagaaaccatgacatttgccatctaggtactctgctgttcagggtggaggcacagatgagcagagtggggtgatgttggttgtatgtgcatagaagtcccctggctccagagccatccagtggtgcttggttctctcttcctgcccaggtattgtgtgtggaccaagtgtttaggaaacaagcatagaagcattatgtcacaggaaggcctggcctctcactccttcacactaatgagccttctactgacccaagtttctttttctcgggcagcctgggaccactatgagcagagagatgggagtctgtgtaagaaggatgcaagtatcctttgatttggagtggacagagcaggtccttgcaaaggcagtgggttaaacaacgggatgtctgtgggacaggccagggaaggagggcagagacagggtctccagttcaccttgccgcagaactagcctaatcgtccctgcttctggtcttggccacttggcaatcatggggaagttgactccccgcctcacttgggcttggagctggatactcgtggccacgcccaggataggttgccagagtttcattaggccgctgggtcgggctggaggcttgtgtacacctcggagcagtcgggcagcaggagggccggaagcctggttggtttgtatatgacctctcttgcccttgtgcactttccttgatttagcaaccttgacctgcactggccctcacagctgttggagggaagtagcctcttgcagggaaatattttcccctgccctggaatctcctatgtgcctgttaaagattccagggccaagaactcggcaggctgaggagcagctaggtaggtgggttatgcggttcaggactgcttctggaagggactgcctgtacttctgtaccaccgttgccctttacactttgctcagggcggggtgggggaagcattcaaacaaaacaaggaagggaactgtctggcaaagcataagtggatgcatccagagctcagtcccctttaatcttttgtctctgggcgttctgctgccttcctcataccggggactggcattccaggtcagcttggctgtggtcttagaggcagggagtgcctacccagtcctgcctcaggagcagggtgagtagctaaatacagacttaggcttttttttccccccttttaagatgcttgctcctctcccttttctttttaccaccctacctttattgttagtggttacaaagtgaccacatattatgtactttgctgtaaataaagacagacaaaaaggcaaaaaaaaaaaaaaaaaaaaaaaaaactgggggggaccaagagggggggggggaaaaagggcgatcgaacggggccacggcccaacagcggtcccggacccagtttccgggtccaagggggaaaaccggggggctcccccaataggggggagaggggaaaaaattgcgaaaagcgcgggcttaccgctagatgtgttcacacaaacacacacngacaacacaaaacgacggaccagaaagaacgaggggggacaacaactccaaaaacagaggggcgaaaacagataga

SEQ ID NO: 446555 - DNA, 4608 bp, Homo sapiens
  misc_feature (4532)..(4532): n is a, c, g, or t
ctcgccgcctccgcctcggcgaatagcagcgcgctgcccgcccggattggagcagcagcatcacgctgacctctgcctgggatgtaaaccggaccagccgctgcgggcaaaggaaggctcttggctccttcgggaaacccagccccgtcaccgggctccgagcggctcgcaggcgagcgacagcggcctcagccccggcagcgcccagcggcggctgcggaaagcggagggagtccgacgcgggcgcgggcggggagcgtgcgtccgttcgcacaggcagcgggaggaggggcggcgcgaaccatggccggggacagcgagcagaccctgcagaaccaccagcagcccaacggcggcgagcccttccttataggcgtcagcgggggaacagctagcggcaagtcttccgtgtgtgctaagatcgtgcagctcctggggcagaatgaggtggactatcgccagaagcaggtggtcatcctgagccaggatagcttctaccgtgtccttacctcggagcagaaggccaaagccctgaagggccagttcaactttgaccacccggatgcctttgacaatgaactcattctcaaaacactcaaagaaatcactgaagggaaaacagtccagatccccgtgtatgactttgtctcccattcccggaaggaggagacagttactgtctatcccgcagacgtggtgctctttgaagggatcctggccttctactcccaggaggtacgagacctgttccagatgaagctttttgtggatacagatgcggacacccggctctcacgcagagtattaagggacatcagcgagagaggcagggatcttgagcagattttatctcagtacattacgttcgtcaagcctgcctttgaggaattctgcttgccaacaaagaagtatgctgatgtgatcatccctagaggtgcagataatctggtggccatcaacctcatcgtgcagcacatccaggacatcctgaatggagggccctccaaacggcagaccaatggctgtctcaacggctacaccccttcacgcaagaggcaggcatcggagtccagcagcaggccgcattgacccgtctccatcggaccccagcccctatctccaagagacagaggaggggtcaggaggcactgctcatctgtacatactgtttcctatgacattactgtatttaagaaaacaccatggagatgaaatgcctttgattttttttttctttttgtactttggaacgacaaaatgaaacagaacttgaccctgagcttaaataacaaaactgtgccaactactactggtgatgcctaattatgaatccaacgtgtaaccagttataaatacatatatatataaaaaaggatctatttttgtgtaaatgtacaaatactgtaaagctgttgccataagtattttgcaggagggtctgtacttgagtgttttaggactggagctggaatttcaccaaggggaaattgcctgttgtgtcccagggtggggaggctcgggcatctgtgagagacagggagggtggctaaggtccagttgcttttgagtgccccgtggaacttgatgggaatggggttggaacaccttgattgcctcctctgtcacatgccactcttggagctggagcttagtgatatgtcaatgagagatactcttgtcttttttttttttcttttcttttttttttggagttgaaattaggtaaaatctcaactcaaaaatcaaactcagggaagaggcccactgaggagaacaagtcttctgcattttcttcctgccctgctcccaccttctcgcctctggctgcttggatagctgtggtgactccttcctcaccctcctgcttctctgtctctccaagaagccagagctgcctctttccttccctggaagagattttatggggatcgcttcctgatagaagatgggaaggagagggcagaactttgcctgctgtcatatctgaagaatcacgggttctttctgcatcccaggggcgtaactgatctgactcctggggcttttcctgtatggtggaatatagaggggaccattgcaggctgggtgtgggtgagggcttcggtaactgatgccggcagcagcgcctcatggagtggcaggggagctctgtctgtggaggggtagtagtttccgcttcctggaggtttgcagtgaggtgaggagagtaactttggtcagggattctcactagcagcgtcatggccaggatgctttacttatttgcaataccacctagtggatatggcaactgcagagcataaaaggggctcggaaaagcagtttttacaaagtatttaaaaggagagtatttaaatcataggtacctaagttggagcctgaggttgaaatatttggggtggagatttctagctttcctgagagctgctgcttggtggtagtgttttctctggaagtacagattcctgacattctgggtggaggggagcccaagtgagcctgaaggagttctgattatagagtcccgagcctcagtttctgactgcagaagagccagagatgttcatttcattgttgaccaccctagtgcttggtggactgtgcccttagctatcccactgtggctgccattgccagaaacattttggagaaccttttcttcccattgctctcagagcctgttcgagccattcaggtaaattggtctccattattacctggtcacaccagattttcccccagactcagcaccatccagtctgattccccgtttctgggctcagtttgactctaaatctgttttgctattttaaaaagtcaaacctggtccccagcagagcttgccacccggagactttcaggagaccgtgcaggctctgaagggagctcccagtcacagcagccgcctacttggagcaagggaaggctcccaagatgcctcctttgaaagccggtgctcaccaagatcagttcaggatcaatcattatccttgtagtcatgccttgatcagttctgagatgaagcagggaatgcaggcctgggttagcatcctgaggacacagggcccctggccttgatggcactgggccgtgctcaggtgaagcccacccgtgtctgggagagccttggcttttcagtgggcagcatgctcaactttacttgaagctcccaggtgccaaaccatttagtgccttggctgtttatcccactgccttggaagatggactcctctcatctctgagcctttacctagctgcttcctcatctacctgtggtgttgggaccaagcctccaatatctctgaatagcccactcctagcttggaaacagctataagggctgccctgccccttgtcaaatgatcaccaattcttggtggcttggctggggacaatgaacagtgtctgctggggtctgtgacacactgtttctggaacaaggaagggatggaaggctctacccctccgtggcagcccagcatttggccaactctgtatctgaacttgagctttctatggaacaaacaatggtcttagttttttaagagcctctgggtctctgattccatggagagtcaggagtagaattagtggaccagaaaccatgacatttgccatctaggtactctgctgttcagggtggaggcacagatgagcagagtggggtgatgttggttgtatgtgcatagaagtcccctggctccagagccatccagtggtgcttggttctctcttcctgcccaggtattgtgtgtggaccaagtgtttaggaaacaagcatagaagcattatgtcacaggaaggcctggcctctcactccttcacactaatgagccttctactgacccaagtttctttttctcgggcagctaggtaggtgggttatgcggttcaggactgcttctggaagggactgcctgtacttctgtaccaccgttgccctttacactttgctcagggcggggtgggggaagcattcaaacaaaacaaggaagggaactgtctggcaaagcataagtggatgcatccagagctcagtcccctttaatcttttgtctctgggcgttctgctgccttcctcataccggggactggcattccaggtcagcttggctgtggtcttagaggcagggagtgcctacccagtcctgcctcaggagcagggtgagtagctaaatacagacttaggcttttttttccccccttttaagatgcttgctcctctcccttttctttttaccaccctacctttattgttagtggttacaaagtgaccacatattatgtactttgctgtaaataaagacagacaaaaaggcaaaaaaaaaaaaaaaaaaaaaaaaaactgggggggaccaagagggggggggggaaaaagggcgatcgaacggggccacggcccaacagcggtcccggacccagtttccgggtccaagggggaaaaccggggggctcccccaataggggggagaggggaaaaaattgcgaaaagcgcgggcttaccgctagatgtgttcacacaaacacacacngacaacacaaaacgacggaccagaaagaacgaggggggacaacaactccaaaaacagaggggcgaaaacagataga

SEQ ID NO: 446556 - DNA, 4592 bp, Homo sapiens
  misc_feature (4516)..(4516): n is a, c, g, or t
tgtggccactttgttggtttggggtagagccagaccagacagacgtcgggattctgtacttcctcacaaatgctttctcgaaggaggagacagttactgtctatcccgcagacgtggtgctctttgaagggatcctggccttctactcccaggaggtacgagacctgttccagatgaagctttttgtggatacagatgcggacacccggctctcacgcagagtattaagggacatcagcgagagaggcagggatcttgagcagattttatctcagtacattacgttcgtcaagcctgcctttgaggaattctgcttgccaacaaagaagtatgctgatgtgatcatccctagaggtgcagataatctggtggccatcaacctcatcgtgcagcacatccaggacatcctgaatggagggccctccaaacggcagaccaatggctgtctcaacggctacaccccttcacgcaagaggcaggcatcggagtccagcagcaggccgcattgacccgtctccatcggaccccagcccctatctccaagagacagaggaggggtcaggaggcactgctcatctgtacatactgtttcctatgacattactgtatttaagaaaacaccatggagatgaaatgcctttgattttttttttctttttgtactttggaacgacaaaatgaaacagaacttgaccctgagcttaaataacaaaactgtgccaactactactggtgatgcctaattatgaatccaacgtgtaaccagttataaatacatatatatataaaaaaggatctatttttgtgtaaatgtacaaatactgtaaagctgttgccataagtattttgcaggagggtctgtacttgagtgttttaggactggagctggaatttcaccaaggggaaattgcctgttgtgtcccagggtggggaggctcgggcatctgtgagagacagggagggtggctaaggtccagttgcttttgagtgccccgtggaacttgatgggaatggggttggaacaccttgattgcctcctctgtcacatgccactcttggagctggagcttagtgatatgtcaatgagagatactcttgtcttttttttttttcttttcttttttttttggagttgaaattaggtaaaatctcaactcaaaaatcaaactcagggaagaggcccactgaggagaacaagtcttctgcattttcttcctgccctgctcccaccttctcgcctctggctgcttggatagctgtggtgactccttcctcaccctcctgcttctctgtctctccaagaagccagagctgcctctttccttccctggaagagattttatggggatcgcttcctgatagaagatgggaaggagagggcagaactttgcctgctgtcatatctgaagaatcacgggttctttctgcatcccaggggcgtaactgatctgactcctggggcttttcctgtatggtggaatatagaggggaccattgcaggctgggtgtgggtgagggcttcggtaactgatgccggcagcagcgcctcatggagtggcaggggagctctgtctgtggaggggtagtagtttccgcttcctggaggtttgcagtgaggtgaggagagtaactttggtcagggattctcactagcagcgtcatggccaggatgctttacttatttgcaataccacctagtggatatggcaactgcagagcataaaaggggctcggaaaagcagtttttacaaagtatttaaaaggagagtatttaaatcataggtacctaagttggagcctgaggttgaaatatttggggtggagatttctagctttcctgagagctgctgcttggtggtagtgttttctctggaagtacagattcctgacattctgggtggaggggagcccaagtgagcctgaaggagttctgattatagagtcccgagcctcagtttctgactgcagaagagccagagatgttcatttcattgttgaccaccctagtgcttggtggactgtgcccttagctatcccactgtggctgccattgccagaaacattttggagaaccttttcttcccattgctctcagagcctgttcgagccattcaggtaaattggtctccattattacctggtcacaccagattttcccccagactcagcaccatccagtctgattccccgtttctgggctcagtttgactctaaatctgttttgctattttaaaaagtcaaacctggtccccagcagagcttgccacccggagactttcaggagaccgtgcaggctctgaagggagctcccagtcacagcagccgcctacttggagcaagggaaggctcccaagatgcctcctttgaaagccggtgctcaccaagatcagttcaggatcaatcattatccttgtagtcatgccttgatcagttctgagatgaagcagggaatgcaggcctgggttagcatcctgaggacacagggcccctggccttgatggcactgggccgtgctcaggtgaagcccacccgtgtctgggagagccttggcttttcagtgggcagcatgctcaactttacttgaagctcccaggtgccaaaccatttagtgccttggctgtttatcccactgccttggaagatggactcctctcatctctgagcctttacctagctgcttcctcatctacctgtggtgttgggaccaagcctccaatatctctgaatagcccactcctagcttggaaacagctataagggctgccctgccccttgtcaaatgatcaccaattcttggtggcttggctggggacaatgaacagtgtctgctggggtctgtgacacactgtttctggaacaaggaagggatggaaggctctacccctccgtggcagcccagcatttggccaactctgtatctgaacttgagctttctatggaacaaacaatggtcttagttttttaagagcctctgggtctctgattccatggagagtcaggagtagaattagtggaccagaaaccatgacatttgccatctaggtactctgctgttcagggtggaggcacagatgagcagagtggggtgatgttggttgtatgtgcatagaagtcccctggctccagagccatccagtggtgcttggttctctcttcctgcccaggtattgtgtgtggaccaagtgtttaggaaacaagcatagaagcattatgtcacaggaaggcctggcctctcactccttcacactaatgagccttctactgacccaagtttctttttctcgggcagcctgggaccactatgagcagagagatgggagtctgtgtaagaaggatgcaagtatcctttgatttggagtggacagagcaggtccttgcaaaggcagtgggttaaacaacgggatgtctgtgggacaggccagggaaggagggcagagacagggtctccagttcaccttgccgcagaactagcctaatcgtccctgcttctggtcttggccacttggcaatcatggggaagttgactccccgcctcacttgggcttggagctggatactcgtggccacgcccaggataggttgccagagtttcattaggccgctgggtcgggctggaggcttgtgtacacctcggagcagtcgggcagcaggagggccggaagcctggttggtttgtatatgacctctcttgcccttgtgcactttccttgatttagcaaccttgacctgcactggccctcacagctgttggagggaagtagcctcttgcagggaaatattttcccctgccctggaatctcctatgtgcctgttaaagattccagggccaagaactcggcaggctgaggagcagctaggtaggtgggttatgcggttcaggactgcttctggaagggactgcctgtacttctgtaccaccgttgccctttacactttgctcagggcggggtgggggaagcattcaaacaaaacaaggaagggaactgtctggcaaagcataagtggatgcatccagagctcagtcccctttaatcttttgtctctgggcgttctgctgccttcctcataccggggactggcattccaggtcagcttggctgtggtcttagaggcagggagtgcctacccagtcctgcctcaggagcagggtgagtagctaaatacagacttaggcttttttttccccccttttaagatgcttgctcctctcccttttctttttaccaccctacctttattgttagtggttacaaagtgaccacatattatgtactttgctgtaaataaagacagacaaaaaggcaaaaaaaaaaaaaaaaaaaaaaaaaactgggggggaccaagagggggggggggaaaaagggcgatcgaacggggccacggcccaacagcggtcccggacccagtttccgggtccaagggggaaaaccggggggctcccccaataggggggagaggggaaaaaattgcgaaaagcgcgggcttaccgctagatgtgttcacacaaacacacacngacaacacaaaacgacggaccagaaagaacgaggggggacaacaactccaaaaacagaggggcgaaaacagataga

SEQ ID NO: 446557 - DNA, 4374 bp, Homo sapiens
  misc_feature (4298)..(4298): n is a, c, g, or t
tctgagaccgggaggaagggaaggaagagcttgggacttaacctggtcttggttgagatacactgggaaggctggaatctctgaagacattgaagatttagaacaaagaagtatgctgatgtgatcatccctagaggtgcagataatctggtggccatcaacctcatcgtgcagcacatccaggacatcctgaatggagggccctccaaacggcagaccaatggctgtctcaacggctacaccccttcacgcaagaggcaggcatcggagtccagcagcaggccgcattgacccgtctccatcggaccccagcccctatctccaagagacagaggaggggtcaggaggcactgctcatctgtacatactgtttcctatgacattactgtatttaagaaaacaccatggagatgaaatgcctttgattttttttttctttttgtactttggaacgacaaaatgaaacagaacttgaccctgagcttaaataacaaaactgtgccaactactactggtgatgcctaattatgaatccaacgtgtaaccagttataaatacatatatatataaaaaaggatctatttttgtgtaaatgtacaaatactgtaaagctgttgccataagtattttgcaggagggtctgtacttgagtgttttaggactggagctggaatttcaccaaggggaaattgcctgttgtgtcccagggtggggaggctcgggcatctgtgagagacagggagggtggctaaggtccagttgcttttgagtgccccgtggaacttgatgggaatggggttggaacaccttgattgcctcctctgtcacatgccactcttggagctggagcttagtgatatgtcaatgagagatactcttgtcttttttttttttcttttcttttttttttggagttgaaattaggtaaaatctcaactcaaaaatcaaactcagggaagaggcccactgaggagaacaagtcttctgcattttcttcctgccctgctcccaccttctcgcctctggctgcttggatagctgtggtgactccttcctcaccctcctgcttctctgtctctccaagaagccagagctgcctctttccttccctggaagagattttatggggatcgcttcctgatagaagatgggaaggagagggcagaactttgcctgctgtcatatctgaagaatcacgggttctttctgcatcccaggggcgtaactgatctgactcctggggcttttcctgtatggtggaatatagaggggaccattgcaggctgggtgtgggtgagggcttcggtaactgatgccggcagcagcgcctcatggagtggcaggggagctctgtctgtggaggggtagtagtttccgcttcctggaggtttgcagtgaggtgaggagagtaactttggtcagggattctcactagcagcgtcatggccaggatgctttacttatttgcaataccacctagtggatatggcaactgcagagcataaaaggggctcggaaaagcagtttttacaaagtatttaaaaggagagtatttaaatcataggtacctaagttggagcctgaggttgaaatatttggggtggagatttctagctttcctgagagctgctgcttggtggtagtgttttctctggaagtacagattcctgacattctgggtggaggggagcccaagtgagcctgaaggagttctgattatagagtcccgagcctcagtttctgactgcagaagagccagagatgttcatttcattgttgaccaccctagtgcttggtggactgtgcccttagctatcccactgtggctgccattgccagaaacattttggagaaccttttcttcccattgctctcagagcctgttcgagccattcaggtaaattggtctccattattacctggtcacaccagattttcccccagactcagcaccatccagtctgattccccgtttctgggctcagtttgactctaaatctgttttgctattttaaaaagtcaaacctggtccccagcagagcttgccacccggagactttcaggagaccgtgcaggctctgaagggagctcccagtcacagcagccgcctacttggagcaagggaaggctcccaagatgcctcctttgaaagccggtgctcaccaagatcagttcaggatcaatcattatccttgtagtcatgccttgatcagttctgagatgaagcagggaatgcaggcctgggttagcatcctgaggacacagggcccctggccttgatggcactgggccgtgctcaggtgaagcccacccgtgtctgggagagccttggcttttcagtgggcagcatgctcaactttacttgaagctcccaggtgccaaaccatttagtgccttggctgtttatcccactgccttggaagatggactcctctcatctctgagcctttacctagctgcttcctcatctacctgtggtgttgggaccaagcctccaatatctctgaatagcccactcctagcttggaaacagctataagggctgccctgccccttgtcaaatgatcaccaattcttggtggcttggctggggacaatgaacagtgtctgctggggtctgtgacacactgtttctggaacaaggaagggatggaaggctctacccctccgtggcagcccagcatttggccaactctgtatctgaacttgagctttctatggaacaaacaatggtcttagttttttaagagcctctgggtctctgattccatggagagtcaggagtagaattagtggaccagaaaccatgacatttgccatctaggtactctgctgttcagggtggaggcacagatgagcagagtggggtgatgttggttgtatgtgcatagaagtcccctggctccagagccatccagtggtgcttggttctctcttcctgcccaggtattgtgtgtggaccaagtgtttaggaaacaagcatagaagcattatgtcacaggaaggcctggcctctcactccttcacactaatgagccttctactgacccaagtttctttttctcgggcagcctgggaccactatgagcagagagatgggagtctgtgtaagaaggatgcaagtatcctttgatttggagtggacagagcaggtccttgcaaaggcagtgggttaaacaacgggatgtctgtgggacaggccagggaaggagggcagagacagggtctccagttcaccttgccgcagaactagcctaatcgtccctgcttctggtcttggccacttggcaatcatggggaagttgactccccgcctcacttgggcttggagctggatactcgtggccacgcccaggataggttgccagagtttcattaggccgctgggtcgggctggaggcttgtgtacacctcggagcagtcgggcagcaggagggccggaagcctggttggtttgtatatgacctctcttgcccttgtgcactttccttgatttagcaaccttgacctgcactggccctcacagctgttggagggaagtagcctcttgcagggaaatattttcccctgccctggaatctcctatgtgcctgttaaagattccagggccaagaactcggcaggctgaggagcagctaggtaggtgggttatgcggttcaggactgcttctggaagggactgcctgtacttctgtaccaccgttgccctttacactttgctcagggcggggtgggggaagcattcaaacaaaacaaggaagggaactgtctggcaaagcataagtggatgcatccagagctcagtcccctttaatcttttgtctctgggcgttctgctgccttcctcataccggggactggcattccaggtcagcttggctgtggtcttagaggcagggagtgcctacccagtcctgcctcaggagcagggtgagtagctaaatacagacttaggcttttttttccccccttttaagatgcttgctcctctcccttttctttttaccaccctacctttattgttagtggttacaaagtgaccacatattatgtactttgctgtaaataaagacagacaaaaaggcaaaaaaaaaaaaaaaaaaaaaaaaaactgggggggaccaagagggggggggggaaaaagggcgatcgaacggggccacggcccaacagcggtcccggacccagtttccgggtccaagggggaaaaccggggggctcccccaataggggggagaggggaaaaaattgcgaaaagcgcgggcttaccgctagatgtgttcacacaaacacacacngacaacacaaaacgacggaccagaaagaacgaggggggacaacaactccaaaaacagaggggcgaaaacagataga

SEQ ID NO: 446558 - DNA, 666 bp, Homo sapiens
tgtggccactttgttggtttggggtagagccagaccagacagacgtcgggattctgtacttcctcacaaatgctttctcgtctgtatcctctttcccaaaacttttctttattttccctccttcccttccccttctgtcctttcctccctcctttcaattgcctcaggactggcggggaggggatggagttgttgagagaaaactgtgagtttctgtttttaaagttcagagtgttaggttccataaatgccaggccatgagagcattcctggagacgccttcagagaaaaaaagaaatcacatctgtttttgtctgcctttattcttcattcaacagcaggtttttttaattccaaggagaaggatgtctgccgtgtatttctgtttcatggtgaaagctcagaagtggtcaaaggagacctttgtcccggccgtgatcacccttggctctttggtggtggtccgagggctctgaattcgaggttcccgcgctcccacggtgttgagctgctctgtcagggaggcactgccctcccaacgcgtcctcaggttctgttgtggtcgtaatcatcatagaacacatgcttattgaacatgtgctaaggtgccagctatggtgctgaagagttttatgcacatctctgtattcctgaatagtaactgta

SEQ ID NO: 446559 - DNA, 3520 bp, Homo sapiens
  misc_feature (1314)..(1314): n is a, c, g, or t
  misc_feature (1319)..(1319): n is a, c, g, or t
  misc_feature (1561)..(1561): n is a, c, g, or t
  misc_feature (1588)..(1588): n is a, c, g, or t
  misc_feature (1602)..(1602): n is a, c, g, or t
  misc_feature (1649)..(1649): n is a, c, g, or t
  misc_feature (1678)..(1678): n is a, c, g, or t
  misc_feature (1768)..(1768): n is a, c, g, or t
  misc_feature (2340)..(2340): n is a, c, g, or t
  misc_feature (2423)..(2423): n is a, c, g, or t
  misc_feature (2479)..(2479): n is a, c, g, or t
  misc_feature (2506)..(2506): n is a, c, g, or t
  misc_feature (2576)..(2576): n is a, c, g, or t
ggtcgacggggtcctggagccgcgctcggggagggcgcggcggagggcgagcggcggcgttaggacccggaggcgcgggcggactgtgggcggcggggctaggacccagcggctccggcagagcggaagcggcggcgggagcttccgggagggcggctcgcaggcaccatgactcctgtgaggatgcagcactccctggcaggtcagacctatgccgtgcccctcatccagccagacctgcggcgagaggaggccgtccagcagatggcggatgccctgcagtacctgcagaaggtctctggagacatcttcagcaggatctcccagcgggtagagcagagccggagccaggtgcaggccattggagagaaggtctccttggcccaggccaagattgagaagatcaagggcagcaagaaggccatcaaggtgttctccagtgccaagtaccctgctccagagcgcctgcaggaatatggctccatcttcacgggcgcccaggaccctggcctgcagagacgcccccgccacaggatccagagcaagcaccgccccctggacgagcgggccctgcaggagaagctgaaggactttcctgtgtgcgtgagcaccaagccggagcccgaggacgatgcagaagagggacttgggggtcttcccagcaacatcagctctgtcagctccttgctgctcttcaacaccaccgagaacctgtatggccagaaggcagggccgaggggtgtgggcgggaggcccggcctggcttagtggggacccagggcatcagacacaggtacagcacataggccaggagccagggggtgactggggtggctcggctcgggaggcctgggaccccacagtgcacgctgtgcccctgatgatgtgggagaggaacatgggctcaggacagcgggtgtcagcttgcctgacccccatgtcgcctccgtaggtacaagaagtatgtcttcctggaccccctggctggtgctgtaacaaagacccatgtgatgctgggggcagagacagaggagaagctgtttgatgcccccttgtccatcagcaagagagagcagctggaacagcaggtcccagagaactacttctatgtgccagacctgggccaggtgcctgagattgatgttccgtcctacctgcctgacctgcccggcattgccaacgacctcatgtacagtgccgacctgggccccggcattgccccctctgcccctggcaccattccggaactgcccaccttccacactgaggtagccgagcctctcaaggcagacctacaagatggggtactaacancaccnccaccgcccccaccaccacccccagctcctgaggtgctggccagtgcatccccactcccaccctcaaccgcggcccctgtaggccaaggcgccaggcaggacgacagcagcagcagcgcgtctccttcaggtgggagcagctctttgaggccacctgatttctggcgtgctcagtgcactcgggtggattttctgtgggtttgttaagtggtcagaaattctcaattttttgaatagtttcnatttcaaatatcttgttctacttggtncataaaatagtggntttcaaactgtagagctctggacttctcacttctagggcagagggancctgaacaagtgaggctctgggttccccnttcctaattaaaccaatggaaagaaggggtctaataacaaactacagcaacacatttttcatttcagcttcactgctgtatctcccagtntaaccctagcatccagaagtggcacaaaacccctctgctggctcatgtgtgcaactgagactgtcagagcatggctagctctggggtccagctctgcagggtgggggctagagaggaagcagggagtatctgcacacaggatgcccgcgctcaggtggttgcagaagtcagtgcccaggcccccccacacagtctccaaaggtccggcctccccagcgcggggctcctcgtttgaggggaggtgacttccctcccagcaggctcttggacacagtaagcttccccagccctgcctgagcagcctttcctccttgccctgttccccacctcccggctccagtccagggagctcccagggaagtggtcgacccctccggtggctgggccactctgctagagtccatccgccaagctgggggcatcggcaaggccaagctgcgcagcatgaaggagcgaaagctggagaagaagaagcagaaggagcaggagcaaggtgagcgggccctggagcctgcggtcggagggccttgggcaagatcgcctcctcccctccagccctgagtccactgggngctttctgcccaccccctgctcttgccagctggcccctgcttcccctagggcacatgctggaagccctgggccgccaccagangtcctcagccctcctgcctgggctatggctccttcctggtttgggagccatagtgnagctttcctctctaagctcacccagcncaaactgtgacaggagaatcttcttcgactgccaagagcggtccaaggcaatggtcagccactgcagccncctgagatatttttagagactggacctgaggcctctggaggctactgatgatgcctgctgtgaacgcagacactggtgtgatgcgatgcctgcgcctgcagcggcagtgccctgggcactatggttttgagcttgtacccagcgctgcttttgccttgctctgtgaccccaggcaagctgcctcacctctctgggccagtttccccatcgtacagtggtgctgcacaccctggccctggcccccgaggtggctgggaggtggctcctcaaacagccgctttctcatcagtgcccggtgctgggtcagggatcgactgaggctctgagctaactaggaaacacagtggccttggagggctggggagtgtcatgggggtggggacagggagccaccggtcgcatgtgactgaactcttcaccccagtctgtggctttcccgttgcagtgagagccacgagccaaggtgggcacttgatgtcggatctcttcaacaagctggtcatgaggcgcaagggcatctctgggaaaggacctggggctggtgaggggcccggaggagcctttgcccgcgtgtcagactccatccctcctgtgcccccaccgcagcagccacaggcagaggaggacgaggacgactgggaatcctagggggctccatgacaccttcccccccagacccagacttgggccgttgctctgacatggacacagccaggacaagctgctcagacctgcttccctgggagggggtgacggaaccagcactgtgtggagaccagcttcaaggagcggaaggctggcttgaggccacacagctggggcggggacttctgtctgcctgtgctccatggggggacggctccacccagcctgcgccactgtgttcttaagaggcttccagagaaaacggcacaccaatcaataaagaactgagcagaaaccaa

SEQ ID NO: 446560 - DNA, 1289 bp, Homo sapiens
  misc_feature (1085)..(1085): n is a, c, g, or t
  misc_feature (1092)..(1092): n is a, c, g, or t
  misc_feature (1099)..(1099): n is a, c, g, or t
ggtcgacggggtcctggagccgcgctcggggagggcgcggcggagggcgagcggcggcgttaggacccggaggcgcgggcggactgtgggcggcggggctaggacccagcggctccggcagagcggaagcggcggcgggagcttccgggagggcggctcgcaggcaccatgactcctgtgaggatgcagcactccctggcaggtcagacctatgccgtgcccctcatccagccagacctgcggcgagaggaggccgtccagcagatggcggatgccctgcagtacctgcagaaggtctctggagacatcttcagcaggatctcccagcgggtagagcagagccggagccaggtgcaggccattggagagaaggtctccttggcccaggccaagattgagaagatcaagggcagcaagaaggccatcaaggtgttctccagtgccaagtaccctgctccagagcgcctgcaggaatatggctccatcttcacgggcgcccaggaccctggcctgcagagacgcccccgccacaggatccagagcaagcaccgccccctggacgagcgggccctgcaggagaagctgaaggactttcctgtgtgcgtgagcaccaagccggagcccgaggacgatgcagaagagggacttgggggtcttcccagcaacatcagctctgtcagctccttgctgctcttcaacaccaccgagaacctgtacaagaagtatgtcttcctggaccccctggctggtgctgtaacaaagacccatgtgatgctgggggcagagacagaggagaagctgtttgatgcccccttgtccatcagcaagagagagcagctggaacagcaggtcccagagaactacttctatgtgccagacctgggccaggtgcctgagattgatgttccgtcctacctgcctgacctgcccggcattgccaacgacctcatgtacagtgccgacctgggccccggcattgccccctctgcccctggcaccattccggaactgcccaccttccacactgaggtagccgagcctctcaaggcagacctacaagatggggtactaacagcaccagcaancgaccancaacggnacgggaggaagacaaggtgcacgcagccatggagaactgccaaggagccaaggacacagtacaggaaacgtcgcgagaccacacaccagagacagcggcagaaagtgacaaaaagctgccggaagaccagaaggcacacacacgaggggagaggcgaacacaaatagaggcaacaggcaaagcgcagcag

SEQ ID NO: 446561 - DNA, 542 bp, Homo sapiens
  misc_feature (44)..(44): n is a, c, g, or t
gtttgtatttttattagagccagggtttccccatgttgctcagnctggtcatgaggcgcaagggcatctctgggaaaggacctggggctggtgaggggcccggaggagcctttgcccgcgtgtcagactccatccctcctgtgcccccaccgcagcagccacaggcagaggaggacgaggacgactgggaatcctagggggctccatgacaccttcccccccagacccagacttgggccgttgctctgacatggacacagccaggacaagctgctcagacctgcttccctgggagggggtgacggaaccagcactgtgtggagaccagcttcaaggagcggaaggctggcttgaggccacacagctggggcggggacttctgtctgcctgtgctccatggggggacggctccacccagcctgcgccactgtgttcttaagaggcttccagagaaaacggcacaccaatcaataaagaactgagcagaaaccaaaacagtgtgcttttaataaaggacctctagctgtgcaggatgcaaacgt

SEQ ID NO: 446562 - DNA, 1862 bp, Homo sapiens
  misc_feature (1075)..(1075): n is a, c, g, or t
  misc_feature (1080)..(1080): n is a, c, g, or t
ggtcgacggggtcctggagccgcgctcggggagggcgcggcggagggcgagcggcggcgttaggacccggaggcgcgggcggactgtgggcggcggggctaggacccagcggctccggcagagcggaagcggcggcgggagcttccgggagggcggctcgcaggcaccatgactcctgtgaggatgcagcactccctggcaggtcagacctatgccgtgcccctcatccagccagacctgcggcgagaggaggccgtccagcagatggcggatgccctgcagtacctgcagaaggtctctggagacatcttcagcaggatctcccagcgggtagagcagagccggagccaggtgcaggccattggagagaaggtctccttggcccaggccaagattgagaagatcaagggcagcaagaaggccatcaaggtgttctccagtgccaagtaccctgctccagagcgcctgcaggaatatggctccatcttcacgggcgcccaggaccctggcctgcagagacgcccccgccacaggatccagagcaagcaccgccccctggacgagcgggccctgcaggagaagctgaaggactttcctgtgtgcgtgagcaccaagccggagcccgaggacgatgcagaagagggacttgggggtcttcccagcaacatcagctctgtcagctccttgctgctcttcaacaccaccgagaacctgtacaagaagtatgtcttcctggaccccctggctggtgctgtaacaaagacccatgtgatgctgggggcagagacagaggagaagctgtttgatgcccccttgtccatcagcaagagagagcagctggaacagcaggtcccagagaactacttctatgtgccagacctgggccaggtgcctgagattgatgttccgtcctacctgcctgacctgcccggcattgccaacgacctcatgtacagtgccgacctgggccccggcattgccccctctgcccctggcaccattccggaactgcccaccttccacactgaggtagccgagcctctcaaggcagacctacaagatggggtactaacancaccnccaccgcccccaccaccacccccagctcctgaggtgctggccagtgcatccccactcccaccctcaaccgcggcccctgtaggccaaggcgccaggcaggacgacagcagcagcagcgcgtctccttcagtccagggagctcccagggaagtggtcgacccctccggtggctgggccactctgctagagtccatccgccaagctgggggcatcggcaaggccaagctgcgcagcatgaaggagcgaaagctggagaagaagaagcagaaggagcaggagcaagtgagagccacgagccaaggtgggcacttgatgtcggatctcttcaacaagctggtcatgaggcgcaagggcatctctgggaaaggacctggggctggtgaggggcccggaggagcctttgcccgcgtgtcagactccatccctcctgtgcccccaccgcagcagccacaggcagaggaggacgaggacgactgggaatcctagggggctccatgacaccttcccccccagacccagacttgggccgttgctctgacatggacacagccaggacaagctgctcagacctgcttccctgggagggggtgacggaaccagcactgtgtggagaccagcttcaaggagcggaaggctggcttgaggccacacagctggggcggggacttctgtctgcctgtgctccatggggggacggctccacccagcctgcgccactgtgttcttaagaggcttccagagaaaacggcacaccaatcaataaagaactgagcagaaaccaa

SEQ ID NO: 446563 - DNA, 2470 bp, Homo sapiens
  misc_feature (1075)..(1075): n is a, c, g, or t
  misc_feature (1080)..(1080): n is a, c, g, or t
  misc_feature (1322)..(1322): n is a, c, g, or t
  misc_feature (1349)..(1349): n is a, c, g, or t
  misc_feature (1363)..(1363): n is a, c, g, or t
  misc_feature (1410)..(1410): n is a, c, g, or t
  misc_feature (1439)..(1439): n is a, c, g, or t
  misc_feature (1529)..(1529): n is a, c, g, or t
ggtcgacggggtcctggagccgcgctcggggagggcgcggcggagggcgagcggcggcgttaggacccggaggcgcgggcggactgtgggcggcggggctaggacccagcggctccggcagagcggaagcggcggcgggagcttccgggagggcggctcgcaggcaccatgactcctgtgaggatgcagcactccctggcaggtcagacctatgccgtgcccctcatccagccagacctgcggcgagaggaggccgtccagcagatggcggatgccctgcagtacctgcagaaggtctctggagacatcttcagcaggatctcccagcgggtagagcagagccggagccaggtgcaggccattggagagaaggtctccttggcccaggccaagattgagaagatcaagggcagcaagaaggccatcaaggtgttctccagtgccaagtaccctgctccagagcgcctgcaggaatatggctccatcttcacgggcgcccaggaccctggcctgcagagacgcccccgccacaggatccagagcaagcaccgccccctggacgagcgggccctgcaggagaagctgaaggactttcctgtgtgcgtgagcaccaagccggagcccgaggacgatgcagaagagggacttgggggtcttcccagcaacatcagctctgtcagctccttgctgctcttcaacaccaccgagaacctgtacaagaagtatgtcttcctggaccccctggctggtgctgtaacaaagacccatgtgatgctgggggcagagacagaggagaagctgtttgatgcccccttgtccatcagcaagagagagcagctggaacagcaggtcccagagaactacttctatgtgccagacctgggccaggtgcctgagattgatgttccgtcctacctgcctgacctgcccggcattgccaacgacctcatgtacagtgccgacctgggccccggcattgccccctctgcccctggcaccattccggaactgcccaccttccacactgaggtagccgagcctctcaaggcagacctacaagatggggtactaacancaccnccaccgcccccaccaccacccccagctcctgaggtgctggccagtgcatccccactcccaccctcaaccgcggcccctgtaggccaaggcgccaggcaggacgacagcagcagcagcgcgtctccttcaggtgggagcagctctttgaggccacctgatttctggcgtgctcagtgcactcgggtggattttctgtgggtttgttaagtggtcagaaattctcaattttttgaatagtttcnatttcaaatatcttgttctacttggtncataaaatagtggntttcaaactgtagagctctggacttctcacttctagggcagagggancctgaacaagtgaggctctgggttccccnttcctaattaaaccaatggaaagaaggggtctaataacaaactacagcaacacatttttcatttcagcttcactgctgtatctcccagtntaaccctagcatccagaagtggcacaaaacccctctgctggctcatgtgtgcaactgagactgtcagagcatggctagctctggggtccagctctgcagggtgggggctagagaggaagcagggagtatctgcacacaggatgcccgcgctcaggtggttgcagaagtcagtgcccaggcccccccacacagtctccaaaggtccggcctccccagcgcggggctcctcgtttgaggggaggtgacttccctcccagcaggctcttggacacagtaagcttccccagccctgcctgagcagcctttcctccttgccctgttccccacctcccggctccagtccagggagctcccagggaagtggtcgacccctccggtggctgggccactctgctagagtccatccgccaagctgggggcatcggcaaggccaagctgcgcagcatgaaggagcgaaagctggagaagaagaagcagaaggagcaggagcaaggtgagcgggccctggagcgcatctctgggaaaggacctggggctggtgaggggcccggaggagcctttgcccgcgtgtcagactccatccctcctgtgcccccaccgcagcagccacaggcagaggaggacgaggacgactgggaatcctagggggctccatgacaccttcccccccagacccagacttgggccgttgctctgacatggacacagccaggacaagctgctcagacctgcttccctgggagggggtgacggaaccagcactgtgtggagaccagcttcaaggagcggaaggctggcttgaggccacacagctggggcggggacttctgtctgcctgtgctccatggggggacggctccacccagcctgcgccactgtgttcttaagaggcttccagagaaaacggcacaccaatcaataaagaactgagcagaaaccaa

SEQ ID NO: 446564 - DNA, 1983 bp, Homo sapiens
  misc_feature (537)..(537): n is a, c, g, or t
  misc_feature (542)..(542): n is a, c, g, or t
  misc_feature (784)..(784): n is a, c, g, or t
  misc_feature (811)..(811): n is a, c, g, or t
  misc_feature (825)..(825): n is a, c, g, or t
  misc_feature (872)..(872): n is a, c, g, or t
  misc_feature (901)..(901): n is a, c, g, or t
  misc_feature (991)..(991): n is a, c, g, or t
accaaatattcaccatcccttggccatcctggccctctgagaagctgaaggactttcctgtgtgcgtgagcaccaagccggagcccgaggacgatgcagaagagggacttgggggtcttcccagcaacatcagctctgtcagctccttgctgctcttcaacaccaccgagaacctgtacaagaagtatgtcttcctggaccccctggctggtgctgtaacaaagacccatgtgatgctgggggcagagacagaggagaagctgtttgatgcccccttgtccatcagcaagagagagcagctggaacagcaggtcccagagaactacttctatgtgccagacctgggccaggtgcctgagattgatgttccgtcctacctgcctgacctgcccggcattgccaacgacctcatgtacagtgccgacctgggccccggcattgccccctctgcccctggcaccattccggaactgcccaccttccacactgaggtagccgagcctctcaaggcagacctacaagatggggtactaacancaccnccaccgcccccaccaccacccccagctcctgaggtgctggccagtgcatccccactcccaccctcaaccgcggcccctgtaggccaaggcgccaggcaggacgacagcagcagcagcgcgtctccttcaggtgggagcagctctttgaggccacctgatttctggcgtgctcagtgcactcgggtggattttctgtgggtttgttaagtggtcagaaattctcaattttttgaatagtttcnatttcaaatatcttgttctacttggtncataaaatagtggntttcaaactgtagagctctggacttctcacttctagggcagagggancctgaacaagtgaggctctgggttccccnttcctaattaaaccaatggaaagaaggggtctaataacaaactacagcaacacatttttcatttcagcttcactgctgtatctcccagtntaaccctagcatccagaagtggcacaaaacccctctgctggctcatgtgtgcaactgagactgtcagagcatggctagctctggggtccagctctgcagggtgggggctagagaggaagcagggagtatctgcacacaggatgcccgcgctcaggtggttgcagaagtcagtgcccaggcccccccacacagtctccaaaggtccggcctccccagcgcggggctcctcgtttgaggggaggtgacttccctcccagcaggctcttggacacagtaagcttccccagccctgcctgagcagcctttcctccttgccctgttccccacctcccggctccagtccagggagctcccagggaagtggtcgacccctccggtggctgggccactctgctagagtccatccgccaagctgggggcatcggcaaggccaagctgcgcagcatgaaggagcgaaagctggagaagaagaagcagaaggagcaggagcaagtgagagccacgagccaaggtgggcacttgatgtcggatctcttcaacaagctggtcatgaggcgcaagggcatctctgggaaaggacctggggctggtgaggggcccggaggagcctttgcccgcgtgtcagactccatccctcctgtgcccccaccgcagcagccacaggcagaggaggacgaggacgactgggaatcctagggggctccatgacaccttcccccccagacccagacttgggccgttgctctgacatggacacagccaggacaagctgctcagacctgcttccctgggagggggtgacggaaccagcactgtgtggagaccagcttcaaggagcggaaggctggcttgaggccacacagctggggcggggacttctgtctgcctgtgctccatggggggacggctccacccagcctgcgccactgtgttcttaagaggcttccagagaaaacggcacaccaatcaataaagaactgagcagaaaccaa

SEQ ID NO: 446565 - DNA, 2248 bp, Homo sapiens
  misc_feature (802)..(802): n is a, c, g, or t
  misc_feature (807)..(807): n is a, c, g, or t
  misc_feature (1049)..(1049): n is a, c, g, or t
  misc_feature (1076)..(1076): n is a, c, g, or t
  misc_feature (1090)..(1090): n is a, c, g, or t
  misc_feature (1137)..(1137): n is a, c, g, or t
  misc_feature (1166)..(1166): n is a, c, g, or t
  misc_feature (1256)..(1256): n is a, c, g, or t
ggtcgacggggtcctggagccgcgctcggggagggcgcggcggagggcgagcggcggcgttaggacccggaggcgcgggcggactgtgggcggcggggctaggacccagcggctccggcagagcggaagcggcggcgggagcttccgggagggcggctcgcaggcaccatgactcctgtgaggatgcagcactccctggcaggtcagacctatgccgtgcccctcatccagccagacctgcggcgagaggaggccgtccagcagatggcggatgccctgcagtacctgcagaaggtctctggagacatcttcagcaggatctcccagcgggtagagcagagccggagccaggtgcaggccattggagagaaggtctccttggcccaggccaagattgagaagatcaagggcagcaagaaggccatcaaggtgttctccagtgccaagtaccctgctccagagcgcctgcaggaatatggctccatcttcacgggcgcccaggaccctggcctgcagagacgcccccgccacaggatccagagcaagcaccgccccctggacgagcgggccctgcaggtcccagagaactacttctatgtgccagacctgggccaggtgcctgagattgatgttccgtcctacctgcctgacctgcccggcattgccaacgacctcatgtacagtgccgacctgggccccggcattgccccctctgcccctggcaccattccggaactgcccaccttccacactgaggtagccgagcctctcaaggcagacctacaagatggggtactaacancaccnccaccgcccccaccaccacccccagctcctgaggtgctggccagtgcatccccactcccaccctcaaccgcggcccctgtaggccaaggcgccaggcaggacgacagcagcagcagcgcgtctccttcaggtgggagcagctctttgaggccacctgatttctggcgtgctcagtgcactcgggtggattttctgtgggtttgttaagtggtcagaaattctcaattttttgaatagtttcnatttcaaatatcttgttctacttggtncataaaatagtggntttcaaactgtagagctctggacttctcacttctagggcagagggancctgaacaagtgaggctctgggttccccnttcctaattaaaccaatggaaagaaggggtctaataacaaactacagcaacacatttttcatttcagcttcactgctgtatctcccagtntaaccctagcatccagaagtggcacaaaacccctctgctggctcatgtgtgcaactgagactgtcagagcatggctagctctggggtccagctctgcagggtgggggctagagaggaagcagggagtatctgcacacaggatgcccgcgctcaggtggttgcagaagtcagtgcccaggcccccccacacagtctccaaaggtccggcctccccagcgcggggctcctcgtttgaggggaggtgacttccctcccagcaggctcttggacacagtaagcttccccagccctgcctgagcagcctttcctccttgccctgttccccacctcccggctccagtccagggagctcccagggaagtggtcgacccctccggtggctgggccactctgctagagtccatccgccaagctgggggcatcggcaaggccaagctgcgcagcatgaaggagcgaaagctggagaagaagaagcagaaggagcaggagcaagtgagagccacgagccaaggtgggcacttgatgtcggatctcttcaacaagctggtcatgaggcgcaagggcatctctgggaaaggacctggggctggtgaggggcccggaggagcctttgcccgcgtgtcagactccatccctcctgtgcccccaccgcagcagccacaggcagaggaggacgaggacgactgggaatcctagggggctccatgacaccttcccccccagacccagacttgggccgttgctctgacatggacacagccaggacaagctgctcagacctgcttccctgggagggggtgacggaaccagcactgtgtggagaccagcttcaaggagcggaaggctggcttgaggccacacagctggggcggggacttctgtctgcctgtgctccatggggggacggctccacccagcctgcgccactgtgttcttaagaggcttccagagaaaacggcacaccaatcaataaagaactgagcagaaaccaa

SEQ ID NO: 446566 - DNA, 2570 bp, Homo sapiens
  misc_feature (1075)..(1075): n is a, c, g, or t
  misc_feature (1080)..(1080): n is a, c, g, or t
  misc_feature (1322)..(1322): n is a, c, g, or t
  misc_feature (1349)..(1349): n is a, c, g, or t
  misc_feature (1363)..(1363): n is a, c, g, or t
  misc_feature (1410)..(1410): n is a, c, g, or t
  misc_feature (1439)..(1439): n is a, c, g, or t
  misc_feature (1529)..(1529): n is a, c, g, or t
ggtcgacggggtcctggagccgcgctcggggagggcgcggcggagggcgagcggcggcgttaggacccggaggcgcgggcggactgtgggcggcggggctaggacccagcggctccggcagagcggaagcggcggcgggagcttccgggagggcggctcgcaggcaccatgactcctgtgaggatgcagcactccctggcaggtcagacctatgccgtgcccctcatccagccagacctgcggcgagaggaggccgtccagcagatggcggatgccctgcagtacctgcagaaggtctctggagacatcttcagcaggatctcccagcgggtagagcagagccggagccaggtgcaggccattggagagaaggtctccttggcccaggccaagattgagaagatcaagggcagcaagaaggccatcaaggtgttctccagtgccaagtaccctgctccagagcgcctgcaggaatatggctccatcttcacgggcgcccaggaccctggcctgcagagacgcccccgccacaggatccagagcaagcaccgccccctggacgagcgggccctgcaggagaagctgaaggactttcctgtgtgcgtgagcaccaagccggagcccgaggacgatgcagaagagggacttgggggtcttcccagcaacatcagctctgtcagctccttgctgctcttcaacaccaccgagaacctgtacaagaagtatgtcttcctggaccccctggctggtgctgtaacaaagacccatgtgatgctgggggcagagacagaggagaagctgtttgatgcccccttgtccatcagcaagagagagcagctggaacagcaggtcccagagaactacttctatgtgccagacctgggccaggtgcctgagattgatgttccgtcctacctgcctgacctgcccggcattgccaacgacctcatgtacagtgccgacctgggccccggcattgccccctctgcccctggcaccattccggaactgcccaccttccacactgaggtagccgagcctctcaaggcagacctacaagatggggtactaacancaccnccaccgcccccaccaccacccccagctcctgaggtgctggccagtgcatccccactcccaccctcaaccgcggcccctgtaggccaaggcgccaggcaggacgacagcagcagcagcgcgtctccttcaggtgggagcagctctttgaggccacctgatttctggcgtgctcagtgcactcgggtggattttctgtgggtttgttaagtggtcagaaattctcaattttttgaatagtttcnatttcaaatatcttgttctacttggtncataaaatagtggntttcaaactgtagagctctggacttctcacttctagggcagagggancctgaacaagtgaggctctgggttccccnttcctaattaaaccaatggaaagaaggggtctaataacaaactacagcaacacatttttcatttcagcttcactgctgtatctcccagtntaaccctagcatccagaagtggcacaaaacccctctgctggctcatgtgtgcaactgagactgtcagagcatggctagctctggggtccagctctgcagggtgggggctagagaggaagcagggagtatctgcacacaggatgcccgcgctcaggtggttgcagaagtcagtgcccaggcccccccacacagtctccaaaggtccggcctccccagcgcggggctcctcgtttgaggggaggtgacttccctcccagcaggctcttggacacagtaagcttccccagccctgcctgagcagcctttcctccttgccctgttccccacctcccggctccagtccagggagctcccagggaagtggtcgacccctccggtggctgggccactctgctagagtccatccgccaagctgggggcatcggcaaggccaagctgcgcagcatgaaggagcgaaagctggagaagaagaagcagaaggagcaggagcaagtgagagccacgagccaaggtgggcacttgatgtcggatctcttcaacaagctggtcatgaggcgcaagggcatctctgggaaaggacctggggctggtgaggggcccggaggagcctttgcccgcgtgtcagactccatccctcctgtgcccccaccgcagcagccacaggcagaggaggacgaggacgactgggaatcctagggggctccatgacaccttcccccccagacccagacttgggccgttgctctgacatggacacagccaggacaagctgctcagacctgcttccctgggagggggtgacggaaccagcactgtgtggagaccagcttcaaggagcggaaggctggcttgaggccacacagctggggcggggacttctgtctgcctgtgctccatggggggacggctccacccagcctgcgccactgtgttcttaagaggcttccagagaaaacggcacaccaatcaataaagaactgagcagaaaccaaaacagtgtgcttttaataaaggacctctagctgtgcaggatgcaaacgt

SEQ ID NO: 446567 - DNA, 1344 bp, Homo sapiens
ggtcgacggggtcctggagccgcgctcggggagggcgcggcggagggcgagcggcggcgttaggacccggaggcgcgggcggactgtgggcggcggggctaggacccagcggctccggcagagcggaagcggcggcgggagcttccgggagggcggctcgcaggcaccatgactcctgtgaggatgcagcactccctggcaggtcagacctatgccgtgcccctcatccagccagacctgcggcgagaggaggccgtccagcagatggcggatgccctgcagtacctgcagaaggtctctggagacatcttcagcaggatctcccagcgggtagagcagagccggagccaggtgcaggccattggagagaaggtctccttggcccaggccaagattgagaagatcaagggcagcaagaaggccatcaaggtgttctccagtgccaagtaccctgctccagagcgcctgcaggaatatggctccatcttcacgggcgcccaggaccctggcctgcagagacgcccccgccacaggatccagagcaagcaccgccccctggacgagcgggccctgcaggagaagctgaaggactttcctgtgtgcgtgagcaccaagccggagcccgaggacgatgcagaagagggacttgggggtcttcccagcaacatcagctctgtcagctccttgctgctcttcaacaccaccgagaacctgtatggccagaaggcagggccgaggggtgtgggcgggaggcccggcctggcttagtggggacccagggcatcagacacaggtacagcacataggccaggagccagggggtgactggggtggctcggctcgggaggcctgggaccccacagtgcacgctgtgcccctgatgatgtgggagaggaacatgggctcaggacagcgggtgtcagcttgcctgacccccatgtcgcctccgtaggtacaagaagtatgtcttcctggaccccctggctggtgctgtaacaaagacccatgtgatgctgggggcagagacagaggagaagctgtttgatgcccccttgtccatcagcaagagagagcagctggaacagcaggtcccagagaactacttctatgtgccagacctgggccaggtgcctgagattgatgttccgtcctacctgcctgacctgcccggcattgccaacgacctcatgtacagtgccgacctgggccccggcattgccccctctgcccctggcaccattccggaactgcccaccttccacactgaggtagccgagcctctcaaggcagacaagatggggtactaagaagcagccgcaaggcaaagggaggagaggggggagt

SEQ ID NO: 446568 - DNA, 515 bp, Homo sapiens
tctgtgaccccaggcaagctgcctcacctctctgggccagtttccccatcgtacagtggtgctgcacaccctggccctggcccccgaggtggctgggaggtggctcctcaaacagccgctttctcatcagtgcccggtgctgggtcagggatcgactgaggctctgagctaactaggaaacacagtggccttggagggctggggagtgtcatgggggtggggacagggagccaccggtcgcatgtgactgaactcttcaccccagtctgtggctttcccgttgcagtgagagccacgagccaaggtgggcacttgatgtcggatctcttcaacaagctggtcatgaggcgcaagggtaggaggcagggccgctgcccgccctgggtcggcaccttgtaattctgtcctgcctttttcttcctgtatttaagtctccgggggctgggggaatcagggtttcccaccaaccaccctcactcagccttttccctccagcatctctgggaaaggacctg

SEQ ID NO: 446569 - DNA, 2521 bp, Homo sapiens
  misc_feature (1075)..(1075): n is a, c, g, or t
  misc_feature (1080)..(1080): n is a, c, g, or t
  misc_feature (1322)..(1322): n is a, c, g, or t
  misc_feature (1349)..(1349): n is a, c, g, or t
  misc_feature (1363)..(1363): n is a, c, g, or t
  misc_feature (1410)..(1410): n is a, c, g, or t
  misc_feature (1439)..(1439): n is a, c, g, or t
  misc_feature (1529)..(1529): n is a, c, g, or t
ggtcgacggggtcctggagccgcgctcggggagggcgcggcggagggcgagcggcggcgttaggacccggaggcgcgggcggactgtgggcggcggggctaggacccagcggctccggcagagcggaagcggcggcgggagcttccgggagggcggctcgcaggcaccatgactcctgtgaggatgcagcactccctggcaggtcagacctatgccgtgcccctcatccagccagacctgcggcgagaggaggccgtccagcagatggcggatgccctgcagtacctgcagaaggtctctggagacatcttcagcaggatctcccagcgggtagagcagagccggagccaggtgcaggccattggagagaaggtctccttggcccaggccaagattgagaagatcaagggcagcaagaaggccatcaaggtgttctccagtgccaagtaccctgctccagagcgcctgcaggaatatggctccatcttcacgggcgcccaggaccctggcctgcagagacgcccccgccacaggatccagagcaagcaccgccccctggacgagcgggccctgcaggagaagctgaaggactttcctgtgtgcgtgagcaccaagccggagcccgaggacgatgcagaagagggacttgggggtcttcccagcaacatcagctctgtcagctccttgctgctcttcaacaccaccgagaacctgtacaagaagtatgtcttcctggaccccctggctggtgctgtaacaaagacccatgtgatgctgggggcagagacagaggagaagctgtttgatgcccccttgtccatcagcaagagagagcagctggaacagcaggtcccagagaactacttctatgtgccagacctgggccaggtgcctgagattgatgttccgtcctacctgcctgacctgcccggcattgccaacgacctcatgtacagtgccgacctgggccccggcattgccccctctgcccctggcaccattccggaactgcccaccttccacactgaggtagccgagcctctcaaggcagacctacaagatggggtactaacancaccnccaccgcccccaccaccacccccagctcctgaggtgctggccagtgcatccccactcccaccctcaaccgcggcccctgtaggccaaggcgccaggcaggacgacagcagcagcagcgcgtctccttcaggtgggagcagctctttgaggccacctgatttctggcgtgctcagtgcactcgggtggattttctgtgggtttgttaagtggtcagaaattctcaattttttgaatagtttcnatttcaaatatcttgttctacttggtncataaaatagtggntttcaaactgtagagctctggacttctcacttctagggcagagggancctgaacaagtgaggctctgggttccccnttcctaattaaaccaatggaaagaaggggtctaataacaaactacagcaacacatttttcatttcagcttcactgctgtatctcccagtntaaccctagcatccagaagtggcacaaaacccctctgctggctcatgtgtgcaactgagactgtcagagcatggctagctctggggtccagctctgcagggtgggggctagagaggaagcagggagtatctgcacacaggatgcccgcgctcaggtggttgcagaagtcagtgcccaggcccccccacacagtctccaaaggtccggcctccccagcgcggggctcctcgtttgaggggaggtgacttccctcccagcaggctcttggacacagtaagcttccccagccctgcctgagcagcctttcctccttgccctgttccccacctcccggctccagtccagggagctcccagggaagtggtcgacccctccggtggctgggccactctgctagagtccatccgccaagctgggggcatcggcaaggccaagctgcgcagcatgaaggagcgaaagctggagaagaagaagcagaaggagcaggagcaagtgagagccacgagccaaggtgggcacttgatgtcggatctcttcaacaagctggtcatgaggcgcaagggcatctctgggaaaggacctggggctggtgaggggcccggaggagcctttgcccgcgtgtcagactccatccctcctgtgcccccaccgcagcagccacaggcagaggaggacgaggacgactgggaatcctagggggctccatgacaccttcccccccagacccagacttgggccgttgctctgacatggacacagccaggacaagctgctcagacctgcttccctgggagggggtgacggaaccagcactgtgtggagaccagcttcaaggagcggaaggctggcttgaggccacacagctggggcggggacttctgtctgcctgtgctccatggggggacggctccacccagcctgcgccactgtgttcttaagaggcttccagagaaaacggcacaccaatcaataaagaactgagcagaaaccaa

SEQ ID NO: 446570 - DNA, 2601 bp, Homo sapiens
  misc_feature (1155)..(1155): n is a, c, g, or t
  misc_feature (1160)..(1160): n is a, c, g, or t
  misc_feature (1402)..(1402): n is a, c, g, or t
  misc_feature (1429)..(1429): n is a, c, g, or t
  misc_feature (1443)..(1443): n is a, c, g, or t
  misc_feature (1490)..(1490): n is a, c, g, or t
  misc_feature (1519)..(1519): n is a, c, g, or t
  misc_feature (1609)..(1609): n is a, c, g, or t
ggtcgacggggtcctggagccgcgctcggggagggcgcggcggagggcgagcggcggcgttaggacccggaggcgcgggcggactgtgggcggcggggctaggacccagcggctccggcagagcggaagcggcggcgggagcttccgggagggcggctcgcaggcaccatgactcctgtgaggatgcagcactccctggcaggtcagacctatgccgtgcccctcatccagccagacctgcggcgagaggaggccgtccagcagatggcggatgccctgcagtacctgcagaaggtctctggagacatcttcagcaggatctcccagcgggtagagcagagccggagccaggtgcaggccattggagagaaggtctccttggcccaggccaagattgagaagatcaagggcagcaagaaggccatcaaggtgttctccagtgccaagtaccctgctccagagcgcctgcaggaatatggctccatcttcacgggcgcccaggaccctggcctgcagagacgcccccgccacaggatccagagcaagcaccgccccctggacgagcgggccctgcaggagaagctgaaggactttcctgtgtgcgtgagcaccaagccggagcccgaggacgatgcagaagagggacttgggggtcttcccagcaacatcagctctgtcagctccttgctgctcttcaacaccaccgagaacctgtatggccagaaggcagggccgaggggtgtgggcgggaggcccggcctggcttagtggggacccagggcatcagacacaggtacaagaagtatgtcttcctggaccccctggctggtgctgtaacaaagacccatgtgatgctgggggcagagacagaggagaagctgtttgatgcccccttgtccatcagcaagagagagcagctggaacagcaggtcccagagaactacttctatgtgccagacctgggccaggtgcctgagattgatgttccgtcctacctgcctgacctgcccggcattgccaacgacctcatgtacagtgccgacctgggccccggcattgccccctctgcccctggcaccattccggaactgcccaccttccacactgaggtagccgagcctctcaaggcagacctacaagatggggtactaacancaccnccaccgcccccaccaccacccccagctcctgaggtgctggccagtgcatccccactcccaccctcaaccgcggcccctgtaggccaaggcgccaggcaggacgacagcagcagcagcgcgtctccttcaggtgggagcagctctttgaggccacctgatttctggcgtgctcagtgcactcgggtggattttctgtgggtttgttaagtggtcagaaattctcaattttttgaatagtttcnatttcaaatatcttgttctacttggtncataaaatagtggntttcaaactgtagagctctggacttctcacttctagggcagagggancctgaacaagtgaggctctgggttccccnttcctaattaaaccaatggaaagaaggggtctaataacaaactacagcaacacatttttcatttcagcttcactgctgtatctcccagtntaaccctagcatccagaagtggcacaaaacccctctgctggctcatgtgtgcaactgagactgtcagagcatggctagctctggggtccagctctgcagggtgggggctagagaggaagcagggagtatctgcacacaggatgcccgcgctcaggtggttgcagaagtcagtgcccaggcccccccacacagtctccaaaggtccggcctccccagcgcggggctcctcgtttgaggggaggtgacttccctcccagcaggctcttggacacagtaagcttccccagccctgcctgagcagcctttcctccttgccctgttccccacctcccggctccagtccagggagctcccagggaagtggtcgacccctccggtggctgggccactctgctagagtccatccgccaagctgggggcatcggcaaggccaagctgcgcagcatgaaggagcgaaagctggagaagaagaagcagaaggagcaggagcaagtgagagccacgagccaaggtgggcacttgatgtcggatctcttcaacaagctggtcatgaggcgcaagggcatctctgggaaaggacctggggctggtgaggggcccggaggagcctttgcccgcgtgtcagactccatccctcctgtgcccccaccgcagcagccacaggcagaggaggacgaggacgactgggaatcctagggggctccatgacaccttcccccccagacccagacttgggccgttgctctgacatggacacagccaggacaagctgctcagacctgcttccctgggagggggtgacggaaccagcactgtgtggagaccagcttcaaggagcggaaggctggcttgaggccacacagctggggcggggacttctgtctgcctgtgctccatggggggacggctccacccagcctgcgccactgtgttcttaagaggcttccagagaaaacggcacaccaatcaataaagaactgagcagaaaccaa

SEQ ID NO: 446571 - DNA, 2648 bp, Homo sapiens
  misc_feature (1202)..(1202): n is a, c, g, or t
  misc_feature (1207)..(1207): n is a, c, g, or t
  misc_feature (1449)..(1449): n is a, c, g, or t
  misc_feature (1476)..(1476): n is a, c, g, or t
  misc_feature (1490)..(1490): n is a, c, g, or t
  misc_feature (1537)..(1537): n is a, c, g, or t
  misc_feature (1566)..(1566): n is a, c, g, or t
  misc_feature (1656)..(1656): n is a, c, g, or t
ggtcgacggggtcctggagccgcgctcggggagggcgcggcggagggcgagcggcggcgttaggacccggaggcgcgggcggactgtgggcggcggggctaggacccagcggctccggcagagcggaagcggcggcgggagcttccgggagggcggctcgcaggcaccatgactcctgtgaggatgcagcactccctggcaggtcagacctatgccgtgcccctcatccagccagacctgcggcgagaggaggccgtccagcagatggcggatgccctgcagtacctgcagaaggtctctggagacatcttcagcaggtgttctccagtgccaagtaccctgctccagagcgcctgcaggaatatggctccatcttcacgggcgcccaggaccctggcctgcagagacgcccccgccacaggatccagagcaagcaccgccccctggacgagcgggccctgcaggagaagctgaaggactttcctgtgtgcgtgagcaccaagccggagcccgaggacgatgcagaagagggacttgggggtcttcccagcaacatcagctctgtcagctccttgctgctcttcaacaccaccgagaacctgtatggccagaaggcagggccgaggggtgtgggcgggaggcccggcctggcttagtggggacccagggcatcagacacaggtacagcacataggccaggagccagggggtgactggggtggctcggctcgggaggcctgggaccccacagtgcacgctgtgcccctgatgatgtgggagaggaacatgggctcaggacagcgggtgtcagcttgcctgacccccatgtcgcctccgtaggtacaagaagtatgtcttcctggaccccctggctggtgctgtaacaaagacccatgtgatgctgggggcagagacagaggagaagctgtttgatgcccccttgtccatcagcaagagagagcagctggaacagcaggtcccagagaactacttctatgtgccagacctgggccaggtgcctgagattgatgttccgtcctacctgcctgacctgcccggcattgccaacgacctcatgtacagtgccgacctgggccccggcattgccccctctgcccctggcaccattccggaactgcccaccttccacactgaggtagccgagcctctcaaggcagacctacaagatggggtactaacancaccnccaccgcccccaccaccacccccagctcctgaggtgctggccagtgcatccccactcccaccctcaaccgcggcccctgtaggccaaggcgccaggcaggacgacagcagcagcagcgcgtctccttcaggtgggagcagctctttgaggccacctgatttctggcgtgctcagtgcactcgggtggattttctgtgggtttgttaagtggtcagaaattctcaattttttgaatagtttcnatttcaaatatcttgttctacttggtncataaaatagtggntttcaaactgtagagctctggacttctcacttctagggcagagggancctgaacaagtgaggctctgggttccccnttcctaattaaaccaatggaaagaaggggtctaataacaaactacagcaacacatttttcatttcagcttcactgctgtatctcccagtntaaccctagcatccagaagtggcacaaaacccctctgctggctcatgtgtgcaactgagactgtcagagcatggctagctctggggtccagctctgcagggtgggggctagagaggaagcagggagtatctgcacacaggatgcccgcgctcaggtggttgcagaagtcagtgcccaggcccccccacacagtctccaaaggtccggcctccccagcgcggggctcctcgtttgaggggaggtgacttccctcccagcaggctcttggacacagtaagcttccccagccctgcctgagcagcctttcctccttgccctgttccccacctcccggctccagtccagggagctcccagggaagtggtcgacccctccggtggctgggccactctgctagagtccatccgccaagctgggggcatcggcaaggccaagctgcgcagcatgaaggagcgaaagctggagaagaagaagcagaaggagcaggagcaagtgagagccacgagccaaggtgggcacttgatgtcggatctcttcaacaagctggtcatgaggcgcaagggcatctctgggaaaggacctggggctggtgaggggcccggaggagcctttgcccgcgtgtcagactccatccctcctgtgcccccaccgcagcagccacaggcagaggaggacgaggacgactgggaatcctagggggctccatgacaccttcccccccagacccagacttgggccgttgctctgacatggacacagccaggacaagctgctcagacctgcttccctgggagggggtgacggaaccagcactgtgtggagaccagcttcaaggagcggaaggctggcttgaggccacacagctggggcggggacttctgtctgcctgtgctccatggggggacggctccacccagcctgcgccactgtgttcttaagaggcttccagagaaaacggcacaccaatcaataaagaactgagcagaaaccaa

SEQ ID NO: 446572 - DNA, 2546 bp, Homo sapiens
  misc_feature (1075)..(1075): n is a, c, g, or t
  misc_feature (1080)..(1080): n is a, c, g, or t
  misc_feature (1322)..(1322): n is a, c, g, or t
  misc_feature (1349)..(1349): n is a, c, g, or t
  misc_feature (1363)..(1363): n is a, c, g, or t
  misc_feature (1410)..(1410): n is a, c, g, or t
  misc_feature (1439)..(1439): n is a, c, g, or t
  misc_feature (1529)..(1529): n is a, c, g, or t
  misc_feature (2534)..(2534): n is a, c, g, or t
ggtcgacggggtcctggagccgcgctcggggagggcgcggcggagggcgagcggcggcgttaggacccggaggcgcgggcggactgtgggcggcggggctaggacccagcggctccggcagagcggaagcggcggcgggagcttccgggagggcggctcgcaggcaccatgactcctgtgaggatgcagcactccctggcaggtcagacctatgccgtgcccctcatccagccagacctgcggcgagaggaggccgtccagcagatggcggatgccctgcagtacctgcagaaggtctctggagacatcttcagcaggatctcccagcgggtagagcagagccggagccaggtgcaggccattggagagaaggtctccttggcccaggccaagattgagaagatcaagggcagcaagaaggccatcaaggtgttctccagtgccaagtaccctgctccagagcgcctgcaggaatatggctccatcttcacgggcgcccaggaccctggcctgcagagacgcccccgccacaggatccagagcaagcaccgccccctggacgagcgggccctgcaggagaagctgaaggactttcctgtgtgcgtgagcaccaagccggagcccgaggacgatgcagaagagggacttgggggtcttcccagcaacatcagctctgtcagctccttgctgctcttcaacaccaccgagaacctgtacaagaagtatgtcttcctggaccccctggctggtgctgtaacaaagacccatgtgatgctgggggcagagacagaggagaagctgtttgatgcccccttgtccatcagcaagagagagcagctggaacagcaggtcccagagaactacttctatgtgccagacctgggccaggtgcctgagattgatgttccgtcctacctgcctgacctgcccggcattgccaacgacctcatgtacagtgccgacctgggccccggcattgccccctctgcccctggcaccattccggaactgcccaccttccacactgaggtagccgagcctctcaaggcagacctacaagatggggtactaacancaccnccaccgcccccaccaccacccccagctcctgaggtgctggccagtgcatccccactcccaccctcaaccgcggcccctgtaggccaaggcgccaggcaggacgacagcagcagcagcgcgtctccttcaggtgggagcagctctttgaggccacctgatttctggcgtgctcagtgcactcgggtggattttctgtgggtttgttaagtggtcagaaattctcaattttttgaatagtttcnatttcaaatatcttgttctacttggtncataaaatagtggntttcaaactgtagagctctggacttctcacttctagggcagagggancctgaacaagtgaggctctgggttccccnttcctaattaaaccaatggaaagaaggggtctaataacaaactacagcaacacatttttcatttcagcttcactgctgtatctcccagtntaaccctagcatccagaagtggcacaaaacccctctgctggctcatgtgtgcaactgagactgtcagagcatggctagctctggggtccagctctgcagggtgggggctagagaggaagcagggagtatctgcacacaggatgcccgcgctcaggtggttgcagaagtcagtgcccaggcccccccacacagtctccaaaggtccggcctccccagcgcggggctcctcgtttgaggggaggtgacttccctcccagcaggctcttggacacagtaagcttccccagccctgcctgagcagcctttcctccttgccctgttccccacctcccggctccagtccagggagctcccagggaagtggtcgacccctccggtggctgggccactctgctagagtccatccgccaagctgggggcatcggcaaggccaagctgcgcagcatgaaggagcgaaagctggagaagaagaagcagaaggagcaggagcaagtgagagccacgagccaaggtgggcacttgatgtcggatctcttcaacaagctggtcatgaggcgcaagggcatctctgggaaaggacctggggctggtgaggggcccggaggagcctttgcccgcgtgtcagactccatccctcctgtgcccccaccgcagcagccacaggcagaggaggacgaggacgactgggaatcctagggggctccatgacaccttcccccccagacccagacttgggccgttgctctgacatggacacagccaggacaagctgctcagacctgcttccctgggagggggtgacggaaccagcactgtgtggagaccagcttcaaggagcggaaggctggcttgaggccacacagctggggcggggacttctgtctgcctgtgctccatggggggacggctccacccagcctgcgccactgtgttcttaagaggcttccagagaaaacggcacaccaatcaataaagaactgagcagaaaccaaaaaaaaaaaaaangaaaaaaaaaaa

SEQ ID NO: 446573 - DNA, 1374 bp, Homo sapiens
  misc_feature (1075)..(1075): n is a, c, g, or t
  misc_feature (1080)..(1080): n is a, c, g, or t
ggtcgacggggtcctggagccgcgctcggggagggcgcggcggagggcgagcggcggcgttaggacccggaggcgcgggcggactgtgggcggcggggctaggacccagcggctccggcagagcggaagcggcggcgggagcttccgggagggcggctcgcaggcaccatgactcctgtgaggatgcagcactccctggcaggtcagacctatgccgtgcccctcatccagccagacctgcggcgagaggaggccgtccagcagatggcggatgccctgcagtacctgcagaaggtctctggagacatcttcagcaggatctcccagcgggtagagcagagccggagccaggtgcaggccattggagagaaggtctccttggcccaggccaagattgagaagatcaagggcagcaagaaggccatcaaggtgttctccagtgccaagtaccctgctccagagcgcctgcaggaatatggctccatcttcacgggcgcccaggaccctggcctgcagagacgcccccgccacaggatccagagcaagcaccgccccctggacgagcgggccctgcaggagaagctgaaggactttcctgtgtgcgtgagcaccaagccggagcccgaggacgatgcagaagagggacttgggggtcttcccagcaacatcagctctgtcagctccttgctgctcttcaacaccaccgagaacctgtacaagaagtatgtcttcctggaccccctggctggtgctgtaacaaagacccatgtgatgctgggggcagagacagaggagaagctgtttgatgcccccttgtccatcagcaagagagagcagctggaacagcaggtcccagagaactacttctatgtgccagacctgggccaggtgcctgagattgatgttccgtcctacctgcctgacctgcccggcattgccaacgacctcatgtacagtgccgacctgggccccggcattgccccctctgcccctggcaccattccggaactgcccaccttccacactgaggtagccgagcctctcaaggcagacctacaagatggggtactaacancaccnccaccgcccccaccttcccccccagacccagacttgggccgttgctctgacatggacacagccaggacaagctgctcagacctgcttccctgggagggggtgacggaaccagcactgtgtggagaccagcttcaaggagcggaaggctggcttgaggccacacagctggggcggggacttctgtctgcctgtgctccatggggggacggctccacccagcctgcgccactgtgttcttaagaggcttccagagaaaacggcacaccaatcaataaagaactgagcagaaaccaa

SEQ ID NO: 446574 - DNA, 253 bp, Homo sapiens
cccaggccaagattgagaagatcaagggcagcaagaaggccatcaaggtagtccccatacccctgtgtcctgaggctactgggcagtccctccatttccccatgcctctgaggccgcccattctctgccctgctgcccacctgtaccttgggctttcttctcgcccaggcttccaactccaccctctcctgccaagcaatcctagccctctgagcctcttagggccccctcagacttgtccctgtgtccacag

SEQ ID NO: 446575 - DNA, 8212 bp, Homo sapiens
aggcccgtctcgcaggcccccggatccggccgttggggcctcttccttctcagggagccccagcatggagctttgggccttggtttcgggaaactgggactggccctggctgctaggctgctccctgctgctgctttttggagatgagagttgctcttccatttatcctccagttaccgcgcgcttttgtgcccgggactcaaactgtggactccttttgcttagtttgaaatgagaagcctagactcttgccttccgataatacatgtaatttaatgaaccacttgtcgatacggctgaaagacacacagaagtcttcatggatatagttgatacatttaatcatttaattcctactgaacacttagatgatgccctatttctaggatccaacctggagaatgaagtctgtgaggattttagtgcaagtcaaaatgtcttagaggactcgctgaagaacatgctcagcgataaggatcctatgctaggatctgcaagtaaccagttctgtttgcctgttttggatagcaatgatcccaatttccagatgccttgttcaacagttgttggtcttgacgatattatggatgaaggagttgttaaagaaagtggcaatgataccattgatgaagaagaactgattttacctaacaggaacttaagggacaaggtagaagaaaattcagtgagatctccaagaaaatcacctcgtttaatggcacaagaacaagtaagaagtttgcgacagagcactattgccaagcgttcaaatgcagcaccattaagtaacacaaaaaaagcatctgggaagactgtatctactgctaaagcaggagtgaaacaaccagaaaggagtcaggttaaagaagaagtatgtatgtcactgaaacctgagtaccataaggagaatagaaggtgcagccgaaatagcggacaaattgaagtggtacctgaagtatcagtgtcttcaagtcattcttcagtgtcatcttgtcttgaaatgaaggatgaagatggattagattctaagcataagtgtaataatccgggagaaatagatgtgccatctcatgaattaaattgttcacttctttcagagacttgtgttactattggagaaaagaaaaatgaagctttgatggaatgtaaagccaagcctgttggtagtccattgtttaagttttcagataaagaagaacatgaacaaaatgattccatttcaggtaaaacgggtgagactgttgttgaagaaatgatagcaacaagaaaagttgaacaagattcaaaggagacagtaaaattatcccatgaagatgaccatattcttgaggacgctggatcttctgatatttctagtgatgctgcttgtacaaatccaaataagacagaaaacagccttgtaggtttgcctagttgtgtagatgaagtgactgaatgtaatttggaattgaaggataccatgggtattgctgataaaactgagaacacccttgaaagaaataaaattgaaccgttgggttattgtgaagatgcggagtctaataggcagttggagagcactgagtttaataaatcaaacttagaggtggttgatactagtacttttggaccggaaagtaatatcttggaaaatgctatttgtgatgtgcctgaccaaaattcaaaacagttgaatgctatagaaagtactaaaatagagtcccatgaaacagcaaaccttcaggatgacagaaacagccagtcaagtagcgtttcttacttagagtcaaaaagtgtaaaatccaaacatacaaaacctgtaattcattctaagcaaaacatgaccacagatgctccgaagaaaattgttgcagcaaagtatgaagtaatacatagcaaaactaaagttaatgtcaaaagtgtgaaacgaaatactgatgtaccagaatctcagcaaaattttcataggccagtcaaagtcagaaaaaaacaaattgataaggagccaaagattcagagttgcaattctggggttaaatctgtgaaaaaccaagctcattctgtactgaaaaaaacattacaggatcaaactttagtacaaattttcaagcccttaactcattctttgagtgataagtcacacgctcatcctggttgcttgaaagaacctcatcatcctgcacaaactggacatgtatcacattctagccagaaacagtgtcataagcctcagcaacaggccccagcaatgaaaaccaatagtcacgtgaaggaagagcttgaacacccaggcgttgagcattttaaggaagaggataaactgaaactgaaaaaacctgagaagaacctacaaccccgccaaagaagaagcagcaaaagtttttctttagatgagccaccattgttcattccagataacatagctaccataagaagagaaggctctgatcatagctcctcatttgaaagcaaatatatgtggactcccagcaagcagtgtgggttttgcaaaaaaccacatggcaacaggtttatggttggctgtgggagatgtgatgactggtttcatggtgattgtgttgggttaagtctttctcaagcacagcagatgggcgaggaagacaaagaatatgtctgtgtaaaatgttgtgctgaagaagacaaaaagactgaaatactagatccagatactttggaaaaccaagctacagttgaattccatagtggagataaaacaatggagtgtgaaaagcttggattatcaaaacacacaacaaatgatagaaccaaatatatagatgatacagtgaagcacaaggtcaaaattttaaaacgggagtctggtgaaggcagaaattcatcagactgtagagataatgaaattaaaaaatggcagctagctcctcttcgtaagatgggacaaccagttttacctcggagatcctcagaagaaaaaagtgaaaaaataccgaaagagtctacaactgttacttgcacaggagaaaaagcttcaaaaccaggtactcatgagaagcaagagatgaaaaagaagaaagttgaaaaaggagtgcttaatgtacatcctgctgcttctgcttccaagccttctgcagatcagatcaggcaaagtgtcagacattctctcaaagacattcttatgaagagacttacagactcaaatttgaaggtaccagaggaaaaggcagcaaaagttgccacaaaaattgagaaagagcttttctctttttttcgggacacagatgctaaatataagaacaaatatagaagtttgatgtttaatttgaaagatcctaaaaacaatatattatttaaaaaagtactgaaaggagaagtaactcctgatcatcttatcagaatgagtccagaagaactagcttctaaagagttagctgcttggagacgaagagaaaacagacataccatagaaatgattgagaaagagcagagagaagtggaacgacggccaatcaccaaaataactcataaaggtgaaatagaaattgagagtgatgccccaatgaaagaacaggaagcagccatggagattcaggaaccagccgccaataagtcattggagaagccagaaggatctgaaaaacaaaaagaggaggttgactctatgtctaaagataccactagtcaacacagacagcatctttttgatctcaactgcaaaatctgcataggtcgaatggcaccacctgtagatgatctttctccaaaaaaagtaaaagttgttgtaggagtagctcgcaaacattcagacaatgaagcagaaagtatagcagatgcattatcttcaacctcaaatattttggcttctgaattctttgaggaggagaaacaggagtctccaaagtcaacgttctctcctgctccacgtccagagatgcctggaactgttgaagttgagtctacctttctggctcgattgaacttcatctggaaaggttttatcaacatgccttctgtggcaaaatttgttaccaaagcctatccagtatctggctccccagaatacctgacagaggacctaccagatagtattcaagtaggtggcaggatatcacctcagacagtttgggattatgtggaaaaaataaaagcatcaggaaccaaggaaatttgtgtggttcgcttcacaccagtaactgaagaagatcaaatttcttatactttgctctttgcatacttcagtagcagaaagcgctatggagtagctgctaacaacatgaagcaggttaaagatatgtaccttattcctttgggtgccacagataaaattccacaccctcttgtgccttttgatggacctgggcttgaactgcatagacctaatctattgttgggcttaattattcgtcagaaactgaagcgacagcacagtgcctgtgctagtactagtcatatagctgagactcctgaaagtgcaccaccaatagcattgccacctgataaaaaaagtaaaatagaagtttctacagaagaagcaccagaggaagaaaatgacttttttaattcttttacaactgtattacacaagcagagaaataaacctcagcagaatcttcaggaagaccttccaacagcagttgaacctttaatggaagtcaccaaacaggagccaccaaaacctttaagatttcttcctggcgtgttgattggctgggagaatcaacctactactctggaattagcaaataaacctcttcctgtggatgatatacttcaaagccttttgggcaccactggtcaagtatatgaccaggcccagtcagtgatggaacaaaacactgttaaagaaattccatttttaaatgagcagaccaactcaaaaatagagaaaacagataatgtggaagtaactgatggtgaaaacaaggagataaaagttaaagtagataatatttcagaatctacagataagtcagcagaaatagaaacatcagtagtagggtcctcttccatttctgcagggtctttgacgagtcttagtctcagaggtaagccaccagatgtttctacagaagcatttttaacaaatttatcaattcagtcaaaacaagaggaaactgtggagagtaaagagaaaacattaaaaagacagcttcaggaagatcaagagaataatttgcaagataaccagacttcaaatagttctccatgcagatctaatgtaggaaaaggaaacatagatggtaatgtgagctgtagtgaaaaccttgttgctaatacagcgaggtctccacagtttatcaacctgaaaagggatcctaggcaagcagcaggacgaagtcagcctgtaactacttcagaaagcaaagatggagatagttgccggaatggagaaaaacacatgctgcctggcctgtcacacaacaaggagcacttaacagaacaaatcaatgtagaggaaaagttgtgttctgcagagaaaaactcgtgtgttcagcagagtgacaatttaaaagttgcacaaaactcaccatcagtagaaaacatacagacttctcaagcagaacaagcaaaacccttacaggaggatattttaatgcaaaatattgaaactgtgcacccatttcgaagaggatcagcagtagcgacatctcattttgaagttggaaacacatgtccatcagaatttccttctaaaagcatcacctttacttccagaagcaccagccccagaacaagtacaaacttttcacccatgaggccacagcagcccaaccttcagcatctcaagtctagcccacctggatttccatttccagggcctcctaattttcccccacaaagcatgtttggatttccaccacatttgccacctccattacttccccctccaggctttggctttgctcaaaatcccatggttccctggccacctgttgttcatctcccaggtcagccacagcgtatgatgggtcctctctcacaagcatcaaggtatataggcccgcagaatttttaccaggttaaagacattcggaggccagaaaggcgccatagtgacccttggggtaggcaagaccaacagcaactggataggccatttaataggggtaaaggggaccgccagagattttatagtgattcacaccatttgaaaagagagcgacatgaaaaggaatgggagcaagaatctgaaaggcatagacgcagagacagaagccaagacaaggacagagacagaaaaagcagggaggaagggcacaaagataaagagagggcacggttatcacatggtgatcgaggaacagatggaaaagcaagcagagatagtaggaatgtagacaagaagccagataaacctaaaagtgaagactatgagaaggacaaagaacgagagaaaagtaaacacagagaaggagaaaaggacagggataggtaccacaaagatagggaccacactgacagaactaaaagcaaaaggtaaaatttgcaggctgcttcaggattacatttaaataactgttaaaatgttgtatcttgtaaacaaaagaaagattgcctgctaggattgtgccatctttaaaatttttactattggtcatttgcagaacagtaaattctgtgtgttggtacagagtgctctgtaccagtgctcatcatcccttcttcataccaacggtccctagttataggaatttaatatttttaaaagttttacattgctgtatattcaaagatttgttttattaatatgcaataaaggcttagaaattttagttttattccttaattggtaaatatggttaactatggaatatatttacttcctctagtgaatgtcctttatataatgactaatttgggagtaatgtgtgctctgtaagtttgttttaaattgcactgtttttaaagaaactgtagaggagcaacaaaaatccaagcaacttcataatcagattatgctaatcatttagttgagcagtttttgaccaagaatcagaagcccaaggggtacatttattgctttaatctgcactcattgaagtcatttattaccatatactacagctttgtggtaggccattattttcattttcatttttggctcttcagaaacttgaatacttaagcttgtacatgatcttgtgttttgctatcctttttactgtaaaatgtaaatattttaagggatattttgattctaaatatgataaaataatttctcacctattttgtgtgtgtgacttgaaattcagtagtaaaagaatttcttctttaaagctttaattaccttcagacattgattttttgttactcagccaagaacatatagaaatagctatctatgtcaggcattagatgaggggaaaaacaatttttttaaaatcttaaattgtaggctgagatgaattgtgtagttctaaagaggctagaatttagaactacctgtgaaacactgtgcagctatagcccactttataggtaagtttctgaaaacttttacaccatcgcaatttggtactctgactcactaatcattaaaattaaagaccgcagaacttgaagagaaatatgttttgaatccttttataaaatgtgcgatttagcctaattcgtaaagtaactgtacagtttcatatgccagttttacttgaaaaaaaaatatgaaaactattgttaattcaaatctaaatttatttaaaccctaaaacacatggttttgatggctgtaatttaaagtaagagctatcaaatgatgctgacaaaagaaaaaccttccaaaatacaaaagaaagagaactctattatttacttacctgtattaatgaagaaaaatataaataattccacaaaattgattgttttcctaaagagcttaaagattagagttaaaaattggttttgaaacagaattatccttgttatttttgctggagagaagggaggaaattcagaaccaaacattctatttaatttgcaatgacttgcagtacttttttccctatccttatcctgtgaaacttactatcataaggttctaaaacagagaacttgtgtttaaataaagcccgtttaactttggtccacttttcttttggaaattaacttgttagaaaacaaagttagttcccaaacaaaacaaaatctaagttataatttgcaccattacaaagaaattgctgtcagggttttacacattttaaaaacatttcaatttcaaatgtgtatatcgtcaataaatctacctttactgata

SEQ ID NO: 446576 - DNA, 8050 bp, Homo sapiens
aggcccgtctcgcaggcccccggatccggccgttggggcctcttccttctcagggagccccagcatggagctttgggccttggtttcgggaaactgggactggccctggctgctaggctgctccctgctgctgctttttggagatgagagttgctcttccatttatcctccagttaccgcgcgcttttgtgcccgggactcaaactgtggactccttttgcttagtttgaaatgagaagcctagactcttgccttccgataatacatgtaatttaatgaaccacttgtcgatacggctgaaagacacacagaagtcttcatggatatagttgatacatttaatcatttaattcctactgaacacttagatgatgccctatttctaggatccaacctggagaatgaagtctgtgaggattttagtgcaagtcaaaatgtcttagaggactcgctgaagaacatgctcagcgataaggatcctatgctaggatctgcaagtaaccagttctgtttgcctgttttggatagcaatgatcccaatttccagatgccttgttcaacagaacaagtaagaagtttgcgacagagcactattgccaagcgttcaaatgcagcaccattaagtaacacaaaaaaagcatctgggaagactgtatctactgctaaagcaggagtgaaacaaccagaaaggagtcaggttaaagaagaagtatgtatgtcactgaaacctgagtaccataaggagaatagaaggtgcagccgaaatagcggacaaattgaagtggtacctgaagtatcagtgtcttcaagtcattcttcagtgtcatcttgtcttgaaatgaaggatgaagatggattagattctaagcataagtgtaataatccgggagaaatagatgtgccatctcatgaattaaattgttcacttctttcagagacttgtgttactattggagaaaagaaaaatgaagctttgatggaatgtaaagccaagcctgttggtagtccattgtttaagttttcagataaagaagaacatgaacaaaatgattccatttcaggtaaaacgggtgagactgttgttgaagaaatgatagcaacaagaaaagttgaacaagattcaaaggagacagtaaaattatcccatgaagatgaccatattcttgaggacgctggatcttctgatatttctagtgatgctgcttgtacaaatccaaataagacagaaaacagccttgtaggtttgcctagttgtgtagatgaagtgactgaatgtaatttggaattgaaggataccatgggtattgctgataaaactgagaacacccttgaaagaaataaaattgaaccgttgggttattgtgaagatgcggagtctaataggcagttggagagcactgagtttaataaatcaaacttagaggtggttgatactagtacttttggaccggaaagtaatatcttggaaaatgctatttgtgatgtgcctgaccaaaattcaaaacagttgaatgctatagaaagtactaaaatagagtcccatgaaacagcaaaccttcaggatgacagaaacagccagtcaagtagcgtttcttacttagagtcaaaaagtgtaaaatccaaacatacaaaacctgtaattcattctaagcaaaacatgaccacagatgctccgaagaaaattgttgcagcaaagtatgaagtaatacatagcaaaactaaagttaatgtcaaaagtgtgaaacgaaatactgatgtaccagaatctcagcaaaattttcataggccagtcaaagtcagaaaaaaacaaattgataaggagccaaagattcagagttgcaattctggggttaaatctgtgaaaaaccaagctcattctgtactgaaaaaaacattacaggatcaaactttagtacaaattttcaagcccttaactcattctttgagtgataagtcacacgctcatcctggttgcttgaaagaacctcatcatcctgcacaaactggacatgtatcacattctagccagaaacagtgtcataagcctcagcaacaggccccagcaatgaaaaccaatagtcacgtgaaggaagagcttgaacacccaggcgttgagcattttaaggaagaggataaactgaaactgaaaaaacctgagaagaacctacaaccccgccaaagaagaagcagcaaaagtttttctttagatgagccaccattgttcattccagataacatagctaccataagaagagaaggctctgatcatagctcctcatttgaaagcaaatatatgtggactcccagcaagcagtgtgggttttgcaaaaaaccacatggcaacaggtttatggttggctgtgggagatgtgatgactggtttcatggtgattgtgttgggttaagtctttctcaagcacagcagatgggcgaggaagacaaagaatatgtctgtgtaaaatgttgtgctgaagaagacaaaaagactgaaatactagatccagatactttggaaaaccaagctacagttgaattccatagtggagataaaacaatggagtgtgaaaagcttggattatcaaaacacacaacaaatgatagaaccaaatatatagatgatacagtgaagcacaaggtcaaaattttaaaacgggagtctggtgaaggcagaaattcatcagactgtagagataatgaaattaaaaaatggcagctagctcctcttcgtaagatgggacaaccagttttacctcggagatcctcagaagaaaaaagtgaaaaaataccgaaagagtctacaactgttacttgcacaggagaaaaagcttcaaaaccaggtactcatgagaagcaagagatgaaaaagaagaaagttgaaaaaggagtgcttaatgtacatcctgctgcttctgcttccaagccttctgcagatcagatcaggcaaagtgtcagacattctctcaaagacattcttatgaagagacttacagactcaaatttgaaggtaccagaggaaaaggcagcaaaagttgccacaaaaattgagaaagagcttttctctttttttcgggacacagatgctaaatataagaacaaatatagaagtttgatgtttaatttgaaagatcctaaaaacaatatattatttaaaaaagtactgaaaggagaagtaactcctgatcatcttatcagaatgagtccagaagaactagcttctaaagagttagctgcttggagacgaagagaaaacagacataccatagaaatgattgagaaagagcagagagaagtggaacgacggccaatcaccaaaataactcataaaggtgaaatagaaattgagagtgatgccccaatgaaagaacaggaagcagccatggagattcaggaaccagccgccaataagtcattggagaagccagaaggatctgaaaaacaaaaagaggaggttgactctatgtctaaagataccactagtcaacacagacagcatctttttgatctcaactgcaaaatctgcataggtcgaatggcaccacctgtagatgatctttctccaaaaaaagtaaaagttgttgtaggagtagctcgcaaacattcagacaatgaagcagaaagtatagcagatgcattatcttcaacctcaaatattttggcttctgaattctttgaggaggagaaacaggagtctccaaagtcaacgttctctcctgctccacgtccagagatgcctggaactgttgaagttgagtctacctttctggctcgattgaacttcatctggaaaggttttatcaacatgccttctgtggcaaaatttgttaccaaagcctatccagtatctggctccccagaatacctgacagaggacctaccagatagtattcaagtaggtggcaggatatcacctcagacagtttgggattatgtggaaaaaataaaagcatcaggaaccaaggaaatttgtgtggttcgcttcacaccagtaactgaagaagatcaaatttcttatactttgctctttgcatacttcagtagcagaaagcgctatggagtagctgctaacaacatgaagcaggttaaagatatgtaccttattcctttgggtgccacagataaaattccacaccctcttgtgccttttgatggacctgggcttgaactgcatagacctaatctattgttgggcttaattattcgtcagaaactgaagcgacagcacagtgcctgtgctagtactagtcatatagctgagactcctgaaagtgcaccaccaatagcattgccacctgataaaaaaagtaaaatagaagtttctacagaagaagcaccagaggaagaaaatgacttttttaattcttttacaactgtattacacaagcagagaaataaacctcagcagaatcttcaggaagaccttccaacagcagttgaacctttaatggaagtcaccaaacaggagccaccaaaacctttaagatttcttcctggcgtgttgattggctgggagaatcaacctactactctggaattagcaaataaacctcttcctgtggatgatatacttcaaagccttttgggcaccactggtcaagtatatgaccaggcccagtcagtgatggaacaaaacactgttaaagaaattccatttttaaatgagcagaccaactcaaaaatagagaaaacagataatgtggaagtaactgatggtgaaaacaaggagataaaagttaaagtagataatatttcagaatctacagataagtcagcagaaatagaaacatcagtagtagggtcctcttccatttctgcagggtctttgacgagtcttagtctcagaggtaagccaccagatgtttctacagaagcatttttaacaaatttatcaattcagtcaaaacaagaggaaactgtggagagtaaagagaaaacattaaaaagacagcttcaggaagatcaagagaataatttgcaagataaccagacttcaaatagttctccatgcagatctaatgtaggaaaaggaaacatagatggtaatgtgagctgtagtgaaaaccttgttgctaatacagcgaggtctccacagtttatcaacctgaaaagggatcctaggcaagcagcaggacgaagtcagcctgtaactacttcagaaagcaaagatggagatagttgccggaatggagaaaaacacatgctgcctggcctgtcacacaacaaggagcacttaacagaacaaatcaatgtagaggaaaagttgtgttctgcagagaaaaactcgtgtgttcagcagagtgacaatttaaaagttgcacaaaactcaccatcagtagaaaacatacagacttctcaagcagaacaagcaaaacccttacaggaggatattttaatgcaaaatattgaaactgtgcacccatttcgaagaggatcagcagtagcgacatctcattttgaagttggaaacacatgtccatcagaatttccttctaaaagcatcacctttacttccagaagcaccagccccagaacaagtacaaacttttcacccatgaggccacagcagcccaaccttcagcatctcaagtctagcccacctggatttccatttccagggcctcctaattttcccccacaaagcatgtttggatttccaccacatttgccacctccattacttccccctccaggctttggctttgctcaaaatcccatggttccctggccacctgttgttcatctcccaggtcagccacagcgtatgatgggtcctctctcacaagcatcaaggtatataggcccgcagaatttttaccaggttaaagacattcggaggccagaaaggcgccatagtgacccttggggtaggcaagaccaacagcaactggataggccatttaataggggtaaaggggaccgccagagattttatagtgattcacaccatttgaaaagagagcgacatgaaaaggaatgggagcaagaatctgaaaggcatagacgcagagacagaagccaagacaaggacagagacagaaaaagcagggaggaagggcacaaagataaagagagggcacggttatcacatggtgatcgaggaacagatggaaaagcaagcagagatagtaggaatgtagacaagaagccagataaacctaaaagtgaagactatgagaaggacaaagaacgagagaaaagtaaacacagagaaggagaaaaggacagggataggtaccacaaagatagggaccacactgacagaactaaaagcaaaaggtaaaatttgcaggctgcttcaggattacatttaaataactgttaaaatgttgtatcttgtaaacaaaagaaagattgcctgctaggattgtgccatctttaaaatttttactattggtcatttgcagaacagtaaattctgtgtgttggtacagagtgctctgtaccagtgctcatcatcccttcttcataccaacggtccctagttataggaatttaatatttttaaaagttttacattgctgtatattcaaagatttgttttattaatatgcaataaaggcttagaaattttagttttattccttaattggtaaatatggttaactatggaatatatttacttcctctagtgaatgtcctttatataatgactaatttgggagtaatgtgtgctctgtaagtttgttttaaattgcactgtttttaaagaaactgtagaggagcaacaaaaatccaagcaacttcataatcagattatgctaatcatttagttgagcagtttttgaccaagaatcagaagcccaaggggtacatttattgctttaatctgcactcattgaagtcatttattaccatatactacagctttgtggtaggccattattttcattttcatttttggctcttcagaaacttgaatacttaagcttgtacatgatcttgtgttttgctatcctttttactgtaaaatgtaaatattttaagggatattttgattctaaatatgataaaataatttctcacctattttgtgtgtgtgacttgaaattcagtagtaaaagaatttcttctttaaagctttaattaccttcagacattgattttttgttactcagccaagaacatatagaaatagctatctatgtcaggcattagatgaggggaaaaacaatttttttaaaatcttaaattgtaggctgagatgaattgtgtagttctaaagaggctagaatttagaactacctgtgaaacactgtgcagctatagcccactttataggtaagtttctgaaaacttttacaccatcgcaatttggtactctgactcactaatcattaaaattaaagaccgcagaacttgaagagaaatatgttttgaatccttttataaaatgtgcgatttagcctaattcgtaaagtaactgtacagtttcatatgccagttttacttgaaaaaaaaatatgaaaactattgttaattcaaatctaaatttatttaaaccctaaaacacatggttttgatggctgtaatttaaagtaagagctatcaaatgatgctgacaaaagaaaaaccttccaaaatacaaaagaaagagaactctattatttacttacctgtattaatgaagaaaaatataaataattccacaaaattgattgttttcctaaagagcttaaagattagagttaaaaattggttttgaaacagaattatccttgttatttttgctggagagaagggaggaaattcagaaccaaacattctatttaatttgcaatgacttgcagtacttttttccctatccttatcctgtgaaacttactatcataaggttctaaaacagagaacttgtgtttaaataaagcccgtttaactttggtccacttttcttttggaaattaacttgttagaaaacaaagttagttcccaaacaaaacaaaatctaagttataatttgcaccattacaaagaaattgctgtcagggttttacacattttaaaaacatttcaatttcaaatgtgtatatcgtcaataaatctacctttactgata

SEQ ID NO: 446577 - DNA, 3361 bp, Homo sapiens
  misc_feature (5)..(5): n is a, c, g, or t
gcggncgctccaacatcagaaaggtagactcaacttcaacagttccaggcatctctggacgtggagcaggagagaacgttgactttgagtctacctttctggctcgattgaacttcatctggaaaggttttatcaacatgccttctgtggcaaaatttgttaccaaagcctatccagtatctggctccccagaatacctgacagaggacctaccagatagtattcaagtaggtggcaggatatcacctcagacagtttgggattatgtggaaaaaataaaagcatcaggaaccaaggaaatttgtgtggttcgcttcacaccagtaactgaagaagatcaaatttcttatactttgctctttgcatacttcagtagcagaaagcgctatggagtagctgctaacaacatgaagcaggttaaagatatgtaccttattcctttgggtgccacagataaaattccacaccctcttgtgccttttgatggacctgggcttgaactgcatagacctaatctattgttgggcttaattattcgtcagaaactgaagcgacagcacagtgcctgtgctagtactagtcatatagctgagactcctgaaagtgcaccaccaatagcattgccacctgataaaaaaagtaaaatagaagtttctacagaagaagcaccagaggaagaaaatgacttttttaattcttttacaactgtattacacaagcagagaaataaacctcagcagaatcttcaggaagaccttccaacagcagttgaacctttaatggaagtcaccaaacaggagccaccaaaacctttaagatttcttcctggcgtgttgattggctgggagaatcaacctactactctggaattagcaaataaacctcttcctgtggatgatatacttcaaagccttttgggcaccactggtcaagtatatgaccaggcccagtcagtgatggaacaaaacactgttaaagaaattccatttttaaatgagcagaccaactcaaaaatagagaaaacagataatgtggaagtaactgatggtgaaaacaaggagataaaagttaaagtagataatatttcagaatctacagataagtcagcagaaatagaaacatcagtagtagggtcctcttccatttctgcagggtctttgacgagtcttagtctcagaggtaagccaccagatgtttctacagaagcatttttaacaaatttatcaattcagtcaaaacaagaggaaactgtggagagtaaagagaaaacattaaaaagacagcttcaggaagatcaagagaataatttgcaagataaccagacttcaaatagttctccatgcagatctaatgtaggaaaaggaaacatagatggtaatgtgagctgtagtgaaaaccttgttgctaatacagcgaggtctccacagtttatcaacctgaaaagggatcctaggcaagcagcaggacgaagtcagcctgtaactacttcagaaagcaaagatggagatagttgccggaatggagaaaaacacatgctgcctggcctgtcacacaacaaggagcacttaacagaacaaatcaatgtagaggaaaagttgtgttctgcagagaaaaactcgtgtgttcagcagagtgacaatttaaaagttgcacaaaactcaccatcagtagaaaacatacagacttctcaagcagaacaagcaaaacccttacaggaggatattttaatgcaaaatattgaaactgtgcacccatttcgaagaggatcagcagtagcgacatctcattttgaagttggaaacacatgtccatcagaatttccttctaaaagcatcacctttacttccagaagcaccagccccagaacaagtacaaacttttcacccatgaggccacagcagcccaaccttcagcatctcaagtctagcccacctggatttccatttccagggcctcctaattttcccccacaaagcatgtttggatttccaccacatttgccacctccattacttccccctccaggctttggctttgctcaaaatcccatggttccctggccacctgttgttcatctcccaggtcagccacagcgtatgatgggtcctctctcacaagcatcaaggtatataggcccgcagaatttttaccaggttaaagacattcggaggccagaaaggcgccatagtgacccttggggtaggcaagaccaacagcaactggataggccatttaataggggtaaaggggaccgccagagattttatagtgattcacaccatttgaaaagagagcgacatgaaaaggaatgggagcaagaatctgaaaggcatagacgcagagacagaagccaagacaaggacagagacagaaaaagcagggaggaagggcacaaagataaagagagggcacggttatcacatggtgatcgaggaacagatggaaaagcaagcagagatagtaggaatgtagacaagaagccagataaacctaaaagtgaagactatgagaaggacaaagaacgagagaaaagtaaacacagagaaggagaaaaggacagggataggtaccacaaagatagggaccacactgacagaactaaaagcaaaaggtaaaatttgcaggctgcttcaggattacatttaaataactgttaaaatgttgtatcttgtaaacaaaagaaagattgcctgctaggattgtgccatctttaaaatttttactattggtcatttgcagaacagtaaattctgtgtgttggtacagagtgctctgtaccagtgctcatcatcccttcttcataccaacggtccctagttataggaatttaatatttttaaaagttttacattgctgtatattcaaagatttgttttattaatatgcaataaaggcttagaaattttagttttattccttaattggtaaatatggttaactatggaatatatttacttcctctagtgaatgtcctttatataatgactaatttgggagtaatgtgtgctctgtaagtttgttttaaattgcactgtttttaaagaaactgtagaggagcaacaaaaatccaagcaacttcataatcagattatgctaatcatttagttgagcagtttttgaccaagaatcagaagcccaaggggtacatttattgctttaatctgcactcattgaagtcatttattaccatatactacagctttgtggtaggccattattttcattttcatttttggctcttcagaaacttgaatacttaagcttgtacatgatcttgtgttttgctatcctttttactgtaaaatgtaaatattttaagggatattttgattctaaatatgataaaataatttctcaccta

SEQ ID NO: 446578 - DNA, 4219 bp, Homo sapiens
aggcccgtctcgcaggcccccggatccggccgttggggcctcttccttctcagggagccccagcatggagctttgggccttggtttcgggaaactgggactggccctggctgctaggctgctccctgctgctgctttttggagatgagagttgctcttccatttatcctccagttaccgcgcgcttttgtgcccgggactcaaactgtggactccttttgcttagtttgaaatgagaagcctagactcttgccttccgataatacatgtaatttaatgaaccacttgtcgatacggctgaaagacacacagaagtcttcatggatatagttgatacatttaatcatttaattcctactgaacacttagatgatgccctatttctaggatccaacctggagaatgaagtctgtgaggattttagtgcaagtcaaaatgtcttagaggactcgctgaagaacatgctcagcgataaggatcctatgctaggatctgcaagtaaccagttctgtttgcctgttttggatagcaatgatcccaatttccagatgccttgttcaacagaacaagtaagaagtttgcgacagagcactattgccaagcgttcaaatgcagcaccattaagtaacacaaaaaaagcatctgggaagactgtatctactgctaaagcaggagtgaaacaaccagaaaggagtcaggttaaagaagaagtatgtatgtcactgaaacctgagtaccataaggagaatagaaggtgcagccgaaatagcggacaaattgaagtggtacctgaagtatcagtgtcttcaagtcattcttcagtgtcatcttgtcttgaaatgaaggatgaagatggattagattctaagcataagtgtaataatccgggagaaatagatgtgccatctcatgaattaaattgttcacttctttcagagacttgtgttactattggagaaaagaaaaatgaagctttgatggaatgtaaagccaagcctgttggtagtccattgtttaagttttcagataaagaagaacatgaacaaaatgattccatttcaggtaaaacgggtgagactgttgttgaagaaatgatagcaacaagaaaagttgaacaagattcaaaggagacagtaaaattatcccatgaagatgaccatattcttgaggacgctggatcttctgatatttctagtgatgctgcttgtacaaatccaaataagacagaaaacagccttgtaggtttgcctagttgtgtagatgaagtgactgaatgtaatttggaattgaaggataccatgggtattgctgataaaactgagaacacccttgaaagaaataaaattgaaccgttgggttattgtgaagatgcggagtctaataggcagttggagagcactgagtttaataaatcaaacttagaggtggttgatactagtacttttggaccggaaagtaatatcttggaaaatgctatttgtgatgtgcctgaccaaaattcaaaacagttgaatgctatagaaagtactaaaatagagtcccatgaaacagcaaaccttcaggatgacagaaacagccagtcaagtagcgtttcttacttagagtcaaaaagtgtaaaatccaaacatacaaaacctgtaattcattctaagcaaaacatgaccacagatgctccgaagaaaattgttgcagcaaagtatgaagtaatacatagcaaaactaaagttaatgtcaaaagtgtgaaacgaaatactgatgtaccagaatctcagcaaaattttcataggccagtcaaagtcagaaaaaaacaaattgataaggagccaaagattcagagttgcaattctggggttaaatctgtgaaaaaccaagctcattctgtactgaaaaaaacattacaggatcaaactttagtacaaattttcaagcccttaactcattctttgagtgataagtcacacgctcatcctggttgcttgaaagaacctcatcatcctgcacaaactggacatgtatcacattctagccagaaacagtgtcataagcctcagcaacaggccccagcaatgaaaaccaatagtcacgtgaaggaagagcttgaacacccaggcgttgagcattttaaggaagaggataaactgaaactgaaaaaacctgagagaatcaacctactactctggaattagcaaataaacctcttcctgtggatgatatacttcaaagccttttgggcaccactggtcaagtatatgaccaggcccagtcagtgatggaacaaaacactgttaaagaaattccatttttaaatgagcagaccaactcaaaaatagagaaaacagataatgtggaagtaactgatggtgaaaacaaggagataaaagttaaagtagataatatttcagaatctacagataagtcagcagaaatagaaacatcagtagtagggtcctcttccatttctgcagggtctttgacgagtcttagtctcagaggtaagccaccagatgtttctacagaagcatttttaacaaatttatcaattcagtcaaaacaagaggaaactgtggagagtaaagagaaaacattaaaaagacagcttcaggaagatcaagagaataatttgcaagataaccagacttcaaatagttctccatgcagatctaatgtaggaaaaggaaacatagatggtaatgtgagctgtagtgaaaaccttgttgctaatacagcgaggtctccacagtttatcaacctgaaaagggatcctaggcaagcagcaggacgaagtcagcctgtaactacttcagaaagcaaagatggagatagttgccggaatggagaaaaacacatgctgcctggcctgtcacacaacaaggagcacttaacagaacaaatcaatgtagaggaaaagttgtgttctgcagagaaaaactcgtgtgttcagcagagtgacaatttaaaagttgcacaaaactcaccatcagtagaaaacatacagacttctcaagcagaacaagcaaaacccttacaggaggatattttaatgcaaaatattgaaactgtgcacccatttcgaagaggatcagcagtagcgacatctcattttgaagttggaaacacatgtccatcagaatttccttctaaaagcatcacctttacttccagaagcaccagccccagaacaagtacaaacttttcacccatgaggccacagcagcccaaccttcagcatctcaagtctagcccacctggatttccatttccagggcctcctaattttcccccacaaagcatgtttggatttccaccacatttgccacctccattacttccccctccaggctttggctttgctcaaaatcccatggttccctggccacctgttgttcatctcccaggtcagccacagcgtatgatgggtcctctctcacaagcatcaaggtatataggcccgcagaatttttaccaggttaaagacattcggaggccagaaaggcgccatagtgacccttggggtaggcaagaccaacagcaactggataggccatttaataggggtaaaggggaccgccagagattttatagtgattcacaccatttgaaaagagagcgacatgaaaaggaatgggagcaagaatctgaaaggcatagacgcagagacagaagccaagacaaggacagagacagaaaaagcagggaggaagggcacaaagataaagagagggcacggttatcacatggtgatcgaggaacagatggaaaagcaagcagagatagtaggaatgtagacaagaagccagataaacctaaaagtgaagactatgagaaggacaaagaacgagagaaaagtaaacacagagaaggagaaaaggacagggataggtaccacaaagatagggaccacactgacagaactaaaagcaaaaggtaaaatttgcaggctgcttcaggattacatttaaataactgttaaaatgttgtatcttgtaaacaaaagaaagattgcctgctaggattgtgccatctttaaaatttttactattggtcatttgcagaacagtaaattctgtgtgttggtacagagtgctctgtaccagtgctcatcatcccttcttcataccaacggtccctagttataggaatttaatatttttaaaagttttacattgctgtatattcaaagatttgttttattaatatgcaataaaggcttagaaatttta

SEQ ID NO: 446579 - DNA, 6192 bp, Homo sapiens
aggcccgtctcgcaggcccccggatccggccgttggggcctcttccttctcagggagccccagcatggagctttgggccttggtttcgggaaactgggactggccctggctgctaggctgctccctgctgctgctttttggagatgagagttgctcttccatttatcctccagttaccgcgcgcttttgtgcccgggactcaaactgtggactccttttgcttagtttgaaatgagaagcctagactcttgccttccgataatacatgtaatttaatgaaccacttgtcgatacggctgaaagacacacagaagtcttcatggatatagttgatacatttaatcatttaattcctactgaacacttagatgatgccctatttctaggatccaacctggagaatgaagtctgtgaggattttagtgcaagtcaaaatgtcttagaggactcgctgaagaacatgctcagcgataaggatcctatgctaggatctgcaagtaaccagttctgtttgcctgttttggatagcaatgatcccaatttccagatgccttgttcaacagaacaagtaagaagtttgcgacagagcactattgccaagcgttcaaatgcagcaccattaagtaacacaaaaaaagcatctgggaagactgtatctactgctaaagcaggagtgaaacaaccagaaaggagtcaggttaaagaagaagtatgtatgtcactgaaacctgagtaccataaggagaatagaaggtgcagccgaaatagcggacaaattgaagtggtacctgaagtatcagtgtcttcaagtcattcttcagtgtcatcttgtcttgaaatgaaggatgaagatggattagattctaagcataagtgtaataatccgggagaaatagatgtgccatctcatgaattaaattgttcacttctttcagagacttgtgttactattggagaaaagaaaaatgaagctttgatggaatgtaaagccaagcctgttggtagtccattgtttaagttttcagataaagaagaacatgaacaaaatgattccatttcaggtaaaacgggtgagactgttgttgaagaaatgatagcaacaagaaaagttgaacaagattcaaaggagacagtaaaattatcccatgaagatgaccatattcttgaggacgctggatcttctgatatttctagtgatgctgcttgtacaaatccaaataagacagaaaacagccttgtaggtttgcctagttgtgtagatgaagtgactgaatgtaatttggaattgaaggataccatgggtattgctgataaaactgagaacacccttgaaagaaataaaattgaaccgttgggttattgtgaagatgcggagtctaataggcagttggagagcactgagtttaataaatcaaacttagaggtggttgatactagtacttttggaccggaaagtaatatcttggaaaatgctatttgtgatgtgcctgaccaaaattcaaaacagttgaatgctatagaaagtactaaaatagagtcccatgaaacagcaaaccttcaggatgacagaaacagccagtcaagtagcgtttcttacttagagtcaaaaagtgtaaaatccaaacatacaaaacctgtaattcattctaagcaaaacatgaccacagatgctccgaagaaaattgttgcagcaaagtatgaagtaatacatagcaaaactaaagttaatgtcaaaagtgtgaaacgaaatactgatgtaccagaatctcagcaaaattttcataggccagtcaaagtcagaaaaaaacaaattgataaggagccaaagattcagagttgcaattctggggttaaatctgtgaaaaaccaagctcattctgtactgaaaaaaacattacaggatcaaactttagtacaaattttcaagcccttaactcattctttgagtgataagtcacacgctcatcctggttgcttgaaagaacctcatcatcctgcacaaactggacatgtatcacattctagccagaaacagtgtcataagcctcagcaacaggccccagcaatgaaaaccaatagtcacgtgaaggaagagcttgaacacccaggcgttgagcattttaaggaagaggataaactgaaactgaaaaaacctgagaagaacctacaaccccgccaaagaagaagcagcaaaagtttttctttagatgagccaccattgttcattccagataacatagctaccataagaagagaaggctctgatcatagctcctcatttgaaagcaaatatatgtggactcccagcaagcagtgtgggttttgcaaaaaaccacatggcaacaggtttatggttggctgtgggagatgtgatgactggtttcatggtgattgtgttgggttaagtctttctcaagcacagcagatgggcgaggaagacaaagaatatgtctgtgtaaaatgttgtgctgaagaagacaaaaagactgaaatactagatccagatactttggaaaaccaagctacagttgaattccatagtggagataaaacaatggagtgtgaaaagcttggattatcaaaacacacaacaaatgatagaaccaaatatatagatgatacagtgaagcacaaggtcaaaattttaaaacgggagtctggtgaaggcagaaattcatcagactgtagagataatgaaattaaaaaatggcagctagctcctcttcgtaagatgggacaaccagttttacctcggagatcctcagaagaaaaaagtgaaaaaataccgaaagagtctacaactgttacttgcacaggagaaaaagcttcaaaaccaggtactcatgagaagcaagagatgaaaaagaagaaagttgaaaaaggagtgcttaatgtacatcctgctgcttctgcttccaagccttctgcagatcagatcaggcaaagtgtcagacattctctcaaagacattcttatgaagagacttacagactcaaatttgaaggtaccagaggaaaaggcagcaaaagttgccacaaaaattgagaaagagcttttctctttttttcgggacacagatgctaaatataagaacaaatatagaagtttgatgtttaatttgaaagatcctaaaaacaatatattatttaaaaaagtactgaaaggagaagtaactcctgatcatcttatcagaatgagtccagaagaactagcttctaaagagttagctgcttggagacgaagagaaaacagacataccatagaaatgattgagaaagagcagagagaagtggaacgacggccaatcaccaaaataactcataaaggtgaaatagaaattgagagtgatgccccaatgaaagaacaggaagcagccatggagattcaggaaccagccgccaataagtcattggagaagccagaaggatctgaaaaacaaaaagaggaggttgactctatgtctaaagataccactagtcaacacagacagcatctttttgatctcaactgcaaaatctgcataggtcgaatggcaccacctgtagatgatctttctccaaaaaaagtaaaagttgttgtaggagtagctcgcaaacattcagacaatgaagcagaaagtatagcagatgcattatcttcaacctcaaatattttggcttctgaattctttgaggaggagaaacaggagtctccaaagtcaacgttctctcctgctccacgtccagagatgcctggaactgttgaagttgagtctacctttctggctcgattgaacttcatctggaaaggttttatcaacatgccttctgtggcaaaatttgttaccaaagcctatccagtatctggctccccagaatacctgacagaggacctaccagatagtattcaagtaggtggcaggatatcacctcagacagtttgggattatgtggaaaaaataaaagcatcaggaaccaaggaaatttgtgtggttcgcttcacaccagtaactgaagaagatcaaatttcttatactttgctctttgcatacttcagtagcagaaagcgctatggagtagctgctaacaacatgaagcaggttaaagatatgtaccttattcctttgggtgccacagataaaattccacaccctcttgtgccttttgatggacctgggcttgaactgcatagacctaatctattgttgggcttaattattcgtcagaaactgaagcgacagcacagtgcctgtgctagtactagtcatatagctgagactcctgaaagtgcaccaccaatagcattgccacctgataaaaaaagtaaaatagaagtttctacagaagaagcaccagaggaagaaaatgacttttttaattcttttacaactgtattacacaagcagagaaataaacctcagcagaatcttcaggaagaccttccaacagcagttgaacctttaatggaagtcaccaaacaggagccaccaaaacctttaagatttcttcctggcgtgttgattggctgggagaatcaacctactactctggaattagcaaataaacctcttcctgtggatgatatacttcaaagccttttgggcaccactggtcaagtatatgaccaggcccagtcagtgatggaacaaaacactgttaaagaaattccatttttaaatgagcagaccaactcaaaaatagagaaaacagataatgtggaagtaactgatggtgaaaacaaggagataaaagttaaagtagataatatttcagaatctacagataagtcagcagaaatagaaacatcagtagtagggtcctcttccatttctgcagggtctttgacgagtcttagtctcagaggtaagccaccagatgtttctacagaagcatttttaacaaatttatcaattcagtcaaaacaagaggaaactgtggagagtaaagagaaaacattaaaaagacagcttcaggaagatcaagagaataatttgcaagataaccagacttcaaatagttctccatgcagatctaatgtaggaaaaggaaacatagatggtaatgtgagctgtagtgaaaaccttgttgctaatacagcgaggtctccacagtttatcaacctgaaaagggatcctaggcaagcagcaggacgaagtcagcctgtaactacttcagaaagcaaagatggagatagttgccggaatggagaaaaacacatgctgcctggcctgtcacacaacaaggagcacttaacagaacaaatcaatgtagaggaaaagttgtgttctgcagagaaaaactcgtgtgttcagcagagtgacaatttaaaagttgcacaaaactcaccatcagtagaaaacatacagacttctcaagcagaacaagcaaaacccttacaggaggatattttaatgcaaaatattgaaactgtgcacccatttcgaagaggatcagcagtagcgacatctcattttgaagttggaaacacatgtccatcagaatttccttctaaaagcatcacctttacttccagaagcaccagccccagaacaagtacaaacttttcacccatgaggccacagcagcccaaccttcagcatctcaagtctagcccacctggatttccatttccagggcctcctaattttcccccacaaagcatgtttggatttccaccacatttgccacctccattacttccccctccaggctttggctttgctcaaaatcccatggttccctggccacctgttgttcatctcccaggtcagccacagcgtatgatgggtcctctctcacaagcatcaaggtatataggcccgcagaatttttaccaggttaaagacattcggaggccagaaaggcgccatagtgacccttggggtaggcaagaccaacagcaactggataggccatttaataggggtaaaggggaccgccagagattttatagtgattcacaccatttgaaaagagagcgacatgaaaaggaatgggagcaagaatctgaaaggcatagacgcagagacagaagccaagacaaggacagagacagaaaaagcagggaggaagggcacaaagataaagagagggcacggttatcacatggtgatcgaggaacagatggaaaagcaagcagagatagtaggaatgtagacaagaagccagataaacctaaaagtgaagactttcaagactatcgagacctgctcgc

SEQ ID NO: 446580 - DNA, 2760 bp, Homo sapiens
aggcccgtctcgcaggcccccggatccggccgttggggcctcttccttctcagggagccccagcatggagctttgggccttggtttcgggaaactgggactggccctggctgctaggctgctccctgctgctgctttttggagatgagagttgctcttccatttatcctccagttaccgcgcgcttttgtgcccgggactcaaactgtggactccttttgcttagtttgaaatgagaagcctagactcttgccttccgataatacatgtaatttaatgaaccacttgtcgatacggctgaaagacacacagaagtcttcatggatatagttgatacatttaatcatttaattcctactgaacacttagatgatgccctatttctaggatccaacctggagaatgaagtctgtgaggattttagtgcaagtcaaaatgtcttagaggactcgctgaagaacatgctcagcgataaggatcctatgctaggatctgcaagtaaccagttctgtttgcctgttttggatagcaatgatcccaatttccagatgccttgttcaacagaacaagtaagaagtttgcgacagagcactattgccaagcgttcaaatgcagcaccattaagtaacacaaaaaaagcatctgggaagactgtatctactgctaaagcaggagtgaaacaaccagaaaggagtcaggttaaagaagaagtatgtatgtcactgaaacctgagtaccataaggagaatagaaggtgcagccgaaatagcggacaaattgaagtggtacctgaagtatcagtgtcttcaagtcattcttcagtgtcatcttgtcttgaaatgaaggatgaagatggattagattctaagcataagtgtaataatccgggagaaatagatgtgccatctcatgaattaaattgttcacttctttcagagacttgtgttactattggagaaaagaaaaatgaagctttgatggaatgtaaagccaagcctgttggtagtccattgtttaagttttcagataaagaagaacatgaacaaaatgattccatttcaggtaaaacgggtgagactgttgttgaagaaatgatagcaacaagaaaagttgaacaagattcaaaggagacagtaaaattatcccatgaagatgaccatattcttgaggacgctggatcttctgatatttctagtgatgctgcttgtacaaatccaaataagacagaaaacagccttgtaggtttgcctagttgtgtagatgaagtgactgaatgtaatttggaattgaaggataccatgggtattgctgataaaactgagaacacccttgaaagaaataaaattgaaccgttgggttattgtgaagatgcggagtctaataggcagttggagagcactgagtttaataaatcaaacttagaggtggttgatactagtacttttggaccggaaagtaatatcttggaaaatgctatttgtgatgtgcctgaccaaaattcaaaacagttgaatgctatagaaagtactaaaatagagtcccatgaaacagcaaaccttcaggatgacagaaacagccagtcaagtagcgtttcttacttagagtcaaaaagtgtaaaatccaaacatacaaaacctgtaattcattctaagcaaaacatgaccacagatgctccgaagaaaattgttgcagcaaagtatgaagtaatacatagcaaaactaaagttaatgtcaaaagtgtgaaacgaaatactgatgtaccagaatctcagcaaaattttcataggccagtcaaagtcagaaaaaaacaaattgataaggagccaaagattcagagttgcaattctggggttaaatctgtgaaaaaccaagctcattctgtactgaaaaaaacattacaggatcaaactttagtacaaattttcaagcccttaactcattctttgagtgataagtcacacgctcatcctggttgcttgaaagaacctcatcatcctgcacaaactggacatgtatcacattctagccagaaacagtgtcataagcctcagcaacaggccccagcaatgaaaaccaatagtcacgtgaaggaagagcttgaacacccaggcgttgagcattttaaggaagaggataaactgaaactgaaaaaacctgagaagaacctacaaccccgccaaagaagaagcagcaaaagtttttctttagatgagccaccattgttcattccagataacatagctaccataagaagagaaggctctgatcatagctcctcatttgaaagcaaatatatgtggactcccagcaagcagtgtgggttttgcaaaaaaccacatggcaacaggtgtgtgtgtatgtgtgtatgagtgatgtgtacattgaaaataaattgcttttttgggggtgggattaatgtgagaattgttttaaagacattatttgatacacagagacctgtgcaaaaacaaaaagcttcatcagtcttggataaatgatagaaagatggatctactgaatttacaaatatatcatcctagaacatttaaaaaagcatagtctggccaacagctgacatacatggaaatattttgtcattgtcacaggttagacagtgtaatttagccactgcatctgcaaaaaagccaaacacttcctggtaattggaaaattgttatactgctttgggtctgtaagttatatattaattcatttggtgtgagaagaactagtaataaagtatgaaggtcataatggaaat

SEQ ID NO: 446581 - DNA, 533 bp, Homo sapiens
atggatgaaggagttgttaaagaaagtggcaatgataccattgatgaagaagaactgattttacctaacaggaacttaagggacaaggtagaagaaaattcagtgagatctccaagaaaatcacctcgtttaatggcacaaggtaatcctttgagagaggtctagctagaaaattagaggtatagggacagatgtgttaggttataaacctgctgagcagaaatcatattttcttgatgttttgctaatccattcgttttgatggcaatcagttttgagatcatatcaatttgttgtataagttttcagtacccaccaccccacactacccatttctccttccccaggggaaaccactagtaactctgagctggtttaatttttttttttttttttttttttggtatttacctttatagctctaggtaacatgcatatgttgctgttttttgattattctgatttattattcatccatctattgacttcccactgtggatggttttcttcctgctacttgtccccatcatata

SEQ ID NO: 446582 - DNA, 7023 bp, Homo sapiens
aggcccgtctcgcaggcccccggatccggccgttggggcctcttccttctcagggagccccagcatggagctttgggccttggtttcgggaaactgggactggccctggctgctaggctgctccctgctgctgctttttggagatgagagttgctcttccatttatcctccagttaccgcgcgcttttgtgcccgggactcaaactgtggactccttttgcttagtttgaaatgagaagcctagactcttgccttccgataatacatgtaatttaatgaaccacttgtcgatacggctgaaagacacacagaagtcttcatggatatagttgatacatttaatcatttaattcctactgaacacttagatgatgccctatttctaggatccaacctggagaatgaagtctgtgaggattttagtgcaagtcaaaatgtcttagaggactcgctgaagaacatgctcagcgataaggatcctatgctaggatctgcaagtaaccagttctgtttgcctgttttggatagcaatgatcccaatttccagatgccttgttcaacagaacaagtaagaagtttgcgacagagcactattgccaagcgttcaaatgcagcaccattaagtaacacaaaaaaagcatctgggaagactgtatctactgctaaagcaggagtgaaacaaccagaaaggagtcaggttaaagaagaagtatgtatgtcactgaaacctgagtaccataaggagaatagaaggtgcagccgaaatagcggacaaattgaagtggtacctgaagtatcagtgtcttcaagtcattcttcagtgtcatcttgtcttgaaatgaaggatgaagatggattagattctaagcataagtgtaataatccgggagaaatagatgtgccatctcatgaattaaattgttcacttctttcagagacttgtgttactattggagaaaagaaaaatgaagctttgatggaatgtaaagccaagcctgttggtagtccattgtttaagttttcagataaagaagaacatgaacaaaatgattccatttcaggtaaaacgggtgagactgttgttgaagaaatgatagcaacaagaaaagttgaacaagattcaaaggagacagtaaaattatcccatgaagatgaccatattcttgaggacgctggatcttctgatatttctagtgatgctgcttgtacaaatccaaataagacagaaaacagccttgtaggtttgcctagttgtgtagatgaagtgactgaatgtaatttggaattgaaggataccatgggtattgctgataaaactgagaacacccttgaaagaaataaaattgaaccgttgggttattgtgaagatgcggagtctaataggcagttggagagcactgagtttaataaatcaaacttagaggtggttgatactagtacttttggaccggaaagtaatatcttggaaaatgctatttgtgatgtgcctgaccaaaattcaaaacagttgaatgctatagaaagtactaaaatagagtcccatgaaacagcaaaccttcaggatgacagaaacagccagtcaagtagcgtttcttacttagagtcaaaaagtgtaaaatccaaacatacaaaacctgtaattcattctaagcaaaacatgaccacagatgctccgaagaaaattgttgcagcaaagtatgaagtaatacatagcaaaactaaagttaatgtcaaaagtgtgaaacgaaatactgatgtaccagaatctcagcaaaattttcataggccagtcaaagtcagaaaaaaacaaattgataaggagccaaagattcagagttgcaattctggggttaaatctgtgaaaaaccaagctcattctgtactgaaaaaaacattacaggatcaaactttagtacaaattttcaagcccttaactcattctttgagtgataagtcacacgctcatcctggttgcttgaaagaacctcatcatcctgcacaaactggacatgtatcacattctagccagaaacagtgtcataagcctcagcaacaggccccagcaatgaaaaccaatagtcacgtgaaggaagagcttgaacacccaggcgttgagcattttaaggaagaggataaactgaaactgaaaaaacctgagaagaacctacaaccccgccaaagaagaagcagcaaaagtttttctttagatgagccaccattgttcattccagataacatagctaccataagaagagaaggctctgatcatagctcctcatttgaaagcaaatatatgtggactcccagcaagcagtgtgggttttgcaaaaaaccacatggcaacaggtttatggttggctgtgggagatgtgatgactggtttcatggtgattgtgttgggttaagtctttctcaagcacagcagatgggcgaggaagacaaagaatatgtctgtgtaaaatgttgtgctgaagaagacaaaaagactgaaatactagatccagatactttggaaaaccaagctacagttgaattccatagtggagataaaacaatggagtgtgaaaagcttggattatcaaaacacacaacaaatgatagaaccaaatatatagatgatacagtgaagcacaaggtcaaaattttaaaacgggagtctggtgaaggcagaaattcatcagactgtagagataatgaaattaaaaaatggcagctagctcctcttcgtaagatgggacaaccagttttacctcggagatcctcagaagaaaaaagtgaaaaaataccgaaagagtctacaactgttacttgcacaggagaaaaagcttcaaaaccaggtactcatgagaagcaagagatgaaaaagaagaaagttgaaaaaggagtgcttaatgtacatcctgctgcttctgcttccaagccttctgcagatcagatcaggcaaagtgtcagacattctctcaaagacattcttatgaagagacttacagactcaaatttgaaggtaccagaggaaaaggcagcaaaagttgccacaaaaattgagaaagagcttttctctttttttcgggacacagatgctaaatataagaacaaatatagaagtttgatgtttaatttgaaagatcctaaaaacaatatattatttaaaaaagtactgaaaggagaagtaactcctgatcatcttatcagaatgagtccagaagaactagcttctaaagagttagctgcttggagacgaagagaaaacagacataccatagaaatgattgagaaagagcagagagaagtggaacgacggccaatcaccaaaataactcataaaggtgaaatagaaattgagagtgatgccccaatgaaagaacaggaagcagccatggagattcaggaaccagccgccaataagtcattggagaagccagaaggatctgaaaaacaaaaagaggaggttgactctatgtctaaagataccactagtcaacacagacagcatctttttgatctcaactgcaaaatctgcataggtcgaatggcaccacctgtagatgatctttctccaaaaaaagtaaaagttgttgtaggagtagctcgcaaacattcagacaatgaagcagaaagtatagcagatgcattatcttcaacctcaaatattttggcttctgaattctttgaggaggagaaacaggagtctccaaagtcaacgttctctcctgctccacgtccagagatgcctggaactgttgaagttgagtctacctttctggctcgattgaacttcatctggaaaggttttatcaacatgccttctgtggcaaaatttgttaccaaagcctatccagtatctggctccccagaatacctgacagaggacctaccagatagtattcaagtaggtggcaggatatcacctcagacagtttgggattatgtggaaaaaataaaagcatcaggaaccaaggaaatttgtgtggttcgcttcacaccagtaactgaagaagatcaaatttcttatactttgctctttgcatacttcagtagcagaaagcgctatggagtagctgctaacaacatgaagcaggttaaagatatgtaccttattcctttgggtgccacagataaaattccacaccctcttgtgccttttgatggacctgggcttgaactgcatagacctaatctattgttgggcttaattattcgtcagaaactgaagcgacagcacagtgcctgtgctagtactagtcatatagctgagactcctgaaagtgcaccaccaatagcattgccacctgataaaaaaagtaaaatagaagtttctacagaagaagcaccagaggaagaaaatgacttttttaattcttttacaactgtattacacaagcagagaaataaacctcagcagaatcttcaggaagaccttccaacagcagttgaacctttaatggaagtcaccaaacaggagccaccaaaacctttaagatttcttcctggcgtgttgattggctgggagaatcaacctactactctggaattagcaaataaacctcttcctgtggatgatatacttcaaagccttttgggcaccactggtcaagtatatgaccaggcccagtcagtgatggaacaaaacactgttaaagaaattccatttttaaatgagcagaccaactcaaaaatagagaaaacagataatgtggaagtaactgatggtgaaaacaaggagataaaagttaaagtagataatatttcagaatctacagataagtcagcagaaatagaaacatcagtagtagggtcctcttccatttctgcagggtctttgacgagtcttagtctcagaggtaagccaccagatgtttctacagaagcatttttaacaaatttatcaattcagtcaaaacaagaggaaactgtggagagtaaagagaaaacattaaaaagacagcttcaggaagatcaagagaataatttgcaagataaccagacttcaaatagttctccatgcagatctaatgtaggaaaaggaaacatagatggtaatgtgagctgtagtgaaaaccttgttgctaatacagcgaggtctccacagtttatcaacctgaaaagggatcctaggcaagcagcaggacgaagtcagcctgtaactacttcagaaagcaaagatggagatagttgccggaatggagaaaaacacatgctgcctggcctgtcacacaacaaggagcacttaacagaacaaatcaatgtagaggaaaagttgtgttctgcagagaaaaactcgtgtgttcagcagagtgacaatttaaaagttgcacaaaactcaccatcagtagaaaacatacagacttctcaagcagaacaagcaaaacccttacaggaggatattttaatgcaaaatattgaaactgtgcacccatttcgaagaggatcagcagtagcgacatctcattttgaagttggaaacacatgtccatcagaatttccttctaaaagcatcacctttacttccagaagcaccagccccagaacaagtacaaacttttcacccatgaggccacagcagcccaaccttcagcatctcaagtctagcccacctggatttccatttccagggcctcctaattttcccccacaaagcatgtttggatttccaccacatttgccacctccattacttccccctccaggctttggctttgctcaaaatcccatggttccctggccacctgttgttcatctcccaggtcagccacagcgtatgatgggtcctctctcacaagcatcaaggtatataggcccgcagaatttttaccaggttaaagacattcggaggccagaaaggcgccatagtgacccttggggtaggcaagaccaacagcaactggataggccatttaataggggtaaaggggaccgccagagattttatagtgattcacaccatttgaaaagagagcgacatgaaaaggaatgggagcaagaatctgaaaggcatagacgcagagacagaagccaagacaaggacagagacagaaaaagcagggaggaagggcacaaagataaagagagggcacggttatcacatggtgatcgaggaacagatggaaaagcaagcagagatagtaggaatgtagacaagaagccagataaacctaaaagtgaagactatgagaaggacaaagaacgagagaaaagtaaacacagagaaggagaaaaggacagggataggtaccacaaagatagggaccacactgacagaactaaaagcaaaaggtaaaatttgcaggctgcttcaggattacatttaaataactgttaaaatgttgtatcttgtaaacaaaagaaagattgcctgctaggattgtgccatctttaaaatttttactattggtcatttgcagaacagtaaattctgtgtgttggtacagagtgctctgtaccagtgctcatcatcccttcttcataccaacggtccctagttataggaatttaatatttttaaaagttttacattgctgtatattcaaagatttgttttattaatatgcaataaaggcttagaaattttagttttattccttaattggtaaatatggttaactatggaatatatttacttcctctagtgaatgtcctttatataatgactaatttgggagtaatgtgtgctctgtaagtttgttttaaattgcactgtttttaaagaaactgtagaggagcaacaaaaatccaagcaacttcataatcagattatgctaatcatttagttgagcagtttttgaccaagaatcagaagcccaaggggtacatttattgctttaatctgcactcattgaagtcatttattaccatatactacagctttgtggtaggccattattttcattttcatttttggctcttcagaaacttgaatacttaagcttgtacatgatcttgtgttttgctatcctttttactgtaaaatgtaaatattttaagggatattttgattctaaatatgataaaataatttctcaccta

SEQ ID NO: 446583 - DNA, 6569 bp, Homo sapiens
aggcccgtctcgcaggcccccggatccggccgttggggcctcttccttctcagggagccccagcatggagctttgggccttggtttcgggaaactgggactggccctggctgctaggctgctccctgctgctgctttttggagatgagagttgctcttccatttatcctccagttaccgcgcgcttttgtgcccgggactcaaactgtggactccttttgcttagtttgaaatgagaagcctagactcttgccttccgataatacatgtaatttaatgaaccacttgtcgatacggctgaaagacacacagaagtcttcatggatatagttgatacatttaatcatttaattcctactgaacacttagatgatgccctatttctaggatccaacctggagaatgaagtctgtgaggattttagtgcaagtcaaaatgtcttagaggactcgctgaagaacatgctcagcgataaggatcctatgctaggatctgcaagtaaccagttctgtttgcctgttttggatagcaatgatcccaatttccagatgccttgttcaacagaacaagtaagaagtttgcgacagagcactattgccaagcgttcaaatgcagcaccattaagtaacacaaaaaaagcatctgggaagactgtatctactgctaaagcaggagtgaaacaaccagaaaggagtcaggttaaagaagaagtatgtatgtcactgaaacctgagtaccataaggagaatagaaggtgcagccgaaatagcggacaaattgaagtggtacctgaagtatcagtgtcttcaagtcattcttcagtgtcatcttgtcttgaaatgaaggatgaagatggattagattctaagcataagtgtaataatccgggagaaatagatgtgccatctcatgaattaaattgttcacttctttcagagacttgtgttactattggagaaaagaaaaatgaagctttgatggaatgtaaagccaagcctgttggtagtccattgtttaagttttcagataaagaagaacatgaacaaaatgattccatttcaggtaaaacgggtgagactgttgttgaagaaatgatagcaacaagaaaagttgaacaagattcaaaggagacagtaaaattatcccatgaagatgaccatattcttgaggacgctggatcttctgatatttctagtgatgctgcttgtacaaatccaaataagacagaaaacagccttgtaggtttgcctagttgtgtagatgaagtgactgaatgtaatttggaattgaaggataccatgggtattgctgataaaactgagaacacccttgaaagaaataaaattgaaccgttgggttattgtgaagatgcggagtctaataggcagttggagagcactgagtttaataaatcaaacttagaggtggttgatactagtacttttggaccggaaagtaatatcttggaaaatgctatttgtgatgtgcctgaccaaaattcaaaacagttgaatgctatagaaagtactaaaatagagtcccatgaaacagcaaaccttcaggatgacagaaacagccagtcaagtagcgtttcttacttagagtcaaaaagtgtaaaatccaaacatacaaaacctgtaattcattctaagcaaaacatgaccacagatgctccgaagaaaattgttgcagcaaagtatgaagtaatacatagcaaaactaaagttaatgtcaaaagtgtgaaacgaaatactgatgtaccagaatctcagcaaaattttcataggccagtcaaagtcagaaaaaaacaaattgataaggagccaaagattcagagttgcaattctggggttaaatctgtgaaaaaccaagctcattctgtactgaaaaaaacattacaggatcaaactttagtacaaattttcaagcccttaactcattctttgagtgataagtcacacgctcatcctggttgcttgaaagaacctcatcatcctgcacaaactggacatgtatcacattctagccagaaacagtgtcataagcctcagcaacaggccccagcaatgaaaaccaatagtcacgtgaaggaagagcttgaacacccaggcgttgagcattttaaggaagaggataaactgaaactgaaaaaacctgagaagaacctacaaccccgccaaagaagaagcagcaaaagtttttctttagatgagccaccattgttcattccagataacatagctaccataagaagagaaggctctgatcatagctcctcatttgaaagcaaatatatgtggactcccagcaagcagtgtgggttttgcaaaaaaccacatggcaacaggtttatggttggctgtgggagatgtgatgactggtttcatggtgattgtgttgggttaagtctttctcaagcacagcagatgggcgaggaagacaaagaatatgtctgtgtaaaatgttgtgctgaagaagacaaaaagactgaaatactagatccagatactttggaaaaccaagctacagttgaattccatagtggagataaaacaatggagtgtgaaaagcttggattatcaaaacacacaacaaatgatagaaccaaatatatagatgatacagtgaagcacaaggtcaaaattttaaaacgggagtctggtgaaggcagaaattcatcagactgtagagataatgaaattaaaaaatggcagctagctcctcttcgtaagatgggacaaccagttttacctcggagatcctcagaagaaaaaagtgaaaaaataccgaaagagtctacaactgttacttgcacaggagaaaaagcttcaaaaccaggtactcatgagaagcaagagatgaaaaagaagaaagttgaaaaaggagtgcttaatgtacatcctgctgcttctgcttccaagccttctgcagatcagatcaggcaaagtgtcagacattctctcaaagacattcttatgaagagacttacagactcaaatttgaaggtaccagaggaaaaggcagcaaaagttgccacaaaaattgagaaagagcttttctctttttttcgggacacagatgctaaatataagaacaaatatagaagtttgatgtttaatttgaaagatcctaaaaacaatatattatttaaaaaagtactgaaaggagaagtaactcctgatcatcttatcagaatgagtccagaagaactagcttctaaagagttagctgcttggagacgaagagaaaacagacataccatagaaatgattgagaaagagcagagagaagtggaacgacggccaatcaccaaaataactcataaaggtgaaatagaaattgagagtgatgccccaatgaaagaacaggaagcagccatggagattcaggaaccagccgccaataagtcattggagaagccagaaggatctgaaaaacaaaaagaggaggttgactctatgtctaaagataccactagtcaacacagacagcatctttttgatctcaactgcaaaatctgcataggtcgaatggcaccacctgtagatgatctttctccaaaaaaagtaaaagttgttgtaggagtagctcgcaaacattcagacaatgaagcagaaagtatagcagatgcattatcttcaacctcaaatattttggcttctgaattctttgaggaggagaaacaggagtctccaaagtcaacgttctctcctgctccacgtccagagatgcctggaactgttgaagttgagtctacctttctggctcgattgaacttcatctggaaaggttttatcaacatgccttctgtggcaaaatttgttaccaaagcctatccagtatctggctccccagaatacctgacagaggacctaccagatagtattcaagtaggtggcaggatatcacctcagacagtttgggattatgtggaaaaaataaaagcatcaggaaccaaggaaatttgtgtggttcgcttcacaccagtaactgaagaagatcaaatttcttatactttgctctttgcatacttcagtagcagaaagcgctatggagtagctgctaacaacatgaagcaggttaaagatatgtaccttattcctttgggtgccacagataaaattccacaccctcttgtgccttttgatggacctgggcttgaactgcatagacctaatctattgttgggcttaattattcgtcagaaactgaagcgacagcacagtgcctgtgctagtactagtcatatagctgagactcctgaaagtgcaccaccaatagcattgccacctgataaaaaaagtaaaatagaagtttctacagaagaagcaccagaggaagaaaatgacttttttaattcttttacaactgtattacacaagcagagaaataaacctcagcagaatcttcaggaagaccttccaacagcagttgaacctttaatggaagtcaccaaacaggagccaccaaaacctttaagatttcttcctggcgtgttgattggctgggagaatcaacctactactctggaattagcaaataaacctcttcctgtggatgatatacttcaaagccttttgggcaccactggtcaagtatatgaccaggcccagtcagtgatggaacaaaacactgttaaagaaattccatttttaaatgagcagaccaactcaaaaatagagaaaacagataatgtggaagtaactgatggtgaaaacaaggagataaaagttaaagtagataatatttcagaatctacagataagtcagcagaaatagaaacatcagtagtagggtcctcttccatttctgcagggtctttgacgagtcttagtctcagaggtaagccaccagatgtttctacagaagcatttttaacaaatttatcaattcagtcaaaacaagaggaaactgtggagagtaaagagaaaacattaaaaagacagcttcaggaagatcaagagaataatttgcaagataaccagacttcaaatagttctccatgcagatctaatgtaggaaaaggaaacatagatggtaatgtgagctgtagtgaaaaccttgttgctaatacagcgaggtctccacagtttatcaacctgaaaagggatcctaggcaagcagcaggacgaagtcagcctgtaactacttcagaaagcaaagatggagatagttgccggaatggagaaaaacacatgctgcctggcctgtcacacaacaaggagcacttaacagaacaaatcaatgtagaggaaaagttgtgttctgcagagaaaaactcgtgtgttcagcagagtgacaatttaaaagttgcacaaaactcaccatcagtagaaaacatacagacttctcaagcagaacaagcaaaacccttacaggaggatattttaatgcaaaatattgaaactgtgcacccatttcgaagaggatcagcagtagcgacatctcattttgaagttggaaacacatgtccatcagaatttccttctaaaagcatcacctttacttccagaagcaccagccccagaacaagtacaaacttttcacccatgaggccacagcagcccaaccttcagcatctcaagtctagcccacctggatttccatttccagggcctcctaattttcccccacaaagcatgtttggatttccaccacatttgccacctccattacttccccctccaggctttggctttgctcaaaatcccatggttccctggccacctgttgttcatctcccaggtcagccacagcgtatgatgggtcctctctcacaagcatcaaggtatataggcccgcagaatttttaccaggttaaagacattcggaggccagaaaggcgccatagtgacccttggggtaggcaagaccaacagcaactggataggccatttaataggggtaaaggggaccgccagagattttatagtgattcacaccatttgaaaagagagcgacatgaaaaggaatgggagcaagaatctgaaaggcatagacgcagagacagaagccaagacaaggacagagacagaaaaagcagggaggaagggcacaaagataaagagagggcacggttatcacatggtgatcgaggaacagatggaaaagcaagcagagatagtaggaatgtagacaagaagccagataaacctaaaagtgaagactatgagaaggacaaagaacgagagaaaagtaaacacagagaaggagaaaaggacagggataggtaccacaaagatagggaccacactgacagaactaaaagcaaaaggtaaaatttgcaggctgcttcaggattacatttaaataactgttaaaatgttgtatcttgtaaacaaaagaaagattgcctgctaggattgtgccatctttaaaatttttactattggtcatttgcagaacagtaaattctgtgtgttggtacagagtgctctgtaccagtgctcatcatcccttcttcataccaacggtccctagttataggaatttaatatttttaaaagttttacattgctgtatattcaaagatttgttttattaatatgcaataaaggcttagaaatttta

SEQ ID NO: 446584 - DNA, 7018 bp, Homo sapiens
aggcccgtctcgcaggcccccggatccggccgttggggcctcttccttctcagggagccccagcatggagctttgggccttggtttcgggaaactgggactggccctggctgctaggctgctccctgctgctgctttttggagatgagagttgctcttccatttatcctccagttaccgcgcgcttttgtgcccgggactcaaactgtggactccttttgcttagtttgaaatgagaagcctagactcttgccttccgataatacatgtaatttaatgaaccacttgtcgatacggctgaaagacacacagaagtcttcatggatatagttgatacatttaatcatttaattcctactgaacacttagatgatgccctatttctaggatccaacctggagaatgaagtctgtgaggattttagtgcaagtcaaaatgtcttagaggactcgctgaagaacatgctcagcgataaggatcctatgctaggatctgcaagtaaccagttctgtttgcctgttttggatagcaatgatcccaatttccagatgccttgttcaacagaacaagtaagaagtttgcgacagagcactattgccaagcgttcaaatgcagcaccattaagtaacacaaaaaaagcatctgggaagactgtatctactgctaaagcaggagtgaaacaaccagaaaggagtcaggttaaagaagaagtatgtatgtcactgaaacctgagtaccataaggagaatagaaggtgcagccgaaatagcggacaaattgaagtggtacctgaagtatcagtgtcttcaagtcattcttcagtgtcatcttgtcttgaaatgaaggatgaagatggattagattctaagcataagtgtaataatccgggagaaatagatgtgccatctcatgaattaaattgttcacttctttcagagacttgtgttactattggagaaaagaaaaatgaagctttgatggaatgtaaagccaagcctgttggtagtccattgtttaagttttcagataaagaagaacatgaacaaaatgattccatttcaggtaaaacgggtgagactgttgttgaagaaatgatagcaacaagaaaagttgaacaagattcaaaggagacagtaaaattatcccatgaagatgaccatattcttgaggacgctggatcttctgatatttctagtgatgctgcttgtacaaatccaaataagacagaaaacagccttgtaggtttgcctagttgtgtagatgaagtgactgaatgtaatttggaattgaaggataccatgggtattgctgataaaactgagaacacccttgaaagaaataaaattgaaccgttgggttattgtgaagatgcggagtctaataggcagttggagagcactgagtttaataaatcaaacttagaggtggttgatactagtacttttggaccggaaagtaatatcttggaaaatgctatttgtgatgtgcctgaccaaaattcaaaacagttgaatgctatagaaagtactaaaatagagtcccatgaaacagcaaaccttcaggatgacagaaacagccagtcaagtagcgtttcttacttagagtcaaaaagtgtaaaatccaaacatacaaaacctgtaattcattctaagcaaaacatgaccacagatgctccgaagaaaattgttgcagcaaagtatgaagtaatacatagcaaaactaaagttaatgtcaaaagtgtgaaacgaaatactgatgtaccagaatctcagcaaaattttcataggccagtcaaagtcagaaaaaaacaaattgataaggagccaaagattcagagttgcaattctggggttaaatctgtgaaaaaccaagctcattctgtactgaaaaaaacattacaggatcaaactttagtacaaattttcaagcccttaactcattctttgagtgataagtcacacgctcatcctggttgcttgaaagaacctcatcatcctgcacaaactggacatgtatcacattctagccagaaacagtgtcataagcctcagcaacaggccccagcaatgaaaaccaatagtcacgtgaaggaagagcttgaacacccaggcgttgagcattttaaggaagaggataaactgaaactgaaaaaacctgagaagaacctacaaccccgccaaagaagaagcagcaaaagtttttctttagatgagccaccattgttcattccagataacatagctaccataagaagagaaggctctgatcatagctcctcatttgaaagcaaatatatgtggactcccagcaagcagtgtgggttttgcaaaaaaccacatggcaacaggtttatggttggctgtgggagatgtgatgactggtttcatggtgattgtgttgggttaagtctttctcaagcacagcagatgggcgaggaagacaaagaatatgtctgtgtaaaatgttgtgctgaagaagacaaaaagactgaaatactagatccagatactttggaaaaccaagctacagttgaattccatagtggagataaaacaatggagtgtgaaaagcttggattatcaaaacacacaacaaatgatagaaccaaatatatagatgatacagtgaagcacaaggtcaaaattttaaaacgggagtctggtgaaggcagaaattcatcagactgtagagataatgaaattaaaaaatggcagctagctcctcttcgtaagatgggacaaccagttttacctcggagatcctcagaagaaaaaagtgaaaaaataccgaaagagtctacaactgttacttgcacaggagaaaaagcttcaaaaccaggtactcatgagaagcaagagatgaaaaagaagaaagttgaaaaaggagtgcttaatgtacatcctgctgcttctgcttccaagccttctgcagatcagatcaggcaaagtgtcagacattctctcaaagacattcttatgaagagacttacagactcaaatttgaaggtaccagaggaaaaggcagcaaaagttgccacaaaaattgagaaagagcttttctctttttttcgggacacagatgctaaatataagaacaaatatagaagtttgatgtttaatttgaaagatcctaaaaacaatatattatttaaaaaagtactgaaaggagaagtaactcctgatcatcttatcagaatgagtccagaagaactagcttctaaagagttagctgcttggagacgaagagaaaacagacataccatagaaatgattgagaaagagcagagagaagtggaacgacggccaatcaccaaaataactcataaaggtgaaatagaaattgagagtgatgccccaatgaaagaacaggaagcagccatggagattcaggaaccagccgccaataagtcattggagaagccagaaggatctgaaaaacaaaaagaggaggttgactctatgtctaaagataccactagtcaacacagacagcatctttttgatctcaactgcaaaatctgcataggtcgaatggcaccacctgtagatgatctttctccaaaaaaagtaaaagttgttgtaggagtagctcgcaaacattcagacaatgaagcagaaagtatagcagatgcattatcttcaacctcaaatattttggcttctgaattctttgaggaggagaaacaggagtctccaaagtcaacgttctctcctgctccacgtccagagatgcctggaactgttgaagttgagtctacctttctggctcgattgaacttcatctggaaaggttttatcaacatgccttctgtggcaaaatttgttaccaaagcctatccagtatctggctccccagaatacctgacagaggacctaccagatagtattcaagtaggtggcaggatatcacctcagacagtttgggattatgtggaaaaaataaaagcatcaggaaccaaggaaatttgtgtggttcgcttcacaccagtaactgaagaagatcaaatttcttatactttgctctttgcatacttcagtagcagaaagcgctatggagtagctgctaacaacatgaagcaggttaaagatatgtaccttattcctttgggtgccacagataaaattccacaccctcttgtgccttttgatggacctgggcttgaactgcatagacctaatctattgttgggcttaattattcgtcagaaactgaagcgacagcacagtgcctgtgctagtactagtcatatagctgagactcctgaaagtgcaccaccaatagcattgccacctgataaaaaaagtaaaatagaagtttctacagaagaagcaccagaggaagaaaatgacttttttaattcttttacaactgtattacacaagcagagaaataaacctcagcagaatcttcaggaagaccttccaacagcagttgaacctttaatggaagtcaccaaacaggagccaccaaaacctttaagatttcttcctggcgtgttgattggctgggagaatcaacctactactctggaattagcaaataaacctcttcctgtggatgatatacttcaaagccttttgggcaccactggtcaagtatatgaccaggcccagtcagtgatggaacaaaacactgttaaagaaattccatttttaaatgagcagaccaatcaaaatcccatggttccctggccacctgttgttcatctcccaggtcagccacagcgtatgatgggtcctctctcacaagcatcaaggtatataggcccgcagaatttttaccaggttaaagacattcggaggccagaaaggcgccatagtgacccttggggtaggcaagaccaacagcaactggataggccatttaataggggtaaaggggaccgccagagattttatagtgattcacaccatttgaaaagagagcgacatgaaaaggaatgggagcaagaatctgaaaggcatagacgcagagacagaagccaagacaaggacagagacagaaaaagcagggaggaagggcacaaagataaagagagggcacggttatcacatggtgatcgaggaacagatggaaaagcaagcagagatagtaggaatgtagacaagaagccagataaacctaaaagtgaagactatgagaaggacaaagaacgagagaaaagtaaacacagagaaggagaaaaggacagggataggtaccacaaagatagggaccacactgacagaactaaaagcaaaaggtaaaatttgcaggctgcttcaggattacatttaaataactgttaaaatgttgtatcttgtaaacaaaagaaagattgcctgctaggattgtgccatctttaaaatttttactattggtcatttgcagaacagtaaattctgtgtgttggtacagagtgctctgtaccagtgctcatcatcccttcttcataccaacggtccctagttataggaatttaatatttttaaaagttttacattgctgtatattcaaagatttgttttattaatatgcaataaaggcttagaaattttagttttattccttaattggtaaatatggttaactatggaatatatttacttcctctagtgaatgtcctttatataatgactaatttgggagtaatgtgtgctctgtaagtttgttttaaattgcactgtttttaaagaaactgtagaggagcaacaaaaatccaagcaacttcataatcagattatgctaatcatttagttgagcagtttttgaccaagaatcagaagcccaaggggtacatttattgctttaatctgcactcattgaagtcatttattaccatatactacagctttgtggtaggccattattttcattttcatttttggctcttcagaaacttgaatacttaagcttgtacatgatcttgtgttttgctatcctttttactgtaaaatgtaaatattttaagggatattttgattctaaatatgataaaataatttctcacctattttgtgtgtgtgacttgaaattcagtagtaaaagaatttcttctttaaagctttaattaccttcagacattgattttttgttactcagccaagaacatatagaaatagctatctatgtcaggcattagatgaggggaaaaacaatttttttaaaatcttaaattgtaggctgagatgaattgtgtagttctaaagaggctagaatttagaactacctgtgaaacactgtgcagctatagcccactttataggtaagtttctgaaaacttttacaccatcgcaatttggtactctgactcactaatcattaaaattaaagaccgcagaacttgaagagaaatatgttttgaatccttttataaaatgtgcgatttagcctaattcgtaaagtaactgtacagtttcatatgccagttttacttgaaaaaaaaatatgaaaactattgttaattcaaatctaaatttatttaaaccctaaaacacatggttttgatggctgtaatttaaagtaagagctatcaaatgatgctgacaaaagaaaaaccttccaaaatacaaaagaaagagaactctattatttacttacctgtattaatgaagaaaaatataaataattccacaaaattgattgttttcctaaagagcttaaagattagagttaaaaattggttttgaaacagaattatccttgttatttttgctggagagaagggaggaaattcagaaccaaacattctatttaatttgcaatgacttgcagtacttttttccctatccttatcctgtgaaacttactatcataaggttctaaaacagagaacttgtgtttaaataaagcccgtttaactttggtccacttttcttttggaaattaacttgttagaaaacaaagttagttcccaaacaaaacaaaatctaagttataatttgcaccattacaaagaaattgctgtcagggttttacacattttaaaaacatttcaatttcaaatgtgtatatcgtcaataaatctacctttactgata

SEQ ID NO: 446585 - DNA, 946 bp, Homo sapiens
agactgaggcaatgcgcatgcccagcgccgtatcgcgcacgcgctctctgcggctttccttgacctctgacccgccgaccacgcttgatccccggccgcggggccaggaagtcggagtttgagccccggaggcagagcggctgccatggccaagtacctggcccagatcattgtgatgggcgtgcaggtggtgggcagggcctttgcacgggccttgcggcaggagtttgcagccagccgggccgcagctgatgcccgaggacgcgctggacaccggtctgcagccgcttccaacctctccggcctcagcctccaggaggcacagcagattctcaacgtgtccaagctgagccctgaggaggtccagaagaactatgaacacttatttaaggtgaatgataaatccgtgggtggctccttctacctgcagtcaaaggtggtccgcgcaaaggagcgcctggatgaggaactcaaaatccaggcccaggaggacagagaaaaagggcagatgccccatacgtgactgctcggctccccccgcccaccccgccgcctctaatttatagcttggtaataaatttcttttctgcaaaaaaaaaaaataccaatttcactggcccggcggttttacaaacgtttttgaactgtgtaatatactcttggccgtttacccacactttataatctggcttttgtaggacaccaattctccccttttttggcccagactttgggcgttaaaatagtcctaatgaagggtctccgtatacccggaaatcggccccttttccccaaaccattttgtctcaaaaccctttgaaatgtgctccaaattgggtcaataaatttggttaaagcgcgtttaaaaaaatatttgggtttaaaaatattctgccggttttaaaaaatttatttgtgtgtacatctaagtctttcttttttttcc

SEQ ID NO: 446586 - DNA, 591 bp, Homo sapiens
agactgaggcaatgcgcatgcccagcgccgtatcgcgcacgcgctctctgcggctttccttgacctctgacccgccgaccacgcttgatccccggccgcggggccaggaagtcggagtttgagccccggaggcagagcggctgccatggccaagtacctggcccagatcattgtgatgggcgtgcaggtggtgggcagggcctttgcacgggccttgcggcaggagtttgcagccagccgggccgcagctgatgcccgaggacgcgctggacaccggtctgcagccgcttccaacctctccggcctcagcctccaggaggcacagcagattctcaacgtgtccaagctgagccctgaggaggtccagaagaactatgaacacttatttaaggtgaatgataaatccgtgggtggctccttctacctgcagtcaaaggtggtccgcgcaaaggagcgcctggatgaggaactcaaaatccaggcccaggaggacagagaaaaagggcagatgccccatacgtgactgctcggctccccccgcccaccccgccgcctctaatttatagcttggtaataaatttcttttctgca

SEQ ID NO: 446587 - DNA, 486 bp, Homo sapiens
cacagggagtggcctgctaaccgggtgcctgctttgcccacaggccaagtacctggcccagatcattgtgatgggcgtgcaggtggtgggcagggcctttgcacgggccttgcggcaggagtttgcagccagccgggccgcagctgatgcccgaggacgcgctggacaccggtctgcagccgcttccaacctctccggcctcagcctccaggaggcacagcagattctcaacgtgtccaagctgagccctgaggaggtccagaagaactatgaacacttatttaaggtgaatgataaatccgtgggtggctccttctacctgcagtcaaaggtggtccgcgcaaaggagcgcctggatgaggaactcaaaatccaggcccaggaggacagagaaaaagggcagatgccccatacgtgactgctcggctccccccgcccaccccgccgcctctaatttatagcttggtaataaatttcttttctgca

SEQ ID NO: 446588 - DNA, 759 bp, Homo sapiens
agactgaggcaatgcgcatgcccagcgccgtatcgcgcacgcgctctctgcggctttccttgacctctgacccgccgaccacgcttgatccccggccgcggggccaggaagtcggagtttgagccccggaggcagagcggctgccatggccaagtacctggcccagatcattgtgatgggcgtgcaggtggtgggcagggcctttgcacgggccttgcggcaggagtttgcagcctctaccccctaaaaaggaaaccactcctggagaagaggcagctcctagccacctgtccctgtgtctctcatcctgtgctggtggcaggggtgagccaccaactcggaaggcccagggtgaagtgtgggctgctgaggactgagcgatcacccacatgtccacacagccagccgggccgcagctgatgcccgaggacgcgctggacaccggtctgcagccgcttccaacctctccggcctcagcctccaggaggcacagcagattctcaacgtgtccaagctgagccctgaggaggtccagaagaactatgaacacttatttaaggtgaatgataaatccgtgggtggctccttctacctgcagtcaaaggtggtccgcgcaaaggagcgcctggatgaggaactcaaaatccaggcccaggaggacagagaaaaagggcagatgccccatacgtgactgctcggctccccccgcccaccccgccgcctctaatttatagcttggtaataaatttcttttctgca

SEQ ID NO: 446589 - DNA, 910 bp, Homo sapiens
agactgaggcaatgcgcatgcccagcgccgtatcgcgcacgcgctctctgcggctttccttgacctctgacccgccgaccacgcttgatccccggccgcggggccaggaagtcggagtttgagccccggaggcagagcggctgccatgtcattggccttggcagaaaagtaaacaagtgattgcaaggctgtacgatggcagcagagggaccgaaggctgttggtgtgaggggtagtctgagacctgagccgtgtttcaagccgaggggaccctctgactttcacctctgtccttcagacagcaccagcatcccatccctgagcctcctgttccactcgggaggggctttaggaaggaggcgaagtcaggtgagaccgcaggtgtcatcaggtgcatccctgaccctccctcatctgcagtacagccacagccctgcccctcgctgtgatcacaggagggtcttctctgggctctttctgctgtgaaatccagaagttatgaagtttccacctacttttgaaatcttaacccacttgtttgttcattcccctaatggcccataatgacatcccacctgttaaggaaagagcaggtcctcggaggctgaacaaggccagctctggagtcgaatccactggaatctggagcaagcccctctggcctcggggttgggttcttgatacttgtcggcttgcccaggtgccctaccttcagaccccgggaccctgcgtagtgactgctgtgacagatagcaccagccttgggtttccgatctgcctccgaggcacctgctgttacgtcctcgggccagtcagcagtcccccacccctgagttgtcagaattaaacggcacaatgaattgaacgtgtttggcaccgtgcctggtgtgtggactcagttgatacctgt

SEQ ID NO: 446590 - DNA, 1305 bp, Homo sapiens
ccctcctctcacggaaccccctcctctcacagaaccccctcctctcacacagaaccccctcctctcacacagaaccccctcctctcacggaaccccctcctctcacggaaccccctcctctcacggaacgccctcctctcacacagaaccccctcctctcaccgaatcccatctcagtcttgagttttccctcgactctgttgcttccgctcacatcttagtgagtccccagggcctctgcggggcatggaatcacacgtgcagtgttccggcatgttcagcctggtgtgtgacagtggggttccctgccaggccagcagtgtgctctgactcggggcagggaccaggttctgtgtagctttgtgctcaagtgctgagcagagttagactctcagcagatgtttgaatgaatgggtgaaccaatggctgcacaaatgaacgagcctgactctccctcatgatttggtccatagtgtgtttaaataccctcctagtgggcttttagctccttgaagatggaaacaggtttgcatagtaagtttgttttattgaatggaatggacttaaagtcttcggacttgggagaattaggacagatctgtttccccgttggtaaagtaaaggttgggcctgatgatctcagaaactcaggaagagtgatggtcggccccagggtcgagagtgagttactgccaggtccagggctgtccctgtgttctggctcccagaccacagtgtttcttcctgaagccggtggttgcagccactttgccttgctcctctacgcctttcctgaaggatgaggtggggccagtctgcctctgggagctcggtcaagttcacccgcctgcctgcctgtccagccaagtacctggcccagatcattgtgatgggcgtgcaggtggtgggcagggcctttgcacgggccttgcggcaggagtttgcagccagccgggccgcagctgatgcccgaggacgcgctggacaccggtctgcagccgcttccaacctctccggcctcagcctccaggaggcacagcagattctcaacgtgtccaagctgagccctgaggaggtccagaagaactatgaacacttatttaaggtgaatgataaatccgtgggtggctccttctacctgcagtcaaaggtggtccgcgcaaaggagcgcctggatgaggaactcaaaatccaggcccaggaggacagagaaaaagggcagatgccccatacgtgactgctcggctccccccgcccaccccgccgcctctaatttatagcttggtaataaatttcttttctgca

SEQ ID NO: 446591 - DNA, 1739 bp, Homo sapiens
ccctcctctcacggaaccccctcctctcacagaaccccctcctctcacacagaaccccctcctctcacacagaaccccctcctctcacggaaccccctcctctcacggaaccccctcctctcacggaacgccctcctctcacacagaaccccctcctctcaccgaatcccatctcagtcttgagttttccctcgactctgttgcttccgctcacatcttagtgagtccccagggcctctgcggggcatggaatcacacgtgcagtgttccggcatgttcagcctggtgtgtgacagtggggttccctgccaggccagcagtgtgctctgactcggggcagggaccaggttctgtgtagctttgtgctcaagtgctgagcagagttagactctcagcagatgtttgaatgaatgggtgaaccaatggctgcacaaatgaacgagcctgactctccctcatgatttggtccatagtgtgtttaaataccctcctagtgggcttttagctccttgaagatggaaacaggtttgcatagtaagtttgttttattgaatggaatggacttaaagtcttcggacttgggagaattaggacagatctgtttccccgttggtaaagtaaaggttgggcctgatgatctcagaaactcaggaagagtgatggtcggccccagggtcgagagtgagttactgccaggtccagggctgtccctgtgttctggctcccagaccacagtgtttcttcctgaagccggtggttgcagccactttgccttgctcctctacgcctttcctgaaggatgaggtggggccagtctgcctctgggagctcggtcaagttcacccgcctgcctgcctgtccagccaagtacctggcccagatcattgtgatgggcgtgcaggtggtgggcagggcctttgcacgggccttgcggcaggagtttgcaggggtgagccaccaactcggaaggcccagggtgaagtgtgggctgctgaggactgagcgatcacccacatgtccacacagccagccgggccgcagctgatgcccgaggacgcgctggacaccggtctgcagccgcttccaacctctccggcctcagcctccaggaggcacagcagattctcaacgtgtccaagctgagccctgaggaggtccagaagaactatgaacacttatttaaggtgaatgataaatccgtgggtggctccttctacctgcagtcaaaggtggtccgcgcaaaggagcgcctggatgaggaactcaaaatccaggcccaggaggacagagaaaaagggcagatgccccatacgtgactgctcggctccccccgcccaccccgccgcctctaatttatagcttggtaataaatttcttttctgcaaaaaaaaaaaataccaatttcactggcccggcggttttacaaacgtttttgaactgtgtaatatactcttggccgtttacccacactttataatctggcttttgtaggacaccaattctccccttttttggcccagactttgggcgttaaaatagtcctaatgaagggtctccgtatacccggaaatcggccccttttccccaaaccattttgtctcaaaaccctttgaaatgtgctccaaattgggtcaataaatttggttaaagcgcgtttaaaaaaatatttgggtttaaaaatattctgccggttttaaaaaatttatttgtgtgtacatctaagtctttcttttttttcc

SEQ ID NO: 446592 - DNA, 1299 bp, Homo sapiens
  misc_feature (1288)..(1288): n is a, c, g, or t
ccctcctctcacggaaccccctcctctcacagaaccccctcctctcacacagaaccccctcctctcacacagaaccccctcctctcacggaaccccctcctctcacggaaccccctcctctcacggaacgccctcctctcacacagaaccccctcctctcaccgaatcccatctcagtcttgagttttccctcgactctgttgcttccgctcacatcttagtgagtccccagggcctctgcggggcatggaatcacacgtgcagtgttccggcatgttcagcctggtgtgtgacagtggggttccctgccaggccagcagtgtgctctgactcggggcagggaccaggttctgtgtagctttgtgctcaagtgctgagcagagttagactctcagcagatgtttgaatgaatgggtgaaccaatggctgcacaaatgaacgagcctgactctccctcatgatttggtccatagtgtgtttaaataccctcctagtgggcttttagctccttgaagatggaaacaggtttgcatagtaagtttgttttattgaatggaatggacttaaagtcttcggacttgggagaattaggacagatctgtttccccgttggtaaagtaaaggttgggcctgatgatctcagaaactcaggaagagtgatggtcggccccagggtcgagagtgagttactgccaggtccagggctgtccctgtgttctggctcccagaccacagtgtttcttcctgaagccggtggttgcagccactttgccttgctcctctacgcctttcctgaaggatgaggtggggccagtctgcctctgggagctcggtcaagttcacccgcctgcctgcctgtccagccaagtacctggcccagatcattgtgatgggcgtgcaggtggtgggcagggcctttgcacgggccttgcggcaggagtttgcagccagccgggccgcagctgatgcccgaggacgcgctggacaccggtctgcagccgcttccaacctctccggcctcagcctccaggaggcacagcagattctcaacgtgtccaagctgagccctgaggaggtccagaagaactatgaacacttatttaaggtgaatgataaatccgtgggtggctccttctacctgcagtcaaaggtggtccgcgcaaaggagcgcctggatgaggaactcaaaatccaggcccaggaggacagagaaaaagggcagatgccccatacgtgatttcttggtttcgtaagtgcctttttaataatcttttcatggaaaagtttntgtgccaggcc

SEQ ID NO: 446593 - DNA, 316 bp, Homo sapiens
ccaggccaccccgaccctggggtgccactgaaggaagcattggtatccacccactgcccttcaaaaaatggacctgggctgatgggaataggccatcccatgtgggcaaggggtatggggcggaggcttggcctcccggcctgattatccgtgacccactaggtggtccgcgcaaaggagcgcctggatgaggaactcaaaatccaggcccaggaggacagagaaaaagggcagatgccccatacgtgactgctcggctccccccgcccaccccgccgcctctaatttatagcttggtaataaatttcttttctgc

SEQ ID NO: 446594 - DNA, 319 bp, Homo sapiens
gccaagtacctggcccagatcattgtgatgggcgtgcaggtggtgggcagggcctttgcacgggccttgcggcaggagtttgcaggtaagcatgggtccgtctcccctgtgggctgggagttcctctccaggtcagattttccccgtagccatgggcacctcaggcctggcggttctgaagtgtgcgtggcctgaggcacttcccatggtggggggtgatgccagaccggggcattcttcagtggtacctggttagcaagagcatccagggcaggagctggcacactggcccatctggatacctgattttgtaaacttg

SEQ ID NO: 446595 - DNA, 728 bp, Homo sapiens
ccctcctctcacggaaccccctcctctcacagaaccccctcctctcacacagaaccccctcctctcacacagaaccccctcctctcacggaaccccctcctctcacggaaccccctcctctcacggaacgccctcctctcacacagaaccccctcctctcaccgaatcccatctcagtcttgagttttccctcgactctgttgcttccgctcacatcttagtgagtccccagggcctctgcggggcatggaatcacacgtgcagtgttccggcatgttcagcctggccaagtacctggcccagatcattgtgatgggcgtgcaggtggtgggcagggcctttgcacgggccttgcggcaggagtttgcagccagccgggccgcagctgatgcccgaggacgcgctggacaccggtctgcagccgcttccaacctctccggcctcagcctccaggaggcacagcagattctcaacgtgtccaagctgagccctgaggaggtccagaagaactatgaacacttatttaaggtgaatgataaatccgtgggtggctccttctacctgcagtcaaaggtggtccgcgcaaaggagcgcctggatgaggaactcaaaatccaggcccaggaggacagagaaaaagggcagatgccccatacgtgactgctcggctccccccgcccaccccgccgcctctaatttatagcttggtaataaatttcttttctgca

SEQ ID NO: 446596 - DNA, 735 bp, Homo sapiens
accggcggcctcagggccagggaaaaccgtctgcctggaagaggccgggcaaacgtggtcgcgctgtgcctagcccgcgtgtgagcgagcagccgtgggcagcggtggagcatgagtctggctggccaagtacctggcccagatcattgtgatgggcgtgcaggtggtgggcagggcctttgcacgggccttgcggcaggagtttgcagcctctaccccctaaaaaggaaaccactcctggagaagaggcagctcctagccacctgtccctgtgtctctcatcctgtgctggtggcaggggtgagccaccaactcggaaggcccagggtgaagtgtgggctgctgaggactgagcgatcacccacatgtccacacagccagccgggccgcagctgatgcccgaggacgcgctggacaccggtctgcagccgcttccaacctctccggcctcagcctccaggaggcacagcagattctcaacgtgtccaagctgagccctgaggaggtccagaagaactatgaacacttatttaaggtgaatgataaatccgtgggtggctccttctacctgcagtcaaaggtggtccgcgcaaaggagcgcctggatgaggaactcaaaatccaggcccaggaggacagagaaaaagggcagatgccccatacgtgactgctcggctccccccgcccaccccgccgcctctaatttatagcttggtaataaatttcttttctgca

SEQ ID NO: 446597 - DNA, 1473 bp, Homo sapiens
ccctcctctcacggaaccccctcctctcacagaaccccctcctctcacacagaaccccctcctctcacacagaaccccctcctctcacggaaccccctcctctcacggaaccccctcctctcacggaacgccctcctctcacacagaaccccctcctctcaccgaatcccatctcagtcttgagttttccctcgactctgttgcttccgctcacatcttagtgagtccccagggcctctgcggggcatggaatcacacgtgcagtgttccggcatgttcagcctggtgtgtgacagtggggttccctgccaggccagcagtgtgctctgactcggggcagggaccaggttctgtgtagctttgtgctcaagtgctgagcagagttagactctcagcagatgtttgaatgaatgggtgaaccaatggctgcacaaatgaacgagcctgactctccctcatgatttggtccatagtgtgtttaaataccctcctagtgggcttttagctccttgaagatggaaacaggtttgcatagtaagtttgttttattgaatggaatggacttaaagtcttcggacttgggagaattaggacagatctgtttccccgttggtaaagtaaaggttgggcctgatgatctcagaaactcaggaagagtgatggtcggccccagggtcgagagtgagttactgccaggtccagggctgtccctgtgttctggctcccagaccacagtgtttcttcctgaagccggtggttgcagccactttgccttgctcctctacgcctttcctgaaggatgaggtggggccagtctgcctctgggagctcggtcaagttcacccgcctgcctgcctgtccagccaagtacctggcccagatcattgtgatgggcgtgcaggtggtgggcagggcctttgcacgggccttgcggcaggagtttgcagcctctaccccctaaaaaggaaaccactcctggagaagaggcagctcctagccacctgtccctgtgtctctcatcctgtgctggtggcaggggtgagccaccaactcggaaggcccagggtgaagtgtgggctgctgaggactgagcgatcacccacatgtccacacagccagccgggccgcagctgatgcccgaggacgcgctggacaccggtctgcagccgcttccaacctctccggcctcagcctccaggaggcacagcagattctcaacgtgtccaagctgagccctgaggaggtccagaagaactatgaacacttatttaaggtgaatgataaatccgtgggtggctccttctacctgcagtcaaaggtggtccgcgcaaaggagcgcctggatgaggaactcaaaatccaggcccaggaggacagagaaaaagggcagatgccccatacgtgactgctcggctccccccgcccaccccgccgcctctaatttatagcttggtaataaatttcttttctgca

SEQ ID NO: 446598 - DNA, 696 bp, Homo sapiens
agactgaggcaatgcgcatgcccagcgccgtatcgcgcacgcgctctctgcggctttccttgacctctgacccgccgaccacgcttgatccccggccgcggggccaggaagtcggagtttgagccccggaggcagagcggctgccatgtcattggccttggcagaaaagtaaacaagtgattgcaaggctgtacgatggcagcagagggaccgaaggctgttggtgtgaggggtagtctgagacctgagccgtgtttcaagccgaggggaccctctgactttcacctctgtccttcagacagcaccagcatcccatccctgagcctcctgttccactcgggaggggctttaggaaggaggcgaagtcaggaaagagcaggtcctcggaggctgaacaaggccagctctggagtcgaatccactggaatctggagcaagcccctctggcctcggggttgggttcttgatacttgtcggcttgcccaggtgccctaccttcagaccccgggaccctgcgtagtgactgctgtgacagatagcaccagccttgggtttccgatctgcctccgaggcacctgctgttacgtcctcgggccagtcagcagtcccccacccctgagttgtcagaattaaacggcacaatgaattgaacgtgtttggcaccgtgcctggtgtgtggactcagttgatacctgt

SEQ ID NO: 446599 - DNA, 1922 bp, Homo sapiens
aataaaattgtatagagaaacatctatctatcacaatgaaacgcctgatgaagacaaaattaactcttacttttaaatttcgaacccagaaaaaagcgtttccaaggacggaagactgttaatttgtccattccactaagtgaaacatcttccaccaaactgtcccacattgatgaatacatttcctcatctccaacctaccagaccgtgcctgattttcagagagtgcagattactggtgactatgcctctggggttacagttgaagattttgaaattgtttgcaaaggtctgtatcgggcactatgcatacgtgagaaatacatgcagaagtcgtttcagaggttccctaaaaccccttccaaatacttgcggaacattgatggtgaggcttgggtagcaaatgagagcttctatccagtaagacctatacccaccggcgcctgaagttcctctcctccaagttccaggtccatcagatgcttaacgagatggacgagttaaaggagctgaaaaacaacccccaccgagatttttataactgcaggaaggtggacacccatatccatgcagccgcttgcatgaaccagaaacatctgctgcgttttattaagaaatcttaccaaattgatgctgacagagtggtctatagcaccaaagagaagaatctgaccctaaaggaactttttgctaaattaaaaatgcatccttatgacctgactgttgattctctggatgttcatgctggacgccagaccttccagcgttttgataagttcaatgacaaatataatcctgtaggagcaagtgagctacgggacctctacttgaagacagacaattacattaatggggaatattttgccactatcatcaaggaggtaggtgcggacctggtggaggccaagtaccagcatgctgagccccgcctgtccatctatggccgcagtcctgatgagtggagcaaactctcctcctggttcgtctgcaatcgcatccactgccccaacatgacatggatgatccaggttcccaggatctatgatgtgttccgttccaagaatttccttccacattttggaaaaatgctggagaatattttcatgccagtgtttgaggccaccatcaacccccaggctgacccagaactcagtgtcttcctcaagcatatcactggctttgacagtgtggatgatgagtccaaacacagtggccacatgttctcctccaagagtcccaagccccaggagtggacattggaaaagaatccatcttacacttactatgcctactacatgtatgcaaacatcatggtgctcaacagcctgagaaaggaacgaggcatgaatacgtttctgttccgacctcactgtggagaagctggagccctcacccatctcatgacagcattcatgatagcagatgatatctctcatggcctaaatttaaaaaagagtcccgtgctacagtacttgtttttcttagcccaaattcccatcgccatgtcaccactaagtaacaatagcctatttctagagtatgccaaaaatccttttttggatttccttcagaaagggctaatgatctcactgtctacagatgacccaatgcaattccactttaccaaggagcccctaatggaagaatatgctattgctgcacaagtcttcaagctgagcacctgtgatatgtgcgaagtggcaaggaacagtgtcttgcagtgtggaatttctcatgaggagaaagtaaagtttctgggcgacaattaccttgaggaaggccctgctggaaatgatatccggaggacaaatgtagcccaaatccgcatggcctatcgctatgaaacctggtgttatgaactcaatttaattgctgagggtcttaaatcaacagaataaaaaaaagtaaaccaaataataata

SEQ ID NO: 446600 - DNA, 671 bp, Homo sapiens
tggggctgcagccgggacggggccttcggcagggcctgcgggggcgggacggagcggacccgagtgatacccgggagactagcttggccacaggagacaacgttgaggtacagacaggtggcagagaaacaaacatcggtattgcttaaaccacttgctatttccagttccggcttttgctaggtctaccataaccaaataccgcagattgagtggttcaaacgccagagattgatattctcacaagtctggaggctgtagaaatctaacatcaaggtgccaacagggattattcaagatcaggttgtagccattttcaacaaggatcactgatcaaaattttctttttacaaagagatttacaagttaaacatgaagggaaaatactggaatcatttggattctgacaggataaagaatacaatatttcacatttacttgtaatggaacctttgtaagattcatcacttgtcattcacccagttgggaacatggatgtggtttttctcgtactactgttcagacactgtcaagaagccactgcaaaaacatcaaacaaaaaatttctcaatgggaaggaagggctaatggtatatctaatccagaaaagtggtgtccaaaggactttggagtgagatataactgtcaccaagagatccgtcttaagaaaa

SEQ ID NO: 446601 - DNA, 446 bp, Homo sapiens
tgcactccagcctgggcgacagagcgagactctgtctcaaaaaaaaaaaagaatgagaaattgtttttctaaagaaacatgatttgcagacaaaatttgatatttcataatatatcaattattacttaatgttgcccaaaacaaagaatgtgttatctgtaaagctctcctatctacacacttagattttgaatcagtttgttaaaaatttttaaatgttcagttagtttgaaagtacagatgataaacattagagaagatgaaaatttactagtcaaatttcaacaaaaatccttgcttaatttaaggtgaatagaattgacaaataagtattctgattcagtcagtgaagctcttctttcattgttttccatgtatttgtggtgagttatctttttctattactgtggccttttgtattagtttgctaggtctaccataaccaa

SEQ ID NO: 446602 - DNA, 2352 bp, Homo sapiens
ttttatagtgtcagtcagtcaccccacagtctcctctctcttcttttctactgtgctatcctagaatcaaggatttcagcaacaatgcctctgttcaaactcccagctgaagagaaacaaattgatgatgcaatgcgcaactttgctgaaaaagtgtttgcctctgaagtcaaagatgaaggaggtcgtcaggagatttccccctttgatgtggatgagatctgtccgatttctcatcatgagatgcaagcacacatattccatctggagactctgtccacctccacagaagccaggagaaaaaagcgtttccaaggacggaagactgttaatttgtccattccactaagtgaaacatcttccaccaaactgtcccacattgatgaatacatttcctcatctccaacctaccagaccgtgcctgattttcagagagtgcagattactggtgactatgcctctggggttacagttgaagattttgaaattgtttgcaaaggtctgtatcgggcactatgcatacgtgagaaatacatgcagaagtcgtttcagaggttccctaaaaccccttccaaatacttgcggaacattgatggtgaggcttgggtagcaaatgagagcttctatccagtctttactcctcctgtgaagaagggagaggaccccttccgaacagacaaccttcctgaaaacctgggctatcacctcaaaatgaaggacggtgtagtttacgtctatcctaatgaagcagcagtcagcaaagatgagcctaagccacttccttacccaaatctggacaccttcttagacgatatgaattttttacttgctttaattgctcaaggacctgttaagacctatacccaccggcgcctgaagttcctctcctccaagttccaggtccatcagatgcttaacgagatggacgagttaaaggagctgaaaaacaacccccaccgagatttttataactgcaggaaggtggacacccatatccatgcagccgcttgcatgaaccagaaacatctgctgcgttttattaagaaatcttaccaaattgatgctgacagagtggtctatagcaccaaagagaagaatctgaccctaaaggaactttttgctaaattaaaaatgcatccttatgacctgactgttgattctctggatgttcatgctggacgccagaccttccagcgttttgataagttcaatgacaaatataatcctgtaggagcaagtgagctacgggacctctacttgaagacagacaattacattaatggggaatattttgccactatcatcaaggaggtaggtgcggacctggtggaggccaagtaccagcatgctgagccccgcctgtccatctatggccgcagtcctgatgagtggagcaaactctcctcctggttcgtctgcaatcgcatccactgccccaacatgacatggatgatccaggttcccaggatctatgatgtgttccgttccaagaatttccttccacattttggaaaaatgctggagaatattttcatgccagtgtttgaggccaccatcaacccccaggctgacccagaactcagtgtcttcctcaagcatatcactggctttgacagtgtggatgatgagtccaaacacagtggccacatgttctcctccaagagtcccaagccccaggagtggacattggaaaagaatccatcttacacttactatgcctactacatgtatgcaaacatcatggtgctcaacagcctgagaaaggaacgaggcatgaatacgtttctgttccgacctcactgtggagaagctggagccctcacccatctcatgacagcattcatgatagcagatgatatctctcatggcctaaatttaaaaaagagtcccgtgctacagtacttgtttttcttagcccaaattcccatcgccatgtcaccactaagtaacaatagcctatttctagagtatgccaaaaatccttttttggatttccttcagaaagggctaatgatctcactgtctacagatgacccaatgcaattccactttaccaaggagcccctaatggaagaatatgctattgctgcacaagtcttcaagctgagcacctgtgatatgtgcgaagtggcaaggaacagtgtcttgcagtgtggaatttctcatgaggagaaagtaaagtttctgggcgacaattaccttgaggaaggccctgctggaaatgatatccggaggacaaatgtagcccaaatccgcatggcctatcgctatgaaacctggtgttatgaactcaatttaattgctgagggtcttaaatcaacagaataaaaaaaagtaaaccaaataataata

SEQ ID NO: 446603 - DNA, 2665 bp, Homo sapiens
ttttatagtgtcagtcagtcaccccacagtctcctctctcttcttttctactgtgctatcctagaatcaaggatttcagcaacaatgcctctgttcaaactcccagctgaagagaaacaaattgatgatgcaatgcgcaactttgctgaaaaagtgtttgcctctgaagtcaaagatgaaggaggtcgtcaggagatttccccctttgatgtggatgagatctgtccgatttctcatcatgagatgcaagcacacatattccatctggagactctgtccacctccacagaagccaggagaaaaaagcgtttccaaggacggaagactgttaatttgtccattccactaagtgaaacatcttccaccaaactgtcccacattgatgaatacatttcctcatctccaacctaccagaccgtgcctgattttcagagagtgcagattactggtgactatgcctctggggttacagttgaagattttgaaattgtttgcaaaggtctgtatcgggcactatgcatacgtgagaaatacatgcagaagtcgtttcagaggttccctaaaaccccttccaaatacttgcggaacattgatggtgaggcttgggtagcaaatgagagcttctatccagtctttactcctcctgtgaagaagggagaggaccccttccgaacagacaaccttcctgaaaacctgggctatcacctcaaaatgaaggacggtgtagtttacgtctatcctaatgaagcagcagtcagcaaagatgagcctaagccacttccttacccaaatctggacaccttcttagacgatatgaattttttacttgctttaattgctcaaggacctgttaagacctatacccaccggcgcctgaagttcctctcctccaagttccaggtccatcagatgcttaacgagatggacgagttaaaggagctgaaaaacaacccccaccgagatttttataactgcaggaaggtggacacccatatccatgcagccgcttgcatgaaccagaaacatctgctgcgttttattaagaaatcttaccaaattgatgctgacagagtggtctatagcaccaaagagaagaatctgaccctaaaggaactttttgctaaattaaaaatgcatccttatgacctgactgttgattctctggatgttcatgctggacgccagaccttccagcgttttgataagttcaatgacaaatataatcctgtaggagcaagtgagctacgggacctctacttgaagacagacaattacattaatggggaatattttgccactatcatcaaggaggtaggtgcggacctggtggaggccaagtaccagcatgctgagccccgcctgtccatctatggccgcagtcctgatgagtggagcaaactctcctcctggttcgtctgcaatcgcatccactgccccaacatgacatggatgatccaggttcccaggatctatgatgtgttccgttccaagaatttccttccacattttggaaaaatgctggagaatattttcatgccagtgtttgaggccaccatcaacccccaggctgacccagaactcagtgtcttcctcaagcatatcactggctttgacagtgtggatgatgagtccaaacacagtggccacatgttctcctccaagagtcccaagccccaggagtggacattggaaaagaatccatcttacacttactatgcctactacatgtatgcaaacatcatggtgctcaacagcctgagaaaggaacgaggcatgaatacgtttctgttccgacctcactgtggagaagctggagccctcacccatctcatgacagcattcatgatagcagatgatatctctcatggcctaaatttaaaaaagagtcccgtgctacagtacttgtttttcttagcccaaattcccatcgccatgtcaccactaagtaacaatagcctatttctagagtatgccaaaaatccttttttggatttccttcagaaagggctaatgatctcactgtctacagatgacccaatgcaattccactttaccaaggagcccctaatggaagaatatgctattgctgcacaagtcttcaagctgagcacctgtgatatgtgcgaagtggcaaggaacagtgtcttgcagtgtggaatttctcatgagtttgctaggtctaccataaccaaataccgcagattgagtggttcaaacgccagagattgatattctcacaagtctggaggctgtagaaatctaacatcaaggtgccaacagggattattcaagatcaggttgtagccattttcaacaaggatcactgatcaaaattttctttttacaaagagatttacaagttaaacatgaagggaaaatactggaatcatttggattctgacaggataaagaatacaatatttcacatttacttgtaatggaacctttgtaagattcatcacttgtcattcacccagttgggaacatggatgtggtttttctcgtactactgttcagacactgtcaagaagccactgcaaaaacatcaaacaaaaaatttctcaatgggaaggaagggctaatggtatatctaatccagaaaagtggtgtccaaaggactttggagtgagatataactgtcaccaagagatccgtcttaagaaaa

SEQ ID NO: 446604 - DNA, 803 bp, Homo sapiens
ccgccgccgcctgtgggttggctagttattttgcaagcgggaggggccgtgcgcgctcctgcctcaggcctctgtcccccaccccctttccccggtcccaggctctccttcggaaagatgtcggacacggcagtagctgatacccggcgccttaactcgaagccgcaggacctgaccgacgcttacgggccgccaagtaacttcctggagatcgacatctttaatcctcagacggtgggcgtgggacgcgcgcgcttcaccacctatgaggttcgcatgcggacaaacctacctatcttcaagctaaaggagtcctgcgtacggcggcgctacagtgactttgagtggctgaaaaatgagctggagagagatagcaagattgtagtaccaccactgcctgggaaagccttgaagcggcagctccctttccgaggagatgaagggatctttgaggagtctttcatcgaagaaaggaggcagggcctcgagcagtttattaacaaaattgctgggcacccactggctcagaatgaacgctgcctacacatgttcctgcaagaggaggcaattgacaggaactacgtcccggggaagagtcttgctgtgtcttgcccaggctggagtgcagtggcatgatctcggctcactgtagcctccacctcccagattcaaacgattctcctgtctcagcctcctgagtagctgggactacaggataaaagaacattggaataattggatactgaggtgcataattgctggcaatggagtggaggagaggagttgatcagctggaaaggagc

SEQ ID NO: 446605 - DNA, 1095 bp, Homo sapiens
ttgtttttttggcaatagccaggctagcaggtgtgcaagtgaaatttcactgtggctttgatttgcatttccctgatgattagcgatgttgagcatcttttcatgtatgtattgggcatttttgtgtctgaaaaaaatgtctcttcaagcccttaagcttatttttatctcaactgacactgttttttttcccaaataaatttgacacaggcagaaaggtgggtgaactctcagaacttttggtgggtggatattcatctgaccagtgagctctgaaatggtttccctacacagagtgggttttggcaagggttggaatgaggggaggtagcagtcttgtcatttagaaaatcaaagctagttttgatgtagctcaacatggaaagaaggtacagaaagtgatgtgttcaaaacattagcaaattaaggctgaatgtggttggctcatgcctgtaatcccagcattttgggaggctgaggcaggaggattgcttgagcccaggaggttgagactagcctgggcaacagagtgagacactgtctctacaaaaaatttcaaaagaaaaaaaaaaaggaaattaatgttacttagcagtatttggttctaagtagaagagtgggggctgtgaggaagttgaggtttttggtagttcatgaatgagatgactaaaaatatctgaggggatagggaagaatgggtatttctgtgaaataaaggaaaggaagggtaaagagagatgcaaccttcataggcagcagtgttagagaatgaactgcagaataaatagaaaagcagctataaaataaagtgttaacaaaaatttggacagatgacaactcatttaacaagtgctaatagtcttctgtgtgtctggtcctatgctaacagcagggctggggatagggtggagtggttgtggtacaagtaaaatatgatattacattctcttttttcgtagaccttaagagttcagttgaagagatgtttagctgggcgtggtggcttatgcctgtaatcccagcactttgggaggattgcttgagcccaggagttggagactagcctgggcaaccgagtgagatctcatctctaca

SEQ ID NO: 446606 - DNA, 491 bp, Homo sapiens
ccgccgccgcctgtgggttggctagttattttgcaagcgggaggggccgtgcgcgctcctgcctcaggcctctgtcccccaccccctttccccggtcccaggctctccttcggaaagatgtcggacacggcagtagctgatacccggcgccttaactcgaagccgcaggacctgaccgacgcttacgggccgccaagtaacttcctggagatcgacatctttaatcctcagacggtgggcgtgggacgcgcgcgcttcaccacctatgaggttcgcatgcggacaaacctacctatcttcaagctaaaggagtcctgcgtacggcggcgctacagtgactttgagtggctgaaaaatgagctggagagagatagcaagattgcaatattcctttgggcctctgcttctcttcacctaaaaaaagagaattagattatattggtggttctcagcaagagaaggagtatgtgttccaatggttgcctttccca

SEQ ID NO: 446607 - DNA, 3630 bp, Homo sapiens
ccgccgccgcctgtgggttggctagttattttgcaagcgggaggggccgtgcgcgctcctgcctcaggcctctgtcccccaccccctttccccggtcccaggctctccttcggaaagatgtcggacacggcagtagctgatacccggcgccttaactcgaagccgcaggacctgaccgacgcttacgggccgccaagtaacttcctggagatcgacatctttaatcctcagacggtgggcgtgggacgcgcgcgcttcaccacctatgaggttcgcatgcggacaaacctacctatcttcaagctaaaggagtcctgcgtacggcggcgctacagtgactttgagtggctgaaaaatgagctggagagagatagcaagaattgctgggcacccactggctcagaatgaacgctgcctacacatgttcctgcaagaggaggcaattgacaggaactacgtcccggggaaggtgcgccagtaggagcccctctcaccacctgccctctactttcctgctgaaatgacattggtttttacactaagcctctctctgtctttgatctgaagttggctgcccatctcctggcctgatagactgtctggcattgtgctccctggtacctgactacaccatgtgggcactctgctaggatcctcttctctgaggagaggtgggaacccacaggcagatgccctttgcttggggttggggtgggtgggtggggggattagactggaaggcaatttcttgggcatttacccatgccagaaggctaacctggggggaggggggcgcttgtgctggtgaggcacttggatacatactgatgctgcaagttcaggggatttttcttactcttaggtttaaccaagaacactgagcagggaaaaaccctgcctttcctaactgcatgtattttttcctttttggaaaggtggtagagactcagaagctttccttgttttcttcaggcctgctcccagttttcttaacagtttcttttgttgctttctctctcccttgttgctttccatggcagtaatcctcctagagtccaagcagtctgttgtatggagcagggtgtgtgggttttctgggcccatcattatggctgcttcagagtcagaagaaagccatagggcagtaggggagctcctattgcctagcccctctccctttgtggctcccactctagctgcctatttttgctcatcagctggtgagtcagtatgggccagcagttctccctccctaagcccttgctactttatgggttagctttgcaggtttggtggcttgaggggtgggggcaactcaccactgccaggtaactccctgaagggtgggagtggattatcttctaggctcttacccgcggtagggaagggcatcaacactgtcttccttccattctcctttcccccatcccatttagtgctgccacagggcagaagcacacaaaccaaccacacagtctctgacttctcctaagcactttgagttgttgaatggggctcaggggcaagagtttttgctgccctccccagcgtggtcacagggttattgaactgcctgcacttgtttctcatgcaactccagcattttccccagaagttgaactatggatagcagcttggtatggatttcctaaatcttaacatttgaagcagcttcttgaggctggcaactatcctggtttctgtcttggagggggtggtttgtttgctggggcccaacgtctgtcccaagtggtggggtgagagtaagttaactttggtgccaggtgagaggtgggggctctttgcttagactccctatcatggaaagattggagttttctatgcagggcactggggaaaaggattgctgattctgactgaccctgatcagagagattaggattgtattttgacataggatttggaacccatctaaatgttgaagttccctgagacagctctccagctgctgagcctgcgccaggggctaagcagcccctaatgagaggctctgctccctttcccacctcgccaatgttgttgttgctgcctttttgatttgtatcctctgttatagacattttttaaaaacgatttcctctttcattgtgcacaagtgctgagagtctgaggccccatttctgctgtgtatatatatcctgactcggggcttttattcagcaaactgttcattcttctgtcagacaatgtcatattcaactctgttcatattaaaccactgtgaagcaagcctctgttttcctgcttaagttgtaaatttagtattctttagtgtctaggatatgctgggtattatgcagaaatcatacagtgtggccagtgtcctgaggtaatgttttgcatttaaatttttttagaaagcagaatcttaacttatcttaatgatatttacctatcctttttgcaactcacaactgactttgtcacagaggtaatgcatctgcttgcaggaagtagctgtaggctcagtacctgttgtttgagtcagatttagcagatttggtttttaagcttgtgggtttgtgctaatttgggcagaatatatttattatatatgtgtgtgtgtatgtgtgtatgtgtgtgtctgcatatgtaatacatgtacataaacacacatgcatgtgttcatcctctgacacacccacacaacaccaacaaacatttcttctataggctttttatctcaactgacactgttttttttcccaaataaatttgacacaggcagaaaggtgggtgaactctcagaacttttggtgggtggatattcatctgaccagtgagctctgaaatggtttccctacacagagtgggttttggcaagggttggaatgaggggaggtagcagtcttgtcatttagaaaatcaaagctagttttgatgtagctcaacatggaaagaaggtacagaaagtgatgtgttcaaaacattagcaaattaaggctgaatgtggttggctcatgcctgtaatcccagcattttgggaggctgaggcaggaggattgcttgagcccaggaggttgagactagcctgggcaacagagtgagacactgtctctacaaaaaatttcaaaagaaaaaaaaaaaggaaattaatgttacttagcagtatttggttctaagtagaagagtgggggctgtgaggaagttgaggtttttggtagttcatgaatgagatgactaaaaatatctgaggggatagggaagaatgggtatttctgtgaaataaaggaaaggaagggtaaagagagatgcaaccttcataggcagcagtgttagagaatgaactgcagaataaatagaaaagcagctataaaataaagtgttaacaaaaatttggacagatgacaactcatttaacaagtgctaatagtcttctgtgtgtctggtcctatgctaacagcagggctggggatagggtggagtggttgtggtacaagtaaaatatgatattacattctcttttttcgtagaccttaagagttcagttgaagagatgtttagctgggcgtggtggcttatgcctgtaatcccagcactttgggaggattgcttgagcccaggagttggagactagcctgggcaaccgagtgagatctcatctctaca

SEQ ID NO: 446608 - DNA, 3701 bp, Homo sapiens
ccgccgccgcctgtgggttggctagttattttgcaagcgggaggggccgtgcgcgctcctgcctcaggcctctgtcccccaccccctttccccggtcccaggctctccttcggaaagatgtcggacacggcagtagctgatacccggcgccttaactcgaagccgcaggacctgaccgacgcttacgggccgccaagtaacttcctggagatcgacatctttaatcctcagacggtgggcgtgggacgcgcgcgcttcaccacctatgaggttcgcatgcggacaaacctacctatcttcaagctaaaggagtcctgcgtacggcggcgctacagtgactttgagtggctgaaaaatgagctggagagagatagcaagattgtagtaccaccactgcctgggaaagccttgaagcggcagctccctttccgaggagatgaagggatctttgaggagtctttcatcgaagaaaggaggcagggcctcgagcagtttattaacaaaattgctgggcacccactggctcagaatgaacgctgcctacacatgttcctgcaagaggaggcaattgacaggaactacgtcccggggaaggtgcgccagtaggagcccctctcaccacctgccctctactttcctgctgaaatgacattggtttttacactaagcctctctctgtctttgatctgaagttggctgcccatctcctggcctgatagactgtctggcattgtgctccctggtacctgactacaccatgtgggcactctgctaggatcctcttctctgaggagaggtgggaacccacaggcagatgccctttgcttggggttggggtgggtgggtggggggattagactggaaggcaatttcttgggcatttacccatgccagaaggctaacctggggggaggggggcgcttgtgctggtgaggcacttggatacatactgatgctgcaagttcaggggatttttcttactcttaggtttaaccaagaacactgagcagggaagactcagaagctttccttgttttcttcaggcctgctcccagttttcttaacagtttcttttgttgctttctctctcccttgttgctttccatggcagtaatcctcctagagtccaagcagtctgttgtatggagcagggtgtgtgggttttctgggcccatcattatggctgcttcagagtcagaagaaagccatagggcagtaggggagctcctattgcctagcccctctccctttgtggctcccactctagctgcctatttttgctcatcagctggtgagtcagtatgggccagcagttctccctccctaagcccttgctactttatgggttagctttgcaggtttggtggcttgaggggtgggggcaactcaccactgccaggtaactccctgaagggtgggagtggattatcttctaggctcttacccgcggtagggaagggcatcaacactgtcttccttccattctcctttcccccatcccatttagtgctgccacagggcagaagcacacaaaccaaccacacagtctctgacttctcctaagcactttgagttgttgaatggggctcaggggcaagagtttttgctgccctccccagcgtggtcacagggttattgaactgcctgcacttgtttctcatgcaactccagcattttccccagaagttgaactatggatagcagcttggtatggatttcctaaatcttaacatttgaagcagcttcttgaggctggcaactatcctggtttctgtcttggagggggtggtttgtttgctggggcccaacgtctgtcccaagtggtggggtgagagtaagttaactttggtgccaggtgagaggtgggggctctttgcttagactccctatcatggaaagattggagttttctatgcagggcactggggaaaaggattgctgattctgactgaccctgatcagagagattaggattgtattttgacataggatttggaacccatctaaatgttgaagttccctgagacagctctccagctgctgagcctgcgccaggggctaagcagcccctaatgagaggctctgctccctttcccacctcgccaatgttgttgttgctgcctttttgatttgtatcctctgttatagacattttttaaaaacgatttcctctttcattgtgcacaagtgctgagagtctgaggccccatttctgctgtgtatatatatcctgactcggggcttttattcagcaaactgttcattcttctgtcagacaatgtcatattcaactctgttcatattaaaccactgtgaagcaagcctctgttttcctgcttaagttgtaaatttagtattctttagtgtctaggatatgctgggtattatgcagaaatcatacagtgtggccagtgtcctgaggtaatgttttgcatttaaatttttttagaaagcagaatcttaacttatcttaatgatatttacctatcctttttgcaactcacaactgactttgtcacagaggtaatgcatctgcttgcaggaagtagctgtaggctcagtacctgttgtttgagtcagatttagcagatttggtttttaagcttgtgggtttgtgctaatttgggcagaatatatttattatatatgtgtgtgtgtatgtgtgtatgtgtgtgtctgcatatgtaatacatgtacataaacacacatgcatgtgttcatcctctgacacacccacacaacaccaacaaacatttcttctataggctttttatctcaactgacactgttttttttcccaaataaatttgacacaggcagaaaggtgggtgaactctcagaacttttggtgggtggatattcatctgaccagtgagctctgaaatggtttccctacacagagtgggttttggcaagggttggaatgaggggaggtagcagtcttgtcatttagaaaatcaaagctagttttgatgtagctcaacatggaaagaaggtacagaaagtgatgtgttcaaaacattagcaaattaaggctgaatgtggttggctcatgcctgtaatcccagcattttgggaggctgaggcaggaggattgcttgagcccaggaggttgagactagcctgggcaacagagtgagacactgtctctacaaaaaatttcaaaagaaaaaaaaaaaggaaattaatgttacttagcagtatttggttctaagtagaagagtgggggctgtgaggaagttgaggtttttggtagttcatgaatgagatgactaaaaatatctgaggggatagggaagaatgggtatttctgtgaaataaaggaaaggaagggtaaagagagatgcaaccttcataggcagcagtgttagagaatgaactgcagaataaatagaaaagcagctataaaataaagtgttaacaaaaatttggacagatgacaactcatttaacaagtgctaatagtcttctgtgtgtctggtcctatgctaacagcagggctggggatagggtggagtggttgtggtacaagtaaaatatgatattacattctcttttttcgtagaccttaagagttcagttgaagagatgtttagctgggcgtggtggcttatgcctgtaatcccagcactttgggaggattgcttgagcccaggagttggagactagcctgggcaaccgagtgagatctcatctctaca

SEQ ID NO: 446609 - DNA, 2429 bp, Homo sapiens
ccgccgccgcctgtgggttggctagttattttgcaagcgggaggggccgtgcgcgctcctgcctcaggcctctgtcccccaccccctttccccggtcccaggctctccttcggaaagatgtcggacacggcagtagctgatacccggcgccttaactcgaagccgcaggacctgaccgacgcttacgggccgccaagtaacttcctggagatcgacatctttaatcctcagacggtgggcgtgggacgcgcgcgcttcaccacctatgaggttcgcatgcggacaaacctacctatcttcaagctaaaggagtcctgcgtacggcggcgctacagtgactttgagtggctgaaaaatgagctggagagagatagcaagattgtagtaccaccactgcctgggaaagccttgaagcggcagctccctttccgaggagatgaagggatctttgaggagtctttcatcgaagaaaggaggcagggcctcgagcagtttattaacaaaattgctgggcacccactggctcagaatgaacgctgcctacacatgttcctgcaagaggaggcaattgacaggaactacgtcccggggaaggtgcgccagtaggagcccctctcaccacctgccctctactttcctgctgaaatgacattggtttttacactaagcctctctctgtctttgatctgaagttggctgcccatctcctggcctgatagactgtctggcattgtgctccctggtacctgactacaccatgtgggcactctgctaggatcctcttctctgaggagaggtgggaacccacaggcagatgccctttgcttggggttggggtgggtgggtggggggattagactggaaggcaatttcttgggcatttacccatgccagaaggctaacctggggggaggggggcgcttgtgctggtgaggcacttggatacatactgatgctgcaagttcaggggatttttcttactcttaggtttaaccaagaacactgagcagggaaaaaccctgcctttcctaactgcatgtattttttcctttttggaaaggtggtagagactcagaagctttccttgttttcttcaggcctgctcccagttttcttaacagtttcttttgttgctttctctctcccttgttgctttccatggcagtaatcctcctagagtccaagcagtctgttgtatggagcagggtgtgtgggttttctgggcccatcattatggctgcttcagagtcagaagaaagccatagggcagtaggggagctcctattgcctagcccctctccctttgtggctcccactctagctgcctatttttgctcatcagctggtgagtcagtatgggccagcagttctccctccctaagcccttgctactttatgggttagctttgcaggtttggtggcttgaggggtgggggcaactcaccactgccaggtaactccctgaagggtgggagtggattatcttctaggctcttacccgcggtagggaagggcatcaacactgtcttccttccattctcctttcccccatcccatttagtgctgccacagggcagaagcacacaaaccaaccacacagtctctgacttctcctaagcactttgagttgttgaatggggctcaggggcaagagtttttgctgccctccccagcgtggtcacagggttattgaactgcctgcacttgtttctcatgcaactccagcattttccccagaagttgaactatggatagcagcttggtatggatttcctaaatcttaacatttgaagcagcttcttgaggctggcaactatcctggtttctgtcttggagggggtggtttgtttgctggggcccaacgtctgtcccaagtggtggggtgagagtaagttaactttggtgccaggtgagaggtgggggctctttgcttagactccctatcatggaaagattggagttttctatgcagggcactggggaaaaggattgctgattctgactgaccctgatcagagagattaggattgtattttgacataggatttggaacccatctaaatgttgaagttccctgagacagctctccagctgctgagcctgcgccaggggctaagcagcccctaatgagaggctctgctccctttcccacctcgccaatgttgttgttgctgcctttttgatttgtatcctctgttatagacattttttaaaaacgatttcctctttcattgtgcacaagtgctgagagtctgaggccccatttctgctgtgtatatatatcctgactcggggcttttattcagcaaactgttcattcttctgtcagacaatgtcatattcaactctgttcatattaaaccactgaaaaaaaaactctctaccgcataaaccctgtccccctcctgggccaatcgattctaacttgg

SEQ ID NO: 446610 - DNA, 2367 bp, Homo sapiens
ccgccgccgcctgtgggttggctagttattttgcaagcgggaggggccgtgcgcgctcctgcctcaggcctctgtcccccaccccctttccccggtcccaggctctccttcggaaagatgtcggacacggcagtagctgatacccggcgccttaactcgaagccgcaggacctgaccgacgcttacgggccgccaagtaacttcctggagatcgacatctttaatcctcagacggtgggcgtgggacgcgcgcgcttcaccacctatgaggttcgcatgcggacaaacctacctatcttcaagctaaaggagtcctgcgtacggcggcgctacagtgactttgagtggctgaaaaatgagctggagagagatagcaagattgtagtaccaccactgcctgggaaagccttgaagcggcagctccctttccgaggagatgaagggatctttgaggagtctttcatcgaagaaaggaggcagggcctcgagcagtttattaacaaaattgctgggcacccactggctcagaatgaacgctgcctacacatgttcctgcaagaggaggcaattgacaggaactacgtcccggggaaggtgcgccagtaggagcccctctcaccacctgccctctactttcctgctgaaatgacattggtttttacactaagcctctctctgtctttgatctgaagttggctgcccatctcctggcctgatagactgtctggcattgtgctccctggtacctgactacaccatgtgggcactctgctaggatcctcttctctgaggagaggtgggaacccacaggcagatgccctttgcttggggttggggtgggtgggtggggggattagactggaaggcaatttcttgggcatttacccatgccagaaggctaacctggggggaggggggcgcttgtgctggtgaggcacttggatacatactgatgctgcaagttcaggggatttttcttactcttaggtttaaccaagaacactgagcagggaaaaaccctgcctttcctaactgcatgtattttttcctttttggaaaggtggtagagactcagaagctttccttgttttcttcaggcctgctcccagttttcttaacagtttcttttgttgctttctctctcccttgttgctttccatggcagtaatcctcctagagtccaagcagtctgttgtatggagcagggtgtgtgggttttctgggcccatcattatggctgcttcagagtcagaagaaagccatagggcagtaggggagctcctattgcctagcccctctccctttgtggctcccactctagctgcctatttttgctcatcagctggtgagtcagtatgggccagcagttctccctccctaagcccttgctactttatgggttagctttgcaggtttggtggcttgaggggtgggggcaactcaccactgccaggtaactccctgaagggtgggagtggattatcttctaggctcttacccgcggtagggaagggcatcaacactgtcttccttccattctcctttcccccatcccatttagtgctgccacagggcagaagcacacaaaccaaccacacagtctctgacttctcctaagcactttgagttgttgaatggggctcaggggcaagagtttttgctgccctccccagcgtggtcacagggttattgaactgcctgcacttgtttctcatgcaactccagcattttccccagaagttgaactatggatagcagcttggtatggatttcctaaatcttaacatttgaagcagcttcttgaggctggcaactatcctggtttctgtcttggagggggtggtttgtttgctggggcccaacgtctgtcccaagtggtggggtgagagtaagttaactttggtgccaggtgagaggtgggggctctttgcttagactccctatcatggaaagattggagttttctatgcagggcactggggaaaaggattgctgattctgactgaccctgatcagagagattaggattgtattttgacataggatttggaacccatctaaatgttgaagttccctgagacagctctccagctgctgagcctgcgccaggggctaagcagcccctaatgagaggctctgctccctttcccacctcgccaatgttgttgttgctgcctttttgatttgtatcctctgttatagacattttttaaaaacgatttcctctttcattgtgcacaagtgctgagagtctgaggccccatttctgctgtgtatatatatcctgactcggggcttttattcagcaaactgttcattcttctgtcagacaatgcaatcgataacctcgaggtcacctgcagcatc

SEQ ID NO: 446611 - DNA, 1918 bp, Homo sapiens
  misc_feature (2)..(2): n is a, c, g, or t
anttcgacggagactctcaccccaacgtctgtcccaagtggtggggtgagagtaagttaactttggtgccaggtgagaggtgggggctctttgcttagactccctatcatggaaagattggagttttctatgcagggcactggggaaaaggattgctgattctgactgaccctgatcagagagattaggattgtattttgacataggatttggaacccatctaaatgttgaagttccctgagacagctctccagctgctgagcctgcgccaggggctaagcagcccctaatgagaggctctgctccctttcccacctcgccaatgttgttgttgctgcctttttgatttgtatcctctgttatagacattttttaaaaacgatttcctctttcattgtgcacaagtgctgagagtctgaggccccatttctgctgtgtatatatatcctgactcggggcttttattcagcaaactgttcattcttctgtcagacaatgtcatattcaactctgttcatattaaaccactgtgaagcaagcctctgttttcctgcttaagttgtaaatttagtattctttagtgtctaggatatgctgggtattatgcagaaatcatacagtgtggccagtgtcctgaggtaatgttttgcatttaaatttttttagaaagcagaatcttaacttatcttaatgatatttacctatcctttttgcaactcacaactgactttgtcacagaggtaatgcatctgcttgcaggaagtagctgtaggctcagtacctgttgtttgagtcagatttagcagatttggtttttaagcttgtgggtttgtgctaatttgggcagaatatatttattatatatgtgtgtgtgtatgtgtgtatgtgtgtgtctgcatatgtaatacatgtacataaacacacatgcatgtgttcatcctctgacacacccacacaacaccaacaaacatttcttctataggctttttatctcaactgacactgttttttttcccaaataaatttgacacaggcagaaaggtgggtgaactctcagaacttttggtgggtggatattcatctgaccagtgagctctgaaatggtttccctacacagagtgggttttggcaagggttggaatgaggggaggtagcagtcttgtcatttagaaaatcaaagctagttttgatgtagctcaacatggaaagaaggtacagaaagtgatgtgttcaaaacattagcaaattaaggctgaatgtggttggctcatgcctgtaatcccagcattttgggaggctgaggcaggaggattgcttgagcccaggaggttgagactagcctgggcaacagagtgagacactgtctctacaaaaaatttcaaaagaaaaaaaaaaaggaaattaatgttacttagcagtatttggttctaagtagaagagtgggggctgtgaggaagttgaggtttttggtagttcatgaatgagatgactaaaaatatctgaggggatagggaagaatgggtatttctgtgaaataaaggaaaggaagggtaaagagagatgcaaccttcataggcagcagtgttagagaatgaactgcagaataaatagaaaagcagctataaaataaagtgttaacaaaaatttggacagatgacaactcatttaacaagtgctaatagtcttctgtgtgtctggtcctatgctaacagcagggctggggatagggtggagtggttgtggtacaagtaaaatatgatattacattctcttttttcgtagaccttaagagttcagttgaagagatgtttagctgggcgtggtggcttatgcctgtaatcccagcactttgggaggattgcttgagcccaggagttggagactagcctgggcaaccgagtgagatctcatctctaca

SEQ ID NO: 446612 - DNA, 2149 bp, Homo sapiens
ccgccgccgcctgtgggttggctagttattttgcaagcgggaggggccgtgcgcgctcctgcctcaggcctctgtcccccaccccctttccccggtcccaggctctccttcggaaagatgtcggacacggcagtagctgatacccggcgccttaactcgaagccgcaggacctgaccgacgcttacgggccgccaagtaacttcctggagatcgacatctttaatcctcagacggtgggcgtgggacgcgcgcgcttcaccacctatgaggttcgcatgcggacaaacctacctatcttcaagctaaaggagtcctgcgtacggcggcgctacagtgactttgagtggctgaaaaatgagctggagagagatagcaagattgtagtaccaccactgcctgggaaagccttgaagcggcagctccctttccgaggagatgaagggatctttgaggagtctttcatcgaagaaaggaggcagggcctcgagcagtttattaacaagggctaagcagcccctaatgagaggctctgctccctttcccacctcgccaatgttgttgttgctgcctttttgatttgtatcctctgttatagacattttttaaaaacgatttcctctttcattgtgcacaagtgctgagagtctgaggccccatttctgctgtgtatatatatcctgactcggggcttttattcagcaaactgttcattcttctgtcagacaatgtcatattcaactctgttcatattaaaccactgtgaagcaagcctctgttttcctgcttaagttgtaaatttagtattctttagtgtctaggatatgctgggtattatgcagaaatcatacagtgtggccagtgtcctgaggtaatgttttgcatttaaatttttttagaaagcagaatcttaacttatcttaatgatatttacctatcctttttgcaactcacaactgactttgtcacagaggtaatgcatctgcttgcaggaagtagctgtaggctcagtacctgttgtttgagtcagatttagcagatttggtttttaagcttgtgggtttgtgctaatttgggcagaatatatttattatatatgtgtgtgtgtatgtgtgtatgtgtgtgtctgcatatgtaatacatgtacataaacacacatgcatgtgttcatcctctgacacacccacacaacaccaacaaacatttcttctataggctttttatctcaactgacactgttttttttcccaaataaatttgacacaggcagaaaggtgggtgaactctcagaacttttggtgggtggatattcatctgaccagtgagctctgaaatggtttccctacacagagtgggttttggcaagggttggaatgaggggaggtagcagtcttgtcatttagaaaatcaaagctagttttgatgtagctcaacatggaaagaaggtacagaaagtgatgtgttcaaaacattagcaaattaaggctgaatgtggttggctcatgcctgtaatcccagcattttgggaggctgaggcaggaggattgcttgagcccaggaggttgagactagcctgggcaacagagtgagacactgtctctacaaaaaatttcaaaagaaaaaaaaaaaggaaattaatgttacttagcagtatttggttctaagtagaagagtgggggctgtgaggaagttgaggtttttggtagttcatgaatgagatgactaaaaatatctgaggggatagggaagaatgggtatttctgtgaaataaaggaaaggaagggtaaagagagatgcaaccttcataggcagcagtgttagagaatgaactgcagaataaatagaaaagcagctataaaataaagtgttaacaaaaatttggacagatgacaactcatttaacaagtgctaatagtcttctgtgtgtctggtcctatgctaacagcagggctggggatagggtggagtggttgtggtacaagtaaaatatgatattacattctcttttttcgtagaccttaagagttcagttgaagagatgtttagctgggcgtggtggcttatgcctgtaatcccagcactttgggaggattgcttgagcccaggagttggagactagcctgggcaaccgagtgagatctcatctctaca

SEQ ID NO: 446613 - DNA, 2038 bp, Homo sapiens
ccgccgccgcctgtgggttggctagttattttgcaagcgggaggggccgtgcgcgctcctgcctcaggcctctgtcccccaccccctttccccggtcccaggctctccttcggaaagatgtcggacacggcagtagctgatacccggcgccttaactcgaagccgcaggacctgaccgacgcttacgggccgccaagtaacttcctggagatcgacatctttaatcctcagacggtgggcgtgggacgcgcgcgcttcaccacctatgaggttcgcatgcggacaaacctacctatcttcaagctaaaggagtcctgcgtacggcggcgctacagtgactttgagtggctgaaaaatgagctggagagagatagcaagattgtagtaccaccactgcctgggaaagccttgaagcggctctgctccctttcccacctcgccaatgttgttgttgctgcctttttgatttgtatcctctgttatagacattttttaaaaacgatttcctctttcattgtgcacaagtgctgagagtctgaggccccatttctgctgtgtatatatatcctgactcggggcttttattcagcaaactgttcattcttctgtcagacaatgtcatattcaactctgttcatattaaaccactgtgaagcaagcctctgttttcctgcttaagttgtaaatttagtattctttagtgtctaggatatgctgggtattatgcagaaatcatacagtgtggccagtgtcctgaggtaatgttttgcatttaaatttttttagaaagcagaatcttaacttatcttaatgatatttacctatcctttttgcaactcacaactgactttgtcacagaggtaatgcatctgcttgcaggaagtagctgtaggctcagtacctgttgtttgagtcagatttagcagatttggtttttaagcttgtgggtttgtgctaatttgggcagaatatatttattatatatgtgtgtgtgtatgtgtgtatgtgtgtgtctgcatatgtaatacatgtacataaacacacatgcatgtgttcatcctctgacacacccacacaacaccaacaaacatttcttctataggctttttatctcaactgacactgttttttttcccaaataaatttgacacaggcagaaaggtgggtgaactctcagaacttttggtgggtggatattcatctgaccagtgagctctgaaatggtttccctacacagagtgggttttggcaagggttggaatgaggggaggtagcagtcttgtcatttagaaaatcaaagctagttttgatgtagctcaacatggaaagaaggtacagaaagtgatgtgttcaaaacattagcaaattaaggctgaatgtggttggctcatgcctgtaatcccagcattttgggaggctgaggcaggaggattgcttgagcccaggaggttgagactagcctgggcaacagagtgagacactgtctctacaaaaaatttcaaaagaaaaaaaaaaaggaaattaatgttacttagcagtatttggttctaagtagaagagtgggggctgtgaggaagttgaggtttttggtagttcatgaatgagatgactaaaaatatctgaggggatagggaagaatgggtatttctgtgaaataaaggaaaggaagggtaaagagagatgcaaccttcataggcagcagtgttagagaatgaactgcagaataaatagaaaagcagctataaaataaagtgttaacaaaaatttggacagatgacaactcatttaacaagtgctaatagtcttctgtgtgtctggtcctatgctaacagcagggctggggatagggtggagtggttgtggtacaagtaaaatatgatattacattctcttttttcgtagaccttaagagttcagttgaagagatgtttagctgggcgtggtggcttatgcctgtaatcccagcactttgggaggattgcttgagcccaggagttggagactagcctgggcaaccgagtgagatctcatctctaca

SEQ ID NO: 446614 - DNA, 480 bp, Homo sapiens
gtgggttgaccgtggcttgtgggttgaccgtggtttgtgggttgaccgtggcttgtgggttgaccgtggcttgttaaggaaagtgaggattatttggagtttatttccttcttttgaggtggtaaacctgtcttcccacagaaacggattaatttttgacctgagccatcctgactgttcttatggtcttagttcttgcaagttgctggctgtgggacaggatggaccctatgcctaataagaaatgaggtacacggtgctttaccatctcattcccactctgtctctctcccatgtggctggaattttgtgtgtgcctgcagattgtagtaccaccactgcctgggaaagccttgaagcggcagctccctttccgaggagatgaagggatctttgaggagtctttcatcgaagaaaggaggcagggcctcgagcagtttattaacaataagccaagttcctgggggctccacttgctac

SEQ ID NO: 446615 - DNA, 3755 bp, Homo sapiens
ccgccgccgcctgtgggttggctagttattttgcaagcgggaggggccgtgcgcgctcctgcctcaggcctctgtcccccaccccctttccccggtcccaggctctccttcggaaagatgtcggacacggcagtagctgatacccggcgccttaactcgaagccgcaggacctgaccgacgcttacgggccgccaagtaacttcctggagatcgacatctttaatcctcagacggtgggcgtgggacgcgcgcgcttcaccacctatgaggttcgcatgcggacaaacctacctatcttcaagctaaaggagtcctgcgtacggcggcgctacagtgactttgagtggctgaaaaatgagctggagagagatagcaagattgtagtaccaccactgcctgggaaagccttgaagcggcagctccctttccgaggagatgaagggatctttgaggagtctttcatcgaagaaaggaggcagggcctcgagcagtttattaacaaaattgctgggcacccactggctcagaatgaacgctgcctacacatgttcctgcaagaggaggcaattgacaggaactacgtcccggggaaggtgcgccagtaggagcccctctcaccacctgccctctactttcctgctgaaatgacattggtttttacactaagcctctctctgtctttgatctgaagttggctgcccatctcctggcctgatagactgtctggcattgtgctccctggtacctgactacaccatgtgggcactctgctaggatcctcttctctgaggagaggtgggaacccacaggcagatgccctttgcttggggttggggtgggtgggtggggggattagactggaaggcaatttcttgggcatttacccatgccagaaggctaacctggggggaggggggcgcttgtgctggtgaggcacttggatacatactgatgctgcaagttcaggggatttttcttactcttaggtttaaccaagaacactgagcagggaaaaaccctgcctttcctaactgcatgtattttttcctttttggaaaggtggtagagactcagaagctttccttgttttcttcaggcctgctcccagttttcttaacagtttcttttgttgctttctctctcccttgttgctttccatggcagtaatcctcctagagtccaagcagtctgttgtatggagcagggtgtgtgggttttctgggcccatcattatggctgcttcagagtcagaagaaagccatagggcagtaggggagctcctattgcctagcccctctccctttgtggctcccactctagctgcctatttttgctcatcagctggtgagtcagtatgggccagcagttctccctccctaagcccttgctactttatgggttagctttgcaggtttggtggcttgaggggtgggggcaactcaccactgccaggtaactccctgaagggtgggagtggattatcttctaggctcttacccgcggtagggaagggcatcaacactgtcttccttccattctcctttcccccatcccatttagtgctgccacagggcagaagcacacaaaccaaccacacagtctctgacttctcctaagcactttgagttgttgaatggggctcaggggcaagagtttttgctgccctccccagcgtggtcacagggttattgaactgcctgcacttgtttctcatgcaactccagcattttccccagaagttgaactatggatagcagcttggtatggatttcctaaatcttaacatttgaagcagcttcttgaggctggcaactatcctggtttctgtcttggagggggtggtttgtttgctggggcccaacgtctgtcccaagtggtggggtgagagtaagttaactttggtgccaggtgagaggtgggggctctttgcttagactccctatcatggaaagattggagttttctatgcagggcactggggaaaaggattgctgattctgactgaccctgatcagagagattaggattgtattttgacataggatttggaacccatctaaatgttgaagttccctgagacagctctccagctgctgagcctgcgccaggggctaagcagcccctaatgagaggctctgctccctttcccacctcgccaatgttgttgttgctgcctttttgatttgtatcctctgttatagacattttttaaaaacgatttcctctttcattgtgcacaagtgctgagagtctgaggccccatttctgctgtgtatatatatcctgactcggggcttttattcagcaaactgttcattcttctgtcagacaatgtcatattcaactctgttcatattaaaccactgtgaagcaagcctctgttttcctgcttaagttgtaaatttagtattctttagtgtctaggatatgctgggtattatgcagaaatcatacagtgtggccagtgtcctgaggtaatgttttgcatttaaatttttttagaaagcagaatcttaacttatcttaatgatatttacctatcctttttgcaactcacaactgactttgtcacagaggtaatgcatctgcttgcaggaagtagctgtaggctcagtacctgttgtttgagtcagatttagcagatttggtttttaagcttgtgggtttgtgctaatttgggcagaatatatttattatatatgtgtgtgtgtatgtgtgtatgtgtgtgtctgcatatgtaatacatgtacataaacacacatgcatgtgttcatcctctgacacacccacacaacaccaacaaacatttcttctataggctttttatctcaactgacactgttttttttcccaaataaatttgacacaggcagaaaggtgggtgaactctcagaacttttggtgggtggatattcatctgaccagtgagctctgaaatggtttccctacacagagtgggttttggcaagggttggaatgaggggaggtagcagtcttgtcatttagaaaatcaaagctagttttgatgtagctcaacatggaaagaaggtacagaaagtgatgtgttcaaaacattagcaaattaaggctgaatgtggttggctcatgcctgtaatcccagcattttgggaggctgaggcaggaggattgcttgagcccaggaggttgagactagcctgggcaacagagtgagacactgtctctacaaaaaatttcaaaagaaaaaaaaaaaggaaattaatgttacttagcagtatttggttctaagtagaagagtgggggctgtgaggaagttgaggtttttggtagttcatgaatgagatgactaaaaatatctgaggggatagggaagaatgggtatttctgtgaaataaaggaaaggaagggtaaagagagatgcaaccttcataggcagcagtgttagagaatgaactgcagaataaatagaaaagcagctataaaataaagtgttaacaaaaatttggacagatgacaactcatttaacaagtgctaatagtcttctgtgtgtctggtcctatgctaacagcagggctggggatagggtggagtggttgtggtacaagtaaaatatgatattacattctcttttttcgtagaccttaagagttcagttgaagagatgtttagctgggcgtggtggcttatgcctgtaatcccagcactttgggaggattgcttgagcccaggagttggagactagcctgggcaaccgagtgagatctcatctctaca

SEQ ID NO: 446616 - DNA, 2988 bp, Homo sapiens
ccgccgccgcctgtgggttggctagttattttgcaagcgggaggggccgtgcgcgctcctgcctcaggcctctgtcccccaccccctttccccggtcccaggctctccttcggaaagatgtcggacacggcagtagctgatacccggcgccttaactcgaagccgcaggacctgaccgacgcttacgggccgccaagtaacttcctggagatcgacatctttaatcctcagacggtgggcgtgggacgcgcgcgcttcaccacctatgaggttcgcatgcggacaaacctacctatcttcaagctaaaggagtcctgcgtacggcggcgctacagtgactttgagtggctgaaaaatgagctggagagagatagcaagcttgttgctttccatggcagtaatcctcctagagtccaagcagtctgttgtatggagcagggtgtgtgggttttctgggcccatcattatggctgcttcagagtcagaagaaagccatagggcagtaggggagctcctattgcctagcccctctccctttgtggctcccactctagctgcctatttttgctcatcagctggtgagtcagtatgggccagcagttctccctccctaagcccttgctactttatgggttagctttgcaggtttggtggcttgaggggtgggggcaactcaccactgccaggtaactccctgaagggtgggagtggattatcttctaggctcttacccgcggtagggaagggcatcaacactgtcttccttccattctcctttcccccatcccatttagtgctgccacagggcagaagcacacaaaccaaccacacagtctctgacttctcctaagcactttgagttgttgaatggggctcaggggcaagagtttttgctgccctccccagcgtggtcacagggttattgaactgcctgcacttgtttctcatgcaactccagcattttccccagaagttgaactatggatagcagcttggtatggatttcctaaatcttaacatttgaagcagcttcttgaggctggcaactatcctggtttctgtcttggagggggtggtttgtttgctggggcccaacgtctgtcccaagtggtggggtgagagtaagttaactttggtgccaggtgagaggtgggggctctttgcttagactccctatcatggaaagattggagttttctatgcagggcactggggaaaaggattgctgattctgactgaccctgatcagagagattaggattgtattttgacataggatttggaacccatctaaatgttgaagttccctgagacagctctccagctgctgagcctgcgccaggggctaagcagcccctaatgagaggctctgctccctttcccacctcgccaatgttgttgttgctgcctttttgatttgtatcctctgttatagacattttttaaaaacgatttcctctttcattgtgcacaagtgctgagagtctgaggccccatttctgctgtgtatatatatcctgactcggggcttttattcagcaaactgttcattcttctgtcagacaatgtcatattcaactctgttcatattaaaccactgtgaagcaagcctctgttttcctgcttaagttgtaaatttagtattctttagtgtctaggatatgctgggtattatgcagaaatcatacagtgtggccagtgtcctgaggtaatgttttgcatttaaatttttttagaaagcagaatcttaacttatcttaatgatatttacctatcctttttgcaactcacaactgactttgtcacagaggtaatgcatctgcttgcaggaagtagctgtaggctcagtacctgttgtttgagtcagatttagcagatttggtttttaagcttgtgggtttgtgctaatttgggcagaatatatttattatatatgtgtgtgtgtatgtgtgtatgtgtgtgtctgcatatgtaatacatgtacataaacacacatgcatgtgttcatcctctgacacacccacacaacaccaacaaacatttcttctataggctttttatctcaactgacactgttttttttcccaaataaatttgacacaggcagaaaggtgggtgaactctcagaacttttggtgggtggatattcatctgaccagtgagctctgaaatggtttccctacacagagtgggttttggcaagggttggaatgaggggaggtagcagtcttgtcatttagaaaatcaaagctagttttgatgtagctcaacatggaaagaaggtacagaaagtgatgtgttcaaaacattagcaaattaaggctgaatgtggttggctcatgcctgtaatcccagcattttgggaggctgaggcaggaggattgcttgagcccaggaggttgagactagcctgggcaacagagtgagacactgtctctacaaaaaatttcaaaagaaaaaaaaaaaggaaattaatgttacttagcagtatttggttctaagtagaagagtgggggctgtgaggaagttgaggtttttggtagttcatgaatgagatgactaaaaatatctgaggggatagggaagaatgggtatttctgtgaaataaaggaaaggaagggtaaagagagatgcaaccttcataggcagcagtgttagagaatgaactgcagaataaatagaaaagcagctataaaataaagtgttaacaaaaatttggacagatgacaactcatttaacaagtgctaatagtcttctgtgtgtctggtcctatgctaacagcagggctggggatagggtggagtggttgtggtacaagtaaaatatgatattacattctcttttttcgtagaccttaagagttcagttgaagagatgtttagctgggcgtggtggcttatgcctgtaatcccagcactttgggaggattgcttgagcccaggagttggagactagcctgggcaaccgagtgagatctcatctctaca

SEQ ID NO: 446617 - DNA, 2540 bp, Homo sapiens
ccgccgccgcctgtgggttggctagttattttgcaagcgggaggggccgtgcgcgctcctgcctcaggcctctgtcccccaccccctttccccggtcccaggctctccttcggaaagatgtcggacacggcagtagctgatacccggcgccttaactcgaagccgcaggacctgaccgacgcttacgggccgccaagtaacttcctggagatcgacatctttaatcctcagacggtgggcgtgggacgcgcgcgcttcaccacctatgaggttcgcatgcggacaaacctacctatcttcaagctaaaggagtcctgcgtacggcggcgctacagtgactttgagtggctgaaaaatgagctggagagagatagcaagattgtagtaccaccactgcctgggaaagccttgaagcggcagctccctttccgaggagatgaagggatctttgaggagtctttcatcgaagaaaggaggcagggcctcgagcagtttattaacaaaattgctgggcacccactggctcagaatgaacgctgcctacacatgttcctgcaagaggaggcaattgacaggaactacgtcccggggaaggtgcgccagtaggagcccctctcaccacctgccctctactttcctgctgaaatgacattggtttttacactaagcctctctctgtctttgatctgaagttggctgcccatctcctggcctgatagactgtctggcattgtgctccctggtacctgactacaccatgtgggcactctgctaggatcctcttctctgaggagaggtgggaacccacaggcagatgccctttgcttggggttggggtgggtgggtggggggattagactggaaggcaatttcttgggcatttacccatgccagaaggctaacctggggggaggggggcgcttgtgctggtgaggcacttggatacatactgatgctgcaagttcaggggatttttcttactcttaggtttaaccaagaacactgagcagggaaaaaccctgcctttcctaactgcatgtattttttcctttttggaaaggtggtagagactcagaagctttccttgttttcttcaggcctgctcccagttttcttaacagtttcttttgttgctttctctctcccttgttgctttccatggcagtaatcctcctagagtccaagcagtctgttgtatggagcagggtgtgtgggttttctgggcccatcattatggctgcttcagagtcagaagaaagccatagggcagtaggggagctcctattgcctagcccctctccctttgtggctcccactctagctgcctatttttgctcatcagctggtgagtcagtatgggccagcagttctccctccctaagcccttgctactttatgggttagctttgcaggtttggtggcttgaggggtgggggcaactcaccactgccaggtaactccctgaagggtgggagtggattatcttctaggctcttacccgcggtagggaagggcatcaacactgtcttccttccattctcctttcccccatcccatttagtgctgccacagggcagaagcacacaaaccaaccacacagtctctgacttctcctaagcactttgagttgttgaatggggctcaggggcaagagtttttgctgccctccccagcgtggtcacagggttattgaactgcctgcacttgtttctcatgcaactccagcattttccccagaagttgaactatggatagcagcttggtatggatttcctaaatcttaacatttgaagcagcttcttgaggctggcaactatcctggtttctgtcttggagggggtggtttgtttgctggggcccaacgtctgtcccaagtggtggggtgagagtaagttaactttggtgccaggtgagaggtgggggctctttgcttagactccctatcatggaaagattggagttttctatgcagggcactggggaaaaggattgctgattctgactgaccctgatcagagagattaggattgtattttgacataggatttggaacccatctaaatgttgaagttccctgagacagctctccagctgctgagcctgcgccaggggctaagcagcccctaatgagaggctctgctccctttcccacctcgccaatgttgttgttgctgcctttttgatttgtatcctctgttatagacattttttaaaaacgatttcctctttcattgtgcacaagtgctgagagtctgaggccccatttctgctgtgtatatatatcctgactcggggcttttattcagcaaactgttcattcttctgtcagacaatgtcatattcaactctgttcatattaaaccactgccatggagcaaaaaaaaaaaaaaaaggggggtaaaattccggggccaataggccgttgtaagggcaaggggaaaaaaagggggtaagagggaggagggttggagacctctgggttggaccgaacggaaaaagttgaggtttggtgagataaagaacaagggggtaagtgcgaa

SEQ ID NO: 446618 - DNA, 2377 bp, Homo sapiens
ccgccgccgcctgtgggttggctagttattttgcaagcgggaggggccgtgcgcgctcctgcctcaggcctctgtcccccaccccctttccccggtcccaggctctccttcggaaagatgtcggacacggcagtagctgatacccggcgccttaactcgaagccgcaggacctgaccgacgcttacgggccgccaagtaacttcctggagatcgacatctttaatcctcagacggtgggcgtgggacgcgcgcgcttcaccacctatgaggttcgcatgcggacaaacctacctatcttcaagctaaaggagtcctgcgtacggcggcgctacagtgactttgagtggctgaaaaatgagctggagagagatagcaagattgtagtaccaccactgcctgggaaagccttgaagcggcagctccctttccgaggagatgaagggatctttgaggagtctttcatcgaagaaaggaggcagggcctcgagcagtttattaacaaaattgctgggcacccactggctcagaatgaacgctgcctacacatgttcctgcaagaggaggcaattgacaggaactacgtcccggggaaggtgcgccagtaggagcccctctcaccacctgccctctactttcctgctgaaatgacattggtttttacactaagcctctctctgtctttgatctgaagttggctgcccatctcctggcctgatagactgtctggcattgtgctccctggtacctgactacaccatgtgggcactctgctaggatcctcttctctgaggagaggtgggaacccacaggcagatgccctttgcttggggttggggtgggtgggtggggggattagactggaaggcaatttcttgggcatttacccatgccagaaggctaacctggggggaggggggcgcttgtgctggtgaggcacttggatacatactgatgctgcaagttcaggggatttttcttactcttaggtttaaccaagaacactgagcagggaaaaaccctgcctttcctaactgcatgtattttttcctttttggaaaggtggtagagactcagaagctttccttgttttcttcaggcctgctcccagttttcttaacagtttcttttgttgctttctctctcccttgttgctttccatggcagtaatcctcctagagtccaagcagtctgttgtatggagcagggtgtgtgggttttctgggcccatcattatggctgcttcagagtcagaagaaagccatagggcagtaggggagctcctattgcctagcccctctccctttgtggctcccactctagctgcctatttttgctcatcagctggtgagtcagtatgggccagcagttctccctccctaagcccttgctactttatgggttagctttgcaggtttggtggcttgaggggtgggggcaactcaccactgccaggtaactccctgaagggtgggagtggattatcttctaggctcttacccgcggtagggaagggcatcaacactgtcttccttccattctcctttcccccatcccatttagtgctgccacagggcagaagcacacaaaccaaccacacagtctctgacttctcctaagcactttgagttgttgaatggggctcaggggcaagagtttttgctgccctccccagcgtggtcacagggttattgaactgcctgcacttgtttctcatgcaactccagcattttccccagaagttgaactatggatagcagcttggtatggatttcctaaatcttaacatttgaagcagcttcttgaggctggcaactatcctggtttctgtcttggagggggtggtttgtttgctggggcccaacgtctgtcccaagtggtggggtgagagtaagttaactttggtgccaggtgagaggtgggggctctttgcttagactccctatcatggaaagattggagttttctatgcagggcactggggaaaaggattgctgattctgactgaccctgatcagagagattaggattgtattttgacataggatttggaacccatctaaatgttgaagttccctgagacagctctccagctgctgagcctgcgccaggggctaagcagcccctaatgagaggctctgctccctttcccacctcgccaatgttgttgttgctgcctttttgatttgtatcctctgttatagacattttttaaaaacgatttcctctttcattgtgcacaagtgctgagagtctgaggccccatttctgctgtgtatatatatcctgactcggggctcacatgcggcgtacagttctcccgtcggtccgacatagtcatcgacagtggcgttaacatatctgcactgtcaaatagca

SEQ ID NO: 446619 - DNA, 4223 bp, Homo sapiens
  misc_feature (1395)..(1395): n is a, c, g, or t
cattcatcttctcctgcccttggacatcacagctccaggaactcagatcttcagactcagggtgaaggacaccaccagctttccaggttccccagcttgcagacggcatacgctaggtcttgactccactaacggggacttctcatacggctttgaacttggaccttggtgcataagcaaatgtaactcagcgaattgtaatggaaagcatatggacaggtctacgccacatcacttaggtgctaagagatgccgtttgcaggcctcatctctgcttgagaatcgggggctccaggcactagaagagccggctgatcctgggctcctagcttgaataagccttcacttccagctgctctccccaacggctgtgtaaactactcgtttctcttaatgatgggtattggtaagaataccacatccaaatcaatggaggctggaagttcaacagaaggcaaatacgaagacgaggcaaagcacccagctttcttcactcttccggtggtgataaatggaggcgccacctccagcggtgagcaggacaatgaggacactgagctcatggcgatctacactacggaaaacggcattgcagaaaagagctctctcgctgagaccctggatagcactggcagtctggacccccagcgatcagacatgatttataccatagaagatgttcctccctggtacctgtgtatatttctggggctacagcactacctgacatgcttcagcggcacgatcgcagtgcccttcctgttggccgatgccatgtgtgtggggtacgaccagtgggccaccagccagctcattgggaccattttcttctgtgtgggaatcactactttgctacagacaacgtttggatgcaggttacccctgtttcaggccagtgcttttgcatttttggcccctgctcgagccatcctgtctttagataaatggaaatgtaacaccacagatgtttcagttgccaatggaacagcagagctgttgcacacagaacacatctggtatccccggatccgagagatccagggggccatcatcatgtcctcactgatagaagtagtcatcggcctcctcggcctgcctggggctctactgaagtacatcggtcccttgaccattacacccacggtggccctaattggcctctctggtttccaggcagcgggggagagagccgggaagcactggggcattgccatgctgacaatattcctagtattactgttttctcaatacgccagaaatgttaaatttcctctcccgatttataaatccaagaaaggatggactgcgtacaagttacagctgttcaaaatgttccctatcatcctggccatcctggtatcctggctgctctgcttcatcttcacggtgacagangtcttccctcccgacagcacaaagtatggcttctatgctcgcacagatgccaggcaaggcgtgcttctggtagccccgtggtttaaggttccatacccatttcagtggggactgcccaccgtgtctgcggccggtgtcatcggcatgctcagtgccgtggtcgccagcatcatcgagtctattggtgactactacgcctgtgcacggctgtcctgtgccccacccccccccatccacgcaataaacaggggaattttcgtggaaggcctctcctgtgttcttgatggcatatttggtactgggaatggctctacttcatccagtcccaacattggagttttgggaattacaaaggtcggcagccgccgcgtgatacagtgcggagcagccctcatgctcgctctgggcatgatcgggaagttcagcgccctctttgcgtcccttccggatcctgtgctgggagccctgttctgcacgctctttggaatgatcacagctgttggcctctctaacctgcagttcattgatttaaattcttcccggaacctctttgtgcttggattttcgatcttctttgggctcgtccttccaagttacctcagacagaaccctctggtcacagggataacaggaatcgatcaagtgttgaacgtccttctcacaactgctatgtttgtagggggctgtgtggcttttatcctggataacaccatcccaggcactccagaggaaagaggaatccggaaatggaagaagggtgtgggcaaagggaacaaatcactcgacggcatggagtcgtacaatttgccatttggcatgaacattataaaaaaatacagatgcttcagctacttacccatcagcccaacctttgtgggctacacatggaaaggcctcaggaagagcgacaacagccggagttcagatgaagactcccaggccacgggatagcctttgctgtgccctgtggcctggccgcagtgaggcatgtatctgtagttccttgctgagtaacaagaagtaaaatacatgtttgtatatctacatttacattctgcgccccagagctaagacagactgcgaatcacttttctgctgtgagggtgatggtgcctgatgcggtgtctcgcctatctccttatttaagcccttaactccttgccctttgagagtgtccattgctggccatggtcactaaatttgaagttccagtcctccctttggagtggacatttaaaatctgcagccattccttgcttcagttcccttccaccacccagggctggctttcctataagccacctccagggtccaggggctttctctctctctccgaagcccctggacctgtttccttgtcatttgaccctcgtctgtgcccgcggagacctcctctgaccaaggggcactagtatgccttgcgctatcatgactgactggcccagtatgattctgttgtcgctgatctcccggaggaggaggctgttgacctgaaaacagtggcgtggctcccctgtgcccagatctggccatgggtgaggcctgcacagatgttgaatgaacatctgtttggggcattggagggaaaaggaaaggaccctgaagccaatatctgattctcggctgcaccttctcttggccaccctggccctgaccgggccagcacgtgcacactggcctcttttcatttcactagtggccgagacaccctctctggcatttatcactgttggccggtgtgatgagtatagagtgccacccaaggcaccagtcacacaagctgatgggcgtcttggctctgccgtcatgtggatgttattgtcgcgcgcgtctataattacaaggttttattcctatttaatgttattgactatagcagattttggaaatcagtgttttccatgtgaccctctttccttgcatccctattccttgtcccccacccactcttccccccatcaagaaaagaaccagcatttgtaaagctgtggacaccatcagggaagcttgttgtaacggcttttgaaggccagtaaccattgttgtggttgtgttttgtattgcttgataccatgaaagtgtaaatactgtaatgcctaatctatttatcaaaactgactactggaccggagcccagaaaccatgggtcaagttacacgtgaatttgttttgtgaagaagggaagctggggcaggtaacacgcagagccgccacgtggaacggtctgtccgccggtctgtcccgcttgccgggcttctgttgcaagtcttggcttaaggagacttcctgtgggttgccatgtcgcacgtccgttagatcttgattttacaggtgagggtggttgccaaaggtgataagaaaagcagccaacaggctccctctcacttaagagagttctaattaataacactaaattcttcctgagaaatgactcctcttggtttggtttgaagtttttcagtgaaggaaaaggcctgagataggaagcagtgccctcgcttcatgaggtggcacatcttcggtggccgttggcctggtcgagctttggtcagctgcgtgggtgcctgtctcctgtctccagcggcagggcatggttcttggcagcctggtgtccacacggtgcattcctgtccccctcggccccaggctggctcagctctccagtgctgcggcgctgtctttgcagcattgccatgtcaccgtagcccccttcactcttggaagtttggggcttcaaggtttattctggcaagaacacctcggagccactgcattgttttgccaaaaacttactgcagattaagtaaagaacttagatgctaaattac

SEQ ID NO: 446620 - DNA, 2055 bp, Homo sapiens
  misc_feature (1395)..(1395): n is a, c, g, or t
cattcatcttctcctgcccttggacatcacagctccaggaactcagatcttcagactcagggtgaaggacaccaccagctttccaggttccccagcttgcagacggcatacgctaggtcttgactccactaacggggacttctcatacggctttgaacttggaccttggtgcataagcaaatgtaactcagcgaattgtaatggaaagcatatggacaggtctacgccacatcacttaggtgctaagagatgccgtttgcaggcctcatctctgcttgagaatcgggggctccaggcactagaagagccggctgatcctgggctcctagcttgaataagccttcacttccagctgctctccccaacggctgtgtaaactactcgtttctcttaatgatgggtattggtaagaataccacatccaaatcaatggaggctggaagttcaacagaaggcaaatacgaagacgaggcaaagcacccagctttcttcactcttccggtggtgataaatggaggcgccacctccagcggtgagcaggacaatgaggacactgagctcatggcgatctacactacggaaaacggcattgcagaaaagagctctctcgctgagaccctggatagcactggcagtctggacccccagcgatcagacatgatttataccatagaagatgttcctccctggtacctgtgtatatttctggggctacagcactacctgacatgcttcagcggcacgatcgcagtgcccttcctgttggccgatgccatgtgtgtggggtacgaccagtgggccaccagccagctcattgggaccattttcttctgtgtgggaatcactactttgctacagacaacgtttggatgcaggttacccctgtttcaggccagtgcttttgcatttttggcccctgctcgagccatcctgtctttagataaatggaaatgtaacaccacagatgtttcagttgccaatggaacagcagagctgttgcacacagaacacatctggtatccccggatccgagagatccagggggccatcatcatgtcctcactgatagaagtagtcatcggcctcctcggcctgcctggggctctactgaagtacatcggtcccttgaccattacacccacggtggccctaattggcctctctggtttccaggcagcgggggagagagccgggaagcactggggcattgccatgctgacaatattcctagtattactgttttctcaatacgccagaaatgttaaatttcctctcccgatttataaatccaagaaaggatggactgcgtacaagttacagctgttcaaaatgttccctatcatcctggccatcctggtatcctggctgctctgcttcatcttcacggtgacagangtcttccctcccgacagcacaaagtatggcttctatgctcgcacagatgccaggcaaggcgtgcttctggtagccccgtggtttaaggttccatacccatttcagtggggactgcccaccgtgtctgcggccggtgtcatcggcatgctcagtgccgtggtcgccagcatcatcgagtctattggtgactactacgcctgtgcacggctgtcctgtgccccacccccccccatccacgcaataaacaggtacgttcctgagaagacaagttcctgattggtcccagcaccttgttactttgttcttaggtttacattaccttgaagacaaaaccaagagtttcagcaggagcccagccaagcagcaggactctagcgactgtttgatgcatcaccacctttgtttactttcgactgtctgatacaccactgcctttgtttactttcattttcctcgtccatgacgtggaacggaattcctacccttccttaattgcagtgacatcaaataacacactctctgcgaaaccactgtaagccttaaattcaaaaaccacatgccaagcactgcacttgttctttgctttttttggggtgtgtgtgtgtgtgtgtgtcatttggagattagatagataaaatcaaagtagctctgtctatatat

SEQ ID NO: 446621 - DNA, 987 bp, Homo sapiens
ctcagcctcccgagtagttggaattacaggcacatgcccccacgcctggctaatttttgtatttttagtagagatggggtttcaccttgttggccaggctggtctcgaactcctgacctcgtgatctgcctgcctcggcctcccaaagtgctgggattacaggcgtgagccaccgcatccggctacgatgttttcttttaattaaagacacagtgcacatcagtcctcattatggccgccttcatctgacttagcaactgtcccaggcatctggtgcttaagattttaaaatgaacagtttccatgagcttcagaatccaagtggatcttgtagagtcttgcagcgttcagaatgactttgggtaactggtcctggtcactttcgcctgcctctctaggagcattcatggttgttttcctcccacagttcagtggggactgcccaccgtgtctgcggccggtgtcatcggcatgctcagtgccgtggtcgccagcatcatcgagtctattggtgactactacgcctgtgcacggctgtcctgtgccccacccccccccatccacgcaataaacaggtacgttcctgagaagacaagttcctgattggtcccagcaccttgttactttgttcttaggtttacattaccttgaagacaaaaccaagagtttcagcaggagcccagccaagcagcaggactctagcgactgtttgatgcatcaccacctttgtttactttcgactgtctgatacaccactgcctttgtttactttcattttcctcgtccatgacgtggaacggaattcctacccttccttaattgcagtgacatcaaataacacactctctgcgaaaccactgtaagccttaaattcaaaaaccacatgccaagcactgcacttgttctttgctttttttggggtgtgtgtgtgtgtgtgtgtcatttggagattagatagataaaatcaaagtagctctgtctatatat

SEQ ID NO: 446622 - DNA, 594 bp, Homo sapiens
ctgtctcctgaaggccttgccattctggtcaggagaggattagacagcaagtaagggaggccctgtccccagagggcagaaaccaacacacagagactgaccggctcccttctcacattagcgagctgtctcttttggatctgctaggatgaaatcctggacaaggggtctcttgccaggtttaagctctggtggccaggatttgagggcagctgcttagataggcaagtatagagctgcttggtcccagagctgccaaagtggaaagatgtgagtgggaacagcctggggattagcaagcaacctgctcaagcatgatggaatttatataatctcttaatgggcagccataatcttttaaatttggccacagctgtagaggtaagttgatagtcactaatggccaaaagctgcatcttaatttgagtgttgtgtaactgttgggggtgtgaatacattccctagctggggtgtcacctggactcgcagctggccccgtgtaggtgatcccagtggttgttacacacttggttccattgtgaagactctagtcccggcgtctgggtttttattagaattggagcctgagcttag

SEQ ID NO: 446623 - DNA, 231 bp, Homo sapiens
ctgtgatcacaccactccacttcagcctggttgacatagtgagaccctgtctcaaaaaacaaatgatgaatgggaattgttgacatcacagcaggaggaagaaaagaacaggtagaatggattaccagggaaaagaaagaagatgttcagggcacaagcaagagcagtgacataaaggaagggaaaggaaatagagttatagaaagaaggaagaatagagaaaggagaaaa

SEQ ID NO: 446624 - DNA, 6983 bp, Homo sapiens
  misc_feature (1395)..(1395): n is a, c, g, or t
cattcatcttctcctgcccttggacatcacagctccaggaactcagatcttcagactcagggtgaaggacaccaccagctttccaggttccccagcttgcagacggcatacgctaggtcttgactccactaacggggacttctcatacggctttgaacttggaccttggtgcataagcaaatgtaactcagcgaattgtaatggaaagcatatggacaggtctacgccacatcacttaggtgctaagagatgccgtttgcaggcctcatctctgcttgagaatcgggggctccaggcactagaagagccggctgatcctgggctcctagcttgaataagccttcacttccagctgctctccccaacggctgtgtaaactactcgtttctcttaatgatgggtattggtaagaataccacatccaaatcaatggaggctggaagttcaacagaaggcaaatacgaagacgaggcaaagcacccagctttcttcactcttccggtggtgataaatggaggcgccacctccagcggtgagcaggacaatgaggacactgagctcatggcgatctacactacggaaaacggcattgcagaaaagagctctctcgctgagaccctggatagcactggcagtctggacccccagcgatcagacatgatttataccatagaagatgttcctccctggtacctgtgtatatttctggggctacagcactacctgacatgcttcagcggcacgatcgcagtgcccttcctgttggccgatgccatgtgtgtggggtacgaccagtgggccaccagccagctcattgggaccattttcttctgtgtgggaatcactactttgctacagacaacgtttggatgcaggttacccctgtttcaggccagtgcttttgcatttttggcccctgctcgagccatcctgtctttagataaatggaaatgtaacaccacagatgtttcagttgccaatggaacagcagagctgttgcacacagaacacatctggtatccccggatccgagagatccagggggccatcatcatgtcctcactgatagaagtagtcatcggcctcctcggcctgcctggggctctactgaagtacatcggtcccttgaccattacacccacggtggccctaattggcctctctggtttccaggcagcgggggagagagccgggaagcactggggcattgccatgctgacaatattcctagtattactgttttctcaatacgccagaaatgttaaatttcctctcccgatttataaatccaagaaaggatggactgcgtacaagttacagctgttcaaaatgttccctatcatcctggccatcctggtatcctggctgctctgcttcatcttcacggtgacagangtcttccctcccgacagcacaaagtatggcttctatgctcgcacagatgccaggcaaggcgtgcttctggtagccccgtggtttaaggttccatacccatttcagtggggactgcccaccgtgtctgcggccggtgtcatcggcatgctcagtgccgtggtcgccagcatcatcgagtctattggtgactactacgcctgtgcacggctgtcctgtgccccacccccccccatccacgcaataaacaggggaattttcgtggaaggcctctcctgtgttcttgatggcatatttggtactgggaatggctctacttcatccagtcccaacattggagttttgggaattacaaaggtcggcagccgccgcgtgatacagtgcggagcagccctcatgctcgctctgggcatgatcgggaagttcagcgccctctttgcgtcccttccggatcctgtgctgggagccctgttctgcacgctctttggaatgatcacagctgttggcctctctaacctgcagttcattgatttaaattcttcccggaacctctttgtgcttggattttcgatcttctttgggctcgtccttccaagttacctcagacagaaccctctggtcacagggataacaggaatcgatcaagtgttgaacgtccttctcacaactgctatgtttgtagggggctgtgtggcttttatcctggataacaccatcccaggcactccagaggaaagaggaatccggaaatggaagaagggtgtgggcaaagggaacaaatcactcgacggcatggagtcgtacaatttgccatttggcatgaacattataaaaaaatacagatgcttcagctacttacccatcagcccaacctttgtgggctacacatggaaaggcctcaggaagagcgacaacagccggagttcagatgaagactcccaggccacgggatagcctttgctgtgccctgtggcctggccgcagtgaggcatgtatctgtagttccttgctgagtaacaagaagtaaaatacatgtttgtatatctacatttacattctgcgccccagagctaagacagactgcgaatcacttttctgctgtgagggtgatggtgcctgatgcggtgtctcgcctatctccttatttaagcccttaactccttgccctttgagagtgtccattgctggccatggtcactaaatttgaagttccagtcctccctttggagtggacatttaaaatctgcagccattccttgcttcagttcccttccaccacccagggctggctttcctataagccacctccagggtccaggggctttctctctctctccgaagcccctggacctgtttccttgtcatttgaccctcgtctgtgcccgcggagacctcctctgaccaaggggcactagtatgccttgcgctatcatgactgactggcccagtatgattctgttgtcgctgatctcccggaggaggaggctgttgacctgaaaacagtggcgtggctcccctgtgcccagatctggccatgggtgaggcctgcacagatgttgaatgaacatctgtttggggcattggagggaaaaggaaaggaccctgaagccaatatctgattctcggctgcaccttctcttggccaccctggccctgaccgggccagcacgtgcacactggcctcttttcatttcactagtggccgagacaccctctctggcatttatcactgttggccggtgtgatgagtatagagtgccacccaaggcaccagtcacacaagctgatgggcgtcttggctctgccgtcatgtggatgttattgtcgcgcgcgtctataattacaaggttttattcctatttaatgttattgactatagcagattttggaaatcagtgttttccatgtgaccctctttccttgcatccctattccttgtcccccacccactcttccccccatcaagaaaagaaccagcatttgtaaagctgtggacaccatcagggaagcttgttgtaacggcttttgaaggccagtaaccattgttgtggttgtgttttgtattgcttgataccatgaaagtgtaaatactgtaatgcctaatctatttatcaaaactgactactggaccggagcccagaaaccatgggtcaagttacacgtgaatttgttttgtgaagaagggaagctggggcaggtaacacgcagagccgccacgtggaacggtctgtccgccggtctgtcccgcttgccgggcttctgttgcaagtcttggcttaaggagacttcctgtgggttgccatgtcgcacgtccgttagatcttgattttacaggtgagggtggttgccaaaggtgataagaaaagcagccaacaggctccctctcacttaagagagttctaattaataacactaaattcttcctgagaaatgactcctcttggtttggtttgaagtttttcagtgaaggaaaaggcctgagataggaagcagtgccctcgcttcatgaggtggcacatcttcggtggccgttggcctggtcgagctttggtcagctgcgtgggtgcctgtctcctgtctccagcggcagggcatggttcttggcagcctggtgtccacacggtgcattcctgtccccctcggccccaggctggctcagctctccagtgctgcggcgctgtctttgcagcattgccatgtcaccgtagcccccttcactcttggaagtttggggcttcaaggtttattctggcaagaacacctcggagccactgcattgttttgccaaaaacttactgcagattaagtaaagaacttagatgctaaattacatctaattttgtatgtttttttaaatgtgtctttgatgcatactttagaagcacactggctcgcggtttccatccctcttgccttgggacactcttgaggctggcagccctcctgcaatgagttgctctcagttccttctgtttggattttgctcaacatctccagtttctctgctctgaaaaatggggaaaactgctaaacatcccagagatttgcaatcttctagctctccaggtgagcagaaagaccaaatatccaaataaaagcctgaaagccattggtgatccaggggcaccttctcttcagcttgactgggcgtcttccgctgcataacactcaaggtgtctgctctagtcatccagaaacccactcccttctgaagcccctccttgggccgggttgtatcaggaggattcaaccccgctaacatgtggggtgccctctgtaggccttcacacagggaaggaagccctaccctttcaactcctgttggagtgagagtttcctgttctgattccactgtggccaacccaataattctgtccgaggaggggtaagggaataggaggtggggagcaaagagggcagcctgactagatgcccctgctgaatctggtactttctgcacagccttgagtgattggagtcccctaatgactaataaacttgaacatgtaacacacacacacacacacacacacaccattttaggaagtggttctcctactggaaaatatgctacagaatgaaagtttgtaattgaaagaaaaagaatgtattcatctgcttcttgggtttaagcacacacctgaaggggagatattgggggacacggtggccactcgcggtctgtgtcatgacacttcccattcacatcattggcctgcgttgctggggctttgaaccaccaccccgtactttgttttgcctgtagagtgttgtaaaatattttggatgtgaatgtccttgcaggccggttagtctccagtttccacagagaccacctacccaccaccttcccaggtcacctgcctggtccctgaaagaaagcatttgtgtgggcaatcccaacatgaaatgtagacagcgtgaatacggacaggaggtgatgccatattcacagtgggggatggagggcccccacccctgcttcacagaataatgggaagtgactctagtctttgtaagcaattttcattctcattaggaagttaaatgtagattcacagatacatttactttcagaatcctcaagaggatttcaaatgctaacttttagtttcttgggattgatcaaggcaagagaagtggctttaaccatgccagccagaatgaagcatcatgggtcctgatggtttcccgttttcatggtaacaaattcgcacagaggttttgctttatactgtagaataccgactttcatgatgacaacttggtttatgcatgaatattgcagtatttccatatagcaaaataacatttctacccaggataatagtcacagttttccagggagggaatgatataattttcatgacaatgtcatgtgatgatagaatttctccattgatgaatctctagtatgtgtgtatactttatttacccatacgtatattttatgaccatgagctaagttgttatttctttcattcatatccctgctgaaatattggtactagcaacttaaagttggcaagtctcatcttcagtaatacggatgccatgggagtggccaggccagattgaaggtgaatatggagcagtagcagaagcctcattccagaacccatctggccagagaagcagcagcatcctgggggatggccgtgcatggggtgtacactcgctataggcataggcccggcatggctgtcgctggacgccagctgtgcacacccagccacacctgctgcacgccgcgttagtgtgcggctccgggcctgagcattcgcaaagctcgcttctccagggagcctcctcttggctttggaaaagagcccagggacttaacgtgctgcctgttgtactctgtcccctcatgactttttagacacagggactaggacatcgaccaccctctgcccctcctgcagtcagaacccgagtagtgcaagaacggccacccggttttgccagcgttcagcgtctgcccatggacccataaggcacattagcgttgggggtctcttttcagcagcctcacagacattcccgtcctttctggttggtgttgactgtgtttcagcatcactctaccctcccatgtccttagcattgctgtgcgtgtttccaggcacttaggacacccttccccacgttgccatcttactgacagttcaaatgactctccttttttgttcgttagtaacaatcttcatttgacaccttaatacatttctgactgttcttaaaacagtggggatgcctatattttccttgagtttttgtgactgactttggctatatatacctttctggggttttgtttgttttttatttttattttgattaccgagggtatttggggtggggttgttttttgagatgtgtaattcttttatggagtttttaaaaagaattttcatattgtttttctaacatggcttcattaaacgtttaagtattttaaaaatatgtaatatttggaccagatgttgtgaataatagtagagataaagctattttattctgtatttttaaaactgttccgtacaaataaaagctctcctggacacagttttgctcttcacgtgcctcct

SEQ ID NO: 446625 - DNA, 6929 bp, Homo sapiens
  misc_feature (1395)..(1395): n is a, c, g, or t
cattcatcttctcctgcccttggacatcacagctccaggaactcagatcttcagactcagggtgaaggacaccaccagctttccaggttccccagcttgcagacggcatacgctaggtcttgactccactaacggggacttctcatacggctttgaacttggaccttggtgcataagcaaatgtaactcagcgaattgtaatggaaagcatatggacaggtctacgccacatcacttaggtgctaagagatgccgtttgcaggcctcatctctgcttgagaatcgggggctccaggcactagaagagccggctgatcctgggctcctagcttgaataagccttcacttccagctgctctccccaacggctgtgtaaactactcgtttctcttaatgatgggtattggtaagaataccacatccaaatcaatggaggctggaagttcaacagaaggcaaatacgaagacgaggcaaagcacccagctttcttcactcttccggtggtgataaatggaggcgccacctccagcggtgagcaggacaatgaggacactgagctcatggcgatctacactacggaaaacggcattgcagaaaagagctctctcgctgagaccctggatagcactggcagtctggacccccagcgatcagacatgatttataccatagaagatgttcctccctggtacctgtgtatatttctggggctacagcactacctgacatgcttcagcggcacgatcgcagtgcccttcctgttggccgatgccatgtgtgtggggtacgaccagtgggccaccagccagctcattgggaccattttcttctgtgtgggaatcactactttgctacagacaacgtttggatgcaggttacccctgtttcaggccagtgcttttgcatttttggcccctgctcgagccatcctgtctttagataaatggaaatgtaacaccacagatgtttcagttgccaatggaacagcagagctgttgcacacagaacacatctggtatccccggatccgagagatccagggggccatcatcatgtcctcactgatagaagtagtcatcggcctcctcggcctgcctggggctctactgaagtacatcggtcccttgaccattacacccacggtggccctaattggcctctctggtttccaggcagcgggggagagagccgggaagcactggggcattgccatgctgacaatattcctagtattactgttttctcaatacgccagaaatgttaaatttcctctcccgatttataaatccaagaaaggatggactgcgtacaagttacagctgttcaaaatgttccctatcatcctggccatcctggtatcctggctgctctgcttcatcttcacggtgacagangtcttccctcccgacagcacaaagtatggcttctatgctcgcacagatgccaggcaaggcgtgcttctggtagccccgtggtttaaggttccatacccatttcagtggggactgcccaccgtgtctgcggccggtgtcatcggcatgctcagtgccgtggtcgccagcatcatcgagtctattggtgactactacgcctgtgcacggctgtcctgtgccccacccccccccatccacgcaataaacaggggaattttcgtggaaggcctctcctgtgttcttgatggcatatttggtactgggaatggctctacttcatccagtcccaacattggagttttgggaattacaaaggtcggcagccgccgcgtgatacagtgcggagcagccctcatgctcgctctgggcatgatcgggaagttcagcgccctctttgcgtcccttccggatcctgtgctgggagccctgttctgcacgctctttggaatgatcacagctgttggcctctctaacctgcagttcattgatttaaattcttcccggaacctctttgtgcttggattttcgatcttctttgggctcgtccttccaagttacctcagacagaaccctctggtcacagggataacaggaatcgatcaagtgttgaacgtccttctcacaactgctatgtttgtagggggctgtgtggcttttatcctggataacaccatcccaggcactccagaggaaagaggaatccggaaatggaagaagggtgtgggcaaagggaacaaatcactcgacggcatggagtcgtacaatttgccatttggcatgaacattataaaaaaatacagatgcttcagctacttacccatcagcccaacctttgtgggctacacatggaaaggcctcaggaagagcgacaacagccggagttcagatgaagactcccaggccacgggatagcctttgctgtgccctgtggcctggccgcagtgaggcatgtatctgtagttccttgctgagtaacaagaagtaaaatacatgtttgtatatctacatttacattctgcgccccagagctaagacagactgcgaatcacttttctgctgtgagggtgatggtgcctgatgcggtgtctcgcctatctccttatttaagcccttaactccttgccctttgagagtgtccattgctggccatggtcactaaatttgaagttccagtcctccctttggagtggacatttaaaatctgcagccattccttgcttcagttcccttccaccacccagggctggctttcctataagccacctccagggtccaggggctttctctctctctccgaagcccctggacctgtttccttgtcatttgaccctcgtctgtgcccgcggagacctcctctgaccaaggggcactagtatgccttgcgctatcatgactgactggcccagtatgattctgttgtcgctgatctcccggaggaggaggctgttgacctgaaaacagtggcgtggctcccctgtgcccagatctggccatgggtgaggcctgcacagatgttgaatgaacatctgtttggggcattggagggccaccctggccctgaccgggccagcacgtgcacactggcctcttttcatttcactagtggccgagacaccctctctggcatttatcactgttggccggtgtgatgagtatagagtgccacccaaggcaccagtcacacaagctgatgggcgtcttggctctgccgtcatgtggatgttattgtcgcgcgcgtctataattacaaggttttattcctatttaatgttattgactatagcagattttggaaatcagtgttttccatgtgaccctctttccttgcatccctattccttgtcccccacccactcttccccccatcaagaaaagaaccagcatttgtaaagctgtggacaccatcagggaagcttgttgtaacggcttttgaaggccagtaaccattgttgtggttgtgttttgtattgcttgataccatgaaagtgtaaatactgtaatgcctaatctatttatcaaaactgactactggaccggagcccagaaaccatgggtcaagttacacgtgaatttgttttgtgaagaagggaagctggggcaggtaacacgcagagccgccacgtggaacggtctgtccgccggtctgtcccgcttgccgggcttctgttgcaagtcttggcttaaggagacttcctgtgggttgccatgtcgcacgtccgttagatcttgattttacaggtgagggtggttgccaaaggtgataagaaaagcagccaacaggctccctctcacttaagagagttctaattaataacactaaattcttcctgagaaatgactcctcttggtttggtttgaagtttttcagtgaaggaaaaggcctgagataggaagcagtgccctcgcttcatgaggtggcacatcttcggtggccgttggcctggtcgagctttggtcagctgcgtgggtgcctgtctcctgtctccagcggcagggcatggttcttggcagcctggtgtccacacggtgcattcctgtccccctcggccccaggctggctcagctctccagtgctgcggcgctgtctttgcagcattgccatgtcaccgtagcccccttcactcttggaagtttggggcttcaaggtttattctggcaagaacacctcggagccactgcattgttttgccaaaaacttactgcagattaagtaaagaacttagatgctaaattacatctaattttgtatgtttttttaaatgtgtctttgatgcatactttagaagcacactggctcgcggtttccatccctcttgccttgggacactcttgaggctggcagccctcctgcaatgagttgctctcagttccttctgtttggattttgctcaacatctccagtttctctgctctgaaaaatggggaaaactgctaaacatcccagagatttgcaatcttctagctctccaggtgagcagaaagaccaaatatccaaataaaagcctgaaagccattggtgatccaggggcaccttctcttcagcttgactgggcgtcttccgctgcataacactcaaggtgtctgctctagtcatccagaaacccactcccttctgaagcccctccttgggccgggttgtatcaggaggattcaaccccgctaacatgtggggtgccctctgtaggccttcacacagggaaggaagccctaccctttcaactcctgttggagtgagagtttcctgttctgattccactgtggccaacccaataattctgtccgaggaggggtaagggaataggaggtggggagcaaagagggcagcctgactagatgcccctgctgaatctggtactttctgcacagccttgagtgattggagtcccctaatgactaataaacttgaacatgtaacacacacacacacacacacacacaccattttaggaagtggttctcctactggaaaatatgctacagaatgaaagtttgtaattgaaagaaaaagaatgtattcatctgcttcttgggtttaagcacacacctgaaggggagatattgggggacacggtggccactcgcggtctgtgtcatgacacttcccattcacatcattggcctgcgttgctggggctttgaaccaccaccccgtactttgttttgcctgtagagtgttgtaaaatattttggatgtgaatgtccttgcaggccggttagtctccagtttccacagagaccacctacccaccaccttcccaggtcacctgcctggtccctgaaagaaagcatttgtgtgggcaatcccaacatgaaatgtagacagcgtgaatacggacaggaggtgatgccatattcacagtgggggatggagggcccccacccctgcttcacagaataatgggaagtgactctagtctttgtaagcaattttcattctcattaggaagttaaatgtagattcacagatacatttactttcagaatcctcaagaggatttcaaatgctaacttttagtttcttgggattgatcaaggcaagagaagtggctttaaccatgccagccagaatgaagcatcatgggtcctgatggtttcccgttttcatggtaacaaattcgcacagaggttttgctttatactgtagaataccgactttcatgatgacaacttggtttatgcatgaatattgcagtatttccatatagcaaaataacatttctacccaggataatagtcacagttttccagggagggaatgatataattttcatgacaatgtcatgtgatgatagaatttctccattgatgaatctctagtatgtgtgtatactttatttacccatacgtatattttatgaccatgagctaagttgttatttctttcattcatatccctgctgaaatattggtactagcaacttaaagttggcaagtctcatcttcagtaatacggatgccatgggagtggccaggccagattgaaggtgaatatggagcagtagcagaagcctcattccagaacccatctggccagagaagcagcagcatcctgggggatggccgtgcatggggtgtacactcgctataggcataggcccggcatggctgtcgctggacgccagctgtgcacacccagccacacctgctgcacgccgcgttagtgtgcggctccgggcctgagcattcgcaaagctcgcttctccagggagcctcctcttggctttggaaaagagcccagggacttaacgtgctgcctgttgtactctgtcccctcatgactttttagacacagggactaggacatcgaccaccctctgcccctcctgcagtcagaacccgagtagtgcaagaacggccacccggttttgccagcgttcagcgtctgcccatggacccataaggcacattagcgttgggggtctcttttcagcagcctcacagacattcccgtcctttctggttggtgttgactgtgtttcagcatcactctaccctcccatgtccttagcattgctgtgcgtgtttccaggcacttaggacacccttccccacgttgccatcttactgacagttcaaatgactctccttttttgttcgttagtaacaatcttcatttgacaccttaatacatttctgactgttcttaaaacagtggggatgcctatattttccttgagtttttgtgactgactttggctatatatacctttctggggttttgtttgttttttatttttattttgattaccgagggtatttggggtggggttgttttttgagatgtgtaattcttttatggagtttttaaaaagaattttcatattgtttttctaacatggcttcattaaacgtttaagtattttaaaaatatgtaatatttggaccagatgttgtgaataatagtagagataaagctattttattctgtatttttaaaactgttccgtacaaataaaagctctcctggacacagttttgctcttcacgtgcctcct

SEQ ID NO: 446626 - DNA, 6929 bp, Homo sapiens
  misc_feature (1395)..(1395): n is a, c, g, or t
cattcatcttctcctgcccttggacatcacagctccaggaactcagatcttcagactcagggtgaaggacaccaccagctttccaggttccccagcttgcagacggcatacgctaggtcttgactccactaacggggacttctcatacggctttgaacttggaccttggtgcataagcaaatgtaactcagcgaattgtaatggaaagcatatggacaggtctacgccacatcacttaggtgctaagagatgccgtttgcaggcctcatctctgcttgagaatcgggggctccaggcactagaagagccggctgatcctgggctcctagcttgaataagccttcacttccagctgctctccccaacggctgtgtaaactactcgtttctcttaatgatgggtattggtaagaataccacatccaaatcaatggaggctggaagttcaacagaaggcaaatacgaagacgaggcaaagcacccagctttcttcactcttccggtggtgataaatggaggcgccacctccagcggtgagcaggacaatgaggacactgagctcatggcgatctacactacggaaaacggcattgcagaaaagagctctctcgctgagaccctggatagcactggcagtctggacccccagcgatcagacatgatttataccatagaagatgttcctccctggtacctgtgtatatttctggggctacagcactacctgacatgcttcagcggcacgatcgcagtgcccttcctgttggccgatgccatgtgtgtggggtacgaccagtgggccaccagccagctcattgggaccattttcttctgtgtgggaatcactactttgctacagacaacgtttggatgcaggttacccctgtttcaggccagtgcttttgcatttttggcccctgctcgagccatcctgtctttagataaatggaaatgtaacaccacagatgtttcagttgccaatggaacagcagagctgttgcacacagaacacatctggtatccccggatccgagagatccagggggccatcatcatgtcctcactgatagaagtagtcatcggcctcctcggcctgcctggggctctactgaagtacatcggtcccttgaccattacacccacggtggccctaattggcctctctggtttccaggcagcgggggagagagccgggaagcactggggcattgccatgctgacaatattcctagtattactgttttctcaatacgccagaaatgttaaatttcctctcccgatttataaatccaagaaaggatggactgcgtacaagttacagctgttcaaaatgttccctatcatcctggccatcctggtatcctggctgctctgcttcatcttcacggtgacagangtcttccctcccgacagcacaaagtatggcttctatgctcgcacagatgccaggcaaggcgtgcttctggtagccccgtggtttaaggttccatacccatttcagtggggactgcccaccgtgtctgcggccggtgtcatcggcatgctcagtgccgtggtcgccagcatcatcgagtctattggtgactactacgcctgtgcacggctgtcctgtgccccacccccccccatccacgcaataaacaggggaattttcgtggaaggcctctcctgtgttcttgatggcatatttggtactgggaatggctctacttcatccagtcccaacattggagttttgggaattacaaaggtcggcagccgccgcgtgatacagtgcggagcagccctcatgctcgctctgggcatgatcgggaagttcagcgccctctttgcgtcccttccggatcctgtgctgggagccctgttctgcacgctctttggaatgatcacagctgttggcctctctaacctgcagttcattgatttaaattcttcccggaacctctttgtgcttggattttcgatcttctttgggctcgtccttccaagttacctcagacagaaccctctggtcacagggataacaggaatcgatcaagtgttgaacgtccttctcacaactgctatgtttgtagggggctgtgtggcttttatcctggataacaccatcccaggcactccagaggaaagaggaatccggaaatggaagaagggtgtgggcaaagggaacaaatcactcgacggcatggagtcgtacaatttgccatttggcatgaacattataaaaaaatacagatgcttcagctacttacccatcagcccaacctttgtgggctacacatggaaaggcctcaggaagagcgacaacagccggagttcagatgaagactcccaggccacgggatagcctttgctgtgccctgtggcctggccgcagtgaggcatgtatctgtagttccttgctgagtaacaagaagtaaaatacatgtttgtatatctacatttacattctgcgccccagagctaagacagactgcgaatcacttttctgctgtgagggtgatggtgcctgatgcggtgtctcgcctatctccttatttaagcccttaactccttgccctttgagagtgtccattgctggccatggtcactaaatttgaagttccagtcctccctttggagtggacatttaaaatctgcagccattccttgcttcagttcccttccaccacccagggctggctttcctataagccacctccagggtccaggggctttctctctctctccgaagcccctggacctgtttccttgtcatttgaccctcgtctgtgcccgcggagacctcctctgaccaaggggcactagtatgccttgcgctatcatgactgactggcccagtatgattctgttgtcgctgatctcccggaggaggaggctgttgacctgaaaacagtggcgtggctcccctgtgcccagatctggccatgggtgaggcctgcacagatgttgaatgaacatctgtttggggcattggagggaaaaggaaaggaccctgaagccaatatctgattctcggctgcaccttctcttggccaccctggccctgaccgggccagcacgtgcacactggcctcttttcatttcactagtggccgagacaccctctctggcatttatcactgttggccggtgtgatgagtatagagtgccacccaaggcaccagtcacacaagctgatgggcgtcttggctctgccgtcatgtggatgttattgtcgcgcgcgtctataattacaaggttttattcctatttaatgttattgactatagcagattttggaaatcagtgttttccatgtgaccctctttccttgcatccctattccttgtcccccacccactcttccccccatcaagaaaagaaccagcatttgtaaagctgtggacaccatcagggaagcttgttgtaacggcttttgaaggccagtaaccattgttgtggttgtgttttgtattgcttgataccatgaaagtgtaaatactgtaatgcctaatctatttatcttgttttgtgaagaagggaagctggggcaggtaacacgcagagccgccacgtggaacggtctgtccgccggtctgtcccgcttgccgggcttctgttgcaagtcttggcttaaggagacttcctgtgggttgccatgtcgcacgtccgttagatcttgattttacaggtgagggtggttgccaaaggtgataagaaaagcagccaacaggctccctctcacttaagagagttctaattaataacactaaattcttcctgagaaatgactcctcttggtttggtttgaagtttttcagtgaaggaaaaggcctgagataggaagcagtgccctcgcttcatgaggtggcacatcttcggtggccgttggcctggtcgagctttggtcagctgcgtgggtgcctgtctcctgtctccagcggcagggcatggttcttggcagcctggtgtccacacggtgcattcctgtccccctcggccccaggctggctcagctctccagtgctgcggcgctgtctttgcagcattgccatgtcaccgtagcccccttcactcttggaagtttggggcttcaaggtttattctggcaagaacacctcggagccactgcattgttttgccaaaaacttactgcagattaagtaaagaacttagatgctaaattacatctaattttgtatgtttttttaaatgtgtctttgatgcatactttagaagcacactggctcgcggtttccatccctcttgccttgggacactcttgaggctggcagccctcctgcaatgagttgctctcagttccttctgtttggattttgctcaacatctccagtttctctgctctgaaaaatggggaaaactgctaaacatcccagagatttgcaatcttctagctctccaggtgagcagaaagaccaaatatccaaataaaagcctgaaagccattggtgatccaggggcaccttctcttcagcttgactgggcgtcttccgctgcataacactcaaggtgtctgctctagtcatccagaaacccactcccttctgaagcccctccttgggccgggttgtatcaggaggattcaaccccgctaacatgtggggtgccctctgtaggccttcacacagggaaggaagccctaccctttcaactcctgttggagtgagagtttcctgttctgattccactgtggccaacccaataattctgtccgaggaggggtaagggaataggaggtggggagcaaagagggcagcctgactagatgcccctgctgaatctggtactttctgcacagccttgagtgattggagtcccctaatgactaataaacttgaacatgtaacacacacacacacacacacacacaccattttaggaagtggttctcctactggaaaatatgctacagaatgaaagtttgtaattgaaagaaaaagaatgtattcatctgcttcttgggtttaagcacacacctgaaggggagatattgggggacacggtggccactcgcggtctgtgtcatgacacttcccattcacatcattggcctgcgttgctggggctttgaaccaccaccccgtactttgttttgcctgtagagtgttgtaaaatattttggatgtgaatgtccttgcaggccggttagtctccagtttccacagagaccacctacccaccaccttcccaggtcacctgcctggtccctgaaagaaagcatttgtgtgggcaatcccaacatgaaatgtagacagcgtgaatacggacaggaggtgatgccatattcacagtgggggatggagggcccccacccctgcttcacagaataatgggaagtgactctagtctttgtaagcaattttcattctcattaggaagttaaatgtagattcacagatacatttactttcagaatcctcaagaggatttcaaatgctaacttttagtttcttgggattgatcaaggcaagagaagtggctttaaccatgccagccagaatgaagcatcatgggtcctgatggtttcccgttttcatggtaacaaattcgcacagaggttttgctttatactgtagaataccgactttcatgatgacaacttggtttatgcatgaatattgcagtatttccatatagcaaaataacatttctacccaggataatagtcacagttttccagggagggaatgatataattttcatgacaatgtcatgtgatgatagaatttctccattgatgaatctctagtatgtgtgtatactttatttacccatacgtatattttatgaccatgagctaagttgttatttctttcattcatatccctgctgaaatattggtactagcaacttaaagttggcaagtctcatcttcagtaatacggatgccatgggagtggccaggccagattgaaggtgaatatggagcagtagcagaagcctcattccagaacccatctggccagagaagcagcagcatcctgggggatggccgtgcatggggtgtacactcgctataggcataggcccggcatggctgtcgctggacgccagctgtgcacacccagccacacctgctgcacgccgcgttagtgtgcggctccgggcctgagcattcgcaaagctcgcttctccagggagcctcctcttggctttggaaaagagcccagggacttaacgtgctgcctgttgtactctgtcccctcatgactttttagacacagggactaggacatcgaccaccctctgcccctcctgcagtcagaacccgagtagtgcaagaacggccacccggttttgccagcgttcagcgtctgcccatggacccataaggcacattagcgttgggggtctcttttcagcagcctcacagacattcccgtcctttctggttggtgttgactgtgtttcagcatcactctaccctcccatgtccttagcattgctgtgcgtgtttccaggcacttaggacacccttccccacgttgccatcttactgacagttcaaatgactctccttttttgttcgttagtaacaatcttcatttgacaccttaatacatttctgactgttcttaaaacagtggggatgcctatattttccttgagtttttgtgactgactttggctatatatacctttctggggttttgtttgttttttatttttattttgattaccgagggtatttggggtggggttgttttttgagatgtgtaattcttttatggagtttttaaaaagaattttcatattgtttttctaacatggcttcattaaacgtttaagtattttaaaaatatgtaatatttggaccagatgttgtgaataatagtagagataaagctattttattctgtatttttaaaactgttccgtacaaataaaagctctcctggacacagttttgctcttcacgtgcctcct

SEQ ID NO: 446627 - DNA, 6930 bp, Homo sapiens
  misc_feature (1395)..(1395): n is a, c, g, or t
cattcatcttctcctgcccttggacatcacagctccaggaactcagatcttcagactcagggtgaaggacaccaccagctttccaggttccccagcttgcagacggcatacgctaggtcttgactccactaacggggacttctcatacggctttgaacttggaccttggtgcataagcaaatgtaactcagcgaattgtaatggaaagcatatggacaggtctacgccacatcacttaggtgctaagagatgccgtttgcaggcctcatctctgcttgagaatcgggggctccaggcactagaagagccggctgatcctgggctcctagcttgaataagccttcacttccagctgctctccccaacggctgtgtaaactactcgtttctcttaatgatgggtattggtaagaataccacatccaaatcaatggaggctggaagttcaacagaaggcaaatacgaagacgaggcaaagcacccagctttcttcactcttccggtggtgataaatggaggcgccacctccagcggtgagcaggacaatgaggacactgagctcatggcgatctacactacggaaaacggcattgcagaaaagagctctctcgctgagaccctggatagcactggcagtctggacccccagcgatcagacatgatttataccatagaagatgttcctccctggtacctgtgtatatttctggggctacagcactacctgacatgcttcagcggcacgatcgcagtgcccttcctgttggccgatgccatgtgtgtggggtacgaccagtgggccaccagccagctcattgggaccattttcttctgtgtgggaatcactactttgctacagacaacgtttggatgcaggttacccctgtttcaggccagtgcttttgcatttttggcccctgctcgagccatcctgtctttagataaatggaaatgtaacaccacagatgtttcagttgccaatggaacagcagagctgttgcacacagaacacatctggtatccccggatccgagagatccagggggccatcatcatgtcctcactgatagaagtagtcatcggcctcctcggcctgcctggggctctactgaagtacatcggtcccttgaccattacacccacggtggccctaattggcctctctggtttccaggcagcgggggagagagccgggaagcactggggcattgccatgctgacaatattcctagtattactgttttctcaatacgccagaaatgttaaatttcctctcccgatttataaatccaagaaaggatggactgcgtacaagttacagctgttcaaaatgttccctatcatcctggccatcctggtatcctggctgctctgcttcatcttcacggtgacagangtcttccctcccgacagcacaaagtatggcttctatgctcgcacagatgccaggcaaggcgtgcttctggtagccccgtggtttaaggttccatacccatttcagtggggactgcccaccgtgtctgcggccggtgtcatcggcatgctcagtgccgtggtcgccagcatcatcgagtctattggtgactactacgcctgtgcacggctgtcctgtgccccacccccccccatccacgcaataaacaggggaattttcgtggaaggcctctcctgtgttcttgatggcatatttggtactgggaatggctctacttcatccagtcccaacattggagttttgggaattacaaaggtcggcagccgccgcgtgatacagtgcggagcagccctcatgctcgctctgggcatgatcgggaagttcagcgccctctttgcgtcccttccggatcctgtgctgggagccctgttctgcacgctctttggaatgatcacagctgttggcctctctaacctgcagttcattgatttaaattcttcccggaacctctttgtgcttggattttcgatcttctttgggctcgtccttccaagttacctcagacagaaccctctggtcacagggataacaggaatcgatcaagtgttgaacgtccttctcacaactgctatgtttgtagggggctgtgtggcttttatcctggataacaccatcccaggcactccagaggaaagaggaatccggaaatggaagaagggtgtgggcaaagggaacaaatcactcgacggcatggagtcgtacaatttgccatttggcatgaacattataaaaaaatacagatgcttcagctacttacccatcagcccaacctttgtgggctacacatggaaaggcctcaggaagagcgacaacagccggagttcagatgaagactcccaggccacgggatagcctttgctgtgccctgtggcctggccgcagtgaggcatgtatctgtagttccttgctgagtaacaagaagtaaaatacatgtttgtatatctacatttacattctgcgccccagagctaagacagactgcgaatcacttttctgctgtgagggtgatggtgcctgatgcggtgtctcgcctatctccttatttaagcccttaactccttgccctttgagagtgtccattgctggccatggtcactaaatttgaagttccagtcctccctttggagtggacatttaaaatctgcagccattccttgcttcagttcccttccaccacccagggctggctttcctataagccacctccagggtccaggggctttctctctctctccgaagcccctggacctgtttccttgtcatttgaccctcgtctgtgcccgcggagacctcctctgaccaaggggcactagtatgccttgcgctatcatgactgactggcccagtatgattctgttgtcgctgatctcccggaggaggaggctgttgacctgaaaacagtggcgtggctcccctgtgcccagatctggccatgggtgaggcctgcacagatgttgaatgaacatctgtttggggcattggagggaaaaggaaaggaccctgaagccaatatctgattctcggctgcaccttctcttggccaccctggccctgaccgggccagcacgtgcacactggcctcttttcatttcactagtggccgagacaccctctctggcatttatcactgttggccggtgtgatgagtatagagtgccacccaaggcaccagtcacacaagctgatgggcgtcttggctctgccgtcatgtggatgttattgtcgcgcgcgtctataattacaaggttttattcctatttaatgttattgactatagcagattttggaaatcagtgttttccatgtgaccctctttccttgcatccctattccttgtcccccacccactcttccccccatcaagaaaagaaccagcatttgtaaagctgtggacaccatcagggaagcttgttgtaacggcttttgaaggccagtaaccattgttgtggttgtgttttgtattgcttgataccatgaaagtgtaaatactgtaatgcctaatctatttatcaaaactgactactggaccggagcccagaaaccatgggtcaagttacacgtgaatttgttttgtgaagaagggaagctggggcaggtaacacgcagagccgccacgtggaacggtctgtccgccggtctgtcccgcttgccgggcttctgttgcaagtcttggcttaaggagacttcctgtgggttgccatgtcgcacgtccgttagatcttgattttacaggtgagggtggttgccaaaggtgataagaaaagcagccaacaggctccctctcacttaagagagttctaattaataacactaaattcttcctgagaaatgactcctcttggtttggtttgaagtttttcagtgaaggaaaaggcctgagataggaagcagtgccctcgcttcatgaggtggcacatcttcggtggccgttggcctggtcgagctttggtcagctgcgtgggtgcctgtctcctgtctccagcggcagggcatggttcttggcagcctggtgtccacacggtgcattcctgtccccctcggccccaggctggctcagctctccagtgctgcggcgctgtctttgcagcattgccatgtcaccgtagcccccttcactcttggaagtttggggcttcaaggtttattctggcaagaacacctcggagccactgcattgttttgccaaaaacttactgcagattaagtaaagaacttagatgctaaattacatctaattttgtatgtttttttaaatgtgtctttgatgcatactttagaagcacactggctcgcggtttccatccctcttgccttgggacactcttgaggctggcagccctcctgcaatgagttgctctcagttccttctgtttggattttgctcaacatctccagtttctctgctctgaaaaatggggaaaactgctaaacatcccagagatttgcaatcttctagctctccaggtgagcagaaagaccaaatatccaaataaaagcctgaaagccattggtgatccaggggcaccttctcttcagcttgactgggcgtcttccgctgcataacactcaaggtgtctgctctagtcatccagaaacccactcccttctgaagcccctccttgggccgggttgtatcaggaggattcaaccccgctaacatgtggggtgccctctgtaggccttcacacagggaaggaagccctaccctttcaactcctgttggagtgagagtttcctgttctgattccactgtggccaacccaataattctgtccgaggaggggtaagggaataggaggtggggagcaaagagggcagcctgactagatgcccctgctgaatctggtactttctgcacagccttgagtgattggagtcccctaatgactaataaacttgaacatgtaacacacacacacacacacacacacaccattttaggaagtggttctcctactggaaaatatgctacagaatgaaagtttgtaattgaaagaaaaagaatgtattcatctgcttcttgggtttaagcacacacctgaaggggagatattgggggacacggtggccactcgcggtctgtgtcatgacacttcccattcacatcattggcctgcgttgctggggctttgaaccaccaccccgtactttgttttgcctgtagagtgttgtaaaatattttggatgtgaatgtccttgcaggccggttagtctccagtttccacagagaccacctacccaccaccttcccaggtcacctgcctggtccctgaaagaaagcatttgtgtgggcaatcccaacatgaaatgtagacagcgtgaatacggacaggaggtgatgccatattcacagtgggggatggagggcccccacccctgcttcacagaataatgggaagtgactctagtctttgtaagcaattttcattctcattaggaagttaaatgtagattcacagatacatttactttcagaatcctcaagaggatttcaaatgctaacttttagtttcttgggattgatcaaggcaagagaagtggctttaaccatgccagccagaatgaagcatcatgggtcctgatggtttcccgttttcatggtaacaaattcgcacagaggttttgctttatactgtagaataccgactttcatgatgacaacttggtttatgcatgaatattgcagtatttccatatagcaaaataacatttctacccaggataatagtcacagttttccagggagggaatgatataattttcatgacaatgtcatgtgatgatagaatttctccattgatgaatctctagtatgtgtgtatactttatttacccatacgtatattttatgaccatgagctaagttgttatttctttcattcatatccctgctgaaatattggtactagcaacttaaagttggcaagtctcatcttcagtaatacggatgccatgggagtggccaggccagattgaaggtgaatatggagcagtagcagaagcctcattccagaacccatctggccagagaagcagcagcatcctgggggatggccgtgcatggggtgtacactcgctataggcataggcccggcatggctgtcgctggacgccagctgtgcacacccagccacacctgctgcacgccgcgttagtgtgcggctccgggcctgagcattcgcaaagctcgcttctccagggagcctcctcttggctttggtttttagacacagggactaggacatcgaccaccctctgcccctcctgcagtcagaacccgagtagtgcaagaacggccacccggttttgccagcgttcagcgtctgcccatggacccataaggcacattagcgttgggggtctcttttcagcagcctcacagacattcccgtcctttctggttggtgttgactgtgtttcagcatcactctaccctcccatgtccttagcattgctgtgcgtgtttccaggcacttaggacacccttccccacgttgccatcttactgacagttcaaatgactctccttttttgttcgttagtaacaatcttcatttgacaccttaatacatttctgactgttcttaaaacagtggggatgcctatattttccttgagtttttgtgactgactttggctatatatacctttctggggttttgtttgttttttatttttattttgattaccgagggtatttggggtggggttgttttttgagatgtgtaattcttttatggagtttttaaaaagaattttcatattgtttttctaacatggcttcattaaacgtttaagtattttaaaaatatgtaatatttggaccagatgttgtgaataatagtagagataaagctattttattctgtatttttaaaactgttccgtacaaataaaagctctcctggacacagttttgctcttcacgtgcctcct

SEQ ID NO: 446628 - DNA, 6928 bp, Homo sapiens
  misc_feature (1395)..(1395): n is a, c, g, or t
cattcatcttctcctgcccttggacatcacagctccaggaactcagatcttcagactcagggtgaaggacaccaccagctttccaggttccccagcttgcagacggcatacgctaggtcttgactccactaacggggacttctcatacggctttgaacttggaccttggtgcataagcaaatgtaactcagcgaattgtaatggaaagcatatggacaggtctacgccacatcacttaggtgctaagagatgccgtttgcaggcctcatctctgcttgagaatcgggggctccaggcactagaagagccggctgatcctgggctcctagcttgaataagccttcacttccagctgctctccccaacggctgtgtaaactactcgtttctcttaatgatgggtattggtaagaataccacatccaaatcaatggaggctggaagttcaacagaaggcaaatacgaagacgaggcaaagcacccagctttcttcactcttccggtggtgataaatggaggcgccacctccagcggtgagcaggacaatgaggacactgagctcatggcgatctacactacggaaaacggcattgcagaaaagagctctctcgctgagaccctggatagcactggcagtctggacccccagcgatcagacatgatttataccatagaagatgttcctccctggtacctgtgtatatttctggggctacagcactacctgacatgcttcagcggcacgatcgcagtgcccttcctgttggccgatgccatgtgtgtggggtacgaccagtgggccaccagccagctcattgggaccattttcttctgtgtgggaatcactactttgctacagacaacgtttggatgcaggttacccctgtttcaggccagtgcttttgcatttttggcccctgctcgagccatcctgtctttagataaatggaaatgtaacaccacagatgtttcagttgccaatggaacagcagagctgttgcacacagaacacatctggtatccccggatccgagagatccagggggccatcatcatgtcctcactgatagaagtagtcatcggcctcctcggcctgcctggggctctactgaagtacatcggtcccttgaccattacacccacggtggccctaattggcctctctggtttccaggcagcgggggagagagccgggaagcactggggcattgccatgctgacaatattcctagtattactgttttctcaatacgccagaaatgttaaatttcctctcccgatttataaatccaagaaaggatggactgcgtacaagttacagctgttcaaaatgttccctatcatcctggccatcctggtatcctggctgctctgcttcatcttcacggtgacagangtcttccctcccgacagcacaaagtatggcttctatgctcgcacagatgccaggcaaggcgtgcttctggtagccccgtggtttaaggttccatacccatttcagtggggactgcccaccgtgtctgcggccggtgtcatcggcatgctcagtgccgtggtcgccagcatcatcgagtctattggtgactactacgcctgtgcacggctgtcctgtgccccacccccccccatccacgcaataaacaggggaattttcgtggaaggcctctcctgtgttcttgatggcatatttggtactgggaatggctctacttcatccagtcccaacattggagttttgggaattacaaaggtcggcagccgccgcgtgatacagtgcggagcagccctcatgctcgctctgggcatgatcgggaagttcagcgccctctttgcgtcccttccggatcctgtgctgggagccctgttctgcacgctctttggaatgatcacagctgttggcctctctaacctgcagttcattgatttaaattcttcccggaacctctttgtgcttggattttcgatcttctttgggctcgtccttccaagttacctcagacagaaccctctggtcacagggataacaggaatcgatcaagtgttgaacgtccttctcacaactgctatgtttgtagggggctgtgtggcttttatcctggataacaccatcccaggcactccagaggaaagaggaatccggaaatggaagaagggtgtgggcaaagggaacaaatcactcgacggcatggagtcgtacaatttgccatttggcatgaacattataaaaaaatacagatgcttcagctacttacccatcagcccaacctttgtgggctacacatggaaaggcctcaggaagagcgacaacagccggagttcagatgaagactcccaggccacgggatagcctttgctgtgccctgtggcctggccgcagtgaggcatgtatctgtagttccttgctgagtaacaagaagtaaaatacatgtttgtatatctacatttacattctgcgccccagagctaagacagactgcgaatcacttttctgctgtgagggtgatggtgcctgatgcggtgtctcgcctatctccttatttaagcccttaactccttgccctttgagagtgtccattgctggccatggtcactaaatttgaagttccagtcctccctttggagtggacatttaaaatctgcagccattccttgcttcagttcccttccaccacccagggctggctttcctataagccacctccagggtccaggggctttctctctctctccgaagcccctggacctgtttccttgtcatttgaccctcgtctgtgcccgcggagacctcctctgaccaaggggcactagtatgccttgcgctatcatgactgactggcccagtatgattctgttgtcgctgatctcccggaggaggaggctgttgacctgaaaacagtggcgtggctcccctgtgcccagatctggccatgggtgaggcctgcacagatgttgaatgaacatctgtttggggcattggagggaaaaggaaaggaccctgaagccaatatctgattctcggctgcaccttctcttggccaccctggccctgaccgggccagcacgtgcacactggcctcttttcatttcactagtggccgagacaccctctctggcatttatcactgttggccggtgtgatgagtatagagtgccacccaaggcaccagtcacacaagctgatgggcgtcttggctctgccgtcatgtggatgttattgtcgcgcgcgtctataattacaaggttttattcctatttaatgttattgactatagcagattttggaaatcagtgttttccatgtgaccctctttccttgcatccctattccttgtcccccacccactcttccccccatcaagaaaagaaccagcatttgtaaagctgtggacaccatcagggaagcttgttgtaacggcttttgaaggccagtaaccattgttgtggttgtgttttgtattgcttgataccatgaaagtgtaaatactgtaatgcctaatctatttatcaaaactgactactggaccggagcccagaaaccatgggtcaagttacacgtgaatttgttttgtgaagaagggaagctggggcaggtaacacgcagagccgccacgtggaacggtctgtccgccggtctgtcccgcttgccgggcttctgttgcaagtcttggcttaaggagacttcctgtgggttgccatgtcgcacgtccgttagatcttgattttacaggtgagggtggttgccaaaggtgataagaaaagcagccaacaggctccctctcacttaagagagttctaattaataacactaaattcttcctgagaaatgactcctcttggtttggtttgaagtttttcagtgaaggaaaaggcctgagataggaagcagtgccctcgcttcatgaggtggcacatcttcggtggccgttggcctggtcgagctttggtcagctgcgtgggtgcctgtctcctgtctccagcggcagggcatggttcttggcagcctggtgtccacacggtgcattcctgtccccctcggccccaggctggctcagctctccagtgctgcggcgctgtctttgcagcattgccatgtcaccgtagcccccttcactcttggaagtttggggcttcaaggtttattctggcaagaacacctcggagccactgcattgttttgccaaaaacttactgcagattaagtaaagaacttagatgctaaattacatctaattttgtatgtttttttaaatgtgtctttgatgcatactttagaagcacactggctcgcggtttccatccctcttgccttgggacactcttgaggctggcagccctcctgcaatgagttgctctcagttccttctgtttggattttgctcaacatctccagtttctctgctctgaaaaatggggaaaactgctaaacatcccagagatttgcaatcttctagctctccaggtgagcagaaagaccaaatatccaaataaaagcctgaaagccattggtgatccaggggcaccttctcttcagcttgactgggcgtcttccgctgcataacactcaaggtgtctgctctagtcatccagaaacccactcccttctgaagcccctccttgggccgggttgtatcaggaggattcaaccccgctaacatgtggggtgccctctgtaggccttcacacagggaaggaagccctaccctttcaactcctgttggagtgagagtttcctgttctgattccactgtggccaacccaataattctgtccgaggaggggtaagggaataggaggtggggagcaaagagggcagcctgactagatgcccctgctgaatctggtactttctgcacagccttgagtgattggagtcccctaatgactaataaacttgaacatgtaacacacacacacacacacacacacaccattttaggaagtggttctcctactggaaaatatgctacagaatgaaagtttgtaattgaaagaaaaagaatgtattcatctgcttcttgggtttaagcacacacctgaaggggagatattgggggacacggtggccactcgcggtctgtgtcatgacacttcccattcacatcattggcctgcgttgctggggctttgaaccaccaccccgtactttgttttgcctgtagagtgttagagaccacctacccaccaccttcccaggtcacctgcctggtccctgaaagaaagcatttgtgtgggcaatcccaacatgaaatgtagacagcgtgaatacggacaggaggtgatgccatattcacagtgggggatggagggcccccacccctgcttcacagaataatgggaagtgactctagtctttgtaagcaattttcattctcattaggaagttaaatgtagattcacagatacatttactttcagaatcctcaagaggatttcaaatgctaacttttagtttcttgggattgatcaaggcaagagaagtggctttaaccatgccagccagaatgaagcatcatgggtcctgatggtttcccgttttcatggtaacaaattcgcacagaggttttgctttatactgtagaataccgactttcatgatgacaacttggtttatgcatgaatattgcagtatttccatatagcaaaataacatttctacccaggataatagtcacagttttccagggagggaatgatataattttcatgacaatgtcatgtgatgatagaatttctccattgatgaatctctagtatgtgtgtatactttatttacccatacgtatattttatgaccatgagctaagttgttatttctttcattcatatccctgctgaaatattggtactagcaacttaaagttggcaagtctcatcttcagtaatacggatgccatgggagtggccaggccagattgaaggtgaatatggagcagtagcagaagcctcattccagaacccatctggccagagaagcagcagcatcctgggggatggccgtgcatggggtgtacactcgctataggcataggcccggcatggctgtcgctggacgccagctgtgcacacccagccacacctgctgcacgccgcgttagtgtgcggctccgggcctgagcattcgcaaagctcgcttctccagggagcctcctcttggctttggaaaagagcccagggacttaacgtgctgcctgttgtactctgtcccctcatgactttttagacacagggactaggacatcgaccaccctctgcccctcctgcagtcagaacccgagtagtgcaagaacggccacccggttttgccagcgttcagcgtctgcccatggacccataaggcacattagcgttgggggtctcttttcagcagcctcacagacattcccgtcctttctggttggtgttgactgtgtttcagcatcactctaccctcccatgtccttagcattgctgtgcgtgtttccaggcacttaggacacccttccccacgttgccatcttactgacagttcaaatgactctccttttttgttcgttagtaacaatcttcatttgacaccttaatacatttctgactgttcttaaaacagtggggatgcctatattttccttgagtttttgtgactgactttggctatatatacctttctggggttttgtttgttttttatttttattttgattaccgagggtatttggggtggggttgttttttgagatgtgtaattcttttatggagtttttaaaaagaattttcatattgtttttctaacatggcttcattaaacgtttaagtattttaaaaatatgtaatatttggaccagatgttgtgaataatagtagagataaagctattttattctgtatttttaaaactgttccgtacaaataaaagctctcctggacacagttttgctcttcacgtgcctcct

SEQ ID NO: 446629 - DNA, 5915 bp, Homo sapiens
ctcagcctcccgagtagttggaattacaggcacatgcccccacgcctggctaatttttgtatttttagtagagatggggtttcaccttgttggccaggctggtctcgaactcctgacctcgtgatctgcctgcctcggcctcccaaagtgctgggattacaggcgtgagccaccgcatccggctacgatgttttcttttaattaaagacacagtgcacatcagtcctcattatggccgccttcatctgacttagcaactgtcccaggcatctggtgcttaagattttaaaatgaacagtttccatgagcttcagaatccaagtggatcttgtagagtcttgcagcgttcagaatgactttgggtaactggtcctggtcactttcgcctgcctctctaggagcattcatggttgttttcctcccacagttcagtggggactgcccaccgtgtctgcggccggtgtcatcggcatgctcagtgccgtggtcgccagcatcatcgagtctattggtgactactacgcctgtgcacggctgtcctgtgccccacccccccccatccacgcaataaacaggggaattttcgtggaaggcctctcctgtgttcttgatggcatatttggtactgggaatggctctacttcatccagtcccaacattggagttttgggaattacaaaggtcggcagccgccgcgtgatacagtgcggagcagccctcatgctcgctctgggcatgatcgggaagttcagcgccctctttgcgtcccttccggatcctgtgctgggagccctgttctgcacgctctttggaatgatcacagctgttggcctctctaacctgcagttcattgatttaaattcttcccggaacctctttgtgcttggattttcgatcttctttgggctcgtccttccaagttacctcagacagaaccctctggtcacagggataacaggaatcgatcaagtgttgaacgtccttctcacaactgctatgtttgtagggggctgtgtggcttttatcctggataacaccatcccaggcactccagaggaaagaggaatccggaaatggaagaagggtgtgggcaaagggaacaaatcactcgacggcatggagtcgtacaatttgccatttggcatgaacattataaaaaaatacagatgcttcagctacttacccatcagcccaacctttgtgggctacacatggaaaggcctcaggaagagcgacaacagccggagttcagatgaagactcccaggccacgggatagcctttgctgtgccctgtggcctggccgcagtgaggcatgtatctgtagttccttgctgagtaacaagaagtaaaatacatgtttgtatatctacatttacattctgcgccccagagctaagacagactgcgaatcacttttctgctgtgagggtgatggtgcctgatgcggtgtctcgcctatctccttatttaagcccttaactccttgccctttgagagtgtccattgctggccatggtcactaaatttgaagttccagtcctccctttggagtggacatttaaaatctgcagccattccttgcttcagttcccttccaccacccagggctggctttcctataagccacctccagggtccaggggctttctctctctctccgaagcccctggacctgtttccttgtcatttgaccctcgtctgtgcccgcggagacctcctctgaccaaggggcactagtatgccttgcgctatcatgactgactggcccagtatgattctgttgtcgctgatctcccggaggaggaggctgttgacctgaaaacagtggcgtggctcccctgtgcccagatctggccatgggtgaggcctgcacagatgttgaatgaacatctgtttggggcattggagggaaaaggaaaggaccctgaagccaatatctgattctcggctgcaccttctcttggccaccctggccctgaccgggccagcacgtgcacactggcctcttttcatttcactagtggccgagacaccctctctggcatttatcactgttggccggtgtgatgagtatagagtgccacccaaggcaccagtcacacaagctgatgggcgtcttggctctgccgtcatgtggatgttattgtcgcgcgcgtctataattacaaggttttattcctatttaatgttattgactatagcagattttggaaatcagtgttttccatgtgaccctctttccttgcatccctattccttgtcccccacccactcttccccccatcaagaaaagaaccagcatttgtaaagctgtggacaccatcagggaagcttgttgtaacggcttttgaaggccagtaaccattgttgtggttgtgttttgtattgcttgataccatgaaagtgtaaatactgtaatgcctaatctatttatcaaaactgactactggaccggagcccagaaaccatgggtcaagttacacgtgaatttgttttgtgaagaagggaagctggggcaggtaacacgcagagccgccacgtggaacggtctgtccgccggtctgtcccgcttgccgggcttctgttgcaagtcttggcttaaggagacttcctgtgggttgccatgtcgcacgtccgttagatcttgattttacaggtgagggtggttgccaaaggtgataagaaaagcagccaacaggctccctctcacttaagagagttctaattaataacactaaattcttcctgagaaatgactcctcttggtttggtttgaagtttttcagtgaaggaaaaggcctgagataggaagcagtgccctcgcttcatgaggtggcacatcttcggtggccgttggcctggtcgagctttggtcagctgcgtgggtgcctgtctcctgtctccagcggcagggcatggttcttggcagcctggtgtccacacggtgcattcctgtccccctcggccccaggctggctcagctctccagtgctgcggcgctgtctttgcagcattgccatgtcaccgtagcccccttcactcttggaagtttggggcttcaaggtttattctggcaagaacacctcggagccactgcattgttttgccaaaaacttactgcagattaagtaaagaacttagatgctaaattacatctaattttgtatgtttttttaaatgtgtctttgatgcatactttagaagcacactggctcgcggtttccatccctcttgccttgggacactcttgaggctggcagccctcctgcaatgagttgctctcagttccttctgtttggattttgctcaacatctccagtttctctgctctgaaaaatggggaaaactgctaaacatcccagagatttgcaatcttctagctctccaggtgagcagaaagaccaaatatccaaataaaagcctgaaagccattggtgatccaggggcaccttctcttcagcttgactgggcgtcttccgctgcataacactcaaggtgtctgctctagtcatccagaaacccactcccttctgaagcccctccttgggccgggttgtatcaggaggattcaaccccgctaacatgtggggtgccctctgtaggccttcacacagggaaggaagccctaccctttcaactcctgttggagtgagagtttcctgttctgattccactgtggccaacccaataattctgtccgaggaggggtaagggaataggaggtggggagcaaagagggcagcctgactagatgcccctgctgaatctggtactttctgcacagccttgagtgattggagtcccctaatgactaataaacttgaacatgtaacacacacacacacacacacacacaccattttaggaagtggttctcctactggaaaatatgctacagaatgaaagtttgtaattgaaagaaaaagaatgtattcatctgcttcttgggtttaagcacacacctgaaggggagatattgggggacacggtggccactcgcggtctgtgtcatgacacttcccattcacatcattggcctgcgttgctggggctttgaaccaccaccccgtactttgttttgcctgtagagtgttgtaaaatattttggatgtgaatgtccttgcaggccggttagtctccagtttccacagagaccacctacccaccaccttcccaggtcacctgcctggtccctgaaagaaagcatttgtgtgggcaatcccaacatgaaatgtagacagcgtgaatacggacaggaggtgatgccatattcacagtgggggatggagggcccccacccctgcttcacagaataatgggaagtgactctagtctttgtaagcaattttcattctcattaggaagttaaatgtagattcacagatacatttactttcagaatcctcaagaggatttcaaatgctaacttttagtttcttgggattgatcaaggcaagagaagtggctttaaccatgccagccagaatgaagcatcatgggtcctgatggtttcccgttttcatggtaacaaattcgcacagaggttttgctttatactgtagaataccgactttcatgatgacaacttggtttatgcatgaatattgcagtatttccatatagcaaaataacatttctacccaggataatagtcacagttttccagggagggaatgatataattttcatgacaatgtcatgtgatgatagaatttctccattgatgaatctctagtatgtgtgtatactttatttacccatacgtatattttatgaccatgagctaagttgttatttctttcattcatatccctgctgaaatattggtactagcaacttaaagttggcaagtctcatcttcagtaatacggatgccatgggagtggccaggccagattgaaggtgaatatggagcagtagcagaagcctcattccagaacccatctggccagagaagcagcagcatcctgggggatggccgtgcatggggtgtacactcgctataggcataggcccggcatggctgtcgctggacgccagctgtgcacacccagccacacctgctgcacgccgcgttagtgtgcggctccgggcctgagcattcgcaaagctcgcttctccagggagcctcctcttggctttggaaaagagcccagggacttaacgtgctgcctgttgtactctgtcccctcatgactttttagacacagggactaggacatcgaccaccctctgcccctcctgcagtcagaacccgagtagtgcaagaacggccacccggttttgccagcgttcagcgtctgcccatggacccataaggcacattagcgttgggggtctcttttcagcagcctcacagacattcccgtcctttctggttggtgttgactgtgtttcagcatcactctaccctcccatgtccttagcattgctgtgcgtgtttccaggcacttaggacacccttccccacgttgccatcttactgacagttcaaatgactctccttttttgttcgttagtaacaatcttcatttgacaccttaatacatttctgactgttcttaaaacagtggggatgcctatattttccttgagtttttgtgactgactttggctatatatacctttctggggttttgtttgttttttatttttattttgattaccgagggtatttggggtggggttgttttttgagatgtgtaattcttttatggagtttttaaaaagaattttcatattgtttttctaacatggcttcattaaacgtttaagtattttaaaaatatgtaatatttggaccagatgttgtgaataatagtagagataaagctattttattctgtatttttaaaactgttccgtacaaataaaagctctcctggacacagttttgctcttcacgtgcctcct

SEQ ID NO: 446630 - DNA, 359 bp, Homo sapiens
  misc_feature (77)..(77): n is a, c, g, or t
cttccccttgaccactccagatcatcctggccatcctggtatcctggctgctctgcttcatcttcacggtgacagangtcttccctcccgacagcacaaagtatggcttctatgctcgcacagatgccaggcaaggcgtgcttctggtagccccgtggtttaaggttccatacccatgtaagtattctgatggctagaggggtcaagagcccacgagggcccaactgagaggggtgggaatttggcagaacagccgtctttgtcccagactgtctcctgaaggccttgccattctggtcaggagaggattagacagcaagtaagggaggccctgtccccagagggcagaaaccaacaca

SEQ ID NO: 446631 - DNA, 802 bp, Homo sapiens
ggaagatggcaaccacttgataaagttgtttttctgtaatagtggcctgtacatggccgagctaacactggtcttcacgtttaatgagcaccttcttttctccttctggctcgcagagctctctcgctgagaccctggatagcactggcagtctggacccccagcgatcagacatgatttataccatagaagatgttcctccctggtacctgtgtatatttctggggctacaggtaagatggttcctgtaggatgtgtaactaccagcaggtgtttgcattgtctaccatctggaattgtttaaaaattccactttggtttttgtttattgaagacttttataaattcctcttttaagagtgatgagtaggggctgagcacagtggctgatgcctgtaatcctagcagttttggaggctgaggtgggcagatcactggagcctaggagctcaagaccagcctgggtaacatggcaaaagtccatctctacaaaaaatacaaaaattagccatgtgtggtggtgtgtgcccacagtcccagctactcaagaggctgaggcaggaggatcgcttgaggttgaggttgcagtgagctgtgatcacaccactccacttcagcctggttgacatagtgagaccctgtctcaaaaaacaaatgatgaatgggaattgttgacatcacagcaggaggaagaaaagaacaggtagaatggattaccagggaaaagaaagaagatgttcagggcacaagcaagagcagtgacataaaggaagggaaaggaaatagagttatagaaagaagg

SEQ ID NO: 446632 - DNA, 2350 bp, Homo sapiens
  misc_feature (1298)..(1298): n is a, c, g, or t
ggcttcctcactccttctctagctcgagacgcgtcgacccgatccattgtgtcagttactcagggaccttggtgcataagcaaatgtaactcagcgaattgtaatggaaagcatatggacaggtctacgccacatcacttaggtgctaagagatgccgtttgcaggcctcatctctgcttgagaatcgggggctccaggcactagaagagccggctgatcctgggctcctagcttgaataagccttcacttccagctgctctccccaacggctgtgtaaactactcgtttctcttaatgatgggtattggtaagaataccacatccaaatcaatggaggctggaagttcaacagaaggcaaatacgaagacgaggcaaagcacccagctttcttcactcttccggtggtgataaatggaggcgccacctccagcggtgagcaggacaatgaggacactgagctcatggcgatctacactacggaaaacggcattgcagaaaagagctctctcgctgagaccctggatagcactggcagtctggacccccagcgatcagacatgatttataccatagaagatgttcctccctggtacctgtgtatatttctggggctacagcactacctgacatgcttcagcggcacgatcgcagtgcccttcctgttggccgatgccatgtgtgtggggtacgaccagtgggccaccagccagctcattgggaccattttcttctgtgtgggaatcactactttgctacagacaacgtttggatgcaggttacccctgtttcaggccagtgcttttgcatttttggcccctgctcgagccatcctgtctttagataaatggaaatgtaacaccacagatgtttcagttgccaatggaacagcagagctgttgcacacagaacacatctggtatccccggatccgagagatccagggggccatcatcatgtcctcactgatagaagtagtcatcggcctcctcggcctgcctggggctctactgaagtacatcggtcccttgaccattacacccacggtggccctaattggcctctctggtttccaggcagcgggggagagagccgggaagcactggggcattgccatgctgacaatattcctagtattactgttttctcaatacgccagaaatgttaaatttcctctcccgatttataaatccaagaaaggatggactgcgtacaagttacagctgttcaaaatgttccctatcatcctggccatcctggtatcctggctgctctgcttcatcttcacggtgacagangtcttccctcccgacagcacaaagtatggcttctatgctcgcacagatgccaggcaaggcgtgcttctggtagccccgtggtttaaggttccatacccatttcagtggggactgcccaccgtgtctgcggccggtgtcatcggcatgctcagtgccgtggtcgccagcatcatcgagtctattggtgactactacgcctgtgcacggctgtcctgtgccccacccccccccatccacgcaataaacaggggaattttcgtggaaggcctctcctgtgttcttgatggcatatttggtactgggaatggctctacttcatccagtcccaacattggagttttgggaattacaaaggtcggcagccgccgcgtgatacagtgcggagcagccctcatgctcgctctgggcatgatcgggaagttcagcgccctctttgcgtcccttccggatcctgtgctgggagccctgttctgcacgctctttggaatgatcacagctgttggcctctctaacctgcagttcattgatttaaattcttcccggaacctctttgtgcttggattttcgatcttctttgggctcgtccttccaagttacctcagacagaaccctctggtcacagggataacaggaatcgatcaagtgttgaacgtccttctcacaactgctatgtttgtagggggctgtgtggcttttatcctggataacaccatcccaggcactccagaggaaagaggaatccggaaatggaagaagggtgtgggcaaagggaacaaatcactcgacggcatggagtcgtacaatttgccatttggcatgaacattataaaaaaatacagatgcttcagctacttacccatcagcccaacctttgtgggctacacatggaaaggcctcaggaagagcgacaacagccggagttcagatgaagactcccaggccacgggatagcctttgctgtgccctgtggcctggccgcagtgaggcatgtatctgtagttccttgctgagtaacaagaagtaaaatacatgtttgtatatctacatttaca

SEQ ID NO: 446633 - DNA, 6321 bp, Homo sapiens
  misc_feature (733)..(733): n is a, c, g, or t
taccagggaggaacatcttctatggtataaatcatgtctgatcgctgggggtccacactacctgacatgcttcagcggcacgatcgcagtgcccttcctgttggccgatgccatgtgtgtggggtacgaccagtgggccaccagccagctcattgggaccattttcttctgtgtgggaatcactactttgctacagacaacgtttggatgcaggttacccctgtttcaggccagtgcttttgcatttttggcccctgctcgagccatcctgtctttagataaatggaaatgtaacaccacagatgtttcagttgccaatggaacagcagagctgttgcacacagaacacatctggtatccccggatccgagagatccagggggccatcatcatgtcctcactgatagaagtagtcatcggcctcctcggcctgcctggggctctactgaagtacatcggtcccttgaccattacacccacggtggccctaattggcctctctggtttccaggcagcgggggagagagccgggaagcactggggcattgccatgctgacaatattcctagtattactgttttctcaatacgccagaaatgttaaatttcctctcccgatttataaatccaagaaaggatggactgcgtacaagttacagctgttcaaaatgttccctatcatcctggccatcctggtatcctggctgctctgcttcatcttcacggtgacagangtcttccctcccgacagcacaaagtatggcttctatgctcgcacagatgccaggcaaggcgtgcttctggtagccccgtggtttaaggttccatacccatttcagtggggactgcccaccgtgtctgcggccggtgtcatcggcatgctcagtgccgtggtcgccagcatcatcgagtctattggtgactactacgcctgtgcacggctgtcctgtgccccacccccccccatccacgcaataaacaggggaattttcgtggaaggcctctcctgtgttcttgatggcatatttggtactgggaatggctctacttcatccagtcccaacattggagttttgggaattacaaaggtcggcagccgccgcgtgatacagtgcggagcagccctcatgctcgctctgggcatgatcgggaagttcagcgccctctttgcgtcccttccggatcctgtgctgggagccctgttctgcacgctctttggaatgatcacagctgttggcctctctaacctgcagttcattgatttaaattcttcccggaacctctttgtgcttggattttcgatcttctttgggctcgtccttccaagttacctcagacagaaccctctggtcacagggataacaggaatcgatcaagtgttgaacgtccttctcacaactgctatgtttgtagggggctgtgtggcttttatcctggataacaccatcccaggcactccagaggaaagaggaatccggaaatggaagaagggtgtgggcaaagggaacaaatcactcgacggcatggagtcgtacaatttgccatttggcatgaacattataaaaaaatacagatgcttcagctacttacccatcagcccaacctttgtgggctacacatggaaaggcctcaggaagagcgacaacagccggagttcagatgaagactcccaggccacgggatagcctttgctgtgccctgtggcctggccgcagtgaggcatgtatctgtagttccttgctgagtaacaagaagtaaaatacatgtttgtatatctacatttacattctgcgccccagagctaagacagactgcgaatcacttttctgctgtgagggtgatggtgcctgatgcggtgtctcgcctatctccttatttaagcccttaactccttgccctttgagagtgtccattgctggccatggtcactaaatttgaagttccagtcctccctttggagtggacatttaaaatctgcagccattccttgcttcagttcccttccaccacccagggctggctttcctataagccacctccagggtccaggggctttctctctctctccgaagcccctggacctgtttccttgtcatttgaccctcgtctgtgcccgcggagacctcctctgaccaaggggcactagtatgccttgcgctatcatgactgactggcccagtatgattctgttgtcgctgatctcccggaggaggaggctgttgacctgaaaacagtggcgtggctcccctgtgcccagatctggccatgggtgaggcctgcacagatgttgaatgaacatctgtttggggcattggagggaaaaggaaaggaccctgaagccaatatctgattctcggctgcaccttctcttggccaccctggccctgaccgggccagcacgtgcacactggcctcttttcatttcactagtggccgagacaccctctctggcatttatcactgttggccggtgtgatgagtatagagtgccacccaaggcaccagtcacacaagctgatgggcgtcttggctctgccgtcatgtggatgttattgtcgcgcgcgtctataattacaaggttttattcctatttaatgttattgactatagcagattttggaaatcagtgttttccatgtgaccctctttccttgcatccctattccttgtcccccacccactcttccccccatcaagaaaagaaccagcatttgtaaagctgtggacaccatcagggaagcttgttgtaacggcttttgaaggccagtaaccattgttgtggttgtgttttgtattgcttgataccatgaaagtgtaaatactgtaatgcctaatctatttatcaaaactgactactggaccggagcccagaaaccatgggtcaagttacacgtgaatttgttttgtgaagaagggaagctggggcaggtaacacgcagagccgccacgtggaacggtctgtccgccggtctgtcccgcttgccgggcttctgttgcaagtcttggcttaaggagacttcctgtgggttgccatgtcgcacgtccgttagatcttgattttacaggtgagggtggttgccaaaggtgataagaaaagcagccaacaggctccctctcacttaagagagttctaattaataacactaaattcttcctgagaaatgactcctcttggtttggtttgaagtttttcagtgaaggaaaaggcctgagataggaagcagtgccctcgcttcatgaggtggcacatcttcggtggccgttggcctggtcgagctttggtcagctgcgtgggtgcctgtctcctgtctccagcggcagggcatggttcttggcagcctggtgtccacacggtgcattcctgtccccctcggccccaggctggctcagctctccagtgctgcggcgctgtctttgcagcattgccatgtcaccgtagcccccttcactcttggaagtttggggcttcaaggtttattctggcaagaacacctcggagccactgcattgttttgccaaaaacttactgcagattaagtaaagaacttagatgctaaattacatctaattttgtatgtttttttaaatgtgtctttgatgcatactttagaagcacactggctcgcggtttccatccctcttgccttgggacactcttgaggctggcagccctcctgcaatgagttgctctcagttccttctgtttggattttgctcaacatctccagtttctctgctctgaaaaatggggaaaactgctaaacatcccagagatttgcaatcttctagctctccaggtgagcagaaagaccaaatatccaaataaaagcctgaaagccattggtgatccaggggcaccttctcttcagcttgactgggcgtcttccgctgcataacactcaaggtgtctgctctagtcatccagaaacccactcccttctgaagcccctccttgggccgggttgtatcaggaggattcaaccccgctaacatgtggggtgccctctgtaggccttcacacagggaaggaagccctaccctttcaactcctgttggagtgagagtttcctgttctgattccactgtggccaacccaataattctgtccgaggaggggtaagggaataggaggtggggagcaaagagggcagcctgactagatgcccctgctgaatctggtactttctgcacagccttgagtgattggagtcccctaatgactaataaacttgaacatgtaacacacacacacacacacacacacaccattttaggaagtggttctcctactggaaaatatgctacagaatgaaagtttgtaattgaaagaaaaagaatgtattcatctgcttcttgggtttaagcacacacctgaaggggagatattgggggacacggtggccactcgcggtctgtgtcatgacacttcccattcacatcattggcctgcgttgctggggctttgaaccaccaccccgtactttgttttgcctgtagagtgttgtaaaatattttggatgtgaatgtccttgcaggccggttagtctccagtttccacagagaccacctacccaccaccttcccaggtcacctgcctggtccctgaaagaaagcatttgtgtgggcaatcccaacatgaaatgtagacagcgtgaatacggacaggaggtgatgccatattcacagtgggggatggagggcccccacccctgcttcacagaataatgggaagtgactctagtctttgtaagcaattttcattctcattaggaagttaaatgtagattcacagatacatttactttcagaatcctcaagaggatttcaaatgctaacttttagtttcttgggattgatcaaggcaagagaagtggctttaaccatgccagccagaatgaagcatcatgggtcctgatggtttcccgttttcatggtaacaaattcgcacagaggttttgctttatactgtagaataccgactttcatgatgacaacttggtttatgcatgaatattgcagtatttccatatagcaaaataacatttctacccaggataatagtcacagttttccagggagggaatgatataattttcatgacaatgtcatgtgatgatagaatttctccattgatgaatctctagtatgtgtgtatactttatttacccatacgtatattttatgaccatgagctaagttgttatttctttcattcatatccctgctgaaatattggtactagcaacttaaagttggcaagtctcatcttcagtaatacggatgccatgggagtggccaggccagattgaaggtgaatatggagcagtagcagaagcctcattccagaacccatctggccagagaagcagcagcatcctgggggatggccgtgcatggggtgtacactcgctataggcataggcccggcatggctgtcgctggacgccagctgtgcacacccagccacacctgctgcacgccgcgttagtgtgcggctccgggcctgagcattcgcaaagctcgcttctccagggagcctcctcttggctttggaaaagagcccagggacttaacgtgctgcctgttgtactctgtcccctcatgactttttagacacagggactaggacatcgaccaccctctgcccctcctgcagtcagaacccgagtagtgcaagaacggccacccggttttgccagcgttcagcgtctgcccatggacccataaggcacattagcgttgggggtctcttttcagcagcctcacagacattcccgtcctttctggttggtgttgactgtgtttcagcatcactctaccctcccatgtccttagcattgctgtgcgtgtttccaggcacttaggacacccttccccacgttgccatcttactgacagttcaaatgactctccttttttgttcgttagtaacaatcttcatttgacaccttaatacatttctgactgttcttaaaacagtggggatgcctatattttccttgagtttttgtgactgactttggctatatatacctttctggggttttgtttgttttttatttttattttgattaccgagggtatttggggtggggttgttttttgagatgtgtaattcttttatggagtttttaaaaagaattttcatattgtttttctaacatggcttcattaaacgtttaagtattttaaaaatatgtaatatttggaccagatgttgtgaataatagtagagataaagctattttattctgtatttttaaaactgttccgtacaaataaaagctctcctggacacagttttgctcttcacgtgcctcct

SEQ ID NO: 446634 - DNA, 6197 bp, Homo sapiens
  misc_feature (609)..(609): n is a, c, g, or t
ctatggaaaagactgttaagctgtcaaatagtgaactacctcggtagttcccgatgccgtgatcatggttttggtctcgtttcttttaggttacccctgtttcaggccagtgcttttgcatttttggcccctgctcgagccatcctgtctttagataaatggaaatgtaacaccacagatgtttcagttgccaatggaacagcagagctgttgcacacagaacacatctggtatccccggatccgagagatccagggggccatcatcatgtcctcactgatagaagtagtcatcggcctcctcggcctgcctggggctctactgaagtacatcggtcccttgaccattacacccacggtggccctaattggcctctctggtttccaggcagcgggggagagagccgggaagcactggggcattgccatgctgacaatattcctagtattactgttttctcaatacgccagaaatgttaaatttcctctcccgatttataaatccaagaaaggatggactgcgtacaagttacagctgttcaaaatgttccctatcatcctggccatcctggtatcctggctgctctgcttcatcttcacggtgacagangtcttccctcccgacagcacaaagtatggcttctatgctcgcacagatgccaggcaaggcgtgcttctggtagccccgtggtttaaggttccatacccatttcagtggggactgcccaccgtgtctgcggccggtgtcatcggcatgctcagtgccgtggtcgccagcatcatcgagtctattggtgactactacgcctgtgcacggctgtcctgtgccccacccccccccatccacgcaataaacaggggaattttcgtggaaggcctctcctgtgttcttgatggcatatttggtactgggaatggctctacttcatccagtcccaacattggagttttgggaattacaaaggtcggcagccgccgcgtgatacagtgcggagcagccctcatgctcgctctgggcatgatcgggaagttcagcgccctctttgcgtcccttccggatcctgtgctgggagccctgttctgcacgctctttggaatgatcacagctgttggcctctctaacctgcagttcattgatttaaattcttcccggaacctctttgtgcttggattttcgatcttctttgggctcgtccttccaagttacctcagacagaaccctctggtcacagggataacaggaatcgatcaagtgttgaacgtccttctcacaactgctatgtttgtagggggctgtgtggcttttatcctggataacaccatcccaggcactccagaggaaagaggaatccggaaatggaagaagggtgtgggcaaagggaacaaatcactcgacggcatggagtcgtacaatttgccatttggcatgaacattataaaaaaatacagatgcttcagctacttacccatcagcccaacctttgtgggctacacatggaaaggcctcaggaagagcgacaacagccggagttcagatgaagactcccaggccacgggatagcctttgctgtgccctgtggcctggccgcagtgaggcatgtatctgtagttccttgctgagtaacaagaagtaaaatacatgtttgtatatctacatttacattctgcgccccagagctaagacagactgcgaatcacttttctgctgtgagggtgatggtgcctgatgcggtgtctcgcctatctccttatttaagcccttaactccttgccctttgagagtgtccattgctggccatggtcactaaatttgaagttccagtcctccctttggagtggacatttaaaatctgcagccattccttgcttcagttcccttccaccacccagggctggctttcctataagccacctccagggtccaggggctttctctctctctccgaagcccctggacctgtttccttgtcatttgaccctcgtctgtgcccgcggagacctcctctgaccaaggggcactagtatgccttgcgctatcatgactgactggcccagtatgattctgttgtcgctgatctcccggaggaggaggctgttgacctgaaaacagtggcgtggctcccctgtgcccagatctggccatgggtgaggcctgcacagatgttgaatgaacatctgtttggggcattggagggaaaaggaaaggaccctgaagccaatatctgattctcggctgcaccttctcttggccaccctggccctgaccgggccagcacgtgcacactggcctcttttcatttcactagtggccgagacaccctctctggcatttatcactgttggccggtgtgatgagtatagagtgccacccaaggcaccagtcacacaagctgatgggcgtcttggctctgccgtcatgtggatgttattgtcgcgcgcgtctataattacaaggttttattcctatttaatgttattgactatagcagattttggaaatcagtgttttccatgtgaccctctttccttgcatccctattccttgtcccccacccactcttccccccatcaagaaaagaaccagcatttgtaaagctgtggacaccatcagggaagcttgttgtaacggcttttgaaggccagtaaccattgttgtggttgtgttttgtattgcttgataccatgaaagtgtaaatactgtaatgcctaatctatttatcaaaactgactactggaccggagcccagaaaccatgggtcaagttacacgtgaatttgttttgtgaagaagggaagctggggcaggtaacacgcagagccgccacgtggaacggtctgtccgccggtctgtcccgcttgccgggcttctgttgcaagtcttggcttaaggagacttcctgtgggttgccatgtcgcacgtccgttagatcttgattttacaggtgagggtggttgccaaaggtgataagaaaagcagccaacaggctccctctcacttaagagagttctaattaataacactaaattcttcctgagaaatgactcctcttggtttggtttgaagtttttcagtgaaggaaaaggcctgagataggaagcagtgccctcgcttcatgaggtggcacatcttcggtggccgttggcctggtcgagctttggtcagctgcgtgggtgcctgtctcctgtctccagcggcagggcatggttcttggcagcctggtgtccacacggtgcattcctgtccccctcggccccaggctggctcagctctccagtgctgcggcgctgtctttgcagcattgccatgtcaccgtagcccccttcactcttggaagtttggggcttcaaggtttattctggcaagaacacctcggagccactgcattgttttgccaaaaacttactgcagattaagtaaagaacttagatgctaaattacatctaattttgtatgtttttttaaatgtgtctttgatgcatactttagaagcacactggctcgcggtttccatccctcttgccttgggacactcttgaggctggcagccctcctgcaatgagttgctctcagttccttctgtttggattttgctcaacatctccagtttctctgctctgaaaaatggggaaaactgctaaacatcccagagatttgcaatcttctagctctccaggtgagcagaaagaccaaatatccaaataaaagcctgaaagccattggtgatccaggggcaccttctcttcagcttgactgggcgtcttccgctgcataacactcaaggtgtctgctctagtcatccagaaacccactcccttctgaagcccctccttgggccgggttgtatcaggaggattcaaccccgctaacatgtggggtgccctctgtaggccttcacacagggaaggaagccctaccctttcaactcctgttggagtgagagtttcctgttctgattccactgtggccaacccaataattctgtccgaggaggggtaagggaataggaggtggggagcaaagagggcagcctgactagatgcccctgctgaatctggtactttctgcacagccttgagtgattggagtcccctaatgactaataaacttgaacatgtaacacacacacacacacacacacacaccattttaggaagtggttctcctactggaaaatatgctacagaatgaaagtttgtaattgaaagaaaaagaatgtattcatctgcttcttgggtttaagcacacacctgaaggggagatattgggggacacggtggccactcgcggtctgtgtcatgacacttcccattcacatcattggcctgcgttgctggggctttgaaccaccaccccgtactttgttttgcctgtagagtgttgtaaaatattttggatgtgaatgtccttgcaggccggttagtctccagtttccacagagaccacctacccaccaccttcccaggtcacctgcctggtccctgaaagaaagcatttgtgtgggcaatcccaacatgaaatgtagacagcgtgaatacggacaggaggtgatgccatattcacagtgggggatggagggcccccacccctgcttcacagaataatgggaagtgactctagtctttgtaagcaattttcattctcattaggaagttaaatgtagattcacagatacatttactttcagaatcctcaagaggatttcaaatgctaacttttagtttcttgggattgatcaaggcaagagaagtggctttaaccatgccagccagaatgaagcatcatgggtcctgatggtttcccgttttcatggtaacaaattcgcacagaggttttgctttatactgtagaataccgactttcatgatgacaacttggtttatgcatgaatattgcagtatttccatatagcaaaataacatttctacccaggataatagtcacagttttccagggagggaatgatataattttcatgacaatgtcatgtgatgatagaatttctccattgatgaatctctagtatgtgtgtatactttatttacccatacgtatattttatgaccatgagctaagttgttatttctttcattcatatccctgctgaaatattggtactagcaacttaaagttggcaagtctcatcttcagtaatacggatgccatgggagtggccaggccagattgaaggtgaatatggagcagtagcagaagcctcattccagaacccatctggccagagaagcagcagcatcctgggggatggccgtgcatggggtgtacactcgctataggcataggcccggcatggctgtcgctggacgccagctgtgcacacccagccacacctgctgcacgccgcgttagtgtgcggctccgggcctgagcattcgcaaagctcgcttctccagggagcctcctcttggctttggaaaagagcccagggacttaacgtgctgcctgttgtactctgtcccctcatgactttttagacacagggactaggacatcgaccaccctctgcccctcctgcagtcagaacccgagtagtgcaagaacggccacccggttttgccagcgttcagcgtctgcccatggacccataaggcacattagcgttgggggtctcttttcagcagcctcacagacattcccgtcctttctggttggtgttgactgtgtttcagcatcactctaccctcccatgtccttagcattgctgtgcgtgtttccaggcacttaggacacccttccccacgttgccatcttactgacagttcaaatgactctccttttttgttcgttagtaacaatcttcatttgacaccttaatacatttctgactgttcttaaaacagtggggatgcctatattttccttgagtttttgtgactgactttggctatatatacctttctggggttttgtttgttttttatttttattttgattaccgagggtatttggggtggggttgttttttgagatgtgtaattcttttatggagtttttaaaaagaattttcatattgtttttctaacatggcttcattaaacgtttaagtattttaaaaatatgtaatatttggaccagatgttgtgaataatagtagagataaagctattttattctgtatttttaaaactgttccgtacaaataaaagctctcctggacacagttttgctcttcacgtgcctcct

SEQ ID NO: 446635 - DNA, 6499 bp, Homo sapiens
  misc_feature (1395)..(1395): n is a, c, g, or t
cattcatcttctcctgcccttggacatcacagctccaggaactcagatcttcagactcagggtgaaggacaccaccagctttccaggttccccagcttgcagacggcatacgctaggtcttgactccactaacggggacttctcatacggctttgaacttggaccttggtgcataagcaaatgtaactcagcgaattgtaatggaaagcatatggacaggtctacgccacatcacttaggtgctaagagatgccgtttgcaggcctcatctctgcttgagaatcgggggctccaggcactagaagagccggctgatcctgggctcctagcttgaataagccttcacttccagctgctctccccaacggctgtgtaaactactcgtttctcttaatgatgggtattggtaagaataccacatccaaatcaatggaggctggaagttcaacagaaggcaaatacgaagacgaggcaaagcacccagctttcttcactcttccggtggtgataaatggaggcgccacctccagcggtgagcaggacaatgaggacactgagctcatggcgatctacactacggaaaacggcattgcagaaaagagctctctcgctgagaccctggatagcactggcagtctggacccccagcgatcagacatgatttataccatagaagatgttcctccctggtacctgtgtatatttctggggctacagcactacctgacatgcttcagcggcacgatcgcagtgcccttcctgttggccgatgccatgtgtgtggggtacgaccagtgggccaccagccagctcattgggaccattttcttctgtgtgggaatcactactttgctacagacaacgtttggatgcaggttacccctgtttcaggccagtgcttttgcatttttggcccctgctcgagccatcctgtctttagataaatggaaatgtaacaccacagatgtttcagttgccaatggaacagcagagctgttgcacacagaacacatctggtatccccggatccgagagatccagggggccatcatcatgtcctcactgatagaagtagtcatcggcctcctcggcctgcctggggctctactgaagtacatcggtcccttgaccattacacccacggtggccctaattggcctctctggtttccaggcagcgggggagagagccgggaagcactggggcattgccatgctgacaatattcctagtattactgttttctcaatacgccagaaatgttaaatttcctctcccgatttataaatccaagaaaggatggactgcgtacaagttacagctgttcaaaatgttccctatcatcctggccatcctggtatcctggctgctctgcttcatcttcacggtgacagangtcttccctcccgacagcacaaagtatggcttctatgctcgcacagatgccaggcaaggcgtgcttctggtagccccgtggtttaaggttccatacccatttcagtggggactgcccaccgtgtctgcggccggtgtcatcggcatgctcagtgccgtggtcgccagcatcatcgagtctattggtgactactacgcctgtgcacggctgtcctgtgccccacccccccccatccacgcaataaacaggggaattttcgtggaaggcctctcctgtgttcttgatggcatatttggtactgggaatggctctacttcatccagtcccaacattggagttttgggaattacaaaggtcggcagccgccgcgtgatacagtgcggagcagccctcatgctcgctctgggcatgatcgggaagttcagcgccctctttgcgtcccttccggatcctgtgctgggagccctgttctgcacgctctttggaatgatcacagctgttggcctctctaacctgcagttcattgatttaaattcttcccggaacctctttgtgcttggattttcgatcttctttgggctcgtccttccaagttacctcagacagaaccctctggtcacagggataacaggaatcgatcaagtgttgaacgtccttctcacaactgctatgtttgtagggggctgtgtggcttttatcctggataacaccatcccaggcactccagaggaaagaggaatccggaaatggaagaagggtgtgggcaaagggaacaaatcactcgacggcatggagtcgtacaatttgccatttggcatgaacattataaaaaaatacagatgcttcagctacttacccatcagcccaacctttgtgggctacacatggaaaggcctcaggaagagcgacaacagccggagttcagatgaagactcccaggccacgggatagcctttgctgtgccctgtggcctggccgcagtgaggcatgtatctgtagttccttgctgagtaacaagaagtaaaatacatgtttgtatatctacatttacattctgcgccccagagctaagacagactgcgaatcacttttctgctgtgagggtgatggtgcctgatgcggtgtctcgcctatctccttatttaagcccttaactccttgccctttgagagtgtccattgctggccatggtcactaaatttgaagttccagtcctccctttggagtggacatttaaaatctgcagccattccttgcttcagttcccttccaccacccagggctggctttcctataagccacctccagggtccaggggctttctctctctctccgaagcccctggacctgtttccttgtcatttgaccctcgtctgtgcccgcggagacctcctctgaccaaggggcactagtatgccttgcgctatcatgactgactggcccagtatgattctgttgtcgctgatctcccggaggaggaggctgttgacctgaaaacagtggcgtggctcccctgtgcccagatctggccatgggtgaggcctgcacagatgttgaatgaacatctgtttggggcattggagggaaaaggaaaggaccctgaagccaatatctgattctcggctgcaccttctcttggccaccctggccctgaccgggccagcacgtgcacactggcctcttttcatttcactagtggccgagacaccctctctggcatttatcactgttggccggtgtgatgagtatagagtgccacccaaggcaccagtcacacaagctgatgggcgtcttggctctgccgtcatgtggatgttattgtcgcgcgcgtctataattacaaggttttattcctatttaatgttattgactatagcagattttggaaatcagtgttttccatgtgaccctctttccttgcatccctattccttgtcccccacccactcttccccccatcaagaaaagaaccagcatttgtaaagctgtggacaccatcagggaagcttgttgtaacggcttttgaaggccagtaaccattgttgtggttgtgttttgtattgcttgataccatgaaagtgtaaatactgtaatgcctaatctatttatcaaaactgactactggaccggagcccagaaaccatgggtcaagttacacgtgaatttgttttgtgaagaagggaagctggggcaggtaacacgcagagccgccacgtggaacggtctgtccgccggtctgtcccgcttgccgggcttctgttgcaagtcttggcttaaggagacttcctgtgggttgccatgtcgcacgtccgttagatcttgattttacaggtgagggtggttgccaaaggtgataagaaaagcagccaacaggctccctctcacttaagagagttctaattaataacactaaattcttcctgagaaatgactcctcttggtttggtttgaagtttttcagtgaaggaaaaggcctgagataggaagcagtgccctcgcttcatgaggtggcacatcttcggtggccgttggcctggtcgagctttggtcagctgcgtgggtgcctgtctcctgtctccagcggcagggcatggttcttggcagcctggtgtccacacggtgcattcctgtccccctcggccccaggctggctcagctctccagtgctgcggcgctgtctttgcagcattgccatgtcaccgtagcccccttcactcttggaagtttggggcttcaaggtttattctggcaagaacacctcggagccactgcattgttttgccaaaaacttactgcagattaagtaaagaacttagatgctaaattacatctaattttgtatgtttttttaaatgtgtctttgatgcatactttagaagcacactggctcgcggtttccatccctcttgccttgggacactcttgaggctggcagccctcctgcaatgagttgctctcagttccttctgtttggattttgctcaacatctccagtttctctgctctgaaaaatggggaaaactgctaaacatcccagagatttgcaatcttctagctctccaggtgagcagaaagaccaaatatccaaataaaagcctgaaagccattggtgatccaggggcaccttctcttcagcttgactgggcgtcttccgctgcataacactcaaggtgtctgctctagtcatccagaaacccactcccttctgaagcccctccttgggccgggttgtatcaggaggattcaaccccgctaacatgtggggtgccctctgtaggccttcacacagggaaggaagccctaccctttcaactcctgttggagtgagagtttcctgttctgattccactgtggccaacccaataattctgtccgaggaggggtaagggaataggaggtggggagcaaagagggcagcctgactagatgcccctgctgaatctggtactttctgcacagccttgagtgattggagtcccctaatgactaataaacttgaacatgtaacacacacacacacacacacacacaccattttaggaagtggttctcctactggaaaatatgctacagaatgaaagtttgtaattgaaagaaaaagaatgtattcatctgcttcttgggtttaagcacacacctgaaggggagatattgggggacacggtggccactcgcggtctgtgtcatgacacttcccattcacatcattggcctgcgttgctggggctttgaaccaccaccccgtactttgttttgcctgtagagtgttgtaaaatattttggatgtgaatgtccttgcaggccggttagtctccagtttccacagagaccacctacccaccaccttcccaggtcacctgcctggtccctgaaagaaagcatttgtgtgggcaatcccaacatgaaatgtagacagcgtgaatacggacaggaggtgatgccatattcacagtgggggatggagggcccccacccctgcttcacagaataatgggaagtgactctagtctttgtaagcaattttcattctcattaggaagttaaatgtagattcacagatacatttactttcagaatcctcaagaggatttcaaatgctaacttttagtttcttgggattgatcaaggcaagagaagtggctttaaccatgccagccagaatgaagcatcatgggtcctgatggtttcccgttttcatggtaacaaattcgcacagaggttttgctttatactgtagaataccgactttcatgatgacaacttggtttatgcatgaatattgcagtatttccatatagcaaaataacatttctacccaggataatagtcacagttttccagggagggaatgatataattttcatgacaatgtcatgtgatgatagaatttctccattgatgaatctctagtatgtgtgtatactttatttacccatacgtatattttatgaccatgagctaagttgttatttctttcattcatatccctgctgaaatatggacccataaggcacattagcgttgggggtctcttttcagcagcctcacagacattcccgtcctttctggttggtgttgactgtgtttcagcatcactctaccctcccatgtccttagcattgctgtgcgtgtttccaggcacttaggacacccttccccacgttgccatcttactgacagttcaaatgactctccttttttgttcgttagtaacaatcttcatttgacaccttaatacatttctgactgttcttaaaacagtggggatgcctatattttccttgagtttttgtgactgactttggctatatatacctttctggggttttgtttgttttttatttttattttgattaccgagggtatttggggtggggttgttttttgagatgtgtaattcttttatggagtttttaaaaagaattttcatattgtttttctaacatggcttcattaaacgtttaagtattttaaaaatatgtaatatttggaccagatgttgtgaataatagtagagataaagctattttattctgtatttttaaaactgttccgtacaaataaaagctctcctggacacagttttgctcttcacgtgcctcct

SEQ ID NO: 446636 - DNA, 5925 bp, Homo sapiens
  misc_feature (1395)..(1395): n is a, c, g, or t
cattcatcttctcctgcccttggacatcacagctccaggaactcagatcttcagactcagggtgaaggacaccaccagctttccaggttccccagcttgcagacggcatacgctaggtcttgactccactaacggggacttctcatacggctttgaacttggaccttggtgcataagcaaatgtaactcagcgaattgtaatggaaagcatatggacaggtctacgccacatcacttaggtgctaagagatgccgtttgcaggcctcatctctgcttgagaatcgggggctccaggcactagaagagccggctgatcctgggctcctagcttgaataagccttcacttccagctgctctccccaacggctgtgtaaactactcgtttctcttaatgatgggtattggtaagaataccacatccaaatcaatggaggctggaagttcaacagaaggcaaatacgaagacgaggcaaagcacccagctttcttcactcttccggtggtgataaatggaggcgccacctccagcggtgagcaggacaatgaggacactgagctcatggcgatctacactacggaaaacggcattgcagaaaagagctctctcgctgagaccctggatagcactggcagtctggacccccagcgatcagacatgatttataccatagaagatgttcctccctggtacctgtgtatatttctggggctacagcactacctgacatgcttcagcggcacgatcgcagtgcccttcctgttggccgatgccatgtgtgtggggtacgaccagtgggccaccagccagctcattgggaccattttcttctgtgtgggaatcactactttgctacagacaacgtttggatgcaggttacccctgtttcaggccagtgcttttgcatttttggcccctgctcgagccatcctgtctttagataaatggaaatgtaacaccacagatgtttcagttgccaatggaacagcagagctgttgcacacagaacacatctggtatccccggatccgagagatccagggggccatcatcatgtcctcactgatagaagtagtcatcggcctcctcggcctgcctggggctctactgaagtacatcggtcccttgaccattacacccacggtggccctaattggcctctctggtttccaggcagcgggggagagagccgggaagcactggggcattgccatgctgacaatattcctagtattactgttttctcaatacgccagaaatgttaaatttcctctcccgatttataaatccaagaaaggatggactgcgtacaagttacagctgttcaaaatgttccctatcatcctggccatcctggtatcctggctgctctgcttcatcttcacggtgacagangtcttccctcccgacagcacaaagtatggcttctatgctcgcacagatgccaggcaaggcgtgcttctggtagccccgtggtttaaggttccatacccatttcagtggggactgcccaccgtgtctgcggccggtgtcatcggcatgctcagtgccgtggtcgccagcatcatcgagtctattggtgactactacgcctgtgcacggctgtcctgtgccccacccccccccatccacgcaataaacaggggaattttcgtggaaggcctctcctgtgttcttgatggcatatttggtactgggaatggctctacttcatccagtcccaacattggagttttgggaattacaaaggtcggcagccgccgcgtgatacagtgcggagcagccctcatgctcgctctgggcatgatcgggaagttcagcgccctctttgcgtcccttccggatcctgtgctgggagccctgttctgcacgctctttggaatgatcacagctgttggcctctctaacctgcagttcattgatttaaattcttcccggaacctctttgtgcttggattttcgatcttctttgggctcgtccttccaagttacctcagacagaaccctctggtcacagggataacaggaatcgatcaagtgttgaacgtccttctcacaactgctatgtttgtagggggctgtgtggcttttatcctggataacaccatcccaggcactccagaggaaagaggaatccggaaatggaagaagggtgtgggcaaagggaacaaatcactcgacggcatggagtcgtacaatttgccatttggcatgaacattataaaaaaatacagatgcttcagctacttacccatcagcccaacctttgtgggctacacatggaaaggcctcaggaagagcgacaacagccggagttcagatgaagactcccaggccacgggatagcctttgctgtgccctgtggcctggccgcagtgaggcatgtatctgtagttccttgctgagtaacaagaagtaaaatacatgtttgtatatctacatttacattctgcgccccagagctaagacagactgcgaatcacttttctgctgtgagggtgatggtgcctgatgcggtgtctcgcctatctccttatttaagcccttaactccttgccctttgagagtgtccattgctggccatggtcactaaatttgaagttccagtcctccctttggagtggacatttaaaatctgcagccattccttgcttcagttcccttccaccacccagggctggctttcctataagccacctccagggtccaggggctttctctctctctccgaagcccctggacctgtttccttgtcatttgaccctcgtctgtgcccgcggagacctcctctgaccaaggggcactagtatgccttgcgctatcatgactgactggcccagtatgattctgttgtcgctgatctcccggaggaggaggctgttgacctgaaaacagtggcgtggctcccctgtgcccagatctggccatgggtgaggcctgcacagatgttgaatgaacatctgtttggggcattggagggaaaaggaaaggaccctgaagccaatatctgattctcggctgcaccttctcttggccaccctggccctgaccgggccagcacgtgcacactggcctcttttcatttcactagtggccgagacaccctctctggcatttatcactgttggccggtgtgatgagtatagagtgccacccaaggcaccagtcacacaagctgatgggcgtcttggctctgccgtcatgtggatgttattgtcgcgcgcgtctataattacaaggttttattcctatttaatgttattgactatagcagattttggaaatcagtgttttccatgtgaccctctttccttgcatccctattccttgtcccccacccactcttccccccatcaagaaaagaaccagcatttgtaaagctgtggacaccatcagggaagcttgttgtaacggcttttgaaggccagtaaccattgttgtggttgtgttttgtattgcttgataccatgaaagtgtaaatactgtaatgcctaatctatttatcaaaactgactactggaccggagcccagaaaccatgggtcaagttacacgtgaatttgttttgtgaagaagggaagctggggcaggtaacacgcagagccgccacgtggaacggtctgtccgccggtctgtcccgcttgccgggcttctgttgcaagtcttggcttaaggagacttcctgtgggttgccatgtcgcacgtccgttagatcttgattttacaggtgagggtggttgccaaaggtgataagaaaagcagccaacaggctccctctcacttaagagagttctaattaataacactaaattcttcctgagaaatgactcctcttggtttggtttgaagtttttcagtgaaggaaaaggcctgagataggaagcagtgccctcgcttcatgaggtggcacatcttcggtggccgttggcctggtcgagctttggtcagctgcgtgggtgcctgtctcctgtctccagcggcagggcatggttcttggcagcctggccactcgcggtctgtgtcatgacacttcccattcacatcattggcctgcgttgctggggctttgaaccaccaccccgtactttgttttgcctgtagagtgttgtaaaatattttggatgtgaatgtccttgcaggccggttagtctccagtttccacagagaccacctacccaccaccttcccaggtcacctgcctggtccctgaaagaaagcatttgtgtgggcaatcccaacatgaaatgtagacagcgtgaatacggacaggaggtgatgccatattcacagtgggggatggagggcccccacccctgcttcacagaataatgggaagtgactctagtctttgtaagcaattttcattctcattaggaagttaaatgtagattcacagatacatttactttcagaatcctcaagaggatttcaaatgctaacttttagtttcttgggattgatcaaggcaagagaagtggctttaaccatgccagccagaatgaagcatcatgggtcctgatggtttcccgttttcatggtaacaaattcgcacagaggttttgctttatactgtagaataccgactttcatgatgacaacttggtttatgcatgaatattgcagtatttccatatagcaaaataacatttctacccaggataatagtcacagttttccagggagggaatgatataattttcatgacaatgtcatgtgatgatagaatttctccattgatgaatctctagtatgtgtgtatactttatttacccatacgtatattttatgaccatgagctaagttgttatttctttcattcatatccctgctgaaatattggtactagcaacttaaagttggcaagtctcatcttcagtaatacggatgccatgggagtggccaggccagattgaaggtgaatatggagcagtagcagaagcctcattccagaacccatctggccagagaagcagcagcatcctgggggatggccgtgcatggggtgtacactcgctataggcataggcccggcatggctgtcgctggacgccagctgtgcacacccagccacacctgctgcacgccgcgttagtgtgcggctccgggcctgagcattcgcaaagctcgcttctccagggagcctcctcttggctttggaaaagagcccagggacttaacgtgctgcctgttgtactctgtcccctcatgactttttagacacagggactaggacatcgaccaccctctgcccctcctgcagtcagaacccgagtagtgcaagaacggccacccggttttgccagcgttcagcgtctgcccatggacccataaggcacattagcgttgggggtctcttttcagcagcctcacagacattcccgtcctttctggttggtgttgactgtgtttcagcatcactctaccctcccatgtccttagcattgctgtgcgtgtttccaggcacttaggacacccttccccacgttgccatcttactgacagttcaaatgactctccttttttgttcgttagtaacaatcttcatttgacaccttaatacatttctgactgttcttaaaacagtggggatgcctatattttccttgagtttttgtgactgactttggctatatatacctttctggggttttgtttgttttttatttttattttgattaccgagggtatttggggtggggttgttttttgagatgtgtaattcttttatggagtttttaaaaagaattttcatattgtttttctaacatggcttcattaaacgtttaagtattttaaaaatatgtaatatttggaccagatgttgtgaataatagtagagataaagctattttattctgtatttttaaaactgttccgtacaaataaaagctctcctggacacagttttgctcttcacgtgcctcct

SEQ ID NO: 446637 - DNA, 1554 bp, Homo sapiens
  misc_feature (1395)..(1395): n is a, c, g, or t
cattcatcttctcctgcccttggacatcacagctccaggaactcagatcttcagactcagggtgaaggacaccaccagctttccaggttccccagcttgcagacggcatacgctaggtcttgactccactaacggggacttctcatacggctttgaacttggaccttggtgcataagcaaatgtaactcagcgaattgtaatggaaagcatatggacaggtctacgccacatcacttaggtgctaagagatgccgtttgcaggcctcatctctgcttgagaatcgggggctccaggcactagaagagccggctgatcctgggctcctagcttgaataagccttcacttccagctgctctccccaacggctgtgtaaactactcgtttctcttaatgatgggtattggtaagaataccacatccaaatcaatggaggctggaagttcaacagaaggcaaatacgaagacgaggcaaagcacccagctttcttcactcttccggtggtgataaatggaggcgccacctccagcggtgagcaggacaatgaggacactgagctcatggcgatctacactacggaaaacggcattgcagaaaagagctctctcgctgagaccctggatagcactggcagtctggacccccagcgatcagacatgatttataccatagaagatgttcctccctggtacctgtgtatatttctggggctacagcactacctgacatgcttcagcggcacgatcgcagtgcccttcctgttggccgatgccatgtgtgtggggtacgaccagtgggccaccagccagctcattgggaccattttcttctgtgtgggaatcactactttgctacagacaacgtttggatgcaggttacccctgtttcaggccagtgcttttgcatttttggcccctgctcgagccatcctgtctttagataaatggaaatgtaacaccacagatgtttcagttgccaatggaacagcagagctgttgcacacagaacacatctggtatccccggatccgagagatccagggggccatcatcatgtcctcactgatagaagtagtcatcggcctcctcggcctgcctggggctctactgaagtacatcggtcccttgaccattacacccacggtggccctaattggcctctctggtttccaggcagcgggggagagagccgggaagcactggggcattgccatgctgacaatattcctagtattactgttttctcaatacgccagaaatgttaaatttcctctcccgatttataaatccaagaaaggatggactgcgtacaagttacagctgttcaaaatgttccctatcatcctggccatcctggtatcctggctgctctgcttcatcttcacggtgacagangtcttccctcccgacagcacaaagtatggcttctatgctcgcacagatgccaggcaaggcgtgcttctggtagccccgtggtttaaggttccatacccatgtaagtattctgatggctagaggggtcaagagcccacgagggcccaactgagaggggtg

SEQ ID NO: 446638 - DNA, 514 bp, Homo sapiens
  misc_feature (497)..(497): n is a, c, g, or t
ccagttcgacggagactctccagtacagtttccgctgtatatgccccgagggaccccatcaccccagctgctactcacaggtgaacgaatgcctgagcaatccctgcatccatggaaactgtactggaggtctcagtggatataagtgtctctgtgatgcaggctgggttggcatcaactgtgaagtggacaaaaatgaatgcctttcgaatccatgccagaatggaggaacttgtgacaatctggtgaatggatacaggtgtacttgcaagaagggctttaaaggctataactgccaggtgaatattgatgaatgtgcctcaaatccatgcctgaaccaaggaacctgctttgatgacataagtggctacacttgccactgtgtgctgccatacacaggcaagaattgtcagacagtattggctccctgttccccaaacccttgtgagaatgctgctgtttgcaaagagtcaccaaattttgagagtctccgtcanactggtaccgagctcga

SEQ ID NO: 446639 - DNA, 11426 bp, Homo sapiens
  misc_feature (4805)..(4805): n is a, c, g, or t
agcgggttgcacacccgagaaagtttcagccaaacttcgggcggcggctgaggcggcggccgaggagcggcggactcggggcgcggggagtcgaggcatttgcgcctgggcttcggagcgtagcgccaggcctgagcctttgaagcaggaggaggggaggagagagtggggctcctctatcgggaccccctccccatgtggatctgcccaggcggcggcggcggcggcggaggaggaggcgaccgagaagatgcccgccctgcgccccgctctgctgtgggcgctgctggcgctctggctgtgctgcgcggcccccgcgcatgcattgcagtgtcgagatggctatgaaccctgtgtaaatgaaggaatgtgtgttacctaccacaatggcacaggatactgcaaatgtccagaaggcttcttgggggaatattgtcaacatcgagacccctgtgagaagaaccgctgccagaatggtgggacttgtgtggcccaggccatgctggggaaagccacgtgccgatgtgcctcagggtttacaggagaggactgccagtactcaacatctcatccatgctttgtgtctcgaccctgcctgaatggcggcacatgccatatgctcagccgggatacctatgagtgcacctgtcaagtcgggtttacaggtaaggagtgccaatggacggatgcctgcctgtctcatccctgtgcaaatggaagtacctgtaccactgtggccaaccagttctcctgcaaatgcctcacaggcttcacagggcagaaatgtgagactgatgtcaatgagtgtgacattccaggacactgccagcatggtggcacctgcctcaacctgcctggttcctaccagtgccagtgccctcagggcttcacaggccagtactgtgacagcctgtatgtgccctgtgcaccctcaccttgtgtcaatggaggcacctgtcggcagactggtgacttcacttttgagtgcaactgccttccaggttttgaagggagcacctgtgagaggaatattgatgactgccctaaccacaggtgtcagaatggaggggtttgtgtggatggggtcaacacttacaactgccgctgtcccccacaatggacaggacagttctgcacagaggatgtggatgaatgcctgctgcagcccaatgcctgtcaaaatgggggcacctgtgccaaccgcaatggaggctatggctgtgtatgtgtcaacggctggagtggagatgactgcagtgagaacattgatgattgtgccttcgcctcctgtactccaggctccacctgcatcgaccgtgtggcctccttctcttgcatgtgcccagaggggaaggcaggtctcctgtgtcatctggatgatgcatgcatcagcaatccttgccacaagggggcactgtgtgacaccaaccccctaaatgggcaatatatttgcacctgcccacaaggctacaaaggggctgactgcacagaagatgtggatgaatgtgccatggccaatagcaatccttgtgagcatgcaggaaaatgtgtgaacacggatggcgccttccactgtgagtgtctgaagggttatgcaggacctcgttgtgagatggacatcaatgagtgccattcagacccctgccagaatgatgctacctgtctggataagattggaggcttcacatgtctgtgcatgccaggtttcaaaggtgtgcattgtgaattagaaataaatgaatgtcagagcaacccttgtgtgaacaatgggcagtgtgtggataaagtcaatcgtttccagtgcctgtgtcctcctggtttcactgggccagtttgccagattgatattgatgactgttccagtactccgtgtctgaatggggcaaagtgtatcgatcacccgaatggctatgaatgccagtgtgccacaggtttcactggtgtgttgtgtgaggagaacattgacaactgtgaccccgatccttgccaccatggtcagtgtcaggatggtattgattcctacacctgcatctgcaatcccgggtacatgggcgccatctgcagtgaccagattgatgaatgttacagcagcccttgcctgaacgatggtcgctgcattgacctggtcaatggctaccagtgcaactgccagccaggcacgtcaggggttaattgtgaaattaattttgatgactgtgcaagtaacccttgtatccatggaatctgtatggatggcattaatcgctacagttgtgtctgctcaccaggattcacagggcagagatgtaacattgacattgatgagtgtgcctccaatccctgtcgcaagggtgcaacatgtatcaacggtgtgaatggtttccgctgtatatgccccgagggaccccatcaccccagctgctactcacaggtgaacgaatgcctgagcaatccctgcatccatggaaactgtactggaggtctcagtggatataagtgtctctgtgatgcaggctgggttggcatcaactgtgaagtggacaaaaatgaatgcctttcgaatccatgccagaatggaggaacttgtgacaatctggtgaatggatacaggtgtacttgcaagaagggctttaaaggctataactgccaggtgaatattgatgaatgtgcctcaaatccatgcctgaaccaaggaacctgctttgatgacataagtggctacacttgccactgtgtgctgccatacacaggcaagaattgtcagacagtattggctccctgttccccaaacccttgtgagaatgctgctgtttgcaaagagtcaccaaattttgagagttatacttgcttgtgtgctcctggctggcaaggtcagcggtgtaccattgacattgacgagtgtatctccaagccctgcatgaaccatggtctctgccataacacccagggcagctacatgtgtgaatgtccaccaggcttcagtggtatggactgtgaggaggacattgatgactgccttgccaatccttgccagaatggaggttcctgtatggatggagtgaatactttctcctgcctctgccttccgggtttcactggggataagtgccagacagacatgaatgagtgtctgagtgaaccctgtaagaatggagggacctgctctgactacgtcaacagttacacttgcaagtgccaggcaggatttgatggagtccattgtgagaacaacatcaatgagtgcactgagagctcctgtttcaatggtggcacatgtgttgatgggattaactccttctcttgcttgtgccctgtgggtttcactggatccttctgcctccatgagatcaatgaatgcagctctcatccatgcctgaatgagggaacgtgtgttgatggcctgggtacctaccgctgcagctgccccctgggctacactgggaaaaactgtcagaccctggtgaatctctgcagtcggtctccatgtaaaaacaaaggtacttgcgttcagaaaaaagcagagtcccagtgcctatgtccatctggatgggctggtgcctattgtgacgtgcccaatgtctcttgtgacatagcagcctccaggagaggtgtgcttgttgaacacttgtgccagcactcaggtgtctgcatcaatgctggcaacacgcattactgtcagtgccccctgggctatactgggagctactgtgaggagcaactcgatgagtgtgcgtccaacccctgccagcacggggcaacatgcagtgacttcattggtggatacagatgcgagtgtgtcccaggctatcagggtgtcaactgtgagtatgaagtggatgagtgccagaatcagccctgccagaatggaggcacctgtattgaccttgtgaaccatttcaagtgctcttgcccaccaggcactcggggcctactctgtgaagagaacattgatgactgtgcccggggtccccattgccttaatggtggtcagtgcatggataggattggaggctacagttgtcgctgcttgcctggctttgctggggagcgttgtgagggagacatcaacgagtgcctctccaacccctgcagctctgagggcagcctggactgtatacagctcaccaatgactacctgtgtgtttgccgtagtgcctttactggccggcactgtgaaaccttcgtcgatgtgtgtccccagatgccctgcctgaatggagggacttgtgctgtggccagtaacatgcctgatggtttcatttgccgttgtcccccgggattttccggggcaaggtgccagagcagctgtggacaagtgaaatgtaggaagggggagcagtgtgtgcacaccgcctctggaccccgctgcttctgccccagtccccgggactgcgagtcaggctgtgccagtagcccctgccagcacgggggcagctgccaccctcagcgccagcctccttattactcctgccagtgtgccccaccattctcgggtagccgctgtgaactctacacggcaccccccagcacccctcctgccacctgtctgagccagtattgtgccgacaaagctcgggatggcgtctgtgatgaggcctgcaacagccatgcctgccagtgggatgggggtgactgttctctcaccatggagaacccctgggccaactgctcctccccacttccctgctgggattatatcaacaaccagtgtgatgagctgtgcaacacggtcgagtgcctgtttgacaactttgaatgccaggggaacagcaagacatgcaagtatgacaaatactgtgcagaccacttcaaagacaaccactgtnaccaggggtgcaacagtgaggagtgtggttgggatgggctggactgtgctgctgaccaacctgagaacctggcagaaggtaccctggttattgtggtattgatgccacctgaacaactgctccaggatgctcgcagcttcttgcgggcactgggtaccctgctccacaccaacctgcgcattaagcgggactcccagggggaactcatggtgtacccctattatggtgagaagtcagctgctatgaagaaacagaggatgacacgcagatcccttcctggtgaacaagaacaggaggtggctggctctaaagtctttctggaaattgacaaccgccagtgtgttcaagactcagaccactgcttcaagaacacggatgcagcagcagctctcctggcctctcacgccatacaggggaccctgtcataccctcttgtgtctgtcgtcagtgaatccctgactccagaacgcactcagctcctctatctccttgctgttgctgttgtcatcattctgtttattattctgctgggggtaatcatggcaaaacgaaagcgtaagcatggctctctctggctgcctgaaggtttcactcttcgccgagatgcaagcaatcacaagcgtcgtgagccagtgggacaggatgctgtggggctgaaaaatctctcagtgcaagtctcagaagctaacctaattggtactggaacaagtgaacactgggtcgatgatgaagggccccagccaaagaaagtaaaggctgaagatgaggccttactctcagaagaagatgaccccattgatcgacggccatggacacagcagcaccttgaagctgcagacatccgtaggacaccatcgctggctctcacccctcctcaggcagagcaggaggtggatgtgttagatgtgaatgtccgtggcccagatggctgcaccccattgatgttggcttctctccgaggaggcagctcagatttgagtgatgaagatgaagatgcagaggactcttctgctaacatcatcacagacttggtctaccagggtgccagcctccaggcccagacagaccggactggtgagatggccctgcaccttgcagcccgctactcacgggctgatgctgccaagcgtctcctggatgcaggtgcagatgccaatgcccaggacaacatgggccgctgtccactccatgctgcagtggcagctgatgcccaaggtgtcttccagattctgattcgcaaccgagtaactgatctagatgccaggatgaatgatggtactacacccctgatcctggctgcccgcctggctgtggagggaatggtggcagaactgatcaactgccaagcggatgtgaatgcagtggatgaccatggaaaatctgctcttcactgggcagctgctgtcaataatgtggaggcaactcttttgttgttgaaaaatggggccaaccgagacatgcaggacaacaaggaagagacacctctgtttcttgctgcccgggaggggagctatgaagcagccaagatcctgttagaccattttgccaatcgagacatcacagaccatatggatcgtcttccccgggatgtggctcgggatcgcatgcaccatgacattgtgcgccttctggatgaatacaatgtgaccccaagccctccaggcaccgtgttgacttctgctctctcacctgtcatctgtgggcccaacagatctttcctcagcctgaagcacaccccaatgggcaagaagtctagacggcccagtgccaagagtaccatgcctactagcctccctaaccttgccaaggaggcaaaggatgccaagggtagtaggaggaagaagtctctgagtgagaaggtccaactgtctgagagttcagtaactttatcccctgttgattccctagaatctcctcacacgtatgtttccgacaccacatcctctccaatgattacatccctgggatcttacaggcctcacccaaccctatgttggccactgccgcccctcctgccccagtccatgcccagcatgcactatctttttctaaccttcatgaaatgcagcctttggcacatggggccagcactgtgcttccctcagtgagccagttgctatcccaccaccacattgtgtctccaggcagtggcagtgctggaagcttgagtaggctccatccagtcccagtcccagcagattggatgaaccgcatggaggtgaatgagacccagtacaatgagatgtttggtatggtcctggctccagctgagggcacccatcctggcatagctccccagagcaggccacctgaagggaagcacataaccacccctcgggagcccttgccccccattgtgactttccagctcatccctaaaggcagtattgcccaaccagcgggggctccccagcctcagtccacctgccctccagctgttgcgggccccctgcccaccatgtaccagattccagaaatggcccgtttgcccagtgtggctttccccactgccatgatgccccagcaggacgggcaggtagctcagaccattctcccagcctatcatcctttcccagcctctgtgggcaagtaccccacacccccttcacagcacagttatgcttcctcaaatgctgctgagcgaacacccagtcacagtggtcacctccagggtgagcatccctacctgacaccatccccagagtctcctgaccagtggtcaagttcatcaccccactctgcttctgactggtcagatgtgaccaccagccctacccctgggggtgctggaggaggtcagcggggacctgggacacacatgtctgagccaccacacaacaacatgcaggtttatgcgtgagagagtccacctccagtgtagagacataactgacttttgtaaatgctgctgaggaacaaatgaaggtcatccgggagagaaatgaagaaatctctggagccagcttctagaggtaggaaagagaagatgttcttattcagataatgcaagagaagcaattcgtcagtttcactgggtatctgcaaggcttattgattattctaatctaataagacaagtttgtggaaatgcaagatgaatacaagccttgggtccatgtttactctcttctatttggagaataagatggatgcttattgaagcccagacattcttgcagcttggactgcattttaagccctgcaggcttctgccatatccatgagaagattctacactagcgtcctgttgggaattatgccctggaattctgcctgaattgacctacgcatctcctcctccttggacattcttttgtcttcatttggtgcttttggttttgcacctctccgtgattgtagccctaccagcatgttatagggcaagacctttgtgcttttgatcattctggcccatgaaagcaactttggtctcctttcccctcctgtcttcccggtatcccttggagtctcacaaggtttactttggtatggttctcagcacaaacctttcaagtatgttgtttctttggaaaatggacatactgtattgtgttctcctgcatatatcattcctggagagagaaggggagaagaatacttttcttcaacaaattttgggggcaggagatcccttcaagaggctgcaccttaatttttcttgtctgtgtgcaggtcttcatataaactttaccaggaagaagggtgtgagtttgttgtttttctgtgtatgggcctggtcagtgtaaagttttatccttgatagtctagttactatgaccctccccacttttttaaaaccagaaaaaggtttggaatgttggaatgaccaagagacaagttaactcgtgcaagagccagttacccacccacaggtccccctacttcctgccaagcattccattgactgcctgtatggaacacatttgtcccagatctgagcattctaggcctgtttcactcactcacccagcatatgaaactagtcttaactgttgagcctttcctttcatatccacagaagacactgtctcaaatgttgtacccttgccatttaggactgaactttccttagcccaagggacccagtgacagttgtcttccgtttgtcagatgatcagtctctactgattatcttgctgcttaaaggcctgctcaccaatctttctttcacaccgtgtggtccgtgttactggtatacccagtatgttctcactgaagacatggactttatatgttcaagtgcaggaattggaaagttggacttgttttctatgatccaaaacagccctataagaaggttggaaaaggaggaactatatagcagcctttgctattttctgctaccatttcttttcctctgaagcggccatgacattccctttggcaactaacgtagaaactcaacagaacattttcctttcctagagtcaccttttagatgataatggacaactatagacttgctcattgttcagactgattgcccctcacctgaatccactctctgtattcatgctcttggcaatttctttgactttcttttaagggcagaagcattttagttaattgtagataaagaatagttttcttcctcttctccttgggccagttaataattggtccatggctacactgcaacttccgtccagtgctgtgatgcccatgacacctgcaaaataagttctgcctgggcattttgtagatattaacaggtgaattcccgactcttttggtttgaatgacagttctcattccttctatggctgcaagtatgcatcagtgcttcccacttacctgatttgtctgtcggtggccccatatggaaaccctgcgtgtctgttggcataatagtttacaaatggttttttcagtcctatccaaatttattgaaccaacaaaaataattacttctgccctgagataagcagattaagtttgttcattctctgctttattctctccatgtggcaacattctgtcagcctctttcatagtgtgcaaacattttatcattctaaatggtgactctctgcccttggacccatttattattcacagatggggagaacctatctgcatggacctctgtggaccacagcgtacctgcccctttctgccctcctgctccagccccacttctgaaagtatcagctactgatccagccactggatattttatatcctcccttttccttaagcacaatgtcagaccaaattgcttgtttctttttcttggactactttaatttggatcctttgggtttggagaaagggaatgtgaaagctgtcattacagacaacaggtttcagtgatgaggaggacaacactgcctttcaaactttttactgatctcttagattttaagaactcttgaattgtgtggtatctaataaaagggaaggtaagatggataatcactttctcatttgggttctgaattggagactcagtttttatgagacacatcttttatgccatgtatagatcctcccctgctatttttggtttatttttattgttataaatgctttctttctttgactcctcttctgcctgcctttggggataggtttttttgtttgtttatttgcttcctctgttttgttttaagcatcattttcttatgtgaggtggggaagggaaaggtatgagggaaagagagtctgagaattaaaatattttagtataagcaattggctgtgatgctcaaatccattgcatcctcttattgaatttgccaatttgtaatttttgcataataaagaaccaaaggtgtaatgttttgttgagaggtggtttagggattttggccctaaccaatacattgaatgtatgatgactatttgggaggacacatttatgtacccagaggcccccactaataagtggtactatggttacttccttgtgtacatttctcttaaaagtgatattatatctgtttgtatgagaaacccagtaaccaataaaatgaccgcatattcctgactaaacgtagtaaggaaaatgcacactttgtttttacttttccgtttcattctaaaggtagttaagatgaaatttatatgaaagcatttttatcacaaaataaaaaaggtttgccaagctcagtggtgttgtattttttattttccaatactgcatccatggcctggcagtgttacctcatgatgtcataatttgctgagagagcaaattttcttttctttctgaatcccacaaagcctagcaccaaacttctttttttcttcctttaattagatcataaataaatgatcctggggaaaaagcatctgtcaaataggaaacatcacaaaactgagcactcttctgtgcactagccatagctggtgacaaacagatggttgctcagggacaaggtgccttccaatggaaatgcgaagtagttgctatagcaagaattgggaactgggatataagtcataatattaattatgctgttatgtaaatgattggtttgtaacattccttaagtgaaatttgtgtagaacttaatatacaggattataaaataatattttgtgtataaatttgttataagttcacattcatacatttatttataaagtcagtgagatatttgaacatgaaaaaaaaaa

SEQ ID NO: 446640 - DNA, 8835 bp, Homo sapiens
  misc_feature (2214)..(2214): n is a, c, g, or t
aaagatcatgggcttctccattttcaaagcctcttaatcaggacttttgacttgaattcagagaacatccttgggataaggaaaattttcgttttcttacctgttcatctgccataaactctgtcatttactttctaggcaagaattgtcagacagtattggctccctgttccccaaacccttgtgagaatgctgctgtttgcaaagagtcaccaaattttgagagttatacttgcttgtgtgctcctggctggcaaggtcagcggtgtaccattgacattgacgagtgtatctccaagccctgcatgaaccatggtctctgccataacacccagggcagctacatgtgtgaatgtccaccaggcttcagtggtatggactgtgaggaggacattgatgactgccttgccaatccttgccagaatggaggttcctgtatggatggagtgaatactttctcctgcctctgccttccgggtttcactggggataagtgccagacagacatgaatgagtgtctgagtgaaccctgtaagaatggagggacctgctctgactacgtcaacagttacacttgcaagtgccaggcaggatttgatggagtccattgtgagaacaacatcaatgagtgcactgagagctcctgtttcaatggtggcacatgtgttgatgggattaactccttctcttgcttgtgccctgtgggtttcactggatccttctgcctccatgagatcaatgaatgcagctctcatccatgcctgaatgagggaacgtgtgttgatggcctgggtacctaccgctgcagctgccccctgggctacactgggaaaaactgtcagaccctggtgaatctctgcagtcggtctccatgtaaaaacaaaggtacttgcgttcagaaaaaagcagagtcccagtgcctatgtccatctggatgggctggtgcctattgtgacgtgcccaatgtctcttgtgacatagcagcctccaggagaggtgtgcttgttgaacacttgtgccagcactcaggtgtctgcatcaatgctggcaacacgcattactgtcagtgccccctgggctatactgggagctactgtgaggagcaactcgatgagtgtgcgtccaacccctgccagcacggggcaacatgcagtgacttcattggtggatacagatgcgagtgtgtcccaggctatcagggtgtcaactgtgagtatgaagtggatgagtgccagaatcagccctgccagaatggaggcacctgtattgaccttgtgaaccatttcaagtgctcttgcccaccaggcactcggggcctactctgtgaagagaacattgatgactgtgcccggggtccccattgccttaatggtggtcagtgcatggataggattggaggctacagttgtcgctgcttgcctggctttgctggggagcgttgtgagggagacatcaacgagtgcctctccaacccctgcagctctgagggcagcctggactgtatacagctcaccaatgactacctgtgtgtttgccgtagtgcctttactggccggcactgtgaaaccttcgtcgatgtgtgtccccagatgccctgcctgaatggagggacttgtgctgtggccagtaacatgcctgatggtttcatttgccgttgtcccccgggattttccggggcaaggtgccagagcagctgtggacaagtgaaatgtaggaagggggagcagtgtgtgcacaccgcctctggaccccgctgcttctgccccagtccccgggactgcgagtcaggctgtgccagtagcccctgccagcacgggggcagctgccaccctcagcgccagcctccttattactcctgccagtgtgccccaccattctcgggtagccgctgtgaactctacacggcaccccccagcacccctcctgccacctgtctgagccagtattgtgccgacaaagctcgggatggcgtctgtgatgaggcctgcaacagccatgcctgccagtgggatgggggtgactgttctctcaccatggagaacccctgggccaactgctcctccccacttccctgctgggattatatcaacaaccagtgtgatgagctgtgcaacacggtcgagtgcctgtttgacaactttgaatgccaggggaacagcaagacatgcaagtatgacaaatactgtgcagaccacttcaaagacaaccactgtnaccaggggtgcaacagtgaggagtgtggttgggatgggctggactgtgctgctgaccaacctgagaacctggcagaaggtaccctggttattgtggtattgatgccacctgaacaactgctccaggatgctcgcagcttcttgcgggcactgggtaccctgctccacaccaacctgcgcattaagcgggactcccagggggaactcatggtgtacccctattatggtgagaagtcagctgctatgaagaaacagaggatgacacgcagatcccttcctggtgaacaagaacaggaggtggctggctctaaagtctttctggaaattgacaaccgccagtgtgttcaagactcagaccactgcttcaagaacacggatgcagcagcagctctcctggcctctcacgccatacaggggaccctgtcataccctcttgtgtctgtcgtcagtgaatccctgactccagaacgcactcagctcctctatctccttgctgttgctgttgtcatcattctgtttattattctgctgggggtaatcatggcaaaacgaaagcgtaagcatggctctctctggctgcctgaaggtttcactcttcgccgagatgcaagcaatcacaagcgtcgtgagccagtgggacaggatgctgtggggctgaaaaatctctcagtgcaagtctcagaagctaacctaattggtactggaacaagtgaacactgggtcgatgatgaagggccccagccaaagaaagtaaaggctgaagatgaggccttactctcagaagaagatgaccccattgatcgacggccatggacacagcagcaccttgaagctgcagacatccgtaggacaccatcgctggctctcacccctcctcaggcagagcaggaggtggatgtgttagatgtgaatgtccgtggcccagatggctgcaccccattgatgttggcttctctccgaggaggcagctcagatttgagtgatgaagatgaagatgcagaggactcttctgctaacatcatcacagacttggtctaccagggtgccagcctccaggcccagacagaccggactggtgagatggccctgcaccttgcagcccgctactcacgggctgatgctgccaagcgtctcctggatgcaggtgcagatgccaatgcccaggacaacatgggccgctgtccactccatgctgcagtggcagctgatgcccaaggtgtcttccagattctgattcgcaaccgagtaactgatctagatgccaggatgaatgatggtactacacccctgatcctggctgcccgcctggctgtggagggaatggtggcagaactgatcaactgccaagcggatgtgaatgcagtggatgaccatggaaaatctgctcttcactgggcagctgctgtcaataatgtggaggcaactcttttgttgttgaaaaatggggccaaccgagacatgcaggacaacaaggaagagacacctctgtttcttgctgcccgggaggggagctatgaagcagccaagatcctgttagaccattttgccaatcgagacatcacagaccatatggatcgtcttccccgggatgtggctcgggatcgcatgcaccatgacattgtgcgccttctggatgaatacaatgtgaccccaagccctccaggcaccgtgttgacttctgctctctcacctgtcatctgtgggcccaacagatctttcctcagcctgaagcacaccccaatgggcaagaagtctagacggcccagtgccaagagtaccatgcctactagcctccctaaccttgccaaggaggcaaaggatgccaagggtagtaggaggaagaagtctctgagtgagaaggtccaactgtctgagagttcagtaactttatcccctgttgattccctagaatctcctcacacgtatgtttccgacaccacatcctctccaatgattacatccctgggatcttacaggcctcacccaaccctatgttggccactgccgcccctcctgccccagtccatgcccagcatgcactatctttttctaaccttcatgaaatgcagcctttggcacatggggccagcactgtgcttccctcagtgagccagttgctatcccaccaccacattgtgtctccaggcagtggcagtgctggaagcttgagtaggctccatccagtcccagtcccagcagattggatgaaccgcatggaggtgaatgagacccagtacaatgagatgtttggtatggtcctggctccagctgagggcacccatcctggcatagctccccagagcaggccacctgaagggaagcacataaccacccctcgggagcccttgccccccattgtgactttccagctcatccctaaaggcagtattgcccaaccagcgggggctccccagcctcagtccacctgccctccagctgttgcgggccccctgcccaccatgtaccagattccagaaatggcccgtttgcccagtgtggctttccccactgccatgatgccccagcaggacgggcaggtagctcagaccattctcccagcctatcatcctttcccagcctctgtgggcaagtaccccacacccccttcacagcacagttatgcttcctcaaatgctgctgagcgaacacccagtcacagtggtcacctccagggtgagcatccctacctgacaccatccccagagtctcctgaccagtggtcaagttcatcaccccactctgcttctgactggtcagatgtgaccaccagccctacccctgggggtgctggaggaggtcagcggggacctgggacacacatgtctgagccaccacacaacaacatgcaggtttatgcgtgagagagtccacctccagtgtagagacataactgacttttgtaaatgctgctgaggaacaaatgaaggtcatccgggagagaaatgaagaaatctctggagccagcttctagaggtaggaaagagaagatgttcttattcagataatgcaagagaagcaattcgtcagtttcactgggtatctgcaaggcttattgattattctaatctaataagacaagtttgtggaaatgcaagatgaatacaagccttgggtccatgtttactctcttctatttggagaataagatggatgcttattgaagcccagacattcttgcagcttggactgcattttaagccctgcaggcttctgccatatccatgagaagattctacactagcgtcctgttgggaattatgccctggaattctgcctgaattgacctacgcatctcctcctccttggacattcttttgtcttcatttggtgcttttggttttgcacctctccgtgattgtagccctaccagcatgttatagggcaagacctttgtgcttttgatcattctggcccatgaaagcaactttggtctcctttcccctcctgtcttcccggtatcccttggagtctcacaaggtttactttggtatggttctcagcacaaacctttcaagtatgttgtttctttggaaaatggacatactgtattgtgttctcctgcatatatcattcctggagagagaaggggagaagaatacttttcttcaacaaattttgggggcaggagatcccttcaagaggctgcaccttaatttttcttgtctgtgtgcaggtcttcatataaactttaccaggaagaagggtgtgagtttgttgtttttctgtgtatgggcctggtcagtgtaaagttttatccttgatagtctagttactatgaccctccccacttttttaaaaccagaaaaaggtttggaatgttggaatgaccaagagacaagttaactcgtgcaagagccagttacccacccacaggtccccctacttcctgccaagcattccattgactgcctgtatggaacacatttgtcccagatctgagcattctaggcctgtttcactcactcacccagcatatgaaactagtcttaactgttgagcctttcctttcatatccacagaagacactgtctcaaatgttgtacccttgccatttaggactgaactttccttagcccaagggacccagtgacagttgtcttccgtttgtcagatgatcagtctctactgattatcttgctgcttaaaggcctgctcaccaatctttctttcacaccgtgtggtccgtgttactggtatacccagtatgttctcactgaagacatggactttatatgttcaagtgcaggaattggaaagttggacttgttttctatgatccaaaacagccctataagaaggttggaaaaggaggaactatatagcagcctttgctattttctgctaccatttcttttcctctgaagcggccatgacattccctttggcaactaacgtagaaactcaacagaacattttcctttcctagagtcaccttttagatgataatggacaactatagacttgctcattgttcagactgattgcccctcacctgaatccactctctgtattcatgctcttggcaatttctttgactttcttttaagggcagaagcattttagttaattgtagataaagaatagttttcttcctcttctccttgggccagttaataattggtccatggctacactgcaacttccgtccagtgctgtgatgcccatgacacctgcaaaataagttctgcctgggcattttgtagatattaacaggtgaattcccgactcttttggtttgaatgacagttctcattccttctatggctgcaagtatgcatcagtgcttcccacttacctgatttgtctgtcggtggccccatatggaaaccctgcgtgtctgttggcataatagtttacaaatggttttttcagtcctatccaaatttattgaaccaacaaaaataattacttctgccctgagataagcagattaagtttgttcattctctgctttattctctccatgtggcaacattctgtcagcctctttcatagtgtgcaaacattttatcattctaaatggtgactctctgcccttggacccatttattattcacagatggggagaacctatctgcatggacctctgtggaccacagcgtacctgcccctttctgccctcctgctccagccccacttctgaaagtatcagctactgatccagccactggatattttatatcctcccttttccttaagcacaatgtcagaccaaattgcttgtttctttttcttggactactttaatttggatcctttgggtttggagaaagggaatgtgaaagctgtcattacagacaacaggtttcagtgatgaggaggacaacactgcctttcaaactttttactgatctcttagattttaagaactcttgaattgtgtggtatctaataaaagggaaggtaagatggataatcactttctcatttgggttctgaattggagactcagtttttatgagacacatcttttatgccatgtatagatcctcccctgctatttttggtttatttttattgttataaatgctttctttctttgactcctcttctgcctgcctttggggataggtttttttgtttgtttatttgcttcctctgttttgttttaagcatcattttcttatgtgaggtggggaagggaaaggtatgagggaaagagagtctgagaattaaaatattttagtataagcaattggctgtgatgctcaaatccattgcatcctcttattgaatttgccaatttgtaatttttgcataataaagaaccaaaggtgtaatgttttgttgagaggtggtttagggattttggccctaaccaatacattgaatgtatgatgactatttgggaggacacatttatgtacccagaggcccccactaataagtggtactatggttacttccttgtgtacatttctcttaaaagtgatattatatctgtttgtatgagaaacccagtaaccaataaaatgaccgcatattcctgactaaacgtagtaaggaaaatgcacactttgtttttacttttccgtttcattctaaaggtagttaagatgaaatttatatgaaagcatttttatcacaaaataaaaaaggtttgccaagctcagtggtgttgtattttttattttccaatactgcatccatggcctggcagtgttacctcatgatgtcataatttgctgagagagcaaattttcttttctttctgaatcccacaaagcctagcaccaaacttctttttttcttcctttaattagatcataaataaatgatcctggggaaaaagcatctgtcaaataggaaacatcacaaaactgagcactcttctgtgcactagccatagctggtgacaaacagatggttgctcagggacaaggtgccttccaatggaaatgcgaagtagttgctatagcaagaattgggaactgggatataagtcataatattaattatgctgttatgtaaatgattggtttgtaacattccttaagtgaaatttgtgtagaacttaatatacaggattataaaataatattttgtgtataaatttgttataagttcacattcatacatttatttataaagtcagtgagatatttgaacatgaaaaaaaaaa

SEQ ID NO: 446641 - DNA, 8011 bp, Homo sapiens
  misc_feature (1390)..(1390): n is a, c, g, or t
cccctgcctctgtttcagaccctggtgaatctctgcagtcggtctccatgtaaaaacaaaggtacttgcgttcagaaaaaagcagagtcccagtgcctatgtccatctggatgggctggtgcctattgtgacgtgcccaatgtctcttgtgacatagcagcctccaggagaggtgtgcttgttgaacacttgtgccagcactcaggtgtctgcatcaatgctggcaacacgcattactgtcagtgccccctgggctatactgggagctactgtgaggagcaactcgatgagtgtgcgtccaacccctgccagcacggggcaacatgcagtgacttcattggtggatacagatgcgagtgtgtcccaggctatcagggtgtcaactgtgagtatgaagtggatgagtgccagaatcagccctgccagaatggaggcacctgtattgaccttgtgaaccatttcaagtgctcttgcccaccaggcactcggggcctactctgtgaagagaacattgatgactgtgcccggggtccccattgccttaatggtggtcagtgcatggataggattggaggctacagttgtcgctgcttgcctggctttgctggggagcgttgtgagggagacatcaacgagtgcctctccaacccctgcagctctgagggcagcctggactgtatacagctcaccaatgactacctgtgtgtttgccgtagtgcctttactggccggcactgtgaaaccttcgtcgatgtgtgtccccagatgccctgcctgaatggagggacttgtgctgtggccagtaacatgcctgatggtttcatttgccgttgtcccccgggattttccggggcaaggtgccagagcagctgtggacaagtgaaatgtaggaagggggagcagtgtgtgcacaccgcctctggaccccgctgcttctgccccagtccccgggactgcgagtcaggctgtgccagtagcccctgccagcacgggggcagctgccaccctcagcgccagcctccttattactcctgccagtgtgccccaccattctcgggtagccgctgtgaactctacacggcaccccccagcacccctcctgccacctgtctgagccagtattgtgccgacaaagctcgggatggcgtctgtgatgaggcctgcaacagccatgcctgccagtgggatgggggtgactgttctctcaccatggagaacccctgggccaactgctcctccccacttccctgctgggattatatcaacaaccagtgtgatgagctgtgcaacacggtcgagtgcctgtttgacaactttgaatgccaggggaacagcaagacatgcaagtatgacaaatactgtgcagaccacttcaaagacaaccactgtnaccaggggtgcaacagtgaggagtgtggttgggatgggctggactgtgctgctgaccaacctgagaacctggcagaaggtaccctggttattgtggtattgatgccacctgaacaactgctccaggatgctcgcagcttcttgcgggcactgggtaccctgctccacaccaacctgcgcattaagcgggactcccagggggaactcatggtgtacccctattatggtgagaagtcagctgctatgaagaaacagaggatgacacgcagatcccttcctggtgaacaagaacaggaggtggctggctctaaagtctttctggaaattgacaaccgccagtgtgttcaagactcagaccactgcttcaagaacacggatgcagcagcagctctcctggcctctcacgccatacaggggaccctgtcataccctcttgtgtctgtcgtcagtgaatccctgactccagaacgcactcagctcctctatctccttgctgttgctgttgtcatcattctgtttattattctgctgggggtaatcatggcaaaacgaaagcgtaagcatggctctctctggctgcctgaaggtttcactcttcgccgagatgcaagcaatcacaagcgtcgtgagccagtgggacaggatgctgtggggctgaaaaatctctcagtgcaagtctcagaagctaacctaattggtactggaacaagtgaacactgggtcgatgatgaagggccccagccaaagaaagtaaaggctgaagatgaggccttactctcagaagaagatgaccccattgatcgacggccatggacacagcagcaccttgaagctgcagacatccgtaggacaccatcgctggctctcacccctcctcaggcagagcaggaggtggatgtgttagatgtgaatgtccgtggcccagatggctgcaccccattgatgttggcttctctccgaggaggcagctcagatttgagtgatgaagatgaagatgcagaggactcttctgctaacatcatcacagacttggtctaccagggtgccagcctccaggcccagacagaccggactggtgagatggccctgcaccttgcagcccgctactcacgggctgatgctgccaagcgtctcctggatgcaggtgcagatgccaatgcccaggacaacatgggccgctgtccactccatgctgcagtggcagctgatgcccaaggtgtcttccagattctgattcgcaaccgagtaactgatctagatgccaggatgaatgatggtactacacccctgatcctggctgcccgcctggctgtggagggaatggtggcagaactgatcaactgccaagcggatgtgaatgcagtggatgaccatggaaaatctgctcttcactgggcagctgctgtcaataatgtggaggcaactcttttgttgttgaaaaatggggccaaccgagacatgcaggacaacaaggaagagacacctctgtttcttgctgcccgggaggggagctatgaagcagccaagatcctgttagaccattttgccaatcgagacatcacagaccatatggatcgtcttccccgggatgtggctcgggatcgcatgcaccatgacattgtgcgccttctggatgaatacaatgtgaccccaagccctccaggcaccgtgttgacttctgctctctcacctgtcatctgtgggcccaacagatctttcctcagcctgaagcacaccccaatgggcaagaagtctagacggcccagtgccaagagtaccatgcctactagcctccctaaccttgccaaggaggcaaaggatgccaagggtagtaggaggaagaagtctctgagtgagaaggtccaactgtctgagagttcagtaactttatcccctgttgattccctagaatctcctcacacgtatgtttccgacaccacatcctctccaatgattacatccctgggatcttacaggcctcacccaaccctatgttggccactgccgcccctcctgccccagtccatgcccagcatgcactatctttttctaaccttcatgaaatgcagcctttggcacatggggccagcactgtgcttccctcagtgagccagttgctatcccaccaccacattgtgtctccaggcagtggcagtgctggaagcttgagtaggctccatccagtcccagtcccagcagattggatgaaccgcatggaggtgaatgagacccagtacaatgagatgtttggtatggtcctggctccagctgagggcacccatcctggcatagctccccagagcaggccacctgaagggaagcacataaccacccctcgggagcccttgccccccattgtgactttccagctcatccctaaaggcagtattgcccaaccagcgggggctccccagcctcagtccacctgccctccagctgttgcgggccccctgcccaccatgtaccagattccagaaatggcccgtttgcccagtgtggctttccccactgccatgatgccccagcaggacgggcaggtagctcagaccattctcccagcctatcatcctttcccagcctctgtgggcaagtaccccacacccccttcacagcacagttatgcttcctcaaatgctgctgagcgaacacccagtcacagtggtcacctccagggtgagcatccctacctgacaccatccccagagtctcctgaccagtggtcaagttcatcaccccactctgcttctgactggtcagatgtgaccaccagccctacccctgggggtgctggaggaggtcagcggggacctgggacacacatgtctgagccaccacacaacaacatgcaggtttatgcgtgagagagtccacctccagtgtagagacataactgacttttgtaaatgctgctgaggaacaaatgaaggtcatccgggagagaaatgaagaaatctctggagccagcttctagaggtaggaaagagaagatgttcttattcagataatgcaagagaagcaattcgtcagtttcactgggtatctgcaaggcttattgattattctaatctaataagacaagtttgtggaaatgcaagatgaatacaagccttgggtccatgtttactctcttctatttggagaataagatggatgcttattgaagcccagacattcttgcagcttggactgcattttaagccctgcaggcttctgccatatccatgagaagattctacactagcgtcctgttgggaattatgccctggaattctgcctgaattgacctacgcatctcctcctccttggacattcttttgtcttcatttggtgcttttggttttgcacctctccgtgattgtagccctaccagcatgttatagggcaagacctttgtgcttttgatcattctggcccatgaaagcaactttggtctcctttcccctcctgtcttcccggtatcccttggagtctcacaaggtttactttggtatggttctcagcacaaacctttcaagtatgttgtttctttggaaaatggacatactgtattgtgttctcctgcatatatcattcctggagagagaaggggagaagaatacttttcttcaacaaattttgggggcaggagatcccttcaagaggctgcaccttaatttttcttgtctgtgtgcaggtcttcatataaactttaccaggaagaagggtgtgagtttgttgtttttctgtgtatgggcctggtcagtgtaaagttttatccttgatagtctagttactatgaccctccccacttttttaaaaccagaaaaaggtttggaatgttggaatgaccaagagacaagttaactcgtgcaagagccagttacccacccacaggtccccctacttcctgccaagcattccattgactgcctgtatggaacacatttgtcccagatctgagcattctaggcctgtttcactcactcacccagcatatgaaactagtcttaactgttgagcctttcctttcatatccacagaagacactgtctcaaatgttgtacccttgccatttaggactgaactttccttagcccaagggacccagtgacagttgtcttccgtttgtcagatgatcagtctctactgattatcttgctgcttaaaggcctgctcaccaatctttctttcacaccgtgtggtccgtgttactggtatacccagtatgttctcactgaagacatggactttatatgttcaagtgcaggaattggaaagttggacttgttttctatgatccaaaacagccctataagaaggttggaaaaggaggaactatatagcagcctttgctattttctgctaccatttcttttcctctgaagcggccatgacattccctttggcaactaacgtagaaactcaacagaacattttcctttcctagagtcaccttttagatgataatggacaactatagacttgctcattgttcagactgattgcccctcacctgaatccactctctgtattcatgctcttggcaatttctttgactttcttttaagggcagaagcattttagttaattgtagataaagaatagttttcttcctcttctccttgggccagttaataattggtccatggctacactgcaacttccgtccagtgctgtgatgcccatgacacctgcaaaataagttctgcctgggcattttgtagatattaacaggtgaattcccgactcttttggtttgaatgacagttctcattccttctatggctgcaagtatgcatcagtgcttcccacttacctgatttgtctgtcggtggccccatatggaaaccctgcgtgtctgttggcataatagtttacaaatggttttttcagtcctatccaaatttattgaaccaacaaaaataattacttctgccctgagataagcagattaagtttgttcattctctgctttattctctccatgtggcaacattctgtcagcctctttcatagtgtgcaaacattttatcattctaaatggtgactctctgcccttggacccatttattattcacagatggggagaacctatctgcatggacctctgtggaccacagcgtacctgcccctttctgccctcctgctccagccccacttctgaaagtatcagctactgatccagccactggatattttatatcctcccttttccttaagcacaatgtcagaccaaattgcttgtttctttttcttggactactttaatttggatcctttgggtttggagaaagggaatgtgaaagctgtcattacagacaacaggtttcagtgatgaggaggacaacactgcctttcaaactttttactgatctcttagattttaagaactcttgaattgtgtggtatctaataaaagggaaggtaagatggataatcactttctcatttgggttctgaattggagactcagtttttatgagacacatcttttatgccatgtatagatcctcccctgctatttttggtttatttttattgttataaatgctttctttctttgactcctcttctgcctgcctttggggataggtttttttgtttgtttatttgcttcctctgttttgttttaagcatcattttcttatgtgaggtggggaagggaaaggtatgagggaaagagagtctgagaattaaaatattttagtataagcaattggctgtgatgctcaaatccattgcatcctcttattgaatttgccaatttgtaatttttgcataataaagaaccaaaggtgtaatgttttgttgagaggtggtttagggattttggccctaaccaatacattgaatgtatgatgactatttgggaggacacatttatgtacccagaggcccccactaataagtggtactatggttacttccttgtgtacatttctcttaaaagtgatattatatctgtttgtatgagaaacccagtaaccaataaaatgaccgcatattcctgactaaacgtagtaaggaaaatgcacactttgtttttacttttccgtttcattctaaaggtagttaagatgaaatttatatgaaagcatttttatcacaaaataaaaaaggtttgccaagctcagtggtgttgtattttttattttccaatactgcatccatggcctggcagtgttacctcatgatgtcataatttgctgagagagcaaattttcttttctttctgaatcccacaaagcctagcaccaaacttctttttttcttcctttaattagatcataaataaatgatcctggggaaaaagcatctgtcaaataggaaacatcacaaaactgagcactcttctgtgcactagccatagctggtgacaaacagatggttgctcagggacaaggtgccttccaatggaaatgcgaagtagttgctatagcaagaattgggaactgggatataagtcataatattaattatgctgttatgtaaatgattggtttgtaacattccttaagtgaaatttgtgtagaacttaatatacaggattataaaataatattttgtgtataaatttgttataagttcacattcatacatttatttataaagtcagtgagatatttgaacatgaaaaaaaaaa

SEQ ID NO: 446642 - DNA, 8226 bp, Homo sapiens
  misc_feature (4805)..(4805): n is a, c, g, or t
agcgggttgcacacccgagaaagtttcagccaaacttcgggcggcggctgaggcggcggccgaggagcggcggactcggggcgcggggagtcgaggcatttgcgcctgggcttcggagcgtagcgccaggcctgagcctttgaagcaggaggaggggaggagagagtggggctcctctatcgggaccccctccccatgtggatctgcccaggcggcggcggcggcggcggaggaggaggcgaccgagaagatgcccgccctgcgccccgctctgctgtgggcgctgctggcgctctggctgtgctgcgcggcccccgcgcatgcattgcagtgtcgagatggctatgaaccctgtgtaaatgaaggaatgtgtgttacctaccacaatggcacaggatactgcaaatgtccagaaggcttcttgggggaatattgtcaacatcgagacccctgtgagaagaaccgctgccagaatggtgggacttgtgtggcccaggccatgctggggaaagccacgtgccgatgtgcctcagggtttacaggagaggactgccagtactcaacatctcatccatgctttgtgtctcgaccctgcctgaatggcggcacatgccatatgctcagccgggatacctatgagtgcacctgtcaagtcgggtttacaggtaaggagtgccaatggacggatgcctgcctgtctcatccctgtgcaaatggaagtacctgtaccactgtggccaaccagttctcctgcaaatgcctcacaggcttcacagggcagaaatgtgagactgatgtcaatgagtgtgacattccaggacactgccagcatggtggcacctgcctcaacctgcctggttcctaccagtgccagtgccctcagggcttcacaggccagtactgtgacagcctgtatgtgccctgtgcaccctcaccttgtgtcaatggaggcacctgtcggcagactggtgacttcacttttgagtgcaactgccttccaggttttgaagggagcacctgtgagaggaatattgatgactgccctaaccacaggtgtcagaatggaggggtttgtgtggatggggtcaacacttacaactgccgctgtcccccacaatggacaggacagttctgcacagaggatgtggatgaatgcctgctgcagcccaatgcctgtcaaaatgggggcacctgtgccaaccgcaatggaggctatggctgtgtatgtgtcaacggctggagtggagatgactgcagtgagaacattgatgattgtgccttcgcctcctgtactccaggctccacctgcatcgaccgtgtggcctccttctcttgcatgtgcccagaggggaaggcaggtctcctgtgtcatctggatgatgcatgcatcagcaatccttgccacaagggggcactgtgtgacaccaaccccctaaatgggcaatatatttgcacctgcccacaaggctacaaaggggctgactgcacagaagatgtggatgaatgtgccatggccaatagcaatccttgtgagcatgcaggaaaatgtgtgaacacggatggcgccttccactgtgagtgtctgaagggttatgcaggacctcgttgtgagatggacatcaatgagtgccattcagacccctgccagaatgatgctacctgtctggataagattggaggcttcacatgtctgtgcatgccaggtttcaaaggtgtgcattgtgaattagaaataaatgaatgtcagagcaacccttgtgtgaacaatgggcagtgtgtggataaagtcaatcgtttccagtgcctgtgtcctcctggtttcactgggccagtttgccagattgatattgatgactgttccagtactccgtgtctgaatggggcaaagtgtatcgatcacccgaatggctatgaatgccagtgtgccacaggtttcactggtgtgttgtgtgaggagaacattgacaactgtgaccccgatccttgccaccatggtcagtgtcaggatggtattgattcctacacctgcatctgcaatcccgggtacatgggcgccatctgcagtgaccagattgatgaatgttacagcagcccttgcctgaacgatggtcgctgcattgacctggtcaatggctaccagtgcaactgccagccaggcacgtcaggggttaattgtgaaattaattttgatgactgtgcaagtaacccttgtatccatggaatctgtatggatggcattaatcgctacagttgtgtctgctcaccaggattcacagggcagagatgtaacattgacattgatgagtgtgcctccaatccctgtcgcaagggtgcaacatgtatcaacggtgtgaatggtttccgctgtatatgccccgagggaccccatcaccccagctgctactcacaggtgaacgaatgcctgagcaatccctgcatccatggaaactgtactggaggtctcagtggatataagtgtctctgtgatgcaggctgggttggcatcaactgtgaagtggacaaaaatgaatgcctttcgaatccatgccagaatggaggaacttgtgacaatctggtgaatggatacaggtgtacttgcaagaagggctttaaaggctataactgccaggtgaatattgatgaatgtgcctcaaatccatgcctgaaccaaggaacctgctttgatgacataagtggctacacttgccactgtgtgctgccatacacaggcaagaattgtcagacagtattggctccctgttccccaaacccttgtgagaatgctgctgtttgcaaagagtcaccaaattttgagagttatacttgcttgtgtgctcctggctggcaaggtcagcggtgtaccattgacattgacgagtgtatctccaagccctgcatgaaccatggtctctgccataacacccagggcagctacatgtgtgaatgtccaccaggcttcagtggtatggactgtgaggaggacattgatgactgccttgccaatccttgccagaatggaggttcctgtatggatggagtgaatactttctcctgcctctgccttccgggtttcactggggataagtgccagacagacatgaatgagtgtctgagtgaaccctgtaagaatggagggacctgctctgactacgtcaacagttacacttgcaagtgccaggcaggatttgatggagtccattgtgagaacaacatcaatgagtgcactgagagctcctgtttcaatggtggcacatgtgttgatgggattaactccttctcttgcttgtgccctgtgggtttcactggatccttctgcctccatgagatcaatgaatgcagctctcatccatgcctgaatgagggaacgtgtgttgatggcctgggtacctaccgctgcagctgccccctgggctacactgggaaaaactgtcagaccctggtgaatctctgcagtcggtctccatgtaaaaacaaaggtacttgcgttcagaaaaaagcagagtcccagtgcctatgtccatctggatgggctggtgcctattgtgacgtgcccaatgtctcttgtgacatagcagcctccaggagaggtgtgcttgttgaacacttgtgccagcactcaggtgtctgcatcaatgctggcaacacgcattactgtcagtgccccctgggctatactgggagctactgtgaggagcaactcgatgagtgtgcgtccaacccctgccagcacggggcaacatgcagtgacttcattggtggatacagatgcgagtgtgtcccaggctatcagggtgtcaactgtgagtatgaagtggatgagtgccagaatcagccctgccagaatggaggcacctgtattgaccttgtgaaccatttcaagtgctcttgcccaccaggcactcggggcctactctgtgaagagaacattgatgactgtgcccggggtccccattgccttaatggtggtcagtgcatggataggattggaggctacagttgtcgctgcttgcctggctttgctggggagcgttgtgagggagacatcaacgagtgcctctccaacccctgcagctctgagggcagcctggactgtatacagctcaccaatgactacctgtgtgtttgccgtagtgcctttactggccggcactgtgaaaccttcgtcgatgtgtgtccccagatgccctgcctgaatggagggacttgtgctgtggccagtaacatgcctgatggtttcatttgccgttgtcccccgggattttccggggcaaggtgccagagcagctgtggacaagtgaaatgtaggaagggggagcagtgtgtgcacaccgcctctggaccccgctgcttctgccccagtccccgggactgcgagtcaggctgtgccagtagcccctgccagcacgggggcagctgccaccctcagcgccagcctccttattactcctgccagtgtgccccaccattctcgggtagccgctgtgaactctacacggcaccccccagcacccctcctgccacctgtctgagccagtattgtgccgacaaagctcgggatggcgtctgtgatgaggcctgcaacagccatgcctgccagtgggatgggggtgactgttctctcaccatggagaacccctgggccaactgctcctccccacttccctgctgggattatatcaacaaccagtgtgatgagctgtgcaacacggtcgagtgcctgtttgacaactttgaatgccaggggaacagcaagacatgcaagtatgacaaatactgtgcagaccacttcaaagacaaccactgtnaccaggggtgcaacagtgaggagtgtggttgggatgggctggactgtgctgctgaccaacctgagaacctggcagaaggtaccctggttattgtggtattgatgccacctgaacaactgctccaggatgctcgcagcttcttgcgggcactgggtaccctgctccacaccaacctgcgcattaagcgggactcccagggggaactcatggtgtacccctattatggtgagaagtcagctgctatgaagaaacagaggatgacacgcagatcccttcctggtgaacaagaacaggaggtggctggctctaaagtctttctggaaattgacaaccgccagtgtgttcaagactcagaccactgcttcaagaacacggatgcagcagcagctctcctggcctctcacgccatacaggggaccctgtcataccctcttgtgtctgtcgtcagtgaatccctgactccagaacgcactcagctcctctatctccttgctgttgctgttgtcatcattctgtttattattctgctgggggtaatcatggcaaaacgaaagcgtaagcatggctctctctggctgcctgaaggtttcactcttcgccgagatgcaagcaatcacaagcgtcgtgagccagtgggacaggatgctgtggggctgaaaaatctctcagtgcaagtctcagaagctaacctaattggtactggaacaagtgaacactgggtcgatgatgaagggccccagccaaagaaagtaaaggctgaagatgaggccttactctcagaagaagatgaccccattgatcgacggccatggacacagcagcaccttgaagctgcagacatccgtaggacaccatcgctggctctcacccctcctcaggcagagcaggaggtggatgtgttagatgtgaatgtccgtggcccagatggctgcaccccattgatgttggcttctctccgaggaggcagctcagatttgagtgatgaagatgaagatgcagaggactcttctgctaacatcatcacagacttggtctaccagggtgccagcctccaggcccagacagaccggactggtgagatggccctgcaccttgcagcccgctactcacgggctgatgctgccaagcgtctcctggatgcaggtgcagatgccaatgcccaggacaacatgggccgctgtccactccatgctgcagtggcagctgatgcccaaggtgtcttccagattctgattcgcaaccgagtaactgatctagatgccaggatgaatgatggtactacacccctgatcctggctgcccgcctggctgtggagggaatggtggcagaactgatcaactgccaagcggatgtgaatgcagtggatgaccatggaaaatctgctcttcactgggcagctgctgtcaataatgtggaggcaactcttttgttgttgaaaaatggggccaaccgagacatgcaggacaacaaggaagagacacctctgtttcttgctgcccgggaggggagctatgaagcagccaagatcctgttagaccattttgccaatcgagacatcacagaccatatggatcgtcttccccgggatgtggctcgggatcgcatgcaccatgacattgtgcgccttctggatgaatacaatgtgaccccaagccctccaggcaccgtgttgacttctgctctctcacctgtcatctgtgggcccaacagatctttcctcagcctgaagcacaccccaatgggcaagaagtctagacggcccagtgccaagagtaccatgcctactagcctccctaaccttgccaaggaggcaaaggatgccaagggtagtaggaggaagaagtctctgagtgagaaggtccaactgtctgagagttcagtaactttatcccctgttgattccctagaatctcctcacacgtatgtttccgacaccacatcctctccaatgattacatccctgggatcttacaggcctcacccaaccctatgttggccactgccgcccctcctgccccagtccatgcccagcatgcactatctttttctaaccttcatgaaatgcagcctttggcacatggggccagcactgtgcttccctcagtgagccagttgctatcccaccaccacattgtgtctccaggcagtggcagtgctggaagcttgagtaggctccatccagtcccagtcccagcagattggatgaaccgcatggaggtgaatgagacccagtacaatgagatgtttggtatggtcctggctccagctgagggcacccatcctggcatagctccccagagcaggccacctgaagggaagcacataaccacccctcgggagcccttgccccccattgtgactttccagctcatccctaaaggcagtattgcccaaccagcgggggctccccagcctcagtccacctgccctccagctgttgcgggccccctgcccaccatgtaccagattccagaaatggcccgtttgcccagtgtggctttccccactgccatgatgccccagcaggacgggcaggtagctcagaccattctcccagcctatcatcctttcccagcctctgtgggcaagtaccccacacccccttcacagcacagttatgcttcctcaaatgctgctgagcgaacacccagtcacagtggtcacctccagggtgagcatccctacctgacaccatccccagagtctcctgaccagtggtcaagttcatcaccccactctgcttctgactggtcagatgtgaccaccagccctacccctgggggtgctggaggaggtcagcggggacctgggacacacatgtctgagccaccacacaacaacatgcaggtttatgcgtgagagagtccacctccagtgtagagacataactgacttttgtaaatgctgctgaggaacaaatgaaggtcatccgggagagaaatgaagaaatctctggagccagcttctagaggtaggaaagagaagatgttcttattcagataatgcaagagaagcaattcgtcagtttcactgggtatctgcaaggcttattgattattctaatctaataagacaagtttgtggaaatgcaagatgaatacaagccttgggtccatgtttactctcttctatttggagaataagatggatgcttattgaagcccagacattcttgcagcttggactgcattttaagccctgcaggcttctgccatatccatgagaagattctacactagcgtcctgttgggaattatgccctggaattctgcctgaattgacctacgcatctcctcctccttggacatggtgttttcataatctggacacttggaaacgaaccgtcctccgtaagctacgcaactaccacagtatacatggtaaagacctctcgctacgtacacacatgtaagtaaagac

SEQ ID NO: 446643 - DNA, 4267 bp, Homo sapiens
agcgggttgcacacccgagaaagtttcagccaaacttcgggcggcggctgaggcggcggccgaggagcggcggactcggggcgcggggagtcgaggcatttgcgcctgggcttcggagcgtagcgccaggcctgagcctttgaagcaggaggaggggaggagagagtggggctcctctatcgggaccccctccccatgtggatctgcccaggcggcggcggcggcggcggaggaggaggcgaccgagaagatgcccgccctgcgccccgctctgctgtgggcgctgctggcgctctggctgtgctgcgcggcccccgcgcatgcattgcagtgtcgagatggctatgaaccctgtgtaaatgaaggaatgtgtgttacctaccacaatggcacaggatactgcaaatgtccagaaggcttcttgggggaatattgtcaacatcgagacccctgtgagaagaaccgctgccagaatggtgggacttgtgtggcccaggccatgctggggaaagccacgtgccgatgtgcctcagggtttacaggagaggactgccagtactcaacatctcatccatgctttgtgtctcgaccctgcctgaatggcggcacatgccatatgctcagccgggatacctatgagtgcacctgtcaagtcgggtttacaggtaaggagtgccaatggacggatgcctgcctgtctcatccctgtgcaaatggaagtacctgtaccactgtggccaaccagttctcctgcaaatgcctcacaggcttcacagggcagaaatgtgagactgatgtcaatgagtgtgacattccaggacactgccagcatggtggcacctgcctcaacctgcctggttcctaccagtgccagtgccctcagggcttcacaggccagtactgtgacagcctgtatgtgccctgtgcaccctcaccttgtgtcaatggaggcacctgtcggcagactggtgacttcacttttgagtgcaactgccttccaggttttgaagggagcacctgtgagaggaatattgatgactgccctaaccacaggtgtcagaatggaggggtttgtgtggatggggtcaacacttacaactgccgctgtcccccacaatggacaggacagttctgcacagaggatgtggatgaatgcctgctgcagcccaatgcctgtcaaaatgggggcacctgtgccaaccgcaatggaggctatggctgtgtatgtgtcaacggctggagtggagatgactgcagtgagaacattgatgattgtgccttcgcctcctgtactccaggctccacctgcatcgaccgtgtggcctccttctcttgcatgtgcccagaggggaaggcaggtctcctgtgtcatctggatgatgcatgcatcagcaatccttgccacaagggggcactgtgtgacaccaaccccctaaatgggcaatatatttgcacctgcccacaaggctacaaaggggctgactgcacagaagatgtggatgaatgtgccatggccaatagcaatccttgtgagcatgcaggaaaatgtgtgaacacggatggcgccttccactgtgagtgtctgaagggttatgcaggacctcgttgtgagatggacatcaatgagtgccattcagacccctgccagaatgatgctacctgtctggataagattggaggcttcacatgtctgtgcatgccaggtttcaaaggtgtgcattgtgaattagaaataaatgaatgtcagagcaacccttgtgtgaacaatgggcagtgtgtggataaagtcaatcgtttccagtgcctgtgtcctcctggtttcactgggccagtttgccagattgatattgatgactgttccagtactccgtgtctgaatggggcaaagtgtatcgatcacccgaatggctatgaatgccagtgtgccacaggtttcactggtgtgttgtgtgaggagaacattgacaactgtgaccccgatccttgccaccatggtcagtgtcaggatggtattgattcctacacctgcatctgcaatcccgggtacatgggcgccatctgcagtgaccagattgatgaatgttacagcagcccttgcctgaacgatggtcgctgcattgacctggtcaatggctaccagtgcaactgccagccaggcacgtcaggggttaattgtgaaattaattttgatgactgtgcaagtaacccttgtatccatggaatctgtatggatggcattaatcgctacagttgtgtctgctcaccaggattcacagggcagagatgtaacattgacattgatgagtgtgcctccaatccctgtcgcaagggtgcaacatgtatcaacggtgtgaatggtttccgctgtatatgccccgagggaccccatcaccccagctgctactcacaggtgaacgaatgcctgagcaatccctgcatccatggaaactgtactggaggtctcagtggatataagtgtctctgtgatgcaggctgggttggcatcaactgtgaagtggacaaaaatgaatgcctttcgaatccatgccagaatggaggaacttgtgacaatctggtgaatggatacaggtgtacttgcaagaagggctttaaaggctataactgccaggtgaatattgatgaatgtgcctcaaatccatgcctgaaccaaggaacctgctttgatgacataagtggctacacttgccactgtgtgctgccatacacaggcaagaattgtcagacagtattggctccctgttccccaaacccttgtgagaatgctgctgtttgcaaagagtcaccaaattttgagagttatacttgcttgtgtgctcctggctggcaaggtcagcggtgtaccattgacattgacgagtgtatctccaagccctgcatgaaccatggtctctgccataacacccagggcagctacatgtgtgaatgtccaccaggcttcagtggtatggactgtgaggaggacattgatgactgccttgccaatccttgccagaatggaggttcctgtatggatggagtgaatactttctcctgcctctgccttccgggtttcactggggataagtgccagacagacatgaatgagtgtctgagtgaaccctgtaagaatggagggacctgctctgactacgtcaacagttacacttgcaagtgccaggcaggatttgatggagtccattgtgagaacaacatcaatgagtgcactgagagctcctgtttcaatggtggcacatgtgttgatgggattaactccttctcttgcttgtgccctgtgggtttcactggatccttctgcctccatgagatcaatgaatgcagctctcatccatgcctgaatgagggaacgtgtgttgatggcctgggtacctaccgctgcagctgccccctgggctacactgggaaaaactgtcagaccctggtgaatctctgcagtcggtctccatgtaaaaacaaaggtacttgcgttcagaaaaaagcagagtcccagtgcctatgtccatctggatgggctggtgcctattgtgacgtgcccaatgtctcttgtgacatagcagcctccaggagaggtgtgcttgttgaacacttgtgccagcactcaggtgtctgcatcaatgctggcaacacgcattactgtcagtgccccctgggctatactgggagctactgtgaggagcaactcgatgagtgtgcgtccaacccctgccagcacggggcaacatgcagtgacttcattggtggatacagatgcgagtgtgtcccaggctatcagggtgtcaactgtgagtatgaagtggatgagtgccagaatcagccctgccagaatggaggcacctgtattgaccttgtgaaccatttcaagtgctcttgcccaccaggcactcggggtatgaaatcatccttatccattttccatccagggcattgtcttaagttataaatccattcttagtgttcaggggattttataaaattaaagataggaagactagcttcattccaagcatttagttctacatcctagtaattcaagccattttattctcccatctcttgctagctctgatgttgtggtttatgttgtcagttttatctggttgtttggcatcttgatattccatgaaacacagaatatggaagggatacaacattagcataacattaaaaaattagcctggtcagtaagatttcttgttgcttcacagaaaagcaactaatggcctctaaaataaacaatttacatttacct

SEQ ID NO: 446644 - DNA, 1257 bp, Homo sapiens
agcgggttgcacacccgagaaagtttcagccaaacttcgggcggcggctgaggcggcggccgaggagcggcggactcggggcgcggggagtcgaggcatttgcgcctgggcttcggagcgtagcgccaggcctgagcctttgaagcaggaggaggggaggagagagtggggctcctctatcgggaccccctccccatgtggatctgcccaggcggcggcggcggcggcggaggaggaggcgaccgagaagatgcccgccctgcgccccgctctgctgtgggcgctgctggcgctctggctgtgctgcgcggcccccgcgcatgcattgcagtgtcgagatggctatgaaccctgtgtaaatgaaggaatgtgtgttacctaccacaatggcacaggatactgcaaatgtccagaaggcttcttgggggaatattgtcaacatcgagacccctgtgagaagaaccgctgccagaatggtgggacttgtgtggcccaggccatgctggggaaagccacgtgccgatgtgcctcagggtttacaggagaggactgccagtactcaacatctcatccatgctttgtgtctcgaccctgcctgaatggcggcacatgccatatgctcagccgggatacctatgagtgcacctgtcaagtcgggtttacaggtaaggagtgccaatggacggatgcctgcctgtctcatccctgtgcaaatggaagtacctgtaccactgtggccaaccagttctcctgcaaatgcctcacaggcttcacagggcagaaatgtgagactgatgtcaatgagtgtgacattccaggacactgccagcatggtggcacctgcctcaacctgcctggttcctaccagtgccagtgccctcagggcttcacaggccagtactgtgacagcctgtatgtgccctgtgcaccctcaccttgtgtcaatggaggcacctgtcggcagactggtgacttcacttttgagtgcaactgccttccagaaacagtgagaaataagaggaacagagctctgggaaagggacaggcaagtctggaatggaaaagaacacgatgagaattagacactggaaaatatgtatgtgtggttaataaagtgctttaaactgaattgacattaacagtaggtgatcaactttcctatgtgcttgtgcttttgcttttgatggagtaattcattgttttcttatccacctaaatgcacccagctgcccttgattttctctgggctactggcct

SEQ ID NO: 446645 - DNA, 525 bp, Homo sapiens
gtttcactggtgtgttgtgtgaggagaacattgacaactgtgaccccgatccttgccaccatggtcagtgtcaggatggtattgattcctacacctgcatctgcaatcccgggtacatgggcgccatctgcagtgaccagattgatgaatgttacagcagcccttgcctgaacgatggtcgctgcattgacctggtcaatggctaccagtgcaactgccagccaggcacgtcaggtaagcccactctgtttatgtttggtatggggttttcactgtttctcaaatctgtttacacagatgtttcagactgttggcatatgctcagatacctaaaaaacagtcctgattctgagaagcacagccaaagccacaaacataaatgtctcaaggcaaatggccctagccagtggagaagtcagagacaatagctctgccaatctgatgattttgtgtgtgtgtttgtgtgtgttttgttaaatagaggcataccacttcaaaaattaaaattaatgatttaaaattgaa

SEQ ID NO: 446646 - DNA, 398 bp, Homo sapiens
ttatttattgagcatgtatttatttattcatgcaacaaatatttattgattgatcatgatagaatcttgggcacaaagataacaagactttccctctcctccaggaatctacactgtagcctcagctctgatgcccttgtttcttcactgagtttcattattttccttcatccaggtgactctcttttctgtactttctcctcttctagattctgattcgcaaccgagtaactgatctagatgccaggatgaatgatggtactacacccctgatcctggctgcccgcctggctgtggagggaatggtggcagaactgatcaactgccaagcggatgtgaatgcagtggatgaccatggtagggatgaaaggcagggatttggattcttacctgcaaag

SEQ ID NO: 446647 - DNA, 362 bp, Homo sapiens
gcagaatagccatagcatgactgtgttacctgaaagacttgatagcacattgttactttttcccctctagaagaaatagtaggccaggcacggtggctcaccctgtaatcccagcactttgggaggccgaggcaggcggatcacgaggtcaggagatcacagccatcctggctaacatggtgaaaccccgtctctactaaaaatataaaaaattagccgggcgtcgtggtgggtgcctgtagtcccagctactcgggaggcggaggcaggagaatggcatgaacctgggaggtggaggttgcagtgagccgagatcgcatcactgcactccagcctgagagtcagagtgagactccgtctca

SEQ ID NO: 446648 - DNA, 478 bp, Homo sapiens
atgctcgcagcttcttgcgggcactgggtaccctgctccacaccaacctgcgcattaagcgggactcccagggggaactcatggtgtacccctattatggtgagaagtcagctgctatgaagaaacagaggatgacacgcagatcccttcctggtgaacaagaacaggaggtggctgggtaggtgtttggtttctgaacttcaaggctaattttatgaagcctagcactttgacatatagcacaagtcataactcaacctatagaaatgcaaagatcagaaaaatagaatggcccaccacttaagataaacccgttaccccagtacttacgtttaaatgtaaagatatgccttcgtcttggctgaaaagtgggcaggggtacacaggaggcagaatgtctggaaggcctcctcagatgccagaatccataaccttttgccagagttgcctcaaatccctttattagtgacattccttt

SEQ ID NO: 446649 - DNA, 9959 bp, Homo sapiens
  misc_feature (4805)..(4805): n is a, c, g, or t
agcgggttgcacacccgagaaagtttcagccaaacttcgggcggcggctgaggcggcggccgaggagcggcggactcggggcgcggggagtcgaggcatttgcgcctgggcttcggagcgtagcgccaggcctgagcctttgaagcaggaggaggggaggagagagtggggctcctctatcgggaccccctccccatgtggatctgcccaggcggcggcggcggcggcggaggaggaggcgaccgagaagatgcccgccctgcgccccgctctgctgtgggcgctgctggcgctctggctgtgctgcgcggcccccgcgcatgcattgcagtgtcgagatggctatgaaccctgtgtaaatgaaggaatgtgtgttacctaccacaatggcacaggatactgcaaatgtccagaaggcttcttgggggaatattgtcaacatcgagacccctgtgagaagaaccgctgccagaatggtgggacttgtgtggcccaggccatgctggggaaagccacgtgccgatgtgcctcagggtttacaggagaggactgccagtactcaacatctcatccatgctttgtgtctcgaccctgcctgaatggcggcacatgccatatgctcagccgggatacctatgagtgcacctgtcaagtcgggtttacaggtaaggagtgccaatggacggatgcctgcctgtctcatccctgtgcaaatggaagtacctgtaccactgtggccaaccagttctcctgcaaatgcctcacaggcttcacagggcagaaatgtgagactgatgtcaatgagtgtgacattccaggacactgccagcatggtggcacctgcctcaacctgcctggttcctaccagtgccagtgccctcagggcttcacaggccagtactgtgacagcctgtatgtgccctgtgcaccctcaccttgtgtcaatggaggcacctgtcggcagactggtgacttcacttttgagtgcaactgccttccaggttttgaagggagcacctgtgagaggaatattgatgactgccctaaccacaggtgtcagaatggaggggtttgtgtggatggggtcaacacttacaactgccgctgtcccccacaatggacaggacagttctgcacagaggatgtggatgaatgcctgctgcagcccaatgcctgtcaaaatgggggcacctgtgccaaccgcaatggaggctatggctgtgtatgtgtcaacggctggagtggagatgactgcagtgagaacattgatgattgtgccttcgcctcctgtactccaggctccacctgcatcgaccgtgtggcctccttctcttgcatgtgcccagaggggaaggcaggtctcctgtgtcatctggatgatgcatgcatcagcaatccttgccacaagggggcactgtgtgacaccaaccccctaaatgggcaatatatttgcacctgcccacaaggctacaaaggggctgactgcacagaagatgtggatgaatgtgccatggccaatagcaatccttgtgagcatgcaggaaaatgtgtgaacacggatggcgccttccactgtgagtgtctgaagggttatgcaggacctcgttgtgagatggacatcaatgagtgccattcagacccctgccagaatgatgctacctgtctggataagattggaggcttcacatgtctgtgcatgccaggtttcaaaggtgtgcattgtgaattagaaataaatgaatgtcagagcaacccttgtgtgaacaatgggcagtgtgtggataaagtcaatcgtttccagtgcctgtgtcctcctggtttcactgggccagtttgccagattgatattgatgactgttccagtactccgtgtctgaatggggcaaagtgtatcgatcacccgaatggctatgaatgccagtgtgccacaggtttcactggtgtgttgtgtgaggagaacattgacaactgtgaccccgatccttgccaccatggtcagtgtcaggatggtattgattcctacacctgcatctgcaatcccgggtacatgggcgccatctgcagtgaccagattgatgaatgttacagcagcccttgcctgaacgatggtcgctgcattgacctggtcaatggctaccagtgcaactgccagccaggcacgtcaggggttaattgtgaaattaattttgatgactgtgcaagtaacccttgtatccatggaatctgtatggatggcattaatcgctacagttgtgtctgctcaccaggattcacagggcagagatgtaacattgacattgatgagtgtgcctccaatccctgtcgcaagggtgcaacatgtatcaacggtgtgaatggtttccgctgtatatgccccgagggaccccatcaccccagctgctactcacaggtgaacgaatgcctgagcaatccctgcatccatggaaactgtactggaggtctcagtggatataagtgtctctgtgatgcaggctgggttggcatcaactgtgaagtggacaaaaatgaatgcctttcgaatccatgccagaatggaggaacttgtgacaatctggtgaatggatacaggtgtacttgcaagaagggctttaaaggctataactgccaggtgaatattgatgaatgtgcctcaaatccatgcctgaaccaaggaacctgctttgatgacataagtggctacacttgccactgtgtgctgccatacacaggcaagaattgtcagacagtattggctccctgttccccaaacccttgtgagaatgctgctgtttgcaaagagtcaccaaattttgagagttatacttgcttgtgtgctcctggctggcaaggtcagcggtgtaccattgacattgacgagtgtatctccaagccctgcatgaaccatggtctctgccataacacccagggcagctacatgtgtgaatgtccaccaggcttcagtggtatggactgtgaggaggacattgatgactgccttgccaatccttgccagaatggaggttcctgtatggatggagtgaatactttctcctgcctctgccttccgggtttcactggggataagtgccagacagacatgaatgagtgtctgagtgaaccctgtaagaatggagggacctgctctgactacgtcaacagttacacttgcaagtgccaggcaggatttgatggagtccattgtgagaacaacatcaatgagtgcactgagagctcctgtttcaatggtggcacatgtgttgatgggattaactccttctcttgcttgtgccctgtgggtttcactggatccttctgcctccatgagatcaatgaatgcagctctcatccatgcctgaatgagggaacgtgtgttgatggcctgggtacctaccgctgcagctgccccctgggctacactgggaaaaactgtcagaccctggtgaatctctgcagtcggtctccatgtaaaaacaaaggtacttgcgttcagaaaaaagcagagtcccagtgcctatgtccatctggatgggctggtgcctattgtgacgtgcccaatgtctcttgtgacatagcagcctccaggagaggtgtgcttgttgaacacttgtgccagcactcaggtgtctgcatcaatgctggcaacacgcattactgtcagtgccccctgggctatactgggagctactgtgaggagcaactcgatgagtgtgcgtccaacccctgccagcacggggcaacatgcagtgacttcattggtggatacagatgcgagtgtgtcccaggctatcagggtgtcaactgtgagtatgaagtggatgagtgccagaatcagccctgccagaatggaggcacctgtattgaccttgtgaaccatttcaagtgctcttgcccaccaggcactcggggcctactctgtgaagagaacattgatgactgtgcccggggtccccattgccttaatggtggtcagtgcatggataggattggaggctacagttgtcgctgcttgcctggctttgctggggagcgttgtgagggagacatcaacgagtgcctctccaacccctgcagctctgagggcagcctggactgtatacagctcaccaatgactacctgtgtgtttgccgtagtgcctttactggccggcactgtgaaaccttcgtcgatgtgtgtccccagatgccctgcctgaatggagggacttgtgctgtggccagtaacatgcctgatggtttcatttgccgttgtcccccgggattttccggggcaaggtgccagagcagctgtggacaagtgaaatgtaggaagggggagcagtgtgtgcacaccgcctctggaccccgctgcttctgccccagtccccgggactgcgagtcaggctgtgccagtagcccctgccagcacgggggcagctgccaccctcagcgccagcctccttattactcctgccagtgtgccccaccattctcgggtagccgctgtgaactctacacggcaccccccagcacccctcctgccacctgtctgagccagtattgtgccgacaaagctcgggatggcgtctgtgatgaggcctgcaacagccatgcctgccagtgggatgggggtgactgttctctcaccatggagaacccctgggccaactgctcctccccacttccctgctgggattatatcaacaaccagtgtgatgagctgtgcaacacggtcgagtgcctgtttgacaactttgaatgccaggggaacagcaagacatgcaagtatgacaaatactgtgcagaccacttcaaagacaaccactgtnaccaggggtgcaacagtgaggagtgtggttgggatgggctggactgtgctgctgaccaacctgagaacctggcagaaggtaccctggttattgtggtattgatgccacctgaacaactgctccaggatgctcgcagcttcttgcgggcactgggtaccctgctccacaccaacctgcgcattaagcgggactcccagggggaactcatggtgtacccctattatggtgagaagtcagctgctatgaagaaacagaggatgacacgcagatcccttcctggtgaacaagaacaggaggtggctggctctaaagtctttctggaaattgacaaccgccagtgtgttcaagactcagaccactgcttcaagaacacggatgcagcagcagctctcctggcctctcacgccatacaggggaccctgtcataccctcttgtgtctgtcgtcagtgaatccctgactccagaacgcactcagctcctctatctccttgctgttgctgttgtcatcattctgtttattattctgctgggggtaatcatggcaaaacgaaagcgtaagcatggctctctctggctgcctgaaggtttcactcttcgccgagatgcaagcaatcacaagcgtcgtgagccagtgggacaggatgctgtggggctgaaaaatctctcagtgcaagtctcagaagctaacctaattggtactggaacaagtgaacactgggtcgatgatgaagggccccagccaaagaaagtaaaggctgaagatgaggccttactctcagaagaagatgaccccattgatcgacggccatggacacagcagcaccttgaagctgcagacatccgtaggacaccatcgctggctctcacccctcctcaggcagagcaggaggtggatgtgttagatgtgaatgtccgtggcccagatggctgcaccccattgatgttggcttctctccgaggaggcagctcagatttgagtgatgaagatgaagatgcagaggactcttctgctaacatcatcacagacttggtctaccagggtgccagcctccaggcccagacagaccggactggtgagatggccctgcaccttgcagcccgctactcacgggctgatgctgccaagcgtctcctggatgcaggtgcagatgccaatgcccaggacaacatgggccgctgtccactccatgctgcagtggcagctgatgcccaaggtgtcttccagattctgattcgcaaccgagtaactgatctagatgccaggatgaatgatggtactacacccctgatcctggctgcccgcctggctgtggagggaatggtggcagaactgatcaactgccaagcggatgtgaatgcagtggatgaccatggaaaatctgctcttcactgggcagctgctgtcaataatgtggaggcaactcttttgttgttgaaaaatggggccaaccgagacatgcaggacaacaaggaagagacacctctgtttcttgctgcccgggaggggagctatgaagcagccaagatcctgttagaccattttgccaatcgagacatcacagaccatatggatcgtcttccccgggatgtggctcgggatcgcatgcaccatgacattgtgcgccttctggatgaatacaatgtgaccccaagccctccaggcaccgtgttgacttctgctctctcacctgtcatctgtgggcccaacagatctttcctcagcctgaagcacaccccaatgggcaagaagtctagacggcccagtgccaagagtaccatgcctactagcctccctaaccttgccaaggaggcaaaggatgccaagggtagtaggaggaagaagtctctgagtgagaaggtccaactgtctgagagttcagtaactttatcccctgttgattccctagaatctcctcacacgtatgtttccgacaccacatcctctccaatgattacatccctgggatcttacaggcctcacccaaccctatgttggccactgccgcccctcctgccccagtccatgcccagcatgcactatctttttctaaccttcatgaaatgcagcctttggcacatggggccagcactgtgcttccctcagtgagccagttgctatcccaccaccacattgtgtctccaggcagtggcagtgctggaagcttgagtaggctccatccagtcccagtcccagcagattggatgaaccgcatggaggtgaatgagacccagtacaatgagatgtttggtatggtcctggctccagctgagggcacccatcctggcatagctccccagagcaggccacctgaagggaagcacataaccacccctcgggagcccttgccccccattgtgactttccagctcatccctaaaggcagtattgcccaaccagcgggggctccccagcctcagtccacctgccctccagctgttgcgggccccctgcccaccatgtaccagattccagaaatggcccgtttgcccagtgtggctttccccactgccatgatgccccagcaggacgggcaggtagctcagaccattctcccagcctatcatcctttcccagcctctgtgggcaagtaccccacacccccttcacagcacagttatgcttcctcaaatgctgctgagcgaacacccagtcacagtggtcacctccagggtgagcatccctacctgacaccatccccagagtctcctgaccagtggtcaagttcatcaccccactctgcttctgactggtcagatgtgaccaccagccctacccctgggggtgctggaggaggtcagcggggacctgggacacacatgtctgagccaccacacaacaacatgcaggtttatgcgtgagagagtccacctccagtgtagagacataactgacttttgtaaatgctgctgaggaacaaatgaaggtcatccgggagagaaatgaagaaatctctggagccagcttctagaggtaggaaagagaagatgttcttattcagataatgcaagagaagcaattcgtcagtttcactgggtatctgcaaggcttattgattattctaatctaataagacaagtttgtggaaatgcaagatgaatacaagccttgggtccatgtttactctcttctatttggagaataagatggatgcttattgaagcccagacattcttgcagcttggactgcattttaagccctgcaggcttctgccatatccatgagaagattctacactagcgtcctgttgggaattatgccctggaattctgcctgaattgacctacgcatctcctcctccttggacattcttttgtcttcatttggtgcttttggttttgcacctctccgtgattgtagccctaccagcatgttatagggcaagacctttgtgcttttgatcattctggcccatgaaagcaactttggtctcctttcccctcctgtcttcccggtatcccttggagtctcacaaggtttactttggtatggttctcagcacaaacctttcaagtatgttgtttctttggaaaatggacatactgtattgtgttctcctgcatatatcattcctggagagagaaggggagaagaatacttttcttcaacaaattttgggggcaggagatcccttcaagaggctgcaccttaatttttcttgtctgtgtgcaggtcttcatataaactttaccaggaagaagggtgtgagtttgttgtttttctgtgtatgggcctggtcagtgtaaagttttatccttgatagtctagttactatgaccctccccacttttttaaaaccagaaaaaggtttggaatgttggaatgaccaagagacaagttaactcgtgcaagagccagttacccacccacaggtccccctacttcctgccaagcattccattgactgcctgtatggaacacatttgtcccagatctgagcattctaggcctgtttcactcactcacccagcatatgaaactagtcttaactgttgagcctttcctttcatatccacagaagacactgtctcaaatgttgtacccttgccatttaggactgaactttccttagcccaagggacccagtgacagttgtcttccgtttgtcagatgatcagtctctactgattatcttgctgcttaaaggcctgctcaccaatctttctttcacaccgtgtggtccgtgttactggtatacccagtatgttctcactgaagacatggactttatatgttcaagtgcaggaattggaaagttggacttgttttctatgatccaaaacagccctataagaaggttggaaaaggaggaactatatagcagcctttgctattttctgctaccatttcttttcctctgaagcggccatgacattccctttggcaactaacgtagaaactcaacagaacattttcctttcctagagtcaccttttagatgataatggacaactatagacttgctcattgttcagactgattgcccctcacctgaatccactctctgtattcatgctcttggcaatttctttgactttcttttaagggcagaagcattttagttaattgtagataaagaatagttttcttcctcttctccttgggccagttaataattggtccatggctacactgcaacttccgtccagtgctgtgatgcccatgacacctgcaaaataagttctgcctgggcattttgtagatattaacaggtgaattcccgactcttttggtttgaatgacagttctcattccttctatggctgcaagtatgcatcagtgcttcccacttacctgatttgtctgtcggtggccccatatggaaaccctgcgtgtctgttggcataatagtttacaaatggttttttcagtcctatccaaatttattgaaccaacaaaaataattacttctgccctgagataagcagattaagtttgttcattctctgctttattctctccatgtggcaacattctgtcagcctctttcatagtgtgcaaacattttatcattctaaatggtgactctctgcccttggacccatttattattcacagatggggagaacctatctgcatggaccctcaccatcctctgtgcagcacacacagtgcagggagccagtggcgatggcgatgactttcttcccctgg

SEQ ID NO: 446650 - DNA, 607 bp, Homo sapiens
ctaacactgtcccccttctccacagggcagagatgtaacattgacattgatgagtgtgcctccaatccctgtcgcaagggtgcaacatgtatcaacggtgtgaatggtttccgctgtatatgccccgagggaccccatcaccccagctgctactcacaggtgaacgaatgcctgagcaatccctgcatccatggaaactgtactggaggtctcagtggatataagtgtctctgtgatgcaggctgggttggcatcaactgtgaagtggacaaaaatgaatgcctttcgaatccatgccagaatggaggaacttgtgacaatctggtgaatggatacaggtgtacttgcaagaagggctttaaaggctataactgccaggtgaatattgatgaatgtgcctcaaatccatgcctgaaccaaggaacctgctttgatgacataagtggctacacttgccactgtgtgctgccatacacaggtgggtcctggaggtaccagcagggaccagaggggatacttgaccttgctttgtcagtgcctgagtctcagtgcccaggtctgtggggctgtaatgctcctccgagggctcactcctcagttgtccttc

SEQ ID NO: 446651 - DNA, 9096 bp, Homo sapiens
  misc_feature (2475)..(2475): n is a, c, g, or t
ccagttcgacggagactctccagtacagtttccgctgtatatgccccgagggaccccatcaccccagctgctactcacaggtgaacgaatgcctgagcaatccctgcatccatggaaactgtactggaggtctcagtggatataagtgtctctgtgatgcaggctgggttggcatcaactgtgaagtggacaaaaatgaatgcctttcgaatccatgccagaatggaggaacttgtgacaatctggtgaatggatacaggtgtacttgcaagaagggctttaaaggctataactgccaggtgaatattgatgaatgtgcctcaaatccatgcctgaaccaaggaacctgctttgatgacataagtggctacacttgccactgtgtgctgccatacacaggcaagaattgtcagacagtattggctccctgttccccaaacccttgtgagaatgctgctgtttgcaaagagtcaccaaattttgagagttatacttgcttgtgtgctcctggctggcaaggtcagcggtgtaccattgacattgacgagtgtatctccaagccctgcatgaaccatggtctctgccataacacccagggcagctacatgtgtgaatgtccaccaggcttcagtggtatggactgtgaggaggacattgatgactgccttgccaatccttgccagaatggaggttcctgtatggatggagtgaatactttctcctgcctctgccttccgggtttcactggggataagtgccagacagacatgaatgagtgtctgagtgaaccctgtaagaatggagggacctgctctgactacgtcaacagttacacttgcaagtgccaggcaggatttgatggagtccattgtgagaacaacatcaatgagtgcactgagagctcctgtttcaatggtggcacatgtgttgatgggattaactccttctcttgcttgtgccctgtgggtttcactggatccttctgcctccatgagatcaatgaatgcagctctcatccatgcctgaatgagggaacgtgtgttgatggcctgggtacctaccgctgcagctgccccctgggctacactgggaaaaactgtcagaccctggtgaatctctgcagtcggtctccatgtaaaaacaaaggtacttgcgttcagaaaaaagcagagtcccagtgcctatgtccatctggatgggctggtgcctattgtgacgtgcccaatgtctcttgtgacatagcagcctccaggagaggtgtgcttgttgaacacttgtgccagcactcaggtgtctgcatcaatgctggcaacacgcattactgtcagtgccccctgggctatactgggagctactgtgaggagcaactcgatgagtgtgcgtccaacccctgccagcacggggcaacatgcagtgacttcattggtggatacagatgcgagtgtgtcccaggctatcagggtgtcaactgtgagtatgaagtggatgagtgccagaatcagccctgccagaatggaggcacctgtattgaccttgtgaaccatttcaagtgctcttgcccaccaggcactcggggcctactctgtgaagagaacattgatgactgtgcccggggtccccattgccttaatggtggtcagtgcatggataggattggaggctacagttgtcgctgcttgcctggctttgctggggagcgttgtgagggagacatcaacgagtgcctctccaacccctgcagctctgagggcagcctggactgtatacagctcaccaatgactacctgtgtgtttgccgtagtgcctttactggccggcactgtgaaaccttcgtcgatgtgtgtccccagatgccctgcctgaatggagggacttgtgctgtggccagtaacatgcctgatggtttcatttgccgttgtcccccgggattttccggggcaaggtgccagagcagctgtggacaagtgaaatgtaggaagggggagcagtgtgtgcacaccgcctctggaccccgctgcttctgccccagtccccgggactgcgagtcaggctgtgccagtagcccctgccagcacgggggcagctgccaccctcagcgccagcctccttattactcctgccagtgtgccccaccattctcgggtagccgctgtgaactctacacggcaccccccagcacccctcctgccacctgtctgagccagtattgtgccgacaaagctcgggatggcgtctgtgatgaggcctgcaacagccatgcctgccagtgggatgggggtgactgttctctcaccatggagaacccctgggccaactgctcctccccacttccctgctgggattatatcaacaaccagtgtgatgagctgtgcaacacggtcgagtgcctgtttgacaactttgaatgccaggggaacagcaagacatgcaagtatgacaaatactgtgcagaccacttcaaagacaaccactgtnaccaggggtgcaacagtgaggagtgtggttgggatgggctggactgtgctgctgaccaacctgagaacctggcagaaggtaccctggttattgtggtattgatgccacctgaacaactgctccaggatgctcgcagcttcttgcgggcactgggtaccctgctccacaccaacctgcgcattaagcgggactcccagggggaactcatggtgtacccctattatggtgagaagtcagctgctatgaagaaacagaggatgacacgcagatcccttcctggtgaacaagaacaggaggtggctggctctaaagtctttctggaaattgacaaccgccagtgtgttcaagactcagaccactgcttcaagaacacggatgcagcagcagctctcctggcctctcacgccatacaggggaccctgtcataccctcttgtgtctgtcgtcagtgaatccctgactccagaacgcactcagctcctctatctccttgctgttgctgttgtcatcattctgtttattattctgctgggggtaatcatggcaaaacgaaagcgtaagcatggctctctctggctgcctgaaggtttcactcttcgccgagatgcaagcaatcacaagcgtcgtgagccagtgggacaggatgctgtggggctgaaaaatctctcagtgcaagtctcagaagctaacctaattggtactggaacaagtgaacactgggtcgatgatgaagggccccagccaaagaaagtaaaggctgaagatgaggccttactctcagaagaagatgaccccattgatcgacggccatggacacagcagcaccttgaagctgcagacatccgtaggacaccatcgctggctctcacccctcctcaggcagagcaggaggtggatgtgttagatgtgaatgtccgtggcccagatggctgcaccccattgatgttggcttctctccgaggaggcagctcagatttgagtgatgaagatgaagatgcagaggactcttctgctaacatcatcacagacttggtctaccagggtgccagcctccaggcccagacagaccggactggtgagatggccctgcaccttgcagcccgctactcacgggctgatgctgccaagcgtctcctggatgcaggtgcagatgccaatgcccaggacaacatgggccgctgtccactccatgctgcagtggcagctgatgcccaaggtgtcttccagattctgattcgcaaccgagtaactgatctagatgccaggatgaatgatggtactacacccctgatcctggctgcccgcctggctgtggagggaatggtggcagaactgatcaactgccaagcggatgtgaatgcagtggatgaccatggaaaatctgctcttcactgggcagctgctgtcaataatgtggaggcaactcttttgttgttgaaaaatggggccaaccgagacatgcaggacaacaaggaagagacacctctgtttcttgctgcccgggaggggagctatgaagcagccaagatcctgttagaccattttgccaatcgagacatcacagaccatatggatcgtcttccccgggatgtggctcgggatcgcatgcaccatgacattgtgcgccttctggatgaatacaatgtgaccccaagccctccaggcaccgtgttgacttctgctctctcacctgtcatctgtgggcccaacagatctttcctcagcctgaagcacaccccaatgggcaagaagtctagacggcccagtgccaagagtaccatgcctactagcctccctaaccttgccaaggaggcaaaggatgccaagggtagtaggaggaagaagtctctgagtgagaaggtccaactgtctgagagttcagtaactttatcccctgttgattccctagaatctcctcacacgtatgtttccgacaccacatcctctccaatgattacatccctgggatcttacaggcctcacccaaccctatgttggccactgccgcccctcctgccccagtccatgcccagcatgcactatctttttctaaccttcatgaaatgcagcctttggcacatggggccagcactgtgcttccctcagtgagccagttgctatcccaccaccacattgtgtctccaggcagtggcagtgctggaagcttgagtaggctccatccagtcccagtcccagcagattggatgaaccgcatggaggtgaatgagacccagtacaatgagatgtttggtatggtcctggctccagctgagggcacccatcctggcatagctccccagagcaggccacctgaagggaagcacataaccacccctcgggagcccttgccccccattgtgactttccagctcatccctaaaggcagtattgcccaaccagcgggggctccccagcctcagtccacctgccctccagctgttgcgggccccctgcccaccatgtaccagattccagaaatggcccgtttgcccagtgtggctttccccactgccatgatgccccagcaggacgggcaggtagctcagaccattctcccagcctatcatcctttcccagcctctgtgggcaagtaccccacacccccttcacagcacagttatgcttcctcaaatgctgctgagcgaacacccagtcacagtggtcacctccagggtgagcatccctacctgacaccatccccagagtctcctgaccagtggtcaagttcatcaccccactctgcttctgactggtcagatgtgaccaccagccctacccctgggggtgctggaggaggtcagcggggacctgggacacacatgtctgagccaccacacaacaacatgcaggtttatgcgtgagagagtccacctccagtgtagagacataactgacttttgtaaatgctgctgaggaacaaatgaaggtcatccgggagagaaatgaagaaatctctggagccagcttctagaggtaggaaagagaagatgttcttattcagataatgcaagagaagcaattcgtcagtttcactgggtatctgcaaggcttattgattattctaatctaataagacaagtttgtggaaatgcaagatgaatacaagccttgggtccatgtttactctcttctatttggagaataagatggatgcttattgaagcccagacattcttgcagcttggactgcattttaagccctgcaggcttctgccatatccatgagaagattctacactagcgtcctgttgggaattatgccctggaattctgcctgaattgacctacgcatctcctcctccttggacattcttttgtcttcatttggtgcttttggttttgcacctctccgtgattgtagccctaccagcatgttatagggcaagacctttgtgcttttgatcattctggcccatgaaagcaactttggtctcctttcccctcctgtcttcccggtatcccttggagtctcacaaggtttactttggtatggttctcagcacaaacctttcaagtatgttgtttctttggaaaatggacatactgtattgtgttctcctgcatatatcattcctggagagagaaggggagaagaatacttttcttcaacaaattttgggggcaggagatcccttcaagaggctgcaccttaatttttcttgtctgtgtgcaggtcttcatataaactttaccaggaagaagggtgtgagtttgttgtttttctgtgtatgggcctggtcagtgtaaagttttatccttgatagtctagttactatgaccctccccacttttttaaaaccagaaaaaggtttggaatgttggaatgaccaagagacaagttaactcgtgcaagagccagttacccacccacaggtccccctacttcctgccaagcattccattgactgcctgtatggaacacatttgtcccagatctgagcattctaggcctgtttcactcactcacccagcatatgaaactagtcttaactgttgagcctttcctttcatatccacagaagacactgtctcaaatgttgtacccttgccatttaggactgaactttccttagcccaagggacccagtgacagttgtcttccgtttgtcagatgatcagtctctactgattatcttgctgcttaaaggcctgctcaccaatctttctttcacaccgtgtggtccgtgttactggtatacccagtatgttctcactgaagacatggactttatatgttcaagtgcaggaattggaaagttggacttgttttctatgatccaaaacagccctataagaaggttggaaaaggaggaactatatagcagcctttgctattttctgctaccatttcttttcctctgaagcggccatgacattccctttggcaactaacgtagaaactcaacagaacattttcctttcctagagtcaccttttagatgataatggacaactatagacttgctcattgttcagactgattgcccctcacctgaatccactctctgtattcatgctcttggcaatttctttgactttcttttaagggcagaagcattttagttaattgtagataaagaatagttttcttcctcttctccttgggccagttaataattggtccatggctacactgcaacttccgtccagtgctgtgatgcccatgacacctgcaaaataagttctgcctgggcattttgtagatattaacaggtgaattcccgactcttttggtttgaatgacagttctcattccttctatggctgcaagtatgcatcagtgcttcccacttacctgatttgtctgtcggtggccccatatggaaaccctgcgtgtctgttggcataatagtttacaaatggttttttcagtcctatccaaatttattgaaccaacaaaaataattacttctgccctgagataagcagattaagtttgttcattctctgctttattctctccatgtggcaacattctgtcagcctctttcatagtgtgcaaacattttatcattctaaatggtgactctctgcccttggacccatttattattcacagatggggagaacctatctgcatggacctctgtggaccacagcgtacctgcccctttctgccctcctgctccagccccacttctgaaagtatcagctactgatccagccactggatattttatatcctcccttttccttaagcacaatgtcagaccaaattgcttgtttctttttcttggactactttaatttggatcctttgggtttggagaaagggaatgtgaaagctgtcattacagacaacaggtttcagtgatgaggaggacaacactgcctttcaaactttttactgatctcttagattttaagaactcttgaattgtgtggtatctaataaaagggaaggtaagatggataatcactttctcatttgggttctgaattggagactcagtttttatgagacacatcttttatgccatgtatagatcctcccctgctatttttggtttatttttattgttataaatgctttctttctttgactcctcttctgcctgcctttggggataggtttttttgtttgtttatttgcttcctctgttttgttttaagcatcattttcttatgtgaggtggggaagggaaaggtatgagggaaagagagtctgagaattaaaatattttagtataagcaattggctgtgatgctcaaatccattgcatcctcttattgaatttgccaatttgtaatttttgcataataaagaaccaaaggtgtaatgttttgttgagaggtggtttagggattttggccctaaccaatacattgaatgtatgatgactatttgggaggacacatttatgtacccagaggcccccactaataagtggtactatggttacttccttgtgtacatttctcttaaaagtgatattatatctgtttgtatgagaaacccagtaaccaataaaatgaccgcatattcctgactaaacgtagtaaggaaaatgcacactttgtttttacttttccgtttcattctaaaggtagttaagatgaaatttatatgaaagcatttttatcacaaaataaaaaaggtttgccaagctcagtggtgttgtattttttattttccaatactgcatccatggcctggcagtgttacctcatgatgtcataatttgctgagagagcaaattttcttttctttctgaatcccacaaagcctagcaccaaacttctttttttcttcctttaattagatcataaataaatgatcctggggaaaaagcatctgtcaaataggaaacatcacaaaactgagcactcttctgtgcactagccatagctggtgacaaacagatggttgctcagggacaaggtgccttccaatggaaatgcgaagtagttgctatagcaagaattgggaactgggatataagtcataatattaattatgctgttatgtaaatgattggtttgtaacattccttaagtgaaatttgtgtagaacttaatatacaggattataaaataatattttgtgtataaatttgttataagttcacattcatacatttatttataaagtcagtgagatatttgaacatgaaaaaaaaaa

SEQ ID NO: 446652 - DNA, 10973 bp, Homo sapiens
  misc_feature (4805)..(4805): n is a, c, g, or t
agcgggttgcacacccgagaaagtttcagccaaacttcgggcggcggctgaggcggcggccgaggagcggcggactcggggcgcggggagtcgaggcatttgcgcctgggcttcggagcgtagcgccaggcctgagcctttgaagcaggaggaggggaggagagagtggggctcctctatcgggaccccctccccatgtggatctgcccaggcggcggcggcggcggcggaggaggaggcgaccgagaagatgcccgccctgcgccccgctctgctgtgggcgctgctggcgctctggctgtgctgcgcggcccccgcgcatgcattgcagtgtcgagatggctatgaaccctgtgtaaatgaaggaatgtgtgttacctaccacaatggcacaggatactgcaaatgtccagaaggcttcttgggggaatattgtcaacatcgagacccctgtgagaagaaccgctgccagaatggtgggacttgtgtggcccaggccatgctggggaaagccacgtgccgatgtgcctcagggtttacaggagaggactgccagtactcaacatctcatccatgctttgtgtctcgaccctgcctgaatggcggcacatgccatatgctcagccgggatacctatgagtgcacctgtcaagtcgggtttacaggtaaggagtgccaatggacggatgcctgcctgtctcatccctgtgcaaatggaagtacctgtaccactgtggccaaccagttctcctgcaaatgcctcacaggcttcacagggcagaaatgtgagactgatgtcaatgagtgtgacattccaggacactgccagcatggtggcacctgcctcaacctgcctggttcctaccagtgccagtgccctcagggcttcacaggccagtactgtgacagcctgtatgtgccctgtgcaccctcaccttgtgtcaatggaggcacctgtcggcagactggtgacttcacttttgagtgcaactgccttccaggttttgaagggagcacctgtgagaggaatattgatgactgccctaaccacaggtgtcagaatggaggggtttgtgtggatggggtcaacacttacaactgccgctgtcccccacaatggacaggacagttctgcacagaggatgtggatgaatgcctgctgcagcccaatgcctgtcaaaatgggggcacctgtgccaaccgcaatggaggctatggctgtgtatgtgtcaacggctggagtggagatgactgcagtgagaacattgatgattgtgccttcgcctcctgtactccaggctccacctgcatcgaccgtgtggcctccttctcttgcatgtgcccagaggggaaggcaggtctcctgtgtcatctggatgatgcatgcatcagcaatccttgccacaagggggcactgtgtgacaccaaccccctaaatgggcaatatatttgcacctgcccacaaggctacaaaggggctgactgcacagaagatgtggatgaatgtgccatggccaatagcaatccttgtgagcatgcaggaaaatgtgtgaacacggatggcgccttccactgtgagtgtctgaagggttatgcaggacctcgttgtgagatggacatcaatgagtgccattcagacccctgccagaatgatgctacctgtctggataagattggaggcttcacatgtctgtgcatgccaggtttcaaaggtgtgcattgtgaattagaaataaatgaatgtcagagcaacccttgtgtgaacaatgggcagtgtgtggataaagtcaatcgtttccagtgcctgtgtcctcctggtttcactgggccagtttgccagattgatattgatgactgttccagtactccgtgtctgaatggggcaaagtgtatcgatcacccgaatggctatgaatgccagtgtgccacaggtttcactggtgtgttgtgtgaggagaacattgacaactgtgaccccgatccttgccaccatggtcagtgtcaggatggtattgattcctacacctgcatctgcaatcccgggtacatgggcgccatctgcagtgaccagattgatgaatgttacagcagcccttgcctgaacgatggtcgctgcattgacctggtcaatggctaccagtgcaactgccagccaggcacgtcaggggttaattgtgaaattaattttgatgactgtgcaagtaacccttgtatccatggaatctgtatggatggcattaatcgctacagttgtgtctgctcaccaggattcacagggcagagatgtaacattgacattgatgagtgtgcctccaatccctgtcgcaagggtgcaacatgtatcaacggtgtgaatggtttccgctgtatatgccccgagggaccccatcaccccagctgctactcacaggtgaacgaatgcctgagcaatccctgcatccatggaaactgtactggaggtctcagtggatataagtgtctctgtgatgcaggctgggttggcatcaactgtgaagtggacaaaaatgaatgcctttcgaatccatgccagaatggaggaacttgtgacaatctggtgaatggatacaggtgtacttgcaagaagggctttaaaggctataactgccaggtgaatattgatgaatgtgcctcaaatccatgcctgaaccaaggaacctgctttgatgacataagtggctacacttgccactgtgtgctgccatacacaggcaagaattgtcagacagtattggctccctgttccccaaacccttgtgagaatgctgctgtttgcaaagagtcaccaaattttgagagttatacttgcttgtgtgctcctggctggcaaggtcagcggtgtaccattgacattgacgagtgtatctccaagccctgcatgaaccatggtctctgccataacacccagggcagctacatgtgtgaatgtccaccaggcttcagtggtatggactgtgaggaggacattgatgactgccttgccaatccttgccagaatggaggttcctgtatggatggagtgaatactttctcctgcctctgccttccgggtttcactggggataagtgccagacagacatgaatgagtgtctgagtgaaccctgtaagaatggagggacctgctctgactacgtcaacagttacacttgcaagtgccaggcaggatttgatggagtccattgtgagaacaacatcaatgagtgcactgagagctcctgtttcaatggtggcacatgtgttgatgggattaactccttctcttgcttgtgccctgtgggtttcactggatccttctgcctccatgagatcaatgaatgcagctctcatccatgcctgaatgagggaacgtgtgttgatggcctgggtacctaccgctgcagctgccccctgggctacactgggaaaaactgtcagaccctggtgaatctctgcagtcggtctccatgtaaaaacaaaggtacttgcgttcagaaaaaagcagagtcccagtgcctatgtccatctggatgggctggtgcctattgtgacgtgcccaatgtctcttgtgacatagcagcctccaggagaggtgtgcttgttgaacacttgtgccagcactcaggtgtctgcatcaatgctggcaacacgcattactgtcagtgccccctgggctatactgggagctactgtgaggagcaactcgatgagtgtgcgtccaacccctgccagcacggggcaacatgcagtgacttcattggtggatacagatgcgagtgtgtcccaggctatcagggtgtcaactgtgagtatgaagtggatgagtgccagaatcagccctgccagaatggaggcacctgtattgaccttgtgaaccatttcaagtgctcttgcccaccaggcactcggggcctactctgtgaagagaacattgatgactgtgcccggggtccccattgccttaatggtggtcagtgcatggataggattggaggctacagttgtcgctgcttgcctggctttgctggggagcgttgtgagggagacatcaacgagtgcctctccaacccctgcagctctgagggcagcctggactgtatacagctcaccaatgactacctgtgtgtttgccgtagtgcctttactggccggcactgtgaaaccttcgtcgatgtgtgtccccagatgccctgcctgaatggagggacttgtgctgtggccagtaacatgcctgatggtttcatttgccgttgtcccccgggattttccggggcaaggtgccagagcagctgtggacaagtgaaatgtaggaagggggagcagtgtgtgcacaccgcctctggaccccgctgcttctgccccagtccccgggactgcgagtcaggctgtgccagtagcccctgccagcacgggggcagctgccaccctcagcgccagcctccttattactcctgccagtgtgccccaccattctcgggtagccgctgtgaactctacacggcaccccccagcacccctcctgccacctgtctgagccagtattgtgccgacaaagctcgggatggcgtctgtgatgaggcctgcaacagccatgcctgccagtgggatgggggtgactgttctctcaccatggagaacccctgggccaactgctcctccccacttccctgctgggattatatcaacaaccagtgtgatgagctgtgcaacacggtcgagtgcctgtttgacaactttgaatgccaggggaacagcaagacatgcaagtatgacaaatactgtgcagaccacttcaaagacaaccactgtnaccaggggtgcaacagtgaggagtgtggttgggatgggctggactgtgctgctgaccaacctgagaacctggcagaaggtaccctggttattgtggtattgatgccacctgaacaactgctccaggatgctcgcagcttcttgcgggcactgggtaccctgctccacaccaacctgcgcattaagcgggactcccagggggaactcatggtgtacccctattatggtgagaagtcagctgctatgaagaaacagaggatgacacgcagatcccttcctggtgaacaagaacaggaggtggctggctctaaagtctttctggaaattgacaaccgccagtgtgttcaagactcagaccactgcttcaagaacacggatgcagcagcagctctcctggcctctcacgccatacaggggaccctgtcataccctcttgtgtctgtcgtcagtgaatccctgactccagaacgcactcagctcctctatctccttgctgttgctgttgtcatcattctgtttattattctgctgggggtaatcatggcaaaacgaaagcgtaagcatggctctctctggctgcctgaaggtttcactcttcgccgagatgcaagcaatcacaagcgtcgtgagccagtgggacaggatgctgtggggctgaaaaatctctcagtgcaagtctcagaagctaacctaattggtactggaacaagtgaacactgggtcgatgatgaagggccccagccaaagaaagtaaaggctgaagatgaggccttactctcagaagaagatgaccccattgatcgacggccatggacacagcagcaccttgaagctgcagacatccgtaggacaccatcgctggctctcacccctcctcaggcagagcaggaggtggatgtgttagatgtgaatgtccgtggcccagatggctgcaccccattgatgttggcttctctccgaggaggcagctcagatttgagtgatgaagatgaagatgcagaggactcttctgctaacatcatcacagacttggtctaccagggtgccagcctccaggcccagacagaccggactggtgagatggccctgcaccttgcagcccgctactcacgggctgatgctgccaagcgtctcctggatgcaggtgcagatgccaatgcccaggacaacatgggccgctgtccactccatgctgcagtggcagctgatgcccaaggtgtcttccagattctgattcgcaaccgagtaactgatctagatgccaggatgaatgatggtactacacccctgatcctggctgcccgcctggctgtggagggaatggtggcagaactgatcaactgccaagcggatgtgaatgcagtggatgaccatggaaaatctgctcttcactgggcagctgctgtcaataatgtggaggcaactcttttgttgttgaaaaatggggccaaccgagacatgcaggacaacaaggaagagacacctctgtttcttgctgcccgggaggggagctatgaagcagccaagatcctgttagaccattttgccaatcgagacatcacagaccatatggatcgtcttccccgggatgtggctcgggatcgcatgcaccatgacattgtgcgccttctggatgaatacaatgtgaccccaagccctccaggcaccgtgttgacttctgctctctcacctgtcatctgtgggcccaacagatctttcctcagcctgaagcacaccccaatgggcaagaagtctagacggcccagtgccaagagtaccatgcctactagcctccctaaccttgccaaggaggcaaaggatgccaagggtagtaggaggaagaagtctctgagtgagaaggtccaactgtctgagagttcagtaactttatcccctgttgattccctagaatctcctcacacgtatgtttccgacaccacatcctctccaatgattacatccctgggatcttacaggcctcacccaaccctatgttggccactgccgcccctcctgccccagtccatgcccagcatgcactatctttttctaaccttcatgaaatgcagcctttggcacatggggccagcactgtgcttccctcagtgagccagttgctatcccaccaccacattgtgtctccaggcagtggcagtgctggaagcttgagtaggctccatccagtcccagtcccagcagattggatgaaccgcatggaggtgaatgagacccagtacaatgagatgtttggtatggtcctggctccagctgagggcacccatcctggcatagctccccagagcaggccacctgaagggaagcacataaccacccctcgggagcccttgccccccattgtgactttccagctcatccctaaaggcagtattgcccaaccagcgggggctccccagcctcagtccacctgccctccagctgttgcgggccccctgcccaccatgtaccagattccagaaatggcccgtttgcccagtgtggctttccccactgccatgatgccccagcaggacgggcaggtagctcagaccattctcccagcctatcatcctttcccagcctctgtgggcaagtaccccacacccccttcacagcacagttatgcttcctcaaatgctgctgagcgaacacccagtcacagtggtcacctccagggtgagcatccctacctgacaccatccccagagtctcctgaccagtggtcaagttcatcaccccactctgcttctgactggtcagatgtgaccaccagccctacccctgggggtgctggaggaggtcagcggggacctgggacacacatgtctgagccaccacacaacaacatgcaggtttatgcgtgagagagtccacctccagtgtagagacataactgacttttgtaaatgctgctgaggaacaaatgaaggtcatccgggagagaaatgaagaaatctctggagccagcttctagaggtaggaaagagaagatgttcttattcagataatgcaagagaagcaattcgtcagtttcactgggtatctgcaaggcttattgattattctaatctaataagacaagtttgtggaaatgcaagatgaatacaagccttgggtccatgtttactctcttctatttggagaataagatggatgcttattgaagcccagacattcttgcagcttggactgcattttaagccctgcaggcttctgccatatccatgagaagattctacactagcgtcctgttgggaattatgccctggaattctgcctgaattgacctacgcatctcctcctccttggacattcttttgtcttcatttggtgcttttggttttgcacctctccgtgattgtagccctaccagcatgttatagggcaagacctttgtgcttttgatcattctggcccatgaaagcaactttggtctcctttcccctcctgtcttcccggtatcccttggagtctcacaaggtttactttggtatggttctcagcacaaacctttcaagtatgttgtttctttggaaaatggacatactgtattgtgttctcctgcatatatcattcctggagagagaaggggagaagaatacttttcttcaacaaattttgggggcaggagatcccttcaagaggctgcaccttaatttttcttgtctgtgtgcaggtcttcatataaactttaccaggaagaagggtgtgagtttgttgtttttctgtgtatgggcctggtcagtgtaaagttttatccttgatagtctagttactatgaccctccccacttttttaaaaccagaaaaaggtttggaatgttggaatgaccaagagacaagttaactcgtgcaagagccagttacccacccacaggtccccctacttcctgccaagcattccattgactgcctgtatggaacacatttgtcccagatctgagcattctaggcctgtttcactcactcacccagcatatgaaactagtcttaactgttgagcctttcctttcatatccacagaagacactgtctcaaatgttgtacccttgccatttaggactgaactttccttagcccaagggacccagtgacagttgtcttccgtttgtcagatgatcagtctctactgattatcttgctgcttaaaggcctgctcaccaatctttctttcacaccgtgtggtccgtgttactggtatacccagtatgttctcactgaagacatggactttatatgttcaagtgcaggaattggaaagttggacttgttttctatgatccaaaacagccctataagaaggttggaaaaggaggaactatatagcagcctttgctattttctgctaccatttcttttcctctgaagcggccatgacattccctttggcaactaacgtagaaactcaacagaacattttcctttcctagagtcaccttttagatgataatggacaactatagacttgctcattgttcagactgattgcccctcacctgaatccactctctgtattcatgctcttggcaatttctttgactttcttttaagggcagaagcattttagttaattgtagataaagaatagttttcttcctcttctccttgggccagttaataattggtccatggctacactgcaacttccgtccagtgctgtgatgcccatgacacctgcaaaataagttctgcctgggcattttgtagatattaacaggtgaattcccgactcttttggtttgaatgacagttctcattccttctatggctgcaagtatgcatcagtgcttcccacttacctgatttgtctgtcggtggccccatatggaaaccctgcgtgtctgttggcataatagtttacaaatggttttttcagtcctatccaaatttattgaaccaacaaaaataattacttctgccctgagataagcagattaagtttgttcattctctgctttattctctccatgtggcaacattctgtcagcctctttcatagtgtgcaaacattttatcattctaaatggtgactctctgcccttggacccatttattattcacagatggggagaacctatctgcatggacctctgtggaccacagcgtacctgcccctttctgccctcctgctccagccccacttctgaaagtatcagctactgatccagccactggatattttatatcctcccttttccttaagcacaatgtcagaccaaattgcttgtttctttttcttggactactttaatttggatcctttgggtttggagaaagggaatgtgaaagctgtcattacagacaacaggtttcagtgatgaggaggacaacactgcctttcaaactttttactgatctcttagattttaagaactcttgaattgtgtggtatctaataaaagggaaggtaagatggataatcactttctcatttgggttctgaattggagactcagtttttatgagacacatcttttatgccatgtatagatcctcccctgctatttttggtttatttttattgttataaatgctttctttctttgactcctcttctgcctgcctttggggataggtttttttgtttgtttatttgcttcctctgttttgttttaagcatcattttcttatgtgaggtggggaagggaaaggtatgagggaaagagagtctgagaattaaaatattttagtataagcaattggctgtgatgctcaaatccattgcatcctcttattgaatttgccaatttgtaatttttgcataataaagaaccaaaggtgtaatgttttgttgagaggtggtttagggattttggccctaaccaatacattgaatgtatgatgactatttgggaggacacatttatgtacccagaggcccccactaataagtggtactatggttacttccttgtgtacatttctcttaaaagtgatattatatctgtttgtatgagaaacccagtaaccaataaaatgaccgcatattcctgactaaacgtagtaaggaaaatgcacactttgtttttacttttccgtttcattctaaaggtagttaagatgaaatttatatgaaagcatttttatcacaaaataaaaaaggtttcatatacatttcatcttaactacctttagaatgaaacggaaaagtaaccaataaaatgaccgcatat

SEQ ID NO: 446653 - DNA, 4517 bp, Homo sapiens
agcgggttgcacacccgagaaagtttcagccaaacttcgggcggcggctgaggcggcggccgaggagcggcggactcggggcgcggggagtcgaggcatttgcgcctgggcttcggagcgtagcgccaggcctgagcctttgaagcaggaggaggggaggagagagtggggctcctctatcgggaccccctccccatgtggatctgcccaggcggcggcggcggcggcggaggaggaggcgaccgagaagatgcccgccctgcgccccgctctgctgtgggcgctgctggcgctctggctgtgctgcgcggcccccgcgcatgcattgcagtgtcgagatggctatgaaccctgtgtaaatgaaggaatgtgtgttacctaccacaatggcacaggatactgcaaatgtccagaaggcttcttgggggaatattgtcaacatcgagacccctgtgagaagaaccgctgccagaatggtgggacttgtgtggcccaggccatgctggggaaagccacgtgccgatgtgcctcagggtttacaggagaggactgccagtactcaacatctcatccatgctttgtgtctcgaccctgcctgaatggcggcacatgccatatgctcagccgggatacctatgagtgcacctgtcaagtcgggtttacaggtaaggagtgccaatggacggatgcctgcctgtctcatccctgtgcaaatggaagtacctgtaccactgtggccaaccagttctcctgcaaatgcctcacaggcttcacagggcagaaatgtgagactgatgtcaatgagtgtgacattccaggacactgccagcatggtggcacctgcctcaacctgcctggttcctaccagtgccagtgccctcagggcttcacaggccagtactgtgacagcctgtatgtgccctgtgcaccctcaccttgtgtcaatggaggcacctgtcggcagactggtgacttcacttttgagtgcaactgccttccaggttttgaagggagcacctgtgagaggaatattgatgactgccctaaccacaggtgtcagaatggaggggtttgtgtggatggggtcaacacttacaactgccgctgtcccccacaatggacaggacagttctgcacagaggatgtggatgaatgcctgctgcagcccaatgcctgtcaaaatgggggcacctgtgccaaccgcaatggaggctatggctgtgtatgtgtcaacggctggagtggagatgactgcagtgagaacattgatgattgtgccttcgcctcctgtactccaggctccacctgcatcgaccgtgtggcctccttctcttgcatgtgcccagaggggaaggcaggtctcctgtgtcatctggatgatgcatgcatcagcaatccttgccacaagggggcactgtgtgacaccaaccccctaaatgggcaatatatttgcacctgcccacaaggctacaaaggggctgactgcacagaagatgtggatgaatgtgccatggccaatagcaatccttgtgagcatgcaggaaaatgtgtgaacacggatggcgccttccactgtgagtgtctgaagggttatgcaggacctcgttgtgagatggacatcaatgagtgccattcagacccctgccagaatgatgctacctgtctggataagattggaggcttcacatgtctgtgcatgccaggtttcaaaggtgtgcattgtgaattagaaataaatgaatgtcagagcaacccttgtgtgaacaatgggcagtgtgtggataaagtcaatcgtttccagtgcctgtgtcctcctggtttcactgggccagtttgccagattgatattgatgactgttccagtactccgtgtctgaatggggcaaagtgtatcgatcacccgaatggctatgaatgccagtgtgccacaggtttcactggtgtgttgtgtgaggagaacattgacaactgtgaccccgatccttgccaccatggtcagtgtcaggatggtattgattcctacacctgcatctgcaatcccgggtacatgggcgccatctgcagtgaccagattgatgaatgttacagcagcccttgcctgaacgatggtcgctgcattgacctggtcaatggctaccagtgcaactgccagccaggcacgtcaggggttaattgtgaaattaattttgatgactgtgcaagtaacccttgtatccatggaatctgtatggatggcattaatcgctacagttgtgtctgctcaccaggattcacagggcagagatgtaacattgacattgatgagtgtgcctccaatccctgtcgcaagggtgcaacatgtatcaacggtgtgaatggtttccgctgtatatgccccgagggaccccatcaccccagctgctactcacaggtgaacgaatgcctgagcaatccctgcatccatggaaactgtactggaggtctcagtggatataagtgtctctgtgatgcaggctgggttggcatcaactgtgaagtggacaaaaatgaatgcctttcgaatccatgccagaatggaggaacttgtgacaatctggtgaatggatacaggtgtacttgcaagaagggctttaaaggctataactgccaggtgaatattgatgaatgtgcctcaaatccatgcctgaaccaaggaacctgctttgatgacataagtggctacacttgccactgtgtgctgccatacacaggcaagaattgtcagacagtattggctccctgttccccaaacccttgtgagaatgctgctgtttgcaaagagtcaccaaattttgagagttatacttgcttgtgtgctcctggctggcaaggtcagcggtgtaccattgacattgacgagtgtatctccaagccctgcatgaaccatggtctctgccataacacccagggcagctacatgtgtgaatgtccaccaggcttcagtggtatggactgtgaggaggacattgatgactgccttgccaatccttgccagaatggaggttcctgtatggatggagtgaatactttctcctgcctctgccttccgggtttcactggggataagtgccagacagacatgaatgagtgtctgagtgaaccctgtaagaatggagggacctgctctgactacgtcaacagttacacttgcaagtgccaggcaggatttgatggagtccattgtgagaacaacatcaatgagtgcactgagagctcctgtttcaatggtggcacatgtgttgatgggattaactccttctcttgcttgtgccctgtgggtttcactggatccttctgcctccatgagatcaatgaatgcagctctcatccatgcctgaatgagggaacgtgtgttgatggcctgggtacctaccgctgcagctgccccctgggctacactgggaaaaactgtcagaccctggtgaatctctgcagtcggtctccatgtaaaaacaaaggtacttgcgttcagaaaaaagcagagtcccagtgcctatgtccatctggatgggctggtgcctattgtgacgtgcccaatgtctcttgtgacatagcagcctccaggagaggtgtgcttgttgaacacttgtgccagcactcaggtgtctgcatcaatgctggcaacacgcattactgtcagtgccccctgggctatactgggagctactgtgaggagcaactcgatgagtgtgcgtccaacccctgccagcacggggcaacatgcagtgacttcattggtggatacagatgcgagtgtgtcccaggctatcagggtgtcaactgtgagtatgaagtggatgagtgccagaatcagccctgccagaatggaggcacctgtattgaccttgtgaaccatttcaagtgctcttgcccaccaggcactcggggcctactctgtgaagagaacattgatgactgtgcccggggtccccattgccttaatggtggtcagtgcatggataggattggaggctacagttgtcgctgcttgcctggctttgctggggagcgttgtgagggagacatcaacgagtgcctctccaacccctgcagctctgagggcagcctggactgtatacagctcaccaatgactacctgtgtgtttgccgtagtgcctttactggccggcactgtgaaaccttcgtcgatgtgtgtccccagatgccctgcctgaatggagggacttgtgctgtggccagtaacatgcctgatggtttcatttgccgttgtcccccgggattttccggggcaaggtgccagagcagctgtggacaagtgaaatgtaggaagggggagcagtgtgtgcacaccgcctctggaccccgctgcttctgccccagtccccgggactgcgagtcaggctgtgccagtagcccctgccagcactctgcatgccagcacccttgtcgagtgctgtctggatgctagggacagcagggccgtggacagcctccagaggtgttctcctgaaacctctgaatgtcccagccacaagaac

SEQ ID NO: 446654 - DNA, 3049 bp, Homo sapiens
agcgggttgcacacccgagaaagtttcagccaaacttcgggcggcggctgaggcggcggccgaggagcggcggactcggggcgcggggagtcgaggcatttgcgcctgggcttcggagcgtagcgccaggcctgagcctttgaagcaggaggaggggaggagagagtggggctcctctatcgggaccccctccccatgtggatctgcccaggcggcggcggcggcggcggaggaggaggcgaccgagaagatgcccgccctgcgccccgctctgctgtgggcgctgctggcgctctggctgtgctgcgcggcccccgcgcatgcattgcagtgtcgagatggctatgaaccctgtgtaaatgaaggaatgtgtgttacctaccacaatggcacaggatactgcaaatgtccagaaggcttcttgggggaatattgtcaacatcgagacccctgtgagaagaaccgctgccagaatggtgggacttgtgtggcccaggccatgctggggaaagccacgtgccgatgtgcctcagggtttacaggagaggactgccagtactcaacatctcatccatgctttgtgtctcgaccctgcctgaatggcggcacatgccatatgctcagccgggatacctatgagtgcacctgtcaagtcgggtttacaggtaaggagtgccaatggacggatgcctgcctgtctcatccctgtgcaaatggaagtacctgtaccactgtggccaaccagttctcctgcaaatgcctcacaggcttcacagggcagaaatgtgagactgatgtcaatgagtgtgacattccaggacactgccagcatggtggcacctgcctcaacctgcctggttcctaccagtgccagtgccctcagggcttcacaggccagtactgtgacagcctgtatgtgccctgtgcaccctcaccttgtgtcaatggaggcacctgtcggcagactggtgacttcacttttgagtgcaactgccttccaggttttgaagggagcacctgtgagaggaatattgatgactgccctaaccacaggtgtcagaatggaggggtttgtgtggatggggtcaacacttacaactgccgctgtcccccacaatggacaggacagttctgcacagaggatgtggatgaatgcctgctgcagcccaatgcctgtcaaaatgggggcacctgtgccaaccgcaatggaggctatggctgtgtatgtgtcaacggctggagtggagatgactgcagtgagaacattgatgattgtgccttcgcctcctgtactccaggctccacctgcatcgaccgtgtggcctccttctcttgcatgtgcccagaggggaaggcaggtctcctgtgtcatctggatgatgcatgcatcagcaatccttgccacaagggggcactgtgtgacaccaaccccctaaatgggcaatatatttgcacctgcccacaaggctacaaaggggctgactgcacagaagatgtggatgaatgtgccatggccaatagcaatccttgtgagcatgcaggaaaatgtgtgaacacggatggcgccttccactgtgagtgtctgaagggttatgcaggacctcgttgtgagatggacatcaatgagtgccattcagacccctgccagaatgatgctacctgtctggataagattggaggcttcacatgtctgtgcatgccaggtttcaaaggtgtgcattgtgaattagaaataaatgaatgtcagagcaacccttgtgtgaacaatgggcagtgtgtggataaagtcaatcgtttccagtgcctgtgtcctcctggtttcactgggccagtttgccagattgatattgatgactgttccagtactccgtgtctgaatggggcaaagtgtatcgatcacccgaatggctatgaatgccagtgtgccacaggtttcactggtgtgttgtgtgaggagaacattgacaactgtgaccccgatccttgccaccatggtcagtgtcaggatggtattgattcctacacctgcatctgcaatcccgggtacatgggcgccatctgcagtgaccagattgatgaatgttacagcagcccttgcctgaacgatggtcgctgcattgacctggtcaatggctaccagtgcaactgccagccaggcacgtcaggggttaattgtgaaattaattttgatgactgtgcaagtaacccttgtatccatggaatctgtatggatggcattaatcgctacagttgtgtctgctcaccaggattcacagggcagagatgtaacattgacattgatgagtgtgcctccaatccctgtcgcaagggtgcaacatgtatcaacggtgtgaatggtttccgctgtatatgccccgagggaccccatcaccccagctgctactcacaggtgaacgaatgcctgagcaatccctgcatccatggaaactgtactggaggtctcagtggatataagtgtctctgtgatgcaggctgggttggcatcaactgtgaagtggacaaaaatgaatgcctttcgaatccatgccagaatggaggaacttgtgacaatctggtgaatggatacaggtgtacttgcaagaagggctttaaaggctataactgccaggtgaatattgatgaatgtgcctcaaatccatgcctgaaccaaggaacctgctttgatgacataagtggctacacttgccactgtgtgctgccatacacagtaccgctacatctcactcagaggtgtcaccccttcgatggctgttacaactgagaagacaagaaatagtaggccaggcacggtggctcaccctgtaatcccagcactttgggaggccgaggcaggcggatcacgaggcaagaattgtcagacagtattggctccctgttccccaaacccttgtgagaatgctgctgtttgcaaagagtcaccaaattttgagagttatacttgcttgtgtgctcctggctggcaaggtcagcgtgtaccacttgacacttgatcgagtgtacctccacccccagcatcaccaaggctctt

SEQ ID NO: 446655 - DNA, 402 bp, Homo sapiens
ggccccctagcggctggaaggctgcaacctaagcctcacaagccatgatgttcattcttcagggagtttaagcaccttggcagcaacttcctaggccacagaagtcttcctggaacttcctaaagcagggggccaaccagtttgtctgtggaatagctccatgcaccccaactaagctcaggtcctgcgtagatttttgtgggaatcagcttccaaggactaggtcatttattggccctgtgttcctaggtcagcggtgtaccattgacattgacgagtgtatctccaagccctgcatgaaccatggtctctgccataacacccagggcagctacatgtgtgaatgtccaccaggcttcagtggtatggactgtgaggaggacattgatgactgccttgcca

SEQ ID NO: 446656 - DNA, 1334 bp, Homo sapiens
gagccggtccctactttccacagggggaatatccacccgtccctcatctgcgtctgttttggggattatctacagctcagtagcttaagaatttagacagccagcctttctagcctaaagttattcacggttatttgggtagagtctcagcccagaactggacattgcttccatcagcaacactaaggggagcttgaagtgcacatatgatgacctaggacttgcctcacaccaggcaaaacacactgcctcttgggagttctgcagaagctgccatttagttgagtgactttacctgaacatcaggaaaataaaccttcaggaggttggagctgggatatcgtgtgaagaaaaacattagtttggccttcttcaagtgaccagggtttagaccctcctggatttatctcagtgtcaaggaaaatgaacactttaaaatgccagtttatcaattaactagtgaattccttgttcctgtggtttctatttgatttcattttgtttttctgattggaattgtgtatttgctccatttttctgtctctggaaactctggtcaaataagctggatgacatatgtgcacagttaagtcacagaatgtaaaaatcatctcgatgtggaaaagttatgtagcatagatgatgtcaaatacaggttggtgtattttgtgtgtgtgtgtgtgtgtgtgtgtgtgtgtggtgtcttagatgtcaaatacaggttggtgtattgtgtgtgtgtgtgtgtgtgtgtgtgtgtgtgtgtgtgtgtgtggtgtccaagtgggatgggaagagatggcaattctatcccagataaaccatttcaaaaccccaagcagagatttacttcccctctctgcctcagtttcctcagctgtaaaacgagaagagtaaactaggtggtccccattctggctgtcactcttatcattgccttcacagtgttgcctttataaccagcaaacatctaagcaggctgaataccagctcatattttgctcttgctcaagaagcttgaatggttgggtggtacccactctccatttgcctggcagaactatccctcatctttcaggtctcagctcagaagctcccacctctgttaaacccttccttgccaaattaggccttccttaccctgggctatgaagactctttgtacaaactgttgcagcgatgaccttattggaatttttactgtatgtttgtctcgtctagactgtgagctccttgagagtgaggaccttatcttttcatctttgtgcctagcccagtgctaggaacatagcaggtgctcaataaatatttgttgtgtgaaggagtaagtgagt

SEQ ID NO: 446657 - DNA, 6081 bp, Homo sapiens
  misc_feature (2)..(2): n is a, c, g, or t
  misc_feature (4)..(4): n is a, c, g, or t
  misc_feature (7)..(7): n is a, c, g, or t
gncncgnggctggacggagctggcaggaggggccttgccagcttccgccgccgcgtcgtttcaggacccggacggcggattcgcgctgcctccgccgccgcggggcagccggggggcagggagcccagcgaggggcgcgcgtgggcgcggccatgggactgcgccggatccggtgacagcagggagccaagcggcccgggccctgagcgcgtcttctccggggggcctcgccctcctgctcgcggggccggggctcctgctccggttgctggcgctgttgctggctgtggcggcggccaggatcatgtcgggtcgccgctgcgccggcgggggagcggcctgcgcgagcgccgcggccgaggccgtggagccggccgcccgagagctgttcgaggcgtgccgcaacggggacgtggaacgagtcaagaggctggtgacgcctgagaaggtgaacagccgcgacacggcgggcaggaaatccaccccgctgcacttcgccgcaggttttgggcggaaagacgtagttgaatatttgcttcagaatggtgcaaatgtccaagcacgtgatgatgggggccttattcctcttcataatgcatgctcttttggtcatgctgaagtagtcaatctccttttgcgacatggtgcagaccccaatgctcgagataattggaattatactcctctccatgaagctgcaattaaaggaaagattgatgtttgcattgtgctgttacagcatggagctgagccaaccatccgaaatacagatggaaggacagcattggatttagcagatccatctgccaaagcagtgcttactggtgaatataagaaagatgaactcttagaaagtgccaggagtggcaatgaagaaaaaatgatggctctactcacaccattaaatgtcaactgccacgcaagtgatggcagaaagtcaactccattacatttggcagcaggatataacagagtaaagattgtacagctgttactgcaacatggagctgatgtccatgctaaagataaaggtgatctggtaccattacacaatgcctgttcttatggtcattatgaagtaactgaacttttggtcaagcatggtgcctgtgtaaatgcaatggacttgtggcaattcactcctcttcatgaggcagcttctaagaacagggttgaagtatgttctcttctcttaagttatggtgcagacccaacactgctcaattgtcacaataaaagtgctatagacttggctcccacaccacagttaaaagaaagattagcatatgaatttaaaggccactcgttgctgcaagctgcacgagaagctgatgttactcgaatcaaaaaacatctctctctggaaatggtgaatttcaagcatcctcaaacacatgaaacagcattgcattgtgctgctgcatctccatatcccaaaagaaagcaaatatgtgaactgttgctaagaaaaggagcaaacatcaatgaaaagactaaagaattcttgactcctctgcacgtggcatctgagaaagctcataatgatgttgttgaagtagtggtgaaacatgaagcaaaggttaatgctctggataatcttggtcagacttctctacacagagctgcatattgtggtcatctacaaacctgccgcctactcctgagctatgggtgtgatcctaacattatatcccttcagggctttactgctttacagatgggaaatgaaaatgtacagcaactcctccaagagggtatctcattaggtaattcagaggcagacagacaattgctggaagctgcaaaggctggagatgtcgaaactgtaaaaaaactgtgtactgttcagagtgtcaactgcagagacattgaagggcgtcagtctacaccacttcattttgcagctgggtataacagagtgtccgtggtggaatatctgctacagcatggagctgatgtgcatgctaaagataaaggaggccttgtacctttgcacaatgcatgttcttatggacattatgaagttgcagaacttcttgttaaacatggagcagtagttaatgtagctgatttatggaaatttacacctttacatgaagcagcagcaaaaggaaaatatgaaatttgcaaacttctgctccagcatggtgcagaccctacaaaaaaaaacagggatggaaatactcctttggatcttgttaaagatggagatacagatattcaagatctgcttaggggagatgcagctttgctagatgctgccaagaagggttgtttagccagagtgaagaagttgtcttctcctgataatgtaaattgccgcgatacccaaggcagacattcaacacctttacatttagcagctggttataataatttagaagttgcagagtatttgttacaacacggagctgatgtgaatgcccaagacaaaggaggacttattcctttacataatgcagcatcttacgggcatgtagatgtagcagctctactaataaagtataatgcatgtgtcaatgccacggacaaatgggctttcacacctttgcacgaagcagcccaaaagggacgaacacagctttgtgctttgttgctagcccatggagctgacccgactcttaaaaatcaggaaggacaaacacctttagatttagtttcagcggatgatgtcagcgctcttctgacagcagccatgcccccatctgctctgccctcttgttacaagcctcaagtgctcaatggtgtgagaagcccaggagccactgcagatgctctctcttcaggtccatctagcccatcaagcctttctgcagccagcagtcttgacaacttatctgggagtttttcagaactgtcttcagtagttagttcaagtggaacagagggtgcttccagtttggagaaaaaggaggttccaggagtagattttagcataactcaattcgtaaggaatcttggacttgagcacctaatggatatatttgagagagaacagatcactttggatgtattagttgagatggggcacaaggagctgaaggagattggaatcaatgcttatggacataggcacaaactaattaaaggagtcgagagacttatctccggacaacaaggtcttaacccatatttaactttgaacacctctggtagtggaacaattcttatagatctgtctcctgatgataaagagtttcagtctgtggaggaagagatgcaaagtacagttcgagagcacagagatggaggtcatgcaggtggaatcttcaacagatacaatattctcaagattcagaaggtttgtaacaagaaactatgggaaagatacactcaccggagaaaagaagtttctgaagaaaaccacaaccatgccaatgaacgaatgctatttcatgggtctccttttgtgaatgcaattatccacaaaggctttgatgaaaggcatgcgtacataggtggtatgtttggagctggcatttattttgctgaaaactcttccaaaagcaatcaatatgtatatggaattggaggaggtactgggtgtccagttcacaaagacagatcttgttacatttgccacaggcagctgctcttttgccgggtaaccttgggaaagtctttcctgcagttcagtgcaatgaaaatggcacattctcctccaggtcatcactcagtcactggtaggcccagtgtaaatggcctagcattagctgaatatgttatttacagaggagaacaggcttatcctgagtatttaattacttaccagattatgaggcctgaaggtatggtcgatggataaatagttattttaagaaactaattccactgaacctaaaatcatcaaagcagcagtggcctctacgttttactcctttgctgaaaaaaaatcatcttgcccacaggcctgtggcaaaaggataaaaatgtgaacgaagtttaacattctgacttgataaagctttaataatgtacagtgttttctaaatatttcctgttttttcagcactttaacagatgccattccaggttaaactgggttgtctgtactaaattataaacagagttaacttgaaccttttatatgttatgcattgattctaacaaactgtaatgccctcaacagaactaattttactaatacaatactgtgttctttaaaacacagcatttacactgaatacaatttcatttgtaaaactgtaaataagagcttttgtactagcccagtatttatttacattgctttgtaatataaatctgttttagaactgcagcggtttacaaaattttttcatatgtattgttcatctatacttcatcttacatcgtcatgattgagtgatctttacatttgattccagaggctatgttcagttgttagttgggaaagattgagttatcagatttaatttgccgatgggagcctttatctgtcattagaaatctttctcatttaagaacttatgaatatgctgaagatttaatttgtgatacctttgtatgtatgagacacattccaaagagctctaactatgataggtcctgattactaaagaagcttctttactggcctcaatttctagctttcatgttggaaaattttctgcagtccttctgtgaaaattagagcaaagtgctcctgttttttagagaaactaaatcttgctgttgaacaattattgtgttcttttcatggaacataagtaggatgttacatttccagggtgggaagggtaatcctaaatcatttcccaatctattctaattaccttaaatctaaaggggaaaaaaaaaatcacaaacaggactgggtagttttttatcctaagtatattttttcctgttctttttacttggttttattgctgtatttatagccaatctatacatcatgggtaaacttaacccagaactataaaatgtagttgtctcagtcccctccaggcctcctgaatgggcaagtgcagtgaaacaggtgcttcttgctcctgggttttctctccatgatgttatgcccaattggaaatatgctgtcagtttgtgcaccatatggtgaccaggcctgtgctcagtttggcagctatagaaggaaatgctgtcccataaaatgccattcctattttctaatataaaactcttttccaggaagcatgcttaagcatcttgttacagagacatacatccattatggcttggcaatctcttttatttgttgactctagctcccttcaaagtcgaggaaagatctttactcacttaatgaggacattccccatcactgtctgtaccagttcacctttattttacgttttattcagtctgtaaattaactggccctttgcagtaacttgtacataaagtgctagaaaatcatgttccttgtcctgagtaagagttaatcagagtaaatgcatttctggagttgtttctgtgatgtaaattatgatcattatttaagaagtcaaatcctgatcttgaagtgctttttatacagctctctaataattacaaatatccgaaagtcatttcttggaacacaagtggagtatgccaaattttatatgaatttttcagattatctaagcttccaggttttataattagaagataatgagagaattaatggggtttatatttacattatctctcaactatgtagcccatattactcaccctatgagtgaatctggaattgcttttcatgtgaaatcattgtggtctatgagtttacaatactgcaaactgtgttattttatctaatccattgcttaatgagtgtgtttttccatgaatgaatataccgtggttcatatgttagcatggcagcattttcagatagctttttgtttgttgggaagttggggttttggggggagggggagtattagtacgttgcatgaaatagcttactttataatgatggaattgctttttcttttgtcttgtgatttttttttttgaagtgaaatttaactttttgtgcaagtagtactattatacccatcttcagtgtcttacttgtactgtatcacattccataccctcatttaattcttaataaaactgttcacttgt

SEQ ID NO: 446658 - DNA, 1544 bp, Homo sapiens
ttctcactccatgtaagttgagacctcactgtccaaagaaaccaattactctatgtgtctttcaagtattttggaagtgataagccacaaatgctaacatggtgagaaaaagctttacttccactggctatcaggagtttctagtccatgcaagacaaaatatgacttgacctttgattggaagttgtgctgtgcatatttatgttagcttttatatctttcttgtagcctatctagaacacttaacattactgtgtccaagttgtctttgtaagtcacaaataatttgtatgcataaaatatttctgtccacttctgcagcgttaaataccatagccttgagacctagaaagacttttagattaatgtaatattttatggtagttttataattgtattcttctttaacttgatctttttaaattctttggctttaaatcctttagcaaaaggataaaaactataatagaaataagttttatttcatggctttaacagcacctaagttcctctactagacttgcagagatgtgtacctctgagttctctctagcaaaaaagcatgctcttgtggccttctggggaagaggactctgaggcccactctggtttgacttgtatgtgattgcagacctttgacttgcagcctctgagacccatgtacctgagttcaagaagtggtatgtaacacccatgaaggcagagactttggtaggaaggttttcataggaaagatacaagcaaatcagtcaatataattttgggaatctacaaagctaattgataacacaaaaagcttccaacttgaggcaagggggaaatgttttccagaaggtaaattgttaatagagtccaatgagctatttcagatttatacaaaatctctttttttatgttttcagtaatgtctatgccttataaatacatatatatatgtatacatgtaatgacttttttatgttaacaagtggaagtattatgacataggactaaaaaagaaaaaacaagtaaagtaattttacttcttttctaaattagctggttataataatttagaagttgcagagtatttgttacaacacggagctgatgtgaatgcccaagacaaaggaggacttattcctttacataatgcagcatcttacggggtaagttcttccgtgttacctttaaaaatttgtggaattttaaagtgaaagtcagtattgcagctcaaatggaatgtagtttgatgttctcattttacagagaagtaagtggcagagctaaagaagttaaataacttccaaatttcggttctgaatctgttctaagcttgctgtgtgatatgcggtgtattgttgtttgttttattatctgccttaacacctgtctcttattttcagtgagatgttggtgattgtgtttatttgttggtacccagaaaatccactggggcaccaacggggtagatggaatctgtacagattcagatgcattgttcctgacttatcatagtccaatgtgacattcaaaattgaccatcttcaatggtatagtttgaa

SEQ ID NO: 446659 - DNA, 866 bp, Homo sapiens
ctggtgatctagcggatccttacactgagttcgagttcactttattactagtatgttacattcagtaagaacaattgaagtaggctctgccagtccccatgtgctttgggaatcattattccaggtaatcattttattggtatcacctttggtaaacaagtttgaaaaatatgcctacttgagccagccttccttataggaagctaaagctttctatttttcctgatggtagctgctaagcacaagcaggaaaaaaaaaaaatctcaaaactctcagaagttacataagcctctcaccaaagttatctgtggtatgggttggtgagagttctcataacaaaataccaaagaccaggtggcttaaacaacagaaatttgttttctcacagttctggaggctaggagtccaagttcaaggtgttggcagagttggtttcttctgaaaccccctcttggcttgcagctgtctaccttctcagtgtgtcctccattggaacatggtgtctctttctatatgtcctagtctctacttttaaggaaaccagtcaaattagattagagcccaccctaatgggctcattttaacttttttagctctttaaaggctctgtctccaaatagagtcatattctaaggtactggggttagggcttcaacataagaattttgcagggtacaattcatttcgtgacatttgttttaaggtttcactcataaaactggcacagtgtacctttgttttcagtgcaaatatacaatatattgtggtttcagtacagctttttcagctgcattacagatgttaggaaatcattaaaatcactgagctatagctaatacctcagtggagttccatcatagacaca

SEQ ID NO: 446660 - DNA, 6555 bp, Homo sapiens
  misc_feature (2)..(2): n is a, c, g, or t
  misc_feature (4)..(4): n is a, c, g, or t
  misc_feature (7)..(7): n is a, c, g, or t
gncncgnggctggacggagctggcaggaggggccttgccagcttccgccgccgcgtcgtttcaggacccggacggcggattcgcgctgcctccgccgccgcggggcagccggggggcagggagcccagcgaggggcgcgcgtgggcgcggccatgggactgcgccggatccggtgacagcagggagccaagcggcccgggccctgagcgcgtcttctccggggggcctcgccctcctgctcgcggggccggggctcctgctccggttgctggcgctgttgctggctgtggcggcggccaggatcatgtcgggtcgccgctgcgccggcgggggagcggcctgcgcgagcgccgcggccgaggccgtggagccggccgcccgagagctgttcgaggcgtgccgcaacggggacgtggaacgagtcaagaggctggtgacgcctgagaaggtgaacagccgcgacacggcgggcaggaaatccaccccgctgcacttcgccgcaggttttgggcggaaagacgtagttgaatatttgcttcagaatggtgcaaatgtccaagcacgtgatgatgggggccttattcctcttcataatgcatgctcttttggtcatgctgaagtagtcaatctccttttgcgacatggtgcagaccccaatgctcgagataattggaattatactcctctccatgaagctgcaattaaaggaaagattgatgtttgcattgtgctgttacagcatggagctgagccaaccatccgaaatacagatggaaggacagcattggatttagcagatccatctgccaaagcagtgcttactggtgaatataagaaagatgaactcttagaaagtgccaggagtggcaatgaagaaaaaatgatggctctactcacaccattaaatgtcaactgccacgcaagtgatggcagaaagtcaactccattacatttggcagcaggatataacagagtaaagattgtacagctgttactgcaacatggagctgatgtccatgctaaagataaaggtgatctggtaccattacacaatgcctgttcttatggtcattatgaagtaactgaacttttggtcaagcatggtgcctgtgtaaatgcaatggacttgtggcaattcactcctcttcatgaggcagcttctaagaacagggttgaagtatgttctcttctcttaagttatggtgcagacccaacactgctcaattgtcacaataaaagtgctatagacttggctcccacaccacagttaaaagaaagattagcatatgaatttaaaggccactcgttgctgcaagctgcacgagaagctgatgttactcgaatcaaaaaacatctctctctggaaatggtgaatttcaagcatcctcaaacacatgaaacagcattgcattgtgctgctgcatctccatatcccaaaagaaagcaaatatgtgaactgttgctaagaaaaggagcaaacatcaatgaaaagactaaagaattcttgactcctctgcacgtggcatctgagaaagctcataatgatgttgttgaagtagtggtgaaacatgaagcaaaggttaatgctctggataatcttggtcagacttctctacacagagctgcatattgtggtcatctacaaacctgccgcctactcctgagctatgggtgtgatcctaacattatatcccttcagggctttactgctttacagatgggaaatgaaaatgtacagcaactcctccaagagggtatctcattaggtaattcagaggcagacagacaattgctggaagctgcaaaggctggagatgtcgaaactgtaaaaaaactgtgtactgttcagagtgtcaactgcagagacattgaagggcgtcagtctacaccacttcattttgcagctgggtataacagagtgtccgtggtggaatatctgctacagcatggagctgatgtgcatgctaaagataaaggaggccttgtacctttgcacaatgcatgttcttatggacattatgaagttgcagaacttcttgttaaacatggagcagtagttaatgtagctgatttatggaaatttacacctttacatgaagcagcagcaaaaggaaaatatgaaatttgcaaacttctgctccagcatggtgcagaccctacaaaaaaaaacagggatggaaatactcctttggatcttgttaaagatggagatacagatattcaagatctgcttaggggagatgcagctttgctagatgctgccaagaagggttgtttagccagagtgaagaagttgtcttctcctgataatgtaaattgccgcgatacccaaggcagacattcaacacctttacatttagcagctggttataataatttagaagttgcagagtatttgttacaacacggagctgatgtgaatgcccaagacaaaggaggacttattcctttacataatgcagcatcttacgggcatgtagatgtagcagctctactaataaagtataatgcatgtgtcaatgccacggacaaatgggctttcacacctttgcacgaagcagcccaaaagggacgaacacagctttgtgctttgttgctagcccatggagctgacccgactcttaaaaatcaggaaggacaaacacctttagatttagtttcagcggatgatgtcagcgctcttctgacagcagccatgcccccatctgctctgccctcttgttacaagcctcaagtgctcaatggtgtgagaagcccaggagccactgcagatgctctctcttcaggtccatctagcccatcaagcctttctgcagccagcagtcttgacaacttatctgggagtttttcagaactgtcttcagtagttagttcaagtggaacagagggtgcttccagtttggagaaaaaggaggttccaggagtagattttagcataactcaattcgtaaggaatcttggacttgagcacctaatggatatatttgagagagaacagatcactttggatgtattagttgagatggggcacaaggagctgaaggagattggaatcaatgcttatggacataggcacaaactaattaaaggagtcgagagacttatctccggacaacaaggtcttaacccatatttaactttgaacacctctggtagtggaacaattcttatagatctgtctcctgatgataaagagtttcagtctgtggaggaagagatgcaaagtacagttcgagagcacagagatggaggtcatgcaggtggaatcttcaacagatacaatattctcaagattcagaaggtttgtaacaagaaactatgggaaagatacactcaccggagaaaagaagtttctgaagaaaaccacaaccatgccaatgaacgaatgctatttcatgggtctccttttgtgaatgcaattatccacaaaggctttgatgaaaggcatgcgtacataggtggtatgtttggagctggcatttattttgctgaaaactcttccaaaagcaatcaatatgtatatggaattggaggaggtactgggtgtccagttcacaaagacagatcttgttacatttgccacaggcagctgctcttttgccgggtaaccttgggaaagtctttcctgcagttcagtgcaatgaaaatggcacattctcctccaggtcatcactcagtcactggtaggcccagtgtaaatggcctagcattagctgaatatgttatttacagaggagaacaggcttatcctgagtatttaattacttaccagattatgaggcctgaaggtatggtcgatggataaatagttattttaagaaactaattccactgaacctaaaatcatcaaagcagcagtggcctctacgttttactcctttgctgaaaaaaaatcatcttgcccacaggcctgtggcaaaaggataaaaatgtgaacgaagtttaacattctgacttgataaagctttaataatgtacagtgttttctaaatatttcctgttttttcagcactttaacagatgccattccaggttaaactgggttgtctgtactaaattataaacagagttaacttgaaccttttatatgttatgcattgattctaacaaactgtaatgccctcaacagaactaattttactaatacaatactgtgttctttaaaacacagcatttacactgaatacaatttcatttgtaaaactgtaaataagagcttttgtactagcccagtatttatttacattgctttgtaatataaatctgttttagaactgcagcggtttacaaaattttttcatatgtattgttcatctatacttcatcttacatcgtcatgattgagtgatctttacatttgattccagaggctatgttcagttgttagttgggaaagattgagttatcagatttaatttgccgatgggagcctttatctgtcattagaaatctttctcatttaagaacttatgaatatgctgaagatttaatttgtgatacctttgtatgtatgagacacattccaaagagctctaactatgataggtcctgattactaaagaagcttctttactggcctcaatttctagctttcatgttggaaaattttctgcagtccttctgtgaaaattagagcaaagtgctcctgttttttagagaaactaaatcttgctgttgaacaattattgtgttcttttcatggaacataagtaggatgttacatttccagggtgggaagggtaatcctaaatcatttcccaatctattctaattaccttaaatctaaaggggaaaaaaaaaatcacaaacaggactgggtagttttttatcctaagtatattttttcctgttctttttacttggttttattgctgtatttatagccaatctatacatcatgggtaaacttaacccagaactataaaatgtagttgtctcagtcccctccaggcctcctgaatgggcaagtgcagtgaaacaggtgcttcttgctcctgggttttctctccatgatgttatgcccaattggaaatatgctgtcagtttgtgcaccatatggtgaccaggcctgtgctcagtttggcagctatagaaggaaatgctgtcccataaaatgccattcctattttctaatataaaactcttttccaggaagcatgcttaagcatcttgttacagagacatacatccattatggcttggcaatctcttttatttgttgactctagctcccttcaaagtcgaggaaagatctttactcacttaatgaggacattccccatcactgtctgtaccagttcacctttattttacgttttattcagtctgtaaattaactggccctttgcagtaacttgtacataaagtgctagaaaatcatgttccttgtcctgagtaagagttaatcagagtaaatgcatttctggagttgtttctgtgatgtaaattatgatcattatttaagaagtcaaatcctgatcttgaagtgctttttatacagctctctaataattacaaatatccgaaagtcatttcttggaacacaagtggagtatgccaaattttatatgaatttttcagattatctaagcttccaggttttataattagaagataatgagagaattaatggggtttatatttacattatctctcaactatgtagcccatattactcaccctatgagtgaatctggaattgcttttcatgtgaaatcattgtggtctatgagtttacaatactgcaaactgtgttattttatctaatccattgcttaatgagtgtgtttttccatgaatgaatataccgtggttcatatgttagcatggcagcattttcagatagctttttgtttgttgggaagttggggttttggggggagggggagtattagtacgttgcatgaaatagcttactttataatgatggaattgctttttcttttgtcttgtgatttttttttttgaagtgaaatttaactttttgtgcaagtagtactattatacccatcttcagtgtcttacttgtactgtatcacattccataccctcatttaattcttaataaaactgttcacttgtttttctgggtagcatggtaattactggaatagtataaatgtgttgaatggtctttgagaaaatgaattaagattacaataaaccacaattgcaggaaaacaatgtagttctgagtctaatagtgataaagaatgcagtttgaagtttgaaatattgaatattgtagctgtacttgctcattaaaatgaaagtagctgtgagatgctttcaacatttagtctattcagcacaactggtaaaccttaaagctcattcctgggaaattaatcttcttaacttataaaaaggaatatatttttatttctgtgtcatatgaaaacattcttaataagtttccaaatctcaaagttagtggtatttattgctattaaaagaaagagtaatcgcatatgtatattagacttcagtatgttaagtttccttgtgtgtgagcaattccctgatttccataataagagaatgatggtgcaaata

SEQ ID NO: 446661 - DNA, 5230 bp, Homo sapiens
ttctcactccatgtaagttgagacctcactgtccaaagaaaccaattactctatgtgtctttcaagtattttggaagtgataagccacaaatgctaacatggtgagaaaaagctttacttccactggctatcaggagtttctagtccatgcaagacaaaatatgacttgacctttgattggaagttgtgctgtgcatatttatgttagcttttatatctttcttgtagcctatctagaacacttaacattactgtgtccaagttgtctttgtaagtcacaaataatttgtatgcataaaatatttctgtccacttctgcagcgttaaataccatagccttgagacctagaaagacttttagattaatgtaatattttatggtagttttataattgtattcttctttaacttgatctttttaaattctttggctttaaatcctttagcaaaaggataaaaactataatagaaataagttttatttcatggctttaacagcacctaagttcctctactagacttgcagagatgtgtacctctgagttctctctagcaaaaaagcatgctcttgtggccttctggggaagaggactctgaggcccactctggtttgacttgtatgtgattgcagacctttgacttgcagcctctgagacccatgtacctgagttcaagaagtggtatgtaacacccatgaaggcagagactttggtaggaaggttttcataggaaagatacaagcaaatcagtcaatataattttgggaatctacaaagctaattgataacacaaaaagcttccaacttgaggcaagggggaaatgttttccagaaggtaaattgttaatagagtccaatgagctatttcagatttatacaaaatctctttttttatgttttcagtaatgtctatgccttataaatacatatatatatgtatacatgtaatgacttttttatgttaacaagtggaagtattatgacataggactaaaaaagaaaaaacaagtaaagtaattttacttcttttctaaattagctggttataataatttagaagttgcagagtatttgttacaacacggagctgatgtgaatgcccaagacaaaggaggacttattcctttacataatgcagcatcttacgggcatgtagatgtagcagctctactaataaagtataatgcatgtgtcaatgccacggacaaatgggctttcacacctttgcacgaagcagcccaaaagggacgaacacagctttgtgctttgttgctagcccatggagctgacccgactcttaaaaatcaggaaggacaaacacctttagatttagtttcagcggatgatgtcagcgctcttctgacagcagccatgcccccatctgctctgccctcttgttacaagcctcaagtgctcaatggtgtgagaagcccaggagccactgcagatgctctctcttcaggtccatctagcccatcaagcctttctgcagccagcagtcttgacaacttatctgggagtttttcagaactgtcttcagtagttagttcaagtggaacagagggtgcttccagtttggagaaaaaggaggttccaggagtagattttagcataactcaattcgtaaggaatcttggacttgagcacctaatggatatatttgagagagaacagatcactttggatgtattagttgagatggggcacaaggagctgaaggagattggaatcaatgcttatggacataggcacaaactaattaaaggagtcgagagacttatctccggacaacaaggtcttaacccatatttaactttgaacacctctggtagtggaacaattcttatagatctgtctcctgatgataaagagtttcagtctgtggaggaagagatgcaaagtacagttcgagagcacagagatggaggtcatgcaggtggaatcttcaacagatacaatattctcaagattcagaaggtttgtaacaagaaactatgggaaagatacactcaccggagaaaagaagtttctgaagaaaaccacaaccatgccaatgaacgaatgctatttcatgggtctccttttgtgaatgcaattatccacaaaggctttgatgaaaggcatgcgtacataggtggtatgtttggagctggcatttattttgctgaaaactcttccaaaagcaatcaatatgtatatggaattggaggaggtactgggtgtccagttcacaaagacagatcttgttacatttgccacaggcagctgctcttttgccgggtaaccttgggaaagtctttcctgcagttcagtgcaatgaaaatggcacattctcctccaggtcatcactcagtcactggtaggcccagtgtaaatggcctagcattagctgaatatgttatttacagaggagaacaggcttatcctgagtatttaattacttaccagattatgaggcctgaaggtatggtcgatggataaatagttattttaagaaactaattccactgaacctaaaatcatcaaagcagcagtggcctctacgttttactcctttgctgaaaaaaaatcatcttgcccacaggcctgtggcaaaaggataaaaatgtgaacgaagtttaacattctgacttgataaagctttaataatgtacagtgttttctaaatatttcctgttttttcagcactttaacagatgccattccaggttaaactgggttgtctgtactaaattataaacagagttaacttgaaccttttatatgttatgcattgattctaacaaactgtaatgccctcaacagaactaattttactaatacaatactgtgttctttaaaacacagcatttacactgaatacaatttcatttgtaaaactgtaaataagagcttttgtactagcccagtatttatttacattgctttgtaatataaatctgttttagaactgcagcggtttacaaaattttttcatatgtattgttcatctatacttcatcttacatcgtcatgattgagtgatctttacatttgattccagaggctatgttcagttgttagttgggaaagattgagttatcagatttaatttgccgatgggagcctttatctgtcattagaaatctttctcatttaagaacttatgaatatgctgaagatttaatttgtgatacctttgtatgtatgagacacattccaaagagctctaactatgataggtcctgattactaaagaagcttctttactggcctcaatttctagctttcatgttggaaaattttctgcagtccttctgtgaaaattagagcaaagtgctcctgttttttagagaaactaaatcttgctgttgaacaattattgtgttcttttcatggaacataagtaggatgttacatttccagggtgggaagggtaatcctaaatcatttcccaatctattctaattaccttaaatctaaaggggaaaaaaaaaatcacaaacaggactgggtagttttttatcctaagtatattttttcctgttctttttacttggttttattgctgtatttatagccaatctatacatcatgggtaaacttaacccagaactataaaatgtagttgtctcagtcccctccaggcctcctgaatgggcaagtgcagtgaaacaggtgcttcttgctcctgggttttctctccatgatgttatgcccaattggaaatatgctgtcagtttgtgcaccatatggtgaccaggcctgtgctcagtttggcagctatagaaggaaatgctgtcccataaaatgccattcctattttctaatataaaactcttttccaggaagcatgcttaagcatcttgttacagagacatacatccattatggcttggcaatctcttttatttgttgactctagctcccttcaaagtcgaggaaagatctttactcacttaatgaggacattccccatcactgtctgtaccagttcacctttattttacgttttattcagtctgtaaattaactggccctttgcagtaacttgtacataaagtgctagaaaatcatgttccttgtcctgagtaagagttaatcagagtaaatgcatttctggagttgtttctgtgatgtaaattatgatcattatttaagaagtcaaatcctgatcttgaagtgctttttatacagctctctaataattacaaatatccgaaagtcatttcttggaacacaagtggagtatgccaaattttatatgaatttttcagattatctaagcttccaggttttataattagaagataatgagagaattaatggggtttatatttacattatctctcaactatgtagcccatattactcaccctatgagtgaatctggaattgcttttcatgtgaaatcattgtggtctatgagtttacaatactgcaaactgtgttattttatctaatccattgcttaatgagtgtgtttttccatgaatgaatataccgtggttcatatgttagcatggcagcattttcagatagctttttgtttgttgggaagttggggttttggggggagggggagtattagtacgttgcatgaaatagcttactttataatgatggaattgctttttcttttgtcttgtgatttttttttttgaagtgaaatttaactttttgtgcaagtagtactattatacccatcttcagtgtcttacttgtactgtatcacattccataccctcatttaattcttaataaaactgttcacttgtttttctgggtagcatggtaattactggaatagtataaatgtgttgaatggtctttgagaaaatgaattaagattacaataaaccacaattgcaggaaaacaatgtagttctgagtctaatagtgataaagaatgcagtttgaagtttgaaatattgaatattgtagctgtacttgctcattaaaatgaaagtagctgtgagatgctttcaacatttagtctattcagcacaactggtaaaccttaaagctcattcctgggaaattaatcttcttaacttataaaaaggaatatatttttatttctgtgtcatatgaaaacattcttaataagtttccaaatctcaaagttagtggtatttattgctattaaaagaaagagtaatcgcatatgtatattagacttcagtatgttaagtttccttgtgtgtgagcaattccctgatttccataataagagaatgatggtgcaaata

SEQ ID NO: 446662 - DNA, 4834 bp, Homo sapiens
  misc_feature (18)..(18): n is a, c, g, or t
  misc_feature (22)..(22): n is a, c, g, or t
  misc_feature (25)..(25): n is a, c, g, or t
ctgttctagaggatcccngctnccnacaagagggtatctcattaggtaattcagaggcagacagacaattgctggaagctgcaaaggctggagatgtcgaaactgtaaaaaaactgtgtactgttcagagtgtcaactgcagagacattgaagggcgtcagtctacaccacttcattttgcagctgggtataacagagtgtccgtggtggaatatctgctacagcatggagctgatgtgcatgctaaagataaaggaggccttgtacctttgcacaatgcatgttcttatggacattatgaagttgcagaacttcttgttaaacatggagcagtagttaatgtagctgatttatggaaatttacacctttacatgaagcagcagcaaaaggaaaatatgaaatttgcaaacttctgctccagcatggtgcagaccctacaaaaaaaaacagggatggaaatactcctttggatcttgttaaagatggagatacagatattcaagatctgcttaggggagatgcagctttgctagatgctgccaagaagggttgtttagccagagtgaagaagttgtcttctcctgataatgtaaattgccgcgatacccaaggcagacattcaacacctttacatttagcagctggttataataatttagaagttgcagagtatttgttacaacacggagctgatgtgaatgcccaagacaaaggaggacttattcctttacataatgcagcatcttacgggcatgtagatgtagcagctctactaataaagtataatgcatgtgtcaatgccacggacaaatgggctttcacacctttgcacgaagcagcccaaaagggacgaacacagctttgtgctttgttgctagcccatggagctgacccgactcttaaaaatcaggaaggacaaacacctttagatttagtttcagcggatgatgtcagcgctcttctgacagcagccatgcccccatctgctctgccctcttgttacaagcctcaagtgctcaatggtgtgagaagcccaggagccactgcagatgctctctcttcaggtccatctagcccatcaagcctttctgcagccagcagtcttgacaacttatctgggagtttttcagaactgtcttcagtagttagttcaagtggaacagagggtgcttccagtttggagaaaaaggaggttccaggagtagattttagcataactcaattcgtaaggaatcttggacttgagcacctaatggatatatttgagagagaacagatcactttggatgtattagttgagatggggcacaaggagctgaaggagattggaatcaatgcttatggacataggcacaaactaattaaaggagtcgagagacttatctccggacaacaaggtcttaacccatatttaactttgaacacctctggtagtggaacaattcttatagatctgtctcctgatgataaagagtttcagtctgtggaggaagagatgcaaagtacagttcgagagcacagagatggaggtcatgcaggtggaatcttcaacagatacaatattctcaagattcagaaggtttgtaacaagaaactatgggaaagatacactcaccggagaaaagaagtttctgaagaaaaccacaaccatgccaatgaacgaatgctatttcatgggtctccttttgtgaatgcaattatccacaaaggctttgatgaaaggcatgcgtacataggtggtatgtttggagctggcatttattttgctgaaaactcttccaaaagcaatcaatatgtatatggaattggaggaggtactgggtgtccagttcacaaagacagatcttgttacatttgccacaggcagctgctcttttgccgggtaaccttgggaaagtctttcctgcagttcagtgcaatgaaaatggcacattctcctccaggtcatcactcagtcactggtaggcccagtgtaaatggcctagcattagctgaatatgttatttacagaggagaacaggcttatcctgagtatttaattacttaccagattatgaggcctgaaggtatggtcgatggataaatagttattttaagaaactaattccactgaacctaaaatcatcaaagcagcagtggcctctacgttttactcctttgctgaaaaaaaatcatcttgcccacaggcctgtggcaaaaggataaaaatgtgaacgaagtttaacattctgacttgataaagctttaataatgtacagtgttttctaaatatttcctgttttttcagcactttaacagatgccattccaggttaaactgggttgtctgtactaaattataaacagagttaacttgaaccttttatatgttatgcattgattctaacaaactgtaatgccctcaacagaactaattttactaatacaatactgtgttctttaaaacacagcatttacactgaatacaatttcatttgtaaaactgtaaataagagcttttgtactagcccagtatttatttacattgctttgtaatataaatctgttttagaactgcagcggtttacaaaattttttcatatgtattgttcatctatacttcatcttacatcgtcatgattgagtgatctttacatttgattccagaggctatgttcagttgttagttgggaaagattgagttatcagatttaatttgccgatgggagcctttatctgtcattagaaatctttctcatttaagaacttatgaatatgctgaagatttaatttgtgatacctttgtatgtatgagacacattccaaagagctctaactatgataggtcctgattactaaagaagcttctttactggcctcaatttctagctttcatgttggaaaattttctgcagtccttctgtgaaaattagagcaaagtgctcctgttttttagagaaactaaatcttgctgttgaacaattattgtgttcttttcatggaacataagtaggatgttacatttccagggtgggaagggtaatcctaaatcatttcccaatctattctaattaccttaaatctaaaggggaaaaaaaaaatcacaaacaggactgggtagttttttatcctaagtatattttttcctgttctttttacttggttttattgctgtatttatagccaatctatacatcatgggtaaacttaacccagaactataaaatgtagttgtctcagtcccctccaggcctcctgaatgggcaagtgcagtgaaacaggtgcttcttgctcctgggttttctctccatgatgttatgcccaattggaaatatgctgtcagtttgtgcaccatatggtgaccaggcctgtgctcagtttggcagctatagaaggaaatgctgtcccataaaatgccattcctattttctaatataaaactcttttccaggaagcatgcttaagcatcttgttacagagacatacatccattatggcttggcaatctcttttatttgttgactctagctcccttcaaagtcgaggaaagatctttactcacttaatgaggacattccccatcactgtctgtaccagttcacctttattttacgttttattcagtctgtaaattaactggccctttgcagtaacttgtacataaagtgctagaaaatcatgttccttgtcctgagtaagagttaatcagagtaaatgcatttctggagttgtttctgtgatgtaaattatgatcattatttaagaagtcaaatcctgatcttgaagtgctttttatacagctctctaataattacaaatatccgaaagtcatttcttggaacacaagtggagtatgccaaattttatatgaatttttcagattatctaagcttccaggttttataattagaagataatgagagaattaatggggtttatatttacattatctctcaactatgtagcccatattactcaccctatgagtgaatctggaattgcttttcatgtgaaatcattgtggtctatgagtttacaatactgcaaactgtgttattttatctaatccattgcttaatgagtgtgtttttccatgaatgaatataccgtggttcatatgttagcatggcagcattttcagatagctttttgtttgttgggaagttggggttttggggggagggggagtattagtacgttgcatgaaatagcttactttataatgatggaattgctttttcttttgtcttgtgatttttttttttgaagtgaaatttaactttttgtgcaagtagtactattatacccatcttcagtgtcttacttgtactgtatcacattccataccctcatttaattcttaataaaactgttcacttgtttttctgggtagcatggtaattactggaatagtataaatgtgttgaatggtctttgagaaaatgaattaagattacaataaaccacaattgcaggaaaacaatgtagttctgagtctaatagtgataaagaatgcagtttgaagtttgaaatattgaatattgtagctgtacttgctcattaaaatgaaagtagctgtgagatgctttcaacatttagtctattcagcacaactggtaaaccttaaagctcattcctgggaaattaatcttcttaacttataaaaaggaatatatttttatttctgtgtcatatgaaaacattcttaataagtttccaaatctcaaagttagtggtatttattgctattaaaagaaagagtaatcgcatatgtatattagacttcagtatgttaagtttccttgtgtgtgagcaattccctgatttccataataagagaatgatggtgcaaata

SEQ ID NO: 446663 - DNA, 4068 bp, Homo sapiens
atttcctttgagcttcacgtcaacattttaaaattttcagatttgggatgtttgacctgtattaacctgtttgcttcactttttaaaatgaataatcctccattgtgatagtactggcacaaattgctgggttttctcatatttttaaatatattttattaggtataatagcattttaaaacttgcttatggcagatgttgtctctgacacgtaccctaggcggatgatgtcagcgctcttctgacagcagccatgcccccatctgctctgccctcttgttacaagcctcaagtgctcaatggtgtgagaagcccaggagccactgcagatgctctctcttcaggtccatctagcccatcaagcctttctgcagccagcagtcttgacaacttatctgggagtttttcagaactgtcttcagtagttagttcaagtggaacagagggtgcttccagtttggagaaaaaggagggacttgagcacctaatggatatatttgagagagaacagatcactttggatgtattagttgagatggggcacaaggagctgaaggagattggaatcaatgcttatggacataggcacaaactaattaaaggagtcgagagacttatctccggacaacaaggtcttaacccatatttaactttgaacacctctggtagtggaacaattcttatagatctgtctcctgatgataaagagtttcagtctgtggaggaagagatgcaaagtacagttcgagagcacagagatggaggtcatgcaggtggaatcttcaacagatacaatattctcaagattcagaaggtttgtaacaagaaactatgggaaagatacactcaccggagaaaagaagtttctgaagaaaaccacaaccatgccaatgaacgaatgctatttcatgggtctccttttgtgaatgcaattatccacaaaggctttgatgaaaggcatgcgtacataggtggtatgtttggagctggcatttattttgctgaaaactcttccaaaagcaatcaatatgtatatggaattggaggaggtactgggtgtccagttcacaaagacagatcttgttacatttgccacaggcagctgctcttttgccgggtaaccttgggaaagtctttcctgcagttcagtgcaatgaaaatggcacattctcctccaggtcatcactcagtcactggtaggcccagtgtaaatggcctagcattagctgaatatgttatttacagaggagaacaggcttatcctgagtatttaattacttaccagattatgaggcctgaaggtatggtcgatggataaatagttattttaagaaactaattccactgaacctaaaatcatcaaagcagcagtggcctctacgttttactcctttgctgaaaaaaaatcatcttgcccacaggcctgtggcaaaaggataaaaatgtgaacgaagtttaacattctgacttgataaagctttaataatgtacagtgttttctaaatatttcctgttttttcagcactttaacagatgccattccaggttaaactgggttgtctgtactaaattataaacagagttaacttgaaccttttatatgttatgcattgattctaacaaactgtaatgccctcaacagaactaattttactaatacaatactgtgttctttaaaacacagcatttacactgaatacaatttcatttgtaaaactgtaaataagagcttttgtactagcccagtatttatttacattgctttgtaatataaatctgttttagaactgcagcggtttacaaaattttttcatatgtattgttcatctatacttcatcttacatcgtcatgattgagtgatctttacatttgattccagaggctatgttcagttgttagttgggaaagattgagttatcagatttaatttgccgatgggagcctttatctgtcattagaaatctttctcatttaagaacttatgaatatgctgaagatttaatttgtgatacctttgtatgtatgagacacattccaaagagctctaactatgataggtcctgattactaaagaagcttctttactggcctcaatttctagctttcatgttggaaaattttctgcagtccttctgtgaaaattagagcaaagtgctcctgttttttagagaaactaaatcttgctgttgaacaattattgtgttcttttcatggaacataagtaggatgttacatttccagggtgggaagggtaatcctaaatcatttcccaatctattctaattaccttaaatctaaaggggaaaaaaaaaatcacaaacaggactgggtagttttttatcctaagtatattttttcctgttctttttacttggttttattgctgtatttatagccaatctatacatcatgggtaaacttaacccagaactataaaatgtagttgtctcagtcccctccaggcctcctgaatgggcaagtgcagtgaaacaggtgcttcttgctcctgggttttctctccatgatgttatgcccaattggaaatatgctgtcagtttgtgcaccatatggtgaccaggcctgtgctcagtttggcagctatagaaggaaatgctgtcccataaaatgccattcctattttctaatataaaactcttttccaggaagcatgcttaagcatcttgttacagagacatacatccattatggcttggcaatctcttttatttgttgactctagctcccttcaaagtcgaggaaagatctttactcacttaatgaggacattccccatcactgtctgtaccagttcacctttattttacgttttattcagtctgtaaattaactggccctttgcagtaacttgtacataaagtgctagaaaatcatgttccttgtcctgagtaagagttaatcagagtaaatgcatttctggagttgtttctgtgatgtaaattatgatcattatttaagaagtcaaatcctgatcttgaagtgctttttatacagctctctaataattacaaatatccgaaagtcatttcttggaacacaagtggagtatgccaaattttatatgaatttttcagattatctaagcttccaggttttataattagaagataatgagagaattaatggggtttatatttacattatctctcaactatgtagcccatattactcaccctatgagtgaatctggaattgcttttcatgtgaaatcattgtggtctatgagtttacaatactgcaaactgtgttattttatctaatccattgcttaatgagtgtgtttttccatgaatgaatataccgtggttcatatgttagcatggcagcattttcagatagctttttgtttgttgggaagttggggttttggggggagggggagtattagtacgttgcatgaaatagcttactttataatgatggaattgctttttcttttgtcttgtgatttttttttttgaagtgaaatttaactttttgtgcaagtagtactattatacccatcttcagtgtcttacttgtactgtatcacattccataccctcatttaattcttaataaaactgttcacttgtttttctgggtagcatggtaattactggaatagtataaatgtgttgaatggtctttgagaaaatgaattaagattacaataaaccacaattgcaggaaaacaatgtagttctgagtctaatagtgataaagaatgcagtttgaagtttgaaatattgaatattgtagctgtacttgctcattaaaatgaaagtagctgtgagatgctttcaacatttagtctattcagcacaactggtaaaccttaaagctcattcctgggaaattaatcttcttaacttataaaaaggaatatatttttatttctgtgtcatatgaaaacattcttaataagtttccaaatctcaaagttagtggtatttattgctattaaaagaaagagtaatcgcatatgtatattagacttcagtatgttaagtttccttgtgtgtgagcaattccctgatttccataataagagaatgatggtgcaaata

SEQ ID NO: 446664 - DNA, 2945 bp, Homo sapiens
tgtccctagatgattctgatctacaacagtaatttagaacctcctccctaagattaggaatacttccggaaagtctgtttatctttcaagaaaatttttgtaccattatttgaatttatctttctcttccaggcttatcctgagtatttaattacttaccagattatgaggcctgaaggtatggtcgatggataaatagttattttaagaaactaattccactgaacctaaaatcatcaaagcagcagtggcctctacgttttactcctttgctgaaaaaaaatcatcttgcccacaggcctgtggcaaaaggataaaaatgtgaacgaagtttaacattctgacttgataaagctttaataatgtacagtgttttctaaatatttcctgttttttcagcactttaacagatgccattccaggttaaactgggttgtctgtactaaattataaacagagttaacttgaaccttttatatgttatgcattgattctaacaaactgtaatgccctcaacagaactaattttactaatacaatactgtgttctttaaaacacagcatttacactgaatacaatttcatttgtaaaactgtaaataagagcttttgtactagcccagtatttatttacattgctttgtaatataaatctgttttagaactgcagcggtttacaaaattttttcatatgtattgttcatctatacttcatcttacatcgtcatgattgagtgatctttacatttgattccagaggctatgttcagttgttagttgggaaagattgagttatcagatttaatttgccgatgggagcctttatctgtcattagaaatctttctcatttaagaacttatgaatatgctgaagatttaatttgtgatacctttgtatgtatgagacacattccaaagagctctaactatgataggtcctgattactaaagaagcttctttactggcctcaatttctagctttcatgttggaaaattttctgcagtccttctgtgaaaattagagcaaagtgctcctgttttttagagaaactaaatcttgctgttgaacaattattgtgttcttttcatggaacataagtaggatgttacatttccagggtgggaagggtaatcctaaatcatttcccaatctattctaattaccttaaatctaaaggggaaaaaaaaaatcacaaacaggactgggtagttttttatcctaagtatattttttcctgttctttttacttggttttattgctgtatttatagccaatctatacatcatgggtaaacttaacccagaactataaaatgtagttgtctcagtcccctccaggcctcctgaatgggcaagtgcagtgaaacaggtgcttcttgctcctgggttttctctccatgatgttatgcccaattggaaatatgctgtcagtttgtgcaccatatggtgaccaggcctgtgctcagtttggcagctatagaaggaaatgctgtcccataaaatgccattcctattttctaatataaaactcttttccaggaagcatgcttaagcatcttgttacagagacatacatccattatggcttggcaatctcttttatttgttgactctagctcccttcaaagtcgaggaaagatctttactcacttaatgaggacattccccatcactgtctgtaccagttcacctttattttacgttttattcagtctgtaaattaactggccctttgcagtaacttgtacataaagtgctagaaaatcatgttccttgtcctgagtaagagttaatcagagtaaatgcatttctggagttgtttctgtgatgtaaattatgatcattatttaagaagtcaaatcctgatcttgaagtgctttttatacagctctctaataattacaaatatccgaaagtcatttcttggaacacaagtggagtatgccaaattttatatgaatttttcagattatctaagcttccaggttttataattagaagataatgagagaattaatggggtttatatttacattatctctcaactatgtagcccatattactcaccctatgagtgaatctggaattgcttttcatgtgaaatcattgtggtctatgagtttacaatactgcaaactgtgttattttatctaatccattgcttaatgagtgtgtttttccatgaatgaatataccgtggttcatatgttagcatggcagcattttcagatagctttttgtttgttgggaagttggggttttggggggagggggagtattagtacgttgcatgaaatagcttactttataatgatggaattgctttttcttttgtcttgtgatttttttttttgaagtgaaatttaactttttgtgcaagtagtactattatacccatcttcagtgtcttacttgtactgtatcacattccataccctcatttaattcttaataaaactgttcacttgtttttctgggtagcatggtaattactggaatagtataaatgtgttgaatggtctttgagaaaatgaattaagattacaataaaccacaattgcaggaaaacaatgtagttctgagtctaatagtgataaagaatgcagtttgaagtttgaaatattgaatattgtagctgtacttgctcattaaaatgaaagtagctgtgagatgctttcaacatttagtctattcagcacaactggtaaaccttaaagctcattcctgggaaattaatcttcttaacttataaaaaggaatatatttttatttctgtgtcatatgaaaacattcttaataagtttccaaatctcaaagttagtggtatttattgctattaaaagaaagagtaatcgcatatgtatattagacttcagtatgttaagtttccttgtgtgtgagcaattccctgatttccataataagagaatgatggtgcaaata

SEQ ID NO: 446665 - DNA, 3682 bp, Homo sapiens
  misc_feature (2)..(2): n is a, c, g, or t
  misc_feature (4)..(4): n is a, c, g, or t
  misc_feature (7)..(7): n is a, c, g, or t
gncncgnggctggacggagctggcaggaggggccttgccagcttccgccgccgcgtcgtttcaggacccggacggcggattcgcgctgcctccgccgccgcggggcagccggggggcagggagcccagcgaggggcgcgcgtgggcgcggccatgggactgcgccggatccggtgacagcagggagccaagcggcccgggccctgagcgcgtcttctccggggggcctcgccctcctgctcgcggggccggggctcctgctccggttgctggcgctgttgctggctgtggcggcggccaggatcatgtcgggtcgccgctgcgccggcgggggagcggcctgcgcgagcgccgcggccgaggccgtggagccggccgcccgagagctgttcgaggcgtgccgcaacggggacgtggaacgagtcaagaggctggtgacgcctgagaaggtgaacagccgcgacacggcgggcaggaaatccaccccgctgcacttcgccgcaggttttgggcggaaagacgtagttgaatatttgcttcagaatggtgcaaatgtccaagcacgtgatgatgggggccttattcctcttcataatgcatgctcttttggtcatgctgaagtagtcaatctccttttgcgacatggtgcagaccccaatgctcgagataattggaattatactcctctccatgaagctgcaattaaaggaaagattgatgtttgcattgtgctgttacagcatggagctgagccaaccatccgaaatacagatggaaggacagcattggatttagcagatccatctgccaaagcagtgcttactggtgaatataagaaagatgaactcttagaaagtgccaggagtggcaatgaagaaaaaatgatggctctactcacaccattaaatgtcaactgccacgcaagtgatggcagaaagtcaactccattacatttggcagcaggatataacagagtaaagattgtacagctgttactgcaacatggagctgatgtccatgctaaagataaaggtgatctggtaccattacacaatgcctgttcttatggtcattatgaagtaactgaacttttggtcaagcatggtgcctgtgtaaatgcaatggacttgtggcaattcactcctcttcatgaggcagcttctaagaacagggttgaagtatgttctcttctcttaagttatggtgcagacccaacactgctcaattgtcacaataaaagtgctatagacttggctcccacaccacagttaaaagaaagattagcatatgaatttaaaggccactcgttgctgcaagctgcacgagaagctgatgttactcgaatcaaaaaacatctctctctggaaatggtgaatttcaagcatcctcaaacacatgaaacagcattgcattgtgctgctgcatctccatatcccaaaagaaagcaaatatgtgaactgttgctaagaaaaggagcaaacatcaatgaaaagactaaagaattcttgactcctctgcacgtggcatctgagaaagctcataatgatgttgttgaagtagtggtgaaacatgaagcaaaggttaatgctctggataatcttggtcagacttctctacacagagctgcatattgtggtcatctacaaacctgccgcctactcctgagctatgggtgtgatcctaacattatatcccttcagggctttactgctttacagatgggaaatgaaaatgtacagcaactcctccaagagggtatctcattaggtaattcagaggcagacagacaattgctggaagctgcaaaggctggagatgtcgaaactgtaaaaaaactgtgtactgttcagagtgtcaactgcagagacattgaagggcgtcagtctacaccacttcattttgcagctgggtataacagagtgtccgtggtggaatatctgctacagcatggagctgatgtgcatgctaaagataaaggaggccttgtacctttgcacaatgcatgttcttatggacattatgaagttgcagaacttcttgttaaacatggagcagtagttaatgtagctgatttatggaaatttacacctttacatgaagcagcagcaaaaggaaaatatgaaatttgcaaacttctgctccagcatggtgcagaccctacaaaaaaaaacagggatggaaatactcctttggatcttgttaaagatggagatacagatattcaagatctgcttaggggagatgcagctttgctagatgctgccaagaagggttgtttagccagagtgaagaagttgtcttctcctgataatgtaaattgccgcgatacccaaggcagacattcaacacctttacatttagcaggtaagtgaatgaagtttcacagatttaggctggtaatatctgagattcattttacccaggtaaaatattttctgtaactaaactttaaaaattcaaatcaggccaagcatggtggctcacacttgtaatcccaacactttatgaggctaaggcaggaggattgcttgagcccaggaatttgagagcagcctgggcaacatggcaaaaccacacctctataaaaaattacaaaaattagccaggagtggtggtgtgcacctgtagtcccagctattcaggaggctgaggtgggaagattgagcccaggaggtcacggatgcaataagccttgattgtgccactgtactccagaaacaaagtgagaccctgtctcaaaaaataaaaaaaataaataaaaattcaaatcaagtatcttctaatgccaccattatactcttcagtgtatttgtacaggacgaccgtacttgaagctattagctgagttcgagttcactttattactagtatgttacattcagtaagaacaattgaagtaggctctgccagtccccatgtgctttgggaatcattattccaggtaatcattttattggtatcacctttggtaaacaagtttgaaaaatatgcctacttgagccagccttccttataggaagctaaagctttctatttttcctgatggtagctgctaagcacaagcaggaaaaaaaaaaaatctcaaaactctcagaagttacataagcctctcaccaaagttatctgtggtatgggttggtgagagttctcataacaaaataccaaagaccaggtggcttaaacaacagaaatttgttttctcacagttctggaggctaggagtccaagttcaaggtgttggcagagttggtttcttctgaaaccccctcttggcttgcagctgtctaccttctcagtgtgtcctccattggaacatggtgtctctttctatatgtcctagtctctacttttaaggaaaccagtcaaattagattagagcccaccctaatgggctcattttaacttttttagctctttaaaggctctgtctccaaatagagtcatattctaaggtactggggttagggcttcaacataagaattttgcagggtacaattcatttcgtgacatttgttttaaggtttcactcataaaactggcacagtgtacctttgttttcagtgcaaatatacaatatattgtggtttcagtacagctttttcagctgcattacagatgttaggaaatcattaaaatcactgagctatagctaatacctcagtggagttccatcatagacaca

SEQ ID NO: 446666 - DNA, 1231 bp, Homo sapiens
  misc_feature (2)..(2): n is a, c, g, or t
  misc_feature (4)..(4): n is a, c, g, or t
  misc_feature (7)..(7): n is a, c, g, or t
gncncgnggctggacggagctggcaggaggggccttgccagcttccgccgccgcgtcgtttcaggacccggacggcggattcgcgctgcctccgccgccgcggggcagccggggggcagggagcccagcgaggggcgcgcgtgggcgcggccatgggactgcgccggatccggtgacagcagggagccaagcggcccgggccctgagcgcgtcttctccggggggcctcgccctcctgctcgcggggccggggctcctgctccggttgctggcgctgttgctggctgtggcggcggccaggatcatgtcgggtcgccgctgcgccggcgggggagcggcctgcgcgagcgccgcggccgaggccgtggagccggccgcccgagagctgttcgaggcgtgccgcaacggggacgtggaacgagtcaagaggctggtgacgcctgagaaggtgaacagccgcgacacggcgggcaggaaatccaccccgctgcacttcgccgcaggttttgggcggaaagacgtagttgaatatttgcttcagaatggtgcaaatgtccaagcacgtgatgatgggggccttattcctcttcataatgcatgctcttttggtcatgctgaagtagtcaatctccttttgcgacatggtgcagaccccaatgctcgagataattggaattatactcctctccatgaagctgcaattaaaggaaagattgatgtttgcattgtgctgttacagcatggagctgagccaaccatccgaaatacagatggaaggacagcattggatttagcagatccatctgccaaagcagtgcttactggtaagtctgtatactctggttattccaggaagcctgtaaagaacaaccttgccaggtaggaaatttgcctcctatgattaatgacttcagctagatttttaaaatagtgtcagttcagtagctatccttttctacgtctagatagctgacattttattctcctctaagaaaaataaagctttctttttattttctaattgctgtttaagtatgtcattgttgccttattgggggtgagggtgatagataattgtatgttgctttagtatattcaggacattttttaaatacccctgagtttttcagataacttatgcctgccctttacatgcaggttgagtatttctaacccaaacttcaaaacacttctggtcttaagcatttcagataagggatattcaagctgt

SEQ ID NO: 446667 - DNA, 222 bp, Homo sapiens
gtaatatttaactgcctctgtattctttttataataattctttgtataaacattagtaacagtgatgttaaccttcaaagtagagtctcaatataaatttagtttttctttggtatagttaacactgactattttctcattgaccaaaggcacatttaagccatttccccctttttttctgtttttcacatgcctagcatggtgcagaccctacaaaaaaaa

SEQ ID NO: 446668 - DNA, 536 bp, Homo sapiens
attttagcataactcaattcgtaaggaatcttggacttgagcacctaatggatatatttgagagagaacaggtgagtagataaatcatattgtttggattagtgttttatggaaactcaaggaaaatttggaacatacttgaaatgagctgaaccatgtaagctattgggggagaatgttttttaagaaatgacatcagtcagccttctaatttggcttgaccttgaaacttccatttagtttattcgcacacagttgactcgagtagtaatggtaaagtagctttcttgaatggaaagtttagcttattcagttcttgaagtaagttatccttgagcactgtctattcagttctctctcaagcctgacacttttctagctgctatgggaaggtatatgaatatgccagccatatctgggcttttctaagcagtctcagtttaaagtactctgtcagaatacatttactgatttttgttgttgttcagaaaataatgttactgtagatttgcactctaagggactttcattgtagt

SEQ ID NO: 446669 - DNA, 462 bp, Homo sapiens
aaaagaaagcaaatatgtgaactgttgctaagaaaaggagcaaacatcaatgaaaagactaaagagtaagtatacatttaatgattaaatatcattgagattttactcttttggaaaatatattcactgtctggctgattttttctctctaagattcttgactcctctgcacgtggcatctgagaaagctcataatgatgttgttgaagtagtggtgaaacatgaagcaaaggtatacttcctttttggtaatctttggtaatccaatgagttattttttatttagcaggtgaaatgcctgacttcctaaactatttactttctcataagtattacttttttttccttataatctatgcttaagaattgtcctgcaggtaaccttttctatatctaatttttgctagaacatctatgggtttattcagatacacattcctgtatgtcctccctcctccattc

SEQ ID NO: 446670 - DNA, 4278 bp, Homo sapiens
  misc_feature (2)..(2): n is a, c, g, or t
  misc_feature (4)..(4): n is a, c, g, or t
  misc_feature (7)..(7): n is a, c, g, or t
gncncgnggctggacggagctggcaggaggggccttgccagcttccgccgccgcgtcgtttcaggacccggacggcggattcgcgctgcctccgccgccgcggggcagccggggggcagggagcccagcgaggggcgcgcgtgggcgcggccatgggactgcgccggatccggtgacagcagggagccaagcggcccgggccctgagcgcgtcttctccggggggcctcgccctcctgctcgcggggccggggctcctgctccggttgctggcgctgttgctggctgtggcggcggccaggatcatgtcgggtcgccgctgcgccggcgggggagcggcctgcgcgagcgccgcggccgaggccgtggagccggccgcccgagagctgttcgaggcgtgccgcaacggggacgtggaacgagtcaagaggctggtgacgcctgagaaggtgaacagccgcgacacggcgggcaggaaatccaccccgctgcacttcgccgcaggttttgggcggaaagacgtagttgaatatttgcttcagaatggtgcaaatgtccaagcacgtgatgatgggggccttattcctcttcataatgcatgctcttttggtcatgctgaagtagtcaatctccttttgcgacatggtgcagaccccaatgctcgagataattggaattatactcctctccatgaagctgcaattaaaggaaagattgatgtttgcattgtgctgttacagcatggagctgagccaaccatccgaaatacagatggaaggacagcattggatttagcagatccatctgccaaagcagtgcttactggtgaatataagaaagatgaactcttagaaagtgccaggagtggcaatgaagaaaaaatgatggctctactcacaccattaaatgtcaactgccacgcaagtgatggcagaaagtcaactccattacatttggcagcaggatataacagagtaaagattgtacagctgttactgcaacatggagctgatgtccatgctaaagataaaggtgatctggtaccattacacaatgcctgttcttatggtcattatgaagtaactgaacttttggtcaagcatggtgcctgtgtaaatgcaatggacttgtggcaattcactcctcttcatgaggcagcttctaagaacagggttgaagtatgttctcttctcttaagttatggtgcagacccaacactgctcaattgtcacaataaaagtgctatagacttggctcccacaccacagttaaaagaaagattagcatatgaatttaaaggccactcgttgctgcaagctgcacgagaagctgatgttactcgaatcaaaaaacatctctctctggaaatggtgaatttcaagcatcctcaaacacatgaaacagcattgcattgtgctgctgcatctccatatcccaaaagaaagcaaatatgtgaactgttgctaagaaaaggagcaaacatcaatgaaaagactaaagaattcttgactcctctgcacgtggcatctgagaaagctcataatgatgttgttgaagtagtggtgaaacatgaagcaaaggttaatgctctggataatcttggtcagacttctctacacagagctgcatattgtggtcatctacaaacctgccgcctactcctgagctatgggtgtgatcctaacattatatcccttcagggctttactgctttacagatgggaaatgaaaatgtacagcaactcctccaagagggtatctcattaggtaattcagaggcagacagacaattgctggaagctgcaaaggctggagatgtcgaaactgtaaaaaaactgtgtactgttcagagtgtcaactgcagagacattgaagggcgtcagtctacaccacttcattttgcagctgggtataacagagtgtccgtggtggaatatctgctacagcatggagctgatgtgcatgctaaagataaaggaggccttgtacctttgcacaatgcatgttcttatggacattatgaagttgcagaacttcttgttaaacatggagcagtagttaatgtagctgatttatggaaatttacacctttacatgaagcagcagcaaaaggaaaatatgaaatttgcaaacttctgctccagcatggtgcagaccctacaaaaaaaaacagggatggaaatactcctttggatcttgttaaagatggagatacagatattcaagatctgcttaggggagatgcagctttgctagatgctgccaagaagggttgtttagccagagtgaagaagttgtcttctcctgataatgtaaattgccgcgatacccaaggcagacattcaacacctttacatttagcagctggttataataatttagaagttgcagagtatttgttacaacacggagctgatgtgaatgcccaagacaaaggaggacttattcctttacataatgcagcatcttacgggcatgtagatgtagcagctctactaataaagtataatgcatgtgtcaatgccacggacaaatgggctttcacacctttgcacgaagcagcccaaaagggacgaacacagctttgtgctttgttgctagcccatggagctgacccgactcttaaaaatcaggaaggacaaacacctttagatttagtttcagcggatgatgtcagcgctcttctgacagcagccatgcccccatctgctctgccctcttgttacaagcctcaagtgctcaatggtgtgagaagcccaggagccactgcagatgctctctcttcaggtccatctagcccatcaagcctttctgcagccagcagtcttgacaacttatctgggagtttttcagaactgtcttcagtagttagttcaagtggaacagagggtgcttccagtttggagaaaaaggaggttccaggagtagattttagcataactcaattcgtaaggaatcttggacttgagcacctaatggatatatttgagagagaacagatcactttggatgtattagttgagatggggcacaaggagctgaaggagattggaatcaatgcttatggacataggcacaaactaattaaaggagtcgagagacttatctccggacaacaaggtcttaacccatatttaactttgaacacctctggtagtggaacaattcttatagatctgtctcctgatgataaagagtttcagtctgtggaggaagagatgcaaagtacagttcgagagcacagagatggaggtcatgcaggtggaatcttcaacagatacaatattctcaagattcagaaggtttgtaacaagaaactatgggaaagatacactcaccggagaaaagaagtttctgaagaaaaccacaaccatgccaatgaacgaatgctatttcatgggtctccttttgtgaatgcaattatccacaaaggctttgatgaaaggcatgcgtacataggtggtatgtttggagctggcatttattttgctgaaaactcttccaaaagcaatcaatatgtatatggaattggaggaggtactgggtgtccagttcacaaagacagatcttgttacatttgccacaggcagctgctcttttgccgggtaaccttgggaaagtctttcctgcagttcagtgcaatgaaaatggcacattctcctccaggtcatcactcagtcactggtaggcccagtgtaaatggcctagcattagctgaatatgttatttacagaggagaacaggcttatcctgagtatttaattacttaccagattatgaggcctgaaggtatggtcgatggataaatagttattttaagaaactaattccactgaacctaaaatcatcaaagcagcagtggcctctacgttttactcctttgctgaaaaaaaatcatcttgcccacaggcctgtggcaaaaggataaaaatgtgaacgaagtttaacattctgacttgataaagctttaataatgtacagtgttttctaaatatttcctgttttttcagcactttaacagatgccattccaggttaaactgggttgtctgtactaaattataaacagagttaacttgaaccttttatatgttatgcattgattctaacaaactgtaatgccctcaacagaactaattttactaatacaatactgtgttctttaaaacacagcatttacactgaatacaatttcatttgtaaaactgtaaataagagcttttgtactagcccagtatttatttacattgctttgtaatataaatctgttttagaactgc

SEQ ID NO: 446671 - DNA, 6291 bp, Homo sapiens
  misc_feature (2)..(2): n is a, c, g, or t
  misc_feature (4)..(4): n is a, c, g, or t
  misc_feature (7)..(7): n is a, c, g, or t
gncncgnggctggacggagctggcaggaggggccttgccagcttccgccgccgcgtcgtttcaggacccggacggcggattcgcgctgcctccgccgccgcggggcagccggggggcagggagcccagcgaggggcgcgcgtgggcgcggccatgggactgcgccggatccggtgacagcagggagccaagcggcccgggccctgagcgcgtcttctccggggggcctcgccctcctgctcgcggggccggggctcctgctccggttgctggcgctgttgctggctgtggcggcggccaggatcatgtcgggtcgccgctgcgccggcgggggagcggcctgcgcgagcgccgcggccgaggccgtggagccggccgcccgagagctgttcgaggcgtgccgcaacggggacgtggaacgagtcaagaggctggtgacgcctgagaaggtgaacagccgcgacacggcgggcaggaaatccaccccgctgcacttcgccgcaggttttgggcggaaagacgtagttgaatatttgcttcagaatggtgcaaatgtccaagcacgtgatgatgggggccttattcctcttcataatgcatgctcttttggtcatgctgaagtagtcaatctccttttgcgacatggtgcagaccccaatgctcgagataattggaattatactcctctccatgaagctgcaattaaaggaaagattgatgtttgcattgtgctgttacagcatggagctgagccaaccatccgaaatacagatggaaggacagcattggatttagcagatccatctgccaaagcagtgcttactggtgaatataagaaagatgaactcttagaaagtgccaggagtggcaatgaagaaaaaatgatggctctactcacaccattaaatgtcaactgccacgcaagtgatggcagaaagtcaactccattacatttggcagcaggatataacagagtaaagattgtacagctgttactgcaacatggagctgatgtccatgctaaagataaaggtgatctggtaccattacacaatgcctgttcttatggtcattatgaagtaactgaacttttggtcaagcatggtgcctgtgtaaatgcaatggacttgtggcaattcactcctcttcatgaggcagcttctaagaacagggttgaagtatgttctcttctcttaagttatggtgcagacccaacactgctcaattgtcacaataaaagtgctatagacttggctcccacaccacagttaaaagaaagattagcatatgaatttaaaggccactcgttgctgcaagctgcacgagaagctgatgttactcgaatcaaaaaacatctctctctggaaatggtgaatttcaagcatcctcaaacacatgaaacagcattgcattgtgctgctgcatctccatatcccaaaagaaagcaaatatgtgaactgttgctaagaaaaggagcaaacatcaatgaaaagactaaagaattcttgactcctctgcacgtggcatctgagaaagctcataatgatgttgttgaagtagtggtgaaacatgaagcaaaggttaatgctctggataatcttggtcagacttctctacacagagctgcatattgtggtcatctacaaacctgccgcctactcctgagctatgggtgtgatcctaacattatatcccttcagggctttactgctttacagatgggaaatgaaaatgtacagcaactcctccaagagggtatctcattaggtaattcagaggcagacagacaattgctggaagctgcaaaggctggagatgtcgaaactgtaaaaaaactgtgtactgttcagagtgtcaactgcagagacattgaagggcgtcagtctacaccacttcattttgcagctgggtataacagagtgtccgtggtggaatatctgctacagcatggagctgatgtgcatgctaaagataaaggaggccttgtacctttgcacaatgcatgttcttatggacattatgaagttgcagaacttcttgttaaacatggagcagtagttaatgtagctgatttatggaaatttacacctttacatgaagcagcagcaaaaggaaaatatgaaatttgcaaacttctgctccagcatggtgcagaccctacaaaaaaaaacagggatggaaatactcctttggatcttgttaaagatggagatacagatattcaagatctgcttaggggagatgcagctttgctagatgctgccaagaagggttgtttagccagagtgaagaagttgtcttctcctgataatgtaaattgccgcgatacccaaggcagacattcaacacctttacatttagcagctggttataataatttagaagttgcagagtatttgttacaacacggagctgatgtgaatgcccaagacaaaggaggacttattcctttacataatgcagcatcttacgggcatgtagatgtagcagctctactaataaagtataatgcatgtgtcaatgccacggacaaatgggctttcacacctttgcacgaagcagcccaaaagggacgaacacagctttgtgctttgttgctagcccatggagctgacccgactcttaaaaatcaggaaggacaaacacctttagatttagtttcagcggatgatgtcagcgctcttctgacagcagccatgcccccatctgctctgccctcttgttacaagcctcaagtgctcaatggtgtgagaagcccaggagccactgcagatgctctctcttcaggtccatctagcccatcaagcctttctgcagccagcagtcttgacaacttatctgggagtttttcagaactgtcttcagtagttagttcaagtggaacagagggtgcttccagtttggagaaaaaggaggttccaggagtagattttagcataactcaattcgtaaggaatcttggacttgagcacctaatggatatatttgagagagaacagatcactttggatgtattagttgagatggggcacaaggagctgaaggagattggaatcaatgcttatggacataggcacaaactaattaaaggagtcgagagacttatctccggacaacaaggtcttaacccatatttaactttgaacacctctggtagtggaacaattcttatagatctgtctcctgatgataaagagtttcagtctgtggaggaagagatgcaaagtacagttcgagagcacagagatggaggtcatgcaggtggaatcttcaacagatacaatattctcaagattcagaaggtttgtaacaagaaactatgggaaagatacactcaccggagaaaagaagtttctgaagaaaaccacaaccatgccaatgaacgaatgctatttcatgggtctccttttgtgaatgcaattatccacaaaggctttgatgaaaggcatgcgtacataggtggtatgtttggagctggcatttattttgctgaaaactcttccaaaagcaatcaatatgtatatggaattggaggaggtactgggtgtccagttcacaaagacagatcttgttacatttgccacaggcagctgctcttttgccgggtaaccttgggaaagtctttcctgcagttcagtgcaatgaaaatggcacattctcctccaggtcatcactcagtcactggtaggcccagtgtaaatggcctagcattagctgaatatgttatttacagaggagaacaggcttatcctgagtatttaattacttaccagattatgaggcctgaaggtatggtcgatggataaatagttattttaagaaactaattccactgaacctaaaatcatcaaagcagcagtggcctctacgttttactcctttgctgaaaaaaaatcatcttgcccacaggcctgtggcaaaaggataaaaatgtgaacgaagtttaacattctgacttgataaagctttaataatgtacagtgttttctaaatatttcctgttttttcagcactttaacagatgccattccaggttaaactgggttgtctgtactaaattataaacagagttaacttgaaccttttatatgttatgcattgattctaacaaactgtaatgccctcaacagaactaattttactaatacaatactgtgttctttaaaacacagcatttacactgaatacaatttcatttgtaaaactgtaaataagagcttttgtactagcccagtatttatttacattgctttgtaatataaatctgttttagaactgcagcggtttacaaaattttttcatatgtattgttcatctatacttcatcttacatcgtcatgattgagtgatctttacatttgattccagaggctatgttcagttgttagttgggaaagattgagttatcagatttaatttgccgatgggagcctttatctgtcattagaaatctttctcatttaagaacttatgaatatgctgaagatttaatttgtgatacctttgtatgtatgagacacattccaaagagctctaactatgataggtcctgattactaaagaagcttctttactggcctcaatttctagctttcatgttggaaaattttctgcagtccttctgtgaaaattagagcaaagtgctcctgttttttagagaaactaaatcttgctgttgaacaattattgtgttcttttcatggaacataagtaggatgttacatttccagggtgggaagggtaatcctaaatcatttcccaattggaaatatgctgtcagtttgtgcaccatatggtgaccaggcctgtgctcagtttggcagctatagaaggaaatgctgtcccataaaatgccattcctattttctaatataaaactcttttccaggaagcatgcttaagcatcttgttacagagacatacatccattatggcttggcaatctcttttatttgttgactctagctcccttcaaagtcgaggaaagatctttactcacttaatgaggacattccccatcactgtctgtaccagttcacctttattttacgttttattcagtctgtaaattaactggccctttgcagtaacttgtacataaagtgctagaaaatcatgttccttgtcctgagtaagagttaatcagagtaaatgcatttctggagttgtttctgtgatgtaaattatgatcattatttaagaagtcaaatcctgatcttgaagtgctttttatacagctctctaataattacaaatatccgaaagtcatttcttggaacacaagtggagtatgccaaattttatatgaatttttcagattatctaagcttccaggttttataattagaagataatgagagaattaatggggtttatatttacattatctctcaactatgtagcccatattactcaccctatgagtgaatctggaattgcttttcatgtgaaatcattgtggtctatgagtttacaatactgcaaactgtgttattttatctaatccattgcttaatgagtgtgtttttccatgaatgaatataccgtggttcatatgttagcatggcagcattttcagatagctttttgtttgttgggaagttggggttttggggggagggggagtattagtacgttgcatgaaatagcttactttataatgatggaattgctttttcttttgtcttgtgatttttttttttgaagtgaaatttaactttttgtgcaagtagtactattatacccatcttcagtgtcttacttgtactgtatcacattccataccctcatttaattcttaataaaactgttcacttgtttttctgggtagcatggtaattactggaatagtataaatgtgttgaatggtctttgagaaaatgaattaagattacaataaaccacaattgcaggaaaacaatgtagttctgagtctaatagtgataaagaatgcagtttgaagtttgaaatattgaatattgtagctgtacttgctcattaaaatgaaagtagctgtgagatgctttcaacatttagtctattcagcacaactggtaaaccttaaagctcattcctgggaaattaatcttcttaacttataaaaaggaatatatttttatttctgtgtcatatgaaaacattcttaataagtttccaaatctcaaagttagtggtatttattgctattaaaagaaagagtaatcgcatatgtatattagacttcagtatgttaagtttccttgtgtgtgagcaattccctgatttccataataagagaatgatggtgcaaata

SEQ ID NO: 446672 - DNA, 4155 bp, Homo sapiens
actagtttcattttaagaaagtaaagtgtgacaaaataatatttcagactgtaacgggtattttcttttacagcatgtagatgtagcagctctactaataaagtataatgcatgtgtcaatgccacggacaaatgggctttcacacctttgcacgaagcagcccaaaagggacgaacacagctttgtgctttgttgctagcccatggagctgacccgactcttaaaaatcaggaaggacaaacacctttagatttagtttcagcggatgatgtcagcgctcttctgacagcagccatgcccccatctgctctgccctcttgttacaagcctcaagtgctcaatggtgtgagaagcccaggagccactgcagatgctctctcttcaggtccatctagcccatcaagcctttctgcagccagcagtcttgacaacttatctgggagtttttcagaactgtcttcagtagttagttcaagtggaacagagggtgcttccagtttggagaaaaaggaggttccaggagtagattttagcataactcaattcgtaaggaatcttggacttgagcacctaatggatatatttgagagagaacagatcactttggatgtattagttgagatggggcacaaggagctgaaggagattggaatcaatgcttatggacataggcacaaactaattaaaggagtcgagagacttatctccggacaacaaggtcttaacccatatttaactttgaacacctctggtagtggaacaattcttatagatctgtctcctgatgataaagagtttcagtctgtggaggaagagatgcaaagtacagttcgagagcacagagatggaggtcatgcaggtggaatcttcaacagatacaatattctcaagattcagaaggtttgtaacaagaaactatgggaaagatacactcaccggagaaaagaagtttctgaagaaaaccacaaccatgccaatgaacgaatgctatttcatgggtctccttttgtgaatgcaattatccacaaaggctttgatgaaaggcatgcgtacataggtggtatgtttggagctggcatttattttgctgaaaactcttccaaaagcaatcaatatgtatatggaattggaggaggtactgggtgtccagttcacaaagacagatcttgttacatttgccacaggcagctgctcttttgccgggtaaccttgggaaagtctttcctgcagttcagtgcaatgaaaatggcacattctcctccaggtcatcactcagtcactggtaggcccagtgtaaatggcctagcattagctgaatatgttatttacagaggagaacaggcttatcctgagtatttaattacttaccagattatgaggcctgaaggtatggtcgatggataaatagttattttaagaaactaattccactgaacctaaaatcatcaaagcagcagtggcctctacgttttactcctttgctgaaaaaaaatcatcttgcccacaggcctgtggcaaaaggataaaaatgtgaacgaagtttaacattctgacttgataaagctttaataatgtacagtgttttctaaatatttcctgttttttcagcactttaacagatgccattccaggttaaactgggttgtctgtactaaattataaacagagttaacttgaaccttttatatgttatgcattgattctaacaaactgtaatgccctcaacagaactaattttactaatacaatactgtgttctttaaaacacagcatttacactgaatacaatttcatttgtaaaactgtaaataagagcttttgtactagcccagtatttatttacattgctttgtaatataaatctgttttagaactgcagcggtttacaaaattttttcatatgtattgttcatctatacttcatcttacatcgtcatgattgagtgatctttacatttgattccagaggctatgttcagttgttagttgggaaagattgagttatcagatttaatttgccgatgggagcctttatctgtcattagaaatctttctcatttaagaacttatgaatatgctgaagatttaatttgtgatacctttgtatgtatgagacacattccaaagagctctaactatgataggtcctgattactaaagaagcttctttactggcctcaatttctagctttcatgttggaaaattttctgcagtccttctgtgaaaattagagcaaagtgctcctgttttttagagaaactaaatcttgctgttgaacaattattgtgttcttttcatggaacataagtaggatgttacatttccagggtgggaagggtaatcctaaatcatttcccaatctattctaattaccttaaatctaaaggggaaaaaaaaaatcacaaacaggactgggtagttttttatcctaagtatattttttcctgttctttttacttggttttattgctgtatttatagccaatctatacatcatgggtaaacttaacccagaactataaaatgtagttgtctcagtcccctccaggcctcctgaatgggcaagtgcagtgaaacaggtgcttcttgctcctgggttttctctccatgatgttatgcccaattggaaatatgctgtcagtttgtgcaccatatggtgaccaggcctgtgctcagtttggcagctatagaaggaaatgctgtcccataaaatgccattcctattttctaatataaaactcttttccaggaagcatgcttaagcatcttgttacagagacatacatccattatggcttggcaatctcttttatttgttgactctagctcccttcaaagtcgaggaaagatctttactcacttaatgaggacattccccatcactgtctgtaccagttcacctttattttacgttttattcagtctgtaaattaactggccctttgcagtaacttgtacataaagtgctagaaaatcatgttccttgtcctgagtaagagttaatcagagtaaatgcatttctggagttgtttctgtgatgtaaattatgatcattatttaagaagtcaaatcctgatcttgaagtgctttttatacagctctctaataattacaaatatccgaaagtcatttcttggaacacaagtggagtatgccaaattttatatgaatttttcagattatctaagcttccaggttttataattagaagataatgagagaattaatggggtttatatttacattatctctcaactatgtagcccatattactcaccctatgagtgaatctggaattgcttttcatgtgaaatcattgtggtctatgagtttacaatactgcaaactgtgttattttatctaatccattgcttaatgagtgtgtttttccatgaatgaatataccgtggttcatatgttagcatggcagcattttcagatagctttttgtttgttgggaagttggggttttggggggagggggagtattagtacgttgcatgaaatagcttactttataatgatggaattgctttttcttttgtcttgtgatttttttttttgaagtgaaatttaactttttgtgcaagtagtactattatacccatcttcagtgtcttacttgtactgtatcacattccataccctcatttaattcttaataaaactgttcacttgtttttctgggtagcatggtaattactggaatagtataaatgtgttgaatggtctttgagaaaatgaattaagattacaataaaccacaattgcaggaaaacaatgtagttctgagtctaatagtgataaagaatgcagtttgaagtttgaaatattgaatattgtagctgtacttgctcattaaaatgaaagtagctgtgagatgctttcaacatttagtctattcagcacaactggtaaaccttaaagctcattcctgggaaattaatcttcttaacttataaaaaggaatatatttttatttctgtgtcatatgaaaacattcttaataagtttccaaatctcaaagttagtggtatttattgctattaaaagaaagagtaatcgcatatgtatattagacttcagtatgttaagtttccttgtgtgtgagcaattccctgatttccataataagagaatgatggtgcaaata

SEQ ID NO: 446673 - DNA, 3958 bp, Homo sapiens
  misc_feature (2)..(2): n is a, c, g, or t
  misc_feature (4)..(4): n is a, c, g, or t
  misc_feature (7)..(7): n is a, c, g, or t
gncncgnggctggacggagctggcaggaggggccttgccagcttccgccgccgcgtcgtttcaggacccggacggcggattcgcgctgcctccgccgccgcggggcagccggggggcagggagcccagcgaggggcgcgcgtgggcgcggccatgggactgcgccggatccggtgacagcagggagccaagcggcccgggccctgagcgcgtcttctccggggggcctcgccctcctgctcgcggggccggggctcctgctccggttgctggcgctgttgctggctgtggcggcggccaggatcatgtcgggtcgccgctgcgccggcgggggagcggcctgcgcgagcgccgcggccgaggccgtggagccggccgcccgagagctgttcgaggcgtgccgcaacggggacgtggaacgagtcaagaggctggtgacgcctgagaaggtgaacagccgcgacacggcgggcaggaaatccaccccgctgcacttcgccgcaggttttgggcggaaagacgtagttgaatatttgcttcagaatggtgcaaatgtccaagcacgtgatgatgggggccttattcctcttcataatgcatgctcttttggtcatgctgaagtagtcaatctccttttgcgacatggtgcagaccccaatgctcgagataattggaattatactcctctccatgaagctgcaattaaaggaaagattgatgtttgcattgtgctgttacagcatggagctgagccaaccatccgaaatacagatggaaggacagcattggatttagcagatccatctgccaaagcagtgcttactggtgaatataagaaagatgaactcttagaaagtgccaggagtggcaatgaagaaaaaatgatggctctactcacaccattaaatgtcaactgccacgcaagtgatggcagaaagtcaactccattacatttggcagcaggatataacagagtaaagattgtacagctgttactgcaacatggagctgatgtccatgctaaagataaaggtgatctggtaccattacacaatgcctgttcttatggtcattatgaagtaactgaacttttggtcaagcatggtgcctgtgtaaatgcaatggacttgtggcaattcactcctcttcatgaggcagcttctaagaacagggttgaagtatgttctcttctcttaagttatggtgcagacccaacactgctcaattgtcacaataaaagtgctatagacttggctcccacaccacagttaaaagaaagattagcatatgaatttaaaggccactcgttgctgcaagctgcacgagaagctgatgttactcgaatcaaaaaacatctctctctggaaatggtgaatttcaagcatcctcaaacacatgaaacagcattgcattgtgctgctgcatctccatatcccaaaagaaagcaaatatgtgaactgttgctaagaaaaggagcaaacatcaatgaaaagactaaagaattcttgactcctctgcacgtggcatctgagaaagctcataatgatgttgttgaagtagtggtgaaacatgaagcaaaggttaatgctctggataatcttggtcagacttctctacacagagctgcatattgtggtcatctacaaacctgccgcctactcctgagctatgggtgtgatcctaacattatatcccttcagggctttactgctttacagatgggaaatgaaaatgtacagcaactcctccaagagggtatctcattaggtaattcagaggcagacagacaattgctggaagctgcaaaggctggagatgtcgaaactgtaaaaaaactgtgtactgttcagagtgtcaactgcagagacattgaagggcgtcagtctacaccacttcattttgcagctgggtataacagagtgtccgtggtggaatatctgctacagcatggagctgatgtgcatgctaaagataaaggaggccttgtacctttgcacaatgcatgttcttatggacattatgaagttgcagaacttcttgttaaacatggagcagtagttaatgtagctgatttatggaaatttacacctttacatgaagcagcagcaaaaggaaaatatgaaatttgcaaacttctgctccagcatggtgcagaccctacaaaaaaaaacagggatggaaatactcctttggatcttgttaaagatggagatacagatattcaagatctgcttaggggagatgcagctttgctagatgctgccaagaagggttgtttagccagagtgaagaagttgtcttctcctgataatgtaaattgccgcgatacccaaggcagacattcaacacctttacatttagcagctggttataataatttagaagttgcagagtatttgttacaacacggagctgatgtgaatgcccaagacaaaggaggacttattcctttacataatgcagcatcttacgggcatgtagatgtagcagctctactaataaagtataatgcatgtgtcaatgccacggacaaatgggctttcacacctttgcacgaagcagcccaaaagggacgaacacagctttgtgctttgttgctagcccatggagctgacccgactcttaaaaatcaggaaggacaaacacctttagatttagtttcagcggatgatgtcagcgctcttctgacagcagccatgcccccatctgctctgccctcttgttacaagcctcaagtgctcaatggtgtgagaagcccaggagccactgcagatgctctctcttcaggtccatctagcccatcaagcctttctgcagccagcagtcttgacaacttatctgggagtttttcagaactgtcttcagtagttagttcaagtggaacagagggtgcttccagtttggagaaaaaggaggttccaggagtagattttagcataactcaattcgtaaggaatcttggacttgagcacctaatggatatatttgagagagaacagatcactttggatgtattagttgagatggggcacaaggagctgaaggagattggaatcaatgcttatggacataggcacaaactaattaaaggagtcgagagacttatctccggacaacaaggtcttaacccatatttaactttgaacacctctggtagtggaacaattcttatagatctgtctcctgatgataaagagtttcagtctgtggaggaagagatgcaaagtacagttcgagagcacagagatggaggtcatgcaggtggaatcttcaacagatacaatattctcaagattcagaaggtttgtaacaagaaactatgggaaagatacactcaccggagaaaagaagtttctgaagaaaaccacaaccatgccaatgaacgaatgctatttcatgggtctccttttgtgaatgcaattatccacaaaggctttgatgaaaggcatgcgtacataggtggtatgtttggagctggcatttattttgctgaaaactcttccaaaagcaatcaatatgtatatggaattggaggaggtactgggtgtccagttcacaaagacagatcttgttacatttgccacaggcagctgctcttttgccgggtaaccttgggaaagtctttcctgcagttcagtgcaatgaaaatggcacattctcctccaggtcatcactcagtcactggtaggcccagtgtaaatggcctagcattagctgaatatgttatttacagaggagaacaggtaatgtagttttatttgttcatcttcaaaaatgctagggaggcatactttaactttttattaatctcttgaattgacaagacatattgccttaactggattttttaaaaattttatttggagataatttcagatttggaaagttacaaaaatagtaaagagaattttcttataacctttacctagatttcctaaatgttaatattttgttctctt

SEQ ID NO: 446674 - DNA, 2388 bp, Homo sapiens
  misc_feature (2)..(2): n is a, c, g, or t
  misc_feature (4)..(4): n is a, c, g, or t
  misc_feature (7)..(7): n is a, c, g, or t
gncncgnggctggacggagctggcaggaggggccttgccagcttccgccgccgcgtcgtttcaggacccggacggcggattcgcgctgcctccgccgccgcggggcagccggggggcagggagcccagcgaggggcgcgcgtgggcgcggccatgggactgcgccggatccggtgacagcagggagccaagcggcccgggccctgagcgcgtcttctccggggggcctcgccctcctgctcgcggggccggggctcctgctccggttgctggcgctgttgctggctgtggcggcggccaggatcatgtcgggtcgccgctgcgccggcgggggagcggcctgcgcgagcgccgcggccgaggccgtggagccggccgcccgagagctgttcgaggcgtgccgcaacggggacgtggaacgagtcaagaggctggtgacgcctgagaaggtgaacagccgcgacacggcgggcaggaaatccaccccgctgcacttcgccgcaggttttgggcggaaagacgtagttgaatatttgcttcagaatggtgcaaatgtccaagcacgtgatgatgggggccttattcctcttcataatgcatgctcttttggtcatgctgaagtagtcaatctccttttgcgacatggtgcagaccccaatgctcgagataattggaattatactcctctccatgaagctgcaattaaaggaaagattgatgtttgcattgtgctgttacagcatggagctgagccaaccatccgaaatacagatggaaggacagcattggatttagcagatccatctgccaaagcagtgcttactggtgaatataagaaagatgaactcttagaaagtgccaggagtggcaatgaagaaaaaatgatggctctactcacaccattaaatgtcaactgccacgcaagtgatggcagaaagtcaactccattacatttggcagcaggatataacagagtaaagattgtacagctgttactgcaacatggagctgatgtccatgctaaagataaaggtgatctggtaccattacacaatgcctgttcttatggtcattatgaagtaactgaacttttggtcaagcatggtgcctgtgtaaatgcaatggacttgtggcaattcactcctcttcatgaggcagcttctaagaacagggttgaagtatgttctcttctcttaagttatggtgcagacccaacactgctcaattgtcacaataaaagtgctatagacttggctcccacaccacagttaaaagaaagattagcatatgaatttaaaggccactcgttgctgcaagctgcacgagaagctgatgttactcgaatcaaaaaacatctctctctggaaatggtgaatttcaagcatcctcaaacacatgaaacagcattgcattgtgctgctgcatctccatatcccaaaagaaagcaaatatgtgaactgttgctaagaaaaggagcaaacatcaatgaaaagactaaagaattcttgactcctctgcacgtggcatctgagaaagctcataatgatgttgttgaagtagtggtgaaacatgaagcaaaggttaatgctctggataatcttggtcagacttctctacacagagctgcatattgtggtcatctacaaacctgccgcctactcctgagctatgggtgtgatcctaacattatatcccttcagggctttactgctttacagatgggaaatgaaaatgtacagcaactcctccaagagggtatctcattaggtaattcagaggcagacagacaattgctggaagctgcaaaggctggagatgtcgaaactgtaaaaaaactgtgtactgttcagagtgtcaactgcagagacattgaagggcgtcagtctacaccacttcattttgcagctgggtataacagagtgtccgtggtggaatatctgctacagcatggagctgatgtgcatgctaaagataaaggaggccttgtacctttgcacaatgcatgttcttatggacattatgaagttgcagaacttcttgttaaacatggagcagtagttaatgtagctgatttatggaaatttacacctttacatgaagcagcagcaaaaggaaaatatgaaatttgcaaacttctgctccagcatggtgcagaccctacaaaaaaaaacagggatggaaatactcctttggatcttgttaaagatggagatacagatattcaagatctgcttaggggagatgcagctttgctagatgctgccaagaagggtttcgatgaccgtcatcaaacccttgggcttattggtaaacttcctgggtttagggtttcgatgacggtcatcaaaccctctatcaagttgcgatgctagtcgccgtgccatacatg

SEQ ID NO: 446675 - DNA, 2059 bp, Homo sapiens
tggggatctctttcaaggtttctgctgggtttctgaactgctgggtttctgcttgctcctctggagatgcagcgtctgttgactccagtgaagcgcattctgcaactgacaagagcggtgcaggaaacctccctcacacctgctcgcctgctcccagtagcccaccaaaggttttctacagcctctgctgtccccctggccaaaacagatacttggccaaaggacgtgggcatcctggccctggaggtctacttcccagcccaatatgtggaccaaactgacctggagaagtataacaatgtggaagcaggaaagtatacagtgggcttgggccagacccgtatgggcttctgctcagtccaagaggacatcaactccctgtgcctgacggtggtgcaacggctgatggagcgcatacagctcccatgggactctgtgggcaggctggaagtaggcactgagaccatcattgacaagtccaaagctgtcaaaacagtgctcatggaactcttccaggattcaggcaatactgatattgagggcatagataccaccaatgcctgctacggtggtactgcctccctcttcaatgctgccaactggatggagtccagttcctgggatggtcgttatgccatggtggtctgtggagacattgccgtctatcccagtggtaatgctcgtcccacaggtggggccggagctgtggctatgctgattgggcccaaggcccctctggccctggagcgagggctgaggggaacccatatggagaatgtgtatgacttctacaaaccaaatttggcctcggagtacccaatagtggatgggaagctttccatccagtgctacttgcgggccttggatcgatgttacacatcataccgtaaaaaaatccagaatcagtggaagcaagctggcagcgatcgacccttcacccttgacgatttacagtacatgatctttcatacacccttttgcaagatggtccagaagtctctggctcgcctgatgttcaatgacttcctgtcagccagcagtgacacacaaaccagcttatataaggggctggaggctttcggggggctaaagctggaagacacctacaccaacaaggacctggataaagcacttctaaaggcctctcaggacatgttcgacaagaaaaccaaggcttccctttacctctccactcacaatgggaacatgtacacctcatccctgtacgggtgcctggcctcgcttctgtcccaccactctgcccaagaactggctggctccaggattggtgccttctcttatggctctggtttagcagcaagtttcttttcatttcgagtatcccaggatgctgctccaggctctcccctggacaagttggtgtccagcacatcagacctgccaaaacgcctagcctcccgaaagtgtgtgtctcctgaggagttcacagaaataatgaaccaaagagagcaattctaccataaggtgaatttctccccacctggtgacacaaacagccttttcccaggtacttggtacctggagcgagtggacgagcagcatcgccgaaagtatgcccggcgtcccgtctaaaggtgttctgcagatccatggaaagcttcctgggaaacgtatgctagcagagcttctccccgtgaatcatatttttaagatcccactcttagctggtaaatgaatttgaatcgacatagtagccccataagcatcagccctgtagagtgaggagccatctctagcgggcccttcattcctctccatgctgcaatcactgtcctgggcttatggtgctatggactaggggtcctttgtgaaagagcaagatggagcaatggagagaagacctcttcctgaatcactggactccagaaatgtgcatgcagatcagctgttgccttcaagatccagataaactttcctgtcatgtgttagaactttattattattaatattgttaaacttctgtgctgttcctgtgaatctccaaattttgtaccttgttctaagctaatatatagcaattaaaaagagagaaagagga

SEQ ID NO: 446676 - DNA, 663 bp, Homo sapiens
tggggatctctttcaaggtttctgctgggtttctgaactgctgggtttctgcttgctcctctggagatgcagcgtctgttgactccagtgaagcgcattctgcaactgacaagagcggtgcaggaaacctccctcacacctgctcgcctgctcccagtagcccaccaaagcgaaagtatgcccggcgtcccgtctaaaggtgttctgcagatccatggaaagcttcctgggaaacgtatgctagcagagcttctccccgtgaatcatatttttaagatcccactcttagctggtaaatgaatttgaatcgacatagtagccccataagcatcagccctgtagagtgaggagccatctctagcgggcccttcattcctctccatgctgcaatcactgtcctgggcttatggtgctatggactaggggtcctttgtgaaagagcaagatggagcaatggagagaagacctcttcctgaatcactggactccagaaatgtgcatgcagatcagctgttgccttcaagatccagataaactttcctgtcatgtgttagaactttattattattaatattgttaaacttctgtgctgttcctgtgaatctccaaattttgtaccttgttctaagctaatatatagcaattaaaaagagagaaagagga

SEQ ID NO: 446677 - DNA, 2005 bp, Homo sapiens
tggggatctctttcaaggtttctgctgggtttctgaactgctgggtttctgcttgctcctctggagatgcagcgtctgttgactccagtgaagcgcattctgcaactgacaagagcggtgcaggaaacctccctcacacctgctcgcctgctcccagtagcccaccaaaggttttctacagcctctgctgtccccctggccaaaacagatacttggccaaaggacgtgggcatcctggccctggaggtctacttcccagcccaatatgtggaccaaactgacctggagaagtataacaatgtggaagcaggaaagtatacagtgggcttgggccagacccgtatgggcttctgctcagtccaagaggacatcaactccctgtgcctgacggtggtgcaacggctgatggagcgcatacagctcccatgggactctgtgggcaggctggaagtaggcactgagaccatcattgacaagtccaaagctgtcaaaacagtgctcatggaactcttccaggattcaggcaatactgatattgagggcatagataccaccaatgcctgctacggtggtactgcctccctcttcaatgctgccaactggatggagtccagttcctgggatggtcgttatgccatggtggtctgtggagacattgccgtctatcccagtggtaatgctcgtcccacaggtggggccggagctgtggctatgctgattgggcccaaggcccctctggccctggagcgagggctgaggggaacccatatggagaatgtgtatgacttctacaaaccaaatttggcctcggagtacccaatagtggatgggaagctttccatccagtgctacttgcgggccttggatcgatgttacacatcataccgtaaagatttacagtacatgatctttcatacacccttttgcaagatggtccagaagtctctggctcgcctgatgttcaatgacttcctgtcagccagcagtgacacacaaaccagcttatataaggggctggaggctttcggggggctaaagctggaagacacctacaccaacaaggacctggataaagcacttctaaaggcctctcaggacatgttcgacaagaaaaccaaggcttccctttacctctccactcacaatgggaacatgtacacctcatccctgtacgggtgcctggcctcgcttctgtcccaccactctgcccaagaactggctggctccaggattggtgccttctcttatggctctggtttagcagcaagtttcttttcatttcgagtatcccaggatgctgctccaggctctcccctggacaagttggtgtccagcacatcagacctgccaaaacgcctagcctcccgaaagtgtgtgtctcctgaggagttcacagaaataatgaaccaaagagagcaattctaccataaggtgaatttctccccacctggtgacacaaacagccttttcccaggtacttggtacctggagcgagtggacgagcagcatcgccgaaagtatgcccggcgtcccgtctaaaggtgttctgcagatccatggaaagcttcctgggaaacgtatgctagcagagcttctccccgtgaatcatatttttaagatcccactcttagctggtaaatgaatttgaatcgacatagtagccccataagcatcagccctgtagagtgaggagccatctctagcgggcccttcattcctctccatgctgcaatcactgtcctgggcttatggtgctatggactaggggtcctttgtgaaagagcaagatggagcaatggagagaagacctcttcctgaatcactggactccagaaatgtgcatgcagatcagctgttgccttcaagatccagataaactttcctgtcatgtgttagaactttattattattaatattgttaaacttctgtgctgttcctgtgaatctccaaattttgtaccttgttctaagctaatatatagcaattaaaaagagagaaagagga

SEQ ID NO: 446678 - DNA, 2005 bp, Homo sapiens
tggggatctctttcaaggtttctgctgggtttctgaactgctgggtttctgcttgctcctctggagatgcagcgtctgttgactccagtgaagcgcattctgcaactgacaagagcggtgcaggaaacctccctcacacctgctcgcctgctcccagtagcccaccaaaggttttctacagcctctgctgtccccctggccaaaacagatacttggccaaaggacgtgggcatcctggccctggaggtctacttcccagcccaatatgtggaccaaactgacctggagaagtataacaatgtggaagcaggaaagtatacagtgggcttgggccagacccgtatgggcttctgctcagtccaagaggacatcaactccctgtgcctgacggtggtgcaacggctgatggagcgcatacagctcccatgggactctgtgggcaggctggaagtaggcactgagaccatcattgacaagtccaaagctggcatagataccaccaatgcctgctacggtggtactgcctccctcttcaatgctgccaactggatggagtccagttcctgggatggtcgttatgccatggtggtctgtggagacattgccgtctatcccagtggtaatgctcgtcccacaggtggggccggagctgtggctatgctgattgggcccaaggcccctctggccctggagcgagggctgaggggaacccatatggagaatgtgtatgacttctacaaaccaaatttggcctcggagtacccaatagtggatgggaagctttccatccagtgctacttgcgggccttggatcgatgttacacatcataccgtaaaaaaatccagaatcagtggaagcaagctggcagcgatcgacccttcacccttgacgatttacagtacatgatctttcatacacccttttgcaagatggtccagaagtctctggctcgcctgatgttcaatgacttcctgtcagccagcagtgacacacaaaccagcttatataaggggctggaggctttcggggggctaaagctggaagacacctacaccaacaaggacctggataaagcacttctaaaggcctctcaggacatgttcgacaagaaaaccaaggcttccctttacctctccactcacaatgggaacatgtacacctcatccctgtacgggtgcctggcctcgcttctgtcccaccactctgcccaagaactggctggctccaggattggtgccttctcttatggctctggtttagcagcaagtttcttttcatttcgagtatcccaggatgctgctccaggctctcccctggacaagttggtgtccagcacatcagacctgccaaaacgcctagcctcccgaaagtgtgtgtctcctgaggagttcacagaaataatgaaccaaagagagcaattctaccataaggtgaatttctccccacctggtgacacaaacagccttttcccaggtacttggtacctggagcgagtggacgagcagcatcgccgaaagtatgcccggcgtcccgtctaaaggtgttctgcagatccatggaaagcttcctgggaaacgtatgctagcagagcttctccccgtgaatcatatttttaagatcccactcttagctggtaaatgaatttgaatcgacatagtagccccataagcatcagccctgtagagtgaggagccatctctagcgggcccttcattcctctccatgctgcaatcactgtcctgggcttatggtgctatggactaggggtcctttgtgaaagagcaagatggagcaatggagagaagacctcttcctgaatcactggactccagaaatgtgcatgcagatcagctgttgccttcaagatccagataaactttcctgtcatgtgttagaactttattattattaatattgttaaacttctgtgctgttcctgtgaatctccaaattttgtaccttgttctaagctaatatatagcaattaaaaagagagaaagagga

SEQ ID NO: 446679 - DNA, 2458 bp, Homo sapiens
tggggatctctttcaaggtttctgctgggtttctgaactgctgggtttctgcttgctcctctggagatgcagcgtctgttgactccagtgaagcgcattctgcaactgacaagagcggtgcaggaaacctccctcacacctgctcgcctgctcccagtagcccaccaaaggttttctacagcctctgctgtccccctggccaaaacagatacttggccaaaggacgtgggcatcctggccctggaggtctacttcccagcccaatatgtggaccaaactgacctggagaagtataacaatgtggaagcaggaaagtatacagtgggcttgggccagacccgtatgggcttctgctcagtccaagaggacatcaactccctgtgcctgacggtggtgcaacggctgatggagcgcatacagctcccatgggactctgtgggcaggctggaagtaggcactgagaccatcattgacaagtccaaagctgtcaaaacagtgctcatggaactcttccaggattcaggcaatactgatattgagggcatagataccaccaatgcctgctacggtggtactgcctccctcttcaatgctgccaactggatggagtccagttcctgggatggtcgttatgccatggtggtctgtggagacattgccgtctatcccagtggtaatgctcgtcccacaggtggggccggagctgtggctatgctgattgggcccaaggcccctctggccctggagcgagggctgaggggaacccatatggagaatgtgtatgacttctacaaaccaaatttggcctcggagtacccaatagtggatgggaagctttccatccagtgctacttgcgggccttggatcgatgttacacatcataccgtaaaaaaatccagaatcagtggaagcaagctggcagcgatcgacccttcacccttgacgatttacagtacatgatctttcatacacccttttgcaagatggtccagaagtctctggctcgcctgatgttcaatgacttcctgtcagccagcagtgacacacaaaccagcttatataaggggctggaggctttcggggggctaaagctggaagacacctacaccaacaaggacctggataaagcacttctaaaggcctctcaggacatgttcgacaagaaaaccaaggcttccctttacctctccactcacaatgggaacatgtacacctcatccctgtacgggtgcctggcctcgcttctgtcccaccactctgcccaagaactggctggctccaggattggtgccttctcttatggctctggtttagcagcaagtttcttttcatttcgagtatcccaggatgctgctccaggctctcccctggacaagttggtgtccagcacatcagacctgccaaaacgcctagcctcccgaaagtgtgtgtctcctgaggagttcacagaaataatgaaccaaagagagcaattctaccataaggtgaatttctccccacctggtgacacaaacagccttttcccaggtacttggtacctggagcgagtggacgagcagcatcgccgaaagtatgcccggcgtcccgtctaaaggtgttctgcagatccatggaaagcttcctgggaaacgtatgctagcagagcttctccccgtgaatcatatttttaagatcccactcttagctggtaaatgaatttgaatcgacatagtagccccataagcatcagccctgtagagtgaggagccatctctagcgggcccttcattcctctccatgctgcaatcactgtcctgggcttatggtgctatggactaggggtcctttgtgaaagagcaagatggagcaatggagagaagacctcttcctgaatcactggactccagaaatgtgcatgcagatcagctgttgccttcaagatccagataaactttcctgtcatgtgttagaactttattattattaatattgttaaacttctgtgctgttcctgtgaatctccaaattttgtaccttgttctaagctaatatatagcaattaaaaagagagaaagaggaaatgattcctgcgtttcttggaacccagaatacaaacccagcctaacatgcagcaagcctgctagaccttgtgggtcagagggctgggtccttgcctcacaggctgcctctgtccccttgcaattccattctatttctgccacatgccaagtgctatgacaggtacaaggcaaataagaacggtagaacacagcttcccccagcccacttccctgttctaaagacaccacatagacagagagcagcagacaggggccagcaggagctgtagttcagatcttcttggtcattccttgccgctgttatttgaacaaataaacacagcgcaaaggttaacaagtttttgccttctatagccaaaaataaaaaaataaataaattttgatgcctggcaggaaa

SEQ ID NO: 446680 - DNA, 2005 bp, Homo sapiens
tggggatctctttcaaggtttctgctgggtttctgaactgctgggtttctgcttgctcctctggagatgcagcgtctgttgactccagtgaagcgcattctgcaactgacaagagcggtgcaggaaacctccctcacacctgctcgcctgctcccagtagcccaccaaaggttttctacagcctctgctgtccccctggccaaaacagatacttggccaaaggacgtgggcatcctggccctggaggtctacttcccagcccaatatgtggaccaaactgacctggagaagtataacaatgtggaagcaggaaagtatacagtgggcttgggccagacccgtatgggcttctgctcagtccaagaggacatcaactccctgtgcctgacggtggtgcaacggctgatggagcgcatacagctcccatgggactctgtgggcaggctggaagtaggcactgagaccatcattgacaagtccaaagctgtcaaaacagtgctcatggaactcttccaggattcaggcaatactgatattgagggcatagataccaccaatgcctgctacggtggtactgcctccctcttcaatgctgccaactggatggagtccagttcctgggatggtcgttatgccatggtggtctgtggagacattgccgtctatcccagtggtaatgctcgtcccacaggtggggccggagctgtggctatgctgattgggcccaaggcccctctggccctggagcgagggctgaggggaacccatatggagaatgtgtatgacttctacaaaccaaatttggcctcggagtacccaatagtggatgggaagctttccatccagtgctacttgcgggccttggatcgatgttacacatcataccgtaaaaaaatccagaatcagtggaagcaagctggcagcgatcgacccttcacccttgacgatttacagtacatgatctttcatacacccttttgcaagatggtccagaagtctctggctcgcctgatgttcaatgacttcctgtcagccagcagtgacacacaaaccagcttatataaggggctggaggctttcggggggctaaagctggaagacacctacaccaacaaggacctggataaagcacttctaaaggcctctcaggacatgttcgacaagaaaaccaaggcttccctttacctctccactcacaatgggaacatgtacacctcatccctgtacgggtgcctggcctcgcttctgtcccaccactctgcccaagaactggctggctccaggattggtgccttctcttatggctctggtttagcagcaagtttcttttcatttcgagtatcccaggatgctgctccaggctctcccctggacaagttggtgtccagcacatcagacctgccaaaccaaagagagcaattctaccataaggtgaatttctccccacctggtgacacaaacagccttttcccaggtacttggtacctggagcgagtggacgagcagcatcgccgaaagtatgcccggcgtcccgtctaaaggtgttctgcagatccatggaaagcttcctgggaaacgtatgctagcagagcttctccccgtgaatcatatttttaagatcccactcttagctggtaaatgaatttgaatcgacatagtagccccataagcatcagccctgtagagtgaggagccatctctagcgggcccttcattcctctccatgctgcaatcactgtcctgggcttatggtgctatggactaggggtcctttgtgaaagagcaagatggagcaatggagagaagacctcttcctgaatcactggactccagaaatgtgcatgcagatcagctgttgccttcaagatccagataaactttcctgtcatgtgttagaactttattattattaatattgttaaacttctgtgctgttcctgtgaatctccaaattttgtaccttgttctaagctaatatatagcaattaaaaagagagaaagagga

SEQ ID NO: 446681 - DNA, 1581 bp, Homo sapiens
aaactatggcaaggacaaaaaaccaaacactgtatgttctcactcgtaggtgggaattgaacaatgagaacacatggacacaggaaggggaatatcacacactggggcctgttttggggtgggaggagtggtgagggatctgagatggtcgttatgccatggtggtctgtggagacattgccgtctatcccagtggtaatgctcgtcccacaggtggggccggagctgtggctatgctgattgggcccaaggcccctctggccctggagcgagggctgaggggaacccatatggagaatgtgtatgacttctacaaaccaaatttggcctcggagtacccaatagtggatgggaagctttccatccagtgctacttgcgggccttggatcgatgttacacatcataccgtaaaaaaatccagaatcagtggaagcaagctggcagcgatcgacccttcacccttgacgatttacagtacatgatctttcatacacccttttgcaagatggtccagaagtctctggctcgcctgatgttcaatgacttcctgtcagccagcagtgacacacaaaccagcttatataaggggctggaggctttcggggggctaaagctggaagacacctacaccaacaaggacctggataaagcacttctaaaggcctctcaggacatgttcgacaagaaaaccaaggcttccctttacctctccactcacaatgggaacatgtacacctcatccctgtacgggtgcctggcctcgcttctgtcccaccactctgcccaagaactggctggctccaggattggtgccttctcttatggctctggtttagcagcaagtttcttttcatttcgagtatcccaggatgctgctccaggctctcccctggacaagttggtgtccagcacatcagacctgccaaaacgcctagcctcccgaaagtgtgtgtctcctgaggagttcacagaaataatgaaccaaagagagcaattctaccataaggtgaatttctccccacctggtgacacaaacagccttttcccaggtacttggtacctggagcgagtggacgagcagcatcgccgaaagtatgcccggcgtcccgtctaaaggtgttctgcagatccatggaaagcttcctgggaaacgtatgctagcagagcttctccccgtgaatcatatttttaagatcccactcttagctggtaaatgaatttgaatcgacatagtagccccataagcatcagccctgtagagtgaggagccatctctagcgggcccttcattcctctccatgctgcaatcactgtcctgggcttatggtgctatggactaggggtcctttgtgaaagagcaagatggagcaatggagagaagacctcttcctgaatcactggactccagaaatgtgcatgcagatcagctgttgccttcaagatccagataaactttcctgtcatgtgttagaactttattattattaatattgttaaacttctgtgctgttcctgtgaatctccaaattttgtaccttgttctaagctaatatatagcaattaaaaagagagaaagagga

SEQ ID NO: 446682 - DNA, 2043 bp, Homo sapiens
tggggatctctttcaaggtttctgctgggtttctgaactgctgggtttctgcttgctcctctggagatgcagcgtctgttgactccagtgaagcgcattctgcaactgacaagagcggtgcaggaaacctccctcacacctgctcgcctgctcccagtagcccaccaaaggttttctacagcctctgctgtccccctggccaaaacagatacttggccaaaggacgtgggcatcctggccctggaggtctacttcccagcccaatatgtggaccaaactgacctggagaagtataacaatgtggaagcaggaaagtatacagtgggcttgggccagacccgtatgggcttctgctcagtccaagaggacatcaactccctgtgcctgacggtggtgcaacggctgatggagcgcatacagctcccatgggactctgtgggcaggctggaagtaggcactgagaccatcattgacaagtccaaagctgtcaaaacagtgctcatggaactcttccaggattcaggcaatactgatattgagggcatagataccaccaatgcctgctacggtggtactgcctccctcttcaatgctgccaactggatggagtccagttcctgggatggtcgttatgccatggtggtctgtggagacattgccgtctatcccagtggtaatgctcgtcccacaggtggggccggagctgtggctatgctgattgggcccaaggcccctctggccctggagcgagggctgaggggaacccatatggagaatgtgtatgacttctacaaaccaaatttggcctcggagtacccaatagtggatgggaagctttccatccagtgctacttgcgggccttggatcgatgttacacatcataccgtaaaaaaatccagaatcagtggaagcaagctggcagcgatcgacccttcacccttgacgatttacagtacatgatctttcatacacccttttgcaagatggtccagaagtctctggctcgcctgatgttcaatgacttcctgtcagccagcagtgacacacaaaccagcttatataaggggctggaggctttcggggggctaaagctggaagacacctacaccaacaaggacctggataaagcacttctaaaggcctctcaggacatgttcgacaagaaaaccaaggcttccctttacctctccactcacaatgggaacatgtacacctcatccctgtacgggtgcctggcctcgcttctgtcccaccactctgcccaagaactggctggctccaggattggtgccttctcttatggctctggtttagcagcaagtttcttttcatttcgagtatcccaggatgctgctccaggctctcccctggacaagttggtgtccagcacatcagacctgccaaaacgcctagcctcccgaaagtgtgtgtctcctgaggagttcacagaaataatgaaccaaagagagcaattctaccataaggtgaatttctccccacctggtgacacaaacagccttttcccaggtacttggtacctggagcgagtggacgagcagcatcgccgaaagtatgcccggcgtcccgtctaaaggtgttctgcagatccatggaaagcttcctgggaaacgtatgctagcagagcttctccccgtgaatcatatttttaagatcccactcttagctggtaaatgaatttgaatcgacatagtagccccataagcatcagccctgtagagtgaggagccatctctagcgggcccttcattcctctccatgctgcaatcactgtcctgggcttatggtgctatggactaggggtcctttgtgaaagagcaagatggagcaatggagagaagacctcttcctgaatcactggactccagaaatgtgcatgcagatcagctgttgccttcaagatccagataaactttcctgtcatgtgttagaactttattattattaatattgttaaacacctagtcccgctttttgtgtcttttcccattatgcacccttctctaaggggttttctttctaat

SEQ ID NO: 446683 - DNA, 1782 bp, Homo sapiens
tggggatctctttcaaggtttctgctgggtttctgaactgctgggtttctgcttgctcctctggagatgcagcgtctgttgactccagtgaagcgcattctgcaactgacaagagcggtgcaggaaacctccctcacacctgctcgcctgctcccagtagcccaccaaaggttttctacagcctctgctgtccccctggccaaaacagatacttggccaaaggacgtgggcatcctggccctggaggtctacttcccagcccaatatgtggaccaaactgacctggagaagtataacaatgtggaagcaggaaagtatacagtgggcttgggccagacccgtatgggcttctgctcagtccaagaggacatcaactccctgtgcctgacggtggtgcaacggctgatggagcgcatacagctcccatgggactctgtgggcaggctggaagtaggcactgagaccatcattgacaagtccaaagctgtcaaaacagtgctcatggaactcttccaggattcaggcaatactgatattgagggcatagataccaccaatgcctgctacggtggtactgcctccctcttcaatgctgccaactggatggagtccagttcctgggatggtcgttatgccatggtggtctgtggagacattgccgtctatcccagtggtaatgctcgtcccacaggtggggccggagctgtggctatgctgattgggcccaaggcccctctggccctggagcgagggctgaggggaacccatatggagaatgtgtatgacttctacaaaccaaatttggcctcggagtacccaatagtggatgggaagctttccatccagtgctacttgcgggccttggatcgatgttacacatcataccgtaaaaaaatccagaatcagtggaagcaagctggcagcgatcgacccttcacccttgacgatttacagtacatgatctttcatacacccttttgcaagatggtccagaagtctctggctcgcctgatgttcaatgagcttccctttacctctccactcacaatgggaacatgtacacctcatccctgtacgggtgcctggcctcgcttctgtcccaccactctgcccaagaactggctggctccaggattggtgccttctcttatggctctggtttagcagcaagtttcttttcatttcgagcaccaacaaggacctggataaagcacttctaaagggcctctcaggaccatgtacgacaagaaaaccaaggcttccctttacctcgtccactcaccaatgggaacatgtacacctcgtcccgtcttaaaacgtgttctgcagatccatggaaagcttcctgggaaacgtatgctagcagagcttctccccgtgaatcatatttttaagatcccactcttagctggtaaatgaatttgaatcgacatagtagccccataagcatcagccctgtagagtgaggagccatctctagcgggcccttcattcctctccatgctgcaatcactgtcctgggcttatggtgctatggactaggggtcctttgtgaaagagcaagatggagcaatggagagaagacctcttcctgaatcactggactccagaaatgtgcatgcagatcagctgttgccttcaagatccagataaactttcctgtcatgtgttagaactttattattattaatattgttaaacttctgtgctgttcctgtgaatctccaaattttgtaccttgttctaagctaatatatagcaattaaaaagagagaaagagga

SEQ ID NO: 446684 - DNA, 1142 bp, Homo sapiens
ttaatagcaaagtaaatcactgaagggatttaagcatggagtaagtttgtttaatttatgtgtttaaagcacttatttggctactacttagagactagattgttcaggcaagaggtaatggtggtttgattgcaactgattaaagagaagttgatggatttgagatacctaataagaatttattgattattttgtgattgatgtgattaaggacatgcatttaagtactatgtggcatacaccttgaccaaatcagtgtgtctgcctgcatgttttgctaacaagtatgcttgcttatcatttcttggtattctaagccacacacaccacacgttcctccagggtgtaacctcccacagaacctggctctctgttgaactcgtgattggcaatagtgataatgacaatgaaaaaggtgtaacaatcttgcttttgcttcccaggctctcccctggacaagttggtgtccagcacatcagacctgccaaaacgcctagcctcccgaaagtgtgtgtctcctgaggagttcacagaaataatgaaccaaagagagcaattctaccataaggtgaatttctccccacctggtgacacaaacagccttttcccaggtacttggtacctggagcgagtggacgagcagcatcgccgaaagtatgcccggcgtcccgtctaaaggtgttctgcagatccatggaaagcttcctgggaaacgtatgctagcagagcttctccccgtgaatcatatttttaagatcccactcttagctggtaaatgaatttgaatcgacatagtagccccataagcatcagccctgtagagtgaggagccatctctagcgggcccttcattcctctccatgctgcaatcactgtcctgggcttatggtgctatggactaggggtcctttgtgaaagagcaagatggagcaatggagagaagacctcttcctgaatcactggactccagaaatgtgcatgcagatcagctgttgccttcaagatccagataaactttcctgtcatgtgttagaactttattattattaatattgttaaacttctgtgctgttcctgtgaatctccaaattttgtaccttgttctaagctaatatatagcaattaaaaagagagaaagagga

SEQ ID NO: 446685 - DNA, 1088 bp, Homo sapiens
ttaatagcaaagtaaatcactgaagggatttaagcatggagtaagtttgtttaatttatgtgtttaaagcacttatttggctactacttagagactagattgttcaggcaagaggtaatggtggtttgattgcaactgattaaagagaagttgatggatttgagatacctaataagaatttattgattattttgtgattgatgtgattaaggacatgcatttaagtactatgtggcatacaccttgaccaaatcagtgtgtctgcctgcatgttttgctaacaagtatgcttgcttatcatttcttggtattctaagccacacacaccacacgttcctccagggtgtaacctcccacagaacctggctctctgttgaactcgtgattggcaatagtgataatgacaatgaaaaaggtgtaacaatcttgcttttgcttcccaggctctcccctggacaagttggtgtccagcacatcagacctgccaaaccaaagagagcaattctaccataaggtgaatttctccccacctggtgacacaaacagccttttcccaggtacttggtacctggagcgagtggacgagcagcatcgccgaaagtatgcccggcgtcccgtctaaaggtgttctgcagatccatggaaagcttcctgggaaacgtatgctagcagagcttctccccgtgaatcatatttttaagatcccactcttagctggtaaatgaatttgaatcgacatagtagccccataagcatcagccctgtagagtgaggagccatctctagcgggcccttcattcctctccatgctgcaatcactgtcctgggcttatggtgctatggactaggggtcctttgtgaaagagcaagatggagcaatggagagaagacctcttcctgaatcactggactccagaaatgtgcatgcagatcagctgttgccttcaagatccagataaactttcctgtcatgtgttagaactttattattattaatattgttaaacttctgtgctgttcctgtgaatctccaaattttgtaccttgttctaagctaatatatagcaattaaaaagagagaaagagga

SEQ ID NO: 446686 - DNA, 656 bp, Homo sapiens
tggggatctctttcaaggtttctgctgggtttctgaactgctgggtttctgcttgctcctctggagatgcagcgtctgttgactccagtgaagcgcattctgcaactgacaagagcggtgcaggaaacctccctcacacctgctcgcctgctcccagtagcccaccaaaggttttctacagcctctgctgtccccctggccaaaacagatacttggccaaaggacgtgggcatcctggccctggaggtctacttcccagcccaatatgtggaccaaactgacctggagaagtataacaatgtggaagcaggaaagtatacagtgggcttgggccagacccgtatgggcttctgctcagtccaagaggacatcaactccctgtgcctgacggtggtgcaacggctgatggagcgcatacagctcccatgggactctgtgggcaggctggaagtaggcactgagaccatcattgacaagtccaaagctggcatagataccaccaatgcctgctacggtggtactgcctccctcttcaatgctgccaactggatggagtccagttcctgggatggtatgtacggccacgaaccttatgtaagggtgctggaattggaggctgatattaccagttttgcttttgttccccgtggcttcat

SEQ ID NO: 446687 - DNA, 210 bp, Homo sapiens
ctggcctcgcttctgtcccagtgagtactgcatctggctccatgtcctccatgcacaccctcagcctccgcccccgtgggctgcagggtcaacaaagttgggtttctcttttggctcagaaatttaaaagaaaggaaggggcctggtgtagtggctcatgcctgtaatctcagcatttggggaggtttaggcgggcagatcgcctgaacc

SEQ ID NO: 446688 - DNA, 414 bp, Homo sapiens
atcgacccttcacccttgacgatttacagtacatgatctttcatacacccttttgcaagatggtccagaagtctctggctcgcctgatgttcaatgacttcctgtcagccagcagtgacacacaaaccagcttatataaggggctggaggctttcgggtgagttctcttcttggggagcctagaggctggtgaggtgtgagcaagaaggaggcttcttcatgccttaagtctagaccaccagcacccctgtgggggacaaatggcaatcctccagcagaacaggaacaatcccaggtccttccacggggtagtgggttattgtctgggtagggccctccatgagttattgcagggaaacatgggggatttggcagcactgcaggatcaaggggcagtaagaaactacagaggat

SEQ ID NO: 446689 - DNA, 506 bp, Homo sapiens
ataaagctcatatgtgtttgcaggaggtgggaagtagttccctgggaggcctggagaaactcggcacagttaaatctcagggaggatatctaaatggctcgcccctcatgccccatccttgccttcacgcttcctcttccagctggcagcgatcgacccttcacccttgacgatttacagtacatgatctttcatacacccttttgcaagatggtccagaagtctctggctcgcctgatgttcaatgacttcctgtcagccagcagtgacacacaaaccagcttatataaggggctggaggctttcgggtgagttctcttcttggggagcctagaggctggtgaggtgtgagcaagaaggaggcttcttcatgccttaagtctagaccaccagcacccctgtgggggacaaatggcaatcctccagcagaacaggaacaatcccaggtccttccacggggtagtgggttattgtctgggtagggccctccatgagttattgcaggg

SEQ ID NO: 446690 - DNA, 2005 bp, Homo sapiens
tggggatctctttcaaggtttctgctgggtttctgaactgctgggtttctgcttgctcctctggagatgcagcgtctgttgactccagtgaagcgcattctgcaactgacaagagcggtgcaggaaacctccctcacacctgctcgcctgctcccagtagcccaccaaaggttttctacagcctctgctgtccccctggccccagcccaatatgtggaccaaactgacctggagaagtataacaatgtggaagcaggaaagtatacagtgggcttgggccagacccgtatgggcttctgctcagtccaagaggacatcaactccctgtgcctgacggtggtgcaacggctgatggagcgcatacagctcccatgggactctgtgggcaggctggaagtaggcactgagaccatcattgacaagtccaaagctgtcaaaacagtgctcatggaactcttccaggattcaggcaatactgatattgagggcatagataccaccaatgcctgctacggtggtactgcctccctcttcaatgctgccaactggatggagtccagttcctgggatggtcgttatgccatggtggtctgtggagacattgccgtctatcccagtggtaatgctcgtcccacaggtggggccggagctgtggctatgctgattgggcccaaggcccctctggccctggagcgagggctgaggggaacccatatggagaatgtgtatgacttctacaaaccaaatttggcctcggagtacccaatagtggatgggaagctttccatccagtgctacttgcgggccttggatcgatgttacacatcataccgtaaaaaaatccagaatcagtggaagcaagctggcagcgatcgacccttcacccttgacgatttacagtacatgatctttcatacacccttttgcaagatggtccagaagtctctggctcgcctgatgttcaatgacttcctgtcagccagcagtgacacacaaaccagcttatataaggggctggaggctttcggggggctaaagctggaagacacctacaccaacaaggacctggataaagcacttctaaaggcctctcaggacatgttcgacaagaaaaccaaggcttccctttacctctccactcacaatgggaacatgtacacctcatccctgtacgggtgcctggcctcgcttctgtcccaccactctgcccaagaactggctggctccaggattggtgccttctcttatggctctggtttagcagcaagtttcttttcatttcgagtatcccaggatgctgctccaggctctcccctggacaagttggtgtccagcacatcagacctgccaaaacgcctagcctcccgaaagtgtgtgtctcctgaggagttcacagaaataatgaaccaaagagagcaattctaccataaggtgaatttctccccacctggtgacacaaacagccttttcccaggtacttggtacctggagcgagtggacgagcagcatcgccgaaagtatgcccggcgtcccgtctaaaggtgttctgcagatccatggaaagcttcctgggaaacgtatgctagcagagcttctccccgtgaatcatatttttaagatcccactcttagctggtaaatgaatttgaatcgacatagtagccccataagcatcagccctgtagagtgaggagccatctctagcgggcccttcattcctctccatgctgcaatcactgtcctgggcttatggtgctatggactaggggtcctttgtgaaagagcaagatggagcaatggagagaagacctcttcctgaatcactggactccagaaatgtgcatgcagatcagctgttgccttcaagatccagataaactttcctgtcatgtgttagaactttattattattaatattgttaaacttctgtgctgttcctgtgaatctccaaattttgtaccttgttctaagctaatatatagcaattaaaaagagagaaagagga

SEQ ID NO: 446691 - DNA, 2006 bp, Homo sapiens
tggggatctctttcaaggtttctgctgggtttctgaactgctgggtttctgcttgctcctctggagatgcagcgtctgttgactccagtgaagcgcattctgcaactgacaagagcggtgcaggaaacctccctcacacctgctcgcctgctcccagtagcccaccaaaggttttctacagcctctgctgtccccctggccaaaacagatacttggccaaaggacgtgggcatcctggccctggaggtctacttcccagcccaatatgtggaccaaactgacctggagaagtataacaatgtggaagcaggaaagtatacagtgggcttgggccagacccgtatgggcttctgctcagtccaagaggacatcaactccctgtgcctgacggtggtgcaacggctgatggagcgcatacagctcccatgggactctgtgggcaggctggaagtaggcactgagaccatcattgacaagtccaaagctgtcaaaacagtgctcatggaactcttccaggattcaggcaatactgatattgagggcatagataccaccaatgcctgctacggtggtactgcctccctcttcaatgctgccaactggatggagtccagttcctgggatggtcgttatgccatggtggtctgtggagacattgccgtctatcccagtggtaatgctcgtcccacaggtggggccggagctgtggctatgctgattgggcccaaggcccctctggccctggagcgagggctgaggggaacccatatggagaatgtgtatgacttctacaaaccaattgcgggccttggatcgatgttacacatcataccgtaaaaaaatccagaatcagtggaagcaagctggcagcgatcgacccttcacccttgacgatttacagtacatgatctttcatacacccttttgcaagatggtccagaagtctctggctcgcctgatgttcaatgacttcctgtcagccagcagtgacacacaaaccagcttatataaggggctggaggctttcggggggctaaagctggaagacacctacaccaacaaggacctggataaagcacttctaaaggcctctcaggacatgttcgacaagaaaaccaaggcttccctttacctctccactcacaatgggaacatgtacacctcatccctgtacgggtgcctggcctcgcttctgtcccaccactctgcccaagaactggctggctccaggattggtgccttctcttatggctctggtttagcagcaagtttcttttcatttcgagtatcccaggatgctgctccaggctctcccctggacaagttggtgtccagcacatcagacctgccaaaacgcctagcctcccgaaagtgtgtgtctcctgaggagttcacagaaataatgaaccaaagagagcaattctaccataaggtgaatttctccccacctggtgacacaaacagccttttcccaggtacttggtacctggagcgagtggacgagcagcatcgccgaaagtatgcccggcgtcccgtctaaaggtgttctgcagatccatggaaagcttcctgggaaacgtatgctagcagagcttctccccgtgaatcatatttttaagatcccactcttagctggtaaatgaatttgaatcgacatagtagccccataagcatcagccctgtagagtgaggagccatctctagcgggcccttcattcctctccatgctgcaatcactgtcctgggcttatggtgctatggactaggggtcctttgtgaaagagcaagatggagcaatggagagaagacctcttcctgaatcactggactccagaaatgtgcatgcagatcagctgttgccttcaagatccagataaactttcctgtcatgtgttagaactttattattattaatattgttaaacttctgtgctgttcctgtgaatctccaaattttgtaccttgttctaagctaatatatagcaattaaaaagagagaaagagga

SEQ ID NO: 446692 - DNA, 1894 bp, Homo sapiens
tggggatctctttcaaggtttctgctgggtttctgaactgctgggtttctgcttgctcctctggagatgcagcgtctgttgactccagtgaagcgcattctgcaactgacaagagcggtgcaggaaacctccctcacacctgctcgcctgctcccagtagcccaccaaaggttttctacagcctctgctgtccccctggccaaaacagatacttggccaaaggacgtgggcatcctggccctggaggtctacttcccagcccaatatgtggaccaaactgacctggagaagtataacaatgtggaagcaggaaagtatacagtgggcttgggccagacccgtatgggcttctgctcagtccaagaggacatcaactccctgtgcctgacggtggtgcaacggctgatggagcgcatacagctcccatgggactctgtgggcaggctggaagtaggcactgagaccatcattgacaagtccaaagctgtcaaaacagtgctcatggaactcttccaggattcaggcaatactgatattgagggcatagataccaccaatgcctgctacggtggtactgcctccctcttcaatgctgccaactggatggagtccagttcctgggatggtcgttatgccatggtggtctgtggagacattgccgtctatcccagtggtaatgctcgtcccacaggtggggccggagctgtggctatgctgattgggcccaaggcccctctggccctggagcgagctggcagcgatcgacccttcacccttgacgatttacagtacatgatctttcatacacccttttgcaagatggtccagaagtctctggctcgcctgatgttcaatgacttcctgtcagccagcagtgacacacaaaccagcttatataaggggctggaggctttcggggggctaaagctggaagacacctacaccaacaaggacctggataaagcacttctaaaggcctctcaggacatgttcgacaagaaaaccaaggcttccctttacctctccactcacaatgggaacatgtacacctcatccctgtacgggtgcctggcctcgcttctgtcccaccactctgcccaagaactggctggctccaggattggtgccttctcttatggctctggtttagcagcaagtttcttttcatttcgagtatcccaggatgctgctccaggctctcccctggacaagttggtgtccagcacatcagacctgccaaaacgcctagcctcccgaaagtgtgtgtctcctgaggagttcacagaaataatgaaccaaagagagcaattctaccataaggtgaatttctccccacctggtgacacaaacagccttttcccaggtacttggtacctggagcgagtggacgagcagcatcgccgaaagtatgcccggcgtcccgtctaaaggtgttctgcagatccatggaaagcttcctgggaaacgtatgctagcagagcttctccccgtgaatcatatttttaagatcccactcttagctggtaaatgaatttgaatcgacatagtagccccataagcatcagccctgtagagtgaggagccatctctagcgggcccttcattcctctccatgctgcaatcactgtcctgggcttatggtgctatggactaggggtcctttgtgaaagagcaagatggagcaatggagagaagacctcttcctgaatcactggactccagaaatgtgcatgcagatcagctgttgccttcaagatccagataaactttcctgtcatgtgttagaactttattattattaatattgttaaacttctgtgctgttcctgtgaatctccaaattttgtaccttgttctaagctaatatatagcaattaaaaagagagaaagagga

SEQ ID NO: 446693 - DNA, 1725 bp, Homo sapiens
aaatgggagaggggaatccgcgaggcttcctctcttgcatcatcaggcattgggataacgatgcatggaatgagtggtgcagatgatggtgaggaatcttagggaactcttctggcaattgaagattaaaatatataactggatataaagtgaaagtctttcctttgagactgttggcttctattctaggttttgttaagcccatgtaggtgaggaaagggaaatatacatctcatttttgtaataccaacaacctgtccaactccttttgaatatgcaagggatgttgaatgggcttgaacttgggcatgggacacagataatgaccagaaacctcctttatatggttctctcatcttttgtgctcaaggtaggctgcattgtgtagtctctgaaacactttgtgtgcctttccagggctgaggggaacccatatggagaatgtgtatgacttctacaaaccaaatttggcctcggagtacccaatagtggatgggaagctttccatccagtgctacttgcgggccttggatcgatgttacacatcataccgtaaaaaaatccagaatcagtggaagcaagctggcagcgatcgacccttcacccttgacgatttacagtacatgatctttcatacacccttttgcaagatggtccagaagtctctggctcgcctgatgttcaatgacttcctgtcagccagcagtgacacacaaaccagcttatataaggggctggaggctttcggggggctaaagctggaagacacctacaccaacaaggacctggataaagcacttctaaaggcctctcaggacatgttcgacaagaaaaccaaggcttccctttacctctccactcacaatgggaacatgtacacctcatccctgtacgggtgcctggcctcgcttctgtcccaccactctgcccaagaactggctggctccaggattggtgccttctcttatggctctggtttagcagcaagtttcttttcatttcgagtatcccaggatgctgctccaggctctcccctggacaagttggtgtccagcacatcagacctgccaaaacgcctagcctcccgaaagtgtgtgtctcctgaggagttcacagaaataatgaaccaaagagagcaattctaccataaggtgaatttctccccacctggtgacacaaacagccttttcccaggtacttggtacctggagcgagtggacgagcagcatcgccgaaagtatgcccggcgtcccgtctaaaggtgttctgcagatccatggaaagcttcctgggaaacgtatgctagcagagcttctccccgtgaatcatatttttaagatcccactcttagctggtaaatgaatttgaatcgacatagtagccccataagcatcagccctgtagagtgaggagccatctctagcgggcccttcattcctctccatgctgcaatcactgtcctgggcttatggtgctatggactaggggtcctttgtgaaagagcaagatggagcaatggagagaagacctcttcctgaatcactggactccagaaatgtgcatgcagatcagctgttgccttcaagatccagataaactttcctgtcatgtgttagaactttattattattaatattgttaaacttctgtgctgttcctgtgaatctccaaattttgtaccttgttctaagctaatatatagcaattaaaaagagagaaagagga

SEQ ID NO: 446694 - DNA, 1832 bp, Homo sapiens
tggggatctctttcaaggtttctgctgggtttctgaactgctgggtttctgcttgctcctctggagatgcagcgtctgttgactccagtgaagcgcattctgcaactgacaagagcggtgcaggaaacctccctcacacctgctcgcctgctcccagtagcccaccaaaggttttctacagcctctgctgtccccctggccaaaacagatacttggccaaaggacgtgggcatcctggccctggaggtctacttcccagcccaatatgtggaccaaactgacctggagaagtataacaatgtggaagcaggaaagtatacagtgggcttgggccagacccgtatgggcttctgctcagtccaagaggacatcaactccctgtgcctgacggtggtgcaacggctgatggagcgcatacagctcccatgggactctgtgggcaggctggaagtaggcactgagaccatcattgacaagtccaaagctgtcaaaacagtgctcatggaactcttccaggattcaggcaatactgatattgagggcatagataccaccaatgcctgctacggtggtactgcctccctcttcaatgctgccaactggatggagtccagttcctgggatggtcgttatgccatggtggtctgtggagacattgccgtctatcccagtggtaatgctcgtcccacaggtggggccggagctgtggctatgctgattgggcccaaggcccctctggccctggagcgagggctgaggggaacccatatggagaatgtgtatgacttctacaaaccaaatttggcctcggagtacccaatagtggatgggaagctttccatccagtgctacttgcgggccttggatcgatgttacacatcataccgtaaaaaaatccagaatcagtggaagcaagctggcagcgatcgacccttcacccttgacgatttacagtacatgatctttcatacacccttttgcaagatggtccagaagtctctggctcgcctgatgttcaatgacttcctgtcagccagcagtgacacacaaaccagcttatataaggggctggaggctttcggggggctaaagctggaagacacctacaccaacaaggacctggataaagcacttctaaaggcctctcaggacatgttcgacaagaaaaccaaggcttccctttacctctccactcacaatgggaacatgtacacctcatccctgtacgggtgcctggcctcgcttctgtcccaccactctgcccaagaactggctggctccaggattggtgccttctcttatggctctggtttagcagcaagtttcttttcatttcgagcgaaagtatgcccggcgtcccgtctaaaggtgttctgcagatccatggaaagcttcctgggaaacgtatgctagcagagcttctccccgtgaatcatatttttaagatcccactcttagctggtaaatgaatttgaatcgacatagtagccccataagcatcagccctgtagagtgaggagccatctctagcgggcccttcattcctctccatgctgcaatcactgtcctgggcttatggtgctatggactaggggtcctttgtgaaagagcaagatggagcaatggagagaagacctcttcctgaatcactggactccagaaatgtgcatgcagatcagctgttgccttcaagatccagataaactttcctgtcatgtgttagaactttattattattaatattgttaaacttctgtgctgttcctgtgaatctccaaattttgtaccttgttctaagctaatatatagcaattaaaaagagagaaagagga

SEQ ID NO: 446695 - DNA, 1226 bp, Homo sapiens
tggggatctctttcaaggtttctgctgggtttctgaactgctgggtttctgcttgctcctctggagatgcagcgtctgttgactccagtgaagcgcattctgcaactgacaagagcggtgcaggaaacctccctcacacctgctcgcctgctcccagtagcccaccaaaggttttctacagcctctgctgtccccctggccaaaacagatacttggccaaaggacgtgggcatcctggccctggaggtctacttcccagcccaatatgtggaccaaactgacctggagaagtataacaatgtggaagcaggaaagtatacagtgggcttgggccagacccgtatgggcttctgctcagtccaagaggacatcaactccctgtgcctgacggtggtgcaacggctgatggagcgcatacagctcccatgggactctgtgggcaggctggaagtaggcactgagaccatcattgacaagtccaaagctgtcaaaacagtgctcatggaactcttccaggattcaggcaatactgatattgagggcatagataccaccaatgcctgctacggtggtactgcctccctcttcaatgctgccaactggatggagtccagttcctgggatggtcgttatgccatggtggtctgtggagacattgccgtctatcccagtggtaatgctcgtcccacaggtggggccggagctgtggctatgctgattgggcccaaggcccctctggccctggagcgagggctgaggggaacccatatggagaatgtgtatgacttctacaaaccaaatttggcctcggagtacccaatagtggatgggaagctttccatccagtgctacttgcgggccttggatcgatgttacacatcataccgtaaaaaaatccagaatcagtggaagcaaggtatgagattcagagggcagaaagtgggggctctatttacataggccaagggtttgtacccaaaggccatgagatggtcttttctctcctgccttgaaaataatgtcaagagaattgtttcctgtcctctttcttacactcttccctgggtctatgctaaaatccatttggaagtcattcaacttcaggtgtaaaattgcttctaacttgagctaaataaaagaaagtaaataatccagggcaaggcccccagtgtgaaaccaagggatgtcagccacctgagaagatggtgttaagaggctgggcagtc

SEQ ID NO: 446696 - DNA, 710 bp, Homo sapiens
tggggatctctttcaaggtttctgctgggtttctgaactgctgggtttctgcttgctcctctggagatgcagcgtctgttgactccagtgaagcgcattctgcaactgacaagagcggtgcaggaaacctccctcacacctgctcgcctgctcccagtagcccaccaaaggttttctacagcctctgctgtccccctggccaaaacagatacttggccaaaggacgtgggcatcctggccctggaggtctacttcccagcccaatatgtggaccaaactgacctggagaagtataacaatgtggaagcaggaaagtatacagtgggcttgggccagacccgtatgggcttctgctcagtccaagaggacatcaactccctgtgcctgacggtggtgcaacggctgatggagcgcatacagctcccatgggactctgtgggcaggctggaagtaggcactgagaccatcattgacaagtccaaagctgtcaaaacagtgctcatggaactcttccaggattcaggcaatactgatattgagggcatagataccaccaatgcctgctacggtggtactgcctccctcttcaatgctgccaactggatggagtccagttcctgggatggtatgtacggccacgaaccttatgtaagggtgctggaattggaggctgatattaccagttttgcttttgttccccgtggcttcat

SEQ ID NO: 446697 - DNA, 4153 bp, Homo sapiens
cttcaaggttttgctgactcagtctggtagtcagagtctgcaggagaagacagttcaaggcagggcctggaggattggatcagtttagggacaggtcaaaggctggcttagagaccttagaggcaggttgcttgggtcgttgaatgctagtctggtcctgagagcccttttctctggcaactgtggactcagagctaaccaattgtagttggcagtgggggtgaagggtgatccagaggcctgagctgcagagggcacaagagagaaaagatgtcttagaaagagctttgagaacatgccttggctgctggcagggaccttggatggggtagtctacacccggaagtgcctgcctgccatcctctagtggctgccttggaaaatatgctcagtgcagccgcgtgcatgaatgaaaacgccgccgggcgcttctagtcggacaaaatgcagccgagaactccgctcgttctgtgcgttctcctgtcccaggtgctgctgctaacatctgcagaagatttggactgcactcctggatttcagcagaaagtgttccatatcaatcagccagctgaattcattgaggaccagtcaattctaaacttgaccttcagtgactgtaagggaaacgacaagctacgctatgaggtctcgagcccatacttcaaggtgaacagcgatggcggcttagttgctctgagaaacataactgcagtgggcaaaactctgttcgtccatgcacggaccccccatgcggaagatatggcagaactcgtgattgtcggggggaaagacatccagggctccttgcaggatatatttaaatttgcaagaacttctcctgtcccaagacaaaagaggtccattgtggtatctcccattttaattccagagaatcagagacagcctttcccaagagatgttggcaaggtagtcgatagtgacaggccagaaaggtccaagttccggctcactggaaagggagtggatcaagagcctaaaggaattttcagaatcaatgagaacacagggagcgtctccgtgacacggaccttggacagagaagtaatcgctgtttatcaactatttgtggagaccactgatgtcaatggcaaaactctcgaggggccggtgcctctggaagtcattgtgattgatcagaatgacaaccgaccgatctttcgggaaggcccctacatcggccacgtcatggaagggtcacccacaggcaccacagtgatgcggatgacagcctttgatgcagatgacccagccaccgataatgccctcctgcggtataatatccgtcaacagacgcctgacaagccatctcccaacatgttctacatcgatcctgagaaaggagacattgtcactgttgtgtcacctgcgctgctggaccgagagactctggaaaatcccaagtatgaactgatcatcgaggctcaagatatggctggactggatgttggattaacaggcacggccacagccacgatcatgatcgatgacaaaaatgatcactcaccaaaattcaccaagaaagagtttcaagccacagtcgaggaaggagctgtgggagttattgtcaatttgacagttgaagataaggatgaccccaccacaggtgcatggagggctgcctacaccatcatcaacggaaaccccgggcagagctttgaaatccacaccaaccctcaaaccaacgaagggatgctttctgttgtcaaaccattggactatgaaatttctgccttccacaccctgctgatcaaagtggaaaatgaagacccactcgtacccgacgtctcctacggccccagctccacagccaccgtccacatcactgtcctggatgtcaacgagggcccagtcttctacccagaccccatgatggtgaccaggcaggaggacctctctgtgggcagcgtgctgctgacagtgaatgccacggaccccgactccctgcagcatcaaaccatcaggtattctgtttacaaggacccagcaggttggctgaatattaaccccatcaatgggactgttgacaccacagctgtgctggaccgtgagtccccatttgtcgacaacagcgtgtacactgctctcttcctggcaattgacagtggcaaccctcccgctacgggcactgggactttgctgataaccctggaggacgtgaatgacaatgccccgttcatttaccccacagtagctgaagtctgtgatgatgccaaaaacctcagtgtagtcattttgggagcatcagataaggatcttcacccgaatacagatcctttcaaatttgaaatccacaaacaagctgttcctgataaagtctggaagatctccaagatcaacaatacacacgccctggtaagccttcttcaaaatctgaacaaagcaaactacaacctgcccatcatggtgacagattcagggaaaccacccatgacgaatatcacagatctcagggtacaagtgtgctcctgcaggaattccaaagtggactgcaacgcggcgggggccctgcgcttcagcctgccctcagtcctgctcctcagcctcttcagcttagcttgtctgtgagaactcctgacgtctgaagcttgactcccaagtttccatagcaacaggaaaaaaaaaaaatctatccaaatctgaagattgcggtttacagctatcgaacttcacaactaggcctcaattgttccggttttttattttctttacaatttcacttagtctgtacttcatcattttgacagcatcttcctccctcctttaattaatggaatcttctgaattttccctgaatgtttaaagatcatgacatatgacttgatcttctgggagcaggaacaatgactactttttctggtgtgttaacatgtcgctagccagtgctccaggcacccagctttgtctgtgggttagtattggtgtatgtatgagtatctgtatgtatatatacacggtatttatagagagagactatcctggagaagcctcgttttgatgccattcttccttgcaaggttaagcaaggtgggtggaaactaagacacctgaaccctccagggcctcccgcatcaaggtcagcatgaggacagaccacagagctgtcacttttgctccgaagctacttctccactgtcccgttcagtctgaatgctgccacaaccagccaggcaggtccacagagagggagagcagagaaagaagtcctttctctttattgagttcgaggactacaaccaatttacactgccatctgatgccgtgatcctgagccaaggaggtgaggagcagagcaggcaatttcaccaccaaatgccaagaaaagggctgacattttctttcatgggcaccaacctgcatttgtatgtgtcccgaatccacagtcgtactgattctaatggggacacagatcatggtagagaatctctccctcctcagtaaatgtacaactgcacctgtcatcatggaggtcatacatgcatacaaagaggtgtacaggtaccatcttgtatacacatatatacccacatgtacagacatacatttatgcacattcacgctgtttgtttcatatatacaggcataaaatagagtaaatacaggtagttttaaaagtacccttttgtgtgaattgactaccgttgtttgcaaacccgaaaataaaagacgttcattatgtatgaaaagtaactgatttgtattctgtgagcatgtaaaagcggaaagttagtgcttgttctaagattaccttcttgttgataaaccataaatgaatcatcaaagctcacaccaaatttttctatcaaataaaactagtgacagcttgtggctttttattagagctcgccacgaactagggtaaggtgagtgtcttagcatattttaatgcagttgcttactaaaggttttaaccgcacatgcacacacacacgctttcttatgcaatctatgtttgcacttgtgctttcagttagccttctgtaggaagtagaagtcatatgttgtctttgttgtagtgaaattatacagatagagttccatatattgtatttgtttcaatggtaaatccttttggaacatatagaatgcagagatttttttttccattaaaataaatgggtattggtggttaaaa

SEQ ID NO: 446698 - DNA, 4559 bp, Homo sapiens
cttcaaggttttgctgactcagtctggtagtcagagtctgcaggagaagacagttcaaggcagggcctggaggattggatcagtttagggacaggtcaaaggctggcttagagaccttagaggcaggttgcttgggtcgttgaatgctagtctggtcctgagagcccttttctctggcaactgtggactcagagctaaccaattgtagttggcagtgggggtgaagggtgatccagaggcctgagctgcagagggcacaagagagaaaagatgtcttagaaagagctttgagaacatgccttggctgctggcagggaccttggatggggtagtctacacccggaagtgcctgcctgccatcctctagtggctgccttggaaaatatgctcagtgcagccgcgtgcatgaatgaaaacgccgccgggcgcttctagtcggacaaaatgcagccgagaactccgctcgttctgtgcgttctcctgtcccaggtgctgctgctaacatctgcagaagatttggactgcactcctggatttcagcagaaagtgttccatatcaatcagccagctgaattcattgaggaccagtcaattctaaacttgaccttcagtgactgtaagggaaacgacaagctacgctatgaggtctcgagcccatacttcaaggtgaacagcgatggcggcttagttgctctgagaaacataactgcagtgggcaaaactctgttcgtccatgcacggaccccccatgcggaagatatggcagaactcgtgattgtcggggggaaagacatccagggctccttgcaggatatatttaaatttgcaagaacttctcctgtcccaagacaaaagaggtccattgtggtatctcccattttaattccagagaatcagagacagcctttcccaagagatgttggcaaggtagtcgatagtgacaggccagaaaggtccaagttccggctcactggaaagggagtggatcaagagcctaaaggaattttcagaatcaatgagaacacagggagcgtctccgtgacacggaccttggacagagaagtaatcgctgtttatcaactatttgtggagaccactgatgtcaatggcaaaactctcgaggggccggtgcctctggaagtcattgtgattgatcagaatgacaaccgaccgatctttcgggaaggcccctacatcggccacgtcatggaagggtcacccacaggcaccacagtgatgcggatgacagcctttgatgcagatgacccagccaccgataatgccctcctgcggtataatatccgtcaacagacgcctgacaagccatctcccaacatgttctacatcgatcctgagaaaggagacattgtcactgttgtgtcacctgcgctgctggaccgagagactctggaaaatcccaagtatgaactgatcatcgaggctcaagatatggctggactggatgttggattaacaggcacggccacagccacgatcatgatcgatgacaaaaatgatcactcaccaaaattcaccaagaaagagtttcaagccacagtcgaggaaggagctgtgggagttattgtcaatttgacagttgaagataaggatgaccccaccacaggtgcatggagggctgcctacaccatcatcaacggaaaccccgggcagagctttgaaatccacaccaaccctcaaaccaacgaagggatgctttctgttgtcaaaccattggactatgaaatttctgccttccacaccctgctgatcaaagtggaaaatgaagacccactcgtacccgacgtctcctacggccccagctccacagccaccgtccacatcactgtcctggatgtcaacgagggcccagtcttctacccagaccccatgatggtgaccaggcaggaggacctctctgtgggcagcgtgctgctgacagtgaatgccacggaccccgactccctgcagcatcaaaccatcaggtattctgtttacaaggacccagcaggttggctgaatattaaccccatcaatgggactgttgacaccacagctgtgctggaccgtgagtccccatttgtcgacaacagcgtgtacactgctctcttcctggcaattgacagtggcaaccctcccgctacgggcactgggactttgctgataaccctggaggacgtgaatgacaatgccccgttcatttaccccacagtagctgaagtctgtgatgatgccaaaaacctcagtgtagtcattttgggagcatcagataaggatcttcacccgaatacagatcctttcaaatttgaaatccacaaacaagctgttcctgataaagtctggaagatctccaagatcaacaatacacacgccctggtaagccttcttcaaaatctgaacaaagcaaactacaacctgcccatcatggtgacagattcagggaaaccacccatgacgaatatcacagatctcagggtacaagtgtgctcctgcaggaattccaaagtggactgcaacgcggcgggggccctgcgcttcagcctgccctcagtcctgctcctcagcctcttcagcttagcttgtctgtgagaactcctgacgtctgaagcttgactcccaagtttccatagcaacaggaaaaaaaaaaaatctatccaaatctgaagattgcggtttacagctatcgaacttcacaactaggcctcaattgttccggttttttattttctttacaatttcacttagtctgtacttcatcattttgacagcatcttcctccctcctttaattaatggaatcttctgaattttccctgaatgtttaaagatcatgacatatgacttgatcttctgggagcaggaacaatgactactttttctggtgtgttaacatgtcgctagccagtgctccaggcacccagctttgtctgtgggttagtattggtgtatgtatgagtatctgtatgtatatatacacggtatttatagagagagactatcctggagaagcctcgttttgatgccattcttccttgcaaggttaagcaaggtgggtggaaactaagacacctgaaccctccagggcctcccgcatcaaggtcagcatgaggacagaccacagagctgtcacttttgctccgaagctacttctccactgtcccgttcagtctgaatgctgccacaaccagccaggcaggtccacagagagggagagcagagaaagaagtcctttctctttattgagttcgaggactacaaccaatttacactgccatctgatgccgtgatcctgagccaaggaggtgaggagcagagcaggcaatttcaccaccaaatgccaagaaaagggctgacattttctttcatgggcaccaacctgcatttgtatgtgtcccgaatccacagtcgtactgattctaatggggacacagatcatggtagagaatctctccctcctcagtaaatgtacaactgcacctgtcatcatggaggtcatacatgcatacaaagaggtgtacaggtaccatcttgtatacacatatatacccacatgtacagacatacatttatgcacattcacgctgtttgtttcatatatacaggcataaaatagagtaaatacaggtagttttaaaagtacccttttgtgtgaattgactaccgttgtttgcaaacccgaaaataaaagacgttcattatgtatgaaaagtaactgatttgtattctgtgagcatgtaaaagcggaaagttagtgcttgttctaagattaccttcttgttgataaaccataaatgaatcatcaaagctcacaccaaatttttctatcaaataaaactagtgacagcttgtggctttttattagagctcgccacgaactagggtaaggtgagtgtcttagcatattttaatgcagttgcttactaaaggttttaaccgcacatgcacacacacacgctttcttatgcaatctatgtttgcacttgtgctttcagttagccttctgtaggaagtagaagtcatatgttgtctttgttgtagtgaaattatacagatagagttccatatattgtatttgtttcaatggtaaatccttttggaacatatagaatgcagagatttttttttccattaaaataaatgggtattggtggttaaaaaaaaaaaaaaaaaaaaaaaaaaaaaaaaaaaaaaaaaaaaaaaaaaaaaaaaaaaaaaagggggggggcccaaaaaaatatctcccccggggggccacatatctctctccgcactaccccttttttgttgtgctaaacaaggggccccactatatggggagctgttttatatataacccgcgggcgcgtgggccgcgtctataaaagtccctgccccggggaacaacacgcgcgacaacgggcgagcaccctgtggcgaagagagcccccctaccctagcgcgggcaggggaaacaaccacggcggacaaacacaccacagagaacataccaccccccccggcgccaaacaacaaacaccacaaggactaacggggccccacccaaccccccccaaaccccgcaca

SEQ ID NO: 446699 - DNA, 3836 bp, Homo sapiens
atcttttgggaagttggctggctggcgaggcagagcctctcctcaaagcctggctcccacggaaaatatgctcagtgcagccgcgtgcatgaatgaaaacgccgccgggcgcttctagtcggacaaaatgcagccgagaactccgctcgttctgtgcgttctcctgtcccaggtgctgctgctaacatctgcagaagatttggactgcactcctggatttcagcagaaagtgttccatatcaatcagccagctgaattcattgaggaccagtcaattctaaacttgaccttcagtgactgtaagggaaacgacaagctacgctatgaggtctcgagcccatacttcaaggtgaacagcgatggcggcttagttgctctgagaaacataactgcagtgggcaaaactctgttcgtccatgcacggaccccccatgcggaagatatggcagaactcgtgattgtcggggggaaagacatccagggctccttgcaggatatatttaaatttgcaagaacttctcctgtcccaagacaaaagaggtccattgtggtatctcccattttaattccagagaatcagagacagcctttcccaagagatgttggcaaggtagtcgatagtgacaggccagaaaggtccaagttccggctcactggaaagggagtggatcaagagcctaaaggaattttcagaatcaatgagaacacagggagcgtctccgtgacacggaccttggacagagaagtaatcgctgtttatcaactatttgtggagaccactgatgtcaatggcaaaactctcgaggggccggtgcctctggaagtcattgtgattgatcagaatgacaaccgaccgatctttcgggaaggcccctacatcggccacgtcatggaagggtcacccacaggcaccacagtgatgcggatgacagcctttgatgcagatgacccagccaccgataatgccctcctgcggtataatatccgtcaacagacgcctgacaagccatctcccaacatgttctacatcgatcctgagaaaggagacattgtcactgttgtgtcacctgcgctgctggaccgagagactctggaaaatcccaagtatgaactgatcatcgaggctcaagatatggctggactggatgttggattaacaggcacggccacagccacgatcatgatcgatgacaaaaatgatcactcaccaaaattcaccaagaaagagtttcaagccacagtcgaggaaggagctgtgggagttattgtcaatttgacagttgaagataaggatgaccccaccacaggtgcatggagggctgcctacaccatcatcaacggaaaccccgggcagagctttgaaatccacaccaaccctcaaaccaacgaagggatgctttctgttgtcaaaccattggactatgaaatttctgccttccacaccctgctgatcaaagtggaaaatgaagacccactcgtacccgacgtctcctacggccccagctccacagccaccgtccacatcactgtcctggatgtcaacgagggcccagtcttctacccagaccccatgatggtgaccaggcaggaggacctctctgtgggcagcgtgctgctgacagtgaatgccacggaccccgactccctgcagcatcaaaccatcaggtattctgtttacaaggacccagcaggttggctgaatattaaccccatcaatgggactgttgacaccacagctgtgctggaccgtgagtccccatttgtcgacaacagcgtgtacactgctctcttcctggcaattgacagtggcaaccctcccgctacgggcactgggactttgctgataaccctggaggacgtgaatgacaatgccccgttcatttaccccacagtagctgaagtctgtgatgatgccaaaaacctcagtgtagtcattttgggagcatcagataaggatcttcacccgaatacagatcctttcaaatttgaaatccacaaacaagctgttcctgataaagtctggaagatctccaagatcaacaatacacacgccctggtaagccttcttcaaaatctgaacaaagcaaactacaacctgcccatcatggtgacagattcagggaaaccacccatgacgaatatcacagatctcagggtacaagtgtgctcctgcaggaattccaaagtggactgcaacgcggcgggggccctgcgcttcagcctgccctcagtcctgctcctcagcctcttcagcttagcttgtctgtgagaactcctgacgtctgaagcttgactcccaagtttccatagcaacaggaaaaaaaaaaaatctatccaaatctgaagattgcggtttacagctatcgaacttcacaactaggcctcaattgttccggttttttattttctttacaatttcacttagtctgtacttcatcattttgacagcatcttcctccctcctttaattaatggaatcttctgaattttccctgaatgtttaaagatcatgacatatgacttgatcttctgggagcaggaacaatgactactttttctggtgtgttaacatgtcgctagccagtgctccaggcacccagctttgtctgtgggttagtattggtgtatgtatgagtatctgtatgtatatatacacggtatttatagagagagactatcctggagaagcctcgttttgatgccattcttccttgcaaggttaagcaaggtgggtggaaactaagacacctgaaccctccagggcctcccgcatcaaggtcagcatgaggacagaccacagagctgtcacttttgctccgaagctacttctccactgtcccgttcagtctgaatgctgccacaaccagccaggcaggtccacagagagggagagcagagaaagaagtcctttctctttattgagttcgaggactacaaccaatttacactgccatctgatgccgtgatcctgagccaaggaggtgaggagcagagcaggcaatttcaccaccaaatgccaagaaaagggctgacattttctttcatgggcaccaacctgcatttgtatgtgtcccgaatccacagtcgtactgattctaatggggacacagatcatggtagagaatctctccctcctcagtaaatgtacaactgcacctgtcatcatggaggtcatacatgcatacaaagaggtgtacaggtaccatcttgtatacacatatatacccacatgtacagacatacatttatgcacattcacgctgtttgtttcatatatacaggcataaaatagagtaaatacaggtagttttaaaagtacccttttgtgtgaattgactaccgttgtttgcaaacccgaaaataaaagacgttcattatgtatgaaaagtaactgatttgtattctgtgagcatgtaaaagcggaaagttagtgcttgttctaagattaccttcttgttgataaaccataaatgaatcatcaaagctcacaccaaatttttctatcaaataaaactagtgacagcttgtggctttttattagagctcgccacgaactagggtaaggtgagtgtcttagcatattttaatgcagttgcttactaaaggttttaaccgcacatgcacacacacacgctttcttatgcaatctatgtttgcacttgtgctttcagttagccttctgtaggaagtagaagtcatatgttgtctttgttgtagtgaaattatacagatagagttccatatattgtatttgtttcaatggtaaatccttttggaacatatagaatgcagagatttttttttccattaaaataaatgggtattggtggttaaaa

SEQ ID NO: 446700 - DNA, 3626 bp, Homo sapiens
agcagagctgccaaccagagcctctgatcaacacaggataaccagcaggagagttggtgtaattccagacagtgtgaccttcagtgactgtaagggaaacgacaagctacgctatgaggtctcgagcccatacttcaaggtgaacagcgatggcggcttagttgctctgagaaacataactgcagtgggcaaaactctgttcgtccatgcacggaccccccatgcggaagatatggcagaactcgtgattgtcggggggaaagacatccagggctccttgcaggatatatttaaatttgcaagaacttctcctgtcccaagacaaaagaggtccattgtggtatctcccattttaattccagagaatcagagacagcctttcccaagagatgttggcaaggtagtcgatagtgacaggccagaaaggtccaagttccggctcactggaaagggagtggatcaagagcctaaaggaattttcagaatcaatgagaacacagggagcgtctccgtgacacggaccttggacagagaagtaatcgctgtttatcaactatttgtggagaccactgatgtcaatggcaaaactctcgaggggccggtgcctctggaagtcattgtgattgatcagaatgacaaccgaccgatctttcgggaaggcccctacatcggccacgtcatggaagggtcacccacaggcaccacagtgatgcggatgacagcctttgatgcagatgacccagccaccgataatgccctcctgcggtataatatccgtcaacagacgcctgacaagccatctcccaacatgttctacatcgatcctgagaaaggagacattgtcactgttgtgtcacctgcgctgctggaccgagagactctggaaaatcccaagtatgaactgatcatcgaggctcaagatatggctggactggatgttggattaacaggcacggccacagccacgatcatgatcgatgacaaaaatgatcactcaccaaaattcaccaagaaagagtttcaagccacagtcgaggaaggagctgtgggagttattgtcaatttgacagttgaagataaggatgaccccaccacaggtgcatggagggctgcctacaccatcatcaacggaaaccccgggcagagctttgaaatccacaccaaccctcaaaccaacgaagggatgctttctgttgtcaaaccattggactatgaaatttctgccttccacaccctgctgatcaaagtggaaaatgaagacccactcgtacccgacgtctcctacggccccagctccacagccaccgtccacatcactgtcctggatgtcaacgagggcccagtcttctacccagaccccatgatggtgaccaggcaggaggacctctctgtgggcagcgtgctgctgacagtgaatgccacggaccccgactccctgcagcatcaaaccatcaggtattctgtttacaaggacccagcaggttggctgaatattaaccccatcaatgggactgttgacaccacagctgtgctggaccgtgagtccccatttgtcgacaacagcgtgtacactgctctcttcctggcaattgacagtggcaaccctcccgctacgggcactgggactttgctgataaccctggaggacgtgaatgacaatgccccgttcatttaccccacagtagctgaagtctgtgatgatgccaaaaacctcagtgtagtcattttgggagcatcagataaggatcttcacccgaatacagatcctttcaaatttgaaatccacaaacaagctgttcctgataaagtctggaagatctccaagatcaacaatacacacgccctggtaagccttcttcaaaatctgaacaaagcaaactacaacctgcccatcatggtgacagattcagggaaaccacccatgacgaatatcacagatctcagggtacaagtgtgctcctgcaggaattccaaagtggactgcaacgcggcgggggccctgcgcttcagcctgccctcagtcctgctcctcagcctcttcagcttagcttgtctgtgagaactcctgacgtctgaagcttgactcccaagtttccatagcaacaggaaaaaaaaaaaatctatccaaatctgaagattgcggtttacagctatcgaacttcacaactaggcctcaattgttccggttttttattttctttacaatttcacttagtctgtacttcatcattttgacagcatcttcctccctcctttaattaatggaatcttctgaattttccctgaatgtttaaagatcatgacatatgacttgatcttctgggagcaggaacaatgactactttttctggtgtgttaacatgtcgctagccagtgctccaggcacccagctttgtctgtgggttagtattggtgtatgtatgagtatctgtatgtatatatacacggtatttatagagagagactatcctggagaagcctcgttttgatgccattcttccttgcaaggttaagcaaggtgggtggaaactaagacacctgaaccctccagggcctcccgcatcaaggtcagcatgaggacagaccacagagctgtcacttttgctccgaagctacttctccactgtcccgttcagtctgaatgctgccacaaccagccaggcaggtccacagagagggagagcagagaaagaagtcctttctctttattgagttcgaggactacaaccaatttacactgccatctgatgccgtgatcctgagccaaggaggtgaggagcagagcaggcaatttcaccaccaaatgccaagaaaagggctgacattttctttcatgggcaccaacctgcatttgtatgtgtcccgaatccacagtcgtactgattctaatggggacacagatcatggtagagaatctctccctcctcagtaaatgtacaactgcacctgtcatcatggaggtcatacatgcatacaaagaggtgtacaggtaccatcttgtatacacatatatacccacatgtacagacatacatttatgcacattcacgctgtttgtttcatatatacaggcataaaatagagtaaatacaggtagttttaaaagtacccttttgtgtgaattgactaccgttgtttgcaaacccgaaaataaaagacgttcattatgtatgaaaagtaactgatttgtattctgtgagcatgtaaaagcggaaagttagtgcttgttctaagattaccttcttgttgataaaccataaatgaatcatcaaagctcacaccaaatttttctatcaaataaaactagtgacagcttgtggctttttattagagctcgccacgaactagggtaaggtgagtgtcttagcatattttaatgcagttgcttactaaaggttttaaccgcacatgcacacacacacgctttcttatgcaatctatgtttgcacttgtgctttcagttagccttctgtaggaagtagaagtcatatgttgtctttgttgtagtgaaattatacagatagagttccatatattgtatttgtttcaatggtaaatccttttggaacatatagaatgcagagatttttttttccattaaaataaatgggtattggtggttaaaa

SEQ ID NO: 446701 - DNA, 3774 bp, Homo sapiens
atcttttgggaagttggctggctggcgaggcagagcctctcctcaaagcctggctcccacggaaaatatgctcagtgcagccgcgtgcatgaatgaaaacgccgccgggcgcttctagtcggacaaaatgcagccgagaactccgctcgttctgtgcgttctcctgtcccaggtgctgctgctaacatctgcagaagatttggactgcactcctggatttcagcagaaagtgttccatatcaatcagccagctgaattcattgaggaccagtcaattctaaacttgaccttcagtgactgtaagggaaacgacaagctacgctatgaggtctcgagcccatacttcaaggtgaacagcgatggcggcttagttgctctgagaaacataactgcagtgggcaaaactctgttcgtccatgcacggaccccccatgcggaagatatggcagaactcgtgattgtcggggggaaagacatccagggctccttgcaggatatatttaaatttgcaagaacttctcctgtcccaagacaaaagaggtccattgtggtatctcccattttaattccagagaatcagagacagcctttcccaagagatgttggcaaggtagtcgatagtgacaggccagaaaggtccaagttccggctcactggaaagggagtggatcaagagcctaaaggaattttcagaatcaatgagaacacagggagcgtctccgtgacacggaccttggacagagaagtaatcgctgtttatcaactatttgtggagaccactgatgtcaatggcaaaactctcgaggggccggtgcctctggaagtcattgtgattgatcagaatgacaaccgaccgatctttcgggaaggcccctacatcggccacgtcatggaagggtcacccacaggcaccacagtgatgcggatgacagcctttgatgcagatgacccagccaccgataatgccctcctgcggtataatatccgtcaacagacgcctgacaagccatctcccaacatgttctacatcgatcctgagaaaggagacattgtcactgttgtgtcacctgcgctgctggaccgagagactctggaaaatcccaagtatgaactgatcatcgaggctcaagatatggctggactggatgttggattaacaggcacggccacagccacgatcatgatcgatgacaaaaatgatcactcaccaaaattcaccaagaaagagtttcaagccacagtcgaggaaggagctgtgggagttattgtcaatttgacagttgaagataaggatgaccccaccacaggtgcatggagggctgcctacaccatcatcaacggaaaccccgggcagagctttgaaatccacaccaaccctcaaaccaacgaagggatgctttctgttgtcaaaccattggactatgaaatttctgccttccacaccctgctgatcaaagtggaaaatgaagacccactcgtacccgacgtctcctacggccccagctccacagccaccgtccacatcactgtcctggatgtcaacgagggcccagtcttctacccagaccccatgatggtgaccaggcaggaggacctctctgtgggcagcgtgctgctgacagtgaatgccacggaccccgactccctgcagcatcaaaccatcaggtattctgtttacaaggacccagcaggttggctgaatattaaccccatcaatgggactgttgacaccacagctgtgctggaccgtgagtccccatttgtcgacaacagcgtgtacactgctctcttcctggcaattgacagtggcaaccctcccgctacgggcactgggactttgctgataaccctggaggacgtgaatgacaatgccccgttcatttaccccacagtagctgaagtctgtgatgatgccaaaaacctcagtgtagtcattttgggagcatcagataaggatcttcacccgaatacagatcctttcaaatttgaaatccacaaacaagctgttcctgataaagtctggaagatctccaagatcaacaatacacacgccctggtaagccttcttcaaaatctgaacaaagcaaactacaacctgcccatcatggtgacagattcagggaaaccacccatgacgaatatcacagatctcagggtacaagtgtgctcctgcaggaattccaaagtggactgcaacgcggcgggggccctgcgcttcagcctgccctcagtcctgctcctcagcctcttcagcttagcttgtctgtgagaactcctgacgtctgaagcttgactcccaagtttccatagcaacaggagcctcaattgttccggttttttattttctttacaatttcacttagtctgtacttcatcattttgacagcatcttcctccctcctttaattaatggaatcttctgaattttccctgaatgtttaaagatcatgacatatgacttgatcttctgggagcaggaacaatgactactttttctggtgtgttaacatgtcgctagccagtgctccaggcacccagctttgtctgtgggttagtattggtgtatgtatgagtatctgtatgtatatatacacggtatttatagagagagactatcctggagaagcctcgttttgatgccattcttccttgcaaggttaagcaaggtgggtggaaactaagacacctgaaccctccagggcctcccgcatcaaggtcagcatgaggacagaccacagagctgtcacttttgctccgaagctacttctccactgtcccgttcagtctgaatgctgccacaaccagccaggcaggtccacagagagggagagcagagaaagaagtcctttctctttattgagttcgaggactacaaccaatttacactgccatctgatgccgtgatcctgagccaaggaggtgaggagcagagcaggcaatttcaccaccaaatgccaagaaaagggctgacattttctttcatgggcaccaacctgcatttgtatgtgtcccgaatccacagtcgtactgattctaatggggacacagatcatggtagagaatctctccctcctcagtaaatgtacaactgcacctgtcatcatggaggtcatacatgcatacaaagaggtgtacaggtaccatcttgtatacacatatatacccacatgtacagacatacatttatgcacattcacgctgtttgtttcatatatacaggcataaaatagagtaaatacaggtagttttaaaagtacccttttgtgtgaattgactaccgttgtttgcaaacccgaaaataaaagacgttcattatgtatgaaaagtaactgatttgtattctgtgagcatgtaaaagcggaaagttagtgcttgttctaagattaccttcttgttgataaaccataaatgaatcatcaaagctcacaccaaatttttctatcaaataaaactagtgacagcttgtggctttttattagagctcgccacgaactagggtaaggtgagtgtcttagcatattttaatgcagttgcttactaaaggttttaaccgcacatgcacacacacacgctttcttatgcaatctatgtttgcacttgtgctttcagttagccttctgtaggaagtagaagtcatatgttgtctttgttgtagtgaaattatacagatagagttccatatattgtatttgtttcaatggtaaatccttttggaacatatagaatgcagagatttttttttccattaaaataaatgggtattggtggttaaaa

SEQ ID NO: 446702 - DNA, 1530 bp, Homo sapiens
  misc_feature (1530)..(1530): n is a, c, g, or t
atcttttgggaagttggctggctggcgaggcagagcctctcctcaaagcctggctcccacggaaaatatgctcagtgcagccgcgtgcatgaatgaaaacgccgccgggcgcttctagtcggacaaaatgcagccgagaactccgctcgttctgtgcgttctcctgtcccaggtgctgctgctaacatctgcagaagatttggactgcactcctggatttcagcagaaagtgttccatatcaatcagccagctgaattcattgaggaccagtcaattctaaactgtaagcaatgtcactcaaagatgcttttagactcttctcatatttgaatttactaatgtttatgactgtgtctcaggatgtggtatttcctaaactaagtgttttctgattatttttcttatgtcactgcttgacccaaagtggaaattcttgaatgagggcctggccaacttagaggttaatagagtgatatgcatctctttttagtattttatcatcagtgggtatctccatactgctgtcagaaaagggggctgtcagcctccaatgagagttgtacactgtgcaaaggaaatgaaattcatttcccctgggcagatccccaaaatcaaaatcattgccttctcgcagattgctgttctacctgtagtttctcatacatagcattagatcaaaataatggtgagagtatgacattggcttctgggaatttttagacacagacatcaaaaactcttattcttaaggctaataagatgggttttagaaagattcaaaacctctactgattattctatggattaagctcaactcatcctgaattccaattgatttatttaaaatatgcatctttcatatctgtggtgatgatctctttttgtttttaatgtcaatattatattgctttatctttaagaagtgttagggtacattgctaaatgcataacaagtacagttttagtgcaatagaatttaaaattggtggtagacaaatagctatttcattgtaggctcttgagtaccttgcttaacaactggaaatgaagaatatggaaacaactgatctaaactgatcagatgcagtcgggtgtgatggctcatgcctgtaatctcaccactttgggaggccgaggaggatggatggcttgaggccagaagttcaagaccagtctgggcaacctggtgaaaccccatctctactaaagttacaaaacttagctgggcatggtggcatatgcctatagtcccagctacgcgggaggctgcggcagaagaatcgctttaacccaggaggtggaggctgcagtgagccgagatcataccattgcactccaacctgggtgacagagcgagactgtgtctcaaaaaagaaaaaaaaaaaagaagaagaagaaaattaaaataagctgatcatacgctccaaggtcttttcaaggaaggtgattccacattggctcttatggtctcaggtttacgttccacgctagctaagttcctttagtcctatgctatgtggctgacaagn

SEQ ID NO: 446703 - DNA, 360 bp, Homo sapiens
ctgaacagcaaagatgttttcttctttatttcaggtcttttcatggaatgaaacagagagggaaaggaggaagaaaagctgaaacatagcaaagcttgggaaatacttttcttttttaatttggaaagtgatgggcacactgctgcactgctattgcccaggtggggaaggggctctggccgttgttgacccattgataaccattccgtgcctttctgtcttgccccggtaggcaccacagtgatgcggatgacagcctttgatgcagatgacccagccaccgataatgccctcctgcggtataatatccgtcaacagacgcctgacaagccatctcccaacatgttctacatcgatcct

SEQ ID NO: 446704 - DNA, 3700 bp, Homo sapiens
cttcaaggttttgctgactcagtctggtagtcagagtctgcaggagaagacagttcaaggcagggcctggaggattggatcagtttagggacaggtcaaaggctggcttagagaccttagaggcaggttgcttgggtcgttgaatgctagtctggtcctgagagcccttttctctggcaactgtggactcagagctaaccaattgtagttggcagtgggggtgaagggtgatccagaggcctgagctgcagagggcacaagagagaaaagatgtcttagaaagagctttgagaacatgccttggctgctggcagggaccttggatggggtagtctacacccggaagtgcctgcctgccatcctctagtggctgccttggaaaatatgctcagtgcagccgcgtgcatgaatgaaaacgccgccgggcgcttctagtcggacaaaatgcagccgagaactccgctcgttctgtgcgttctcctgtcccaggtgctgctgctaacatctgcagaagatttggactgcactcctggatttcagcagaaagtgttccatatcaatcagccagctgaattcattgaggaccagtcaattctaaacttgaccttcagtgactgtaagggaaacgacaagctacgctatgaggtctcgagcccatacttcaaggtgaacagcgatggcggcttagttgctctgagaaacataactgcagtgggcaaaactctgttcgtccatgcacggaccccccatgcggaagatatggcagaactcgtgattgtcggggggaaagacatccagggctccttgcaggatatatttaaatttgcaagaacttctcctgtcccaagacaaaagaggtccattgtggtatctcccattttaattccagagaatcagagacagcctttcccaagagatgttggcaaggtagtcgatagtgacaggccagaaaggtccaagttccggctcactggaaagggagtggatcaagagcctaaaggaattttcagaatcaatgagaacacagggagcgtctccgtgacacggaccttggacagagaagtaatcgctgtttatcaactatttgtggagaccactgatgtcaatggcaaaactctcgaggggccggtgcctctggaagtcattgtgattgatcagaatgacaaccgaccgatctttcgggaaggcccctacatcggccacgtcatggaagggtcacccacaggcaccacagtgatgcggatgacagcctttgatgcagatgacccagccaccgataatgccctcctgcggtataatatccgtcaacagacgcctgacaagccatctcccaacatgttctacatcgatcctgagaaaggagacattgtcactgttgtgtcacctgcgctgctggaccgagagactctggaaaatcccaagtatgaactgatcatcgaggctcaagatatggctggactggatgttggattaacaggcacggccacagccacgatcatgatcgatgacaaaaatgatcactcaccaaaattcaccaagaaagagtttcaagccacagtcgaggaaggagctgtgggagttattgtcaatttgacagttgaagataaggatgaccccaccacaggtgcatggagggctgcctacaccatcatcaacggaaaccccgggcagagctttgaaatccacaccaaccctcaaaccaacgaagggatgctttctgttgtcaaaccattggactatgaaatttctgccttccacaccctgctgatcaaagtggaaaatgaagacccactcgtacccgacgtctcctacggccccagctccacagccaccgtccacatcactgtcctggatgtcaacgagggcccagtcttctacccagaccccatgatggtgaccaggcaggaggacctctctgtgggcagcgtgctgctgacagtgaatgccacggaccccgactccctgcagcatcaaaccatcaggtattctgtttacaaggacccagcaggttggctgaatattaaccccatcaatgggactgttgacaccacagctgtgctggaccgtgagtccccatttgtcgacaacagcgtgtacactgctctcttcctggcaattgacagtggcaaccctcccgctacgggcactgggactttgctgataaccctggaggacgtgaatgacaatgccccgttcatttaccccacagtagctgaagtctgtgatgatgccaaaaacctcagtgtagtcattttgggagcatcagataaggatcttcacccgaatacagatcctttcaaatttgaaatccacaaacaagctgttcctgataaagtctggaagatctccaagatcaacaatacacacgccctggtaagccttcttcaaaatctgaacaaagcaaactacaacctgcccatcatggtgacagattcagggaaaccacccatgacgaatatcacagatctcagggtacaagtgtgctcctgcaggaattccaaagtggactgcaacgcggcgggggccctgcgcttcagcctgccctcagtcctgctcctcagcctcttcagcttagcttgtctgtgagaactcctgacgtctgaagcttgactcccaagtttccatagcaacaggaaaaaaaaaaaatctatccaaatctgaagattgcggtttacagctatcgaacttcacaactaggcctcaattgttccggttttttattttctttacaatttcacttagtctgtacttcatcattttgacagcatcttcctccctcctttaattaatggaatcttctgaattttccctgaatgtttaaagatcatgacatatgacttgatcttctgggagcaggaacaatgactactttttctggtgtgttaacatgtcgctagccagtgctccaggcacccagctttgtctgtgggttagtattggtgtatgtatgagtatctgtatgtatatatacacggtatttatagagagagactatcctggagaagcctcgttttgatgccattcttccttgcaaggttaagcaaggtgggtggaaactaagacacctgaaccctccagggcctcccgcatcaaggtcagcatgaggacagaccacagagctgtcacttttgctccgaagctacttctccactgtcccgttcagtctgaatgctgccacaaccagccaggcaggtccacagagagggagagcagagaaagaagtcctttctctttattgagttcgaggactacaaccaatttacactgccatctgatgccgtgatcctgagccaaggaggtgaggagcagagcaggcaatttcaccaccaaatgccaagaaaagggctgacattttctttcatgggcaccaacctgcatttgtatgtgtcccgaatccacagtcgtactgattctaatggggacacagatcatggtagagaatctctccctcctcagtaaatgtacaactgcacctgtcatcatggaggtcatacatgcatacaaagaggtgtacaggtaccatcttgtatacacatatatacccacatgtacagacatacatttatgcacattcacgctgtttgtttcatatatacaggcataaaatagagtaaatacaggtagttttaaaagtacccttttgtgtgaattgactaccgttgtttgcaaacccgaaaataaaagacgttcattatgtatg

SEQ ID NO: 446705 - DNA, 4174 bp, Homo sapiens
cttcaaggttttgctgactcagtctggtagtcagagtctgcaggagaagacagttcaaggcagggcctggaggattggatcagtttagggacaggtcaaaggctggcttagagaccttagaggcaggttgcttgggtcgttgaatgctagtctggtcctgagagcccttttctctggcaactgtggactcagagctaaccaattgtagttggcagtgggggtgaagggtgatccagaggcctgagctgcagagggcacaagagagaaaagatgtcttagaaagagctttgagaacatgccttggctgctggcagggaccttggatggggtagtctacacccggaagtgcctgcctgccatcctctagtggctgccttggaaaatatgctcagtgcagccgcgtgcatgaatgaaaacgccgccgggcgcttctagtcggacaaaatgcagccgagaactccgctcgttctgtgcgttctcctgtcccaggtgctgctgctaacatctgcagaagatttggactgcactcctggatttcagcagaaagtgttccatatcaatcagccagctgaattcattgaggaccagtcaattctaaacttgaccttcagtgactgtaagggaaacgacaagctacgctatgaggtctcgagcccatacttcaaggtgaacagcgatggcggcttagttgctctgagaaacataactgcagtgggcaaaactctgttcgtccatgcacggaccccccatgcggaagatatggcagaactcgtgattgtcggggggaaagacatccagggctccttgcaggatatatttaaatttgcaagaacttctcctgtcccaagacaaaagaggtccattgtggtatctcccattttaattccagagaatcagagacagcctttcccaagagatgttggcaaggtagtcgatagtgacaggccagaaaggtccaagttccggctcactggaaagggagtggatcaagagcctaaaggaattttcagaatcaatgagaacacagggagcgtctccgtgacacggaccttggacagagaagtaatcgctgtttatcaactatttgtggagaccactgatgtcaatggcaaaactctcgaggggccggtgcctctggaagtcattgtgattgatcagaatgacaaccgaccgatctttcgggaaggcccctacatcggccacgtcatggaagggtcacccacaggcaccacagtgatgcggatgacagcctttgatgcagatgacccagccaccgataatgccctcctgcggtataatatccgtcaacagacgcctgacaagccatctcccaacatgttctacatcgatcctgagaaaggagacattgtcactgttgtgtcacctgcgctgctggaccgagagactctggaaaatcccaagtatgaactgatcatcgaggctcaagatatggctggactggatgttggattaacaggcacggccacagccacgatcatgatcgatgacaaaaatgatcactcaccaaaattcaccaagaaagagtttcaagccacagtcgaggaaggagctgtgggagttattgtcaatttgacagttgaagataaggatgaccccaccacaggtgcatggagggctgcctacaccatcatcaacggaaaccccgggcagagctttgaaatccacaccaaccctcaaaccaacgaagggatgctttctgttgtcaaaccattggactatgaaatttctgccttccacaccctgctgatcaaagtggaaaatgaagacccactcgtacccgacgtctcctacggccccagctccacagccaccgtccacatcactgtcctggatgtcaacgagggcccagtcttctacccagaccccatgatggtgaccaggcaggaggacctctctgtgggcagcgtgctgctgacagtgaatgccacggaccccgactccctgcagcatcaaaccatcaggtattctgtttacaaggacccagcaggttggctgaatattaaccccatcaatgggactgttgacaccacagctgtgctggaccgtgagtccccatttgtcgacaacagcgtgtacactgctctcttcctggcaattgacagtggcaaccctcccgctacgggcactgggactttgctgataaccctggaggacgtgaatgacaatgccccgttcatttaccccacagtagctgaagtctgtgatgatgccaaaaacctcagtgtagtcattttgggagcatcagataaggatcttcacccgaatacagatcctttcaaatttgaaatccacaaacaagctgttcctgataaagtctggaagatctccaagatcaacaatacacacgccctggtaagccttcttcaaaatctgaacaaagcaaactacaacctgcccatcatggtgacagattcagggaaaccacccatgacgaatatcacagatctcagggtacaagtgtgctcctgcaggaattccaaagtggactgcaacgcggcgggggccctgcgcttcagcctgccctcagtcctgctcctcagcctcttcagcttagcttgtctgtgagaactcctgacgtctgaagcttgactcccaagtttccatagcaacaggaaaaaaaaaaaatctatccaaatctgaagattgcggtttacagctatcgaacttcacaactaggcctcaattgttccggttttttattttctttacaatttcacttagtctgtacttcatcattttgacagcatcttcctccctcctttaattaatggaatcttctgaattttccctgaatgtttaaagatcatgacatatgacttgatcttctgggagcaggaacaatgactactttttctggtgtgttaacatgtcgctagccagtgctccaggcacccagctttgtctgtgggttagtattggtgtatgtatgagtatctgtatgtatatatacacggtatttatagagagagactatcctggagaagcctcgttttgatgccattcttccttgcaaggttaagcaaggtgggtggaaactaagacacctgaaccctccagggcctcccgcatcaaggtcagcatgaggacagaccacagagctgtcacttttgctccgaagctacttctccactgtcccgttcagtctgaatgctgccacaaccagccaggcaggtccacagagagggagagcagagaaagaagtcctttctctttattgagttcgaggactacaaccaatttacactgccatctgatgccgtgatcctgagccaaggaggtgaggagcagagcaggcaatttcaccaccaaatgccaagaaaagggctgacattttctttcatgggcaccaacctgcatttgtatgtgtcccgaatccacagtcgtactgattctaatggggacacagatcatggtagagaatctctccctcctcagtaaatgtacaactgcacctgtcatcatggaggtcatacatgcatacaaagaggtgtacaggtaccatcttgtatacacatatatacccacatgtacagacatacatttatgcacattcacgctgtttgtttcatatatacaggcataaaatagagtaaatacaggtagttttaaaagtacccttttgtgtgaattgactaccgttgtttgcaaacccgaaaataaaagacgttcattatgtatgaaaagtaactgatttgtattctgtgagcatgtaaaagcggaaagttagtgcttgttctaagattaccttcttgttgataaaccataaatgaatcatcaaagctcacaccaaatttttctatcaaataaaactagtgacagcttgtggctttttattagagctcgccacgaactagggtaaggtgagtgtcttagcatattttaatgcagttgcttactaaaggttttaaccgcacatgcacacacacacgctttcttatgcaatctatgtttgcacttgtgctttcagttagccttctgtaggaagtagaagtcatatgttgtctttgttgtagtgaaattatacagatagagttccatatattgtatttgtttcaatggtaaatccttttggaacatatagaatgcagagatttttttttccattaaaataaatgggtattggtggttaaaactgctggacagtaaaaattct

SEQ ID NO: 446706 - DNA, 3782 bp, Homo sapiens
  misc_feature (771)..(771): n is a, c, g, or t
atcttttgggaagttggctggctggcgaggcagagcctctcctcaaagcctggctcccacggaaaatatgctcagtgcagccgcgtgcatgaatgaaaacgccgccgggcgcttctagtcggacaaaatgcagccgagaactccgctcgttctgtgcgttctcctgtcccaggtgctgctgctaacatctgcagaagatttggactgcactcctggatttcagcagaaagtgttccatatcaatcagccagctgaattcattgaggaccagtcaattctaaacttgaccttcagtgactgtaagggaaacgacaagctacgctatgaggtctcgagcccatacttcaaggtgaacagcgatggcggcttagttgctctgagaaacataactgcagtgggcaaaactctgttcgtccatgcacggaccccccatgcggaagatatggcagaactcgtgattgtcggggggaaagacatccagggctccttgcaggatatatttaaatttgcaagaacttctcctgtcccaagacaaaagaggtccattgtggtatctcccattttaattccagagaatcagagacagcctttcccaagagatgttggcaaggtagtcgatagtgacaggccagaaaggtccaagttccggctcactggaaagggagtggatcaagagcctaaaggaattttcagaatcaatgagaacacagggagcgtctccgtgacacggaccttggacagagaagtaatcgctgtttatcaactatttgnggagaccactgatgtcaatgacaaccgaccgatctttcgggaaggcccctacatcggccacgtcatggaagggtcacccacaggcaccacagtgatgcggatgacagcctttgatgcagatgacccagccaccgataatgccctcctgcggtataatatccgtcaacagacgcctgacaagccatctcccaacatgttctacatcgatcctgagaaaggagacattgtcactgttgtgtcacctgcgctgctggaccgagagactctggaaaatcccaagtatgaactgatcatcgaggctcaagatatggctggactggatgttggattaacaggcacggccacagccacgatcatgatcgatgacaaaaatgatcactcaccaaaattcaccaagaaagagtttcaagccacagtcgaggaaggagctgtgggagttattgtcaatttgacagttgaagataaggatgaccccaccacaggtgcatggagggctgcctacaccatcatcaacggaaaccccgggcagagctttgaaatccacaccaaccctcaaaccaacgaagggatgctttctgttgtcaaaccattggactatgaaatttctgccttccacaccctgctgatcaaagtggaaaatgaagacccactcgtacccgacgtctcctacggccccagctccacagccaccgtccacatcactgtcctggatgtcaacgagggcccagtcttctacccagaccccatgatggtgaccaggcaggaggacctctctgtgggcagcgtgctgctgacagtgaatgccacggaccccgactccctgcagcatcaaaccatcaggtattctgtttacaaggacccagcaggttggctgaatattaaccccatcaatgggactgttgacaccacagctgtgctggaccgtgagtccccatttgtcgacaacagcgtgtacactgctctcttcctggcaattgacagtggcaaccctcccgctacgggcactgggactttgctgataaccctggaggacgtgaatgacaatgccccgttcatttaccccacagtagctgaagtctgtgatgatgccaaaaacctcagtgtagtcattttgggagcatcagataaggatcttcacccgaatacagatcctttcaaatttgaaatccacaaacaagctgttcctgataaagtctggaagatctccaagatcaacaatacacacgccctggtaagccttcttcaaaatctgaacaaagcaaactacaacctgcccatcatggtgacagattcagggaaaccacccatgacgaatatcacagatctcagggtacaagtgtgctcctgcaggaattccaaagtggactgcaacgcggcgggggccctgcgcttcagcctgccctcagtcctgctcctcagcctcttcagcttagcttgtctgtgagaactcctgacgtctgaagcttgactcccaagtttccatagcaacaggaaaaaaaaaaaatctatccaaatctgaagattgcggtttacagctatcgaacttcacaactaggcctcaattgttccggttttttattttctttacaatttcacttagtctgtacttcatcattttgacagcatcttcctccctcctttaattaatggaatcttctgaattttccctgaatgtttaaagatcatgacatatgacttgatcttctgggagcaggaacaatgactactttttctggtgtgttaacatgtcgctagccagtgctccaggcacccagctttgtctgtgggttagtattggtgtatgtatgagtatctgtatgtatatatacacggtatttatagagagagactatcctggagaagcctcgttttgatgccattcttccttgcaaggttaagcaaggtgggtggaaactaagacacctgaaccctccagggcctcccgcatcaaggtcagcatgaggacagaccacagagctgtcacttttgctccgaagctacttctccactgtcccgttcagtctgaatgctgccacaaccagccaggcaggtccacagagagggagagcagagaaagaagtcctttctctttattgagttcgaggactacaaccaatttacactgccatctgatgccgtgatcctgagccaaggaggtgaggagcagagcaggcaatttcaccaccaaatgccaagaaaagggctgacattttctttcatgggcaccaacctgcatttgtatgtgtcccgaatccacagtcgtactgattctaatggggacacagatcatggtagagaatctctccctcctcagtaaatgtacaactgcacctgtcatcatggaggtcatacatgcatacaaagaggtgtacaggtaccatcttgtatacacatatatacccacatgtacagacatacatttatgcacattcacgctgtttgtttcatatatacaggcataaaatagagtaaatacaggtagttttaaaagtacccttttgtgtgaattgactaccgttgtttgcaaacccgaaaataaaagacgttcattatgtatgaaaagtaactgatttgtattctgtgagcatgtaaaagcggaaagttagtgcttgttctaagattaccttcttgttgataaaccataaatgaatcatcaaagctcacaccaaatttttctatcaaataaaactagtgacagcttgtggctttttattagagctcgccacgaactagggtaaggtgagtgtcttagcatattttaatgcagttgcttactaaaggttttaaccgcacatgcacacacacacgctttcttatgcaatctatgtttgcacttgtgctttcagttagccttctgtaggaagtagaagtcatatgttgtctttgttgtagtgaaattatacagatagagttccatatattgtatttgtttcaatggtaaatccttttggaacatatagaatgcagagatttttttttccattaaaataaatgggtattggtggttaaaa

SEQ ID NO: 446707 - DNA, 839 bp, Homo sapiens
atcttttgggaagttggctggctggcgaggcagagcctctcctcaaagcctggctcccacggaaaatatgctcagtgcagccgcgtgcatgaatgaaaacgccgccgggcgcttctagtcggacaaaatgcagccgagaactccgctcgttctgtgcgttctcctgtcccaggtgctgctgctaacatctgcagaagatttggactgcactcctggatttcagcagaaagtgttccatatcaatcagccagctgaattcattgaggaccagtcaattctaaacttgaccttcagtgactgtaagggaaacgacaagctacgctatgaggtctcgagcccatacttcaaggtgaacagcgatggcggcttagttgctctgagaaacataactgcagtgggcaaaactctgttcgtccatgcacggaccccccatgcggaagatatggcagaactcgtgattgtcggggggaaagacatccagggctccttgcaggatatatttaaatttgcaagaacttctcctgtcccaagacaaaagaggtccattgtggtatctcccattttaattccagagaatcagagacagcctttcccaagagatgttggcaaggtaagaacccacaatcctattaacagcgaacttctcttgaatgaaggcattacagcagatttaaatccatgcattacaattttagcaatttaatgaacatcctatttggcgacattattgctttaaaggaataaatcacaaacattttacttcccactagcactcggtatttcaaatccattttctctacagaatgatgtgtttaaataaatcctgagttgactgaatt

SEQ ID NO: 446708 - DNA, 1550 bp, Homo sapiens
tggagctaagctgtttccagggtgacagagtggcgacctcggtggtcgattgagcaggtctgagaattgttcccaaagggttgtgcgtcaccgagtcgttggcgctgtcatggcgggtgtgctgaagaagaccactggccttgtgggattggctgtgtgcaatactcctcacgagaggctaagaatattgtacacaaagattcttgatgttcttgaggaaatccctaaaaatgcagcatatagaaagtatacagaacagattacaaatgagaagctggctatggttaaagcggaaccagatgttaaaaaattagaagaccaacttcaaggcggtcaattagaagaggtgattcttcaggctgaacatgaactaaatctggcaagaaaaatgagggaatggaaactatgggagccattagtggaagagcctcctgccgatcagtggaaatggccaatataattattaagtgactttggtgtgttcatgggaaactgatgtaattaaatattctgttatattaagagcgtgttcttattactgacattttgtaatcaagaaaagtgatatagaaaatatgtaggagactgttaaaattggtgattatggtaatatggtcatgtgaatcaatttttgatttataaagtactcacacaagttgtttcaaagatgatatttctgtgaacagagaggccatgggaagatttgaaaattattaaagaaaaattcctacagattttcaatgcagagaccataatcaaaaagtaaactttctttagtagtatgttcaatacatcatttaattttttaagttatcctgaagaaggaaaggtccttaattattatagtctaaacaaatttatagattactgtttgaagtaaataatacgagtgaatattttcaaatgtgataaaatagcacaagtggctggtgataaaatttgaaattatggttaacctcagctgtgatcttatgtatgtaaagtgaaatttaaatagataattataggttgattacaaaatccatagtgtcattttattttagtcattattgaattataccatttactctgttttcttatagtcttaattttattatattttgttgttactgtattatatttgaaaaccttcaaattagaatacattgtacagttaaagaaattgacttggtacttaaaagaaagatttcccattgcatacaggttattggagaaattttccttttgttgcatttgtggaagttagttttctggcccgtggcctttaattttcttaatcaacctaattacatcaggatagaggtagagtttctgtaaaagaagagacattaagagttcctgaaatttatatctggcatacggataggcttatattcaaaacatcttagtcatacgaccataaattaaaagtggagtcactaaatagtttgcagtacgtttctaatataagtgtaggtgggtatcaaaacaagacaaatgctgttcagggaaagaagttggcaagcttaaggttaaacaaaaataaaattacatgtgttttcgccttccta

SEQ ID NO: 446709 - DNA, 951 bp, Homo sapiens
  misc_feature (839)..(839): n is a, c, g, or t
  misc_feature (893)..(893): n is a, c, g, or t
  misc_feature (895)..(895): n is a, c, g, or t
  misc_feature (897)..(897): n is a, c, g, or t
  misc_feature (899)..(899): n is a, c, g, or t
tggagctaagctgtttccagggtgacagagtggcgacctcggtggtcgattgagcaggtctgagaattgttcccaaagggttgtgcgtcaccgagtcgttggcgctgtcatggcgggtgtgctgaagaagaccactggccttgtgggattggctgtgtgcaatactcctcacgagaggctaagaatattgtacacaaagattcttgatgttcttgaggaaatccctaaaaatgcagcatatagaaagtatacagaacagattacaaatgagaagctggctatggttaaagcggaaccagatgttaaaaaattagaagaccaacttcaaggcggtcaattagaagaggtgattcttcaggctgaacatgaactaaatctggcaagaaaaatgagggaatggaaactatgggagccattagtggaagagcctcctgccgatcagtggaaatggccaatataattattaagtgactttggtgtgttcatgggaaactgatgtaattaaatattctgttatattaagagcgtgttcttattactgacattttgtaatcaagaaaagtgatatagaaaatatgtaggagactgttaaaattggtgattatggtaatatggtcatgtgaatcaatttttgatttataaagtactcacacaagttgtttcaaagatgatatttctgtgaacagagaggccatgggaagatttgaaaattattaaagaaaaattcctacagattttcaatgcagagaccataatcaaaaagtaaactttctttagtagtatgttcaatacatcatttaattttttaagttatcctgaagaaggcctaatttttggtnaaccaattttgatcgggggggaaaaaagggggatttccggttaagccggggggnanangnatggggcccgcggctctgtacgacaacttgtggtcaccccggttttctgagc

SEQ ID NO: 446710 - DNA, 2886 bp, Homo sapiens
  misc_feature (1740)..(1740): n is a, c, g, or t
  misc_feature (1845)..(1845): n is a, c, g, or t
  misc_feature (1852)..(1852): n is a, c, g, or t
  misc_feature (2718)..(2718): n is a, c, g, or t
tggagctaagctgtttccagggtgacagagtggcgacctcggtggtcgattgagcaggtctgagaattgttcccaaagggttgtgcgtcaccgagtcgttggcgctgtcatggcgggtgtgctgaagaagaccactggccttgtgggattggctgtgtgcaatactcctcacgaggtatgtacctttgttctttcttcgttcttgaattcccaaggaagactaaattcctgtcactttgcttattgcagggttaacgggatacagatgtttcaagcccttaattacaagccgcgtgagctcttgagacacgggcgctgtccacctacttcgttgatccgatgtcacatttttatttattttcgccatgacctctttattaagccagttttcttgttgactttttccttgacattttcatggcttcacttgtgcttgcttctgtcagcgccatctcaaatttatatctccgttttccatcttttctccttgccttaccgtttctgcttaggtgcgttggattacatatatttaggcttactaaaggtactgcccccttttccttctgttaggtcttttccatctgtattcacgaatgttttcatcaaaaaaacccacaaaattttttttattcttcttgtcccttctataatcacaccatttctttgcttcactttacagataactcaaaagagttatctctattttctccaatttctttcttattcacccttgaatgcactcagtcacccttggcgtttttcaagttcaccaattatctccatgctgccaaatccaatggtcagctcatatttctcaccttcattgacctaatagcagcgtttttttgacacatttgacactttttccatcacgctcttttcaagttcaccagttatctccatgttgccaaatccaatggtcagcttatgtttctcaccttcattgacctaatagcagcgtttttttttttttgacacatttgacactttttccatcatgcgctttctttactgggcttcaggactcccccagtctcctgattttttccccctactctttggctttctctttttctggttatttctcttatgcccacttttaaaatttgagttagtcaggatttagttcttggaccttttcttttggacctgtactctgtcaccaagagagagcaaatccaaatagagaacggttttaaataccacctatacactgacaacagatttccatgtaaagcactgacctcttcctttataaaagtcctgaatatttaattgcttagtgggcatctctatttgtatgtgtcagacaggcaacccaaacttaacatgtccaaaatggggttcctgatcttctgcctaaaacctgctcttctctcagtcttgctcatctcaattaatggcagctcaattattttgactcaggtcagaaacttgaaatcatctttgattccttcctttctcttacactccacatttgttatttcagtaaaccctctaggttccaccttcaaaatatatcttgattttgacaacatctcactacctcctctgctactaccctcttcctcagtcaccatcatcactgatgtggataattgcattcacttcttaactgcctctcaatgcttgtcacagcctccatttggtctttttttccagccaggctactagagttagtctgttaaaatatgaggtaggtcagatctctcctttccttaaaactaatggctttccatntcactctaaataaagacaagtttcttactgtgaccctctggttcactattctactgatttattttgttatgtctctactagaatgtaggtttcatgaaggcaggnatttgtnattgtttcactgctagaactctgtcacatagtatgtgctcagtaaatagtgttagttgaatgagtgtcttgcacttcctatgatttcataataactttattgtcattgatgtaaagaactgaactcatggtttttcccttctaaatatatttcttcctctgtgggctgtatttttcttgatagtttcagatctttctactccctaggctgggaatttggacatcatagttggtatttctcttatacttgtactctcatattcattccaatgatgatttttatttttattttttttgctgatccttttctataacagctctccagtctgacttctgtttactatttctattgttactaccatagttcaggtccttgttcttgtttagagaattgcaacaacctccttactggcctttctgccttgtttctccttcagtccttttaactcactacaatgaagctaattttcctaatctaatcatatgattttcctaaatcttttaattgtccacaggataaagcccgaatgctttaacttggaatgcagaaccacttataatgtgacattttctctaactttatctcctatgcatttccttatgtgtcctgtacagcagtatattccaaaatccccagtggatgtctgaaaaccacatatagtaccaaactgtatatatgctatgttttgtttcatacatacctataataaagtttaatttatgaattaggcacaataagagataagcaggctggacgtgctggctcacgcctgtaatcccagcactttgggaggctgaggcgggtggattgctttagcccaggagtttaagaccagcctggccaacatggcaaaaccccgtctctanaaaaaatgtggaaattaatcaggtgtggtggtgtgcacctagtcccagctactcgggaggcagaggcagcaggattgcttgagccccagaggttgaggctgcagtgagctgtgatgatgccattacactctagcctgggtgatggagtgagaccctgtctcaaaaaag

SEQ ID NO: 446711 - DNA, 558 bp, Homo sapiens
  misc_feature (558)..(558): n is a, c, g, or t
caaacactgcacagcaatcagaaacttttcagtttcttgcagatatattaccaaagaagaggtgattcttcgctgaacatgaactaaatctggcaagaaaaatgagggaatggaaactatgggagccattagtggaagagcctcctgccgatcagtggaaatggccaatataattattaagtgactttggtgtgttcatgggaaactgatgtaattaaatattctgttataaaaaaaaaaaaaaaaaaaaaaaaaaaaaattttggggggcgtggcaccctcgagaagacgctttctaaaacccactcgcgtgggggggagccgggccccagaatgaggttacggagcacaccgggccaaacaagccggttccctaagaagaagtactgcggcgcacagcaccaaagctgggggggctttccccacaaataaaaaaacggcccgcgggggcacagacgaccggttgtggaacaacatcccgaaggagaccgaggagcaacaacgagcgtcaaaaccagagggctccaagagagccgatattaattagccgcccggagn

SEQ ID NO: 446712 - DNA, 370 bp, Homo sapiens
actgaaaatcaaacaactgaaaacatgagccaaatctattagcactgaactcctccaacagcactgatgtcacaggcccctggaagaatccacgttgttgacattactctggtcatttagttgccatgtagccaagcaaagagatggggtttgaccttgttgtccaggctggtttcaaactcctgagttcgagcaatctacccacccttcaaagtgttgggatcacaggtgactcttagaatcatctagtcaaaatggaattgtgactgtaagtgcactaagaaaagatccctttgggaagaatgaacttattttgacaaatatgttcaatatttttacatatttaaaatattgactctcacccaggaaa

SEQ ID NO: 446713 - DNA, 1213 bp, Homo sapiens
  misc_feature (1127)..(1127): n is a, c, g, or t
  misc_feature (1154)..(1154): n is a, c, g, or t
  misc_feature (1156)..(1156): n is a, c, g, or t
tggagctaagctgtttccagggtgacagagtggcgacctcggtggtcgattgagcaggtctgagaattgttcccaaagggttgtgcgtcaccgagtcgttggcgctgtcatggcgggtgtgctgaagaagaccactggccttgtgggattggctgtgtgcaatactcctcacgagaggctaagaatattgtacacaaagattcttgatgttcttgaggaaatccctaaaaatgcagcatatagaaagtatacagaacagattacaaatgagaagctggctatggttaaagcggaaccagatgttaaaaaattagaagaccaacttcaaggcggtcaattagaagaggtgattcttcaggctgaacatgaactaaatctggcaagaaaaatgagggaatggaaactatgggagccattagtggaagagcctcctgccgatcagtggaaatggccaatataattattaagtgactttggtgtgttcatgggaaactgatgtaattaaatattctgttatattaagagcgtgttcttattactgacattttgtaatcaagaaaagtgatatagaaaatatgtaggagactgttaaaattggtgattatggtaatatggtcatgtgaatcaatttttgatttataaagtactcacacaagttgtttcaaagatgatatttctgtgaacagagaggccatgggaagatttgaaaattattaaagaaaaattcctacagattttcaatgcagagaccataatcaaaaagtaaactttctttagtagtatgttcaatacatcatttaattttttaagttatcctgaagaaggaaaggtccttaattattatagtctaaacaaatttatagattactgtttgaagtaaataatacgagtgaatattttcaaatgtgataaaatagcacaagtggctggtgataaaatttgaaattatggttaacctcagctgtgatcttatgtatgtaaagtgaaatttaaatagataattataggttgattacaaaatccatagtgtcattttattttagtcattattgaattataccatttactctgttttcttatagtcttaaatataattgggggcggttaattggactcaattgaattgncgaaaagcgtgggttaaaaaaatcccngnacgttggaaacttggggggaaaaaggggggaattaaacaaaagaggagtggaaaaat

SEQ ID NO: 446714 - DNA, 1617 bp, Homo sapiens
tggagctaagctgtttccagggtgacagagtggcgacctcggtggtcgattgagcaggtctgagaattgttcccaaagggttgtgcgtcaccgagtcgttggcgctgtcatggcgggtgtgctgaagaagaccactggccttgtgggattggctgtgtgcaatactcctcacgagaggctaagaatattgtacacaaagattcttgatgttcttgaggaaatccctaaaaatgcagcatatagaaagtatacagaacagattacaaatgagaagctggctatggttaaagcggaaccagatgttaaaaaattagaagaccaacttcaaggcggtcaattagaagaggtgattcttcaggctgaacatgaactaaatctggcaagaaaaatgagggaatggaaactatgggagccattagtggaagagcctcctgccgatcagtggaaatggccaatataattattaagtgactttggtgtgttcatgggaaactgatgtaattaaatattctgttatattaagagcgtgttcttattactgacattttgtaatcaagaaaagtgatatagaaaatatgtaggagactgttaaaattggtgattatggtaatatggtcatgtgaatcaatttttgatttataaagtactcacacaagttgtttcaaagatgatatttctgtgaacagagaggccatgggaagatttgaaaattattaaagaaaaattcctacagattttcaatgcagagaccataatcaaaaagtaaactttctttagtagtatgttcaatacatcatttaattttttaagttatcctgaagaaggaaaggtccttaattattatagtctaaacaaatttatagattactgtttgaagtaaataatacgagtgatgcagttgaactattgattccaaagtcgttgagtatatacattcagccacataagtagagacatgggctgcagtgaagagactatatcgcagaaaagtttgacttgggttgtaaacacttctaggcattgagtgattctttattggtattgttaataggaaatttaaatagataattataggttgattacaaaatccatagtgtcattttattttagtcattattgaattataccatttactctgttttcttatagtcttaattttattatattttgttgttactgtattatatttgaaaaccttcaaattagaatacattgtacagttaaagaaattgacttggtacttaaaagaaagatttcccattgcatacaggttattggagaaattttccttttgttgcatttgtggaagttagttttctggcccgtggcctttaattttcttaatcaacctaattacatcaggatagaggtagagtttctgtaaaagaagagacattaagagttcctgaaatttatatctggcatacggataggcttatattcaaaacatcttagtcatacgaccataaattaaaagtggagtcactaaatagtttgcagtacgtttctaatataagtgtaggtgggtatcaaaacaagacaaatgctgttcagggaaagaagttggcaagcttaaggttaaacaaaaataaaattacatgtgttttcgccttccta

SEQ ID NO: 446715 - DNA, 1490 bp, Homo sapiens
tggagctaagctgtttccagggtgacagagtggcgacctcggtggtcgattgagcaggtctgagaattgttcccaaagggttgtgcgtcaccgagtcgttggcgctgtcatggcgggtgtgctgaagaagaccactggccttgtgggattggctgtgtgcaatactcctcacgagaggctaagaatattgtacacaaagattcttgatgttcttgaggaaatccctaaaaatgcagcatatagaaagtatacagaacagattacaaatgagaagctggctatggttaaagcggaaccagatgttaaaaaattagaagaccaacttcaaggcggtcaattagaagaggtgattcttcaggctgaacatgaactaaatctggcaagaaaaatgagggaatggaaactatgggagccattagtggaagagcctcctgccgatcagtggaaatggccaatataattattaagtgactttggtgtgttcatgggaaactgatgtaattaaatattctgttatattaagagcgtgttcttattactgacattttgtaatcaagaaaagtgatatagaaaatatgtaggagactgttaaaattggtgattatggtaatatggtcatgtgaatcaatttttgatttataaagtactcacacaagttgtttcaaagatgatatttctgtgaacagagaggccatgggaagatttgaaaattattaaagaaaaattcctacagattttcaatgcagagaccataatcaaaaagggaaaggtccttaattattatagtctaaacaaatttatagattactgtttgaagtaaataatacgagtgaatattttcaaatgtgataaaatagcacaagtggctggtgataaaatttgaaattatggttaacctcagctgtgatcttatgtatgtaaagtgaaatttaaatagataattataggttgattacaaaatccatagtgtcattttattttagtcattattgaattataccatttactctgttttcttatagtcttaattttattatattttgttgttactgtattatatttgaaaaccttcaaattagaatacattgtacagttaaagaaattgacttggtacttaaaagaaagatttcccattgcatacaggttattggagaaattttccttttgttgcatttgtggaagttagttttctggcccgtggcctttaattttcttaatcaacctaattacatcaggatagaggtagagtttctgtaaaagaagagacattaagagttcctgaaatttatatctggcatacggataggcttatattcaaaacatcttagtcatacgaccataaattaaaagtggagtcactaaatagtttgcagtacgtttctaatataagtgtaggtgggtatcaaaacaagacaaatgctgttcagggaaagaagttggcaagcttaaggttaaacaaaaataaaattacatgtgttttcgccttccta

SEQ ID NO: 446716 - DNA, 1678 bp, Homo sapiens
caattcagctgcagggagtgttgctactgatggaacaaaaccaaaccacttggaattaacgcacaatttaaagagatggggtttgaccttgttgtccaggctggtttcaaactcctgagttcgagcaatctacccacccttcaaagtgttgggatcacaggtgactcttagaatcatctagtcaaaatggaattgtgactatggaaatattggcatagttccagaggagttaaaggactcacccaggccgtacagctgaccactggccttgtgggattggctgtgtgcaatactcctcacgagaggctaagaatattgtacacaaagattcttgatgttcttgaggaaatccctaaaaatgcagcatatagaaagtatacagaacagattacaaatgagaagctggctatggttaaagcggaaccagatgttaaaaaattagaagaccaacttcaaggcggtcaattagaagaggtgattcttcaggctgaacatgaactaaatctggcaagaaaaatgagggaatggaaactatgggagccattagtggaagagcctcctgccgatcagtggaaatggccaatataattattaagtgactttggtgtgttcatgggaaactgatgtaattaaatattctgttatattaagagcgtgttcttattactgacattttgtaatcaagaaaagtgatatagaaaatatgtaggagactgttaaaattggtgattatggtaatatggtcatgtgaatcaatttttgatttataaagtactcacacaagttgtttcaaagatgatatttctgtgaacagagaggccatgggaagatttgaaaattattaaagaaaaattcctacagattttcaatgcagagaccataatcaaaaagtaaactttctttagtagtatgttcaatacatcatttaattttttaagttatcctgaagaaggaaaggtccttaattattatagtctaaacaaatttatagattactgtttgaagtaaataatacgagtgaatattttcaaatgtgataaaatagcacaagtggctggtgataaaatttgaaattatggttaacctcagctgtgatcttatgtatgtaaagtgaaatttaaatagataattataggttgattacaaaatccatagtgtcattttattttagtcattattgaattataccatttactctgttttcttatagtcttaattttattatattttgttgttactgtattatatttgaaaaccttcaaattagaatacattgtacagttaaagaaattgacttggtacttaaaagaaagatttcccattgcatacaggttattggagaaattttccttttgttgcatttgtggaagttagttttctggcccgtggcctttaattttcttaatcaacctaattacatcaggatagaggtagagtttctgtaaaagaagagacattaagagttcctgaaatttatatctggcatacggataggcttatattcaaaacatcttagtcatacgaccataaattaaaagtggagtcactaaatagtttgcagtacgtttctaatataagtgtaggtgggtatcaaaacaagacaaatgctgttcagggaaagaagttggcaagcttaaggttaaacaaaaataaaattacatgtgttttcgccttccta

SEQ ID NO: 446717 - DNA, 1458 bp, Homo sapiens
gcggccgctccaagctgtcatggcgggtgtgctgaagaaccactggccttgtgggattggctgtgtgcaatactcctcacgagaggctaagaatattgtacacaaagattcttgatgttcttgaggaaatccctaaaaatgcagcatatagaaagtatacagaacagattacaaatgagaagctggctatggttaaagcggaaccagatgttaaaaaattagaagaccaacttcaaggcggtcaattagaagaggtgattcttcaggctgaacatgaactaaatctggcaagaaaaatgagggaatggaaactatgggagccattagtggaagagcctcctgccgatcagtggaaatggccaatataattattaagtgactttggtgtgttcatgggaaactgatgtaattaaatattctgttatattaagagcgtgttcttattactgacattttgtaatcaagaaaagtgatatagaaaatatgtaggagactgttaaaattggtgattatggtaatatggtcatgtgaatcaatttttgatttataaagtactcacacaagttgtttcaaagatgatatttctgtgaacagagaggccatgggaagatttgaaaattattaaagaaaaattcctacagattttcaatgcagagaccataatcaaaaagtaaactttctttagtagtatgttcaatacatcatttaattttttaagttatcctgaagaaggaaaggtccttaattattatagtctaaacaaatttatagattactgtttgaagtaaataatacgagtgaatattttcaaatgtgataaaatagcacaagtggctggtgataaaatttgaaattatggttaacctcagctgtgatcttatgtatgtaaagtgaaatttaaatagataattataggttgattacaaaatccatagtgtcattttattttagtcattattgaattataccatttactctgttttcttatagtcttaattttattatattttgttgttactgtattatatttgaaaaccttcaaattagaatacattgtacagttaaagaaattgacttggtacttaaaagaaagatttcccattgcatacaggttattggagaaattttccttttgttgcatttgtggaagttagttttctggcccgtggcctttaattttcttaatcaacctaattacatcaggatagaggtagagtttctgtaaaagaagagacattaagagttcctgaaatttatatctggcatacggataggcttatattcaaaacatcttagtcatacgaccataaattaaaagtggagtcactaaatagtttgcagtacgtttctaatataagtgtaggtgggtatcaaaacaagacaaatgctgttcagggaaagaagttggcaagcttaaggttaaacaaaaataaaattacatgtgttttcgccttccta

SEQ ID NO: 446718 - DNA, 1505 bp, Homo sapiens
tggagctaagctgtttccagggtgacagagtggcgacctcggtggtcgattgagcaggtctgagaattgttcccaaagggttgtgcgtcaccgagtcgttggcgctgtcatggcgggtgtgctgaagaagaggctaagaatattgtacacaaagattcttgatgttcttgaggaaatccctaaaaatgcagcatatagaaagtatacagaacagattacaaatgagaagctggctatggttaaagcggaaccagatgttaaaaaattagaagaccaacttcaaggcggtcaattagaagaggtgattcttcaggctgaacatgaactaaatctggcaagaaaaatgagggaatggaaactatgggagccattagtggaagagcctcctgccgatcagtggaaatggccaatataattattaagtgactttggtgtgttcatgggaaactgatgtaattaaatattctgttatattaagagcgtgttcttattactgacattttgtaatcaagaaaagtgatatagaaaatatgtaggagactgttaaaattggtgattatggtaatatggtcatgtgaatcaatttttgatttataaagtactcacacaagttgtttcaaagatgatatttctgtgaacagagaggccatgggaagatttgaaaattattaaagaaaaattcctacagattttcaatgcagagaccataatcaaaaagtaaactttctttagtagtatgttcaatacatcatttaattttttaagttatcctgaagaaggaaaggtccttaattattatagtctaaacaaatttatagattactgtttgaagtaaataatacgagtgaatattttcaaatgtgataaaatagcacaagtggctggtgataaaatttgaaattatggttaacctcagctgtgatcttatgtatgtaaagtgaaatttaaatagataattataggttgattacaaaatccatagtgtcattttattttagtcattattgaattataccatttactctgttttcttatagtcttaattttattatattttgttgttactgtattatatttgaaaaccttcaaattagaatacattgtacagttaaagaaattgacttggtacttaaaagaaagatttcccattgcatacaggttattggagaaattttccttttgttgcatttgtggaagttagttttctggcccgtggcctttaattttcttaatcaacctaattacatcaggatagaggtagagtttctgtaaaagaagagacattaagagttcctgaaatttatatctggcatacggataggcttatattcaaaacatcttagtcatacgaccataaattaaaagtggagtcactaaatagtttgcagtacgtttctaatataagtgtaggtgggtatcaaaacaagacaaatgctgttcagggaaagaagttggcaagcttaaggttaaacaaaaataaaattacatgtgttttcgccttccta

SEQ ID NO: 446719 - DNA, 1759 bp, Homo sapiens
tggagctaagctgtttccagggtgacagagtggcgacctcggtggtcgattgagcaggtctgagaattgttcccaaagggttgtgcgtcaccgagtcgttggcgctgtcatggcgggtgtgctgaagaagaccactggccttgtgggattggctgtgtgcaatactcctcacgagaaattcaaataagaaaaattaaaaaaaaaaatttgcagtgcttcggacctcactttgaaaaatactgattcaggctgggtgggctcacgcctgtaatcccagcactttgggaggctgaggtgggcggatcacctgaagtcaggagtttgagaccatcctggccaacatggcaaaaccctgtctctactaaaaatagaaaaaatagccagaggctaagaatattgtacacaaagattcttgatgttcttgaggaaatccctaaaaatgcagcatatagaaagtatacagaacagattacaaatgagaagctggctatggttaaagcggaaccagatgttaaaaaattagaagaccaacttcaaggcggtcaattagaagaggtgattcttcaggctgaacatgaactaaatctggcaagaaaaatgagggaatggaaactatgggagccattagtggaagagcctcctgccgatcagtggaaatggccaatataattattaagtgactttggtgtgttcatgggaaactgatgtaattaaatattctgttatattaagagcgtgttcttattactgacattttgtaatcaagaaaagtgatatagaaaatatgtaggagactgttaaaattggtgattatggtaatatggtcatgtgaatcaatttttgatttataaagtactcacacaagttgtttcaaagatgatatttctgtgaacagagaggccatgggaagatttgaaaattattaaagaaaaattcctacagattttcaatgcagagaccataatcaaaaagtaaactttctttagtagtatgttcaatacatcatttaattttttaagttatcctgaagaaggaaaggtccttaattattatagtctaaacaaatttatagattactgtttgaagtaaataatacgagtgaatattttcaaatgtgataaaatagcacaagtggctggtgataaaatttgaaattatggttaacctcagctgtgatcttatgtatgtaaagtgaaatttaaatagataattataggttgattacaaaatccatagtgtcattttattttagtcattattgaattataccatttactctgttttcttatagtcttaattttattatattttgttgttactgtattatatttgaaaaccttcaaattagaatacattgtacagttaaagaaattgacttggtacttaaaagaaagatttcccattgcatacaggttattggagaaattttccttttgttgcatttgtggaagttagttttctggcccgtggcctttaattttcttaatcaacctaattacatcaggatagaggtagagtttctgtaaaagaagagacattaagagttcctgaaatttatatctggcatacggataggcttatattcaaaacatcttagtcatacgaccataaattaaaagtggagtcactaaatagtttgcagtacgtttctaatataagtgtaggtgggtatcaaaacaagacaaatgctgttcagggaaagaagttggcaagcttaaggttaaacaaaaataaaattacatgtgttttcgccttccta

SEQ ID NO: 446720 - DNA, 1608 bp, Homo sapiens
cacagaaaatacagaatgttcccatgtttatatacaggtttttcctaagttataaagggtgtagatagggcacagacataaagaagtcagagcaaagaagagttaaattaaaaaaaaaaagcaaaaaaaaaaaacagatgtgagttttgtttgttttgtctttgagacaagtgttccattaagtctttggtaatattttaacctatggaaatttgtatggtttgtcttttcagaggctaagaatattgtacacaaagattcttgatgttcttgaggaaatccctaaaaatgcagcatatagaaagtatacagaacagattacaaatgagaagctggctatggttaaagcggaaccagatgttaaaaaattagaagaccaacttcaaggcggtcaattagaagaggtgattcttcaggctgaacatgaactaaatctggcaagaaaaatgagggaatggaaactatgggagccattagtggaagagcctcctgccgatcagtggaaatggccaatataattattaagtgactttggtgtgttcatgggaaactgatgtaattaaatattctgttatattaagagcgtgttcttattactgacattttgtaatcaagaaaagtgatatagaaaatatgtaggagactgttaaaattggtgattatggtaatatggtcatgtgaatcaatttttgatttataaagtactcacacaagttgtttcaaagatgatatttctgtgaacagagaggccatgggaagatttgaaaattattaaagaaaaattcctacagattttcaatgcagagaccataatcaaaaagtaaactttctttagtagtatgttcaatacatcatttaattttttaagttatcctgaagaaggaaaggtccttaattattatagtctaaacaaatttatagattactgtttgaagtaaataatacgagtgaatattttcaaatgtgataaaatagcacaagtggctggtgataaaatttgaaattatggttaacctcagctgtgatcttatgtatgtaaagtgaaatttaaatagataattataggttgattacaaaatccatagtgtcattttattttagtcattattgaattataccatttactctgttttcttatagtcttaattttattatattttgttgttactgtattatatttgaaaaccttcaaattagaatacattgtacagttaaagaaattgacttggtacttaaaagaaagatttcccattgcatacaggttattggagaaattttccttttgttgcatttgtggaagttagttttctggcccgtggcctttaattttcttaatcaacctaattacatcaggatagaggtagagtttctgtaaaagaagagacattaagagttcctgaaatttatatctggcatacggataggcttatattcaaaacatcttagtcatacgaccataaattaaaagtggagtcactaaatagtttgcagtacgtttctaatataagtgtaggtgggtatcaaaacaagacaaatgctgttcagggaaagaagttggcaagcttaaggttaaacaaaaataaaattacatgtgttttcgccttccta

SEQ ID NO: 446721 - DNA, 1433 bp, Homo sapiens
tggagctaagctgtttccagggtgacagagtggcgacctcggtggtcgattgagcaggtctgagaattgttcccaaagggttgtgcgtcaccgagtcgttggcgctgtcatggcgggtgtgctgaagaagaccactggccttgtgggattggctgtgtgcaatactcctcacgaggaaccagatgttaaaaaattagaagaccaacttcaaggcggtcaattagaagaggtgattcttcaggctgaacatgaactaaatctggcaagaaaaatgagggaatggaaactatgggagccattagtggaagagcctcctgccgatcagtggaaatggccaatataattattaagtgactttggtgtgttcatgggaaactgatgtaattaaatattctgttatattaagagcgtgttcttattactgacattttgtaatcaagaaaagtgatatagaaaatatgtaggagactgttaaaattggtgattatggtaatatggtcatgtgaatcaatttttgatttataaagtactcacacaagttgtttcaaagatgatatttctgtgaacagagaggccatgggaagatttgaaaattattaaagaaaaattcctacagattttcaatgcagagaccataatcaaaaagtaaactttctttagtagtatgttcaatacatcatttaattttttaagttatcctgaagaaggaaaggtccttaattattatagtctaaacaaatttatagattactgtttgaagtaaataatacgagtgaatattttcaaatgtgataaaatagcacaagtggctggtgataaaatttgaaattatggttaacctcagctgtgatcttatgtatgtaaagtgaaatttaaatagataattataggttgattacaaaatccatagtgtcattttattttagtcattattgaattataccatttactctgttttcttatagtcttaattttattatattttgttgttactgtattatatttgaaaaccttcaaattagaatacattgtacagttaaagaaattgacttggtacttaaaagaaagatttcccattgcatacaggttattggagaaattttccttttgttgcatttgtggaagttagttttctggcccgtggcctttaattttcttaatcaacctaattacatcaggatagaggtagagtttctgtaaaagaagagacattaagagttcctgaaatttatatctggcatacggataggcttatattcaaaacatcttagtcatacgaccataaattaaaagtggagtcactaaatagtttgcagtacgtttctaatataagtgtaggtgggtatcaaaacaagacaaatgctgttcagggaaagaagttggcaagcttaaggttaaacaaaaataaaattacatgtgttttcgccttccta

SEQ ID NO: 446722 - DNA, 1363 bp, Homo sapiens
  misc_feature (48)..(48): n is a, c, g, or t
ggctggtgcatcccccccgggggctagatcccaagctggtgtctgggnatcctaaatgcgcggaagtttccgaccggttccaatgagagctggcttggttaagcggaaccagatgttaaaaaattagaagaccaacttcaaggcggtcaattagaagaggtgattcttcaggctgaacatgaactaaatctggcaagaaaaatgagggaatggaaactatgggagccattagtggaagagcctcctgccgatcagtggaaatggccaatataattattaagtgactttggtgtgttcatgggaaactgatgtaattaaatattctgttatattaagagcgtgttcttattactgacattttgtaatcaagaaaagtgatatagaaaatatgtaggagactgttaaaattggtgattatggtaatatggtcatgtgaatcaatttttgatttataaagtactcacacaagttgtttcaaagatgatatttctgtgaacagagaggccatgggaagatttgaaaattattaaagaaaaattcctacagattttcaatgcagagaccataatcaaaaagtaaactttctttagtagtatgttcaatacatcatttaattttttaagttatcctgaagaaggaaaggtccttaattattatagtctaaacaaatttatagattactgtttgaagtaaataatacgagtgaatattttcaaatgtgataaaatagcacaagtggctggtgataaaatttgaaattatggttaacctcagctgtgatcttatgtatgtaaagtgaaatttaaatagataattataggttgattacaaaatccatagtgtcattttattttagtcattattgaattataccatttactctgttttcttatagtcttaattttattatattttgttgttactgtattatatttgaaaaccttcaaattagaatacattgtacagttaaagaaattgacttggtacttaaaagaaagatttcccattgcatacaggttattggagaaattttccttttgttgcatttgtggaagttagttttctggcccgtggcctttaattttcttaatcaacctaattacatcaggatagaggtagagtttctgtaaaagaagagacattaagagttcctgaaatttatatctggcatacggataggcttatattcaaaacatcttagtcatacgaccataaattaaaagtggagtcactaaatagtttgcagtacgtttctaatataagtgtaggtgggtatcaaaacaagacaaatgctgttcagggaaagaagttggcaagcttaaggttaaacaaaaataaaattacatgtgttttcgccttccta

SEQ ID NO: 446723 - DNA, 1710 bp, Homo sapiens
tggagctaagctgtttccagggtgacagagtggcgacctcggtggtcgattgagcaggtctgagaattgttcccaaagggttgtgcgtcaccgagtcgttggcgctgtcatggcgggtgtgctgaagaagaccactggccttgtgggattggctgtgtgcaatactcctcacgagaggctaagaatattgtacacaaagattcttgatgttcttgaggaaatccctaaaaatgcagcatatagaaagtatacagaacagattacaaatgagaagctggctatggttaaagcgcctatcataatgcaaattatcagtagttaatcaataagaaggtgttatttgagcaaagatttgaaaagtggtgaagaaacaagtgatgcagataccctgggccatccagcaagataccctgaggcagtaacatatcacgtcttgtgttgaaaagcaaaatgaaccagatgttaaaaaattagaagaccaacttcaaggcggtcaattagaagaggtgattcttcaggctgaacatgaactaaatctggcaagaaaaatgagggaatggaaactatgggagccattagtggaagagcctcctgccgatcagtggaaatggccaatataattattaagtgactttggtgtgttcatgggaaactgatgtaattaaatattctgttatattaagagcgtgttcttattactgacattttgtaatcaagaaaagtgatatagaaaatatgtaggagactgttaaaattggtgattatggtaatatggtcatgtgaatcaatttttgatttataaagtactcacacaagttgtttcaaagatgatatttctgtgaacagagaggccatgggaagatttgaaaattattaaagaaaaattcctacagattttcaatgcagagaccataatcaaaaagtaaactttctttagtagtatgttcaatacatcatttaattttttaagttatcctgaagaaggaaaggtccttaattattatagtctaaacaaatttatagattactgtttgaagtaaataatacgagtgaatattttcaaatgtgataaaatagcacaagtggctggtgataaaatttgaaattatggttaacctcagctgtgatcttatgtatgtaaagtgaaatttaaatagataattataggttgattacaaaatccatagtgtcattttattttagtcattattgaattataccatttactctgttttcttatagtcttaattttattatattttgttgttactgtattatatttgaaaaccttcaaattagaatacattgtacagttaaagaaattgacttggtacttaaaagaaagatttcccattgcatacaggttattggagaaattttccttttgttgcatttgtggaagttagttttctggcccgtggcctttaattttcttaatcaacctaattacatcaggatagaggtagagtttctgtaaaagaagagacattaagagttcctgaaatttatatctggcatacggataggcttatattcaaaacatcttagtcatacgaccataaattaaaagtggagtcactaaatagtttgcagtacgtttctaatataagtgtaggtgggtatcaaaacaagacaaatgctgttcagggaaagaagttggcaagcttaaggttaaacaaaaataaaattacatgtgttttcgccttccta

SEQ ID NO: 446724 - DNA, 1317 bp, Homo sapiens
  misc_feature (80)..(80): n is a, c, g, or t
ttgaaacagcactcacacaagttgtttcaaagatgatatttctgtgaacagagaggccatgggaagatttgaaaattatnaaagaaaaattcctacagattttcaatgcagagaccataatcaaaaagtaaactttctttagtagtatgttcaatacatcatttaattttttaagttatccattagtggaagagcctcctgccgatcagtggaaatggccaatataattattaagtgactttggtgtgttcatgggaaactgatgtaattaaatattctgttatattaagagcgtgttcttattactgacattttgtaatcaagaaaagtgatatagaaaatatgtaggagactgttaaaattggtgattatggtaatatggtcatgtgaatcaatttttgatttataaagtactcacacaagttgtttcaaagatgatatttctgtgaacagagaggccatgggaagatttgaaaattattaaagaaaaattcctacagattttcaatgcagagaccataatcaaaaagtaaactttctttagtagtatgttcaatacatcatttaattttttaagttatcctgaagaaggaaaggtccttaattattatagtctaaacaaatttatagattactgtttgaagtaaataatacgagtgaatattttcaaatgtgataaaatagcacaagtggctggtgataaaatttgaaattatggttaacctcagctgtgatcttatgtatgtaaagtgaaatttaaatagataattataggttgattacaaaatccatagtgtcattttattttagtcattattgaattataccatttactctgttttcttatagtcttaattttattatattttgttgttactgtattatatttgaaaaccttcaaattagaatacattgtacagttaaagaaattgacttggtacttaaaagaaagatttcccattgcatacaggttattggagaaattttccttttgttgcatttgtggaagttagttttctggcccgtggcctttaattttcttaatcaacctaattacatcaggatagaggtagagtttctgtaaaagaagagacattaagagttcctgaaatttatatctggcatacggataggcttatattcaaaacatcttagtcatacgaccataaattaaaagtggagtcactaaatagtttgcagtacgtttctaatataagtgtaggtgggtatcaaaacaagacaaatgctgttcagggaaagaagttggcaagcttaaggttaaacaaaaataaaattacatgtgttttcgccttccta

SEQ ID NO: 446725 - DNA, 1401 bp, Homo sapiens
tggagctaagctgtttccagggtgacagagtggcgacctcggtggtcgattgagcaggtctgagaattgttcccaaagggttgtgcgtcaccgagtcgttggcgctgtcatggcgggtgtgctgaagaagaccactggccttgtgggattggctgtgtgcaatactcctcacgagaggctaagaatattgtacacaaagattcttgatgttcttgaggaaatccctaaaaatgcagcatatagaaagtatacagaacagattacaaatgagaagctggctatggttaaagcggtggaaatggccaatataattattaagtgactttggtgtgttcatgggaaactgatgtaattaaatattctgttatattaagagcgtgttcttattactgacattttgtaatcaagaaaagtgatatagaaaatatgtaggagactgttaaaattggtgattatggtaatatggtcatgtgaatcaatttttgatttataaagtactcacacaagttgtttcaaagatgatatttctgtgaacagagaggccatgggaagatttgaaaattattaaagaaaaattcctacagattttcaatgcagagaccataatcaaaaagtaaactttctttagtagtatgttcaatacatcatttaattttttaagttatcctgaagaaggaaaggtccttaattattatagtctaaacaaatttatagattactgtttgaagtaaataatacgagtgaatattttcaaatgtgataaaatagcacaagtggctggtgataaaatttgaaattatggttaacctcagctgtgatcttatgtatgtaaagtgaaatttaaatagataattataggttgattacaaaatccatagtgtcattttattttagtcattattgaattataccatttactctgttttcttatagtcttaattttattatattttgttgttactgtattatatttgaaaaccttcaaattagaatacattgtacagttaaagaaattgacttggtacttaaaagaaagatttcccattgcatacaggttattggagaaattttccttttgttgcatttgtggaagttagttttctggcccgtggcctttaattttcttaatcaacctaattacatcaggatagaggtagagtttctgtaaaagaagagacattaagagttcctgaaatttatatctggcatacggataggcttatattcaaaacatcttagtcatacgaccataaattaaaagtggagtcactaaatagtttgcagtacgtttctaatataagtgtaggtgggtatcaaaacaagacaaatgctgttcagggaaagaagttggcaagcttaaggttaaacaaaaataaaattacatgtgttttcgccttccta

SEQ ID NO: 446726 - DNA, 1245 bp, Homo sapiens
gttcagagcgtgacgttgtagactcaaattctcgaggcatggaagataactgagggatcaattgtgactaggtatcgtatacgaccatgtgagtgcgcaaggacggactctctgactgtctacaagtgagagacacgtggaaatggccaatataattattaagtgactttggtgtgttcatgggaaactgatgtaattaaatattctgttatattaagagcgtgttcttattactgacattttgtaatcaagaaaagtgatatagaaaatatgtaggagactgttaaaattggtgattatggtaatatggtcatgtgaatcaatttttgatttataaagtactcacacaagttgtttcaaagatgatatttctgtgaacagagaggccatgggaagatttgaaaattattaaagaaaaattcctacagattttcaatgcagagaccataatcaaaaagtaaactttctttagtagtatgttcaatacatcatttaattttttaagttatcctgaagaaggaaaggtccttaattattatagtctaaacaaatttatagattactgtttgaagtaaataatacgagtgaatattttcaaatgtgataaaatagcacaagtggctggtgataaaatttgaaattatggttaacctcagctgtgatcttatgtatgtaaagtgaaatttaaatagataattataggttgattacaaaatccatagtgtcattttattttagtcattattgaattataccatttactctgttttcttatagtcttaattttattatattttgttgttactgtattatatttgaaaaccttcaaattagaatacattgtacagttaaagaaattgacttggtacttaaaagaaagatttcccattgcatacaggttattggagaaattttccttttgttgcatttgtggaagttagttttctggcccgtggcctttaattttcttaatcaacctaattacatcaggatagaggtagagtttctgtaaaagaagagacattaagagttcctgaaatttatatctggcatacggataggcttatattcaaaacatcttagtcatacgaccataaattaaaagtggagtcactaaatagtttgcagtacgtttctaatataagtgtaggtgggtatcaaaacaagacaaatgctgttcagggaaagaagttggcaagcttaaggttaaacaaaaataaaattacatgtgttttcgccttccta

SEQ ID NO: 446727 - DNA, 1352 bp, Homo sapiens
tggagctaagctgtttccagggtgacagagtggcgacctcggtggtcgattgagcaggtctgagaattgttcccaaagggttgtgcgtcaccgagtcgttggcgctgtcatggcgggtgtgctgaagaagaccactggccttgtgggattggctgtgtgcaatactcctcacgagaggctaagaatattgtacacaaagattcttgatgttcttgaggaaatccctaaaaatgcagcatatagaaagtatacagaacagattacaaatgagaagctggctatggttaaagcggaaccagatgttaaaaaattagaagaccaacttcaaggcggtcaattagaagaggtgattcttcaggctgaacatgaactaaatctggcaagaaaaatgagggaatggaaactatgggagccattagtggaagagcctcctgccgatcagtggaaatggccaatataattattaagtgactttggtgtgttcatgggaaactgatgtaattaaatattctgttatattaagagcgtgttcttattactgacattttgtaatcaagaaaagtgataaactttctttagtagtatgttcaatacatcatttaattttttaagttatcctgaagaaggaaaggtccttaattattatagtctaaacaaatttatagattactgtttgaagtaaataatacgagtgaatattttcaaatgtgataaaatagcacaagtggctggtgataaaatttgaaattatggttaacctcagctgtgatcttatgtatgtaaagtgaaatttaaatagataattataggttgattacaaaatccatagtgtcattttattttagtcattattgaattataccatttactctgttttcttatagtcttaattttattatattttgttgttactgtattatatttgaaaaccttcaaattagaatacattgtacagttaaagaaattgacttggtacttaaaagaaagatttcccattgcatacaggttattggagaaattttccttttgttgcatttgtggaagttagttttctggcccgtggcctttaattttcttaatcaacctaattacatcaggatagaggtagagtttctgtaaaagaagagacattaagagttcctgaaatttatatctggcatacggataggcttatattcaaaacatcttagtcatacgaccataaattaaaagtggagtcactaaatagtttgcagtacgtttctaatataagtgtaggtgggtatcaaaacaagacaaatgctgttcagggaaagaagttggcaagcttaaggttaaacaaaaataaaattacatgtgttttcgccttccta

SEQ ID NO: 446728 - DNA, 1304 bp, Homo sapiens
gcggccgctccaagctgtcatggcgggtgtgctgaagaaccactggccttgtgggattggctgtgtgcaatactcctcacgagaggctaagaatattgtacacaaagattcttgatgttcttgaggaaatccctaaaaatgcagcatatagaaagtatacagaacagattacaaatgagaagctggctatggttaaagcggaaccagatgttaaaaaattagaagaccaacttcaaggcggtcaattagaagaggtgattcttcaggctgaacatgaactaaatctggcaagaaaaatgagggaatggaaactatgggagccattagtggaagagcctcctgccgatcagtggaaatggccaatataattattaagtgactttggtgtgttcatgggaaactgatgtaattaaatattctgttatattaagagcgtgttcttattactgacattttgtaatcaagaaaagtgaaaaaattcctacagattttcaatgcagagaccataatcaaaaagtaaactttctttagtagtatgttcaatacatcatttaattttttaagttatcctgaagaaggaaaggtccttaattattatagtctaaacaaatttatagattactgtttgaagtaaataatacgagtgaatattttcaaatgtgataaaatagcacaagtggctggtgataaaatttgaaattatggttaacctcagctgtgatcttatgtatgtaaagtgaaatttaaatagataattataggttgattacaaaatccatagtgtcattttattttagtcattattgaattataccatttactctgttttcttatagtcttaattttattatattttgttgttactgtattatatttgaaaaccttcaaattagaatacattgtacagttaaagaaattgacttggtacttaaaagaaagatttcccattgcatacaggttattggagaaattttccttttgttgcatttgtggaagttagttttctggcccgtggcctttaattttcttaatcaacctaattacatcaggatagaggtagagtttctgtaaaagaagagacattaagagttcctgaaatttatatctggcatacggataggcttatattcaaaacatcttagtcatacgaccataaattaaaagtggagtcactaaatagtttgcagtacgtttctaatataagtgtaggtgggtatcaaaacaagacaaatgctgttcagggaaagaagttggcaagcttaaggttaaacaaaaataaaattacatgtgttttcgccttccta

SEQ ID NO: 446729 - DNA, 849 bp, Homo sapiens
gaagaagttcatggatcaacatccagagatggatttttccaaggctaaattcaactagcccctgttttttcctccctgaactcttggggctgagctgcaaccacccgactttctttcccactcttctctgggacttgtgggcctcagggcttggggtggcatcgataaacaccggtgtttatcgatgccactatattttcaaatgtgataaaatagcacaagtggctggtgataaaatttgaaattatggttaacctcagctgtgatcttatgtatgtaaagtgaaatttaaatagataattataggttgattacaaaatccatagtgtcattttattttagtcattattgaattataccatttactctgttttcttatagtcttaattttattatattttgttgttactgtattatatttgaaaaccttcaaattagaatacattgtacagttaaagaaattgacttggtacttaaaagaaagatttcccattgcatacaggttattggagaaattttccttttgttgcatttgtggaagttagttttctggcccgtggcctttaattttcttaatcaacctaattacatcaggatagaggtagagtttctgtaaaagaagagacattaagagttcctgaaatttatatctggcatacggataggcttatattcaaaacatcttagtcatacgaccataaattaaaagtggagtcactaaatagtttgcagtacgtttctaatataagtgtaggtgggtatcaaaacaagacaaatgctgttcagggaaagaagttggcaagcttaaggttaaacaaaaataaaattacatgtgttttcgccttccta

SEQ ID NO: 446730 - DNA, 723 bp, Homo sapiens
ggaaacacgcggttttaaaaaacaacttacaaaatttaaacccggagaacggttttgcaaacacttatattttcaaatgtgataaaatagcacaagtggctggtgataaaatttgaaattatggttaacctcagctgtgatcttatgtatgtaaagtgaaatttaaatagataattataggttgattacaaaatccatagtgtcattttattttagtcattattgaattataccatttactctgttttcttatagtcttaattttattatattttgttgttactgtattatatttgaaaaccttcaaattagaatacattgtacagttaaagaaattgacttggtacttaaaagaaagatttcccattgcatacaggttattggagaaattttccttttgttgcatttgtggaagttagttttctggcccgtggcctttaattttcttaatcaacctaattacatcaggatagaggtagagtttctgtaaaagaagagacattaagagttcctgaaatttatatctggcatacggataggcttatattcaaaacatcttagtcatacgaccataaattaaaagtggagtcactaaatagtttgcagtacgtttctaatataagtgtaggtgggtatcaaaacaagacaaatgctgttcagggaaagaagttggcaagcttaaggttaaacaaaaataaaattacatgtgttttcgccttccta

SEQ ID NO: 446731 - DNA, 451 bp, Homo sapiens
gtttgttttgtctttgagacaagtgttccattaagtctttggtaatattttaacctatggaaatttgtatggtttgtcttttcagaggctaagaatattgtacacaaagattcttgatgttcttgaggaaatccctaaaaatgcagcatatagaaagtatacagaacagattacaaatgagaagctggctatggttaaagcggtaagtagctaagtcagttttgttgtcttgtgtaacatttaaccaaaaaagtttagttccttattttttatatattcgacacacttttcttctattctccttccttgaatgctcttttcccatcattcctcccttttattcagcaaactcttgtttattgagtgttttctatatgcaggcctctgttacatactggagtttgagactaggatcagatccttccttgaagtaacattgtagctgttcctt

SEQ ID NO: 446732 - DNA, 1877 bp, Homo sapiens
  misc_feature (1877)..(1877): n is a, c, g, or t
tggagctaagctgtttccagggtgacagagtggcgacctcggtggtcgattgagcaggtctgagaattgttcccaaagggttgtgcgtcaccgagtcgttggcgctgtcatggcgggtgtgctgaagaagaccactggccttgtgggattggctgtgtgcaatactcctcacgagaggctaagaatattgtacacaaagattcttgatgttcttgaggaaatccctaaaaatgcagcatatagaaagtatacagaacagattacaaatgagaagctggctatggttaaagcggaaccagatgttaaaaaattagaagaccaacttcaaggcggtcaattagaagaggtgattcttcaggctgaacatgaactaaatctggcaagaaaaatgagggaatggaaactatgggagccattagtggaagagcctcctgccgatcagtggaaatggccaatataattattaagtgactttggtgtgttcatgggaaactgatgtaattaaatattctgttatattaagagcgtgttcttattactgacattttgtaatcaagaaaagtgatatagaaaatatgtaggagactgttaaaattggtgattatggtaatatggtcatgtgaatcaatttttgatttataaagtactcacacaagttgtttcaaagatgatatttctgtgaacagagaggccatgggaagatttgaaaattattaaagaaaaattcctacagattttcaatgcagagaccataatcaaaaagtaaactttctttagtagtatgttcaatacatcatttaattttttaagttatcctgaagaaggaaaggtccttaattattatagtctaaacaaatttatagattactgtttgaagtaaataatacgagtgaatattttcaaatgtgataaaatagcacaagtggctggtgataaaatttgaaattatggttaacctcagctgtgatcttatgtatgtaaagtgaaatttaaatagataattataggttgattacaaaatccatagtgtcattttattttagtcattattgaattataccatttactctgttttcttatagtcttaattttattatattttgttgttactgtattatatttgaaaaccttcaaattagaatacattgtacagttaaagaaattgacttggtacttaaaagaaagatttcccattgcatacaggttattggagaaattttccttttgttgcatttgtggaagttagttttctggcccgtggcctttaattttcttaatcaacctaattacatcaggatagaggtagagtttctgtaaaagaagagacattaagagttcctgaaatttatatctggcatacggataggcttatattcaaaacatcttagtcatacgaccataaattaaaagtggagtcactaaatagtttgcagtacgtttctaatataagtgtaggtgggtatcaaaacaagacaaatgctgttcagggaaagaagttggcaagcttaaggttaaacaaaaataaaattacatgtgttttcgccttcctaaaaaaaaaaaaaaaaaaaaaaaaaaaaaattttggggggcgtggcaccctcgagaagacgctttctaaaacccactcgcgtgggggggagccgggccccagaatgaggttacggagcacaccgggccaaacaagccggttccctaagaagaagtactgcggcgcacagcaccaaagctgggggggctttccccacaaataaaaaaacggcccgcgggggcacagacgaccggttgtggaacaacatcccgaaggagaccgaggagcaacaacgagcgtcaaaaccagagggctccaagagagccgatattaattagccgcccggagn

SEQ ID NO: 446733 - DNA, 962 bp, Homo sapiens
  misc_feature (776)..(776): n is a, c, g, or t
tggagctaagctgtttccagggtgacagagtggcgacctcggtggtcgattgagcaggtctgagaattgttcccaaagggttgtgcgtcaccgagtcgttggcgctgtcatggcgggtgtgctgaagaagaccactggccttgtgggattggctgtgtgcaatactcctcacgagaggctaagaatattgtacacaaagattcttgatgttcttgaggaaatccctaaaaatgcagcatatagaaagtatacagaacagattacaaatgagaagctggctatggttaaagcggaaccagatgttaaaaaattagaagaccaacttcaaggcggtcaattagaagaggtgattcttcaggctgaacatgaactaaatctggcaagaaaaatgagggaatggaaactatgggagccattagtggaagagcctcctgccgatcagtggaaatggccaatataattattaagtgactttggtgtgttcatgggaaactgatgtaattaaatattctgttatattaagagcgtgttcttattactgacattttgtaatcaagaaaagtgatatagaaaatatgtaggagactgttaaaattggtgattatggtaatatggtcatgtgaatcaatttttgatttataaagtactcacacaagttgtttcaaagatgatatttctgtgaacagagaggccatgggaagatttgaaaattattaaagaaaaattcctacagattttcaatgcagagaccataatcaaaaaggagaggttgtcancctcttaattttagtatcgaagaaggaggccattttgtcaaccctttgatacggggggatatacgggtttccgggaaccccgggggacttgaaggccccggcccttgtgagaaatggggacaggcttttccggaccgctcaattaggcttaccggaggacgcgctggccgacgaagtagtgttcaa

SEQ ID NO: 446734 - DNA, 1547 bp, Homo sapiens
tggagctaagctgtttccagggtgacagagtggcgacctcggtggtcgattgagcaggtctgagaattgttcccaaagggttgtgcgtcaccgagtcgttggcgctgtcatggcgggtgtgctgaagaagaccactggccttgtgggattggctgtgtgcaatactcctcacgagaggctaagaatattgtacacaaagattcttgatgttcttgaggaaatccctaaaaatgcagcatatagaaagtatacagaacagattacaaatgagaagctggctatggttaaagcggaaccagatgttaaaaaattagaagaccaacttcaaggcggtcaattagaagaggtgattcttcaggctgaacatgaactaaatctggcaagaaaaatgagggaatggaaactatgggagccattagtggaagagcctcctgccgatcagtggaaatggccaatataattattaagtgactttggtgtgttcatgggaaactgatgtaattaaatattctgttatattaagagcgtgttcttattactgacattttgtaatcaagaaaagtgatatagaaaatatgtaggagactgttaaaattggtgattatggtaatatggtcatgtgaatcaatttttgatttataaagtactcacacaagttgtttcaaagatgatatttctgtgaacagagaggccatgggaagatttgaaaattattaaagaaaaattcctacagattttcaatgcagagaccataatcaaaaagtaaactttctttagtagtatgttcaatacatcatttaattttttaagttatcctgaagaaggaaaggtccttaattattatagtctaaacaaatttatagattactgtttgaagtaaataatacgagtgaatattttcaaatgtgataaaatagcacaagtggctggtgataaaatttgaaattatggttaacctcagctgtgatcttatgtatgtaaagtgaaatttaaatagataattataggttgattacaaaatccatagtgtcattttattttagtcattattgaattataccatttactctgttttcttatagtcttaattttattatattttgttgttactgtattatatttgaaaaccttcaaattagaatacattgtacagttaaagaaattgacttggtacttaaaagaaagatttcccattgcatacaggttattggagaaattttccttttgttgcatttgtggaagttagttttctggcccgtggcctttaattttcttaatcaacctaattacatcaggatagaggtagagtttaatgaagaaaaaacagctgaggagctgcgctgaggcgaaactgcaaggaagctccctcctcagcagtcagcacagtggataggagctgtctcttcccaagggcgcagtcacaagtcatcccaaagctgccgcagtgtcccgtccagcaagtcctgagggacctggagtgcttcactttctcctcactgtggacgcacacctgccacacggtgcctgtagtccagctgcttgggagg

SEQ ID NO: 446735 - DNA, 1508 bp, Homo sapiens
tggagctaagctgtttccagggtgacagagtggcgacctcggtggtcgattgagcaggtctgagaattgttcccaaagggttgtgcgtcaccgagtcgttggcgctgtcatggcgggtgtgctgaagaagaccactggccttgtgggattggctgtgtgcaatactcctcacgagaggctaagaatattgtacacaaagattcttgatgttcttgaggaaatccctaaaaatgcagcatatagaaagtatacagaacagattacaaatgagaagctggctatggttaaagcggaaccagatgttaaaaaattagaagaccaacttcaaggcggtcaattagaagaggtgattcttcaggctgaacatgaactaaatctggcaagaaaaatgagggaatggaaactatgggagccattagtggaagagcctcctgccgatcagtggaaatggccaatataattattaagtgactttggtgtgttcatgggaaactgatgtaattaaatattctgttatattaagagcgtgttcttattactgacattttgtaatcaagaaaagtgatatagaaaatatgtaggagactgttaaaattggtgattatggtaatatggtcatgtgaatcaatttttgatttataaagtactcacacaagttgtttcaaagatgatatttctgtgaacagagaggccatgggaagatttgaaaattattaaagaaaaattcctacagattttcaatgcagagaccataatcaaaaagtaaactttctttagtagtatgttcaatacatcatttaattttttaagttatcctgaagaatactgtttgaagtaaataatacgagtgaatattttcaaatgtgataaaatagcacaagtggctggtgataaaatttgaaattatggttaacctcagctgtgatcttatgtatgtaaagtgaaatttaaatagataattataggttgattacaaaatccatagtgtcattttattttagtcattattgaattataccatttactctgttttcttatagtcttaattttattatattttgttgttactgtattatatttgaaaaccttcaaattagaatacattgtacagttaaagaaattgacttggtacttaaaagaaagatttcccattgcatacaggttattggagaaattttccttttgttgcatttgtggaagttagttttctggcccgtggcctttaattttcttaatcaacctaattacatcaggatagaggtagagtttctgtaaaagaagagacattaagagttcctgaaatttatatctggcatacggataggcttatattcaaaacatcttagtcatacgaccataaattaaaagtggagtcactaaatagtttgcagtacgtttctaatataagtgtaggtgggtatcaaaacaagacaaatgctgttcagggaaagaagttggcaagcttaaggttaaacaaaaataaaattacatgtgttttcgccttccta

SEQ ID NO: 446736 - DNA, 1691 bp, Homo sapiens
tggagctaagctgtttccagggtgacagagtggcgacctcggtggtcgattgagcaggtctgagaattgttcccaaagggttgtgcgtcaccgagtcgttggcgctgtcatggcgggtgtgctgaagaaggtgagacgaatggaggtcactgttggaatttagactgtgggggtagactcagtccgatagccctacttcccgcgggtgttgacccctactgtcgcgggctcggcggtgcttttcggggactcgttctgcatgccttaccggaccactggccttgtgggattggctgtgtgcaatactcctcacgagaggctaagaatattgtacacaaagattcttgatgttcttgaggaaatccctaaaaatgcagcatatagaaagtatacagaacagattacaaatgagaagctggctatggttaaagcggaaccagatgttaaaaaattagaagaccaacttcaaggcggtcaattagaagaggtgattcttcaggctgaacatgaactaaatctggcaagaaaaatgagggaatggaaactatgggagccattagtggaagagcctcctgccgatcagtggaaatggccaatataattattaagtgactttggtgtgttcatgggaaactgatgtaattaaatattctgttatattaagagcgtgttcttattactgacattttgtaatcaagaaaagtgatatagaaaatatgtaggagactgttaaaattggtgattatggtaatatggtcatgtgaatcaatttttgatttataaagtactcacacaagttgtttcaaagatgatatttctgtgaacagagaggccatgggaagatttgaaaattattaaagaaaaattcctacagattttcaatgcagagaccataatcaaaaagtaaactttctttagtagtatgttcaatacatcatttaattttttaagttatcctgaagaaggaaaggtccttaattattatagtctaaacaaatttatagattactgtttgaagtaaataatacgagtgaatattttcaaatgtgataaaatagcacaagtggctggtgataaaatttgaaattatggttaacctcagctgtgatcttatgtatgtaaagtgaaatttaaatagataattataggttgattacaaaatccatagtgtcattttattttagtcattattgaattataccatttactctgttttcttatagtcttaattttattatattttgttgttactgtattatatttgaaaaccttcaaattagaatacattgtacagttaaagaaattgacttggtacttaaaagaaagatttcccattgcatacaggttattggagaaattttccttttgttgcatttgtggaagttagttttctggcccgtggcctttaattttcttaatcaacctaattacatcaggatagaggtagagtttctgtaaaagaagagacattaagagttcctgaaatttatatctggcatacggataggcttatattcaaaacatcttagtcatacgaccataaattaaaagtggagtcactaaatagtttgcagtacgtttctaatataagtgtaggtgggtatcaaaacaagacaaatgctgttcagggaaagaagttggcaagcttaaggttaaacaaaaataaaattacatgtgttttcgccttccta

SEQ ID NO: 446737 - DNA, 1714 bp, Homo sapiens
caattcagctgcagggagtgttgctactgatggaacaaaaccaaaccacttggaattaacgcacaatttaaagagatggggtttgaccttgttgtccaggctggtttcaaactcctgagttcgagcaatctacccacccttcaaagtgttgggatcacagatattttaccattacaatatagatggagattttcatctattaataaaagatgttctctattcacaaatggaaatggagcaacagtacacaatttctgccccagaattcatggctggtgcagatggaaatattggcatagttccagaggagttaaaggactcacccaggccgtacagctgaggctaagaatattgtacacaaagattcttgatgttcttgaggaaatccctaaaaatgcagcatatagaaagtatacagaacagattacaaatgagaagctggctatggttaaagcggaaccagatgttaaaaaattagaagaccaacttcaaggcggtcaattagaagaggtgattcttcaggctgaacatgaactaaatctggcaagaaaaatgagggaatggaaactatgggagccattagtggaagagcctcctgccgatcagtggaaatggccaatataattattaagtgactttggtgtgttcatgggaaactgatgtaattaaatattctgttatattaagagcgtgttcttattactgacattttgtaatcaagaaaagtgatatagaaaatatgtaggagactgttaaaattggtgattatggtaatatggtcatgtgaatcaatttttgatttataaagtactcacacaagttgtttcaaagatgatatttctgtgaacagagaggccatgggaagatttgaaaattattaaagaaaaattcctacagattttcaatgcagagaccataatcaaaaagtaaactttctttagtagtatgttcaatacatcatttaattttttaagttatcctgaagaaggaaaggtccttaattattatagtctaaacaaatttatagattactgtttgaagtaaataatacgagtgaatattttcaaatgtgataaaatagcacaagtggctggtgataaaatttgaaattatggttaacctcagctgtgatcttatgtatgtaaagtgaaatttaaatagataattataggttgattacaaaatccatagtgtcattttattttagtcattattgaattataccatttactctgttttcttatagtcttaattttattatattttgttgttactgtattatatttgaaaaccttcaaattagaatacattgtacagttaaagaaattgacttggtacttaaaagaaagatttcccattgcatacaggttattggagaaattttccttttgttgcatttgtggaagttagttttctggcccgtggcctttaattttcttaatcaacctaattacatcaggatagaggtagagtttctgtaaaagaagagacattaagagttcctgaaatttatatctggcatacggataggcttatattcaaaacatcttagtcatacgaccataaattaaaagtggagtcactaaatagtttgcagtacgtttctaatataagtgtaggtgggtatcaaaacaagacaaatgctgttcagggaaagaagttggcaagcttaaggttaaacaaaaataaaattacatgtgttttcgccttccta

SEQ ID NO: 446738 - DNA, 1085 bp, Homo sapiens
tggagctaagctgtttccagggtgacagagtggcgacctcggtggtcgattgagcaggtctgagaattgttcccaaagggttgtgcgtcaccgagtcgttggcgctgtcatggcgggtgtgctgaagaagaccactggccttgtgggattggctgtgtgcaatactcctcacgagaggctaagaatattgtacacaaagattcttgatgttcttgaggaaatccctaaaaatgcagcatatagaaagtatacagaacagattacaaatgagaagctggctatggttaaagcggaaccagatgttaaaaaattagaagaccaacttcaaggcggtcaattagaagaggtgattcttcagggaaaggtccttaattattatagtctaaacaaatttatagattactgtttgaagtaaataatacgagtgaatattttcaaatgtgataaaatagcacaagtggctggtgataaaatttgaaattatggttaacctcagctgtgatcttatgtatgtaaagtgaaatttaaatagataattataggttgattacaaaatccatagtgtcattttattttagtcattattgaattataccatttactctgttttcttatagtcttaattttattatattttgttgttactgtattatatttgaaaaccttcaaattagaatacattgtacagttaaagaaattgacttggtacttaaaagaaagatttcccattgcatacaggttattggagaaattttccttttgttgcatttgtggaagttagttttctggcccgtggcctttaattttcttaatcaacctaattacatcaggatagaggtagagtttctgtaaaagaagagacattaagagttcctgaaatttatatctggcatacggataggcttatattcaaaacatcttagtcatacgaccataaattaaaagtggagtcactaaatagtttgcagtacgtttctaatataagtgtaggtgggtatcaaaacaagacaaatgctgttcagggaaagaagttggcaagcttaaggttaaacaaaaataaaattacatgtgttttcgccttccta

SEQ ID NO: 446739 - DNA, 1996 bp, Homo sapiens
  misc_feature (56)..(59): n is a, c, g, or t
aaattttttagagacagggtctcactctgctgcccaggctggagtgcagtggcacnnnnacctgtcattcgttcgtcctcagtgcagggcaacaggactttaggttcaagatggtgactgcagccatgctgctacagtgctgcccagtgcttgcccggggccccacaagcctcctaggcaaggtggttaagactcaccagttcctgtttggtattggacgctgtcccatcctggctacccaaggaccaaactgttctcaaatccaccttaaggcaacaaaggctggaggagattctccatcttgggcgaagggccactgtcccttcatgctgtcggaactccaggatgggaagagcaagattgtgcagaaggcagccccagaagtccaggaagatgtgaaggctttcaagacagatctgcctagctccctggtctcagtcagcctaaggaagccattttccggtccccaggagcaggagcagatctctgggaaggtcacacacctgattcagaacaatatgcctggaaactatgtcttcagttatgaccagtttttcagggacaagatcatggagaagaaacaggatcacacctaccgtgtgttcaagactgtgaaccgctgggctgatgcatatccctttgcccaacatttctctgaggcatctgtggcctcaaaggatgtgtccgtctggtgtagtaatgattacctgggcatgagccgacaccctcaggtcttgcaagccacacaggagaccctgcagcgtcatggtgctggagctggtggcacccgcaacatctcaggcaccagtaagtttcatgtggagcttgagcaggagctggctgagctgcaccagaaggactcagccctgctcttctcctcctgctttgttgccaatgactctactctcttcaccttggccaagatcctgccagggtgcgagatttactcagacgcaggcaaccatgcttccatgatccaaggtatccgtaacagtggagcagccaagtttgtcttcaggcacaatgaccctgaccacctaaagaaacttctagagaagtctaaccctaagatacccaaaattgtggcctttgagactgtccactccatggatggtgccatctgtcccctcgaggagttgtgtgatgtgtcccaccagtatggggccctgaccttcgtggatgaggtccatgctgtaggactgtatgggtcccggggcgctgggattggggagcgtgatggaattatgcataagattgacatcatctctggaactcttggcaaggcctttggctgtgtgggcggctacattgccagcacccgtgacttggtggacatggtgcgctcctatgctgcaggcttcatctttaccacttctctgccccccatggtgctctctggagctctagaatctgtgcggctgctcaagggagaggagggccaagccctgaggcgagcccaccagcgcaatgtcaagcacatgcgccagctactcatggacaggggccttcctgtcatcccctgccccagccacatcatccccatccgggtgggcaatgcagcactcaacagcaagctctgtgatctcctgctctccaagcatggcatctatgtgcaggccatcaactacccaactgtcccccggggtgaagagctcctgcgcttggcaccctccccccaccacagccctcagatgatggaagattttgtggagaagctgctgctggcttggactgcggtggggctgcccctccaggatgtgtctgtggctgcctgcaatttctgtcgccgtcctgtacactttgagctcatgagtgagtgggaacgttcctacttcgggaacatggggccccagtatgtcaccacctatgcctgagaagccagctgcctaggattcacaccccacctgcgcttcacttgggtccaggcctactcctgtcttctgctttgttgtgtgcctctagctgaattgagcctaaaaataaagcacaaaccaca

SEQ ID NO: 446740 - DNA, 216 bp, Homo sapiens
tggagactgaatttcactcttgttgcccaggctggagtgcaatgcatgatctcagcccactgcaacctccgcctcccagtgctgggattacaggcgtgcaccactgtgcctggtctaccagtcccattttcaaaggtgagaagaggcttggctagagcaagcactgtgttcaaagcaatgctcccactttccaggtcacagtatacaggaaacatt

SEQ ID NO: 446741 - DNA, 2057 bp, Homo sapiens
gcaggttggtacagccccggattaatgggatcctcagtgcaggcaacagggcccacatgccttggccccacataccaacccaggctgctgtgacagcccatgagagggggagaggttgctctgggatggaacaagaaaaagaggttgttttgtgaggactttaggttcaagatggtgactgcagccatgctgctacagtgctgcccagtgcttgcccggggccccacaagcctcctaggcaaggtggttaagactcaccagttcctgtttggtattggacgctgtcccatcctggctacccaaggaccaaactgttctcaaatccaccttaaggcaacaaaggctggaggagattctccatcttgggcgaagggccactgtcccttcatgctgtcggaactccaggatgggaagagcaagattgtgcagaaggcagccccagaagtccaggaagatgtgaaggctttcaagacagatctgcctagctccctggtctcagtcagcctaaggaagccattttccggtccccaggagcaggagcagatctctgggaaggtcacacacctgattcagaacaatatgcctggaaactatgtcttcagttatgaccagtttttcagggacaagatcatggagaagaaacaggatcacacctaccgtgtgttcaagactgtgaaccgctgggctgatgcatatccctttgcccaacatttctctgaggcatctgtggcctcaaaggatgtgtccgtctggtgtagtaatgattacctgggcatgagccgacaccctcaggtcttgcaagccacacaggagaccctgcagcgtcatggtgctggagctggtggcacccgcaacatctcaggcaccagtaagtttcatgtggagcttgagcaggagctggctgagctgcaccagaaggactcagccctgctcttctcctcctgctttgttgccaatgactctactctcttcaccttggccaagatcctgccagggtgcgagatttactcagacgcaggcaaccatgcttccatgatccaaggtatccgtaacagtggagcagccaagtttgtcttcaggcacaatgaccctgaccacctaaagaaacttctagagaagtctaaccctaagatacccaaaattgtggcctttgagactgtccactccatggatggtgccatctgtcccctcgaggagttgtgtgatgtgtcccaccagtatggggccctgaccttcgtggatgaggtccatgctgtaggactgtatgggtcccggggcgctgggattggggagcgtgatggaattatgcataagattgacatcatctctggaactcttggcaaggcctttggctgtgtgggcggctacattgccagcacccgtgacttggtggacatggtgcgctcctatgctgcaggcttcatctttaccacttctctgccccccatggtgctctctggagctctagaatctgtgcggctgctcaagggagaggagggccaagccctgaggcgagcccaccagcgcaatgtcaagcacatgcgccagctactcatggacaggggccttcctgtcatcccctgccccagccacatcatccccatccgggtgggcaatgcagcactcaacagcaagctctgtgatctcctgctctccaagcatggcatctatgtgcaggccatcaactacccaactgtcccccggggtgaagagctcctgcgcttggcaccctccccccaccacagccctcagatgatggaagattttgtggagaagctgctgctggcttggactgcggtggggctgcccctccaggatgtgtctgtggctgcctgcaatttctgtcgccgtcctgtacactttgagctcatgagtgagtgggaacgttcctacttcgggaacatggggccccagtatgtcaccacctatgcctgagaagccagctgcctaggattcacaccccacctgcgcttcacttgggtccaggcctactcctgtcttctgctttgttgtgtgcctctagctgaattgagcctaaaaataaagcacaaaccaca

SEQ ID NO: 446742 - DNA, 2308 bp, Homo sapiens
  misc_feature (56)..(59): n is a, c, g, or t
aaattttttagagacagggtctcactctgctgcccaggctggagtgcagtggcacnnnnacctgtcattcgttcgtcctcagtgcagggcaacaggactttaggttcaagatggtgactgcagccatgctgctacagtgctgcccagtgcttgcccggggccccacaagcctcctaggcaaggtggttaagactcaccagttcctgtttggtattggacgctgtcccatcctggctacccaaggaccaaactgttctcaaatccaccttaaggcaacaaaggctggaggagattctccatcttgggcgaagggccactgtcccttcatgctgtcggaactccaggatgggaagagcaagattgtgcagaaggcagccccagaagtccaggaagatgtgaaggctttcaagacagatctgcctagctccctggtctcagtcagcctaaggaagccattttccggtccccaggagcaggagcagatctctgggaaggtcacacacctgattcagaacaatatgcctggaaactatgtcttcagttatgaccagtttttcagggacaagatcatggagaagaaacaggatcacacctaccgtgtgttcaagactgtgaaccgctgggctgatgcatatccctttgcccaacatttctctgaggcatctgtggcctcaaaggatgtgtccgtctggtgtagtaatgattacctgggcatgagccgacaccctcaggtcttgcaagccacacaggagaccctgcagcgtcatggtgctggagctggtggcacccgcaacatctcaggcaccagtaagtttcatgtggagcttgagcaggagctggctgagctgcaccagaaggactcagccctgctcttctcctcctgctttgttgccaatgactctactctcttcaccttggccaagatcctgccagggtgcgagatttactcagacgcaggcaaccatgcttccatgatccaaggtatccgtaacagtggagcagccaagtttgtcttcaggcacaatgaccctgaccacctaaagaaacttctagagaagtctaaccctaagatacccaaaattgtggcctttgagactgtccactccatggatggtgccatctgtcccctcgaggagttgtgtgatgtgtcccaccagtatggggccctgaccttcgtggatgaggtccatgctgtaggactgtatgggtcccggggcgctgggattggggagcgtgatggaattatgcataagattgacatcatctctggaactcttggcaaggcctttggctgtgtgggcggctacattgccagcacccgtgacttggtggacatggtgcgctcctatgctgcaggcttcatctttaccacttctctgccccccatggtgctctctggagctctagaatctgtgcggctgctcaagggagaggagggccaagccctgaggcgagcccaccagcgcaatgtcaagcacatgcgccagctactcatggacaggggccttcctgtcatcccctgccccagccacatcatccccatccggagaagctgctgctggcttggactgcggtggggctgcccctccaggatgtgtctgtggctgcctgcaatttctgtcgccgtcctgtacactttgagctcatgagtgagtgggaacgttcctacttcgggaacatggggccccagtatgtcaccacctatgcctgagaagccagctgcctaggattcacaccccacctgcgcttcacttgggtccaggcctactcctgtcttctgctttgttgtgtgcctctagctgaattgagcctaaaaataaagcacaaaccacagcaaaaaaaagccttttattggacagggaacagacaagtgcattctgactccctcagacaagtggcagatctatgaggtaaccataggtcacttgttggtcaccattccattttaccaacagggaaacagaatgagaaagaggaaggaaatgcccaaaaactacacagtgagttgcaaagagctaggatacttggcagatttatttgagatggctcttctccaatggtttcaataaaaatccagggattgacgcttcactggtaatccgggccctggaaatctgggcccagggtagcccctgaagccaggaaatgagtcagccctaaccaaattccctagaaaggagtggttccccaaaaccaaagaggtattttccataaggggatatggatgtcttcctcaatccattatcctctctccctcccacggcatcccacagaacaggatttaccagtcccattctttttcttttct

SEQ ID NO: 446743 - DNA, 1880 bp, Homo sapiens
  misc_feature (56)..(59): n is a, c, g, or t
aaattttttagagacagggtctcactctgctgcccaggctggagtgcagtggcacnnnnacctgtcattcgttcgtcctcagtgcagggcaacaggactttaggttcaagatggtgactgcagccatgctgctacagtgctgcccagtgcttgcccggggccccacaagcctcctaggcaaggtggttaagactcaccagttcctgtttggtattggacgctgtcccatcctggctacccaaggaccaaactgttctcaaatccaccttaaggcaacaaaggctggaggagattctccatcttgggcgaagggccactgtcccttcatgctgtcggaactccaggatgggaagagcaagattgtgcagaaggcagccccagaagtccaggaagatgtgaaggctttcaagacagatctgcctagctccctggtctcagtcagcctaaggaagccattttccggtccccaggagcaggagcagatctctgggaaggtcacacacctgattcagaacaatatgcctggaaactatgtcttcagttatgaccagtttttcagggacaagatcatggagaagaaacaggatcacacctaccgtgtgttcaagactgtgaaccgctgggctgatgcatatccctttgcccaacatttctctgaggcatctgtggcctcaaaggatgtgtccgtctggtgtagtaatgattacctgggcatgagccgacaccctcaggtcttgcaagccacacaggagaccctgcagcgtcatggtgctggagctggtggcacccgcaacatctcaggcaccagtaagtttcatgtggagcttgagcaggagctggctgagctgcaccagaaggactcagccctgctcttctcctcctgctttgttgccaatgactctactctcttcaccttggccaagatcctgccagggtgcgagatttactcagacgcaggcaaccatgcttccatgatccaaggtatccgtaacagtggagcagccaagtttgtcttcaggcacaatgaccctgaccacctaaagaaacttctagagaagtctaaccctaagatacccaaaattgtggcctttgagactgtccactccatggatggtgccatctgtcccctcgaggagttgtgtgatgtgtcccaccagtatggggccctgaccttcgtggatgaggtccatgctgtaggactgtatgggtcccggggcgctgggattggggagcgtgatggaattatgcataagattgacatcatctctggaactcttggcaaggcctttggctgtgtgggcggctacattgccagcacccgtgacttggtggacatggtgcgctcctatgctgcaggcttcatctttaccacttctctgccccccatggtgctctctggagctctagaatctgtgcggctgctcaagggagaggagggccaagccctgaggcgagcccaccagcgcaatgtcaagcacatgcgccagctactcatggacaggggccttcctgtcatcccctgccccagccacatcatccccatccgggtgagagccccaccatgcccattgccctctccacctatttattctgggagcctcacgctcccaacaaacctacatctgttgctgtcttcaattatttgctttcctgctaaccattccctttattgccagctttgtttccctttttgaaaaattatcagccattctggattaaccagtcttttccttgcatcagccattacctcatgcttattagattatcctaaccctaacaatagcgagtgctcacagcctataattcagagtttttcaaactggatcaagacaattaatgggtcacaaaatcagcttagtgggttatcattagcattaaaa

SEQ ID NO: 446744 - DNA, 734 bp, Homo sapiens
cacagcaaaaaaaagccttttattggacagggaacagacaagtgcattctgactccctcagacaagtggcagatctatgaggtaaccataggtcacttgttggtcaccattccattttaccaacagggaaacagaatgagaaagaggaaggaaatgcccaaaaactacacagtgagttgcaaagagctaggatacttggcagatttatttgagatggctcttctccaatggtttcaataaaaatccagggattgacgcttcactggtaatccgggccctggaaatctgggcccagggtagcccctgaagccaggaaatgagtcagccctaaccaaattccctagaaaggagtggttccccaaaaccaaagaggtattttccataaggggatatggatgtcttcctcaatccattatcctctctccctcccacggcatcccacagaacaggatttaccagtcccattctttttcttttctttttttttttttggagactgaatttcactcttgttgcccaggctggagtgcaatgcatgatctcagcccactgcaacctccgcctcccaggtacaagctattctcctgtctcagcctcctaagtagcttggattacaggcacgcgccaccacgcccagttaatttttttgtatttagtagagacggggtctcaccatgttaggctggttgcgaactcctgacctcaggtgatccacccatctcagcctcccaaag

SEQ ID NO: 446745 - DNA, 2471 bp, Homo sapiens
  misc_feature (56)..(59): n is a, c, g, or t
aaattttttagagacagggtctcactctgctgcccaggctggagtgcagtggcacnnnnacctgtcattcgttcgtcctcagtgcagggcaacaggactttaggttcaagatggtgactgcagccatgctgctacagtgctgcccagtgcttgcccggggccccacaagcctcctaggcaaggtggttaagactcaccagttcctgtttggtattggacgctgtcccatcctggctacccaaggaccaaactgttctcaaatccaccttaaggcaacaaaggctggaggagattctccatcttgggcgaagggccactgtcccttcatgctgtcggaactccaggatgggaagagcaagattgtgcagaaggcagccccagaagtccaggaagatgtgaaggctttcaagacagatctgcctagctccctggtctcagtcagcctaaggaagccattttccggtccccaggagcaggagcagatctctgggaaggtcacacacctgattcagaacaatatgcctggaaactatgtcttcagttatgaccagtttttcagggacaagatcatggagaagaaacaggatcacacctaccgtgtgttcaagactgtgaaccgctgggctgatgcatatccctttgcccaacatttctctgaggcatctgtggcctcaaaggatgtgtccgtctggtgtagtaatgattacctgggcatgagccgacaccctcaggtcttgcaagccacacaggagaccctgcagcgtcatggtgctggagctggtggcacccgcaacatctcaggcaccagtaagtttcatgtggagcttgagcaggagctggctgagctgcaccagaaggactcagccctgctcttctcctcctgctttgttgccaatgactctactctcttcaccttggccaagatcctgccagggtgcgagatttactcagacgcaggcaaccatgcttccatgatccaaggtatccgtaacagtggagcagccaagtttgtcttcaggcacaatgaccctgaccacctaaagaaacttctagagaagtctaaccctaagatacccaaaattgtggcctttgagactgtccactccatggatggtgccatctgtcccctcgaggagttgtgtgatgtgtcccaccagtatggggccctgaccttcgtggatgaggtccatgctgtaggactgtatgggtcccggggcgctgggattggggagcgtgatggaattatgcataagattgacatcatctctggaactcttggcaaggcctttggctgtgtgggcggctacattgccagcacccgtgacttggtggacatggtgcgctcctatgctgcaggcttcatctttaccacttctctgccccccatggtgctctctggagctctagaatctgtgcggctgctcaagggagaggagggccaagccctgaggcgagcccaccagcgcaatgtcaagcacatgcgccagctactcatggacaggggccttcctgtcatcccctgccccagccacatcatccccatccgggtgggcaatgcagcactcaacagcaagctctgtgatctcctgctctccaagcatggcatctatgtgcaggccatcaactacccaactgtcccccggggtgaagagctcctgcgcttggcaccctccccccaccacagccctcagatgatggaagattttgtggagaagctgctgctggcttggactgcggtggggctgcccctccaggatgtgtctgtggctgcctgcaatttctgtcgccgtcctgtacactttgagctcatgagtgagtgggaacgttcctacttcgggaacatggggccccagtatgtcaccacctatgcctgagaagccagctgcctaggattcacaccccacctgcgcttcacttgggtccaggcctactcctgtcttctgctttgttgtgtgcctctagctgaattgagcctaaaaataaagcacaaaccacagcaaaaaaaagccttttattggacagggaacagacaagtgcattctgactccctcagacaagtggcagatctatgaggtaaccataggtcacttgttggtcaccattccattttaccaacagggaaacagaatgagaaagaggaaggaaatgcccaaaaactacacagtgagttgcaaagagctaggatacttggcagatttatttgagatggctcttctccaatggtttcaataaaaatccagggattgacgcttcactggtaatccgggccctggaaatctgggcccagggtagcccctgaagccaggaaatgagtcagccctaaccaaattccctagaaaggagtggttccccaaaaccaaagaggtattttccataaggggatatggatgtcttcctcaatccattatcctctctccctcccacggcatcccacagaacaggatttaccagtcccattctttttcttttct

SEQ ID NO: 446746 - DNA, 1946 bp, Homo sapiens
gcaggttggtacagccccggattaatgggatcctcagtgcaggcaacagggcccacatgccttggccccacataccaacccaggctgctgtgacagcccatgagagggggagaggttgctctgggatggaacaagaaaaagaggttgttttgtgaggactttaggttcaagatggtgactgcagccatgctgctacagtgctgcccagtgcttgcccggggccccacaagcctcctaggcaaggtggttaagactcaccagttcctgtttggtattggacgctgtcccatcctggctacccaaggaccaaactgttctcaaatccaccttaaggcaacaaaggctggaggagattctccatcttgggcgaagggccactgtcccttcatgctgtcggaactccaggatgggaagagcaagattgtgcagaaggcagccccagaagtccaggaagatgtgaaggctttcaagacaggaaactatgtcttcagttatgaccagtttttcagggacaagatcatggagaagaaacaggatcacacctaccgtgtgttcaagactgtgaaccgctgggctgatgcatatccctttgcccaacatttctctgaggcatctgtggcctcaaaggatgtgtccgtctggtgtagtaatgattacctgggcatgagccgacaccctcaggtcttgcaagccacacaggagaccctgcagcgtcatggtgctggagctggtggcacccgcaacatctcaggcaccagtaagtttcatgtggagcttgagcaggagctggctgagctgcaccagaaggactcagccctgctcttctcctcctgctttgttgccaatgactctactctcttcaccttggccaagatcctgccagggtgcgagatttactcagacgcaggcaaccatgcttccatgatccaaggtatccgtaacagtggagcagccaagtttgtcttcaggcacaatgaccctgaccacctaaagaaacttctagagaagtctaaccctaagatacccaaaattgtggcctttgagactgtccactccatggatggtgccatctgtcccctcgaggagttgtgtgatgtgtcccaccagtatggggccctgaccttcgtggatgaggtccatgctgtaggactgtatgggtcccggggcgctgggattggggagcgtgatggaattatgcataagattgacatcatctctggaactcttggcaaggcctttggctgtgtgggcggctacattgccagcacccgtgacttggtggacatggtgcgctcctatgctgcaggcttcatctttaccacttctctgccccccatggtgctctctggagctctagaatctgtgcggctgctcaagggagaggagggccaagccctgaggcgagcccaccagcgcaatgtcaagcacatgcgccagctactcatggacaggggccttcctgtcatcccctgccccagccacatcatccccatccgggtgggcaatgcagcactcaacagcaagctctgtgatctcctgctctccaagcatggcatctatgtgcaggccatcaactacccaactgtcccccggggtgaagagctcctgcgcttggcaccctccccccaccacagccctcagatgatggaagattttgtggagaagctgctgctggcttggactgcggtggggctgcccctccaggatgtgtctgtggctgcctgcaatttctgtcgccgtcctgtacactttgagctcatgagtgagtgggaacgttcctacttcgggaacatggggccccagtatgtcaccacctatgcctgagaagccagctgcctaggattcacaccccacctgcgcttcacttgggtccaggcctactcctgtcttctgctttgttgtgtgcctctagctgaattgagcctaaaaataaagcacaaaccaca

SEQ ID NO: 446747 - DNA, 2984 bp, Homo sapiens
cagcgggagaggggcggctccgcgtcatgtgactggagtccgcgtaggaggggtcggaggtcttacccaacagattgacgcggcgttagtattggccgtgtacccgaaaaactgattgactgggctggcgttaactgtgcggaggcagttggccgtgtttacatcagtggttggagaccagacctaacagacaggtgtgtcctgtttgcaaagctggcatcagccgagacaaggtcatccccctctatggaaggggcagcactgggcaacaggaccccagagagaagacccctcctcgtcctcaaggacagaggccagagccggagaatagagggggatttcaaggatttggatttggagatggtggcttccagatgtcttttggaattggggcatttccctttgggatatttgccacagcatttaatataaatgatgggcggcctcctccagctgtccctgggacaccccagtatgtggacgagcagttcctgtcacgcctcttcctatttgtggccctggtgatcatgttctggctcctgattgcctaatgctgggctcctgcctacatccgtggcagggctctggactggtgacgtgccaccccaactcctggtgtttggcttcctggctaatcttgactcctggaatcagtgggatcagtaacacatcaaggagtcttgtttcttcatcagagctttggaactcgagaccagttggcgatgacccctgaatatcgccaccgctgtaaacactctataacttcaggccttggcattgagtcatctctcatgggtgacaccatgaaatcttgtttcagccagttctgcaggtcctgactctgcagagggaagaggcagaaagagagaaactgtcagagtataatttcacctgagtttaatattacagaaacaaagggatgcaccaaatggtatttctggaaattttcatgtctttaaataccccttggtaagttgcttctgaagccagtgggggctcctcagatagagaggttcccctttcaaatcccagtgccgctctgttctctttccttcccctcccactccccctcttcttcctctgtagagatgcaagaaattgctgtcccataaaaatcataattgcagtagctaaagctggggtcacttcgtgaattcaccagagactcaaagatcttttattggctctgggctgtgctcagtgtctttggcctcagagaacaacttgaatgacttcctggtttcctggcataaattattcctggtgagacatgtggcttaactcacaggtttcccatcagctttctccctaaaactatgttcatctgcctctctctgccagagaacatacagccgagaatactgccgaagctgagactgactactgtgcattaggaaagacctggagtcaggactttggtgggatttggagctccgaggcagtaataactgaacaagcagccctgtcccctaggctgcagaagcttgaatgcatcctctcccagaacctgccacaggaaactgggggctttgtcaggtcagcccaactgcatgcaaaagaccaccatcctcagaagccaagttgtcttttatgaagaggcaaggaaaggggaaacccacatgtgaccctgattttggtatggcttgatagagttccctgaaaactccttgtatgtgtgctaaaaccagggaagcatgtgactgccaagcaggcaacccctgatgatttgtaaagccaggtggcagggccttggggagccccagcacaatgatattgtgtggtcttccctcctgtggaatcgaggggaaattattcttcccaataccttgatttgattttcagtttcataagcttcttcctctgaatcttattgagggactatggtaccaagcaggtaggactgttcacctggtggaacagttcttgctctgccttctaggcttcatcccagaaatccagcctctttctggagaccccaaagctggagggagatgggctttcctctgggcctctctcctactttgccatccacactgctcctggctaaccccagcaataaccaacaaatggtaggaagccccatctattgctttttctcaattatgactgcatagtttgtggaaacaaagatcttgaggaagatgagggaagccctcccctcttcatagtccccatctcttctcctttgtacctgtcaacaccagagttcagtgtttaaacagacaaaatataaagtattgagtaggtggttcatatgccgaatccacttggtaggaagaaaccaccagctttatagtgtgcctgatagattttaaacattcctgggcacccactcaagagtgctctttttatcaccttctggaaatccgcaaagttgcaggggcctctggagtgtctcttctctagagagaattggtgggacccccctcagtgcagtggccccaactagtggagggagagaggacttaagtcagatggactcaacagaaatgggtttccagaagaataatgaaaagttgtgggtaggaaaatgaatcatttggactcttcaatgaaatggagtgagcccaggagagctcagccaacagaggcactctgggaacctgttagtaaagccaggctggccaaatgccatttgattttgaacctcgtaggtccccactcaccctctgccaggagctaagtaaggcaggagagctgacttgggactcctggctcggccccaacagggagcccccttcccaccatccctcggcaagctcaccacctcatccttctgccaaggcagctttcctttcttttgtgtgttttctgtgttcttagcctccaccctcctcctgccacccttgtggactaggaccaggtcctgaccccagtcagaaaatgatgatatgtacagtggcacaccttaaccagtcactaattttcactgttgtgaaagtgatttgatttagaattaaacaaatggttttacattactatga

SEQ ID NO: 446748 - DNA, 2625 bp, Homo sapiens
cagcgggagaggggcggctccgcgtcatgtgactggagtccgcgtaggaggggtcggaggtcttacccaacagattgacgcggcgttagtattggccgtgtacccgaaaaactgattgactgggctggcgttaactgtgcggaggcaggatttccctggggaaagtcttcactcagagcttcgctgacagccaaggatggcaagcaaggggccctcggcctctgcatctcctgagaactccagtgcaggggggcccagtgggagcagcaatggcgctggcgagagcggagggcaggacagcactttcgagtgcaacatctgcttggacacagccaaggatgccgtcatcagcctgtgtggccacctcttctgttggccgtgtttacatcagtggttggagaccagacctaacagacaggtgtgtcctgtttgcaaagctggcatcagccgagacaaggtcatccccctctatggaaggggcagcactgggcaacaggaccccagagagaagacccctcctcgtcctcaaggacagaggccagagccggagaatagagggggatttcaaggatttggatttggagatggtggcttccagatgtcttttggaattggggcatttccctttgggatatttgccacagcatttaatataaatgatgggcggcctcctccagctgtccctgggacaccccagtatgtggacgagcagttcctgtcacgcctcttcctatttgtggccctggtgatcatgttctggctcctgattgcctaaagctggggtcacttcgtgaattcaccagagactcaaagatcttttattggctctgggctgtgctcagtgtctttggcctcagagaacaacttgaatgacttcctggtttcctggcataaattattcctggtgagacatgtggcttaactcacaggtttcccatcagctttctccctaaaactatgttcatctgcctctctctgccagagaacatacagccgagaatactgccgaagctgagactgactactgtgcattaggaaagacctggagtcaggactttggtgggatttggagctccgaggcagtaataactgaacaagcagccctgtcccctaggctgcagaagcttgaatgcatcctctcccagaacctgccacaggaaactgggggctttgtcaggtcagcccaactgcatgcaaaagaccaccatcctcagaagccaagttgtcttttatgaagaggcaaggaaaggggaaacccacatgtgaccctgattttggtatggcttgatagagttccctgaaaactccttgtatgtgtgctaaaaccagggaagcatgtgactgccaagcaggcaacccctgatgatttgtaaagccaggtggcagggccttggggagccccagcacaatgatattgtgtggtcttccctcctgtggaatcgaggggaaattattcttcccaataccttgatttgattttcagtttcataagcttcttcctctgaatcttattgagggactatggtaccaagcaggtaggactgttcacctggtggaacagttcttgctctgccttctaggcttcatcccagaaatccagcctctttctggagaccccaaagctggagggagatgggctttcctctgggcctctctcctactttgccatccacactgctcctggctaaccccagcaataaccaacaaatggtaggaagccccatctattgctttttctcaattatgactgcatagtttgtggaaacaaagatcttgaggaagatgagggaagccctcccctcttcatagtccccatctcttctcctttgtacctgtcaacaccagagttcagtgtttaaacagacaaaatataaagtattgagtaggtggttcatatgccgaatccacttggtaggaagaaaccaccagctttatagtgtgcctgatagattttaaacattcctgggcacccactcaagagtgctctttttatcaccttctggaaatccgcaaagttgcaggggcctctggagtgtctcttctctagagagaattggtgggacccccctcagtgcagtggccccaactagtggagggagagaggacttaagtcagatggactcaacagaaatgggtttccagaagaataatgaaaagttgtgggtaggaaaatgaatcatttggactcttcaatgaaatggagtgagcccaggagagctcagccaacagaggcactctgggaacctgttagtaaagccaggctggccaaatgccatttgattttgaacctcgtaggtccccactcaccctctgccaggagctaagtaaggcaggagagctgacttgggactcctggctcggccccaacagggagcccccttcccaccatccctcggcaagctcaccacctcatccttctgccaaggcagctttcctttcttttgtgtgttttctgtgttcttagcctccaccctcctcctgccacccttgtggactaggaccaggtcctgaccccagtcagaaaatgatgatatgtacagtggcacaccttaaccagtcactaattttcactgttgtgaaagtgatttgatttagaattaaacaaatggttttacattactatga

SEQ ID NO: 446749 - DNA, 599 bp, Homo sapiens
ctcgtgccgaattcggcatgaggagaattggtgggacccccctcagtgcagtggccccaactagtggagggagagaggacttaagtcagatggactcaacagaaatgggtttccagaagaataatgaaaagttgtgggtaggaaaatgaatcatttggactcttcaatgaaatggagtgagcccaggagagctcagccaacagaggcactctgggaacctgttagtaaagccaggctggccaaatgccatttgattttgaacctcgtaggtccccactcaccctctgccaggagctaagtaaggcaggagagctgacttgggactcctggctcggccccaacagggagcccccttcccaccatccctcggcaagctcaccacctcatccttctgccaaggcagctttcctttcttttgtgtgttttctgtgttcttagcctccaccctcctcctgccacccttgtggactaggaccaggtcctgaccccagtcagaaaatgatgatatgtacagtggcacaccttaaccagtcactaattttcactgttgtgaaagtgatttgatttagaattaaacaaatggttttacattactatga

SEQ ID NO: 446750 - DNA, 176 bp, Homo sapiens
gatgatatgtacagtggcacaccttaaccagtcatcattttctgactggggtcaggacctggtcccagtcagaaaatgatgatatgtacagtggcacaccttaaccagtcactaattttcactgttgtgaaagtgatttgatttagaattaaacaaatggttttacattactatga

SEQ ID NO: 446751 - DNA, 3208 bp, Homo sapiens
cagcgggagaggggcggctccgcgtcatgtgactggagtccgcgtaggaggggtcggaggtcttacccaacagattgacgcggcgttagtattggccgtgtacccgaaaaactgattgactgggctggcgttaactgtgcggaggcaggatttccctggggaaagtcttcactcagagcttcgctgacagccaaggatggcaagcaaggggccctcggcctctgcatctcctgagaactccagtgcaggggggcccagtgggagcagcaatggcgctggcgagagcggagggcaggacagcactttcgagtgcaacatctgcttggacacagccaaggatgccgtcatcagcctgtgtggccacctcttctgttggccgtgtttacatcagtggttggagaccagacctaacagacaggtgtgtcctgtttgcaaagctggcatcagccgagacaaggtcatccccctctatggaaggggcagcactgggcaacaggaccccagagagaagacccctcctcgtcctcaaggacagaggccagagccggagaatagagggggatttcaaggatttggatttggagatggtggcttccagatgtcttttggaattggggcatttccctttgggatatttgccacagcatttaatataaatgatgggcggcctcctccagctgtccctgggacaccccagtatgtggacgagcagttcctgtcacgcctcttcctatttgtggccctggtgatcatgttctggctcctgattgcctaatgctgggctcctgcctacatccgtggcagggctctggactggtgacgtgccaccccaactcctggtgtttggcttcctggctaatcttgactcctggaatcagtgggatcagtaacacatcaaggagtcttgtttcttcatcagagctttggaactcgagaccagttggcgatgacccctgaatatcgccaccgctgtaaacactctataacttcaggccttggcattgagtcatctctcatgggtgacaccatgaaatcttgtttcagccagttctgcaggtcctgactctgcagagggaagaggcagaaagagagaaactgtcagagtataatttcacctgagtttaatattacagaaacaaagggatgcaccaaatggtatttctggaaattttcatgtctttaaataccccttggtaagttgcttctgaagccagtgggggctcctcagatagagaggttcccctttcaaatcccagtgccgctctgttctctttccttcccctcccactccccctcttcttcctctgtagagatgcaagaaattgctgtcccataaaaatcataattgcagtagctaaagctggggtcacttcgtgaattcaccagagactcaaagatcttttattggctctgggctgtgctcagtgtctttggcctcagagaacaacttgaatgacttcctggtttcctggcataaattattcctggtgagacatgtggcttaactcacaggtttcccatcagctttctccctaaaactatgttcatctgcctctctctgccagagaacatacagccgagaatactgccgaagctgagactgactactgtgcattaggaaagacctggagtcaggactttggtgggatttggagctccgaggcagtaataactgaacaagcagccctgtcccctaggctgcagaagcttgaatgcatcctctcccagaacctgccacaggaaactgggggctttgtcaggtcagcccaactgcatgcaaaagaccaccatcctcagaagccaagttgtcttttatgaagaggcaaggaaaggggaaacccacatgtgaccctgattttggtatggcttgatagagttccctgaaaactccttgtatgtgtgctaaaaccagggaagcatgtgactgccaagcaggcaacccctgatgatttgtaaagccaggtggcagggccttggggagccccagcacaatgatattgtgtggtcttccctcctgtggaatcgaggggaaattattcttcccaataccttgatttgattttcagtttcataagcttcttcctctgaatcttattgagggactatggtaccaagcaggtaggactgttcacctggtggaacagttcttgctctgccttctaggcttcatcccagaaatccagcctctttctggagaccccaaagctggagggagatgggctttcctctgggcctctctcctactttgccatccacactgctcctggctaaccccagcaataaccaacaaatggtaggaagccccatctattgctttttctcaattatgactgcatagtttgtggaaacaaagatcttgaggaagatgagggaagccctcccctcttcatagtccccatctcttctcctttgtacctgtcaacaccagagttcagtgtttaaacagacaaaatataaagtattgagtaggtggttcatatgccgaatccacttggtaggaagaaaccaccagctttatagtgtgcctgatagattttaaacattcctgggcacccactcaagagtgctctttttatcaccttctggaaatccgcaaagttgcaggggcctctggagtgtctcttctctagagagaattggtgggacccccctcagtgcagtggccccaactagtggagggagagaggacttaagtcagatggactcaacagaaatgggtttccagaagaataatgaaaagttgtgggtaggaaaatgaatcatttggactcttcaatgaaatggagtgagcccaggagagctcagccaacagaggcactctgggaacctgttagtaaagccaggctggccaaatgccatttgattttgaacctcgtaggtccccactcaccctctgccaggagctaagtaaggcaggagagctgacttgggactcctggctcggccccaacagggagcccccttcccaccatccctcggcaagctcaccacctcatccttctgccaaggcagctttcctttcttttgtgtgttttctgtgttcttagcctccaccctcctcctgccacccttgtggactaggaccaggtcctgaccccagtcagaaaatgatgatatgtacagtggcacaccttaaccagtcactaattttcactgttgtgaaagtgatttgatttagaattaaacaaatggttttacattactatga

SEQ ID NO: 446752 - DNA, 3040 bp, Homo sapiens
cagcgggagaggggcggctccgcgtcatgtgactggagtccgcgtaggaggggtcggaggtcttacccaacagattgacgcggcgttagtattggccgtgtacccgaaaaactgattgactgggctggcgttaactgtgcggaggcaggatttccctggggaaagtcttcactcagagcttcgctgacagccaaggatggcaagcaaggggccctcggcctctgcatctcctgagaactccagtgcaggggggcccagtgggagcagcaatggcgctggcgagagcggagggcaggacagcactttcgagtgcaacatctgcttggacacagccaaggatgccgtcatcagcctgtgtggccacctcttctgttggccgtgtttacatcagggatttcaaggatttggatttggagatggtggcttccagatgtcttttggaattggggcatttccctttgggatatttgccacagcatttaatataaatgatgggcggcctcctccagctgtccctgggacaccccagtatgtggacgagcagttcctgtcacgcctcttcctatttgtggccctggtgatcatgttctggctcctgattgcctaatgctgggctcctgcctacatccgtggcagggctctggactggtgacgtgccaccccaactcctggtgtttggcttcctggctaatcttgactcctggaatcagtgggatcagtaacacatcaaggagtcttgtttcttcatcagagctttggaactcgagaccagttggcgatgacccctgaatatcgccaccgctgtaaacactctataacttcaggccttggcattgagtcatctctcatgggtgacaccatgaaatcttgtttcagccagttctgcaggtcctgactctgcagagggaagaggcagaaagagagaaactgtcagagtataatttcacctgagtttaatattacagaaacaaagggatgcaccaaatggtatttctggaaattttcatgtctttaaataccccttggtaagttgcttctgaagccagtgggggctcctcagatagagaggttcccctttcaaatcccagtgccgctctgttctctttccttcccctcccactccccctcttcttcctctgtagagatgcaagaaattgctgtcccataaaaatcataattgcagtagctaaagctggggtcacttcgtgaattcaccagagactcaaagatcttttattggctctgggctgtgctcagtgtctttggcctcagagaacaacttgaatgacttcctggtttcctggcataaattattcctggtgagacatgtggcttaactcacaggtttcccatcagctttctccctaaaactatgttcatctgcctctctctgccagagaacatacagccgagaatactgccgaagctgagactgactactgtgcattaggaaagacctggagtcaggactttggtgggatttggagctccgaggcagtaataactgaacaagcagccctgtcccctaggctgcagaagcttgaatgcatcctctcccagaacctgccacaggaaactgggggctttgtcaggtcagcccaactgcatgcaaaagaccaccatcctcagaagccaagttgtcttttatgaagaggcaaggaaaggggaaacccacatgtgaccctgattttggtatggcttgatagagttccctgaaaactccttgtatgtgtgctaaaaccagggaagcatgtgactgccaagcaggcaacccctgatgatttgtaaagccaggtggcagggccttggggagccccagcacaatgatattgtgtggtcttccctcctgtggaatcgaggggaaattattcttcccaataccttgatttgattttcagtttcataagcttcttcctctgaatcttattgagggactatggtaccaagcaggtaggactgttcacctggtggaacagttcttgctctgccttctaggcttcatcccagaaatccagcctctttctggagaccccaaagctggagggagatgggctttcctctgggcctctctcctactttgccatccacactgctcctggctaaccccagcaataaccaacaaatggtaggaagccccatctattgctttttctcaattatgactgcatagtttgtggaaacaaagatcttgaggaagatgagggaagccctcccctcttcatagtccccatctcttctcctttgtacctgtcaacaccagagttcagtgtttaaacagacaaaatataaagtattgagtaggtggttcatatgccgaatccacttggtaggaagaaaccaccagctttatagtgtgcctgatagattttaaacattcctgggcacccactcaagagtgctctttttatcaccttctggaaatccgcaaagttgcaggggcctctggagtgtctcttctctagagagaattggtgggacccccctcagtgcagtggccccaactagtggagggagagaggacttaagtcagatggactcaacagaaatgggtttccagaagaataatgaaaagttgtgggtaggaaaatgaatcatttggactcttcaatgaaatggagtgagcccaggagagctcagccaacagaggcactctgggaacctgttagtaaagccaggctggccaaatgccatttgattttgaacctcgtaggtccccactcaccctctgccaggagctaagtaaggcaggagagctgacttgggactcctggctcggccccaacagggagcccccttcccaccatccctcggcaagctcaccacctcatccttctgccaaggcagctttcctttcttttgtgtgttttctgtgttcttagcctccaccctcctcctgccacccttgtggactaggaccaggtcctgaccccagtcagaaaatgatgatatgtacagtggcacaccttaaccagtcactaattttcactgttgtgaaagtgatttgatttagaattaaacaaatggttttacattactatga

SEQ ID NO: 446753 - DNA, 3021 bp, Homo sapiens
cagcgggagaggggcggctccgcgtcatgtgactggagtccgcgtaggaggggtcggaggtcttacccaacagattgacgcggcgttagtattggccgtgtacccgaaaaactgattgactgggctggcgttaactgtgcggaggcaggatttccctggggaaagtcttcactcagagcttcgctgacagccaaggatggcaagcaaggggccctcggcctctgcatctcctgagaactccagtgcaggggggcccagtgggagcagcaatggcgctggcgagagcggagggcaggacagcactttcgagtgcaacatctgcttggacacagccaaggatgccgtcatcagcctgtgtggccacctcttctgggatttcaaggatttggatttggagatggtggcttccagatgtcttttggaattggggcatttccctttgggatatttgccacagcatttaatataaatgatgggcggcctcctccagctgtccctgggacaccccagtatgtggacgagcagttcctgtcacgcctcttcctatttgtggccctggtgatcatgttctggctcctgattgcctaatgctgggctcctgcctacatccgtggcagggctctggactggtgacgtgccaccccaactcctggtgtttggcttcctggctaatcttgactcctggaatcagtgggatcagtaacacatcaaggagtcttgtttcttcatcagagctttggaactcgagaccagttggcgatgacccctgaatatcgccaccgctgtaaacactctataacttcaggccttggcattgagtcatctctcatgggtgacaccatgaaatcttgtttcagccagttctgcaggtcctgactctgcagagggaagaggcagaaagagagaaactgtcagagtataatttcacctgagtttaatattacagaaacaaagggatgcaccaaatggtatttctggaaattttcatgtctttaaataccccttggtaagttgcttctgaagccagtgggggctcctcagatagagaggttcccctttcaaatcccagtgccgctctgttctctttccttcccctcccactccccctcttcttcctctgtagagatgcaagaaattgctgtcccataaaaatcataattgcagtagctaaagctggggtcacttcgtgaattcaccagagactcaaagatcttttattggctctgggctgtgctcagtgtctttggcctcagagaacaacttgaatgacttcctggtttcctggcataaattattcctggtgagacatgtggcttaactcacaggtttcccatcagctttctccctaaaactatgttcatctgcctctctctgccagagaacatacagccgagaatactgccgaagctgagactgactactgtgcattaggaaagacctggagtcaggactttggtgggatttggagctccgaggcagtaataactgaacaagcagccctgtcccctaggctgcagaagcttgaatgcatcctctcccagaacctgccacaggaaactgggggctttgtcaggtcagcccaactgcatgcaaaagaccaccatcctcagaagccaagttgtcttttatgaagaggcaaggaaaggggaaacccacatgtgaccctgattttggtatggcttgatagagttccctgaaaactccttgtatgtgtgctaaaaccagggaagcatgtgactgccaagcaggcaacccctgatgatttgtaaagccaggtggcagggccttggggagccccagcacaatgatattgtgtggtcttccctcctgtggaatcgaggggaaattattcttcccaataccttgatttgattttcagtttcataagcttcttcctctgaatcttattgagggactatggtaccaagcaggtaggactgttcacctggtggaacagttcttgctctgccttctaggcttcatcccagaaatccagcctctttctggagaccccaaagctggagggagatgggctttcctctgggcctctctcctactttgccatccacactgctcctggctaaccccagcaataaccaacaaatggtaggaagccccatctattgctttttctcaattatgactgcatagtttgtggaaacaaagatcttgaggaagatgagggaagccctcccctcttcatagtccccatctcttctcctttgtacctgtcaacaccagagttcagtgtttaaacagacaaaatataaagtattgagtaggtggttcatatgccgaatccacttggtaggaagaaaccaccagctttatagtgtgcctgatagattttaaacattcctgggcacccactcaagagtgctctttttatcaccttctggaaatccgcaaagttgcaggggcctctggagtgtctcttctctagagagaattggtgggacccccctcagtgcagtggccccaactagtggagggagagaggacttaagtcagatggactcaacagaaatgggtttccagaagaataatgaaaagttgtgggtaggaaaatgaatcatttggactcttcaatgaaatggagtgagcccaggagagctcagccaacagaggcactctgggaacctgttagtaaagccaggctggccaaatgccatttgattttgaacctcgtaggtccccactcaccctctgccaggagctaagtaaggcaggagagctgacttgggactcctggctcggccccaacagggagcccccttcccaccatccctcggcaagctcaccacctcatccttctgccaaggcagctttcctttcttttgtgtgttttctgtgttcttagcctccaccctcctcctgccacccttgtggactaggaccaggtcctgaccccagtcagaaaatgatgatatgtacagtggcacaccttaaccagtcactaattttcactgttgtgaaagtgatttgatttagaattaaacaaatggttttacattactatga

SEQ ID NO: 446754 - DNA, 2797 bp, Homo sapiens
cagcgggagaggggcggctccgcgtcatgtgactggagtccgcgtaggaggggtcggaggtcttacccaacagattgacgcggcgttagtattggccgtgtacccgaaaaactgattgactgggctggcgttaactgtgcggaggcagggatttcaaggatttggatttggagatggtggcttccagatgtcttttggaattggggcatttccctttgggatatttgccacagcatttaatataaatgatgggcggcctcctccagctgtccctgggacaccccagtatgtggacgagcagttcctgtcacgcctcttcctatttgtggccctggtgatcatgttctggctcctgattgcctaatgctgggctcctgcctacatccgtggcagggctctggactggtgacgtgccaccccaactcctggtgtttggcttcctggctaatcttgactcctggaatcagtgggatcagtaacacatcaaggagtcttgtttcttcatcagagctttggaactcgagaccagttggcgatgacccctgaatatcgccaccgctgtaaacactctataacttcaggccttggcattgagtcatctctcatgggtgacaccatgaaatcttgtttcagccagttctgcaggtcctgactctgcagagggaagaggcagaaagagagaaactgtcagagtataatttcacctgagtttaatattacagaaacaaagggatgcaccaaatggtatttctggaaattttcatgtctttaaataccccttggtaagttgcttctgaagccagtgggggctcctcagatagagaggttcccctttcaaatcccagtgccgctctgttctctttccttcccctcccactccccctcttcttcctctgtagagatgcaagaaattgctgtcccataaaaatcataattgcagtagctaaagctggggtcacttcgtgaattcaccagagactcaaagatcttttattggctctgggctgtgctcagtgtctttggcctcagagaacaacttgaatgacttcctggtttcctggcataaattattcctggtgagacatgtggcttaactcacaggtttcccatcagctttctccctaaaactatgttcatctgcctctctctgccagagaacatacagccgagaatactgccgaagctgagactgactactgtgcattaggaaagacctggagtcaggactttggtgggatttggagctccgaggcagtaataactgaacaagcagccctgtcccctaggctgcagaagcttgaatgcatcctctcccagaacctgccacaggaaactgggggctttgtcaggtcagcccaactgcatgcaaaagaccaccatcctcagaagccaagttgtcttttatgaagaggcaaggaaaggggaaacccacatgtgaccctgattttggtatggcttgatagagttccctgaaaactccttgtatgtgtgctaaaaccagggaagcatgtgactgccaagcaggcaacccctgatgatttgtaaagccaggtggcagggccttggggagccccagcacaatgatattgtgtggtcttccctcctgtggaatcgaggggaaattattcttcccaataccttgatttgattttcagtttcataagcttcttcctctgaatcttattgagggactatggtaccaagcaggtaggactgttcacctggtggaacagttcttgctctgccttctaggcttcatcccagaaatccagcctctttctggagaccccaaagctggagggagatgggctttcctctgggcctctctcctactttgccatccacactgctcctggctaaccccagcaataaccaacaaatggtaggaagccccatctattgctttttctcaattatgactgcatagtttgtggaaacaaagatcttgaggaagatgagggaagccctcccctcttcatagtccccatctcttctcctttgtacctgtcaacaccagagttcagtgtttaaacagacaaaatataaagtattgagtaggtggttcatatgccgaatccacttggtaggaagaaaccaccagctttatagtgtgcctgatagattttaaacattcctgggcacccactcaagagtgctctttttatcaccttctggaaatccgcaaagttgcaggggcctctggagtgtctcttctctagagagaattggtgggacccccctcagtgcagtggccccaactagtggagggagagaggacttaagtcagatggactcaacagaaatgggtttccagaagaataatgaaaagttgtgggtaggaaaatgaatcatttggactcttcaatgaaatggagtgagcccaggagagctcagccaacagaggcactctgggaacctgttagtaaagccaggctggccaaatgccatttgattttgaacctcgtaggtccccactcaccctctgccaggagctaagtaaggcaggagagctgacttgggactcctggctcggccccaacagggagcccccttcccaccatccctcggcaagctcaccacctcatccttctgccaaggcagctttcctttcttttgtgtgttttctgtgttcttagcctccaccctcctcctgccacccttgtggactaggaccaggtcctgaccccagtcagaaaatgatgatatgtacagtggcacaccttaaccagtcactaattttcactgttgtgaaagtgatttgatttagaattaaacaaatggttttacattactatga

SEQ ID NO: 446755 - DNA, 2509 bp, Homo sapiens
cagcgggagaggggcggctccgcgtcatgtgactggagtccgcgtaggaggggtcggaggtcttacccaacagattgacgcggcgttagtattggccgtgtacccgaaaaactgattgagacgtgccaccccaactcctggtgtttggcttcctggctaatcttgactcctggaatcagtgggatcagtaacacatcaaggagtcttgtttcttcatcagagctttggaactcgagaccagttggcgatgacccctgaatatcgccaccgctgtaaacactctataacttcaggccttggcattgagtcatctctcatgggtgacaccatgaaatcttgtttcagccagttctgcaggtcctgactctgcagagggaagaggcagaaagagagaaactgtcagagtataatttcacctgagtttaatattacagaaacaaagggatgcaccaaatggtatttctggaaattttcatgtctttaaataccccttggtaagttgcttctgaagccagtgggggctcctcagatagagaggttcccctttcaaatcccagtgccgctctgttctctttccttcccctcccactccccctcttcttcctctgtagagatgcaagaaattgctgtcccataaaaatcataattgcagtagctaaagctggggtcacttcgtgaattcaccagagactcaaagatcttttattggctctgggctgtgctcagtgtctttggcctcagagaacaacttgaatgacttcctggtttcctggcataaattattcctggtgagacatgtggcttaactcacaggtttcccatcagctttctccctaaaactatgttcatctgcctctctctgccagagaacatacagccgagaatactgccgaagctgagactgactactgtgcattaggaaagacctggagtcaggactttggtgggatttggagctccgaggcagtaataactgaacaagcagccctgtcccctaggctgcagaagcttgaatgcatcctctcccagaacctgccacaggaaactgggggctttgtcaggtcagcccaactgcatgcaaaagaccaccatcctcagaagccaagttgtcttttatgaagaggcaaggaaaggggaaacccacatgtgaccctgattttggtatggcttgatagagttccctgaaaactccttgtatgtgtgctaaaaccagggaagcatgtgactgccaagcaggcaacccctgatgatttgtaaagccaggtggcagggccttggggagccccagcacaatgatattgtgtggtcttccctcctgtggaatcgaggggaaattattcttcccaataccttgatttgattttcagtttcataagcttcttcctctgaatcttattgagggactatggtaccaagcaggtaggactgttcacctggtggaacagttcttgctctgccttctaggcttcatcccagaaatccagcctctttctggagaccccaaagctggagggagatgggctttcctctgggcctctctcctactttgccatccacactgctcctggctaaccccagcaataaccaacaaatggtaggaagccccatctattgctttttctcaattatgactgcatagtttgtggaaacaaagatcttgaggaagatgagggaagccctcccctcttcatagtccccatctcttctcctttgtacctgtcaacaccagagttcagtgtttaaacagacaaaatataaagtattgagtaggtggttcatatgccgaatccacttggtaggaagaaaccaccagctttatagtgtgcctgatagattttaaacattcctgggcacccactcaagagtgctctttttatcaccttctggaaatccgcaaagttgcaggggcctctggagtgtctcttctctagagagaattggtgggacccccctcagtgcagtggccccaactagtggagggagagaggacttaagtcagatggactcaacagaaatgggtttccagaagaataatgaaaagttgtgggtaggaaaatgaatcatttggactcttcaatgaaatggagtgagcccaggagagctcagccaacagaggcactctgggaacctgttagtaaagccaggctggccaaatgccatttgattttgaacctcgtaggtccccactcaccctctgccaggagctaagtaaggcaggagagctgacttgggactcctggctcggccccaacagggagcccccttcccaccatccctcggcaagctcaccacctcatccttctgccaaggcagctttcctttcttttgtgtgttttctgtgttcttagcctccaccctcctcctgccacccttgtggactaggaccaggtcctgaccccagtcagaaaatgatgatatgtacagtggcacaccttaaccagtcactaattttcactgttgtgaaagtgatttgatttagaattaaacaaatggttttacattactatga

SEQ ID NO: 446756 - DNA, 2425 bp, Homo sapiens
cagcgggagaggggcggctccgcgtcatgtgactggagtccgcgtaggaggggtcggaggtcttacccaacagattgacgcggcgttagtattggccgtgtacccgaaaaactgattgactgggctggcgttaactgtgcggaggcagggatttcaaggatttggatttggagatggtggcttccagatgtcttttggaattggggcatttccctttgggatatttgccacagcatttaatataaatgatgggcggcctcctccagctgtccctgggacaccccagtatgtggacgagcagttcctgtcacgcctcttcctatttgtggccctggtgatcatgttctggctcctgattgcctaatgctgggctcctgcctacatccgtggcagggctctggactggtgacgtgccaccccaactcctggtgtttggcttcctggctaatcttgactcctggaatcagtgggatcagtaacacatcaaggagtcttgtttcttcatcagagctttggaactcgagaccagttggcgatgacccctgaatatcgccaccgctgtaaacactctataacttcaggccttggcattgagtcatctctcatgggtgacaccatgaaatcttgtttcagccagttctgcaggtcctgactctgcagagggaagaggcagaaagagagaaactgtcagagtataatttcacctgagtttaatattacagaaacaaagggatgcaccaaatggtatttctggaaattttcatgtctttaaataccccttgagaacatacagccgagaatactgccgaagctgagactgactactgtgcattaggaaagacctggagtcaggactttggtgggatttggagctccgaggcagtaataactgaacaagcagccctgtcccctaggctgcagaagcttgaatgcatcctctcccagaacctgccacaggaaactgggggctttgtcaggtcagcccaactgcatgcaaaagaccaccatcctcagaagccaagttgtcttttatgaagaggcaaggaaaggggaaacccacatgtgaccctgattttggtatggcttgatagagttccctgaaaactccttgtatgtgtgctaaaaccagggaagcatgtgactgccaagcaggcaacccctgatgatttgtaaagccaggtggcagggccttggggagccccagcacaatgatattgtgtggtcttccctcctgtggaatcgaggggaaattattcttcccaataccttgatttgattttcagtttcataagcttcttcctctgaatcttattgagggactatggtaccaagcaggtaggactgttcacctggtggaacagttcttgctctgccttctaggcttcatcccagaaatccagcctctttctggagaccccaaagctggagggagatgggctttcctctgggcctctctcctactttgccatccacactgctcctggctaaccccagcaataaccaacaaatggtaggaagccccatctattgctttttctcaattatgactgcatagtttgtggaaacaaagatcttgaggaagatgagggaagccctcccctcttcatagtccccatctcttctcctttgtacctgtcaacaccagagttcagtgtttaaacagacaaaatataaagtattgagtaggtggttcatatgccgaatccacttggtaggaagaaaccaccagctttatagtgtgcctgatagattttaaacattcctgggcacccactcaagagtgctctttttatcaccttctggaaatccgcaaagttgcaggggcctctggagtgtctcttctctagagagaattggtgggacccccctcagtgcagtggccccaactagtggagggagagaggacttaagtcagatggactcaacagaaatgggtttccagaagaataatgaaaagttgtgggtaggaaaatgaatcatttggactcttcaatgaaatggagtgagcccaggagagctcagccaacagaggcactctgggaacctgttagtaaagccaggctggccaaatgccatttgattttgaacctcgtaggtccccactcaccctctgccaggagctaagtaaggcaggagagctgacttgggactcctggctcggccccaacagggagcccccttcccaccatccctcggcaagctcaccacctcatccttctgccaaggcagctttcctttcttttgtgtgttttctgtgttcttagcctccaccctcctcctgccacccttgtggactaggaccaggtcctgaccccagtcagaaaatgatgatatgtacagtggcacaccttaaccagtcactaattttcactgttgtgaaagtgatttgatttagaattaaacaaatggttttacattactatga

SEQ ID NO: 446757 - DNA, 2113 bp, Homo sapiens
cagcgggagaggggcggctccgcgtcatgtgactggagtccgcgtaggaggggtcggaggtcttacccaacagattgacgcggcgttagtattggccgtgtacccgaaaaactgattgactgggctggcgttaactgtgcggaggcaggatttccctggggaaagtcttcactcagagcttcgctgacagccaaggatggcaagcaaggggccctcggcctctgcatctcctgagaactccagtgcaggggggcccagtgggagcagcaatggcgctggcgagagcggagggcaggacagcactttcgagtgcaacatctgcttggacacagccaaggatgccgtcatcagcctgtgtggccacctcttctgttggccgtgtttacatcagtggttggagaccagacctaacagacaggtgtgtcctgtttgcaaagctggcatcagccgagacaaggtcatccccctctatggaaggggcagcactgggcaacaggaccccagagagaagacccctcctcgtcctcaaggacagaggccagagccggagaatagagggggatttcaaggatttggatttggagatggtggcttccagatgtcttttggaattggggcatttccctttgggatatttgccacagcatttaatataaatgatgggcggcctcctccagctgtccctgggacaccccagtatgtggacgagcagttcctgtcacgcctcttcctatttgtggccctggtgatcatgttctggctcctgattgcctaatgctgggctcctgcctacatccgtggcagggctctggactggtgacgtgccaccccaactcctggtgtttggcttcctggctaatcttgactcctggaatcagtgggatcagtaacacatcaaggagtcttgtttcttcatcagagctttggaactcgagaccagttggcgatgacccctgaatatcgccaccgctgtaaacactctataacttcaggccttggcattgagtcatctctcatgggtgacaccatgaaatcttgtttcagccagttctgcaggtcctgactctgcagagggaagaggcagaaagagagaaactgtcagagtataatttcacctgagtttaatattacagaaacaaagggatgcaccaaatggtatttctggaaattttcatgtctttaaataccccttggtaagttgcttctgaagccagtgggggctcctcagatagagaggttcccctttcaaatcccagtgccgctctgttctctttccttccccctcccctcttcatagtccccatctcttctcctttgtacctgtcaacaccagagttcagtgtttaaacagacaaaatataaagtattgagtaggtggttcatatgccgaatccacttggtaggaagaaaccaccagctttatagtgtgcctgatagattttaaacattcctgggcacccactcaagagtgctctttttatcaccttctggaaatccgcaaagttgcaggggcctctggagtgtctcttctctagagagaattggtgggacccccctcagtgcagtggccccaactagtggagggagagaggacttaagtcagatggactcaacagaaatgggtttccagaagaataatgaaaagttgtgggtaggaaaatgaatcatttggactcttcaatgaaatggagtgagcccaggagagctcagccaacagaggcactctgggaacctgttagtaaagccaggctggccaaatgccatttgattttgaacctcgtaggtccccactcaccctctgccaggagctaagtaaggcaggagagctgacttgggactcctggctcggccccaacagggagcccccttcccaccatccctcggcaagctcaccacctcatccttctgccaaggcagctttcctttcttttgtgtgttttctgtgttcttagcctccaccctcctcctgccacccttgtggactaggaccaggtcctgaccccagtcagaaaatgatgatatgtacagtggcacaccttaaccagtcactaattttcactgttgtgaaagtgatttgatttagaattaaacaaatggttttacattactatga

SEQ ID NO: 446758 - DNA, 2926 bp, Homo sapiens
cagcgggagaggggcggctccgcgtcatgtgactggagtccgcgtaggaggggtcggaggtcttacccaacagattgacgcggcgttagtattggccgtgtacccgaaaaactgattgactgggctggcgttaactgtgcggaggcaggatttccctggggaaagtcttcactcagagcttcgctgacagccaaggatggcaagcaaggggccctcggcctctgcatctcctgagaactccagtgcaggggggcccagtgggagcagcaatggcgctggcgagagcggagggcaggacagcactttcgagtgcaacatctgcttggacacagccaaggatgccgtcatcagcctgtgtggccacctcttctgttggccgtgtttacatcagtggttggagaccagacctaacagacaggtgtgtcctgtttgcaaagctggcatcagccgagacaaggtcatccccctctatggaaggggcagcactgggcaacaggaccccagagagaagacccctcctcgtcctcaaggacagaggccagagccggagaatagagggggatttcaaggatttggatttggagatggtggcttccagatgtcttttggaattggggcatttccctttgggatatttgccacagcatttaatataaatgatgggcggcctcctccagctgtccctgggacaccccagtatgtggacgagcagttcctgtcacgcctcttcctatttgtggccctggtgatcatgttctggctcctgattgcctaatgctgggctcctgcctacatccgtggcagggctctggactggtgacgtgccaccccaactcctggtgtttggcttcctggctaatcttgactcctggaatcagtgggatcagtaacacatcaaggagtcttgtttcttcatcagagctttggaactcgagaccagttggcgatgacccctgaatatcgccaccgctgtaaacactctataacttcaggccttggcattgagtcatctctcatgggtgacaccatgaaatcttgtttcagccagttctgcaggtcctgactctgcagagggaagaggcagaaagagagaaactgtcagagtataatttcacctgagtttaatattacagaaacaaagggatgcaccaaatggtatttctggaaattttcatgtctttaaataccccttggtaagttgcttctgaagccagtgggggctcctcagatagagaggttcccctttcaaatcccagtgccgctctgttctctttccttcccctcccactccccctcttcttcctctgtagagatgcaagaaattgctgtcccataaaaatcataattgcagtagctaaagctggggtcacttcgtgaattcaccagagactcaaagatcttttattggctctgggctgtgctcagtgtctttggcctcagagaacaacttgaatgacttcctggtttcctggcataaattattcctggtgagacatgtggcttaactcacaggtttcccatcagctttctccctaaaactatgttcatctgcctctctctgccagagaacatacagccgagaatactgccgaagctgagactgactactgtgcattaggaaagacctggagtcaggactttggtgggatttggagctccgaggcagtaataactgaacaagcagccctgtcccctaggctgcagaagcttgaatgcatcctctcccagaacctgccacaggaaactgggggctttgtcaggtcagcccaactgcatgcaaaagaccaccatcctcagaagccaagttgtcttttatgaagaggcaaggaaaggggaaacccacatgtgaccctgattttggtatggcttgatagagttccctgaaaactccttgtatgtgtgctaaaaccagggaagcatgtgactgccaagcaggcaacccctgatgatttgtaaagccaggtggcagggccttggggagccccagcacaatgatattgtgtggtcttccctcctgtggaatcgaggggaaattattcttcccaataccttgatttgattttcagtttcataagcttcttcctctgaatcttattgagggactatggtaccaagcaggtaggactgttcacctggtggaacagttcttgctctgccttctaggcttcatcccagaaatccagcctctttctggagaccccaaagctggagggagatgggctttcctctgggcctctctcctactttgccatccacactgctcctggctaaccccagcaataaccaacaaatggtaggaagccccatctattgctttttctcaattatgactgcatagtttgtggaaacaaagatcttgaggaagatgagggaagccctcccctcttcatagtccccatctcttctcctttgtacctgtcaacaccagagttcagtgtttaaacagacaaaatataaagtattgagtaggtggttcatatgccgaatccacttggtaggaagaaaccaccagctttatagtgtgcctgatagattttaaacattcctgggcacccactcaagagtgctctttttatcaccttctggaaatccgcaaagttgcaggggcctctggagtgtctcttctctagagagaattggtgggacccccctcagtgcagtggccccaaagggagcccccttcccaccatccctcggcaagctcaccacctcatccttctgccaaggcagctttcctttcttttgtgtgttttctgtgttcttagcctccaccctcctcctgccacccttgtggactaggaccaggtcctgaccccagtcagaaaatgatgatatgtacagtggcacaccttaaccagtcactaattttcactgttgtgaaagtgatttgatttagaattaaacaaatggttttacattactatga

SEQ ID NO: 446759 - DNA, 1068 bp, Homo sapiens
cagcgggagaggggcggctccgcgtcatgtgactggagtccgcgtaggaggggtcggaggtcttacccaacagattgacgcggcgttagtattggccgtgtacccgaaaaactgattgactgggctggcgttaactgtgcggaggcaggatttccctggggaaagtcttcactcagagcttcgctgacagccaaggatggcaagcaaggggccctcggcctctgcatctcctgagaactccagtgcaggggggcccagtgggagcagcaatggcgctggcgagagcggagggcaggacagcactttcgagtgcaacatctgcttggacacagccaaggatgccgtcatcagcctgtgtggccacctcttctgttggccgtgtttacatcagtggttggagaccagacctaacagacaggtgtgtcctgtttgcaaagctggcatcagccgagacaaggtcatccccctctatggaaggggcagcactgggcaacaggaccccagagagaagacccctcctcgtcctcaaggacagaggccagagccggagaatagagggggatttcaaggatttggatttggagatggtggcttccagatgtcttttggaattggggcatttccctttgggatatttgccacagcatttaatataaatgatgggcggcctcctccagctgtccctgggacaccccagtatgtggacgagcagttcctgtcacgcctcttcctatttgtggccctggtgatcatgttctggctcctgattgcctaatgctgggctcctgcctacatccgtggcagggctctggactggtgccatttgattttgaacctcgtaggtccccactcaccctctgccaggagctaagtaaggcaggagagctgacttgggactcctggctcggccccaacagggagcccccttcccaccatccctcggcaagctcaccaccccagtcagaaaatgatgatatgtacagtggcacaccttaaccagtcactaattttcactgttgtgaaagtgatttgatttagaattaaacaaatggttttacattactatga

SEQ ID NO: 446760 - DNA, 534 bp, Homo sapiens
ggagcagtttggaccaggttttctgatgtcatctccccagcctccggatcatcacaaaccatgtcatctccctgggcctccagctcaggatctttcacttcaaattctttctgggtactggttccttcagttgctacatttttacttttcttcaacttgatctttttctttggtgagctagactttccctcctcctcctcctcttcttctgaaacagcttgtgcctttctcttgggtgcttcctttgagaagagactggagggattcttggcaggggagaccaactggtaatctgtcaattcctcaaagctcaccacctcatccttctgccaaggcagctttcctttcttttgtgtgttttctgtgttcttagcctccaccctcctcctgccacccttgtggactaggaccaggtcctgaccccagtcagaaaatgatgatatgtacagtggcacaccttaaccagtcactaattttcactgttgtgaaagtgatttgatttagaattaaacaaatggttttacattactatga

SEQ ID NO: 446761 - DNA, 945 bp, Homo sapiens
cagcgggagaggggcggctccgcgtcatgtgactggagtccgcgtaggaggggtcggaggtcttacccaacagattgacgcggcgttagtattggccgtgtacccgaaaaactgattgactgggctggcgttaactgtgcggaggcagaatctcgctctgtcgcccaggctggagtgcagtgggctcgctgcagcctctccctcccaggttcaagcaattctcctgtgtcagactcccagctgctccaaatcctgggctcaagcaatcttcctgcctcagcctcccaaagtgctaggaatgcaggatttccctggggaaagtcttcactcagagcttcgctgacagccaaggatggcaagcaaggggccctcggcctctgcatctcctgagaactccagtgcaggggggcccagtgggagcagcaatggcgctggcgagagcggagggcaggacagcactttcgagtgcaacatctgcttggacacagccaaggatgccgtcatcagcctgtgtggccacctcttctgttggccgtgtttacatcagtggttggagaccagacctaacagacaggtgtgtcctgtttgcaaagctggcatcagccgagacaaggtcatccccctctatggaaggggcagcactgggcaacaggaccccagagagaagacccctcctcgtcctcaaggacagaggccagagccggagaatagagggggatttcaaggatttggatttggagatggtggcttccagatgtcttttgtgtgttttctgtgttcttagcctccaccctcctcctgccacccttgtggactaggaccaggtcctgaccccagtcagaaaatgatgatatgtacagtggcacaccttaaccagtcactaattttcactgttgtgaaagtgatttgatttagaattaaacaaatggttttacattactatga

SEQ ID NO: 446762 - DNA, 453 bp, Homo sapiens
cgtcatcagcctgtgtggccacctcttctggtcagtacccctacttccaccccagagagcacattgccaagtttggaaagcctgtggccctgggtggtttggagcagaatgcttcctgctcactttgggaatacactcaggctcaagggacaagagacctgagttcccatcccagctctgctaccaatgagctggatgaccttgggcaaatcctgtctccactctaagctcgttctccccatctctaaagtaataatacttaccatttagtgagcacttactacctgctacttgctgtgctgagcctagaggcagtatagcataatggttataagcaaggactgtggaactgggcttcctccttttgaagcttgactctgccaccttcctgtttgaccttggacaaggtacttacacacattctgcctcattttacagggtcgtttgcaagca

SEQ ID NO: 446763 - DNA, 795 bp, Homo sapiens
cagcgggagaggggcggctccgcgtcatgtgactggagtccgcgtaggaggggtcggaggtcttacccaacagattgacgcggcgttagtattggccgtgtacccgaaaaactgattgactgggctggcgttaactgtgcggaggcagaactttattgtttgtcctgtagaaagtcccacattctggatttggctgatgacatcttcatggagtcgtttaatacttgcacctatcctccatattttctgtaaataggatttccctggggaaagtcttcactcagagcttcgctgacagccaaggatggcaagcaaggggccctcggcctctgcatctcctgagaactccagtgcaggggggcccagtgggagcagcaatggcgctggcgagagcggagggcaggacagcactttcgagtgcaacatctgcttggacacagccaaggatgccgtcatcagcctgtgtggccacctcttctgttggccgtgtttacatcagtggttggagaccagacctaacagacaggtgtgtcctgtttgcaaagctggcatcagccgagacaaggtcatccccctctatggaaggggcagcactgggcaacaggaccccagagagaagacccctcctcgtcctcaaggacagaggccagagccggagaatagaggggtgaggaacattctaggagaagcttctacaaatgagctgatggctttagaagtttccttcttagccttacaatttttctccttgattataaaagtaaaggaaaacttgtaaaatacagaaaggaaaag

SEQ ID NO: 446764 - DNA, 3364 bp, Homo sapiens
cagcgggagaggggcggctccgcgtcatgtgactggagtccgcgtaggaggggtcggaggtcttacccaacagattgacgcggcgttagtattggccgtgtacccgaaaaactgattgactgggctggcgttaactgtgcggaggcagaatctcgctctgtcgcccaggctggagtgcagtgggctcgctgcagcctctccctcccaggttcaagcaattctcctgtgtcagactcccagctgctccaaatcctgggctcaagcaatcttcctgcctcagcctcccaaagtgctaggaatgcaggatttccctggggaaagtcttcactcagagcttcgctgacagccaaggatggcaagcaaggggccctcggcctctgcatctcctgagaactccagtgcaggggggcccagtgggagcagcaatggcgctggcgagagcggagggcaggacagcactttcgagtgcaacatctgcttggacacagccaaggatgccgtcatcagcctgtgtggccacctcttctgttggccgtgtttacatcagtggttggagaccagacctaacagacaggtgtgtcctgtttgcaaagctggcatcagccgagacaaggtcatccccctctatggaaggggcagcactgggcaacaggaccccagagagaagacccctcctcgtcctcaaggacagaggccagagccggagaatagagggggatttcaaggatttggatttggagatggtggcttccagatgtcttttggaattggggcatttccctttgggatatttgccacagcatttaatataaatgatgggcggcctcctccagctgtccctgggacaccccagtatgtggacgagcagttcctgtcacgcctcttcctatttgtggccctggtgatcatgttctggctcctgattgcctaatgctgggctcctgcctacatccgtggcagggctctggactggtgacgtgccaccccaactcctggtgtttggcttcctggctaatcttgactcctggaatcagtgggatcagtaacacatcaaggagtcttgtttcttcatcagagctttggaactcgagaccagttggcgatgacccctgaatatcgccaccgctgtaaacactctataacttcaggccttggcattgagtcatctctcatgggtgacaccatgaaatcttgtttcagccagttctgcaggtcctgactctgcagagggaagaggcagaaagagagaaactgtcagagtataatttcacctgagtttaatattacagaaacaaagggatgcaccaaatggtatttctggaaattttcatgtctttaaataccccttggtaagttgcttctgaagccagtgggggctcctcagatagagaggttcccctttcaaatcccagtgccgctctgttctctttccttcccctcccactccccctcttcttcctctgtagagatgcaagaaattgctgtcccataaaaatcataattgcagtagctaaagctggggtcacttcgtgaattcaccagagactcaaagatcttttattggctctgggctgtgctcagtgtctttggcctcagagaacaacttgaatgacttcctggtttcctggcataaattattcctggtgagacatgtggcttaactcacaggtttcccatcagctttctccctaaaactatgttcatctgcctctctctgccagagaacatacagccgagaatactgccgaagctgagactgactactgtgcattaggaaagacctggagtcaggactttggtgggatttggagctccgaggcagtaataactgaacaagcagccctgtcccctaggctgcagaagcttgaatgcatcctctcccagaacctgccacaggaaactgggggctttgtcaggtcagcccaactgcatgcaaaagaccaccatcctcagaagccaagttgtcttttatgaagaggcaaggaaaggggaaacccacatgtgaccctgattttggtatggcttgatagagttccctgaaaactccttgtatgtgtgctaaaaccagggaagcatgtgactgccaagcaggcaacccctgatgatttgtaaagccaggtggcagggccttggggagccccagcacaatgatattgtgtggtcttccctcctgtggaatcgaggggaaattattcttcccaataccttgatttgattttcagtttcataagcttcttcctctgaatcttattgagggactatggtaccaagcaggtaggactgttcacctggtggaacagttcttgctctgccttctaggcttcatcccagaaatccagcctctttctggagaccccaaagctggagggagatgggctttcctctgggcctctctcctactttgccatccacactgctcctggctaaccccagcaataaccaacaaatggtaggaagccccatctattgctttttctcaattatgactgcatagtttgtggaaacaaagatcttgaggaagatgagggaagccctcccctcttcatagtccccatctcttctcctttgtacctgtcaacaccagagttcagtgtttaaacagacaaaatataaagtattgagtaggtggttcatatgccgaatccacttggtaggaagaaaccaccagctttatagtgtgcctgatagattttaaacattcctgggcacccactcaagagtgctctttttatcaccttctggaaatccgcaaagttgcaggggcctctggagtgtctcttctctagagagaattggtgggacccccctcagtgcagtggccccaactagtggagggagagaggacttaagtcagatggactcaacagaaatgggtttccagaagaataatgaaaagttgtgggtaggaaaatgaatcatttggactcttcaatgaaatggagtgagcccaggagagctcagccaacagaggcactctgggaacctgttagtaaagccaggctggccaaatgccatttgattttgaacctcgtaggtccccactcaccctctgccaggagctaagtaaggcaggagagctgacttgggactcctggctcggccccaacagggagcccccttcccaccatccctcggcaagctcaccacctcatccttctgccaaggcagctttcctttcttttgtgtgttttctgtgttcttagcctccaccctcctcctgccacccttgtggactaggaccaggtcctgaccccagtcagaaaatgatgatatgtacagtggcacaccttaaccagtcactaattttcactgttgtgaaagtgatttgatttagaattaaacaaatggttttacattactatga

SEQ ID NO: 446765 - DNA, 3420 bp, Homo sapiens
cagcgggagaggggcggctccgcgtcatgtgactggagtccgcgtaggaggggtcggaggtcttacccaacagattgacgcggcgttagtattggccgtgtacccgaaaaactgattgactgggctggcgttaactgtgcggaggcaggatttccctggggaaagtcttcactcagagcttcgctgacagccaaggatggcaagcaaggggccctcggcctctgcatctcctgagaactccagtgcaggggggcccagtgggagcagcaatggcgctggcgagagcggagggcaggacagcactttcgagtgcaacatctgcttggacacagccaaggatgccgtcatcagcctgtgtggccacctcttctgttggccgtgtttacatcagtggttggagaccagacctaacagacaggtgtgtcctgtttgcaaagctggcatcagccgagacaaggtcatccccctctatggaaggggcagcactgggcaacaggaccccagagagaagacccctcctcgtcctcaaggacagaggccagagccggagaatagagggggatttcaaggatttggatttggagatggtggcttccagatgtcttttggaattggggcatttccctttgggatatttgccacagcatttaatataaatgatgggcggcctcctccagctgtccctgggacaccccagtatgtggacgagcagttcctgtcacgcctcttcctatttgtggccctggtgatcatgttctggctcctgattgcctaatgctgggctcctgcctacatccgtggcagggctctggactggtgacgtgccaccccaactcctggtgtttggcttcctggctaatcttgactcctggaatcagtgggatcagtaacacatcaaggagtcttgtttcttcatcagagctttggaactcgagaccagttggcgatgacccctgaatatcgccaccgctgtaaacactctataacttcaggccttggcattgagtcatctctcatgggtgacaccatgaaatcttgtttcagccagttctgcaggtcctgactctgcagagggaagaggcagaaagagagaaactgtcagagtataatttcacctgagtttaatattacagaaacaaagggatgcaccaaatggtatttctggaaattttcatgtctttaaataccccttggtaagttgcttctgaagccagtgggggctcctcagatagagaggttcccctttcaaatcccagtgccgctctgttctctttccttcccctcccactccccctcttcttcctctgtagagatgcaagaaattgctgtcccataaaaatcataattgcagtagctaaagctggggtcacttcgtgaattcaccagagactcaaagatcttttattggctctgggctgtgctcagtgtctttggcctcagagaacaacttgaatgacttcctggtttcctggcataaattattcctggtgagacatgtggcttaactcacaggtttcccatcagctttctccctaaaactatgttcatctgcctctctctgccagagaacatacagccgagaatactgccgaagctgagactgactactgtgcattaggaaagacctggagtcaggactttggtgggatttggagctccgaggcagtaataactgaacaagcagccctgtcccctaggctgcagaagcttgaatgcatcctctcccagaacctgccacaggaaactgggggctttgtcaggtcagcccaactgcatgcaaaagaccaccatcctcagaagccaagttgtcttttatgaagaggcaaggaaaggggaaacccacatgtgaccctgattttggtatggcttgatagagttccctgaaaactccttgtatgtgtgctaaaaccagggaagcatgtgactgccaagcaggcaacccctgatgatttgtaaagccaggtggcagggccttggggagccccagcacaatgatattgtgtggtcttccctcctgtggaatcgaggggaaattattcttcccaataccttgatttgattttcagtttcataagcttcttcctctgaatcttattgagggactatggtaccaagcaggtaggactgttcacctggtggaacagttcttgctctgccttctaggcttcatcccagaaatccagcctctttctggagaccccaaagctggagggagatgggctttcctctgggcctctctcctactttgccatccacactgctcctggctaaccccagcaataaccaacaaatggtaggaagccccatctattgctttttctcaattatgactgcatagtttgtggaaacaaagatcttgaggaagatgagggaagccctcccctcttcatagtccccatctcttctcctttgtacctgtcaacaccagagttcagtgtttaaacagacaaaatataaagtattgagtaggtggttcatatgccgaatccacttggtaggaagaaaccaccagctttatagtgtgcctgatagattttaaacattcctgggcacccactcaagagtgctctttttatcaccttctggaaatccgcaaagttgcaggggcctctggagtgtctcttctctagagagaattggtgggacccccctcagtgcagtggccccaactagtggagggagagaggacttaagtcagatggactcaacagaaatgggtttccagaagaataatgaaaagttgtgggtaggaaaatgaatcatttggactcttcaatgaaatggagtgagcccaggagagctcagccaacagaggcactctgggaacctgttagtaaagccaggctggccaaatgccatttgattttgaacctcgtaggtccccactcaccctctgccaggagctaagtaaggcaggagagctgacttgggactcctggctcggccccaacagggagcccccttcccaccatccctcggcaagctcaccacctcatccttctgccaaggcagctttcctttcttttgtgtgttttctgtgttcttagcctccaccctcctcctgccacccttgtggactaggaccaggtcctgaccccagtcagaaaatgatgatatgtacagtggcacaccttaaccagtcactaattttcactgttgtgaaagtgatttgatttagaattaaacaaatggttttacattactatgaaaaaacaaaaaaaaaagacaacaactgtggggggccagattaggaccgcgaaaaaactctttcaacacaatagcgttgggaggcggggcccaagtaggataaggacacaggcgccaacgacggtcccagggcactcggcgacgaagacaagagggggagtcctcaccaataaagaagcccggagaaacaacagggctgaaaaacagaagagg

SEQ ID NO: 446766 - DNA, 1620 bp, Homo sapiens
cagcgggagaggggcggctccgcgtcatgtgactggagtccgcgtaggaggggtcggaggtcttacccaacagattgacgcggcgttagtattggccgtgtacccgaaaaactgattgactgggctggcgttaactgtgcggaggcaggatttccctggggaaagtcttcactcagagcttcgctgacagccaaggatggcaagcaaggggccctcggcctctgcatctcctgagaactccagtgcaggggggcccagtgggagcagcaatggcgctggcgagagcggagggcaggacagcactttcgagtgcaacatctgcttggacacagccaaggatgccgtcatcagcctgtgtggccacctcttctgttggccgtgtttacatcagtggttggagaccagacctaacagacaggtgtgtcctgtttgcaaagctggcatcagccgagacaaggtcatccccctctatggaaggggcagcactgggcaacaggaccccagagagaagacccctcctcgtcctcaaggacagaggccagagccggagaatagagggggatttcaaggatttggatttggagatggtggcttccagatgtcttttggaattggggcatttccctttgggatatttgccacagcatttaatataaatgatgggcggcctcctccagctgtccctgggacaccccagtatgtggacgagcagttcctgtcacgcctcttcctatttgtggccctggtgatcatgttctggctcctgattgcctaatgctgggctcctgcctacatccgtggcagggctctggactggtgacgtgccaccccaactcctggtgtttggcttcctggctaatcttgactcctggaatcagtgggatcagtaacacatcaaggagtcttgtttcttcatcagagctttggaactcgagaccagttggcgatgacccctgaatatcgccaccgctgtaaacactctataacttcaggccttggcattgagtcatctctcatgggtgacaccatgaaatcttgtttcagccagttctgcaggtcctgactctgcagagggaagaggcagaaagagagaaactgtcagagtataatttcacctgagtttaatattacagaaacaaagggatgcaccaaatggtatttctggaaattttcatgtctttaaataccccttggtaagttgcttctgaagccagtgggggctcctcagatagagaggttcccctttcaaatcccagtgccgctctgttctctttccttcccctcccactccccctcttcttccctctgccaggagctaagtaaggcaggagagctgacttgggactcctggctcggccccaacagggagcccccttcccaccatccctcggcaagctcaccacctcatccttctgccaaggcagctttcctttcttttgtgtgttttctgtgttcttagcctccaccctcctcctgccacccttgtggactaggaccaggtcctgaccccagtcagaaaatgatgatatgtacagtggcacaccttaaccagtcactaattttcactgttgtgaaagtgatttgatttagaattaaacaaatggttttacattactatga

SEQ ID NO: 446767 - DNA, 932 bp, Homo sapiens
cagcgggagaggggcggctccgcgtcatgtgactggagtccgcgtaggaggggtcggaggtcttacccaacagattgacgcggcgttagtattggccgtgtacccgaaaaactgattgactgggctggcgttaactgtgcggaggcaggatttccctggggaaagtcttcactcagagcttcgctgacagccaaggatggcaagcaaggggccctcggcctctgcatctcctgagaactccagtgcaggggggcccagtgggagcagcaatggcgctggcgagagcggagggcaggacagcactttcgagtgcaacatctgcttggacacagccaaggatgccgtcatcagcctgtgtggccacctcttctgttggccgtgtttacatcagtggttggagaccagacctaacagacaggtgtgtcctgtttgcaaagctggcatcagccgagacaaggtcatccccctctatggaaggggcagcactgggcaacaggaccccagagagaagacccctcctcgtcctcaaggacagaggccagagccggagaatagagggggatttcaaggatttggatttggagatggtggcttccagatgtcttttggaattggggcatttccctttgggatatttgccacagcatttaatataaatgatgggcggcctcctccagctgtccctgggacaccccagtatgtggacgagcagttcctgtcacgcctcttcctatttgtggccctggtgatcatgttctggctcctgattgcctaatgctgggctcctgccacccttgtggactaggaccaggtcctgaccccagtcagaaaatgatgatatgtacagtggcacaccttaaccagtcactaattttcactgttgtgaaagtgatttgatttagaattaaacaaatggttttacattactatga

SEQ ID NO: 446768 - DNA, 3764 bp, Homo sapiens
ccgtttcctcccctcccctccactcggccgtccctccttcctcctccctcctccctcctcctcccgctcctgaagagcgcgccgcgtgggggacggcccggttacttcctccagagactgacgagtgcggtgtcgctccagctcagagctcccggagccgcccggccagcgtccggcctccctgatcgtctctggccggcgccctcgccctcgcccggcgcgcaccgagcagccgcgggcgccgagcagccaccgtcccgaccaagcgccggccctgcccgcagcggcaggatgaatgatttcggaatcaagaatatggaccaggtagcccctgtggctaacagttacagagggacactcaagcgccagccagcctttgacacctttgatgggtccctgtttgctgtttttccttctctaaatgaagagcaaacactgcaagaagtgccaacaggcttggattccatttctcatgactccgccaactgtgaattgcctttgttaaccccgtgcagcaaggctgtgatgagtcaagccttaaaagctaccttcagtggcttcaaaaaggaacagcggcgcctgggcattccaaagaacccctggctgtggagtgagcaacaggtatgccagtggcttctctgggccaccaatgagttcagtctggtgaacgtgaatctgcagaggttcggcatgaatggccagatgctgtgtaaccttggcaaggaacgctttctggagctggcacctgactttgtgggtgacattctctgggaacatctggagcaaatgatcaaagaaaaccaagaaaagacagaagatcaatatgaagaaaattcacacctcacctccgttcctcattggattaacagcaatacattaggttttggcacagagcaggcgccctatggaatgcagacacagaattaccccaaaggcggcctcctggacagcatgtgtccggcctccacacccagcgtactcagctctgagcaggagtttcagatgttccccaagtctcggctcagctccgtcagcgtcacctactgctctgtcagtcaggacttcccaggcagcaacttgaatttgctcaccaacaattctgggacgcccaaagaccacgactcccctgagaacggtgcggacagcttcgagagctcagactccctcctccagtcctggaacagccagtcgtccttgctggatgtgcaacgggttccttccttcgagagcttcgaagatgactgcagccagtctctctgcctcaataagccaaccatgtctttcaaggattacatccaagagaggagtgacccggtggagcaaggcaaaccagttatacctgcagctgtgctggccggcttcacaggaagtggacctattcagctgtggcagtttctcctggagctgctatcagacaaatcctgccagtcattcatcagctggactggagacggatgggagtttaagctcgccgaccccgatgaggtggcccgccggtggggaaagaggaaaaataagcccaagatgaactacgagaagctgagccggggcttacgctactattacgacaagaacatcatccacaagacgtcggggaagcgctacgtgtaccgcttcgtgtgcgacctccagaacttgctggggttcacgcccgaggaactgcacgccatcctgggcgtccagcccgacacggaggactgaggtcgccgggaccaccctgagccggccccaggctcgtggactgagtgggaagcccatcctgaccagctgctccgaggacccaggaaaggcaggattgaaaatgtccaggaaagtggccaagaagcagtggccttattgcatcccaaaccacgcctcttgaccaggctgcctcccttgtggcagcaacggcacagctaattctactcacagtgcttttaagtgaaaatggtcgagaaagaggcaccgggaagccgtcctggcgcctggcagtccgtgggacgggatggttctggctgtttgagattctcaaaggagcgagcatgtcgtggacacacacagactatttttagattttcttttgccttttgcaaccaggaacagcaaatgcaaaaactctttgagagggtaggagggtgggaaggaaacaaccatgtcatttcagaagttagtttgtatatattataataatcttataattgttctcagaatcccttaacagttgtatttaacagaaattgtatattgtaatttaaaataattatataactgtatttgaaataagaattcagacatctgaggttttatttcatttttcaatagcacatatggaattttgcaaagatttaatctgccaagggccgactaagagaagttgtaaagtatgtattatttacatttaatagacttacagggataaggcctgtggggggtaatccctgctttttgtgtttttttgtttgtttgtttgtttgtttttggggggttttcttgccttggttgtctggcaaggactttgtacatttgggagtttttatgagaaacttaaatgttattatctgggcttatatctggcctctgctttctcctttaattgtaaagtaaaagctataaagcagtatttttcttgacaaatggcatatgttttccacttctttgcatgcgtttaagtcagtttatacacaaaatggattttattttttagtttaactgtgtttctccgacagctcacctctctctgaccacccagccatttccttcctgtgctccacgttcttctgtgtgattaaaataagaatattatttttggaaatatgcaactccttttcagagatcaggagggatttatgtagcagctatttttactgcaaaagtaattcactggaaaaaaaatgtaatttgtaagaaagctttatttttatctcagctctatgtaaagttaaagttactgtacagagctgaaggacggggggcggtaggggtcttgatgaaacctcttgaacgaagcacagtttgtcccatctttgttcactcgtgtgtctcaaccatcttaatagcatgctgctcctttttgctcagtgtccacagcaagatgacgtgattcttattttcttggacacagactattctgaggcacagagcggggacttaagatgggaaagagaaagcatcggagccattcattcggagaaaacgttttgatcaaaatggagacttttgtagtcgtttcaaaagagcacctgagtcatgtgtattcccggcctttataaatgacccggtcaagttggtttcaaagtccgacaggcttgtctgtttactagctgcgtggccttggacgggtggctgacatctgtaaagaatcctcctgtgatgaaactgaggaatcgggtggccgggcaagctgggaagagcaaagccagagctgcgctgcctcaatacccacaaaagaccattcccagtatacataagcacaggatgtttttctcaagagggatgtatttatcacttggacatctgtttataatataaacagacatgtgactgggaacatcttgctgccaaaagaatcctaggcagtggctcattgtatgtgaggttgaaccacgtgaaattgccaatattaggctggcttttatctacaaagaaggagtttcatggggttcagcctaacagttatggaaactacagtccttataaaccattggcatggtaataaacagatcttaagtataaaaattttgtaattgggcctttactctctcaataataaagtattttgtttatat

SEQ ID NO: 446769 - DNA, 3710 bp, Homo sapiens
ccgtttcctcccctcccctccactcggccgtccctccttcctcctccctcctccctcctcctcccgctcctgaagagcgcgccgcgtgggggacggcccggttacttcctccagagactgacgagtgcggtgtcgctccagctcagagctcccggagccgcccggccagcgtccggcctccctgatcgtctctggccggcgccctcgccctcgcccggcgcgcaccgagcagccgcgggcgccgagcagccaccgtcccgaccaagcgccggccctgcccgcagcggcaggatgaatgatttcggaatcaagaatatggaccaggtagcccctgtggctaacagttacagagggacactcaagcgccagccagcctttgacacctttgatgggtccctgtttgctgtttttccttctctaaatgaagagcaaacactgcaagaagtgccaacaggcttggattccatttctcatgactccgccaactgtgaattgcctttgttaaccccgtgcagcaaggctgtgatgagtcaagccttaaaagctaccttcagtggcttcaaaaaggaacagcggcgcctgggcattccaaagaacccctggctgtggagtgagcaacaggtatgccagtggcttctctgggccaccaatgagttcagtctggtgaacgtgaatctgcagaggttcggcatgaatggccagatgctgtgtaaccttggcaaggaacgctttctggagctggcacctgactttgtgggtgacattctctgggaacatctggagcaaatgatcaaagaaaaccaagaaaagacagaagatcaatatgaagaaaattcacacctcacctccgttcctcattggattaacagcaatacattaggttttggcacagagcaggcgccctatggaatgcagacacagaattaccccaaaggcggcctcctggacagcatgtgtccggcctccacacccagcgtactcagctctgagcaggagtttcagatgttccccaagtctcggctcagctccgtcagcgtcacctactgctctgtcagtcaggacttcccaggcagcaacttgaatttgctcaccaacaattctgggacgcccaaagaccacgactcccctgagaacggtgcggacagcttcgagagctcagactccctcctccagtcctggaacagccagtcgtccttgctggatgtgcaacgggttccttccttcgagagcttcgaagatgactgcagccagtctctctgcctcaataagccaaccatgtctttcaaggattacatccaagagaggagtgacccggtggagcaaggcaaaccagttatacctgcagctgtgctggccggcttcacaggaagtggacctattcagctgtggcagtttctcctggagctgctatcagacaaatcctgccagtcattcatcagctggactggagacggatgggagtttaagctcgccgaccccgatgaggtggcccgccggtggggaaagaggaaaaataagcccaagatgaactacgagaagctgagccggggcttacgctactattacgacaagaacatcatccacaagacgtcggggaagcgctacgtgtaccgcttcgtgtgcgacctccagaacttgctggggttcacgcccgaggaactgcacgccatcctgggcgtccagcccgacacggaggactgaggtcgccgggaccaccctgagccggccccaggctcgtggactgagtgggaagcccatcctgaccagctgctccgaggacccaggaaaggcaggattgaaaatgtccaggaaagtggccaagaagcagtggccttattgcatcccaaaccacgcctcttgaccaggctgcctcccttgtggcagcaacggcacagctaattctactcacagtgcttttaagtgaaaatggtcgagaaagaggcaccgggaagccgtcctggcgcctggcagtccgtgggacgggatggttctggctgtttgagattctcaaaggagcgagcatgtcgtggacacacacagactatttttagattttcttttgccttttgcaaccaggaacagcaaatgcaaaaactctttgagagggtaggagggtgggaaggaaacaaccatgtcatttcagaagttagtttgtatatattataataatcttataattgttctcagaatcccttaacagttgtatttaacagaaattgtatattgtaatttaaaataattatataactgtatttgaaataagaattcagacatctgaggttttatttcatttttcaatagcacatatggaattttgcaaagatttaatctgccaagggccgactaagagaagttgtaaagtatgtattatttacatttaatagacttacagggataaggcctgtggggggtaatccctgctttttgtgtttttttgtttgtttgtttgtttgtttttggggggttttcttgccttggttgtctggcaaggactttgtacatttgggagtttttatgagaaacttaaatgttattatctgggcttatatctggcctctgctttctcctttaattgtaaagtaaaagctataaagcagtatttttcttgacaaatggcatatgttttccacttctttgcatgcgtttaagtcagtttatacacaaaatggattttattttttagtttaactgtgtttctccgacagctcacctctctctgaccacccagccatttccttcctgtgctccacgttcttctgtgtgattaaaataagaatattatttttggaaatatgcaactccttttcagagatcaggagggatttatgtagcagctatttttactgcaaaagtaattcactggaaaaaaaatgtaatttgtaagaaagctttatttttatctcagctctatgtaaagttaaagttactgtacagagctgaaggacggggggcggtaggggtcttgatgaaacctcttgaacgaagcacagtttgtcccatctttgttcactcgtgtgtctcaaccatcttaatagcatgctgctcctttttgctcagtgtccacagcaagatgacgtgattcttattttcttggacacagactattctgaggcacagagcggggacttaagatgggaaagagaaagcatcggagccattcattcggagaaaacgttttgatcaaaatggagacttttgtagtcgtttcttggtttcaaagtccgacaggcttgtctgtttactagctgcgtggccttggacgggtggctgacatctgtaaagaatcctcctgtgatgaaactgaggaatcgggtggccgggcaagctgggaagagcaaagccagagctgcgctgcctcaatacccacaaaagaccattcccagtatacataagcacaggatgtttttctcaagagggatgtatttatcacttggacatctgtttataatataaacagacatgtgactgggaacatcttgctgccaaaagaatcctaggcagtggctcattgtatgtgaggttgaaccacgtgaaattgccaatattaggctggcttttatctacaaagaaggagtttcatggggttcagcctaacagttatggaaactacagtccttataaaccattggcatggtaataaacagatcttaagtataaaaattttgtaattgggcctttactctctcaataataaagtattttgtttatat

SEQ ID NO: 446770 - DNA, 3814 bp, Homo sapiens
  misc_feature (3767)..(3767): n is a, c, g, or t
ccgtttcctcccctcccctccactcggccgtccctccttcctcctccctcctccctcctcctcccgctcctgaagagcgcgccgcgtgggggacggcccggttacttcctccagagactgacgagtgcggtgtcgctccagctcagagctcccggagccgcccggccagcgtccggcctccctgatcgtctctggccggcgccctcgccctcgcccggcgcgcaccgagcagccgcgggcgccgagcagccaccgtcccgaccaagcgccggccctgcccgcagcggcaggatgaatgatttcggaatcaagaatatggaccaggtagcccctgtggctaacagttacagagggacactcaagcgccagccagcctttgacacctttgatgggtccctgtttgctgtttttccttctctaaatgaagagcaaacactgcaagaagtgccaacaggcttggattccatttctcatgactccgccaactgtgaattgcctttgttaaccccgtgcagcaaggctgtgatgagtcaagccttaaaagctaccttcagtggcttcaaaaaggaacagcggcgcctgggcattccaaagaacccctggctgtggagtgagcaacaggtatgccagtggcttctctgggccaccaatgagttcagtctggtgaacgtgaatctgcagaggttcggcatgaatggccagatgctgtgtaaccttggcaaggaacgctttctggagctggcacctgactttgtgggtgacattctctgggaacatctggagcaaatgatcaaagaaaaccaagaaaagacagaagatcaatatgaagaaaattcacacctcacctccgttcctcattggattaacagcaatacattaggttttggcacagagcaggcgccctatggaatgcagacacagaattaccccaaaggcggcctcctggacagcatgtgtccggcctccacacccagcgtactcagctctgagcaggagtttcagatgttccccaagtctcggctcagctccgtcagcgtcacctactgctctgtcagtcaggacttcccaggcagcaacttgaatttgctcaccaacaattctgggacgcccaaagaccacgactcccctgagaacggtgcggacagcttcgagagctcagactccctcctccagtcctggaacagccagtcgtccttgctggatgtgcaacgggttccttccttcgagagcttcgaagatgactgcagccagtctctctgcctcaataagccaaccatgtctttcaaggattacatccaagagaggagtgacccggtggagcaaggcaaaccagttatacctgcagctgtgctggccggcttcacaggaagtggacctattcagctgtggcagtttctcctggagctgctatcagacaaatcctgccagtcattcatcagctggactggagacggatgggagtttaagctcgccgaccccgatgaggtggcccgccggtggggaaagaggaaaaataagcccaagatgaactacgagaagctgagccggggcttacgctactattacgacaagaacatcatccacaagacgtcggggaagcgctacgtgtaccgcttcgtgtgcgacctccagaacttgctggggttcacgcccgaggaactgcacgccatcctgggcgtccagcccgacacggaggactgaggtcgccgggaccaccctgagccggccccaggctcgtggactgagtgggaagcccatcctgaccagctgctccgaggacccaggaaaggcaggattgaaaatgtccaggaaagtggccaagaagcagtggccttattgcatcccaaaccacgcctcttgaccaggctgcctcccttgtggcagcaacggcacagctaattctactcacagtgcttttaagtgaaaatggtcgagaaagaggcaccgggaagccgtcctggcgcctggcagtccgtgggacgggatggttctggctgtttgagattctcaaaggagcgagcatgtcgtggacacacacagactatttttagattttcttttgccttttgcaaccaggaacagcaaatgcaaaaactctttgagagggtaggagggtgggaaggaaacaaccatgtcatttcagaagttagtttgtatatattataataatcttataattgttctcagaatcccttaacagttgtatttaacagaaattgtatattgtaatttaaaataattatataactgtatttgaaataagaattcagacatctgaggttttatttcatttttcaatagcacatatggaattttgcaaagatttaatctgccaagggccgactaagagaagttgtaaagtatgtattatttacatttaatagacttacagggataaggcctgtggggggtaatccctgctttttgtgtttttttgtttgtttgtttgtttgtttttggggggttttcttgccttggttgtctggcaaggactttgtacatttgggagtttttatgagaaacttaaatgttattatctgggcttatatctggcctctgctttctcctttaattgtaaagtaaaagctataaagcagtatttttcttgacaaatggcatatgttttccacttctttgcatgcgtttaagtcagtttatacacaaaatggattttattttttagtttaactgtgtttctccgacagctcacctctctctgaccacccagccatttccttcctgtgctccacgttcttctgtgtgattaaaataagaatattatttttggaaatatgcaactccttttcagagatcaggagggatttatgtagcagctatttttactgcaaaagtaattcactggaaaaaaaatgtaatttgtaagaaagctttatttttatctcagctctatgtaaagttaaagttactgtacagagctgaaggacggggggcggtaggggtcttgatgaaacctcttgaacgaagcacagtttgtcccatctttgttcactcgtgtgtctcaaccatcttaatagcatgctgctcctttttgctcagtgtccacagcaagatgacgtgattcttattttcttggacacagactattctgaggcacagagcggggacttaagatgggaaagagaaagcatcggagccattcattcggagaaaacgttttgatcaaaatggagacttttgtagtcgtttcaaaagagcacctgagtcatgtgtattcccggcctttataaatgacccggtcaagttggtttcaaagtccgacaggcttgtctgtttactagctgcgtggccttggacgggtggctgacatctgtaaagaatcctcctgtgatgaaactgaggaatcgggtggccgggcaagctgggaagagcaaagccagagctgcgctgcctcaatacccacaaaagaccattcccagtatacataagcacaggatgtttttctcaagagggatgtatttatcacttggacatctgtttataatataaacagacatgtgactgggaacatcttgctgccaaaagaatcctaggcagtggctcattgtatgtgaggttgaaccacgtgaaattgccaatattaggctggcttttatctacaaagaaggagtttcatggggttcagcctaacagttatggaaactacagtccttataaaccattggcatggtaataaacagatcttaagtataaaaattttgtaattgggcctttactctctcaataataaagtattttgtttatattantacaccaaacaacaagccatcaacaccacaatacaacaaaaaaaaga

SEQ ID NO: 446771 - DNA, 3834 bp, Homo sapiens
ccgtttcctcccctcccctccactcggccgtccctccttcctcctccctcctccctcctcctcccgctcctgaagagcgcgccgcgtgggggacggcccggttacttcctccagagactgacgagtgcggtgtcgctccagctcagagctcccggagccgcccggccagcgtccggcctccctgatcgtctctggccggcgccctcgccctcgcccggcgcgcaccgagcagccgcgggcgccgagcagccaccgtcccgaccaagcgccggccctgcccgcagcggcaggatgaatgatttcggaatcaagaatatggaccaggtagcccctgtggctaacagttacagagggacactcaagcgccagccagcctttgacacctttgatgggtccctgtttgctgtttttccttctctaaatgaagagcaaacactgcaagaagtgccaacaggcttggattccatttctcatgactccgccaactgtgaattgcctttgttaaccccgtgcagcaaggctgtgatgagtcaagccttaaaagctaccttcagtggcttcaaaaaggaacagcggcgcctgggcattccaaagaacccctggctgtggagtgagcaacaggtatgccagtggcttctctgggccaccaatgagttcagtctggtgaacgtgaatctgcagaggttcggcatgaatggccagatgctgtgtaaccttggcaaggaacgctttctggagctggcacctgactttgtgggtgacattctctgggaacatctggagcaaatgatcaaagaaaaccaagaaaagacagaagatcaatatgaagaaaattcacacctcacctccgttcctcattggattaacagcaatacattaggttttggcacagagcaggcgccctatggaatgcagacacagaattaccccaaaggcggcctcctggacagcatgtgtccggcctccacacccagcgtactcagctctgagcaggagtttcagatgttccccaagtctcggctcagctccgtcagcgtcacctactgctctgtcagtcaggacttcccaggcagcaacttgaatttgctcaccaacaattctgggacgcccaaagaccacgactcccctgagaacggtgcggacagcttcgagagctcagactccctcctccagtcctggaacagccagtcgtccttgctggatgtgcaacgggttccttccttcgagagcttcgaagatgactgcagccagtctctctgcctcaataagccaaccatgtctttcaaggattacatccaagagaggagtgacccggtggagcaaggcaaaccagttatacctgcagctgtgctggccggcttcacaggaagtggacctattcagctgtggcagtttctcctggagctgctatcagacaaatcctgccagtcattcatcagctggactggagacggatgggagtttaagctcgccgaccccgatgaggtggcccgccggtggggaaagaggaaaaataagcccaagatgaactacgagaagctgagccggggcttacgctactattacgacaagaacatcatccacaagacgtcggggaagcgctacgtgtaccgcttcgtgtgcgacctccagaacttgctggggttcacgcccgaggaactgcacgccatcctgggcgtccagcccgacacggaggactgaggtcgccgggaccaccctgagccggccccaggctcgtggactgagtgggaagcccatcctgaccagctgctccgaggacccaggaaaggcaggattgaaaatgtccaggaaagtggccaagaagcagtggccttattgcatcccaaaccacgcctcttgaccaggctgcctcccttgtggcagcaacggcacagctaattctactcacagtgcttttaagtgaaaatggtcgagaaagaggcaccgggaagccgtcctggcgcctggcagtccgtgggacgggatggttctggctgtttgagattctcaaaggagcgagcatgtcgtggacacacacagactatttttagattttcttttgccttttgcaaccaggaacagcaaatgcaaaaactctttgagagggtaggagggtgggaaggaaacaaccatgtcatttcagaagttagtttgtatatattataataatcttataattgttctcagaatcccttaacagttgtatttaacagaaattgtatattgtaatttaaaataattatataactgtatttgaaataagaattcagacatctgaggttttatttcatttttcaatagcacatatggaattttgcaaagatttaatctgccaagggccgactaagagaagttgtaaagtatgtattatttacatttaatagacttacagggataaggcctgtggggggtaatccctgctttttgtgtttttttgtttgtttgtttgtttgtttttggggggttttcttgccttggttgtctggcaaggactttgtacatttgggagtttttatgagaaacttaaatgttattatctgggcttatatctggcctctgctttctcctttaattgtaaagtaaaagctataaagcagtatttttcttgacaaatggcatatgttttccacttctttgcatgcgtttaagtcagtttatacacaaaatggattttattttttagtttaactgtgtttctccgacagctcacctctctctgaccacccagccatttccttcctgtgctccacgttcttctgtgtgattaaaataagaatattatttttggaaatatgcaactccttttcagagatcaggagggatttatgtagcagctatttttactgcaaaagtaattcactggaaaaaaaatgtaatttgtaagaaagctttatttttatctcagctctatgtaaagttaaagttactgtacagagctgaaggacggggggcggtaggggtcttgatgaaacctcttgaacgaagcacagtttgtcccatctttgttcactcgtgtgtctcaaccatcttaatagcatgctgctcctttttgctcagtgtccacagcaagatgacgtgattcttattttcttggacacagactattctgaggcacagagcggggacttaagatgggaaagagaaagcatcggagccattcattcggagaaaacgttttgatcaaaatggagacttttgtagtcgtttcaaaagagcacctgagtcatgtgtattcccggcctttataaatgacccggtcaagttggtttcaaagtccgacaggcttgtctgtttactagctgcgtggccttggacgggtggctgacatctgtaaagaatcctcctgtgatgaaactgaggaatcgggtggccgggcaagctgggaagagcaaagccagagctgcgctgcctcaatacccacaaaagaccattcccagtatacataagcacaggatgtttttctcaagagggatgtatttatcacttggacatctgtttataatataaacagacatgtgactgggaacatcttgctgccaaaagaatcctaggcagtggctcattgtatgtgaggttgaaccacgtgaaattgccaatattaggctggcttttatctacaaagaaggagtttcatggggttcagcctaacagttatggaaactacagtccttataaaccattggcatggtaataaacagatcttaagtataaaaattttgtaattgggcctttactctctcaataataaagtattttgtttatataggtagtatattgaaagcaacacaaaaccgagtacacacaaggggggaggcacccacaagaaggattccc

SEQ ID NO: 446772 - DNA, 3710 bp, Homo sapiens
ccgtttcctcccctcccctccactcggccgtccctccttcctcctccctcctccctcctcctcccgctcctgaagagcgcgccgcgtgggggacggcccggttacttcctccagagactgacgagtgcggtgtcgctccagctcagagctcccggagccgcccggccagcgtccggcctccctgatcgtctctggccggcgccctcgccctcgcccggcgcgcaccgagcagccgcgggcgccgagcagccaccgtcccgaccaagcgccggccctgcccgcagcggcaggatgaatgatttcggaatcaagaatatggaccaggtagcccctgtggctaacagttacagagggacactcaagcgccagccagcctttgacacctttgatgggtccctgtttgctgtttttccttctctaaatgaagagcaaacactgcaagaagtgccaacaggcttggattccatttctcatgactccgccaactgtgaattgcctttgttaaccccgtgcagcaaggctgtgatgagtcaagccttaaaagctaccttcagtggcttcaaaaaggaacagcggcgcctgggcattccaaagaacccctggctgtggagtgagcaacaggtatgccagtggcttctctgggccaccaatgagttcagtctggtgaacgtgaatctgcagaggttcggcatgaatggccagatgctgtgtaaccttggcaaggaacgctttctggagctggcacctgactttgtgggtgacattctctgggaacatctggagcaaatgatcaaagaaaaccaagaaaagacagaagatcaatatgaagaaaattcacacctcacctccgttcctcattggattaacagcaatacattaggttttggcacagagcaggcgccctatggaatgcagacacagaattaccccaaaggcggcctcctggacagcatgtgtccggcctccacacccagcgtactcagctctgagcaggagtttcagatgttccccaagtctcggctcagctccgtcagcgtcacctactgctctgtcagtcaggacttcccaggcagcaacttgaatttgctcaccaacaattctgggacgcccaaagaccacgactcccctgagaacggtgcggacagcttcgagagctcagactccctcctccagtcctggaacagccagtcgtccttgctggatgtgcaacgggttccttccttcgagagcttcgaagatgactgcagccagtctctctgcctcaataagccaaccatgtctttcaaggattacatccaagagaggagtgacccggtggagcaaggcaaaccagttatacctgcagctgtgctggccggcttcacaggaagtggacctattcagctgtggcagtttctcctggagctgctatcagacaaatcctgccagtcattcatcagctggactggagacggatgggagtttaagctcgccgaccccgatgaggtggcccgccggtggggaaagaggaaaaataagcccaagatgaactacgagaagctgagccggggcttacgctactattacgacaagaacatcatccacaagacgtcggggaagcgctacgtgtaccgcttcgtgtgcgacctccagaacttgctggggttcacgcccgaggaactgcacgccatcctgggcgtccagcccgacacggaggactgaggtcgccgggaccaccctgagccggccccaggctcgtggactgagtgggaagcccatcctgaccagctgctccgaggacccaggaaaggcaggattgaaaatgtccaggaaagtggccaagaagcagtggccttattgcatcccaaaccacgcctcttgaccaggctgcctcccttgtggcagcaacggcacagctaattctactcacagtgcttttaagtgaaaatggtcgagaaagaggcaccgggaagccgtcctggcgcctggcagtccgtgggacgggatggttctggctgtttgagattctcaaaggagcgagcatgtcgtggacacacacagactatttttagattttcttttgccttttgcaaccaggaacagcaaatgcaaaaactctttgagagggtaggagggtgggaaggaaacaaccatgtcatttcagaagttagtttgtatatattataataatcttataattgttctcagaatcccttaacagttgtatttaacagaaattgtatattgtaatttaaaataattatataactgtatttgaaataagaattcagacatctgaggttttatttcatttttcaatagcacatatggaattttgcaaagatttaatctgccaagggccgactaagagaagttgtaaagtatgtattatttacatttaatagacttacagggataaggcctgtggggggtaatccctgctttttgtgtttttttgtttgtttgtttgtttgtttttggggggttttcttgccttggttgtctggcaaggactttgtacatttgggagtttttatgagaaacttaaatgttattatctgggcttatatctggcctctgctttctcctttaattgtaaagtaaaagctataaagcagtatttttcttgacaaatggcatatgttttccacttctttgcatgcgtttaagtcagtttatacacaaaatggattttattttttagtttaactgtgtttctccgacagctcacctctctctgaccacccagccatttccttcctgtgctccacgttcttctgtgtgattaaaataagaatattatttttggaaatatgcaactccttttcagagatcaggagggatttatgtagcagctatttttactgcaaaagtaattcactggaaaaaaaatgtaatttgtaagaaagctttatttttatctcagctctatgtaaagttaaagttactgtacagagctgaaggacggggggcggtaggggtcttgatgaaacctcttgaacgaagcacagtttgtcccatctttgttcactcgtgtgtctcaaccatcttaatagcatgctgctcctttttgctcagtgtccacagcaagatgacgtgattcttattttcttggacacagactattctgaggcacagagcggggacttaagatgggaaagagaaagcatcggagccattcattcggagaaaacgttttgatcaaaatggagacttttgtagtcgtttcaaaagagcacctgagtcatgtgtattcccggcctttataaatgacccggtcaagttggtttcaaagtccgacaggcttgtctgtttactagctgcgtggccttggacgggtggctgacatctgtaaagaatcctcctgtgatgaaactgaggaatcgggtggccgggcaagctgggaagagcaaagccagagctgcgttctcaagagggatgtatttatcacttggacatctgtttataatataaacagacatgtgactgggaacatcttgctgccaaaagaatcctaggcagtggctcattgtatgtgaggttgaaccacgtgaaattgccaatattaggctggcttttatctacaaagaaggagtttcatggggttcagcctaacagttatggaaactacagtccttataaaccattggcatggtaataaacagatcttaagtataaaaattttgtaattgggcctttactctctcaataataaagtattttgtttatat

SEQ ID NO: 446773 - DNA, 3710 bp, Homo sapiens
ccgtttcctcccctcccctccactcggccgtccctccttcctcctccctcctccctcctcctcccgctcctgaagagcgcgccgcgtgggggacggcccggttacttcctccagagactgacgagtgcggtgtcgctccagctcagagctcccggagccgcccggccagcgtccggcctccctgatcgtctctggccggcgccctcgccctcgcccggcgcgcaccgagcagccgcgggcgccgagcagccaccgtcccgaccaagcgccggccctgcccgcagcggcaggatgaatgatttcggaatcaagaatatggaccaggtagcccctgtggctaacagttacagagggacactcaagcgccagccagcctttgacacctttgatgggtccctgtttgctgtttttccttctctaaatgaagagcaaacactgcaagaagtgccaacaggcttggattccatttctcatgactccgccaactgtgaattgcctttgttaaccccgtgcagcaaggctgtgatgagtcaagccttaaaagctaccttcagtggcttcaaacaggtatgccagtggcttctctgggccaccaatgagttcagtctggtgaacgtgaatctgcagaggttcggcatgaatggccagatgctgtgtaaccttggcaaggaacgctttctggagctggcacctgactttgtgggtgacattctctgggaacatctggagcaaatgatcaaagaaaaccaagaaaagacagaagatcaatatgaagaaaattcacacctcacctccgttcctcattggattaacagcaatacattaggttttggcacagagcaggcgccctatggaatgcagacacagaattaccccaaaggcggcctcctggacagcatgtgtccggcctccacacccagcgtactcagctctgagcaggagtttcagatgttccccaagtctcggctcagctccgtcagcgtcacctactgctctgtcagtcaggacttcccaggcagcaacttgaatttgctcaccaacaattctgggacgcccaaagaccacgactcccctgagaacggtgcggacagcttcgagagctcagactccctcctccagtcctggaacagccagtcgtccttgctggatgtgcaacgggttccttccttcgagagcttcgaagatgactgcagccagtctctctgcctcaataagccaaccatgtctttcaaggattacatccaagagaggagtgacccggtggagcaaggcaaaccagttatacctgcagctgtgctggccggcttcacaggaagtggacctattcagctgtggcagtttctcctggagctgctatcagacaaatcctgccagtcattcatcagctggactggagacggatgggagtttaagctcgccgaccccgatgaggtggcccgccggtggggaaagaggaaaaataagcccaagatgaactacgagaagctgagccggggcttacgctactattacgacaagaacatcatccacaagacgtcggggaagcgctacgtgtaccgcttcgtgtgcgacctccagaacttgctggggttcacgcccgaggaactgcacgccatcctgggcgtccagcccgacacggaggactgaggtcgccgggaccaccctgagccggccccaggctcgtggactgagtgggaagcccatcctgaccagctgctccgaggacccaggaaaggcaggattgaaaatgtccaggaaagtggccaagaagcagtggccttattgcatcccaaaccacgcctcttgaccaggctgcctcccttgtggcagcaacggcacagctaattctactcacagtgcttttaagtgaaaatggtcgagaaagaggcaccgggaagccgtcctggcgcctggcagtccgtgggacgggatggttctggctgtttgagattctcaaaggagcgagcatgtcgtggacacacacagactatttttagattttcttttgccttttgcaaccaggaacagcaaatgcaaaaactctttgagagggtaggagggtgggaaggaaacaaccatgtcatttcagaagttagtttgtatatattataataatcttataattgttctcagaatcccttaacagttgtatttaacagaaattgtatattgtaatttaaaataattatataactgtatttgaaataagaattcagacatctgaggttttatttcatttttcaatagcacatatggaattttgcaaagatttaatctgccaagggccgactaagagaagttgtaaagtatgtattatttacatttaatagacttacagggataaggcctgtggggggtaatccctgctttttgtgtttttttgtttgtttgtttgtttgtttttggggggttttcttgccttggttgtctggcaaggactttgtacatttgggagtttttatgagaaacttaaatgttattatctgggcttatatctggcctctgctttctcctttaattgtaaagtaaaagctataaagcagtatttttcttgacaaatggcatatgttttccacttctttgcatgcgtttaagtcagtttatacacaaaatggattttattttttagtttaactgtgtttctccgacagctcacctctctctgaccacccagccatttccttcctgtgctccacgttcttctgtgtgattaaaataagaatattatttttggaaatatgcaactccttttcagagatcaggagggatttatgtagcagctatttttactgcaaaagtaattcactggaaaaaaaatgtaatttgtaagaaagctttatttttatctcagctctatgtaaagttaaagttactgtacagagctgaaggacggggggcggtaggggtcttgatgaaacctcttgaacgaagcacagtttgtcccatctttgttcactcgtgtgtctcaaccatcttaatagcatgctgctcctttttgctcagtgtccacagcaagatgacgtgattcttattttcttggacacagactattctgaggcacagagcggggacttaagatgggaaagagaaagcatcggagccattcattcggagaaaacgttttgatcaaaatggagacttttgtagtcgtttcaaaagagcacctgagtcatgtgtattcccggcctttataaatgacccggtcaagttggtttcaaagtccgacaggcttgtctgtttactagctgcgtggccttggacgggtggctgacatctgtaaagaatcctcctgtgatgaaactgaggaatcgggtggccgggcaagctgggaagagcaaagccagagctgcgctgcctcaatacccacaaaagaccattcccagtatacataagcacaggatgtttttctcaagagggatgtatttatcacttggacatctgtttataatataaacagacatgtgactgggaacatcttgctgccaaaagaatcctaggcagtggctcattgtatgtgaggttgaaccacgtgaaattgccaatattaggctggcttttatctacaaagaaggagtttcatggggttcagcctaacagttatggaaactacagtccttataaaccattggcatggtaataaacagatcttaagtataaaaattttgtaattgggcctttactctctcaataataaagtattttgtttatat

SEQ ID NO: 446774 - DNA, 3304 bp, Homo sapiens
ctggtacagatggcatttcataaatacttaactgtttcttgaatgcatgaatgaattcaatacaccatctggaccttttgcgatagaaaatttagtgttgccaatgacatcattcattttggaaaatttattttagtaattggaaaaatgggttgctttctctcgttttttgaaaaagacaggcagggacgtggagcaccatgagattaaatgtgaagcactccgtgcatctcatcattctaaaattatcatctcacaggaattcagaaagtcaatttgttctgtgtagttttcacctacatctgccatcttacgtctcctgtgtctgcttttcagaaaaccaagaaaagacagaagatcaatatgaagaaaattcacacctcacctccgttcctcattggattaacagcaatacattaggttttggcacagagcaggcgccctatggaatgcagacacagaattaccccaaaggcggcctcctggacagcatgtgtccggcctccacacccagcgtactcagctctgagcaggagtttcagatgttccccaagtctcggctcagctccgtcagcgtcacctactgctctgtcagtcaggacttcccaggcagcaacttgaatttgctcaccaacaattctgggacgcccaaagaccacgactcccctgagaacggtgcggacagcttcgagagctcagactccctcctccagtcctggaacagccagtcgtccttgctggatgtgcaacgggttccttccttcgagagcttcgaagatgactgcagccagtctctctgcctcaataagccaaccatgtctttcaaggattacatccaagagaggagtgacccggtggagcaaggcaaaccagttatacctgcagctgtgctggccggcttcacaggaagtggacctattcagctgtggcagtttctcctggagctgctatcagacaaatcctgccagtcattcatcagctggactggagacggatgggagtttaagctcgccgaccccgatgaggtggcccgccggtggggaaagaggaaaaataagcccaagatgaactacgagaagctgagccggggcttacgctactattacgacaagaacatcatccacaagacgtcggggaagcgctacgtgtaccgcttcgtgtgcgacctccagaacttgctggggttcacgcccgaggaactgcacgccatcctgggcgtccagcccgacacggaggactgaggtcgccgggaccaccctgagccggccccaggctcgtggactgagtgggaagcccatcctgaccagctgctccgaggacccaggaaaggcaggattgaaaatgtccaggaaagtggccaagaagcagtggccttattgcatcccaaaccacgcctcttgaccaggctgcctcccttgtggcagcaacggcacagctaattctactcacagtgcttttaagtgaaaatggtcgagaaagaggcaccgggaagccgtcctggcgcctggcagtccgtgggacgggatggttctggctgtttgagattctcaaaggagcgagcatgtcgtggacacacacagactatttttagattttcttttgccttttgcaaccaggaacagcaaatgcaaaaactctttgagagggtaggagggtgggaaggaaacaaccatgtcatttcagaagttagtttgtatatattataataatcttataattgttctcagaatcccttaacagttgtatttaacagaaattgtatattgtaatttaaaataattatataactgtatttgaaataagaattcagacatctgaggttttatttcatttttcaatagcacatatggaattttgcaaagatttaatctgccaagggccgactaagagaagttgtaaagtatgtattatttacatttaatagacttacagggataaggcctgtggggggtaatccctgctttttgtgtttttttgtttgtttgtttgtttgtttttggggggttttcttgccttggttgtctggcaaggactttgtacatttgggagtttttatgagaaacttaaatgttattatctgggcttatatctggcctctgctttctcctttaattgtaaagtaaaagctataaagcagtatttttcttgacaaatggcatatgttttccacttctttgcatgcgtttaagtcagtttatacacaaaatggattttattttttagtttaactgtgtttctccgacagctcacctctctctgaccacccagccatttccttcctgtgctccacgttcttctgtgtgattaaaataagaatattatttttggaaatatgcaactccttttcagagatcaggagggatttatgtagcagctatttttactgcaaaagtaattcactggaaaaaaaatgtaatttgtaagaaagctttatttttatctcagctctatgtaaagttaaagttactgtacagagctgaaggacggggggcggtaggggtcttgatgaaacctcttgaacgaagcacagtttgtcccatctttgttcactcgtgtgtctcaaccatcttaatagcatgctgctcctttttgctcagtgtccacagcaagatgacgtgattcttattttcttggacacagactattctgaggcacagagcggggacttaagatgggaaagagaaagcatcggagccattcattcggagaaaacgttttgatcaaaatggagacttttgtagtcgtttcaaaagagcacctgagtcatgtgtattcccggcctttataaatgacccggtcaagttggtttcaaagtccgacaggcttgtctgtttactagctgcgtggccttggacgggtggctgacatctgtaaagaatcctcctgtgatgaaactgaggaatcgggtggccgggcaagctgggaagagcaaagccagagctgcgctgcctcaatacccacaaaagaccattcccagtatacataagcacaggatgtttttctcaagagggatgtatttatcacttggacatctgtttataatataaacagacatgtgactgggaacatcttgctgccaaaagaatcctaggcagtggctcattgtatgtgaggttgaaccacgtgaaattgccaatattaggctggcttttatctacaaagaaggagtttcatggggttcagcctaacagttatggaaactacagtccttataaaccattggcatggtaataaacagatcttaagtataaaaattttgtaattgggcctttactctctcaataataaagtattttgtttatat

SEQ ID NO: 446775 - DNA, 3165 bp, Homo sapiens
ctgtaatgtctgaaattttcgttcatggtaaacataatctgccggacactcaaatgtgtttatttgttttcctttgatcttggtaatacatttcggaaatcagtaagttactaacagcaataggtattaaccatacgcagtaaggtccacagacgaaattaggatgtgcttttcttgttctaggctgtcctagtttgatcgcactgcgttcgtccagtatcaatatgaagaaaattcacacctcacctccgttcctcattggattaacagcaatacattaggttttggcacagagcaggcgccctatggaatgcagacacagaattaccccaaaggcggcctcctggacagcatgtgtccggcctccacacccagcgtactcagctctgagcaggagtttcagatgttccccaagtctcggctcagctccgtcagcgtcacctactgctctgtcagtcaggacttcccaggcagcaacttgaatttgctcaccaacaattctgggacgcccaaagaccacgactcccctgagaacggtgcggacagcttcgagagctcagactccctcctccagtcctggaacagccagtcgtccttgctggatgtgcaacgggttccttccttcgagagcttcgaagatgactgcagccagtctctctgcctcaataagccaaccatgtctttcaaggattacatccaagagaggagtgacccggtggagcaaggcaaaccagttatacctgcagctgtgctggccggcttcacaggaagtggacctattcagctgtggcagtttctcctggagctgctatcagacaaatcctgccagtcattcatcagctggactggagacggatgggagtttaagctcgccgaccccgatgaggtggcccgccggtggggaaagaggaaaaataagcccaagatgaactacgagaagctgagccggggcttacgctactattacgacaagaacatcatccacaagacgtcggggaagcgctacgtgtaccgcttcgtgtgcgacctccagaacttgctggggttcacgcccgaggaactgcacgccatcctgggcgtccagcccgacacggaggactgaggtcgccgggaccaccctgagccggccccaggctcgtggactgagtgggaagcccatcctgaccagctgctccgaggacccaggaaaggcaggattgaaaatgtccaggaaagtggccaagaagcagtggccttattgcatcccaaaccacgcctcttgaccaggctgcctcccttgtggcagcaacggcacagctaattctactcacagtgcttttaagtgaaaatggtcgagaaagaggcaccgggaagccgtcctggcgcctggcagtccgtgggacgggatggttctggctgtttgagattctcaaaggagcgagcatgtcgtggacacacacagactatttttagattttcttttgccttttgcaaccaggaacagcaaatgcaaaaactctttgagagggtaggagggtgggaaggaaacaaccatgtcatttcagaagttagtttgtatatattataataatcttataattgttctcagaatcccttaacagttgtatttaacagaaattgtatattgtaatttaaaataattatataactgtatttgaaataagaattcagacatctgaggttttatttcatttttcaatagcacatatggaattttgcaaagatttaatctgccaagggccgactaagagaagttgtaaagtatgtattatttacatttaatagacttacagggataaggcctgtggggggtaatccctgctttttgtgtttttttgtttgtttgtttgtttgtttttggggggttttcttgccttggttgtctggcaaggactttgtacatttgggagtttttatgagaaacttaaatgttattatctgggcttatatctggcctctgctttctcctttaattgtaaagtaaaagctataaagcagtatttttcttgacaaatggcatatgttttccacttctttgcatgcgtttaagtcagtttatacacaaaatggattttattttttagtttaactgtgtttctccgacagctcacctctctctgaccacccagccatttccttcctgtgctccacgttcttctgtgtgattaaaataagaatattatttttggaaatatgcaactccttttcagagatcaggagggatttatgtagcagctatttttactgcaaaagtaattcactggaaaaaaaatgtaatttgtaagaaagctttatttttatctcagctctatgtaaagttaaagttactgtacagagctgaaggacggggggcggtaggggtcttgatgaaacctcttgaacgaagcacagtttgtcccatctttgttcactcgtgtgtctcaaccatcttaatagcatgctgctcctttttgctcagtgtccacagcaagatgacgtgattcttattttcttggacacagactattctgaggcacagagcggggacttaagatgggaaagagaaagcatcggagccattcattcggagaaaacgttttgatcaaaatggagacttttgtagtcgtttcaaaagagcacctgagtcatgtgtattcccggcctttataaatgacccggtcaagttggtttcaaagtccgacaggcttgtctgtttactagctgcgtggccttggacgggtggctgacatctgtaaagaatcctcctgtgatgaaactgaggaatcgggtggccgggcaagctgggaagagcaaagccagagctgcgctgcctcaatacccacaaaagaccattcccagtatacataagcacaggatgtttttctcaagagggatgtatttatcacttggacatctgtttataatataaacagacatgtgactgggaacatcttgctgccaaaagaatcctaggcagtggctcattgtatgtgaggttgaaccacgtgaaattgccaatattaggctggcttttatctacaaagaaggagtttcatggggttcagcctaacagttatggaaactacagtccttataaaccattggcatggtaataaacagatcttaagtataaaaattttgtaattgggcctttactctctcaataataaagtattttgtttatat

SEQ ID NO: 446776 - DNA, 2952 bp, Homo sapiens
ctcgtaggggttagttactggggtaacactgactttaagagctctgccgtccgattgttctgttccaggttttggcacagagcaggcgccctatggaatgcagacacagaattaccccaaaggcggcctcctggacagcatgtgtccggcctccacacccagcgtactcagctctgagcaggagtttcagatgttccccaagtctcggctcagctccgtcagcgtcacctactgctctgtcagtcaggacttcccaggcagcaacttgaatttgctcaccaacaattctgggacgcccaaagaccacgactcccctgagaacggtgcggacagcttcgagagctcagactccctcctccagtcctggaacagccagtcgtccttgctggatgtgcaacgggttccttccttcgagagcttcgaagatgactgcagccagtctctctgcctcaataagccaaccatgtctttcaaggattacatccaagagaggagtgacccggtggagcaaggcaaaccagttatacctgcagctgtgctggccggcttcacaggaagtggacctattcagctgtggcagtttctcctggagctgctatcagacaaatcctgccagtcattcatcagctggactggagacggatgggagtttaagctcgccgaccccgatgaggtggcccgccggtggggaaagaggaaaaataagcccaagatgaactacgagaagctgagccggggcttacgctactattacgacaagaacatcatccacaagacgtcggggaagcgctacgtgtaccgcttcgtgtgcgacctccagaacttgctggggttcacgcccgaggaactgcacgccatcctgggcgtccagcccgacacggaggactgaggtcgccgggaccaccctgagccggccccaggctcgtggactgagtgggaagcccatcctgaccagctgctccgaggacccaggaaaggcaggattgaaaatgtccaggaaagtggccaagaagcagtggccttattgcatcccaaaccacgcctcttgaccaggctgcctcccttgtggcagcaacggcacagctaattctactcacagtgcttttaagtgaaaatggtcgagaaagaggcaccgggaagccgtcctggcgcctggcagtccgtgggacgggatggttctggctgtttgagattctcaaaggagcgagcatgtcgtggacacacacagactatttttagattttcttttgccttttgcaaccaggaacagcaaatgcaaaaactctttgagagggtaggagggtgggaaggaaacaaccatgtcatttcagaagttagtttgtatatattataataatcttataattgttctcagaatcccttaacagttgtatttaacagaaattgtatattgtaatttaaaataattatataactgtatttgaaataagaattcagacatctgaggttttatttcatttttcaatagcacatatggaattttgcaaagatttaatctgccaagggccgactaagagaagttgtaaagtatgtattatttacatttaatagacttacagggataaggcctgtggggggtaatccctgctttttgtgtttttttgtttgtttgtttgtttgtttttggggggttttcttgccttggttgtctggcaaggactttgtacatttgggagtttttatgagaaacttaaatgttattatctgggcttatatctggcctctgctttctcctttaattgtaaagtaaaagctataaagcagtatttttcttgacaaatggcatatgttttccacttctttgcatgcgtttaagtcagtttatacacaaaatggattttattttttagtttaactgtgtttctccgacagctcacctctctctgaccacccagccatttccttcctgtgctccacgttcttctgtgtgattaaaataagaatattatttttggaaatatgcaactccttttcagagatcaggagggatttatgtagcagctatttttactgcaaaagtaattcactggaaaaaaaatgtaatttgtaagaaagctttatttttatctcagctctatgtaaagttaaagttactgtacagagctgaaggacggggggcggtaggggtcttgatgaaacctcttgaacgaagcacagtttgtcccatctttgttcactcgtgtgtctcaaccatcttaatagcatgctgctcctttttgctcagtgtccacagcaagatgacgtgattcttattttcttggacacagactattctgaggcacagagcggggacttaagatgggaaagagaaagcatcggagccattcattcggagaaaacgttttgatcaaaatggagacttttgtagtcgtttcaaaagagcacctgagtcatgtgtattcccggcctttataaatgacccggtcaagttggtttcaaagtccgacaggcttgtctgtttactagctgcgtggccttggacgggtggctgacatctgtaaagaatcctcctgtgatgaaactgaggaatcgggtggccgggcaagctgggaagagcaaagccagagctgcgctgcctcaatacccacaaaagaccattcccagtatacataagcacaggatgtttttctcaagagggatgtatttatcacttggacatctgtttataatataaacagacatgtgactgggaacatcttgctgccaaaagaatcctaggcagtggctcattgtatgtgaggttgaaccacgtgaaattgccaatattaggctggcttttatctacaaagaaggagtttcatggggttcagcctaacagttatggaaactacagtccttataaaccattggcatggtaataaacagatcttaagtataaaaattttgtaattgggcctttactctctcaataataaagtattttgtttatat

SEQ ID NO: 446777 - DNA, 3710 bp, Homo sapiens
ccgtttcctcccctcccctccactcggccgtccctccttcctcctccctcctccctcctcctcccgctcctgaagagcgcgccgcgtgggggacggcccggttacttcctccagagactgacgagtgcggtgtcgctccagctcagagctcccggagccgcccggccagcgtccggcctccctgatcgtctctggccggcgccctcgccctcgcccggcgcgcaccgagcagccgcgggcgccgagcagccaccgtcccgaccaagcgccggccctgcccgcagcggcaggatgaatgatttcggaatcaagaatatggaccaggtagcccctgtggctaacagttacagagggacactcaagcgccagccagcctttgacacctttgatgggtccctgtttgctgtttttccttctctaaatgaagagcaaacactgcaagaagtgccaacaggcttggattccatttctcatgactccgccaactgtgaattgcctttgttaaccccgtgcagcaaggctgtgatgagtcaagccttaaaagctaccttcagtggcttcaaaaaggaacagcggcgcctgggcattccaaagaacccctggctgtggagtgagcaacaggtatgccagtggcttctctgggccaccaatgagttcagtctggtgaacgtgaatctgcagaggttcggcatgaatggccagatgctgtgtaaccttggcaaggaacgctttctggagctggcacctgactttgtgggtgacattctctgggaacatctggagcaaatgatcaaagaaaaccaagaaaagacagaagatcaatatgaagaaaattcacacctcacctccgttcctcattggattaacagcaatacattaggttttggcacagagcaggcgccctatggaatgcagacacagaattaccccaaaggcggcctcctggacagcatgtgtccggcctccacacccagcgtactcagctctgagcaggagtttcagatgttccccaagtctcggctcagctccgtcagcgtcacctactgctctgtcagtcaggacttcccaggcagcaacttgaatttgctcaccaacaattctgggacgcccaaagaccacgactcccctgagaacggtgcggacagcttcgagagctcagactccctcctccagtcctggaacagccagtcgtccttgctggatgtgcaacgggttccttccttcgagagcttcgaagatgactgcagccagtctctctgcctcaataagccaaccatgtctttcaaggattacatccaagagaggagtgacccggtggagcaaggcaaaccagttatacctgcagctgtgctggccggcttcacaggaagtggacctattcagctgtggcagtttctcctggagctgctatcagacaaatcctgccagtcattcatcagctggactggagacggatgggagtttaagctcgccgaccccgatgaggtggcccgccggtggggaaagaggaaaaataagcccaagatgaactacgagaagctgagccggggcttacgctactattacgacaagaacatcatccacaagacgtcggggaagcgctacgtgtaccgcttcgtgtgcgacctccagaacttgctggggttcacgcccgaggaactgcacgccatcctgggcgtccagcccgacacggaggactgaggtcgccgggaccaccctgagccggccccaggctcgtggactgagtgggaagcccatcctgaccagctgctccgaggacccaggaaaggcaggattgaaaatgtccaggaaagtggccaagaagcagtggccttattgcatcccaaaccacgcctcttgaccaggctgcctcccttgtggcagcaacggcacagctaattctactcacagtgcttttaagtgggacgggatggttctggctgtttgagattctcaaaggagcgagcatgtcgtggacacacacagactatttttagattttcttttgccttttgcaaccaggaacagcaaatgcaaaaactctttgagagggtaggagggtgggaaggaaacaaccatgtcatttcagaagttagtttgtatatattataataatcttataattgttctcagaatcccttaacagttgtatttaacagaaattgtatattgtaatttaaaataattatataactgtatttgaaataagaattcagacatctgaggttttatttcatttttcaatagcacatatggaattttgcaaagatttaatctgccaagggccgactaagagaagttgtaaagtatgtattatttacatttaatagacttacagggataaggcctgtggggggtaatccctgctttttgtgtttttttgtttgtttgtttgtttgtttttggggggttttcttgccttggttgtctggcaaggactttgtacatttgggagtttttatgagaaacttaaatgttattatctgggcttatatctggcctctgctttctcctttaattgtaaagtaaaagctataaagcagtatttttcttgacaaatggcatatgttttccacttctttgcatgcgtttaagtcagtttatacacaaaatggattttattttttagtttaactgtgtttctccgacagctcacctctctctgaccacccagccatttccttcctgtgctccacgttcttctgtgtgattaaaataagaatattatttttggaaatatgcaactccttttcagagatcaggagggatttatgtagcagctatttttactgcaaaagtaattcactggaaaaaaaatgtaatttgtaagaaagctttatttttatctcagctctatgtaaagttaaagttactgtacagagctgaaggacggggggcggtaggggtcttgatgaaacctcttgaacgaagcacagtttgtcccatctttgttcactcgtgtgtctcaaccatcttaatagcatgctgctcctttttgctcagtgtccacagcaagatgacgtgattcttattttcttggacacagactattctgaggcacagagcggggacttaagatgggaaagagaaagcatcggagccattcattcggagaaaacgttttgatcaaaatggagacttttgtagtcgtttcaaaagagcacctgagtcatgtgtattcccggcctttataaatgacccggtcaagttggtttcaaagtccgacaggcttgtctgtttactagctgcgtggccttggacgggtggctgacatctgtaaagaatcctcctgtgatgaaactgaggaatcgggtggccgggcaagctgggaagagcaaagccagagctgcgctgcctcaatacccacaaaagaccattcccagtatacataagcacaggatgtttttctcaagagggatgtatttatcacttggacatctgtttataatataaacagacatgtgactgggaacatcttgctgccaaaagaatcctaggcagtggctcattgtatgtgaggttgaaccacgtgaaattgccaatattaggctggcttttatctacaaagaaggagtttcatggggttcagcctaacagttatggaaactacagtccttataaaccattggcatggtaataaacagatcttaagtataaaaattttgtaattgggcctttactctctcaataataaagtattttgtttatat

SEQ ID NO: 446778 - DNA, 1678 bp, Homo sapiens
  misc_feature (1)..(1): n is a, c, g, or t
naattcgcggccgcgtcgacacggctgcgagagacgacagaagccatgtcatttcagaagttagtttgtatatattataataatcttataattgttctcagaatcccttaacagttgtatttaacagaaattgtatattgtaatttaaaataattatataactgtatttgaaataagaattcagacatctgaggttttatttcatttttcaatagcacatatggaattttgcaaagatttaatctgccaagggccgactaagagaagttgtaaagtatgtattatttacatttaatagacttacagggataaggcctgtggggggtaatccctgctttttgtgtttttttgtttgtttgtttgtttgtttttggggggttttcttgccttggttgtctggcaaggactttgtacatttgggagtttttatgagaaacttaaatgttattatctgggcttatatctggcctctgctttctcctttaattgtaaagtaaaagctataaagcagtatttttcttgacaaatggcatatgttttccacttctttgcatgcgtttaagtcagtttatacacaaaatggattttattttttagtttaactgtgtttctccgacagctcacctctctctgaccacccagccatttccttcctgtgctccacgttcttctgtgtgattaaaataagaatattatttttggaaatatgcaactccttttcagagatcaggagggatttatgtagcagctatttttactgcaaaagtaattcactggaaaaaaaatgtaatttgtaagaaagctttatttttatctcagctctatgtaaagttaaagttactgtacagagctgaaggacggggggcggtaggggtcttgatgaaacctcttgaacgaagcacagtttgtcccatctttgttcactcgtgtgtctcaaccatcttaatagcatgctgctcctttttgctcagtgtccacagcaagatgacgtgattcttattttcttggacacagactattctgaggcacagagcggggacttaagatgggaaagagaaagcatcggagccattcattcggagaaaacgttttgatcaaaatggagacttttgtagtcgtttcaaaagagcacctgagtcatgtgtattcccggcctttataaatgacccggtcaagttggtttcaaagtccgacaggcttgtctgtttactagctgcgtggccttggacgggtggctgacatctgtaaagaatcctcctgtgatgaaactgaggaatcgggtggccgggcaagctgggaagagcaaagccagagctgcgctgcctcaatacccacaaaagaccattcccagtatacataagcacaggatgtttttctcaagagggatgtatttatcacttggacatctgtttataatataaacagacatgtgactgggaacatcttgctgccaaaagaatcctaggcagtggctcattgtatgtgaggttgaaccacgtgaaattgccaatattaggctggcttttatctacaaagaaggagtttcatggggttcagcctaacagttatggaaactacagtccttataaaccattggcatggtaataaacagatcttaagtataaaaattttgtaattgggcctttactctctcaataataaagtattttgtttatat

SEQ ID NO: 446779 - DNA, 1401 bp, Homo sapiens
ccgtttcctcccctcccctccactcggccgtccctccttcctcctccctcctccctcctcctcccgctcctgaagagcgcgccgcgtgggggacggcccggttacttcctccagagactgacgagtgcggtgtcgctccagctcagagctcccggagccgcccggccagcgtccggcctccctgatcgtctctggccggcgccctcgccctcgcccggcgcgcaccgagcagccgcgggcgccgagcagccaccgtcccgaccaagcgccggccctgcccgcagcggcaggatgaatgatttcggaatcaagaatatggaccaggtagcccctgtggctaacagttacagagggacactcaagcgccagccagcctttgacacctttgatgggtccctgtttgctgtttttccttctctaaatgaagagcaaacactgcaagaagtgccaacaggcttggattccatttctcatgactccgccaactgtgaattgcctttgttaaccccgtgcagcaaggctgtgatgagtcaagccttaaaagctaccttcagtggcttcaaaaaggaacagcggcgcctgggcattccaaagaacccctggctgtggagtgagcaacaggtatgccagtggcttctctgggccaccaatgagttcagtctggtgaacgtgaatctgcagaggttcggcatgaatggccagatgctgtgtaaccttggcaaggaacgctttctggagctggcacctgactttgtgggtgacattctctgggaacatctggagcaaatgatcaaagaaaaccaagaaaagacagaagatcaatatgaagaaaattcacacctcacctccgttcctcattggattaacagcaatacattaggtcagtccgattgattctgcccttaagaactttgtcttcagtcttcccagtagacttggaatctctctactgtaggctcctaaggggccacctagacctgtgtgtctcttatggtggccacacgtgggtgttgagctataagccattgaaatgtgactggtccacatcgagatgtgtaggaagagtatagtcatgcacaccagatttggaagtcttagtatgaaacagagaatataaaatgtctccctgataatttttaatgtattgattacatattgaaatgataattgctatatgaggccaagtaaaataagaaaattaacttcacctgtttctttttgcttttttaatatggccactagaactttcgcagttgcttaagtggctcacacgatcttccataggtcagcactgttagtgctagtccaggcaattcttagagcaaggagcagaacgaagtgagctgattaccgcagtcaccagtaatgttggtttagtgtagcaaacaagaggcggcaggc

SEQ ID NO: 446780 - DNA, 1414 bp, Homo sapiens
ccgtttcctcccctcccctccactcggccgtccctccttcctcctccctcctccctcctcctcccgctcctgaagagcgcgccgcgtgggggacggcccggttacttcctccagagactgacgagtgcggtgtcgctccagctcagagctcccggagccgcccggccagcgtccggcctccctgatcgtctctggccggcgccctcgccctcgcccggcgcgcaccgagcagccgcgggcgccgagcagccaccgtcccgaccaagcgccggccctgcccgcagcggcaggatgaatgatttcggaatcaagaatatggaccaggtagcccctgtggctaacagttacagagggacactcaagcgccagccagcctttgacacctttgatgggtccctgtttgctgtttttccttctctaaatgaagagcaaacactgcaagaagtgccaacaggcttggattccatttctcatgactccgccaactgtgaattgcctttgttaaccccgtgcagcaaggctgtgatgagtcaagccttaaaagctaccttcagtggcttcaaaaaggaacagcggcgcctgggcattccaaagaacccctggctgtggagtgagcaacaggtatgccagtggcttctctgggccaccaatgagttcagtctggtgaacgtgaatctgcagaggttcggcatgaatggccagatgctgtgtaaccttggcaaggaacgctttctggagctggcacctgactttgtgggtgacattctctgggaacatctggagcaaatgatcaaaggtaccagctgaacgtcttacttctccttgtccaggatgagctgtggccgggaagactgattgggaaagtcacgtgggtgttcttcaaccttagggttgccacttgaaatgacatagagtaccttgcctcaaaatgccactcaagtgagtcagatatatggcagtgattatagatttttatcccactttatgtgagtgtgtgtgtgtgtgtgtgtgtgtgtgtatagcatcaagtatagccacaaggtagtagccttagtcactaaattgtttgctattgctggctgtattcatcacgggagtccatgttgactcagatatgtaggacagcaagaattcccacgtcttctgagctcaccttacagagctaagagatatggcagccttaatgaaaggggggagcctttactcacataaaccctgtgaattctactgtaaattttcctacatccaaatggaatgtattttggatgttgaggattgttgagggggcggggtctgtttttaaacaagtgagaaattgatatatatttacacgctatcatattgtacagaaactggccattgatcagtagaaatctcaccaaatacagagaaagtcttgattcaaaacttaaaa

SEQ ID NO: 446781 - DNA, 424 bp, Homo sapiens
gagaccagcctggccaacatggtgaaaccctgtctgtactaaaaatgcaaaaattatccaggcgtggtggtgggcgcctgtagtcccagctactcgggaggctgaggcaggagaatcgcttgaacccaggagggggaggttgcagtgagccaagattgcaccactgcactctggcctgtgtgacagagtaagacctgtctcaaaataataataataataatccacagtaaaatacaatcatttcagtcactttgaccattttacgagtctgttttaaggactgactggttgattccatgtttgcttcaaaattgccagtttaatcagggactattggtaggattgcccacagaccacttttacaacaggtaattcaatcagtttaaatattgtatttccattttttttccatctgtttttgcag

SEQ ID NO: 446782 - DNA, 642 bp, Homo sapiens
ccgtttcctcccctcccctccactcggccgtccctccttcctcctccctcctccctcctcctcccgctcctgaagagcgcgccgcgtgggggacggcccggttacttcctccagagactgacgagtgcggtgtcgctccagctcagagctcccggagccgcccggccagcgtccggcctccctgatcgtctctggccggcgccctcgccctcgcccggcgcgcaccgagcagccgcgggcgccgagcagccaccgtcccgaccaagcgccggccctgcccgcagcggcaggatgaatgatttcggaatcaagaatatggaccaggtagcccctgtggctaacagttacagagggacactcaagcgccagccagcctttgacacctttgatgggtccctgtttgctgtttttccttctctaaatgaagagcaaacactgcaagaagtgccaacaggcttggattccatttctcatgactccgccaactgtgaattgcctttgttaaccccgtgcagcaaggactttgtacatttgggagtttttatgagaaacttaaatgttattatctgggcttatatctggcctctgctttctcctttaattgtaaagtaaaagctataaagcagtatttttcttgacaaa

SEQ ID NO: 446783 - DNA, 3715 bp, Homo sapiens
ccgtttcctcccctcccctccactcggccgtccctccttcctcctccctcctccctcctcctcccgctcctgaagagcgcgccgcgtgggggacggcccggttacttcctccagagactgacgagtgcggtgtcgctccagctcagagctcccggagccgcccggccagcgtccggcctccctgatcgtctctggccggcgccctcgccctcgcccggcgcgcaccgagcagccgcgggcgccgagcagccaccgtcccgaccaagcgccggccctgcccgcagcggcaggatgaatgatttcggaatcaagaatatggaccaggtagcccctgtggctaacagttacagagggacactcaagcgccagccagcctttgacacctttgatgggtccctgtttgctgtttttccttctctaaatgaagagcaaacactgcaagaagtgccaacaggcttggattccatttctcatgactccgccaactgtgaattgcctttgttaaccccgtgcagcaaggctgtgatgagtcaagccttaaaagctaccttcagtggcttcaaaaaggaacagcggcgcctgggcattccaaagaacccctggctgtggagtgagcaacaggtatgccagtggcttctctgggccaccaatgagttcagtctggtgaacgtgaatctgcagaggttcggcatgaatggccagatgctgtgtaaccttggcaaggaacgctttctggagctggcacctgactttgtgggtgacattctctgggaacatctggagcaaatgatcaaagaaaaccaagaaaagacagaagatcaatatgaagaaaattcacacctcacctccgttcctcattggattaacagcaatacattaggttttggcacagagcaggcgccctatggaatgcagacacagaattaccccaaaggcggcctcctggacagcatgtgtccggcctccacacccagcgtactcagctctgagcaggagtttcagatgttccccaagtctcggctcagctccgtcagcgtcacctactgctctgtcagtcaggacttcccaggcagcaacttgaatttgctcaccaacaattctgggacgcccaaagaccacgactcccctgagaacggtgcggacagcttcgagagctcagactccctcctccagtcctggaacagccagtcgtccttgctggatgtgcaacgggttccttccttcgagagcttcgaagatgactgcagccagtctctctgcctcaataagccaaccatgtctttcaaggattacatccaagagaggagtgacccggtggagcaaggcaaaccagttatacctgcagctgtgctggccggcttcacaggaagtggacctattcagctgtggcagtttctcctggagctgctatcagacaaatcctgccagtcattcatcagctggactggagacggatgggagtttaagctcgccgaccccgatgaggtggcccgccggtggggaaagaggaaaaataagcccaagatgaactacgagaagctgagccggggcttacgctactattacgacaagaacatcatccacaagacgtcggggaagcgctacgtgtaccgcttcgtgtgcgacctccagaacttgctggggttcacgcccgaggaactgcacgccatcctgggcgtccagcccgacacggaggactgaggtcgccgggaccaccctgagccggccccaggctcgtggactgagtgggaagcccatcctgaccagctgctccgaggacccaggaaaggcaggattgaaaatgtccaggaaagtggccaagaagcagtggccttattgcatcccaaaccacgcctcttgaccaggctgcctcccttgtggcagcaacggcacagctaattctactcacagtgcttttaagtgaaaatggtcgagaaagaggcaccgggaagccgtcctggcgcctggcagtccgtgggacgggatggttctggctgtttgagattctcaaaggagcgagcatgtcgtggacacacacagactatttttagattttcttttgccttttgcaaccaggaacagcaaatgcaaaaactctttgagagggtaggagggtgggaaggaaacaaccatgtcatttcagaagttagtttgtatatattataataatcttataattgttctcagaatcccttaacagttgtatttaacagaaattgtatattgtaatttaaaataattatataactgtatttgaaataagaattcagacatctgaggttttatttcatttttcaatagcacatatggaattttgcaaagatttaatctgccaagggccgactaagagaagttgtaaagtatgtattatttacatttaatagacttacagggataaggcctgtggggggtaatccctgctttttgtgtttttttgtttgtttgtttgtttgtttttggggggttttcttgccttggttgtctggcaaggactttgtacatttgggagtttttatgagaaacttaaatgttattatctgggcttatatctggcctctgctttctcctttaattgtaaagtaaaagctataaagcagtatttttcttgacaaatggcatatgttttccacttctttgcatgcgtttaagtcagtttatacacaaaatggattttattttttagtttaactgtgtttctccgacagctcacctctctctgaccacccagccatttccttcctgtgctccacgttcttctgtgtgattaaaataagaatattatttttggaaatatgcaactccttttcagagatcaggagggatttatgtagcagctatttttactgcaaaagtaattcactggtaaagttaaagttactgtacagagctgaaggacggggggcggtaggggtcttgatgaaacctcttgaacgaagcacagtttgtcccatctttgttcactcgtgtgtctcaaccatcttaatagcatgctgctcctttttgctcagtgtccacagcaagatgacgtgattcttattttcttggacacagactattctgaggcacagagcggggacttaagatgggaaagagaaagcatcggagccattcattcggagaaaacgttttgatcaaaatggagacttttgtagtcgtttcaaaagagcacctgagtcatgtgtattcccggcctttataaatgacccggtcaagttggtttcaaagtccgacaggcttgtctgtttactagctgcgtggccttggacgggtggctgacatctgtaaagaatcctcctgtgatgaaactgaggaatcgggtggccgggcaagctgggaagagcaaagccagagctgcgctgcctcaatacccacaaaagaccattcccagtatacataagcacaggatgtttttctcaagagggatgtatttatcacttggacatctgtttataatataaacagacatgtgactgggaacatcttgctgccaaaagaatcctaggcagtggctcattgtatgtgaggttgaaccacgtgaaattgccaatattaggctggcttttatctacaaagaaggagtttcatggggttcagcctaacagttatggaaactacagtccttataaaccattggcatggtaataaacagatcttaagtataaaaattttgtaattgggcctttactctctcaataataaagtattttgtttatat

SEQ ID NO: 446784 - DNA, 2613 bp, Homo sapiens
ccgtttcctcccctcccctccactcggccgtccctccttcctcctccctcctccctcctcctcccgctcctgaagagcgcgccgcgtgggggacggcccggttacttcctccagagactgacgagtgcggtgtcgctccagctcagagctcccggagccgcccggccagcgtccggcctccctgatcgtctctggccggcgccctcgccctcgcccggcgcgcaccgagcagccgcgggcgccgagcagccaccgtcccgaccaagcgccggccctgcccgcagcggcaggatgaatgatttcggaatcaagaatatggaccaggtagcccctgtggctaacagttacagagggacactcaagcgccagccagcctttgacacctttgatgggtccctgtttgctgtttttccttctctaaatgaagagcaaacactgcaagaagtgccaacaggcttggattccatttctcatgactccgccaactgtgaattgcctttgttaaccccgtgcagcaaggctgtgatgagtcaagccttaaaagctaccttcagtggcttcaaaaaggaacagcggcgcctgggcattccaaagaacccctggctgtggagtgagcaacaggtatgccagtggcttctctgggccaccaatgagttcagtctggtgaacgtgaatctgcagaggttcggcatgaatggccagatgctgtgtaaccttggcaaggaacgctttctggagctggcacctgactttgtgggtgacattctctgggaacatctggagcaaatgatcaaagaaaaccaagaaaagacagaagatcaatatgaagaaaattcacacctcacctccgttcctcattggattaacagcaatacattaggttttggcacagagcaggcgccctatggaatgcagacacagaattaccccaaaggcggcctcctggacagcatgtgtccggcctccacacccagcgtactcagctctgagcaggagtttcagatgttccccaagtctcggctcagctccgtcagcgtcacctactgctctgtcagtcaggacttcccaggcagcaacttgaatttgctcaccaacaattctgggacgcccaaagaccacgactcccctgagaacggtgcggacagcttcgagagctcagactccctcctccagtcctggaacagccagtcgtccttgctggatgtgcaacgggttccttccttcgagagcttcgaagatgactgcagccagtctctctgcctcaataagccaaccatgtctttcaaggattacatccaagagaggagtgacccggtggagcaaggcaaaccagttatacctgcagctgtgctggccggcttcacaggaagtggacctattcagctgtggcagtttctcctggagctgctatcagacaaatcctgccagtcattcatcagctggactggagacggatgggagtttaagctcgccgaccccgatgaggtggcccgccggtggggaaagaggaaaaataagcccaagatgaactacgagaagctgagccggggcttacgctactattacgacaagaacatcatccacaagacgtcggggaagcgctacgtgtaccgcttcgtgtgcgacctccagaacttgctggggttcacgcccgaggaactgcacgccatcctgggcgtccagcccgacacggaggactgaggtcgccgggaccaccctgagccggccccaggctcgtggactgagtgggaagcccatcctgaccagctgctccgaggacccaggaaaggcaggattgaaaatgtccaggaaagtggccaagaagcagtggccttattgcatcccaaaccacgcctcttgaccaggctgcctcccttgtggcagcaacggcacagctaattctactcacagtgcttttaagtgaaaatggtcgagaaagaggcaccgggaagccgtcctggcgcctggcagtccgtgggacgggatggttctggctgtttgagattctcaaaggagcgagcatgtcgtggacacacacagactatttttagattttcttttgccttttgcaaccaggaacagcaaatgcaaaaactctttgagagggtaggagggtgggaaggaaacaaccatgtcatttcagaagttagtttgtatatattataataatcttataattgttctcagaatcccttaacagttgtatttaacagaaattgtatattgtaatttaaaataattatataactgtatttgaaataagaattcagacatctgaggttttatttcatttttcaatagcacatatggaattttgcaaagatttaatctgccaagggccgactaagagaagttgtaaagtatgtattatttacatttaatagacttacagggataaggcctgtggggggtaatccctgctttttgtgtttttttgtttgtttgtttgtttgtttttggggggttttcttgccttggttgtctggcaaggactttgtacatttgggagtttttatgagaaacttaaatgttattatctgggcttatatctggcctctgctttctcctttaattgtaaagtaaaagctataaagcagtatttttcttgacaaa

SEQ ID NO: 446785 - DNA, 3791 bp, Homo sapiens
  misc_feature (3771)..(3771): n is a, c, g, or t
ccgtttcctcccctcccctccactcggccgtccctccttcctcctccctcctccctcctcctcccgctcctgaagagcgcgccgcgtgggggacggcccggttacttcctccagagactgacgagtgcggtgtcgctccagctcagagctcccggagccgcccggccagcgtccggcctccctgatcgtctctggccggcgccctcgccctcgcccggcgcgcaccgagcagccgcgggcgccgagcagccaccgtcccgaccaagcgccggccctgcccgcagcggcaggatgaatgatttcggaatcaagaatatggaccaggtagcccctgtggctaacagttacagagggacactcaagcgccagccagcctttgacacctttgatgggtccctgtttgctgtttttccttctctaaatgaagagcaaacactgcaagaagtgccaacaggcttggattccatttctcatgactccgccaactgtgaattgcctttgttaaccccgtgcagcaaggctgtgatgagtcaagccttaaaagctaccttcagtggcttcaaaaaggaacagcggcgcctgggcattccaaagaacccctggctgtggagtgagcaacaggtatgccagtggcttctctgggccaccaatgagttcagtctggtgaacgtgaatctgcagaggttcggcatgaatggccagatgctgtgtaaccttggcaaggaacgctttctggagctggcacctgactttgtgggtgacattctctgggaacatctggagcaaatgatcaaagaaaaccaagaaaagacagaagatcaatatgaagaaaattcacacctcacctccgttcctcattggattaacagcaatacattaggttttggcacagagcaggcgccctatggaatgcagacacagaattaccccaaaggcggcctcctggacagcatgtgtccggcctccacacccagcgtactcagctctgagcaggagtttcagatgttccccaagtctcggctcagctccgtcagcgtcacctactgctctgtcagtcaggacttcccaggcagcaacttgaatttgctcaccaacaattctgggacgcccaaagaccacgactcccctgagaacggtgcggacagcttcgagagctcagactccctcctccagtcctggaacagccagtcgtccttgctggatgtgcaacgggttccttccttcgagagcttcgaagatgactgcagccagtctctctgcctcaataagccaaccatgtctttcaaggattacatccaagagaggagtgacccggtggagcaaggcaaaccagttatacctgcagctgtgctggccggcttcacaggaagtggacctattcagctgtggcagtttctcctggagctgctatcagacaaatcctgccagtcattcatcagctggactggagacggatgggagtttaagctcgccgaccccgatgaggtggcccgccggtggggaaagaggaaaaataagcccaagatgaactacgagaagctgagccggggcttacgctactattacgacaagaacatcatccacaagacgtcggggaagcgctacgtgtaccgcttcgtgtgcgacctccagaacttgctggggttcacgcccgaggaactgcacgccatcctgggcgtccagcccgacacggaggactgaggtcgccgggaccaccctgagccggccccaggctcgtggactgagtgggaagcccatcctgaccagctgctccgaggacccaggaaaggcaggattgaaaatgtccaggaaagtggccaagaagcagtggccttattgcatcccaaaccacgcctcttgaccaggctgcctcccttgtggcagcaacggcacagctaattctactcacagtgcttttaagtgaaaatggtcgagaaagaggcaccgggaagccgtcctggcgcctggcagtccgtgggacgggatggttctggctgtttgagattctcaaaggagcgagcatgtcgtggacacacacagactatttttagattttcttttgccttttgcaaccaggaacagcaaatgcaaaaactctttgagagggtaggagggtgggaaggaaacaaccatgtcatttcagaagttagtttgtatatattataataatcttataattgttctcagaatcccttaacagttgtatttaacagaaattgtatattgtaatttaaaataattatataactgtatttgaaataagaattcagacatctgaggttttatttcatttttcaatagcacatatggaattttgcaaagatttaatctgccaagggccgactaagagaagttgtaaagtatgtattatttacatttaatagacttacagggataaggcctgtggggggtaatccctgctttttgtgtttttttgtttgtttgtttgtttgtttttggggggttttcttgccttggttgtctggcaaggactttgtacatttgggagtttttatgagaaacttaaatgttattatctgggcttatatctggcctctgctttctcctttaattgtaaagtaaaagctataaagcagtatttttcttgacaaatggcatatgttttccacttctttgcatgcgtttaagtcagtttatacacaaaatggattttattttttagtttaactgtgtttctccgacagctcacctctctctgaccacccagccatttccttcctgtgctccacgttcttctgtgtgattaaaataagaatattatttttggaaatatgcaactccttttcagagatcaggagggatttatgtagcagctatttttactgcaaaagtaattcactggaaaaaaaatgtaatttgtaagaaagctttatttttatctcagctctatgtaaagttaaagttactgtacagagctgaaggacggggggcggtaggggtcttgatgaaacctcttgaacgaagcacagtttgtcccatctttgttcactcgtgtgtctcaaccatcttaatagcatgctgctcctttttgctcagtgtccacagcaagatgacgtgattcttattttcttggacacagactattctgaggcacagagcggggacttaagatgggaaagagaaagcatcggagccattcattcggagaaaacgttttgatcaaaatggagacttttgtagtcgtttcaaaagagcacctgagtcatgtgtattcccggcctttataaatgacccggtcaagttggtttcaaagtccgacaggcttgtctgtttactagctgcgtggccttggacgggtggctgacatctgtaaagaatcctcctgtgatgaaactgaggaatcgggtggccgggcaagctgggaagagcaaagccagagctgcgctgcctcaatacccacaaaagaccattcccagtatacataagcacaggatgtttttctcaagagggatgtatttatcacttggacatctgtttataatataaacagacatgtgactgggaacatcttgctgccaaaagaatcctaggcagtggctcattgtatgtgaggttgaaccacgtgaaattgccaatattaggctggcttttatctacaaagaaggagtttcatggggttcagcctaacagttatggaaactacagtccttataaaccattggcatggtaataaacagatcttaagtataaaaattttgtaattgggcctttactctctcaataataaagtattttgtttatattaagaancacacgaagaaaaacaggcg

SEQ ID NO: 446786 - DNA, 4122 bp, Homo sapiens
ccgtttcctcccctcccctccactcggccgtccctccttcctcctccctcctccctcctcctcccgctcctgaagagcgcgccgcgtgggggacggcccggttacttcctccagagactgacgagtgcggtgtcgctccagctcagagctcccggagccgcccggccagcgtccggcctccctgatcgtctctggccggcgccctcgccctcgcccggcgcgcaccgagcagccgcgggcgccgagcagccaccgtcccgaccaagcgccggccctgcccgcagcggcagggaaacgcaggcctggtagggggtcctgcccagtggatgtcccggcgaacatgatttcgcgaacgggagtgggggcacaggagagcgtgtccgaggtggcctggcgccccggctttgagggtgacttcctggagcggcgccgggcccggaggatctggggcgcccaagacacctgaaggctgcggcaccgcgggaacctgcggggcgcggggtgccatggtcacctgctcgccgcgtccagggcccgggctggggacccctcggtcgtgcgaggagagcgtggggaacctgtcggaaatgagatctggttgcgctgggctgcctttattttctcgttcctacagcatttgaatgaagagatgaatgatttcggaatcaagaatatggaccaggtagcccctgtggctaacagttacagagggacactcaagcgccagccagcctttgacacctttgatgggtccctgtttgctgtttttccttctctaaatgaagagcaaacactgcaagaagtgccaacaggcttggattccatttctcatgactccgccaactgtgaattgcctttgttaaccccgtgcagcaaggctgtgatgagtcaagccttaaaagctaccttcagtggcttcaaaaaggaacagcggcgcctgggcattccaaagaacccctggctgtggagtgagcaacaggtatgccagtggcttctctgggccaccaatgagttcagtctggtgaacgtgaatctgcagaggttcggcatgaatggccagatgctgtgtaaccttggcaaggaacgctttctggagctggcacctgactttgtgggtgacattctctgggaacatctggagcaaatgatcaaagaaaaccaagaaaagacagaagatcaatatgaagaaaattcacacctcacctccgttcctcattggattaacagcaatacattaggttttggcacagagcaggcgccctatggaatgcagacacagaattaccccaaaggcggcctcctggacagcatgtgtccggcctccacacccagcgtactcagctctgagcaggagtttcagatgttccccaagtctcggctcagctccgtcagcgtcacctactgctctgtcagtcaggacttcccaggcagcaacttgaatttgctcaccaacaattctgggacgcccaaagaccacgactcccctgagaacggtgcggacagcttcgagagctcagactccctcctccagtcctggaacagccagtcgtccttgctggatgtgcaacgggttccttccttcgagagcttcgaagatgactgcagccagtctctctgcctcaataagccaaccatgtctttcaaggattacatccaagagaggagtgacccggtggagcaaggcaaaccagttatacctgcagctgtgctggccggcttcacaggaagtggacctattcagctgtggcagtttctcctggagctgctatcagacaaatcctgccagtcattcatcagctggactggagacggatgggagtttaagctcgccgaccccgatgaggtggcccgccggtggggaaagaggaaaaataagcccaagatgaactacgagaagctgagccggggcttacgctactattacgacaagaacatcatccacaagacgtcggggaagcgctacgtgtaccgcttcgtgtgcgacctccagaacttgctggggttcacgcccgaggaactgcacgccatcctgggcgtccagcccgacacggaggactgaggtcgccgggaccaccctgagccggccccaggctcgtggactgagtgggaagcccatcctgaccagctgctccgaggacccaggaaaggcaggattgaaaatgtccaggaaagtggccaagaagcagtggccttattgcatcccaaaccacgcctcttgaccaggctgcctcccttgtggcagcaacggcacagctaattctactcacagtgcttttaagtgaaaatggtcgagaaagaggcaccgggaagccgtcctggcgcctggcagtccgtgggacgggatggttctggctgtttgagattctcaaaggagcgagcatgtcgtggacacacacagactatttttagattttcttttgccttttgcaaccaggaacagcaaatgcaaaaactctttgagagggtaggagggtgggaaggaaacaaccatgtcatttcagaagttagtttgtatatattataataatcttataattgttctcagaatcccttaacagttgtatttaacagaaattgtatattgtaatttaaaataattatataactgtatttgaaataagaattcagacatctgaggttttatttcatttttcaatagcacatatggaattttgcaaagatttaatctgccaagggccgactaagagaagttgtaaagtatgtattatttacatttaatagacttacagggataaggcctgtggggggtaatccctgctttttgtgtttttttgtttgtttgtttgtttgtttttggggggttttcttgccttggttgtctggcaaggactttgtacatttgggagtttttatgagaaacttaaatgttattatctgggcttatatctggcctctgctttctcctttaattgtaaagtaaaagctataaagcagtatttttcttgacaaatggcatatgttttccacttctttgcatgcgtttaagtcagtttatacacaaaatggattttattttttagtttaactgtgtttctccgacagctcacctctctctgaccacccagccatttccttcctgtgctccacgttcttctgtgtgattaaaataagaatattatttttggaaatatgcaactccttttcagagatcaggagggatttatgtagcagctatttttactgcaaaagtaattcactggaaaaaaaatgtaatttgtaagaaagctttatttttatctcagctctatgtaaagttaaagttactgtacagagctgaaggacggggggcggtaggggtcttgatgaaacctcttgaacgaagcacagtttgtcccatctttgttcactcgtgtgtctcaaccatcttaatagcatgctgctcctttttgctcagtgtccacagcaagatgacgtgattcttattttcttggacacagactattctgaggcacagagcggggacttaagatgggaaagagaaagcatcggagccattcattcggagaaaacgttttgatcaaaatggagacttttgtagtcgtttcaaaagagcacctgagtcatgtgtattcccggcctttataaatgacccggtcaagttggtttcaaagtccgacaggcttgtctgtttactagctgcgtggccttggacgggtggctgacatctgtaaagaatcctcctgtgatgaaactgaggaatcgggtggccgggcaagctgggaagagcaaagccagagctgcgctgcctcaatacccacaaaagaccattcccagtatacataagcacaggatgtttttctcaagagggatgtatttatcacttggacatctgtttataatataaacagacatgtgactgggaacatcttgctgccaaaagaatcctaggcagtggctcattgtatgtgaggttgaaccacgtgaaattgccaatattaggctggcttttatctacaaagaaggagtttcatggggttcagcctaacagttatggaaactacagtccttataaaccattggcatggtaataaacagatcttaagtataaaaattttgtaattgggcctttactctctcaataataaagtattttgtttatat

SEQ ID NO: 446787 - DNA, 4152 bp, Homo sapiens
ccgtttcctcccctcccctccactcggccgtccctccttcctcctccctcctccctcctcctcccgctcctgaagagcgcgccgcgtgggggacggcccggttacttcctccagagactgacgagtgcggtgtcgctccagctcagagctcccggagccgcccggccagcgtccggcctccctgatcgtctctggccggcgccctcgccctcgcccggcgcgcaccgagcagccgcgggcgccgagcagccaccgtcccgaccaagcgccggccctgcccgcagcggcaggatgaatgatttcggaatcaagaatatggaccaggtagcccctgtggctaacagttacagagggacactcaagcgccagccagcctttgacacctttgatgggtccctgtttgctgtttttccttctctaaatgaagagcaaacactgcaagaagtgccaacaggcttggattccatttctcatgactccgccaactgtgaattgcctttgttaaccccgtgcagcaaggctgtgatgagtcaagccttaaaagctaccttcagtggcttcaaaaaggaacagcggcgcctgggcattccaaagagtaagtactgctttcctgagcctgcactgggtgagaagaaccaacttcagtgcagttgtttgatcttgacttgtttattaagcttttgcttggggtattctgcaaagagtagcatggatgtcgttaacctgagccagtttctgtttcaccccaatcaacccaagacttgatccagaactcattaaatatgtagtagaaggacgcattactggtgtcttgaaatgtgcctgggtcgtgtcagaatggtgacgtgtcatcatggtatcttgctcattcgtgggttctggtgtatgtcggtacttggtgcataaattagggatgacagtggtctcactacctttccactgtttttacctcatgtgttccattttttcttctctcctggtagacccctggctgtggagtgagcaacaggtatgccagtggcttctctgggccaccaatgagttcagtctggtgaacgtgaatctgcagaggttcggcatgaatggccagatgctgtgtaaccttggcaaggaacgctttctggagctggcacctgactttgtgggtgacattctctgggaacatctggagcaaatgatcaaagaaaaccaagaaaagacagaagatcaatatgaagaaaattcacacctcacctccgttcctcattggattaacagcaatacattaggttttggcacagagcaggcgccctatggaatgcagacacagaattaccccaaaggcggcctcctggacagcatgtgtccggcctccacacccagcgtactcagctctgagcaggagtttcagatgttccccaagtctcggctcagctccgtcagcgtcacctactgctctgtcagtcaggacttcccaggcagcaacttgaatttgctcaccaacaattctgggacgcccaaagaccacgactcccctgagaacggtgcggacagcttcgagagctcagactccctcctccagtcctggaacagccagtcgtccttgctggatgtgcaacgggttccttccttcgagagcttcgaagatgactgcagccagtctctctgcctcaataagccaaccatgtctttcaaggattacatccaagagaggagtgacccggtggagcaaggcaaaccagttatacctgcagctgtgctggccggcttcacaggaagtggacctattcagctgtggcagtttctcctggagctgctatcagacaaatcctgccagtcattcatcagctggactggagacggatgggagtttaagctcgccgaccccgatgaggtggcccgccggtggggaaagaggaaaaataagcccaagatgaactacgagaagctgagccggggcttacgctactattacgacaagaacatcatccacaagacgtcggggaagcgctacgtgtaccgcttcgtgtgcgacctccagaacttgctggggttcacgcccgaggaactgcacgccatcctgggcgtccagcccgacacggaggactgaggtcgccgggaccaccctgagccggccccaggctcgtggactgagtgggaagcccatcctgaccagctgctccgaggacccaggaaaggcaggattgaaaatgtccaggaaagtggccaagaagcagtggccttattgcatcccaaaccacgcctcttgaccaggctgcctcccttgtggcagcaacggcacagctaattctactcacagtgcttttaagtgaaaatggtcgagaaagaggcaccgggaagccgtcctggcgcctggcagtccgtgggacgggatggttctggctgtttgagattctcaaaggagcgagcatgtcgtggacacacacagactatttttagattttcttttgccttttgcaaccaggaacagcaaatgcaaaaactctttgagagggtaggagggtgggaaggaaacaaccatgtcatttcagaagttagtttgtatatattataataatcttataattgttctcagaatcccttaacagttgtatttaacagaaattgtatattgtaatttaaaataattatataactgtatttgaaataagaattcagacatctgaggttttatttcatttttcaatagcacatatggaattttgcaaagatttaatctgccaagggccgactaagagaagttgtaaagtatgtattatttacatttaatagacttacagggataaggcctgtggggggtaatccctgctttttgtgtttttttgtttgtttgtttgtttgtttttggggggttttcttgccttggttgtctggcaaggactttgtacatttgggagtttttatgagaaacttaaatgttattatctgggcttatatctggcctctgctttctcctttaattgtaaagtaaaagctataaagcagtatttttcttgacaaatggcatatgttttccacttctttgcatgcgtttaagtcagtttatacacaaaatggattttattttttagtttaactgtgtttctccgacagctcacctctctctgaccacccagccatttccttcctgtgctccacgttcttctgtgtgattaaaataagaatattatttttggaaatatgcaactccttttcagagatcaggagggatttatgtagcagctatttttactgcaaaagtaattcactggaaaaaaaatgtaatttgtaagaaagctttatttttatctcagctctatgtaaagttaaagttactgtacagagctgaaggacggggggcggtaggggtcttgatgaaacctcttgaacgaagcacagtttgtcccatctttgttcactcgtgtgtctcaaccatcttaatagcatgctgctcctttttgctcagtgtccacagcaagatgacgtgattcttattttcttggacacagactattctgaggcacagagcggggacttaagatgggaaagagaaagcatcggagccattcattcggagaaaacgttttgatcaaaatggagacttttgtagtcgtttcaaaagagcacctgagtcatgtgtattcccggcctttataaatgacccggtcaagttggtttcaaagtccgacaggcttgtctgtttactagctgcgtggccttggacgggtggctgacatctgtaaagaatcctcctgtgatgaaactgaggaatcgggtggccgggcaagctgggaagagcaaagccagagctgcgctgcctcaatacccacaaaagaccattcccagtatacataagcacaggatgtttttctcaagagggatgtatttatcacttggacatctgtttataatataaacagacatgtgactgggaacatcttgctgccaaaagaatcctaggcagtggctcattgtatgtgaggttgaaccacgtgaaattgccaatattaggctggcttttatctacaaagaaggagtttcatggggttcagcctaacagttatggaaactacagtccttataaaccattggcatggtaataaacagatcttaagtataaaaattttgtaattgggcctttactctctcaataataaagtattttgtttatat

SEQ ID NO: 446788 - DNA, 3710 bp, Homo sapiens
ccgtttcctcccctcccctccactcggccgtccctccttcctcctccctcctccctcctcctcccgctcctgaagagcgcgccgcgtgggggacggcccggttacttcctccagagactgacgagtgcggtgtcgctccagctcagagctcccggagccgcccggccagcgtccggcctccctgatcgtctctggccggcgccctcgccctcgcccggcgcgcaccgagcagccgcgggcgccgagcagccaccgtcccgaccaagcgccggccctgcccgcagcggcaggatgaatgatttcggaatcaagaatatggaccaggtagcccctgtggctaacagttacagagggacactcaagcgccagccagcctttgacacctttgatgggtccctgtttgctgtttttccttctctaaatgaagagcaaacactgcaagaagtgccaacaggcttggattccatttctcatgactccgccaactgtgaattgcctttgttaaccccgtgcagcaaggctgtgatgagtcaagccttaaaagctaccttcagtggcttcaaaaaggaacagcggcgcctgggcattccaaagaacccctggctgtggagtgagcaacaggtatgccagtggcttctctgggccaccaatgagttcagtctggtgaacgtgaatctgcagaggttcggcatgaatggccagatgctgtgtaaccttggcaaggaacgctttctggagctggcacctgactttgtgggtgacattctctgggaacatctggagcaaatgatcaaagaaaaccaagaaaagacagaagatcaatatgaagaaaattcacacctcacctccgttcctcattggattaacagcaatacattaggttttggcacagagcaggcgccctatggaatgcagacacagaattaccccaaaggcggcctcctggacagcatgtgtccggcctccacacccagcgtactcagctctgagcaggagtttcagatgttccccaagtctcggctcagctccgtcagcgtcacctactgctctgtcagtcaggacttcccaggcagcaacttgaatttgctcaccaacaattctgggacgcccaaagaccacgactcccctgagaacggtgcggacagcttcgagagctcagactccctcctccagtcctggaacagccagtcgtccttgctggatgtgcaacgggttccttccttcgagagcttcgaagatgactgcagccagtctctctgcctcaataagccaaccatgtctttcaaggattacatccaagagaggagtgacccggtggagcaaggcaaaccagttatacctgcagctgtgctggccggcttcacaggaagtggacctattcagctgtggcagtttctcctggagctgctatcagacaaatcctgccagtcattcatcagctggactggagacggatgggagtttaagctcgccgaccccgatgaggtggcccgccggtggggaaagaggaaaaataagcccaagatgaactacgagaagctgagccggggcttacgctactattacgacaagaacatcatccacaagacgtcggggaagcgctacgtgtaccgcttcgtgtgcgacctccagaacttgctggggttcacgcccgaggaactgcacgccatcctgggcgtccagcccgacacggaggactgaggtcgccgggaccaccctgagccggccccaggctcgtggactgagtgggaagcccatcctgaccagctgctccgaggacccaggaaaggcaggattgaaaatgtccaggaaagtggccaagaagcagtggccttattgcatcccaaaccacgcctcttgaccaggctgcctcccttgtggcagcaacggcacagctaattctactcacagtgcttttaagtgaaaatggtcgagaaagaggcaccgggaagccgtcctggcgcctggcagtccgtgggacgggatggttctggctgtttgagattctcaaaggagcgagcatgtcgtggacacacacagactatttttagattttcttttgccttttgcaaccaggaacagcaaatgcaaaaactctttgagagggtaggagggtgggaaggaaacaaccatgtcatttcagaagttagtttgtatatattataataatcttataattgttctcagaatcccttaacagttgtatttaacagaaattgtatattgtaatttaaaataattatataactgtatttgaaataagaattcagacatctgaggttttatttcatttttcaatagcacatatggaattttgcaaagatttaatctgccaagggccgactaagagaagttgtaaagtatgtattatttacatttaatagacttacagggataaggcctgtggggggtaatccctgctttttgtgtttttttgtttgtttgtttgtttgtttttggggggttttcttgccttggttgtctggcaaggactttgtacatttgggagtttttatgagaaacttaaatgttattatctgggcttatatctggcctctgctttctcctttaattgtaaagtaaaagctataaagcagtatttttcttgacaaatggcatatgttttccacttctttgcatgcgtttaagtcagtttatacacaaaatggattttattttttagtttaactgtgtttctccgacagctcacctctctctgaccacccagccatttccttcctgtgctccacgttcttctgtgtgattaaaataagaatattatttttggaaatatgcaactccttttcagagatcaggagggatttatgtagcagctatttttactgcaaaagtaattcactggaaaaaaaatgtaatttgtaagaaagctttatttttatctcagctctatgtaaagttaaagttactgtacagagctgaaggacggggggcggtaggggtcttgatgaaacctcttgaacgaagcacagtttgtcccatctttgttcactcgtgtgtctcaaccatcttaatagcatgctgctcctttttgctcagtgtccacagcaagatgacgtgattcttattttcttggacacagactattctgaggcacagagcggggacttaagatgggaaagagaaagcatcggagccattcattcggagaaaacgttttgatcaaaatggagacttttgtagtcgtttcaaaagagcacctgagtcatgtgtattcccggcctttataaatgacccggtcaagttggtttcaaagtccgacaggcttgtctgtttactagctgcgtggccttggacgggtggctgacatctgtaaagaatcctcctgtgatgaaactgaggaatcgggtggccgggcaagctgggaagagcaaagccagagctgcgctgcctcaatacccacaaaagaccattcccagtatacataagcacaggatgtttttctcaagagggatgtatttatcacttggacatctgtttataatataaacagacatgtgactgggaacatcttgctgccccaatattaggctggcttttatctacaaagaaggagtttcatggggttcagcctaacagttatggaaactacagtccttataaaccattggcatggtaataaacagatcttaagtataaaaattttgtaattgggcctttactctctcaataataaagtattttgtttatat

SEQ ID NO: 446789 - DNA, 2988 bp, Homo sapiens
caggggattcgggataacgggcaggagacagaagatcaggagatgaagagatatgtcacagctcgacctccgttccctcatgggattaacagcaatagagtatagttttggcacagagcaggcgccctatggaatgcagacacagaattaccccaaaggcggcctcctggacagcatgtgtccggcctccacacccagcgtactcagctctgagcaggagtttcagatgttccccaagtctcggctcagctccgtcagcgtcacctactgctctgtcagtcaggacttcccaggcagcaacttgaatttgctcaccaacaattctgggacgcccaaagaccacgactcccctgagaacggtgcggacagcttcgagagctcagactccctcctccagtcctggaacagccagtcgtccttgctggatgtgcaacgggttccttccttcgagagcttcgaagatgactgcagccagtctctctgcctcaataagccaaccatgtctttcaaggattacatccaagagaggagtgacccggtggagcaaggcaaaccagttatacctgcagctgtgctggccggcttcacaggaagtggacctattcagctgtggcagtttctcctggagctgctatcagacaaatcctgccagtcattcatcagctggactggagacggatgggagtttaagctcgccgaccccgatgaggtggcccgccggtggggaaagaggaaaaataagcccaagatgaactacgagaagctgagccggggcttacgctactattacgacaagaacatcatccacaagacgtcggggaagcgctacgtgtaccgcttcgtgtgcgacctccagaacttgctggggttcacgcccgaggaactgcacgccatcctgggcgtccagcccgacacggaggactgaggtcgccgggaccaccctgagccggccccaggctcgtggactgagtgggaagcccatcctgaccagctgctccgaggacccaggaaaggcaggattgaaaatgtccaggaaagtggccaagaagcagtggccttattgcatcccaaaccacgcctcttgaccaggctgcctcccttgtggcagcaacggcacagctaattctactcacagtgcttttaagtgaaaatggtcgagaaagaggcaccgggaagccgtcctggcgcctggcagtccgtgggacgggatggttctggctgtttgagattctcaaaggagcgagcatgtcgtggacacacacagactatttttagattttcttttgccttttgcaaccaggaacagcaaatgcaaaaactctttgagagggtaggagggtgggaaggaaacaaccatgtcatttcagaagttagtttgtatatattataataatcttataattgttctcagaatcccttaacagttgtatttaacagaaattgtatattgtaatttaaaataattatataactgtatttgaaataagaattcagacatctgaggttttatttcatttttcaatagcacatatggaattttgcaaagatttaatctgccaagggccgactaagagaagttgtaaagtatgtattatttacatttaatagacttacagggataaggcctgtggggggtaatccctgctttttgtgtttttttgtttgtttgtttgtttgtttttggggggttttcttgccttggttgtctggcaaggactttgtacatttgggagtttttatgagaaacttaaatgttattatctgggcttatatctggcctctgctttctcctttaattgtaaagtaaaagctataaagcagtatttttcttgacaaatggcatatgttttccacttctttgcatgcgtttaagtcagtttatacacaaaatggattttattttttagtttaactgtgtttctccgacagctcacctctctctgaccacccagccatttccttcctgtgctccacgttcttctgtgtgattaaaataagaatattatttttggaaatatgcaactccttttcagagatcaggagggatttatgtagcagctatttttactgcaaaagtaattcactggaaaaaaaatgtaatttgtaagaaagctttatttttatctcagctctatgtaaagttaaagttactgtacagagctgaaggacggggggcggtaggggtcttgatgaaacctcttgaacgaagcacagtttgtcccatctttgttcactcgtgtgtctcaaccatcttaatagcatgctgctcctttttgctcagtgtccacagcaagatgacgtgattcttattttcttggacacagactattctgaggcacagagcggggacttaagatgggaaagagaaagcatcggagccattcattcggagaaaacgttttgatcaaaatggagacttttgtagtcgtttcaaaagagcacctgagtcatgtgtattcccggcctttataaatgacccggtcaagttggtttcaaagtccgacaggcttgtctgtttactagctgcgtggccttggacgggtggctgacatctgtaaagaatcctcctgtgatgaaactgaggaatcgggtggccgggcaagctgggaagagcaaagccagagctgcgctgcctcaatacccacaaaagaccattcccagtatacataagcacaggatgtttttctcaagagggatgtatttatcacttggacatctgtttataatataaacagacatgtgactgggaacatcttgctgccaaaagaatcctaggcagtggctcattgtatgtgaggttgaaccacgtgaaattgccaatattaggctggcttttatctacaaagaaggagtttcatggggttcagcctaacagttatggaaactacagtccttataaaccattggcatggtaataaacagatcttaagtataaaaattttgtaattgggcctttactctctcaataataaagtattttgtttatat

SEQ ID NO: 446790 - DNA, 3467 bp, Homo sapiens
ccgtttcctcccctcccctccactcggccgtccctccttcctcctccctcctccctcctcctcccgctcctgaagagcgcgccgcgtgggggacggcccggttacttcctccagagactgacgagtgcggtgtcgctccagctcagagctcccggagccgcccggccagcgtccggcctccctgatcgtctctggccggcgccctcgccctcgcccggcgcgcaccgagcagccgcgggcgccgagcagccaccgtcccgaccaagcgccggccctgcccgcagcggcaggatgaatgatttcggaatcaagaatatggaccaggtagcccctgtggctaacagttacagagggacactcaagcgccagccagcctttgacacctttgatgggtccctgtttgctgtttttccttctctaaatgaagagcaaacactgcaagaagtgccaacaggcttggattccatttctcatgactccgccaactgtgaattgcctttgttaaccccgtgcagcaaggctgtgatgagtcaagccttaaaagctaccttcagtggcttcaaaaaggaacagcggcgcctgggcattccaaagaacccctggctgtggagtgagcaacaggtatgccagtggcttctctgggccaccaatgagttcagtctggtgaacgtgaatctgcagaggttcggcatgaatggccagatgctgtgtaaccttggcaaggaacgctttctggagctggcacctgactttgtgggtgacattctctgggaacatctggagcaaatgatcaaagaaaaccaagaaaagacagaagatcaatatgaagaaaattcacacctcacctccgttcctcattggattaacagcaatacattaggttttggcacagagcaggcgccctatggaatgcagacacagaattaccccaaaggcggcctcctggacagcatgtgtccggcctccacacccagcgtactcagctctgagcaggagtttcagatgttccccaagtctcggctcagctccgtcagcgtcacctactgctctgtcagtcaggacttcccaggcagcaacttgaatttgctcaccaacaattctgggacgcccaaagaccacgactcccctgagaacggtgcggacagcttcgagagctcagactccctcctccagtcctggaacagccagtcgtccttgctggatgtgcaacgggttccttccttcgagagcttcgaagatgactgcagccagtctctctgcctcaataagccaaccatgtctttcaaggattacatccaagagaggagtgacccggtggagcaaggcaaaccagttatacctgcagctgtgctggccggcttcacaggaagtggacctattcagctgtggcagtttctcctggagctgctatcagacaaatcctgccagtcattcatcagctggactggagacggatgggagtttaagctcgccgaccccgatgaggtggcccgccggtggggaaagaggaaaaataagcccaagatgaactacgagaagctgagccggggcttacgctactattacgacaagaacatcatccacaagacgtcggggaagcgctacgtgtaccgcttcgtgtgcgacctccagaacttgctggggttcacgcccgaggaactgcacgccatcctgggcgtccagcccgacacggaggactgaggtcgccgggaccaccctgagccggccccaggctcgtggactgagtgggaagcccatcctgaccagctgctccgaggacccaggaaaggcaggattgaaaatgtccaggaaagtggccaagaagcagtggccttattgcatcccaaaccacgcctcttgaccaggctgcctcccttgtggcagcaacggcacagctaattctactcacagtgcttttaagtgaaaatggtcgagaaagaggcaccgggaagccgtcctggcgcctggcagtccgtgggacgggatggttctggctgtttgagattctcaaaggagcgagcatgtcgtggacacacacagactatttttagattttcttttgccttttgcaaccaggaacagcaaatgcaaaaactctttgagagggtaggagggtgggaaggaaacaaccatgtcatttcagaagttagtttgtatatattataataatcttataattgttctcagaatcccttaacagttgtatttaacagaaattgtatattgtaatttaaaataattatataactgtatttgaaataagaattcagacatctgaggttttatttcatttttcaatagcacatatggaattttgcaaagatttaatctgccaagggccgactaagagaagttgtaaagtatgtattatttacatttaatagacttacagggataaggcctgtggggggtaatccctgctttttgtgtttttttgtttgtttgtttgtttgtttttggggggttttcttgccttggttgtctggcaaggactttgtacatttgggagtttttatgagaaacttaaatgttattatctgggcttatatctggcctctgctttctcctttaattgtaaagtaaaagctataaagcagtatttttcttgacaaatggcatatgttttccacttctttgcatgcgtttaagtcagtttatacacaaaatggattttattttttagtttaactgtgtttctccgacagctcacctctctctgaccacccagccatttccttcctgtgctccacgttcttctgtgtgattaaaataagaatattatttttggaaatatgcaactccttttcagagatcaggagggatttatgtagcagctatttttactgcaaaagtaattcactggtaaagttaaagttactgtacagagctgaaggacggggggcggtaggggtcttgatgaaacctcttgaacgaagcacagtttgtcccatctttgttcactcgtgtgtctcaaccatcttaatagcatgctgctcctttttgctcagtgtccacagcaagatgacgtgattcttattttcttggacacagactattctgaggcacagagcggggacttaagatgggaaagagaaagcatcggagccattcattcggagaaaacgttttgatcaaaatggagacttttgtagtcgtttcaaaagagcacctgagtcatgtgtattcccggcctttataaatgacccggtcaagttggtttcaaagtccgacaggcttgtctgtttactagctgcgtggccttggacgggtggctgacatctgtaaagaatcctcctgtgatgaaactgaggaatcgggtggccgggcaagctgggaagagcaaagccagagctgcgcttggctcaataccccacagcaccatttccccagggatacattatatacccagggattgtcttttcttaaaggggggaaggatttttaattcacttgggccttttggggct

SEQ ID NO: 446791 - DNA, 2337 bp, Homo sapiens
tatagatagctgaactcagctggcaaggatgggggttaagctcgccgaccccgatgaggtggcccgccggtggggaaagaggaaaaataagcccaagatgaactacgagaagctgagccggggcttacgctactattacgacaagaacatcatccacaagacgtcggggaagcgctacgtgtaccgcttcgtgtgcgacctccagaacttgctggggttcacgcccgaggaactgcacgccatcctgggcgtccagcccgacacggaggactgaggtcgccgggaccaccctgagccggccccaggctcgtggactgagtgggaagcccatcctgaccagctgctccgaggacccaggaaaggcaggattgaaaatgtccaggaaagtggccaagaagcagtggccttattgcatcccaaaccacgcctcttgaccaggctgcctcccttgtggcagcaacggcacagctaattctactcacagtgcttttaagtgaaaatggtcgagaaagaggcaccgggaagccgtcctggcgcctggcagtccgtgggacgggatggttctggctgtttgagattctcaaaggagcgagcatgtcgtggacacacacagactatttttagattttcttttgccttttgcaaccaggaacagcaaatgcaaaaactctttgagagggtaggagggtgggaaggaaacaaccatgtcatttcagaagttagtttgtatatattataataatcttataattgttctcagaatcccttaacagttgtatttaacagaaattgtatattgtaatttaaaataattatataactgtatttgaaataagaattcagacatctgaggttttatttcatttttcaatagcacatatggaattttgcaaagatttaatctgccaagggccgactaagagaagttgtaaagtatgtattatttacatttaatagacttacagggataaggcctgtggggggtaatccctgctttttgtgtttttttgtttgtttgtttgtttgtttttggggggttttcttgccttggttgtctggcaaggactttgtacatttgggagtttttatgagaaacttaaatgttattatctgggcttatatctggcctctgctttctcctttaattgtaaagtaaaagctataaagcagtatttttcttgacaaatggcatatgttttccacttctttgcatgcgtttaagtcagtttatacacaaaatggattttattttttagtttaactgtgtttctccgacagctcacctctctctgaccacccagccatttccttcctgtgctccacgttcttctgtgtgattaaaataagaatattatttttggaaatatgcaactccttttcagagatcaggagggatttatgtagcagctatttttactgcaaaagtaattcactggaaaaaaaatgtaatttgtaagaaagctttatttttatctcagctctatgtaaagttaaagttactgtacagagctgaaggacggggggcggtaggggtcttgatgaaacctcttgaacgaagcacagtttgtcccatctttgttcactcgtgtgtctcaaccatcttaatagcatgctgctcctttttgctcagtgtccacagcaagatgacgtgattcttattttcttggacacagactattctgaggcacagagcggggacttaagatgggaaagagaaagcatcggagccattcattcggagaaaacgttttgatcaaaatggagacttttgtagtcgtttcaaaagagcacctgagtcatgtgtattcccggcctttataaatgacccggtcaagttggtttcaaagtccgacaggcttgtctgtttactagctgcgtggccttggacgggtggctgacatctgtaaagaatcctcctgtgatgaaactgaggaatcgggtggccgggcaagctgggaagagcaaagccagagctgcgctgcctcaatacccacaaaagaccattcccagtatacataagcacaggatgtttttctcaagagggatgtatttatcacttggacatctgtttataatataaacagacatgtgactgggaacatcttgctgccaaaagaatcctaggcagtggctcattgtatgtgaggttgaaccacgtgaaattgccaatattaggctggcttttatctacaaagaaggagtttcatggggttcagcctaacagttatggaaactacagtccttataaaccattggcatggtaataaacagatcttaagtataaaaattttgtaattgggcctttactctctcaataataaagtattttgtttatat

SEQ ID NO: 446792 - DNA, 1802 bp, Homo sapiens
ccgtttcctcccctcccctccactcggccgtccctccttcctcctccctcctccctcctcctcccgctcctgaagagcgcgccgcgtgggggacggcccggttacttcctccagagactgacgagtgcggtgtcgctccagctcagagctcccggagccgcccggccagcgtccggcctccctgatcgtctctggccggcgccctcgccctcgcccggcgcgcaccgagcagccgcgggcgccgagcagccaccgtcccgaccaagcgccggccctgcccgcagcggcaggatgaatgatttcggaatcaagaatatggaccaggtagcccctgtggctaacagttacagagggacactcaagcgccagccagcctttgacacctttgatgggtccctgtttgctgtttttccttctctaaatgaagagcaaacactgcaagaagtgccaacaggcttggattccatttctcatgactccgccaactgtgaattgcctttgttaaccccgtgcagcaaggctgtgatgagtcaagccttaaaagctaccttcagtggcttcaaaaaggaacagcggcgcctgggcattccaaagagtaagtactgctttcctgagcctgcactgggtgagaagaaccaacttcagtgcagttgtttgatcttgacttgtttattaagcttttgcttggggtattctgcaaagagtagcatggatgtcgttaacctgagccagtttctgtttcaccccaatcaacccaagacttgatccagaactcattaaatatgtagtagaaggacgcattactggtgtcttgaaatgtgcctgggtcgtgtcagaatggtgacgtgtcatcatggtatcttgctcattcgtgggttctggtgtatgtcggtacttggtgcataaattagggatgacagtggtctcactacctttccactgtttttacctcatgtgttccattttttcttctctcctggtagacccctggctgtggagtgagcaacaggtatgccagtggcttctctgggccaccaatgagttcagtctggtgaacgtgaatctgcagaggttcggcatgaatggccagatgctgtgtaaccttggcaaggaacgctttctggagctggcacctgactttgtgggtgacattctctgggaacatctggagcaaatgatcaaaggtaccagctgaacgtcttacttctccttgtccaggatgagctgtggccgggaagactgattgggaaagtcacgtgggtgttcttcaaccttagggttgccacttgaaatgacatagagtaccttgcctcaaaatgccactcaagtgagtcagatatatggcagtgattatagatttttatcccactttatgtgagtgtgtgtgtgtgtgtgtgtgtgtgtgtatagcatcaagtatagccacaaggtagtagccttagtcactaaattgtttgctattgctggctgtattcatcacgggagtccatgttgactcagatatgtaggacagcaagaattcccacgtcttctgagctcaccttacagagctaagagatatggcagccttaatgaaaggggggagcctttactcacataaaccctgtgaattctactgtaaattttcctacatccaaatggaatgtattttggatgttgaggattgttgagggggcggggtctgtttttaaacaagtgagaaattgatatatatttacacgctatcatattgtacagaaactggccattgatcagtagaaatctcaccaaatacagagaaagtcttgattcaaaacttaaaa

SEQ ID NO: 446793 - DNA, 905 bp, Homo sapiens
ggccggcggagtttcttcagaggaactaccgccctgggaggaagcgtctgtttagtttcaacacagacgactgggcttgggagcctacgaggttgcagtctggagggcgccaacagcagctaccagggctgcttttcctgaacacgctgcaagcacgtcaaggtagtcggagtcccctaacaatggataaattcgtcattcgaacgcctagaatccagaatagccctcagaagaaagattctggaggaaaggtttacaagcaggccacgattgaatctctgaagagagttgtggttgtagaagacataaaaagatggaaaactatgctggagcttcctgatcaaaccaaagagaatcttgttgaagccttacaagaattaaagaagaaaataccctccagggaagtgttaaaatcaacaaggataggtcacactgtgaacaagatgcgtaaacactcagattcagaagtggcttctcttgccagagaagtttacactgagtggaaaactttcactgaaaaacattcaaatagaccttctattgaagttagaagtgatcccaaaaccgagtcgttgaggaaaaatgctcagaaattactctcagaagccttggaattaaagatggatcacctactggttgaaaatagtgaacgtggatgaagttggtggtgaggccctgggcaggctgctggtggtctacccttggacccagaggttctttgagtcctttggggatctgtccactcctgatgctgttatgggcaaccctaaggtgaaggctcatggcaagaaagtgctcggtgcctttagtgatggcctggctcacctggacaacctcaagggcacctttgccacactgagtgagctgcactgtgacaagctgcacgtggatcctgagaacttcag

SEQ ID NO: 446794 - DNA, 780 bp, Homo sapiens
ggccggcggagtttcttcagaggaactaccgccctgggaggaagcgtctgtttagtttcaacacagacgactgggcttgggagcctgcgagagccagccaactaccccttcttcccagagctcacttatctgaacgtttcagctctccctggaagaccttctgcgttggtctccagagcccccatgctgaggctactaatgaggaactggcccgaagcctcccacacctcagggtttatttgaatacgctggcgctctcagtttagggctctgtagaagatacataatgaaatttctcttgaaatgaattactgcagtagaaaaaagtacatacatatatatgttaaaatgaaatatctctacacaggcctgttttaacaattacgtaaataatacttgtttttttaaaagtaatagtaagctgggaacttttttttctaaaacaaaaggtggagttcgttcactgaaaagtgttttgagttgagaaggggtacagttggtgaaatttaaaaatgatggaacaaggatttgaggaatgtagaagactcaaggaagtggggattagattaggggagactggagcacgtttgtaatctgaaaaatgaaaacaacaatacctacttaatacaatgggtgagagaagtaagcaatatttttacaaaactatataaagatccaggtaaaggttaataaactgtcttaggaaaagtgcctagtatttagaaggtaggcaataatgttagtcccgtcccttctccccttgcttttcacctcgtgccg

SEQ ID NO: 446795 - DNA, 1994 bp, Homo sapiens
ggccggcggagtttcttcagaggaactaccgccctgggaggaagcgtctgtttagtttcaacacagacgactgggcttgggagcctacgaggttgcagtctggagggcgccaacagcagctaccagggctgcttttcctgaacacgctgcaagcacgtcaaggtagtcggagtcccctaacaatggataaattcgtcattcgaacgcctagaatccagaatagccctcagaagaaagattctggaggaaaggtttacaagcaggccacgattgaatctctgaagagagttgtggttgtagaagacataaaaagatggaaaactatgctggagcttcctgatcaaaccaaagagaatcttgttgaagccttacaagaattaaagaagaaaataccctccagggaagtgttaaaatcaacaaggataggtcacactgtgaacaagatgcgtaaacactcagattcagaagtggcttctcttgccagagaagtttacactgagtggaaaactttcactgaaaaacattcaaatagaccttctattgaagttagaagtgatcccaaaaccgagtcgttgaggaaaaatgctcagaaattactctcagaagccttggaattaaagatggatcacctactggttgaaaatattgaacgggaaacgtttcatctctgctcccgcctcattaatgggccgtaccggcggacggtgagagccctggtcttcacattaaagcaccgagctgaaatccgggctcaggtgaagagcggctcgctgccagtcggcacgtttgtacagacccacaaaaagtgacctgaggacggttccagccctgggccaggcagagaggaaaatgggcctgtctctgccgttcaaagacgcttttgagtttgggtgatggctgatgctggctgtgctagattttcccatggtgccgttcctttgcagacagaggattcggagagccctaggagacaggcctgcaggaatgtgcttcattagctgcagtgcgctggtgctgcctaacagaacgcacactggctgtcactaggaagcgccatacggttgctatcacccaacatggtgaaagggtgatggatttcactgtgaatatgccaaggacacctctaaacttcccccatgtcagtcagatgaagttactactatatttcaccaccctgcaggtaactgaaactcaattaccgctgccgctcactcggttccatccccctgagtttagatagctctggtgcctctcagaactcccctgtctgttctctttgctctatcccaggggtgagcctgcgagagccagccaactaccccttcttcccagagctcacttatctgaacgtttcagctctccctggaagaccttctgcgttggtctccagagcccccatgctgaggctactaatgaggaactggcccgaagcctcccacacctcagggtttatttgaatacgctggcgctctcagtttagggctctgtagaagatacataatgaaatttctcttgaaatgaattactgcagtagaaaaaagtacatacatatatatgttaaaatgaaatatctctacacaggcctgttttaacaattacgtaaataatacttgtttttttaaaagtaatagtaagctgggaacttttttttctaaaacaaaaggtggagttcgttcactgaaaagtgttttgagttgagaaggggtacagttggtgaaatttaaaaatgatggaacaaggatttgaggaatgtagaagactcaaggaagtggggattagattaggggagactggagcacgtttgtaatctgaaaaatgaaaacaacaatacctacttaatacaatgggtgagagaagtaagcaatatttttacaaaactatataaagatccaggtaaaggttaataaactgtcttaggaaaagtgcctagtatttagaaggtaggcaataatgttagtcccgtcccttctccccttgcttttcacctcgtgccg

SEQ ID NO: 446796 - DNA, 2326 bp, Homo sapiens
tggagactgaaagcggcggaagggacgctggaatgtggagcggttgtggggcggcagctgcggaactgcgcgattgtggttcccgccgtatttcccgttccccatctagtaactcccatctcagcccacgtatctccctgagtggaaatctcgggccccagaccagtcgattgggaggtccgccctccccttcagcgacttggtctgtgttttggcagttgccgcgacaacagtcacttccgggaaggggctctgcgaatctccttccgtcggtccgctcagaatcagctgtcctctcagactgtgtgggtggtttccccggccgcagctccgtacgggcttggattgctgggcctcggtgcaccccagcctcccccactcgggttctgagcttgagctggcggctctttaactctgcttcactgttgctcttggcaacatccacttccgggagcgagtgccgtttcccccgctcaccgcgggctagggagcgtgggattccggactgtgagcggctgttagtgcgtcgcagctgctggcgatccggcgaccctcggccggcaggacccgcgggccacgcagccggggccttctcaacgcctcagtacctcggcgggaccgccatggttctgctgcacgtgaagcggggcgacgagagccagttcctgctgcaggcgcctgggagtaccgagctggaggagctcacggtgcaggtggcccgggtctataatgggcggctcaaggtgcagcgcctctgctcagaaatggaagaattagccgaacatggcatatttctccctcctaatatgcaaggactgaccgatgatcagattgaagaattgaaattgaaggatgaatggggtgaaaaatgcgtacccagcggaggtgcagtgtttaaaaaggatgatattggacgaaggaatgggcaagctccaaatgagaagatgaagcaagtgttaaagaagactatagaagaagccaaagcaataatatctaagaaacaagtggaagccggtgtctgtgttaccatggagatggtgaaagatgccttggaccagcttcgaggcgcggtgatgattgtttaccccatggggttgccaccgtatgatcccatccgcatggagtttgaaaataaggaagacttgtcgggaacacaggcagggctcaacgtcattaaagaggcagaggcgcagctgtggtgggcagccaaggagctgagaagaacgaagaagctttcagactacgtggggaagaatgaaaaaaccaaaattatcgccaagattcagcaaaggggacagggagctccagcccgagagcctattattagcagtgaggagcagaagcagctgatgctgtactatcacagaagacaagaggagctcaagagattggaagaaaatgatgatgatgcctatttaaactcaccatgggcggataacactgctttgaaaagacattttcatggagtgaaagacataaagtggagaccaagatgaagttcaccagctgatgacacttccaaagagattagctcacctttctcctaggcaattataatttaaaaaaaaaaaaaaggccacttactgccctctgtaaaagatgttaacatttctagttttcttttagtgtgaatttttaaaatagcagttattcaaggttttagaacttaataaatacctagtcagaagaaaatgtgtaaatcgtttttgtttcaggactatttagtatgtcatggttttctttgataaaatactaaacttttggccgggcgcggtggctcacgcctgtaatcccagcactttgggaggccgaggcaggcagatcacgaggtcaggagatcaagaccatccaggctaacacggtgaaaccccgtctctactaaaaatacaaaaaattagccgggcatggtggcaggcgcctgtagtcccagctactcgggaggctgaggcaggagaatggcgtgaacccgggaggtggagcttacagtgagccaagatcactgccactgcactctatcctgggcaacagagcgaaactcttgtctcaaaaaaaaaaaaaaaaaaaaaaaaagctacacttttttttcttcctgattgttttatattctcatgataactggtttattggaggaaagctgatgactggcagtgaccactagtgaccactagatgccgccaggcactcagcatgctttttctcctggccctctagatctattggaagctgaactcccagccttgctggagagacttctctaaccctgctgcggggtctaactgtagccttctttaaccctgctgcggggtctaactgtagccttctttaa

SEQ ID NO: 446797 - DNA, 2624 bp, Homo sapiens
tggagactgaaagcggcggaagggacgctggaatgtggagcggttgtggggcggcagctgcggaactgcgcgattgtggttcccgccgtatttcccgttccccatctagtaactcccatctcagcccacgtatctccctgagtggaaatctcgggccccagaccagtcgattgggaggtccgccctccccttcagcgacttggtctgtgttttggcagttgccgcgacaacagtcacttccgggaaggggctctgcgaatctccttccgtcggtccgctcagaatcagctgtcctctcagactgtgtgggtggtttccccggccgcagctccgtacgggcttggattgctgggcctcggtgcaccccagcctcccccactcgggttctgagcttgagctggcggctctttaactctgcttcactgttgctcttggcaacatccacttccgggagcgagtgccgtttcccccgctcaccgcgggctagggagcgtgggattccggactgtgagcggctgttagtgcgtcgcagctgctggcgatccggcgaccctcggccggcaggacccgcgggccacgcagccggggccttctcaacgcctcagtacctcggcgggaccgccatggttctgctgcacgtgaagcggggcgacgagagccagttcctgctgcaggcgcctgggagtaccgagctggaggagctcacggtgcaggtggcccgggtctataatgggcggctcaaggtgcagcgcctctgctcagaaatggaagaattagccgaacatggcatatttctccctcctaatatgcaaggactgaccgatgatcagattgaagaattgaaattgaaggatgaatggggtgaaaaatgcgtacccagcggaggtgcagtgtttaaaaaggatgatattggacgaaggaatgggcaagctccaaatgagaagatgaagcaagtgttaaagaagactatagaagaagccaaagcaataatatctaagaaacaagtggaagccggtgtctgtgttaccatggagatggtgaaagatgccttggaccagcttcgaggcgcggtgatgattgtttaccccatggggttgccaccgtatgatcccatccgcatggagtttgaaaataaggaagacttgtcgggaacacaggcagggctcaacgtcattaaagaggcagaggcgcagctgtggtgggcagccaaggagctgagaagaacgaagaagctttcagactacgtggggaagaatgaaaaaaccaaaattatcgccaagattcagcaaaggggacagggagctccagcccgagagcctattattagcagtgaggagcagaagcagctgatgctgtactatcacagaagacaagaggagctcaaggtagcaggggacagatgggctttctgcagtgctggcgcccacacatagcctgtgtgccttacctggggctgctggggagcagtgagctctgcagaatgccggggaggggtctttctagagcttctgtctgcaggtctgtcggggtcctgccaggtgtcccctggtgttagacatggcagtatcctgctcctagagggcagggagagggggaggtcagtcatggactctttcttcagtctctttatgtgcaaaacactttcctgaaatgcctgcctgaataaaacatacttatttccagagattggaagaaaatgatgatgatgcctatttaaactcaccatgggcggataacactgctttgaaaagacattttcatggagtgaaagacataaagtggagaccaagatgaagttcaccagctgatgacacttccaaagagattagctcacctttctcctaggcaattataatttaaaaaaaaaaaaaaggccacttactgccctctgtaaaagatgttaacatttctagttttcttttagtgtgaatttttaaaatagcagttattcaaggttttagaacttaataaatacctagtcagaagaaaatgtgtaaatcgtttttgtttcaggactatttagtatgtcatggttttctttgataaaatactaaacttttggccgggcgcggtggctcacgcctgtaatcccagcactttgggaggccgaggcaggcagatcacgaggtcaggagatcaagaccatccaggctaacacggtgaaaccccgtctctactaaaaatacaaaaaattagccgggcatggtggcaggcgcctgtagtcccagctactcgggaggctgaggcaggagaatggcgtgaacccgggaggtggagcttacagtgagccaagatcactgccactgcactctatcctgggcaacagagcgaaactcttgtctcaaaaaaaaaaaaaaaaaaaaaaaaagctacacttttttttcttcctgattgttttatattctcatgataactggtttattggaggaaagctgatgactggcagtgaccactagtgaccactagatgccgccaggcactcagcatgctttttctcctggccctctagatctattggaagctgaactcccagccttgctggagagacttctctaaccctgctgcggggtctaactgtagccttctttaaccctgctgcggggtctaactgtagccttctttaa

SEQ ID NO: 446798 - DNA, 3364 bp, Homo sapiens
tggagactgaaagcggcggaagggacgctggaatgtggagcggttgtggggcggcagctgcggaactgcgcgattgtggttcccgccgtatttcccgttccccatctagtaactcccatctcagcccacgtatctccctgagtggaaatctcgggccccagaccagtcgattgggaggtccgccctccccttcagcgacttggtctgtgttttggcagttgccgcgacaacagtcacttccgggaaggggctctgcgaatctccttccgtcggtccgctcagaatcagctgtcctctcagactgtgtgggtggtttccccggccgcagctccgtacgggcttggattgctgggcctcggtgcaccccagcctcccccactcgggttctgagcttgagctggcggctctttaactctgcttcactgttgctcttggcaacatccacttccgggagcgagtgccgtttcccccgctcaccgcgggctagggagcgtgggattccggactgtgagcggctgttagtgcgtcgcagctgctggcgatccggcgaccctcggccggcaggacccgcgggccacgcagccggggccttctcaacgcctcagtacctcggcgggaccgccatggttctgctgcacgtgaagcggggcgacgagagccagttcctgctgcaggcgcctgggagtaccgagctggaggagctcacggtgcaggtggcccgggtctataatgggcggctcaaggtgcagcgcctctgctcagaaatggaagaattagccgaacatggcatatttctccctcctaatatgcaaggactgaccgatgatcagattgaagaattgaaattgaaggatgaatggggtgaaaaatgcgtacccagcggaggtgcagtgtttaaaaaggatgatattggacgaaggaatgggcaagctccaaatgagaagatgaagcaagtgttaaagaagactatagaagaagccaaagcaataatatctaagaaacaagtggaagccggtgtctgtgttaccatggagatggtgaaagatgccttggaccagcttcgaggcgcggtgatgattgtttaccccatggggttgccaccgtatgatcccatccgcatggagtttgaaaataaggaagacttgtcgggaacacaggcagggctcaacgtcattaaagaggcagaggcgcagctgtggtgggcagccaaggagctgagaagaacgaagaagctttcagactacgtggggaagaatgaaaaaaccaaaattatcgccaagattcagcaagtaagtactttttgctttaatgtgtcagtagtttttgttatttcccttcaaactgataaaaatgtacagtgaatccgaaagatttaaactactggtacaaatattttaatcttattggctcgggtttaaactaaaaatatcctcttcctgcacaccaacaaaaactggaagaaaatatggattgagtaccaatatctagagtttgttttaatatgtgggggagaggaaatatactatgttaatttcaagcgtaaaaatagggctgcaagtaaacagatatgttccttgaaatgtaggagggggaggaggaaaggttcgagacctttgaaggacatcgtgtagcgctgtaacctgaggggccgccttggttttgtgggtgctcctacgtcactaggctgtgattttggggaaatggggccctccaccttatgtagatccagagtccgtggctctgagcatcctccctttcccactggacctgcctgcagtgtctgccttgggaatggtcaagacagagatggtatcgtgcagcctctggtctccacacagtgagagtccagggctcagggctgctcaagaccaaggcttcccttgatgcttcacttcgggtgatcagacatgggggacctgtttatctttagtagccggcaaaggcaatcgtaaaacatttgttgtaacttcaggattgtcactctaagaacaccttaatccacaatttgctctgctctcctctttgcagaaggggacagggagctccagcccgagagcctattattagcagtgaggagcagaagcagctgatgctgtactatcacagaagacaagaggagctcaaggtagcaggggacagatgggctttctgcagtgctggcgcccacacatagcctgtgtgccttacctggggctgctggggagcagtgagctctgcagaatgccggggaggggtctttctagagcttctgtctgcaggtctgtcggggtcctgccaggtgtcccctggtgttagacatggcagtatcctgctcctagagggcagggagagggggaggtcagtcatggactctttcttcagtctctttatgtgcaaaacactttcctgaaatgcctgcctgaataaaacatacttatttccagagattggaagaaaatgatgatgatgcctatttaaactcaccatgggcggataacactgctttgaaaagacattttcatggagtgaaagacataaagtggagaccaagatgaagttcaccagctgatgacacttccaaagagattagctcacctttctcctaggcaattataatttaaaaaaaaaaaaaaggccacttactgccctctgtaaaagatgttaacatttctagttttcttttagtgtgaatttttaaaatagcagttattcaaggttttagaacttaataaatacctagtcagaagaaaatgtgtaaatcgtttttgtttcaggactatttagtatgtcatggttttctttgataaaatactaaacttttggccgggcgcggtggctcacgcctgtaatcccagcactttgggaggccgaggcaggcagatcacgaggtcaggagatcaagaccatccaggctaacacggtgaaaccccgtctctactaaaaatacaaaaaattagccgggcatggtggcaggcgcctgtagtcccagctactcgggaggctgaggcaggagaatggcgtgaacccgggaggtggagcttacagtgagccaagatcactgccactgcactctatcctgggcaacagagcgaaactcttgtctcaaaaaaaaaaaaaaaaaaaaaaaaagctacacttttttttcttcctgattgttttatattctcatgataactggtttattggaggaaagctgatgactggcagtgaccactagtgaccactagatgccgccaggcactcagcatgctttttctcctggccctctagatctattggaagctgaactcccagccttgctggagagacttctctaaccctgctgcggggtctaactgtagccttctttaaccctgctgcggggtctaactgtagccttctttaa

SEQ ID NO: 446799 - DNA, 2230 bp, Homo sapiens
tggagactgaaagcggcggaagggacgctggaatgtggagcggttgtggggcggcagctgcggaactgcgcgattgtggttcccgccgtatttcccgttccccatctagtaactcccatctcagcccacgtatctccctgagtggaaatctcgggccccagaccagtcgattgggaggtccgccctccccttcagcgacttggtctgtgttttggcagttgccgcgacaacagtcacttccgggaaggggctctgcgaatctccttccgtcggtccgctcagaatcagctgtcctctcagactgtgtgggtggtttccccggccgcagctccgtacgggcttggattgctgggcctcggtgcaccccagcctcccccactcgggttctgagcttgagctggcggctctttaactctgcttcactgttgctcttggcaacatccacttccgggagcgagtgccgtttcccccgctcaccgcgggctagggagcgtgggattccggactgtgagcggctgttagtgcgtcgcagctgctggcgatccggcgaccctcggccggcaggacccgcgggccacgcagccggggccttctcaacgcctcagtacctcggcgggaccgccatggttctgctgcacgtgaagcggggcgacgagagccagttcctgctgcaggcgcctgggagtaccgagctggaggagctcacggtgcaggtggcccgggtctataatgggcggctcaaggtgcagcgcctctgctcagaaatggaagaattagccgaacatggcatatttctccctcctaatatgcaaggactgaccgatgatcagattgaagaattgaaattgaaggatgaatggggtgaaaaatgcgtacccagcggaggtgcagtgtttaaaaaggatgatattggacgaaggaatgggcaagctccaaatgagaagatgaagcaagtgttaaagaagactatagaagaagccaaagcaataatatctaagaaacaagtggaagccggtgtctgtgttaccatggagatggtgaaagatgccttggaccagcttcgaggcgcggtgatgattgtttaccccatggggttgccaccgtatgatcccatccgcatggagtttgaaaataaggaagacttgtcgggaacacaggcagggctcaacgtcattaaagaggcagaggcgcagctgtggtgggcagccaaggagctgagaagaacgaagaagctttcagactacgtggggaagaatgaaaaaaccaaaattatcgccaagattcagcaaagattggaagaaaatgatgatgatgcctatttaaactcaccatgggcggataacactgctttgaaaagacattttcatggagtgaaagacataaagtggagaccaagatgaagttcaccagctgatgacacttccaaagagattagctcacctttctcctaggcaattataatttaaaaaaaaaaaaaaggccacttactgccctctgtaaaagatgttaacatttctagttttcttttagtgtgaatttttaaaatagcagttattcaaggttttagaacttaataaatacctagtcagaagaaaatgtgtaaatcgtttttgtttcaggactatttagtatgtcatggttttctttgataaaatactaaacttttggccgggcgcggtggctcacgcctgtaatcccagcactttgggaggccgaggcaggcagatcacgaggtcaggagatcaagaccatccaggctaacacggtgaaaccccgtctctactaaaaatacaaaaaattagccgggcatggtggcaggcgcctgtagtcccagctactcgggaggctgaggcaggagaatggcgtgaacccgggaggtggagcttacagtgagccaagatcactgccactgcactctatcctgggcaacagagcgaaactcttgtctcaaaaaaaaaaaaaaaaaaaaaaaaagctacacttttttttcttcctgattgttttatattctcatgataactggtttattggaggaaagctgatgactggcagtgaccactagtgaccactagatgccgccaggcactcagcatgctttttctcctggccctctagatctattggaagctgaactcccagccttgctggagagacttctctaaccctgctgcggggtctaactgtagccttctttaaccctgctgcggggtctaactgtagccttctttaa

SEQ ID NO: 446800 - DNA, 2258 bp, Homo sapiens
tggagactgaaagcggcggaagggacgctggaatgtggagcggttgtggggcggcagctgcggaactgcgcgattgtggttcccgccgtatttcccgttccccatctagtaactcccatctcagcccacgtatctccctgagtggaaatctcgggccccagaccagtcgattgggaggtccgccctccccttcagcgacttggtctgtgttttggcagttgccgcgacaacagtcacttccgggaaggggctctgcgaatctccttccgtcggtccgctcagaatcagctgtcctctcagactgtgtgggtggtttccccggccgcagctccgtacgggcttggattgctgggcctcggtgcaccccagcctcccccactcgggttctgagcttgagctggcggctctttaactctgcttcactgttgctcttggcaacatccacttccgggagcgagtgccgtttcccccgctcaccgcgggctagggagcgtgggattccggactgtgagcggctgttagtgcgtcgcagctgctggcgatccggcgaccctcggccggcaggacccgcgggccacgcagccggggccttctcaacgcctcagtacctcggcgggaccgccatggttctgctgcacgtgaagcggggcgacgagagccagttcctgctgcaggcgcctgggagtaccgagctggaggagctcacggtgcaggtggcccgggtctataatgggcggctcaaggtgcagcgcctctgctcagaaatggaagaattagccgaacatggcatatttctccctcctaatatgcaaggactgaccgatgatcagattgaagaattgaaattgaaggatgaatggggtgaaaaatgcgtacccagcggaggtgcagtgtttaaaaaggatgatattggacgaaggaatgggcaagaaacaagtggaagccggtgtctgtgttaccatggagatggtgaaagatgccttggaccagcttcgaggcgcggtgatgattgtttaccccatggggttgccaccgtatgatcccatccgcatggagtttgaaaataaggaagacttgtcgggaacacaggcagggctcaacgtcattaaagaggcagaggcgcagctgtggtgggcagccaaggagctgagaagaacgaagaagctttcagactacgtggggaagaatgaaaaaaccaaaattatcgccaagattcagcaaaggggacagggagctccagcccgagagcctattattagcagtgaggagcagaagcagctgatgctgtactatcacagaagacaagaggagctcaagagattggaagaaaatgatgatgatgcctatttaaactcaccatgggcggataacactgctttgaaaagacattttcatggagtgaaagacataaagtggagaccaagatgaagttcaccagctgatgacacttccaaagagattagctcacctttctcctaggcaattataatttaaaaaaaaaaaaaaggccacttactgccctctgtaaaagatgttaacatttctagttttcttttagtgtgaatttttaaaatagcagttattcaaggttttagaacttaataaatacctagtcagaagaaaatgtgtaaatcgtttttgtttcaggactatttagtatgtcatggttttctttgataaaatactaaacttttggccgggcgcggtggctcacgcctgtaatcccagcactttgggaggccgaggcaggcagatcacgaggtcaggagatcaagaccatccaggctaacacggtgaaaccccgtctctactaaaaatacaaaaaattagccgggcatggtggcaggcgcctgtagtcccagctactcgggaggctgaggcaggagaatggcgtgaacccgggaggtggagcttacagtgagccaagatcactgccactgcactctatcctgggcaacagagcgaaactcttgtctcaaaaaaaaaaaaaaaaaaaaaaaaagctacacttttttttcttcctgattgttttatattctcatgataactggtttattggaggaaagctgatgactggcagtgaccactagtgaccactagatgccgccaggcactcagcatgctttttctcctggccctctagatctattggaagctgaactcccagccttgctggagagacttctctaaccctgctgcggggtctaactgtagccttctttaaccctgctgcggggtctaactgtagccttctttaa

SEQ ID NO: 446801 - DNA, 1630 bp, Homo sapiens
  misc_feature (20)..(20): n is a, c, g, or t
tatccacggctcatttgagntcttctcagctccttggctgcccaccacagcagcgcctctgctcagaaatggaagaattagccgaacatggcatatttctccctcctaatatgcaaggactgaccgatgatcagattgaagaattgaaattgaaggatgaatggggtgaaaaatgcgtacccagcggaggtgcagtgtttaaaaaggatgatattggacgaaggaatgggcaagctccaaatgagaagatgaagcaagtgttaaagaagactatagaagaagccaaagcaataatatctaagaaacaagtggaagccggtgtctgtgttaccatggagatggtgaaagatgccttggaccagcttcgaggcgcggtgatgattgtttaccccatggggttgccaccgtatgatcccatccgcatggagtttgaaaataaggaagacttgtcgggaacacaggcagggctcaacgtcattaaagaggcagaggcgcagctgtggtgggcagccaaggagctgagaagaacgaagaagctttcagactacgtggggaagaatgaaaaaaccaaaattatcgccaagattcagcaaaggggacagggagctccagcccgagagcctattattagcagtgaggagcagaagcagctgatgctgtactatcacagaagacaagaggagctcaagagattggaagaaaatgatgatgatgcctatttaaactcaccatgggcggataacactgctttgaaaagacattttcatggagtgaaagacataaagtggagaccaagatgaagttcaccagctgatgacacttccaaagagattagctcacctttctcctaggcaattataatttaaaaaaaaaaaaaaggccacttactgccctctgtaaaagatgttaacatttctagttttcttttagtgtgaatttttaaaatagcagttattcaaggttttagaacttaataaatacctagtcagaagaaaatgtgtaaatcgtttttgtttcaggactatttagtatgtcatggttttctttgataaaatactaaacttttggccgggcgcggtggctcacgcctgtaatcccagcactttgggaggccgaggcaggcagatcacgaggtcaggagatcaagaccatccaggctaacacggtgaaaccccgtctctactaaaaatacaaaaaattagccgggcatggtggcaggcgcctgtagtcccagctactcgggaggctgaggcaggagaatggcgtgaacccgggaggtggagcttacagtgagccaagatcactgccactgcactctatcctgggcaacagagcgaaactcttgtctcaaaaaaaaaaaaaaaaaaaaaaaaagctacacttttttttcttcctgattgttttatattctcatgataactggtttattggaggaaagctgatgactggcagtgaccactagtgaccactagatgccgccaggcactcagcatgctttttctcctggccctctagatctattggaagctgaactcccagccttgctggagagacttctctaaccctgctgcggggtctaactgtagccttctttaaccctgctgcggggtctaactgtagccttctttaa

SEQ ID NO: 446802 - DNA, 1094 bp, Homo sapiens
ataggtacaagtgtacgaactcgaattatgtactcattgctcgatagctgtgaccgtaggggacagggagctccagcccgagagcctattattagcagtgaggagcagaagcagctgatgctgtactatcacagaagacaagaggagctcaagagattggaagaaaatgatgatgatgcctatttaaactcaccatgggcggataacactgctttgaaaagacattttcatggagtgaaagacataaagtggagaccaagatgaagttcaccagctgatgacacttccaaagagattagctcacctttctcctaggcaattataatttaaaaaaaaaaaaaaggccacttactgccctctgtaaaagatgttaacatttctagttttcttttagtgtgaatttttaaaatagcagttattcaaggttttagaacttaataaatacctagtcagaagaaaatgtgtaaatcgtttttgtttcaggactatttagtatgtcatggttttctttgataaaatactaaacttttggccgggcgcggtggctcacgcctgtaatcccagcactttgggaggccgaggcaggcagatcacgaggtcaggagatcaagaccatccaggctaacacggtgaaaccccgtctctactaaaaatacaaaaaattagccgggcatggtggcaggcgcctgtagtcccagctactcgggaggctgaggcaggagaatggcgtgaacccgggaggtggagcttacagtgagccaagatcactgccactgcactctatcctgggcaacagagcgaaactcttgtctcaaaaaaaaaaaaaaaaaaaaaaaaagctacacttttttttcttcctgattgttttatattctcatgataactggtttattggaggaaagctgatgactggcagtgaccactagtgaccactagatgccgccaggcactcagcatgctttttctcctggccctctagatctattggaagctgaactcccagccttgctggagagacttctctaaccctgctgcggggtctaactgtagccttctttaaccctgctgcggggtctaactgtagccttctttaa

SEQ ID NO: 446803 - DNA, 2069 bp, Homo sapiens
tggagactgaaagcggcggaagggacgctggaatgtggagcggttgtggggcggcagctgcggaactgcgcgattgtggttcccgccgtatttcccgttccccatctagtaactcccatctcagcccacgtatctccctgagtggaaatctcgggccccagaccagtcgattgggaggtccgccctccccttcagcgacttggtctgtgttttggcagttgccgcgacaacagtcacttccgggaaggggctctgcgaatctccttccgtcggtccgctcagaatcagctgtcctctcagactgtgtgggtggtttccccggccgcagctccgtacgggcttggattgctgggcctcggtgcaccccagcctcccccactcgggttctgagcttgagctggcggctctttaactctgcttcactgttgctcttggcaacatccacttccgggagcgagtgccgtttcccccgctcaccgcgggctagggagcgtgggattccggactgtgagcggctgttagtgcgtcgcagctgctggcgatccggcgaccctcggccggcaggacccgcgggccacgcagccggggccttctcaacgcctcagtacctcggcgggaccgccatggttctgctgcacgtgaagcggggcgacgagagccagttcctgctgcaggcgcctgggagtaccgagctggaggagctcacggtgcaggtggcccgggtctataatgggcggctcaaggtgcagcgcctctgctcagaaatggaagaattagccgaacatggcatatttctccctcctaatatgcaaggactgaccgatgatcagattgaagaattgaaattgaaggatgaatggggtgaaaaatgcgtacccagcggaggtgcagtgtttaaaaaggatgatattggacgaaggaatgggcaagctccaaatgagaagatgaagcaagtgttaaagaagactatagaagaagccaaagcaataatatctaagaaacaagtggaagccggtgtctgtgttaccatggagatggtgaaagatgccttggaccagcttcgaggcgcggtgatgattgtttaccccatggggttgccaccgtatgatcccatccgcatggagtttgaaaataaggaagacttgtcgggaacacaggcagggctcaacgtcattaaagaggcagaggcgcagctgtggtgggcagccaaggagctgagaagaacgaagaagctttcagactacgtggggaagaatgaaaaaaccaaaattatcgccaagattcagcaaaggggacagggagctccagcccgagagcctattattagcagtgaggagcagaagcagctgatgctgtactatcacagaagacaagaggagctcaagagattggaagaaaatgatgatgatgcctatttaaactcaccatgggcggataacactgctttgaaaagacattttcatggagtgaaagacataaagtggagaccaagatgaagttcaccagctgatgacacttccaaagagattagctcacctttctcctaggcaattataatttaaaaaaaaaaaaaaggccacttactgccctctgtaaaagatgttaacatttctagttttcttttagtgtgaatttttaaaatagcagttattcaaggttttagaacttaataaatacctagtctcaccttagttcaaaaaaaaaaaaaaaaaaacctccggggcctctcttttctccggggggcgggaaaaagggggtatggaatgggccatgggccataagctgtgtttccctgtgaccacagtttctctgtgtcacaagggggaaaaactcggcgggatcccccttattggagagcgatataacttcgaataaacccgggttaccctgttagaattggtcaaaaagcaataggccccgacaccacgacacagcagcatgacgggtgtacggagcgggcaccaccccacgctgtgaaccaagaaacacaagggccaggaaaaacttatcacacagttgacaacacataccattattgtcaccagacgaaaaaacacagagtagataat

SEQ ID NO: 446804 - DNA, 3418 bp, Homo sapiens
tggagactgaaagcggcggaagggacgctggaatgtggagcggttgtggggcggcagctgcggaactgcgcgattgtggttcccgccgtatttcccgttccccatctagtaactcccatctcagcccacgtatctccctgagtggaaatctcgggccccagaccagtcgattgggaggtccgccctccccttcagcgacttggtctgtgttttggcagttgccgcgacaacagtcacttccgggaaggggctctgcgaatctccttccgtcggtccgctcagaatcagctgtcctctcagactgtgtgggtggtttccccggccgcagctccgtacgggcttggattgctgggcctcggtgcaccccagcctcccccactcgggttctgagcttgagctggcggctctttaactctgcttcactgttgctcttggcaacatccacttccgggagcgagtgccgtttcccccgctcaccgcgggctagggagcgtgggattccggactgtgagcggctgttagtgcgtcgcagctgctggcgatccggcgaccctcggccggcaggacccgcgggccacgcagccggggccttctcaacgcctcagtacctcggcgggaccgccatggttctgctgcacgtgaagcggggcgacgagagccagttcctgctgcaggcgcctgggagtaccgagctggaggagctcacggtgcaggtggcccgggtctataatgggcggctcaaggtgcagcgcctctgctcagaaatggaagaattagccgaacatggcatatttctccctcctaatatgcaaggactgaccgatgatcagattgaagaattgaaattgaaggatgaatggggtgaaaaatgcgtacccagcggaggtgcagtgtttaaaaaggatgatattggacgaaggaatgggcaagctccaaatgagaagatgaagcaagtgttaaagaagactatagaagaagccaaagcaataatatctaagaaacaagtggaagccggtgtctgtgttaccatggagatggtgaaagatgccttggaccagcttcgaggcgcggtgatgattgtttaccccatggggttgccaccgtatgatcccatccgcatggagtttgaaaataaggaagacttgtcgggaacacaggcagggctcaacgtcattaaagaggcagaggcgcagctgtggtgggcagccaaggagctgagaagaacgaagaagctttcagactacgtggggaagaatgaaaaaaccaaaattatcgccaagattcagcaagtaagtactttttgctttaatgtgtcagtagtttttgttatttcccttcaaactgataaaaatgtacagtgaatccgaaagatttaaactactggtacaaatattttaatcttattggctcgggtttaaactaaaaatatcctcttcctgcacaccaacaaaaactggaagaaaatatggattgagtaccaatatctagagtttgttttaatatgtgggggagaggaaatatactatgttaatttcaagcgtaaaaatagggctgcaagtaaacagatatgttccttgaaatgtaaaatttcgcccgtcactgatttcaggctttttcaaactgctgatgctgtgtacaggagggggaggaggaaaggttcgagacctttgaaggacatcgtgtagcgctgtaacctgaggggccgccttggttttgtgggtgctcctacgtcactaggctgtgattttggggaaatggggccctccaccttatgtagatccagagtccgtggctctgagcatcctccctttcccactggacctgcctgcagtgtctgccttgggaatggtcaagacagagatggtatcgtgcagcctctggtctccacacagtgagagtccagggctcagggctgctcaagaccaaggcttcccttgatgcttcacttcgggtgatcagacatgggggacctgtttatctttagtagccggcaaaggcaatcgtaaaacatttgttgtaacttcaggattgtcactctaagaacaccttaatccacaatttgctctgctctcctctttgcagaaggggacagggagctccagcccgagagcctattattagcagtgaggagcagaagcagctgatgctgtactatcacagaagacaagaggagctcaaggtagcaggggacagatgggctttctgcagtgctggcgcccacacatagcctgtgtgccttacctggggctgctggggagcagtgagctctgcagaatgccggggaggggtctttctagagcttctgtctgcaggtctgtcggggtcctgccaggtgtcccctggtgttagacatggcagtatcctgctcctagagggcagggagagggggaggtcagtcatggactctttcttcagtctctttatgtgcaaaacactttcctgaaatgcctgcctgaataaaacatacttatttccagagattggaagaaaatgatgatgatgcctatttaaactcaccatgggcggataacactgctttgaaaagacattttcatggagtgaaagacataaagtggagaccaagatgaagttcaccagctgatgacacttccaaagagattagctcacctttctcctaggcaattataatttaaaaaaaaaaaaaaggccacttactgccctctgtaaaagatgttaacatttctagttttcttttagtgtgaatttttaaaatagcagttattcaaggttttagaacttaataaatacctagtcagaagaaaatgtgtaaatcgtttttgtttcaggactatttagtatgtcatggttttctttgataaaatactaaacttttggccgggcgcggtggctcacgcctgtaatcccagcactttgggaggccgaggcaggcagatcacgaggtcaggagatcaagaccatccaggctaacacggtgaaaccccgtctctactaaaaatacaaaaaattagccgggcatggtggcaggcgcctgtagtcccagctactcgggaggctgaggcaggagaatggcgtgaacccgggaggtggagcttacagtgagccaagatcactgccactgcactctatcctgggcaacagagcgaaactcttgtctcaaaaaaaaaaaaaaaaaaaaaaaaagctacacttttttttcttcctgattgttttatattctcatgataactggtttattggaggaaagctgatgactggcagtgaccactagtgaccactagatgccgccaggcactcagcatgctttttctcctggccctctagatctattggaagctgaactcccagccttgctggagagacttctctaaccctgctgcggggtctaactgtagccttctttaaccctgctgcggggtctaactgtagccttctttaa

SEQ ID NO: 446805 - DNA, 1629 bp, Homo sapiens
tggagactgaaagcggcggaagggacgctggaatgtggagcggttgtggggcggcagctgcggaactgcgcgattgtggttcccgccgtatttcccgttccccatctagtaactcccatctcagcccacgtatctccctgagtggaaatctcgggccccagaccagtcgattgggaggtccgccctccccttcagcgacttggtctgtgttttggcagttgccgcgacaacagtcacttccgggaaggggctctgcgaatctccttccgtcggtccgctcagaatcagctgtcctctcagactgtgtgggtggtttccccggccgcagctccgtacgggcttggattgctgggcctcggtgcaccccagcctcccccactcgggttctgagcttgagctggcggctctttaactctgcttcactgttgctcttggcaacatccacttccgggagcgagtgccgtttcccccgctcaccgcgggctagggagcgtgggattccggactgtgagcggctgttagtgcgtcgcagctgctggcgatccggcgaccctcggccggcaggacccgcgggccacgcagccggggccttctcaacgcctcagtacctcggcgggaccgccatggttctgctgcacgtgaagcggggcgacgagagccagttcctgctgcaggcgcctgggagtaccgagctggaggagctcacggtgcaggtggcccgggtctataatgggcggctcaaggtgcagcgcctctgctcagaaatggaagaattagccgaacatggcatatttctccctcctaatatgcaaggactgaccgatgatcagattgaagaattgaaattgaaggatgaatggggtgaaaaatgcgtacccagcggaggtgcagtgtttaaaaaggatgatattggacgaaggaatgggcaagctccaaatgagaagatgaagcaagtgttaaagaagactatagaagaagccaaagcaataatatctaagaaacaagtggaagccggtgtctgtgttaccatggagatggtgaaagatgccttggaccagcttcgaggcgcggtgatgattgtttaccccatggggttgccaccgtatgatcccatccgcatggagtttgaaaataaggaagacttgtcgggaacacaggcagggctcaacgtcattaaagaggcagaggcgcagctgtggtgggcagccaaggagctgagaagaacgaagaagctttcagactacgtggggaagaatgaaaaaaccaaaattatcgccaagattcagcaaatttttgccactttccaggtggtcgttctttgtcctcctgagcttgggcctcgctccttgggacccctggaccagaaccccaatcagctcaggaacaggcttctggcagatgagcccggcggcagtggagcgagagatgcagtgagcaatgtggctccataagcacagtacaatgcatatcctttcagccacgtctttgtttatttcattagctttgctttatgaaatatttcaagaactggcattgtgtgcaaggctctagaagaattttttgcatgtgtttgattttaattttctctgtttgctttttagtaattaagagtaaagtcaaccaagaaca

SEQ ID NO: 446806 - DNA, 2285 bp, Homo sapiens
tggagactgaaagcggcggaagggacgctggaatgtggagcggttgtggggcggcagctgcggaactgcgcgattgtggttcccgccgtatttcccgttccccatctagtaactcccatctcagcccacgtatctccctgagtggaaatctcgggccccagaccagtcgattgggaggtccgccctccccttcagcgacttggtctgtgttttggcagttgccgcgacaacagtcacttccgggaaggggctctgcgaatctccttccgtcggtccgctcagaatcagctgtcctctcagactgtgtgggtggtttccccggccgcagctccgtacgggcttggattgctgggcctcggtgcaccccagcctcccccactcgggttctgagcttgagctggcggctctttaactctgcttcactgttgctcttggcaacatccacttccgggagcgagtgccgtttcccccgctcaccgcgggctagggagcgtgggattccggactgtgagcggctgttagtgcgtcgcagctgctggcgatccggcgaccctcggccggcaggacctcggcgggaccgccatggttctgctgcacgtgaagcggggcgacgagagccagttcctgctgcaggcgcctgggagtaccgagctggaggagctcacggtgcaggtggcccgggtctataatgggcggctcaaggtgcagcgcctctgctcagaaatggaagaattagccgaacatggcatatttctccctcctaatatgcaaggactgaccgatgatcagattgaagaattgaaattgaaggatgaatggggtgaaaaatgcgtacccagcggaggtgcagtgtttaaaaaggatgatattggacgaaggaatgggcaagctccaaatgagaagatgaagcaagtgttaaagaagactatagaagaagccaaagcaataatatctaagaaacaagtggaagccggtgtctgtgttaccatggagatggtgaaagatgccttggaccagcttcgaggcgcggtgatgattgtttaccccatggggttgccaccgtatgatcccatccgcatggagtttgaaaataaggaagacttgtcgggaacacaggcagggctcaacgtcattaaagaggcagaggcgcagctgtggtgggcagccaaggagctgagaagaacgaagaagctttcagactacgtggggaagaatgaaaaaaccaaaattatcgccaagattcagcaaaggggacagggagctccagcccgagagcctattattagcagtgaggagcagaagcagctgatgctgtactatcacagaagacaagaggagctcaagagattggaagaaaatgatgatgatgcctatttaaactcaccatgggcggataacactgctttgaaaagacattttcatggagtgaaagacataaagtggagaccaagatgaagttcaccagctgatgacacttccaaagagattagctcacctttctcctaggcaattataatttaaaaaaaaaaaaaaggccacttactgccctctgtaaaagatgttaacatttctagttttcttttagtgtgaatttttaaaatagcagttattcaaggttttagaacttaataaatacctagtcagaagaaaatgtgtaaatcgtttttgtttcaggactatttagtatgtcatggttttctttgataaaatactaaacttttggccgggcgcggtggctcacgcctgtaatcccagcactttgggaggccgaggcaggcagatcacgaggtcaggagatcaagaccatccaggctaacacggtgaaaccccgtctctactaaaaatacaaaaaattagccgggcatggtggcaggcgcctgtagtcccagctactcgggaggctgaggcaggagaatggcgtgaacccgggaggtggagcttacagtgagccaagatcactgccactgcactctatcctgggcaacagagcgaaactcttgtctcaaaaaaaaaaaaaaaaaaaaaaaaagctacacttttttttcttcctgattgttttatattctcatgataactggtttattggaggaaagctgatgactggcagtgaccactagtgaccactagatgccgccaggcactcagcatgctttttctcctggccctctagatctattggaagctgaactcccagccttgctggagagacttctctaaccctgctgcggggtctaactgtagccttctttaaccctgctgcggggtctaactgtagccttctttaa

SEQ ID NO: 446807 - DNA, 1536 bp, Homo sapiens
tgtgaaggtgtgttctagggcgggagggggtatctagtgatgtgtgtctgtgtgtgtctgtgtatgtaatggtgaaaaatgcgtacccagcggaggtgcagtgtttaaaaaggatgatattggacgaaggaatgggcaagctccaaatgagaagatgaagcaagtgttaaagaagactatagaagaagccaaagcaataatatctaagaaacaagtggaagccggtgtctgtgttaccatggagatggtgaaagatgccttggaccagcttcgaggcgcggtgatgattgtttaccccatggggttgccaccgtatgatcccatccgcatggagtttgaaaataaggaagacttgtcgggaacacaggcagggctcaacgtcattaaagaggcagaggcgcagctgtggtgggcagccaaggagctgagaagaacgaagaagctttcagactacgtggggaagaatgaaaaaaccaaaattatcgccaagattcagcaaaggggacagggagctccagcccgagagcctattattagcagtgaggagcagaagcagctgatgctgtactatcacagaagacaagaggagctcaagagattggaagaaaatgatgatgatgcctatttaaactcaccatgggcggataacactgctttgaaaagacattttcatggagtgaaagacataaagtggagaccaagatgaagttcaccagctgatgacacttccaaagagattagctcacctttctcctaggcaattataatttaaaaaaaaaaaaaaggccacttactgccctctgtaaaagatgttaacatttctagttttcttttagtgtgaatttttaaaatagcagttattcaaggttttagaacttaataaatacctagtcagaagaaaatgtgtaaatcgtttttgtttcaggactatttagtatgtcatggttttctttgataaaatactaaacttttggccgggcgcggtggctcacgcctgtaatcccagcactttgggaggccgaggcaggcagatcacgaggtcaggagatcaagaccatccaggctaacacggtgaaaccccgtctctactaaaaatacaaaaaattagccgggcatggtggcaggcgcctgtagtcccagctactcgggaggctgaggcaggagaatggcgtgaacccgggaggtggagcttacagtgagccaagatcactgccactgcactctatcctgggcaacagagcgaaactcttgtctcaaaaaaaaaaaaaaaaaaaaaaaaagctacacttttttttcttcctgattgttttatattctcatgataactggtttattggaggaaagctgatgactggcagtgaccactagtgaccactagatgccgccaggcactcagcatgctttttctcctggccctctagatctattggaagctgaactcccagccttgctggagagacttctctaaccctgctgcggggtctaactgtagccttctttaaccctgctgcggggtctaactgtagccttctttaa

SEQ ID NO: 446808 - DNA, 994 bp, Homo sapiens
  misc_feature (799)..(799): n is a, c, g, or t
  misc_feature (802)..(803): n is a, c, g, or t
  misc_feature (805)..(805): n is a, c, g, or t
  misc_feature (811)..(811): n is a, c, g, or t
  misc_feature (814)..(814): n is a, c, g, or t
  misc_feature (827)..(827): n is a, c, g, or t
  misc_feature (841)..(841): n is a, c, g, or t
ctaagtgttactgtttgggattgacaactggaattttgttaagtcctaacttcagtccactgttggatctctaaattccctaactcaggcctgctttacagagcccttgtgagagggtgctaaggagcctaagacaacagcaagcttcttttatgctttccaccccccaggagtggtgaaaggacataggaaggagtctggggaactgtactacagcattgaaaaagaaggccaaagaaagtggtataagcgaatggctgtcatcctgtccttggagcaaggaaacagactgagagagcagtatgggcttggcccctatgaagcagtaacacctcttacaaaggcagcagatatcagcttagacaatttggtggaagggaagcggaaacggcgcagtaacgtcagctccccagccacccctactgcctccagtagcagcagcacaacccctacccgaaagatcacagaaagtcctcgtgcctccatgggagttctctcaggcaaaagaaaacttatcacttctgaagaggaacggtcccctgccaagcgaggtcgcaagtctgccacagtaaaacctggtgcagtaggggcaggagagtttgtgagcccctgtgagagtggagacaacaccggtgaaccctctgccctggaagagcagagagggcctttgcctctcaacaagaccttgtttctgggctacgcatttctccttaccatggccacaaccagtgacaagttggccagccgctccaaactgccagatggtcctacaggaagcagtgaagaagaggaggaattnggnnantcctcnttncacaggcagatangaatcccggtgaangaggggtaatcccgaaattccacgagccgcggcacacgctacacgggcttaaaggcggagaaaattggcaccccgaaatccggcggcacgggaccggggcaaggggcgcgaagggagcccgcaaaaggattgcgcggcgcagagacatggtgc

SEQ ID NO: 446809 - DNA, 470 bp, Homo sapiens
ttggtggtgttctagaggatctcgggttcccttgtcggggtaattcgatacaaaatgatttcaggagtttatctagtttatttccctaggttacattggctaggaaccttttgcaaatgtgtgaagatttgtatataggttcaatattctcaacctgtaaagtcagagaactaagttttaagcaagcattaaaaatatataggctcaggagcatgatttggattattctcagccccagaacaaacatggaaattagaaagccaggaatgcaaggaatacagatcattcatagaaagaaggaagagaagggggaccctaatatagggcttagttttttaagatgaagtcttgctctgtcacctaggctgtacccagctggcaacagataattacggtagttctggagctggtgggcatggcaactatcatggacccagacatgagacaaagggaaacaccgggtaccgagc

SEQ ID NO: 446810 - DNA, 6758 bp, Homo sapiens
acagcggcgacctagggatcgatctggagggacttggggagcgtgcagagacctctagctcgagcgcgagggacctcccgccgggatgcctggggagcagatggaccctactggaagtcagttggattcagatttctctcagcaagatactccttgcctgataattgaagattctcagcctgaaagccaggttctagaggatgattctggttctcacttcagtatgctatctcgacaccttcctaatctccagacgcacaaagaaaatcctgtgttggatgttgtgtccaatcctgaacaaacagctggagaagaacgaggagacggtaatagtgggttcaatgaacatttgaaagaaaacaaggttgcagaccctgtggattcttctaacttggacacatgtggttccatcagtcaggtcattgagcagttacctcagccaaacaggacaagcagtgttctgggaatgtcagtggaatctgctcctgctgtggaggaagagaagggagaagagttggaacagaaggagaaagagaaggaagaagatacttcaggcaatactacacattcccttggtgctgaagatactgcctcatcacagttgggttttggggttctggaactctcccagagccaggatgttgaggaaaatactgtgccatatgaagtggacaaagagcagctacaatcagtaaccaccaactctggttataccaggctgtctgatgtggatgctaatactgcaattaagcatgaagaacagtccaacgaagatatccccatagcagaacagtccagcaaggacatccctgtgacagcacagcccagtaaggatgtacatgttgtaaaagagcaaaatccaccacctgcaaggtcagaggacatgccttttagccccaaagcatctgttgctgctatggaagcaaaagaacagttgtctgcacaagaacttatggaaagtggactgcagattcagaagtcaccagagcctgaggttttgtcaactcaggaagacttgtttgaccagagcaataaaacagtatcttctgatggttgctctactccttcaagggaggaaggtgggtgttctttggcttccactcctgccaccactctgcatctcctgcagctctctggtcagaggtcccttgttcaggacagtctttccacgaattcttcagatcttgttgctccttctcctgatgctttccgatctactccttttatcgttcctagcagtcccacagagcaagaagggagacaagataagccaatggacacgtcagtgttatctgaagaaggaggagagccttttcagaagaaacttcaaagtggtgaaccagtggagttagaaaacccccctctcctgcctgagtccactgtatcaccacaagcctcaacaccaatatctcagagcacaccagtcttccctcctgggtcacttcctatcccatcccagcctcagttttctcatgacatttttattccttccccaagtctggaagaacaatcaaatgatgggaagaaagatggagatatgcatagttcatctttgacagttgagtgttctaaaacttcagagattgaaccaaagaattcccctgaggatcttgggctatctttgacaggggattcttgcaagttgatgctttctacaagtgaatatagtcagtccccaaagatggagagcttgagttctcacagaattgatgaagatggagaaaacacacagattgaggatacggaacccatgtctccagttctcaattctaaatttgttcctgctgaaaatgatagtatcctgatgaatccagcacaggatggtgaagtacaactgagtcagaatgatgacaaaacaaagggagatgatacagacaccagggatgacattagtattttagccactggttgcaagggcagagaagaaacggtagcagaagatgtttgtattgatctcacttgtgattcggggagtcaggcagttccgtcaccagctactcgatctgaggcactttctagtgtgttagatcaggaggaagctatggaaattaaagaacaccatccagaggaggggtcttcagggtctgaggtggaagaaatccctgagacaccttgtgaaagtcaaggagaggaactcaaagaagaaaatatggagagtgttccgttgcacctttctctgactgaaactcagtcccaagggttgtgtcttcaaaaggaaatgccaaaaaaagaatgctcagaagctatggaagttgaaaccagtgtgattagtattgattcccctcaaaagttggcaatacttgaccaagaattggaacataaggaacaggaagcttgggaagaagctacttcagaggactccagtgttgtcattgtagatgtgaaagagccatctcccagagttgatgtttcttgtgaacctttggagggagtggagaagtgctcagattcccagtcatgggaggatattgctccagaaatagaaccatgtgctgagaatagattagacaccaaggaagaaaagagtgtagaatatgaaggagatctgaaatcagggactgcagaaacagaacctgtagagcaagattcttcacagccttccttacctttagtgagagcagatgatcctttaagacttgaccaggagttgcagcagccccaaactcaggagaaaacaagtaattcattaacagaagactcaaaaatggctaatgcaaagcagctaagctcagatgcagaggcccagaagctggggaagccctctgcccatgcctcacaaagcttctgtgaaagttctagtgaaaccccatttcatttcactttgcctaaagaaggtgatatcatcccaccattgactggtgcaaccccacctcttattgggcacctaaaattggagcccaagagacacagtactcctattggtattagcaactatccagaaagcaccatagcaaccagtgatgtcatgtctgaaagcatggtggagacccatgatcccatacttgggagtggaaaaggggattctggggctgccccagacgtggatgataaattatgtctaagaatgaaactggttagtcctgagactgaggcgagtgaagagtctttgcagttcaacctggaaaagcctgcaactggtgaaagaaaaaatggatctactgctgttgctgagtctgttgccagtccccagaagaccatgtctgtgttgagctgtatctgtgaagccaggcaagagaatgaggctcgaagtgaggatccccccaccacacccatcagggggaacttgctccactttccaagttctcaaggagaagaggagaaagaaaaattggagggtgaccatacaatcaggcagagtcaacagcctatgaagcccattagtcctgtcaaggaccctgtttctcctgcttcccagaagatggtcatacaagggccatccagtcctcaaggagaggcaatggtgacagatgtgctagaagaccagaaagaaggacggagtactaataaggaaaatcctagtaaggccttgattgaaaggcccagccaaaataacataggaatccaaaccatggagtgttccttgagggtcccagaaactgtttcagcagcaacccagactataaagaatgtgtgtgagcaggggaccagtacagtggaccagaactttggaaagcaagatgccacagttcagactgagagggggagtggtgagaaaccagtcagtgctcctggggatgatacagagtcgctccatagccagggagaagaagagtttgatatgcctcagcctccacatggccatgtcttacatcgtcacatgagaacaatccgggaagtacgcacacttgtcactcgtgtcattacagatgtgtattatgtggatggaacagaagtagaaagaaaagtaactgaggagactgaagagccaattgtagagtgtcaggagtgtgaaactgaagtttccccttcacagactgggggctcctcaggtgacctgggggatatcagctccttctcctccaaggcatccagcttacaccgcacatcaagtgggacaagtctctcagctatgcacagcagtggaagctcagggaaaggagccggaccactcagagggaaaaccagcgggacagaacccgcagattttgccttacccagctcccgaggaggcccaggaaaactgagtcctagaaaaggggtcagtcagacagggacgccagtgtgtgaggaggatggtgatgcaggccttggcatcagacagggagggaaggctccagtcacgcctcgtgggcgtgggcgaaggggccgcccaccttctcggaccactggaaccagagaaacagctgtgcctggccccttgggcatagaggacatttcacctaacttgtcaccagatgataaatccttcagccgtgtcgtgccccgagtgccagactccaccagacgaacagatgtgggtgctggtgctttgcgtcgtagtgactctccagaaattcctttccaggctgctgctggcccttctgatggcttagatgcctcctctccaggaaatagctttgtagggctccgtgttgtagccaagtggtcatccaatggctacttttactctgggaaaatcacacgagatgtcggagctgggaagtataaattgctctttgatgatgggtacgaatgtgatgtgttgggcaaagacattctgttatgtgaccccatcccgctggacactgaagtgacggccctctcggaggatgagtatttcagtgcaggagtggtgaaaggacataggaaggagtctggggaactgtactacagcattgaaaaagaaggccaaagaaagtggtataagcgaatggctgtcatcctgtccttggagcaaggaaacagactgagagagcagtatgggcttggcccctatgaagcagtaacacctcttacaaaggcagcagatatcagcttagacaatttggtggaagggaagcggaaacggcgcagtaacgtcagctccccagccacccctactgcctccagtagcagcagcacaacccctacccgaaagatcacagaaagtcctcgtgcctccatgggagttctctcaggcaaaagaaaacttatcacttctgaagaggaacggtcccctgccaagcgaggtcgcaagtctgccacagtaaaacctggtgcagtaggggcaggagagtttgtgagcccctgtgagagtggagacaacaccggtgaaccctctgccctggaagagcagagagggcctttgcctctcaacaagaccttgtttctgggctacgcatttctccttaccatggccacaaccagtgacaagttggccagccgctccaaactgccagatggtcctacaggaagcagtgaagaagaggaggaatttttggaaattcctcctttcaacaagcagtatacagaatcccagcttcgagcaggagctggctatatccttgaagatttcaatgaagcccagtgtaacacagcttaccagtgtcttctaattgcggatcagcattgtcgaacccggaagtacttcctgtgccttgccagtgggattccttgtgtgtctcatgtctgggtccatgatagttgccatgccaaccagctccagaactaccgtaattatctgttgccagctgggtacagccttgaggagcaaagaattctggactggcaaccccgtgaaaatcctttccagaatctgaaggtactcttggtatcagaccaacagcagaacttcctggagctctggtctgagatcctcatgactggtggtgcagcctctgtgaagcagcaccattcaagtgcccataacaaagatattgctttaggggtatttgatgtggtggtgacggacccctcatgcccagcctcggtgctgaagtgtgctgaagcattgcagctgcctgtggtgtcacaagagtgggtgatccagtgcctcattgttggggagagaattggattcaagcagcatccaaaatataaacacgattatgtttctcactaaagatacttggtcttactggttttattccctgctatcgtggagattgtgttttaaccaggttttaaatgtgtcttgtgtgtaactggattccttgcatggatcttgtatatagttttatttgctgaacttttatgataaaataaatgttgaatctctttggttgtagtaactgggatttcttcatctgtttttttgagcttaatctcagaacaaatgacaagacatagtactttctctgagtctttcaacaggcttattcacttacggaggacagctcaccaaggaaattgaaaagttaagagtgaactttattctgtggcatcattcccaaaaggttattccagggtgtctaaaatgctatgcttgcagaaactcagtttaaggtaggtgaaggcccagattaacagttgtgccaaaagttgagtggaattgggcacagctctgtttcctgacagttaaaaaagacctcatgctctctctctgagctgagatcacagctcacctgtgggtactccccaactcttagagctaaagggagaacgaaaggaccaactgccatgaagggacagtgaccataagcttgatggaatgaccttccgtaagataaacatgggaagcacaagtgagaacacctggaaatgttacacgttctagtcaaagacccaatattattattattattattgtcacaatagctggaagcagttccttcccttcctctggcatcactgatccctgc

SEQ ID NO: 446811 - DNA, 5706 bp, Homo sapiens
  misc_feature (18)..(18): n is a, c, g, or t
  misc_feature (24)..(24): n is a, c, g, or t
cccgtagcacttccttanctttantgagagcagatgatcctctaagacttgaccaggagttgcagcagccccaaactcaggagaaaacaagtaattcattaacagaagactcaaaaatggctaatgcaaagcagctaagctcagatgcagaggcccagaagctggggaagccctctgcccatgcctcacaaagcttctgtgaaagttctagtgataagccaatggacacgtcagtgttatctgaagaaggaggagagccttttcagaagaaacttcaaagtggtgaaccagtggagttagaaaacccccctctcctgcctgagtccactgtatcaccacaagcctcaacaccaatatctcagagcacaccagtcttccctcctgggtcacttcctatcccatcccagcctcagttttctcatgacatttttattccttccccaagtctggaagaacaatcaaatgatgggaagaaagatggagatatgcatagttcatctttgacagttgagtgttctaaaacttcagagattgaaccaaagaattcccctgaggatcttgggctatctttgacaggggattcttgcaagttgatgctttctacaagtgaatatagtcagtccccaaagatggagagcttgagttctcacagaattgatgaagatggagaaaacacacagattgaggatacggaacccatgtctccagttctcaattctaaatttgttcctgctgaaaatgatagtatcctgatgaatccagcacaggatggtgaagtacaactgagtcagaatgatgacaaaacaaagggagatgatacagacaccagggatgacattagtattttagccactggttgcaagggcagagaagaaacggtagcagaagatgtttgtattgatctcacttgtgattcggggagtcaggcagttccgtcaccagctactcgatctgaggcactttctagtgtgttagatcaggaggaagctatggaaattaaagaacaccatccagaggaggggtcttcagggtctgaggtggaagaaatccctgagacaccttgtgaaagtcaaggagaggaactcaaagaagaaaatatggagagtgttccgttgcacctttctctgactgaaactcagtcccaagggttgtgtcttcaaaaggaaatgccaaaaaaagaatgctcagaagctatggaagttgaaaccagtgtgattagtattgattcccctcaaaagttggcaatacttgaccaagaattggaacataaggaacaggaagcttgggaagaagctacttcagaggactccagtgttgtcattgtagatgtgaaagagccatctcccagagttgatgtttcttgtgaacctttggagggagtggagaagtgctcagattcccagtcatgggaggatattgctccagaaatagaaccatgtgctgagaatagattagacaccaaggaagaaaagagtgtagaatatgaaggagatctgaaatcagggactgcagaaacagaacctgtagagcaagattcttcacagccttccttacctttagtgagagcagatgatcctttaagacttgaccaggagttgcagcagccccaaactcaggagaaaacaagtaattcattaacagaagactcaaaaatggctaatgcaaagcagctaagctcagatgcagaggcccagaagctggggaagccctctgcccatgcctcacaaagcttctgtgaaagttctagtgaaaccccatttcatttcactttgcctaaagaaggtgatatcatcccaccattgactggtgcaaccccacctcttattgggcacctaaaattggagcccaagagacacagtactcctattggtattagcaactatccagaaagcaccatagcaaccagtgatgtcatgtctgaaagcatggtggagacccatgatcccatacttgggagtggaaaaggggattctggggctgccccagacgtggatgataaattatgtctaagaatgaaactggttagtcctgagactgaggcgagtgaagagtctttgcagttcaacctggaaaagcctgcaactggtgaaagaaaaaatggatctactgctgttgctgagtctgttgccagtccccagaagaccatgtctgtgttgagctgtatctgtgaagccaggcaagagaatgaggctcgaagtgaggatccccccaccacacccatcagggggaacttgctccactttccaagttctcaaggagaagaggagaaagaaaaattggagggtgaccatacaatcaggcagagtcaacagcctatgaagcccattagtcctgtcaaggaccctgtttctcctgcttcccagaagatggtcatacaagggccatccagtcctcaaggagaggcaatggtgacagatgtgctagaagaccagaaagaaggacggagtactaataaggaaaatcctagtaaggccttgattgaaaggcccagccaaaataacataggaatccaaaccatggagtgttccttgagggtcccagaaactgtttcagcagcaacccagactataaagaatgtgtgtgagcaggggaccagtacagtggaccagaactttggaaagcaagatgccacagttcagactgagagggggagtggtgagaaaccagtcagtgctcctggggatgatacagagtcgctccatagccagggagaagaagagtttgatatgcctcagcctccacatggccatgtcttacatcgtcacatgagaacaatccgggaagtacgcacacttgtcactcgtgtcattacagatgtgtattatgtggatggaacagaagtagaaagaaaagtaactgaggagactgaagagccaattgtagagtgtcaggagtgtgaaactgaagtttccccttcacagactgggggctcctcaggtgacctgggggatatcagctccttctcctccaaggcatccagcttacaccgcacatcaagtgggacaagtctctcagctatgcacagcagtggaagctcagggaaaggagccggaccactcagagggaaaaccagcgggacagaacccgcagattttgccttacccagctcccgaggaggcccaggaaaactgagtcctagaaaaggggtcagtcagacagggacgccagtgtgtgaggaggatggtgatgcaggccttggcatcagacagggagggaaggctccagtcacgcctcgtgggcgtgggcgaaggggccgcccaccttctcggaccactggaaccagagaaacagctgtgcctggccccttgggcatagaggacatttcacctaacttgtcaccagatgataaatccttcagccgtgtcgtgccccgagtgccagactccaccagacgaacagatgtgggtgctggtgctttgcgtcgtagtgactctccagaaattcctttccaggctgctgctggcccttctgatggcttagatgcctcctctccaggaaatagctttgtagggctccgtgttgtagccaagtggtcatccaatggctacttttactctgggaaaatcacacgagatgtcggagctgggaagtataaattgctctttgatgatgggtacgaatgtgatgtgttgggcaaagacattctgttatgtgaccccatcccgctggacactgaagtgacggccctctcggaggatgagtatttcagtgcaggagtggtgaaaggacataggaaggagtctggggaactgtactacagcattgaaaaagaaggccaaagaaagtggtataagcgaatggctgtcatcctgtccttggagcaaggaaacagactgagagagcagtatgggcttggcccctatgaagcagtaacacctcttacaaaggcagcagatatcagcttagacaatttggtggaagggaagcggaaacggcgcagtaacgtcagctccccagccacccctactgcctccagtagcagcagcacaacccctacccgaaagatcacagaaagtcctcgtgcctccatgggagttctctcaggcaaaagaaaacttatcacttctgaagaggaacggtcccctgccaagcgaggtcgcaagtctgccacagtaaaacctggtgcagtaggggcaggagagtttgtgagcccctgtgagagtggagacaacaccggtgaaccctctgccctggaagagcagagagggcctttgcctctcaacaagaccttgtttctgggctacgcatttctccttaccatggccacaaccagtgacaagttggccagccgctccaaactgccagatggtcctacaggaagcagtgaagaagaggaggaatttttggaaattcctcctttcaacaagcagtatacagaatcccagcttcgagcaggagctggctatatccttgaagatttcaatgaagcccagtgtaacacagcttaccagtgtcttctaattgcggatcagcattgtcgaacccggaagtacttcctgtgccttgccagtgggattccttgtgtgtctcatgtctgggtccatgatagttgccatgccaaccagctccagaactaccgtaattatctgttgccagctgggtacagccttgaggagcaaagaattctggactggcaaccccgtgaaaatcctttccagaatctgaaggtactcttggtatcagaccaacagcagaacttcctggagctctggtctgagatcctcatgactggtggtgcagcctctgtgaagcagcaccattcaagtgcccataacaaagatattgctttaggggtatttgatgtggtggtgacggacccctcatgcccagcctcggtgctgaagtgtgctgaagcattgcagctgcctgtggtgtcacaagagtgggtgatccagtgcctcattgttggggagagaattggattcaagcagcatccaaaatataaacacgattatgtttctcactaaagatacttggtcttactggttttattccctgctatcgtggagattgtgttttaaccaggttttaaatgtgtcttgtgtgtaactggattccttgcatggatcttgtatatagttttatttgctgaacttttatgataaaataaatgttgaatctctttggttgtagtaactgggatttcttcatctgtttttttgagcttaatctcagaacaaatgacaagacatagtactttctctgagtctttcaacaggcttattcacttacggaggacagctcaccaaggaaattgaaaagttaagagtgaactttattctgtggcatcattcccaaaaggttattccagggtgtctaaaatgctatgcttgcagaaactcagtttaaggtaggtgaaggcccagattaacagttgtgccaaaagttgagtggaattgggcacagctctgtttcctgacagttaaaaaagacctcatgctctctctctgagctgagatcacagctcacctgtgggtactccccaactcttagagctaaagggagaacgaaaggaccaactgccatgaagggacagtgaccataagcttgatggaatgaccttccgtaagataaacatgggaagcacaagtgagaacacctggaaatgttacacgttctagtcaaagacccaatattattattattattattgtcacaatagctggaagcagttccttcccttcctctggcatcactgatccctgc

SEQ ID NO: 446812 - DNA, 6737 bp, Homo sapiens
acagcggcgacctagggatcgatctggagggacttggggagcgtgcagagacctctagctcgagcgcgagggacctcccgccgggatgcctggggagcagatggaccctactggaagtcagttggattcagatttctctcagcaagatactccttgcctgataattgaagattctcagcctgaaagccaggttctagaggatgattctggttctcacttcagtatgctatctcgacaccttcctaatctccagacgcacaaagaaaatcctgtgttggatgttgtgtccaatcctgaacaaacagctggagaagaacgaggagacggtaatagtgggttcaatgaacatttgaaagaaaacaaggttgcagaccctgtggattcttctaacttggacacatgtggttccatcagtcaggtcattgagcagttacctcagccaaacaggacaagcagtgttctgggaatgtcagtggaatctgctcctgctgtggaggaagagaagggagaagagttggaacagaaggagaaagagaaggaagaagatacttcaggcaatactacacattcccttggtgctgaagatactgcctcatcacagttgggttttggggttctggaactctcccagagccaggatgttgaggaaaatactgtgccatatgaagtggacaaagagcagctacaatcagtaaccaccaactctggttataccaggctgtctgatgtggatgctaatactgcaattaagcatgaagaacagtccaacgaagatatccccatagcagaacagtccagcaaggacatccctgtgacagcacagcccagtaaggatgtacatgttgtaaaagagcaaaatccaccacctgcaaggtcagaggacatgccttttagccccaaagcatctgttgctgctatggaagcaaaagaacagttgtctgcacaagaacttatggaaagtggactgcagattcagaagtcaccagagcctgaggttttgtcaactcaggaagacttgtttgaccagagcaataaaacagtatcttctgatggttgctctactccttcaagggaggaaggtgggtgttctttggcttccactcctgccaccactctgcatctcctgcagctctctggtcagaggtcccttgttcaggacagtctttccacgaattcttcagatcttgttgctccttctcctgatgctttccgatctactccttttatcgttcctagcagtcccacagagcaagaagggagacaagataagccaatggacacgtcagtgttatctgaagaaggaggagagccttttcagaagaaacttcaaagtggtgaaccagtggagttagaaaacccccctctcctgcctgagtccactgtatcaccacaagcctcaacaccaatatctcagagcacaccagtcttccctcctgggtcacttcctatcccatcccagcctcagttttctcatgacatttttattccttccccaagtctggaagaacaatcaaatgatgggaagaaagatggagatatgcatagttcatctttgacagttgagtgttctaaaacttcagagattgaaccaaagaattcccctgaggatcttgggctatctttgacaggggattcttgcaagttgatgctttctacaagtgaatatagtcagtccccaaagatggagagcttgagttctcacagaattgatgaagatggagaaaacacacagattgaggatacggaacccatgtctccagttctcaattctaaatttgttcctgctgaaaatgatagtatcctgatgaatccagcacaggatggtgaagtacaactgagtcagaatgatgacaaaacaaagggagatgatacagacaccagggatgacattagtattttagccactggttgcaagggcagagaagaaacggtagcagaagatgtttgtattgatctcacttgtgattcggggagtcaggcagttccgtcaccagctactcgatctgaggcactttctagtgtgttagatcaggaggaagctatggaaattaaagaacaccatccagaggaggggtcttcagggtctgaggtggaagaaatccctgagacaccttgtgaaagtcaaggagaggaactcaaagaagaaaatatggagagtgttccgttgcacctttctctgactgaaactcagtcccaagggttgtgtcttcaaaaggaaatgccaaaaaaagaatgctcagaagctatggaagttgaaaccagtgtgattagtattgattcccctcaaaagttggcaatacttgaccaagaattggaacataaggaacaggaagcttgggaagaagctacttcagaggactccagtgttgtcattgtagatgtgaaagagccatctcccagagttgatgtttcttgtgaacctttggagggagtggagaagtgctcagattcccagtcatgggaggatattgctccagaaatagaaccatgtgctgagaatagattagacaccaaggaagaaaagagtgtagaatatgaaggagatctgaaatcagggactgcagaaacagaacctgtagagcaagattcttcacagccttccttacctttagtgagagcagatgatcctttaagacttgaccaggagttgcagcagccccaaactcaggagaaaacaagtaattcattaacagaagactcaaaaatggctaatgcaaagcagctaagctcagatgcagaggcccagaagctggggaagccctctgcccatgcctcacaaagcttctgtgaaagttctagtgaaaccccatttcatttcactttgcctaaagaaggtgatatcatcccaccattgactggtgcaaccccacctcttattgggcacctaaaattggagcccaagagacacagtactcctattggtattagcaactatccagaaagcaccatagcaaccagtgatgtcatgtctgaaagcatggtggagacccatgatcccatacttgggagtggaaaaggggattctggggctgccccagacgtggatgataaattatgtctaagaatgaaactggttagtcctgagactgaggcgagtgaagagtctttgcagttcaacctggaaaagcctgcaactggtgaaagaaaaaatggatctactgctgttgctgagtctgttgccagtccccagaagaccatgtctgtgttgagctgtatctgtgaagccaggcaagagaatgaggctcgaagtgaggatccccccaccacacccatcagggggaacttgctccactttccaagttctcaaggagaagaggagaaagaaaaattggagggtgaccatacaatcaggcagagtcaacagcctatgaagcccattagtcctgtcaaggaccctgtttctcctgcttcccagaagatggtcatacaagggccatccagtcctcaaggagaggcaatggtgacagatgtgctagaagaccagaaagaaggacggagtactaataaggaaaatcctagtaaggccttgattgaaaggcccagccaaaataacataggaatccaaaccatggagtgttccttgagggtcccagaaactgtttcagcagcaacccagactataaagaatgtgtgtgagcaggggaccagtacagtggaccagaactttggaaagcaagatgccacagttcagactgagagggggagtggtgagaaaccagtcagtgctcctggggatgatacagagtcgctccatagccagggagaagaagagtttgatatgcctcagcctccacatggccatgtcttacatcgtcacatgagaacaatccgggaagtacgcacacttgtcactcgtgtcattacagatgtgtattatgtggatggaacagaagtagaaagaaaagtaactgaggagactgaagagccaattgtagagtgtcaggagtgtgaaactgaagtttccccttcacagactgggggctcctcaggtgacctgggggatatcagctccttctcctccaaggcatccagcttacaccgcacatcaagtgggacaagtctctcagctatgcacagcagtggaagctcagggaaaggagccggaccactcagagggaaaaccagcgggacagaacccgcagattttgccttacccagctcccgaggaggcccaggaaaactgagtcctagaaaaggggtcagtcagacagggacgccagtgtgtgaggaggatggtgatgcaggccttggcatcagacagggagggaaggctccagtcacgcctcgtgggcgtgggcgaaggggccgcccaccttctcggaccactggaaccagagaaacagctgtgcctggccccttgggcatagaggacatttcacctaacttgtcaccagatgataaatccttcagccgtgtcgtgccccgagtgccagactccaccagacgaacagatgtgggtgctggtgctttgcgtcgtagtgactctccagaaattcctttccaggctgctgctggcccttctgatggcttagatgcctcctctccaggaaatagctttgtagggctccgtgttgtagccaagtggtcatccaatggctacttttactctgggaaaatcacacgagatgtcggagctgggaagtataaattgctctttgatgatgggtacgaatgtgatgtgttgggcaaagacattctgttatgtgaccccatcccgctggacactgaagtgacggccctctcggaggatgagtatttcagtgcaggagtggtgaaaggacataggaaggagtctggggaactgtactacagcattgaaaaagaaggccaaagaaagtggtataagcgaatggctgtcatcctgtccttggagcaaggaaacagactgagagagcagtatgggcttggcccctatgaagcagtaacacctcttacaaaggcagcagatatcagcttagacaatttggtggaagggaagcggaaacggcgcagtaacgtcagctccccagccacccctactgcctccagtagcagcagcacaacccctacccgaaagatcacagaaagtcctcgtgcctccatgggagttctctcaggcaaaagaaaacttatcacttctgaagaggaacggtcccctgccaagcgaggtcgcaagtctgccacagtaaaacctggtgcagtaggggcaggagagtttgtgagcccctgtgagagtggagacaacaccggtgaaccctctgccctggaagagcagagagggcctttgcctctcaacaagaccttgtttctgggctacgcatttctccttaccatggccacaaccagtgacaagttggccagccgctccaaactgccagatggtcctacaggaagcagtgaagaagaggaggaatttttggaaattcctcctttcaacaagcagtatacagaatcccagcttcgagcaggagctggctatatccttgaagatttcaatgaagcccaggtgaggagtttctttgtgtaacctaatatagtggcaatgataagagccaacttgctgtgttgagaagaggcctgggaggggttggggaacctggataaagtagccagagatttcaggaactgagaaactgccaaaatgtttttgcatgaaatagaatttttgttgtgtatagggaagagaaggtaggaccttgggttagttaatggctatggttctgttgctgggacaaaagaagattgatgtttatgtttagtagtagaaacccctattagggttgctgatttttagcctgaaaggctgagttcataggttttggttgtccgttgaggatttaggtcctcagtatgctgcaggtgaggcagagagaacatctatggaaattacttgggccttccagtgagaagagtggccttgggcaggatagactaaatcacattttgggtagtagttgggagtcttcagatctgctcttcatggctcattatggctgctgcttaggagctttccacagaagtcaccaaacccattggctctgcttcttttcttgcagtgtaacacagcttaccagtgtcttctaattgcggatcagcattgtcgaacccggaagtacttcctgtgccttgccagtgggattccttgtgtgtctcatgtctgggtccatgatagttgccatgccaaccagctccagaactaccgtaattatctgttgccagctgggtacagccttgaggagcaaagaattctggactggcaaccccgtgaaaatcctttccagaatctgaaggtactcttggtatcagaccaacagcagaacttcctggagctctggtctgagatcctcatgactggtggtgcagcctctgtgaagcagcaccattcaagtgcccataacaaagatattgctttaggggtatttgatgtggtggtgacggacccctcatgcccagcctcggtgctgaagtgtgctgaagcattgcagctgcctgtggtgtcacaagagtgggtgatccagtgcctcattgttggggagagaattggattcaagcagcatccaaaatataaacacgattatgtttctcactaaagatacttggtcttactggttttattccctgctatcgtggagattgtgttttaaccaggttttaaatgtgtcttgtgtgtaactggattccttgcatggatcttgtatatagttttatttgctgaacttttatgataaaataaatgttgaatctctttggttgtagta

SEQ ID NO: 446813 - DNA, 6283 bp, Homo sapiens
acagcggcgacctagggatcgatctggagggacttggggagcgtgcagagacctctagctcgagcgcgagggacctcccgccgggatgcctggggagcagatggaccctactggaagtcagttggattcagatttctctcagcaagatactccttgcctgataattgaagattctcagcctgaaagccaggttctagaggatgattctggttctcacttcagtatgctatctcgacaccttcctaatctccagacgcacaaagaaaatcctgtgttggatgttgtgtccaatcctgaacaaacagctggagaagaacgaggagacggtaatagtgggttcaatgaacatttgaaagaaaacaaggttgcagaccctgtggattcttctaacttggacacatgtggttccatcagtcaggtcattgagcagttacctcagccaaacaggacaagcagtgttctgggaatgtcagtggaatctgctcctgctgtggaggaagagaagggagaagagttggaacagaaggagaaagagaaggaagaagatacttcaggcaatactacacattcccttggtgctgaagatactgcctcatcacagttgggttttggggttctggaactctcccagagccaggatgttgaggaaaatactgtgccatatgaagtggacaaagagcagctacaatcagtaaccaccaactctggttataccaggctgtctgatgtggatgctaatactgcaattaagcatgaagaacagtccaacgaagatatccccatagcagaacagtccagcaaggacatccctgtgacagcacagcccagtaaggatgtacatgttgtaaaagagcaaaatccaccacctgcaaggtcagaggacatgccttttagccccaaagcatctgttgctgctatggaagcaaaagaacagttgtctgcacaagaacttatggaaagtggactgcagattcagaagtcaccagagcctgaggttttgtcaactcaggaagacttgtttgaccagagcaataaaacagtatcttctgatggttgctctactccttcaagggaggaaggtgggtgttctttggcttccactcctgccaccactctgcatctcctgcagctctctggtcagaggtcccttgttcaggacagtctttccacgaattcttcagatcttgttgctccttctcctgatgctttccgatctactccttttatcgttcctagcagtcccacagagcaagaagggagacaagataagccaatggacacgtcagtgttatctgaagaaggaggagagccttttcagaagaaacttcaaagtggtgaaccagtggagttagaaaacccccctctcctgcctgagtccactgtatcaccacaagcctcaacaccaatatctcagagcacaccagtcttccctcctgggtcacttcctatcccatcccagcctcagttttctcatgacatttttattccttccccaagtctggaagaacaatcaaatgatgggaagaaagatggagatatgcatagttcatctttgacagttgagtgttctaaaacttcagagattgaaccaaagaattcccctgaggatcttgggctatctttgacaggggattcttgcaagttgatgctttctacaagtgaatatagtcagtccccaaagatggagagcttgagttctcacagaattgatgaagatggagaaaacacacagattgaggatacggaacccatgtctccagttctcaattctaaatttgttcctgctgaaaatgatagtatcctgatgaatccagcacaggatggtgaagtacaactgagtcagaatgatgacaaaacaaagggagatgatacagacaccagggatgacattagtattttagccactggttgcaagggcagagaagaaacggtagcagaagatgtttgtattgatctcacttgtgattcggggagtcaggcagttccgtcaccagctactcgatctgaggcactttctagtgtgttagatcaggaggaagctatggaaattaaagaacaccatccagaggaggggtcttcagggtctgaggtggaagaaatccctgagacaccttgtgaaagtcaaggagaggaactcaaagaagaaaatatggagagtgttccgttgcacctttctctgactgaaactcagtcccaagggttgtgtcttcaaaaggaaatgccaaaaaaagaatgctcagaagctatggaagttgaaaccagtgtgattagtattgattcccctcaaaagttggcaatacttgaccaagaattggaacataaggaacaggaagcttgggaagaagctacttcagaggactccagtgttgtcattgtagatgtgaaagagccatctcccagagttgatgtttcttgtgaacctttggagggagtggagaagtgctcagattcccagtcatgggaggatattgctccagaaatagaaccatgtgctgagaatagattagacaccaaggaagaaaagagtgtagaatatgaaggagatctgaaatcagggactgcagaaacagaacctgtagagcaagattcttcacagccttccttacctttagtgagagcagatgatcctttaagacttgaccaggagttgcagcagccccaaactcaggagaaaacaagtaattcattaacagaagactcaaaaatggctaatgcaaagcagctaagctcagatgcagaggcccagaagctggggaagccctctgcccatgcctcacaaagcttctgtgaaagttctagtgaaaccccatttcatttcactttgcctaaagaaggtgatatcatcccaccattgactggtgcaaccccacctcttattgggcacctaaaattggagcccaagagacacagtactcctattggtattagcaactatccagaaagcaccatagcaaccagtgatgtcatgtctgaaagcatggtggagacccatgatcccatacttgggagtggaaaaggggattctggggctgccccagacgtggatgataaattatgtctaagaatgaaactggttagtcctgagactgaggcgagtgaagagtctttgcagttcaacctggaaaagcctgcaactggtgaaagaaaaaatggatctactgctgttgctgagtctgttgccagtccccagaagaccatgtctgtgttgagctgtatctgtgaagccaggcaagagaatgaggctcgaagtgaggatccccccaccacacccatcagggggaacttgctccactttccaagttctcaaggagaagaggagaaagaaaaattggagggtgaccatacaatcaggcagagtcaacagcctatgaagcccattagtcctgtcaaggaccctgtttctcctgcttcccagaagatggtcatacaagggccatccagtcctcaaggagaggcaatggtgacagatgtgctagaagaccagaaagaaggacggagtactaataaggaaaatcctagtaaggccttgattgaaaggcccagccaaaataacataggaatccaaaccatggagtgttccttgagggtcccagaaactgtttcagcagcaacccagactataaagaatgtgtgtgagcaggggaccagtacagtggaccagaactttggaaagcaagatgccacagttcagactgagagggggagtggtgagaaaccagtcagtgctcctggggatgatacagagtcgctccatagccagggagaagaagagtttgatatgcctcagcctccacatggccatgtcttacatcgtcacatgagaacaatccgggaagtacgcacacttgtcactcgtgtcattacagatgtgtattatgtggatggaacagaagtagaaagaaaagtaactgaggagactgaagagccaattgtagagtgtcaggagtgtgaaactgaagtttccccttcacagactgggggctcctcaggtgacctgggggatatcagctccttctcctccaaggcatccagcttacaccgcacatcaagtgggacaagtctctcagctatgcacagcagtggaagctcagggaaaggagccggaccactcagagggaaaaccagcgggacagaacccgcagattttgccttacccagctcccgaggaggcccaggaaaactgagtcctagaaaaggggtcagtcagacagggacgccagtgtgtgaggaggatggtgatgcaggccttggcatcagacagggagggaaggctccagtcacgcctcgtgggcgtgggcgaaggggccgcccaccttctcggaccactggaaccagagaaacagctgtgcctggccccttgggcatagaggacatttcacctaacttgtcaccagatgataaatccttcagccgtgtcgtgccccgagtgccagactccaccagacgaacagatgtgggtgctggtgctttgcgtcgtagtgactctccagaaattcctttccaggctgctgctggcccttctgatggcttagatgcctcctctccaggaaatagctttgtagggctccgtgttgtagccaagtggtcatccaatggctacttttactctgggaaaatcacacgagatgtcggagctgggaagtataaattgctctttgatgatgggtacgaatgtgatgtgttgggcaaagacattctgttatgtgaccccatcccgctggacactgaagtgacggccctctcggaggatgagtatttcagtgcaggagtggtgaaaggacataggaaggagtctggggaactgtactacagcattgaaaaagaaggccaaagaaagtggtataagcgaatggctgtcatcctgtccttggagcaaggaaacagactgagagagcagtatgggcttggcccctatgaagcagtaacacctcttacaaaggcagcagatatcagcttagacaatttggtggaagggaagcggaaacggcgcagtaacgtcagctccccagccacccctactgcctccagtagcagcagcacaacccctacccgaaagatcacagaaagtcctcgtgcctccatgggagttctctcaggcaaaagaaaacttatcacttctgaagaggaacggtcccctgccaagcgaggtcgcaagtctgccacagtaaaacctggtgcagtaggggcaggagagtttgtgagcccctgtgagagtggagacaacaccggtgaaccctctgccctggaagagcagagagggcctttgcctctcaacaagaccttgtttctgggctacgcatttctccttaccatggccacaaccagtgacaagttggccagccgctccaaactgccagatggtcctacaggaagcagtgaagaagaggaggcctactgcaaccatccaagtcaatcaggtctgaatgccctgccatcttccccatttgcgttctatgggcatctgctagagcaaacccatgtggaggaatttttggaaattcctcctttcaacaagcagtatacagaatcccagcttcgagcaggagctggctatatccttgaagatttcaatgaagcccagtgtaacacagcttaccagtgtcttctaattgcggatcagcattgtcgaacccggaagtacttcctgtgccttgccagtgggattccttgtgtgtctcatgtctgggtccatgatagttgccatgccaaccagctccagaactaccgtaattatctgttgccagctgggtacagccttgaggagcaaagaattctggactggcaaccccgtgaaaatcctttccagaatctgaaggtactcttggtatcagaccaacagcagaacttcctggagctctggtctgagatcctcatgactggtggtgcagcctctgtgaagcagcaccattcaagtgcccataacaaagatattgctttaggggtatttgatgtggtggtgacggacccctcatgcccagcctcggtgctgaagtgtgctgaagcattgcagctgcctgtggtgtcacaagagtgggtgatccagtgcctcattgttggggagagaattggattcaagcagcatccaaaatataaacacgattatgtttctcactaaagatacttggtcttactggttttattccctgctatcgtggagattgtgttttaaccaggttttaaatgtgtcttgtgtgtaactggattccttgcatggatcttgtatatagttttatttgctgaacttttatgataaaataaatgttgaatctctttggttgtagta

SEQ ID NO: 446814 - DNA, 7777 bp, Homo sapiens
acagcggcgacctagggatcgatctggagggacttggggagcgtgcagagacctctagctcgagcgcgagggacctcccgccgggatgcctggggagcagatggaccctactggaagtcagttggattcagatttctctcagcaagatactccttgcctgataattgaagattctcagcctgaaagccaggttctagaggatgattctggttctcacttcagtatgctatctcgacaccttcctaatctccagacgcacaaagaaaatcctgtgttggatgttgtgtccaatcctgaacaaacagctggagaagaacgaggagacggtaatagtgggttcaatgaacatttgaaagaaaacaaggttgcagaccctgtggattcttctaacttggacacatgtggttccatcagtcaggtcattgagcagttacctcagccaaacaggacaagcagtgttctgggaatgtcagtggaatctgctcctgctgtggaggaagagaagggagaagagttggaacagaaggagaaagagaaggaagaagatacttcaggcaatactacacattcccttggtgctgaagatactgcctcatcacagttgggttttggggttctggaactctcccagagccaggatgttgaggaaaatactgtgccatatgaagtggacaaagagcagctacaatcagtaaccaccaactctggttataccaggctgtctgatgtggatgctaatactgcaattaagcatgaagaacagtccaacgaagatatccccatagcagaacagtccagcaaggacatccctgtgacagcacagcccagtaaggatgtacatgttgtaaaagagcaaaatccaccacctgcaaggtcagaggacatgccttttagccccaaagcatctgttgctgctatggaagcaaaagaacagttgtctgcacaagaacttatggaaagtggactgcagattcagaagtcaccagagcctgaggttttgtcaactcaggaagacttgtttgaccagagcaataaaacagtatcttctgatggttgctctactccttcaagggaggaaggtgggtgttctttggcttccactcctgccaccactctgcatctcctgcagctctctggtcagaggtcccttgttcaggacagtctttccacgaattcttcagatcttgttgctccttctcctgatgctttccgatctactccttttatcgttcctagcagtcccacagagcaagaagggagacaagataagccaatggacacgtcagtgttatctgaagaaggaggagagccttttcagaagaaacttcaaagtggtgaaccagtggagttagaaaacccccctctcctgcctgagtccactgtatcaccacaagcctcaacaccaatatctcagagcacaccagtcttccctcctgggtcacttcctatcccatcccagcctcagttttctcatgacatttttattccttccccaagtctggaagaacaatcaaatgatgggaagaaagatggagatatgcatagttcatctttgacagttgagtgttctaaaacttcagagattgaaccaaagaattcccctgaggatcttgggctatctttgacaggggattcttgcaagttgatgctttctacaagtgaatatagtcagtccccaaagatggagagcttgagttctcacagaattgatgaagatggagaaaacacacagattgaggatacggaacccatgtctccagttctcaattctaaatttgttcctgctgaaaatgatagtatcctgatgaatccagcacaggatggtgaagtacaactgagtcagaatgatgacaaaacaaagggagatgatacagacaccagggatgacattagtattttagccactggttgcaagggcagagaagaaacggtagcagaagatgtttgtattgatctcacttgtgattcggggagtcaggcagttccgtcaccagctactcgatctgaggcactttctagtgtgttagatcaggaggaagctatggaaattaaagaacaccatccagaggaggggtcttcagggtctgaggtggaagaaatccctgagacaccttgtgaaagtcaaggagaggaactcaaagaagaaaatatggagagtgttccgttgcacctttctctgactgaaactcagtcccaagggttgtgtcttcaaaaggaaatgccaaaaaaagaatgctcagaagctatggaagttgaaaccagtgtgattagtattgattcccctcaaaagttggcaatacttgaccaagaattggaacataaggaacaggaagcttgggaagaagctacttcagaggactccagtgttgtcattgtagatgtgaaagagccatctcccagagttgatgtttcttgtgaacctttggagggagtggagaagtgctcagattcccagtcatgggaggatattgctccagaaatagaaccatgtgctgagaatagattagacaccaaggaagaaaagagtgtagaatatgaaggagatctgaaatcagggactgcagaaacagaacctgtagagcaagattcttcacagccttccttacctttagtgagagcagatgatcctttaagacttgaccaggagttgcagcagccccaaactcaggagaaaacaagtaattcattaacagaagactcaaaaatggctaatgcaaagcagctaagctcagatgcagaggcccagaagctggggaagccctctgcccatgcctcacaaagcttctgtgaaagttctagtgaaaccccatttcatttcactttgcctaaagaaggtgatatcatcccaccattgactggtgcaaccccacctcttattgggcacctaaaattggagcccaagagacacagtactcctattggtattagcaactatccagaaagcaccatagcaaccagtgatgtcatgtctgaaagcatggtggagacccatgatcccatacttgggagtggaaaaggggattctggggctgccccagacgtggatgataaattatgtctaagaatgaaactggttagtcctgagactgaggcgagtgaagagtctttgcagttcaacctggaaaagcctgcaactggtgaaagaaaaaatggatctactgctgttgctgagtctgttgccagtccccagaagaccatgtctgtgttgagctgtatctgtgaagccaggcaagagaatgaggctcgaagtgaggatccccccaccacacccatcagggggaacttgctccactttccaagttctcaaggagaagaggagaaagaaaaattggagggtgaccatacaatcaggcagagtcaacagcctatgaagcccattagtcctgtcaaggaccctgtttctcctgcttcccagaagatggtcatacaagggccatccagtcctcaaggagaggcaatggtgacagatgtgctagaagaccagaaagaaggacggagtactaataaggaaaatcctagtaaggccttgattgaaaggcccagccaaaataacataggaatccaaaccatggagtgttccttgagggtcccagaaactgtttcagcagcaacccagactataaagaatgtgtgtgagcaggggaccagtacagtggaccagaactttggaaagcaagatgccacagttcagactgagagggggagtggtgagaaaccagtcagtgctcctggggatgatacagagtcgctccatagccagggagaagaagagtttgatatgcctcagcctccacatggccatgtcttacatcgtcacatgagaacaatccgggaagtacgcacacttgtcactcgtgtcattacagatgtgtattatgtggatggaacagaagtagaaagaaaagtaactgaggagactgaagagccaattgtagagtgtcaggagtgtgaaactgaagtttccccttcacagactgggggctcctcaggtgacctgggggatatcagctccttctcctccaaggcatccagcttacaccgcacatcaagtgggacaagtctctcagctatgcacagcagtggaagctcagggaaaggagccggaccactcagagggaaaaccagcgggacagaacccgcagattttgccttacccagctcccgaggaggcccaggaaaactgagtcctagaaaaggggtcagtcagacagggacgccagtgtgtgaggaggatggtgatgcaggccttggcatcagacagggagggaaggctccagtcacgcctcgtgggcgtgggcgaaggggccgcccaccttctcggaccactggaaccagagaaacagctgtgcctggccccttgggcatagaggacatttcacctaacttgtcaccagatgataaatccttcagccgtgtcgtgccccgagtgccagactccaccagacgaacagatgtgggtgctggtgctttgcgtcgtagtgactctccagaaattcctttccaggctgctgctggcccttctgatggcttagatgcctcctctccaggaaatagctttgtagggctccgtgttgtagccaagtggtcatccaatggctacttttactctgggaaaatcacacgagatgtcggagctgggaagtataaattgctctttgatgatgggtacgaatgtgatgtgttgggcaaagacattctgttatgtgaccccatcccgctggacactgaagtgacggccctctcggaggatgagtatttcagtgcaggagtggtgaaaggacataggaaggagtctggggaactgtactacagcattgaaaaagaaggccaaagaaagtggtataagcgaatggctgtcatcctgtccttggagcaaggaaacagactgagagagcagtatgggcttggcccctatgaagcagtaacacctcttacaaaggcagcagatatcagcttagacaatttggtggaagggaagcggaaacggcgcagtaacgtcagctccccagccacccctactgcctccagtagcagcagcacaacccctacccgaaagatcacagaaagtcctcgtgcctccatgggagttctctcaggcaaaagaaaacttatcacttctgaagaggaacggtcccctgccaagcgaggtcgcaagtctgccacagtaaaacctggtgcagtaggggcaggagagtttgtgagcccctgtgagagtggagacaacaccggtgaaccctctgccctggaagagcagagagggcctttgcctctcaacaagaccttgtttctgggctacgcatttctccttaccatggccacaaccagtgacaagttggccagccgctccaaactgccagatggtcctacaggaagcagtgaagaagaggaggaatttttggaaattcctcctttcaacaagcagtatacagaatcccagcttcgagcaggagctggctatatccttgaagatttcaatgaagcccaggtgaggagtttctttgtgtaacctaatatagtggcaatgataagagccaacttgctgtgttgagaagaggcctgggaggggttggggaacctggataaagtagccagagatttcaggaactgagaaactgccaaaatgtttttgcatgaaatagaatttttgttgtgtatagggaagagaaggtaggaccttgggttagttaatggctatggttctgttgctgggacaaaagaagattgatgtttatgtttagtagtagaaacccctattagggttgctgatttttagcctgaaaggctgagttcataggttttggttgtccgttgaggatttaggtcctcagtatgctgcaggtgaggcagagagaacatctatggaaattacttgggccttccagtgagaagagtggccttgggcaggatagactaaatcacattttgggtagtagttgggagtcttcagatctgctcttcatggctcattatggctgctgcttaggagctttccacagaagtcaccaaacccattggctctgcttcttttcttgcagtgtaacacagcttaccagtgtcttctaattgcggatcagcattgtcgaacccggaagtacttcctgtgccttgccagtgggattccttgtgtgtctcatgtctgggtccatgatagttgccatgccaaccagctccagaactaccgtaattatctgttgccagctgggtacagccttgaggagcaaagaattctggactggtaagtatttgaagcccatccagaattgtataggcaggaggacagcaagctttggagggaagagaatctaggtgagagagtaaagctttctagaaattggaatgtctgtgggataaatttgagtgggtttgaaatgacttcaggagtttatctagtttatttccctaggttacattggctaggaaccttttgcaaatgtgtgaagatttgtatataggttcaatattctcaacctgtaaagtcagagaactaagttttaagcaagcattaaaaatatataggctcaggagcatgatttggattattctcagccccagaacaaacatggaaattagaaagccaggaatgcaaggaatacagatcattcatagaaagaaggaagagaagggggaccctaatatagggcttagttttttaagatgaagtcttgctctgtcacctaggctggagtacagtggcgcagtgacgacttactgcagcctcaacctcccaggctgaagtgatccccctacctcagcctcccaagctgctgggactacaggcactcgccaccacacccagctaatttttttgttgtcttttgtagagatggggtctcaccacattgcccaggctggtctcgaactcccaggcccaagagatccaaccacgacagcctcccaaagtgctgggattacaggcttgagacactatgtctgatggggcatttatttttgaaagcattcagatgtacatgagtccctttgcagaaaggcagtttgttggatattacttgtcatgctaaggtcctttcctgtctccttcataggcaaccccgtgaaaatcctttccagaatctgaaggtactcttggtatcagaccaacagcagaacttcctggagctctggtctgagatcctcatgactggtggtgcagcctctgtgaagcagcaccattcaagtgcccataacaaaggtacctgaaagagtgtgtgtagtgtctttgttccagggatctccttagacctgtaggtgttaggccttgtggtccaaggctcaggcctaataggttgaccgtatccatgtttcttagagaagaaaagtaccaccttcaagaggtgagtcaacataagtgaagcactggacgtatatttgttaaatatttctacaaggtcagcacatagtgattataactctgcctttggtcatgatcagtagcagtgtgtttgacataatagggctttggtttgtgcagagtgggatgtattggttagaatcaaatctctctttctaatggagggctaagttgagtgtcctttccttcttcactttcccttgctccttgcagatattgctttaggggtatttgatgtggtggtgacggacccctcatgcccagcctcggtgctgaagtgtgctgaagcattgcagctgcctgtggtgtcacaagagtgggtgatccagtgcctcattgttggggagagaattggattcaagcagcatccaaaatataaacacgattatggtcgaccggccgatgaatttagtagtagtaggcggctgc

SEQ ID NO: 446815 - DNA, 5371 bp, Homo sapiens
acagcggcgacctagggatcgatctggagggacttggggagcgtgcagagacctctagctcgagcgcgagggacctcccgccgggatgcctggggagcagatggaccctactggaagtcagttggattcagatttctctcagcaagatactccttgcctgataattgaagattctcagcctgaaagccaggttctagaggatgattctggttctcacttcagtatgctatctcgacaccttcctaatctccagacgcacaaagaaaatcctgtgttggatgttgtgtccaatcctgaacaaacagctggagaagaacgaggagacggtaatagtgggttcaatgaacatttgaaagaaaacaaggttgcagaccctgtggattcttctaacttggacacatgtggttccatcagtcaggtcattgagcagttacctcagccaaacaggacaagcagtgttctgggaatgtcagtggaatctgctcctgctgtggaggaagagaagggagaagagttggaacagaaggagaaagagaaggaagaagatacttcaggcaatactacacattcccttggtgctgaagatactgcctcatcacagttgggttttggggttctggaactctcccagagccaggatgttgaggaaaatactgtgccatatgaagtggacaaagagcagctacaatcagtaaccaccaactctggttataccaggctgtctgatgtggatgctaatactgcaattaagcatgaagaacagtccaacgaagatatccccatagcagaacagtccagcaaggacatccctgtgacagcacagcccagtaaggatgtacatgttgtaaaagagcaaaatccaccacctgcaaggtcagaggacatgccttttagccccaaagcatctgttgctgctatggaagcaaaagaacagttgtctgcacaagaacttatggaaagtggactgcagattcagaagtcaccagagcctgaggttttgtcaactcaggaagacttgtttgaccagagcaataaaacagtatcttctgatggttgctctactccttcaagggaggaaggtgggtgttctttggcttccactcctgccaccactctgcatctcctgcagctctctggtcagaggtcccttgttcaggacagtctttccacgaattcttcagatcttgttgctccttctcctgatgctttccgatctactccttttatcgttcctagcagtcccacagagcaagaagggagacaagataagccaatggacacgtcagtgttatctgaagaaggaggagagccttttcagaagaaacttcaaagtggtgaaccagtggagttagaaaacccccctctcctgcctgagtccactgtatcaccacaagcctcaacaccaatatctcagagcacaccagtcttccctcctgggtcacttcctatcccatcccagcctcagttttctcatgacatttttattccttccccaagtctggaagaacaatcaaatgatgggaagaaagatggagatatgcatagttcatctttgacagttgagtgttctaaaacttcagagattgaaccaaagaattcccctgaggatcttgggctatctttgacaggggattcttgcaagttgatgctttctacaagtgaatatagtcagtccccaaagatggagagcttgagttctcacagaattgatgaagatggagaaaacacacagattgaggatacggaacccatgtctccagttctcaattctaaatttgttcctgctgaaaatgatagtatcctgatgaatccagcacaggatggtgaagtacaactgagtcagaatgatgacaaaacaaagggagatgatacagacaccagggatgacattagtattttagccactggttgcaagggcagagaagaaacggtagcagaagatgtttgtattgatctcacttgtgattcggggagtcaggcagttccgtcaccagctactcgatctgaggcactttctagtgtgttagatcaggaggaagctatggaaattaaagaacaccatccagaggaggggtcttcagggtctgaggtggaagaaatccctgagacaccttgtgaaagtcaaggagaggaactcaaagaagaaaatatggagagtgttccgttgcacctttctctgactgaaactcagtcccaagggttgtgtcttcaaaaggaaatgccaaaaaaagaatgctcagaagctatggaagttgaaaccagtgtgattagtattgattcccctcaaaagttggcaatacttgaccaagaattggaacataaggaacaggaagcttgggaagaagctacttcagaggactccagtgttgtcattgtagatgtgaaagagccatctcccagagttgatgtttcttgtgaacctttggagggagtggagaagtgctcagattcccagtcatgggaggatattgctccagaaatagaaccatgtgctgagaatagattagacaccaaggaagaaaagagtgtagaatatgaaggagatctgaaatcagggactgcagaaacagaacctgtagagcaagattcttcacagccttccttacctttagtgagagcagatgatcctttaagacttgaccaggagttgcagcagccccaaactcaggagaaaacaagtaattcattaacagaagactcaaaaatggctaatgcaaagcagctaagctcagatgcagaggcccagaagctggggaagccctctgcccatgcctcacaaagcttctgtgaaagttctagtgaaaccccatttcatttcactttgcctaaagaaggtgatatcatcccaccattgactggtgcaaccccacctcttattgggcacctaaaattggagcccaagagacacagtactcctattggtattagcaactatccagaaagcaccatagcaaccagtgatgtcatgtctgaaagcatggtggagacccatgatcccatacttgggagtggaaaaggggattctggggctgccccagacgtggatgataaattatgtctaagaatgaaactggttagtcctgagactgaggcgagtgaagagtctttgcagttcaacctggaaaagcctgcaactggtgaaagaaaaaatggatctactgctgttgctgagtctgttgccagtccccagaagaccatgtctgtgttgagctgtatctgtgaagccaggcaagagaatgaggctcgaagtgaggatccccccaccacacccatcagggggaacttgctccactttccaagttctcaaggagaagaggagaaagaaaaattggagggtgaccatacaatcaggcagagtcaacagcctatgaagcccattagtcctgtcaaggaccctgtttctcctgcttcccagaagatggtcatacaagggccatccagtcctcaaggagaggcaatggtgacagatgtgctagaagaccagaaagaaggacggagtactaataaggaaaatcctagtaaggccttgattgaaaggcccagccaaaataacataggaatccaaaccatggagtgttccttgagggtcccagaaactgtttcagcagcaacccagaactccaccagacgaacagatgtgggtgctggtgctttgcgtcgtagtgactctccagaaattcctttccaggctgctgctggcccttctgatggcttagatgcctcctctccaggaaatagctttgtagggctccgtgttgtagccaagtggtcatccaatggctacttttactctgggaaaatcacacgagatgtcggagctgggaagtataaattgctctttgatgatgggtacgaatgtgatgtgttgggcaaagacattctgttatgtgaccccatcccgctggacactgaagtgacggccctctcggaggatgagtatttcagtgcaggagtggtgaaaggacataggaaggagtctggggaactgtactacagcattgaaaaagaaggccaaagaaagtggtataagcgaatggctgtcatcctgtccttggagcaaggaaacagactgagagagcagtatgggcttggcccctatgaagcagtaacacctcttacaaaggcagcagatatcagcttagacaatttggtggaagggaagcggaaacggcgcagtaacgtcagctccccagccacccctactgcctccagtagcagcagcacaacccctacccgaaagatcacagaaagtcctcgtgcctccatgggagttctctcaggcaaaagaaaacttatcacttctgaagaggaacggtcccctgccaagcgaggtcgcaagtctgccacagtaaaacctggtgcagtaggggcaggagagtttgtgagcccctgtgagagtggagacaacaccggtgaaccctctgccctggaagagcagagagggcctttgcctctcaacaagaccttgtttctgggctacgcatttctccttaccatggccacaaccagtgacaagttggccagccgctccaaactgccagatggtcctacaggaagcagtgaagaagaggaggaatttttggaaattcctcctttcaacaagcagtatacagaatcccagcttcgagcaggagctggctatatccttgaagatttcaatgaagcccagtgtaacacagcttaccagtgtcttctaattgcggatcagcattgtcgaacccggaagtacttcctgtgccttgccagtgggattccttgtgtgtctcatgtctgggtccatgatagttgccatgccaaccagctccagaactaccgtaattatctgttgccagctgggtacagccttgaggagcaaagaattctggactggcaaccccgtgaaaatcctttccagaatctgaaggtactcttggtatcagaccaacagcagaacttcctggagctctggtctgagatcctcatgactggtggtgcagcctctgtgaagcagcaccattcaagtgcccataacaaagatattgctttaggggtatttgatgtggtggtgacggacccctcatgcccagcctcggtgctgaagtgtgctgaagcattgcagctgcctgtggtgtcacaagagtgggtgatccagtgcctcattgttggggagagaattggattcaagcagcatccaaaatataaacacgattatgtttctcactaaagatacttggtcttactggttttattccctgctatcgtggagattgtgttttaaccaggttttaaatgtgtcttgtgtgtaactggattccttgcatggatcttgtatatagttttatttgctgaacttttatgataaaataaatgttgaatctctttggttgtagta

SEQ ID NO: 446816 - DNA, 2591 bp, Homo sapiens
accaatatagtaccatgtttattttatattttattgagatacagtatagtcccattagaatgaacaattcttctcagaatcacctgggggagaaaaaaaaaagaacagatcctaaatgttcagttcagtggcttttgaaaattttatctaaccactactcaaaacagatacagaacattcccattattccagaaagtctcctgattctcacctttttgaattataattttgtgccatctgtaggattttccaaccatcatattagcattgtgttattatggcatcttttatcttctgtatctattttttccttgcaggagactgaagagccaattgtagagtgtcaggagtgtgaaactgaagtttccccttcacagactgggggctcctcaggtgacctgggggatatcagctccttctcctccaaggcatccagcttacaccgcacatcaagtgggacaagtctctcagctatgcacagcagtggaagctcagggaaaggagccggaccactcagagggaaaaccagcgggacagaacccgcagattttgccttacccagctcccgaggaggcccaggaaaactgagtcctagaaaaggggtcagtcagacagggacgccagtgtgtgaggaggatggtgatgcaggccttggcatcagacagggagggaaggctccagtcacgcctcgtgggcgtgggcgaaggggccgcccaccttctcggaccactggaaccagagaaacagctgtgcctggccccttgggcatagaggacatttcacctaacttgtcaccagatgataaatccttcagccgtgtcgtgccccgagtgccagactccaccagacgaacagatgtgggtgctggtgctttgcgtcgtagtgactctccagaaattcctttccaggctgctgctggcccttctgatggcttagatgcctcctctccaggaaatagctttgtagggctccgtgttgtagccaagtggtcatccaatggctacttttactctgggaaaatcacacgagatgtcggagctgggaagtataaattgctctttgatgatgggtacgaatgtgatgtgttgggcaaagacattctgttatgtgaccccatcccgctggacactgaagtgacggccctctcggaggatgagtatttcagtgcaggagtggtgaaaggacataggaaggagtctggggaactgtactacagcattgaaaaagaaggccaaagaaagtggtataagcgaatggctgtcatcctgtccttggagcaaggaaacagactgagagagcagtatgggcttggcccctatgaagcagtaacacctcttacaaaggcagcagatatcagcttagacaatttggtggaagggaagcggaaacggcgcagtaacgtcagctccccagccacccctactgcctccagtagcagcagcacaacccctacccgaaagatcacagaaagtcctcgtgcctccatgggagttctctcaggcaaaagaaaacttatcacttctgaagaggaacggtcccctgccaagcgaggtcgcaagtctgccacagtaaaacctggtgcagtaggggcaggagagtttgtgagcccctgtgagagtggagacaacaccggtgaaccctctgccctggaagagcagagagggcctttgcctctcaacaagaccttgtttctgggctacgcatttctccttaccatggccacaaccagtgacaagttggccagccgctccaaactgccagatggtcctacaggaagcagtgaagaagaggaggaatttttggaaattcctcctttcaacaagcagtatacagaatcccagcttcgagcaggagctggctatatccttgaagatttcaatgaagcccagtgtaacacagcttaccagtgtcttctaattgcggatcagcattgtcgaacccggaagtacttcctgtgccttgccagtgggattccttgtgtgtctcatgtctgggtccatgatagttgccatgccaaccagctccagaactaccgtaattatctgttgccagctgggtacagccttgaggagcaaagaattctggactggcaaccccgtgaaaatcctttccagaatctgaaggtactcttggtatcagaccaacagcagaacttcctggagctctggtctgagatcctcatgactggtggtgcagcctctgtgaagcagcaccattcaagtgcccataacaaagatattgctttaggggtatttgatgtggtggtgacggacccctcatgcccagcctcggtgctgaagtgtgctgaagcattgcagctgcctgtggtgtcacaagagtgggtgatccagtgcctcattgttggggagagaattggattcaagcagcatccaaaatataaacacgattatgtttctcactaaagatacttggtcttactggttttattccctgctatcgtggagattgtgttttaaccaggttttaaatgtgtcttgtgtgtaactggattccttgcatggatcttgtatatagttttatttgctgaacttttatgataaaataaatgttgaatctctttggttgtagta
